United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 14

SEQ ID NO: 527285 - RNA, 21 nt, Chlamydophila pneumoniae J138
auaccacagcuguacagaaca

SEQ ID NO: 527286 - RNA, 22 nt, Chlamydophila pneumoniae J138
auaccacagcuguacagaacaa

SEQ ID NO: 527287 - RNA, 23 nt, Chlamydophila pneumoniae J138
auaccuuucuaagaauucuuugc

SEQ ID NO: 527288 - RNA, 14 nt, Chlamydophila pneumoniae J138
auacgaaggaucau

SEQ ID NO: 527289 - RNA, 16 nt, Chlamydophila pneumoniae J138
auaccguuuuaggaag

SEQ ID NO: 527290 - RNA, 16 nt, Chlamydophila pneumoniae J138
auacgcuuacaaauaa

SEQ ID NO: 527291 - RNA, 19 nt, Chlamydophila pneumoniae J138
auacgcuuacaaauaacua

SEQ ID NO: 527292 - RNA, 14 nt, Chlamydophila pneumoniae J138
auacgcuuuucuuc

SEQ ID NO: 527293 - RNA, 21 nt, Chlamydophila pneumoniae J138
auacggacuucacaaagaacc

SEQ ID NO: 527294 - RNA, 20 nt, Chlamydophila pneumoniae J138
auacgccgggccacuucauc

SEQ ID NO: 527295 - RNA, 22 nt, Chlamydophila pneumoniae J138
auacuaagaagcucacucuuua

SEQ ID NO: 527296 - RNA, 19 nt, Chlamydophila pneumoniae J138
auacuaaaacuacaacagg

SEQ ID NO: 527297 - RNA, 23 nt, Chlamydophila pneumoniae J138
auagaccggaucccguaaaagaa

SEQ ID NO: 527298 - RNA, 20 nt, Chlamydophila pneumoniae J138
auagacacuugcuuaaggaa

SEQ ID NO: 527299 - RNA, 21 nt, Chlamydophila pneumoniae J138
auagacacuugcuuaaggaaa

SEQ ID NO: 527300 - RNA, 22 nt, Chlamydophila pneumoniae J138
auagacaggauggaaucaggga

SEQ ID NO: 527301 - RNA, 14 nt, Chlamydophila pneumoniae J138
auagacauucccua

SEQ ID NO: 527302 - RNA, 17 nt, Chlamydophila pneumoniae J138
auagaccccccauucca

SEQ ID NO: 527303 - RNA, 17 nt, Chlamydophila pneumoniae J138
auagaucacaucaagau

SEQ ID NO: 527304 - RNA, 23 nt, Chlamydophila pneumoniae J138
auagauucguuauccucgucuuc

SEQ ID NO: 527305 - RNA, 14 nt, Chlamydophila pneumoniae J138
auagauaugccuca

SEQ ID NO: 527306 - RNA, 23 nt, Chlamydophila pneumoniae J138
auagauauacgcccaugucuuca

SEQ ID NO: 527307 - RNA, 22 nt, Chlamydophila pneumoniae J138
auagauagggccgugaagcaga

SEQ ID NO: 527308 - RNA, 15 nt, Chlamydophila pneumoniae J138
auagauacaaacauc

SEQ ID NO: 527309 - RNA, 15 nt, Chlamydophila pneumoniae J138
auagacucucacuga

SEQ ID NO: 527310 - RNA, 20 nt, Chlamydophila pneumoniae J138
auagacucucacugaguguc

SEQ ID NO: 527311 - RNA, 13 nt, Chlamydophila pneumoniae J138
auagcagucuugc

SEQ ID NO: 527312 - RNA, 17 nt, Chlamydophila pneumoniae J138
auagcaguauagagaag

SEQ ID NO: 527313 - RNA, 15 nt, Chlamydophila pneumoniae J138
auagcauacgacagu

SEQ ID NO: 527314 - RNA, 13 nt, Chlamydophila pneumoniae J138
auagcaaaucaau

SEQ ID NO: 527315 - RNA, 18 nt, Chlamydophila pneumoniae J138
auagcaaacggaacuaaa

SEQ ID NO: 527316 - RNA, 17 nt, Chlamydophila pneumoniae J138
auagccuccauuuagac

SEQ ID NO: 527317 - RNA, 18 nt, Chlamydophila pneumoniae J138
auagccuccauuuagaca

SEQ ID NO: 527318 - RNA, 18 nt, Chlamydophila pneumoniae J138
auagcauguucgauuuuc

SEQ ID NO: 527319 - RNA, 16 nt, Chlamydophila pneumoniae J138
auagccgagaucuuug

SEQ ID NO: 527320 - RNA, 20 nt, Chlamydophila pneumoniae J138
auagcauguucgauuuucuc

SEQ ID NO: 527321 - RNA, 16 nt, Chlamydophila pneumoniae J138
auagcauuauucccua

SEQ ID NO: 527322 - RNA, 17 nt, Chlamydophila pneumoniae J138
auagcaucccuucuucu

SEQ ID NO: 527323 - RNA, 12 nt, Chlamydophila pneumoniae J138
auagccaaagac

SEQ ID NO: 527324 - RNA, 15 nt, Chlamydophila pneumoniae J138
auagccaaagacucu

SEQ ID NO: 527325 - RNA, 20 nt, Chlamydophila pneumoniae J138
auagccgacaugcuuuccuu

SEQ ID NO: 527326 - RNA, 18 nt, Chlamydophila pneumoniae J138
auacuuaggaauuuuucu

SEQ ID NO: 527327 - RNA, 23 nt, Chlamydophila pneumoniae J138
auacuuaauccuguagggaaaga

SEQ ID NO: 527328 - RNA, 20 nt, Chlamydophila pneumoniae J138
auacuacuuacaagaacaag

SEQ ID NO: 527329 - RNA, 12 nt, Chlamydophila pneumoniae J138
auagaaaaggau

SEQ ID NO: 527330 - RNA, 19 nt, Chlamydophila pneumoniae J138
auagaaaagguauuaggaa

SEQ ID NO: 527331 - RNA, 16 nt, Chlamydophila pneumoniae J138
auagaaauucuguaga

SEQ ID NO: 527332 - RNA, 14 nt, Chlamydophila pneumoniae J138
auagaaauucugua

SEQ ID NO: 527333 - RNA, 13 nt, Chlamydophila pneumoniae J138
auagaaaguacag

SEQ ID NO: 527334 - RNA, 15 nt, Chlamydophila pneumoniae J138
auagaagaucauuaa

SEQ ID NO: 527335 - RNA, 18 nt, Chlamydophila pneumoniae J138
auagaacucuccucgagg

SEQ ID NO: 527336 - RNA, 15 nt, Chlamydophila pneumoniae J138
auagaagcugcugcu

SEQ ID NO: 527337 - RNA, 12 nt, Chlamydophila pneumoniae J138
auagacaaccua

SEQ ID NO: 527338 - RNA, 17 nt, Chlamydophila pneumoniae J138
auauaaagacucucuuc

SEQ ID NO: 527339 - RNA, 15 nt, Chlamydophila pneumoniae J138
auauaaagaucuuuu

SEQ ID NO: 527340 - RNA, 19 nt, Chlamydophila pneumoniae J138
auauaaagguuacaagcaa

SEQ ID NO: 527341 - RNA, 16 nt, Chlamydophila pneumoniae J138
auaguuaaauuuccaa

SEQ ID NO: 527342 - RNA, 21 nt, Chlamydophila pneumoniae J138
auagucuguuuuggaaagaag

SEQ ID NO: 527343 - RNA, 19 nt, Chlamydophila pneumoniae J138
auagcgaaagucaaagggc

SEQ ID NO: 527344 - RNA, 23 nt, Chlamydophila pneumoniae J138
auagccuuccauaucuagaaguu

SEQ ID NO: 527345 - RNA, 20 nt, Chlamydophila pneumoniae J138
auagccucuucuacaccaua

SEQ ID NO: 527346 - RNA, 21 nt, Chlamydophila pneumoniae J138
auagccucgagcagaaacucc

SEQ ID NO: 527347 - RNA, 18 nt, Chlamydophila pneumoniae J138
auaguaucguaagccggc

SEQ ID NO: 527348 - RNA, 16 nt, Chlamydophila pneumoniae J138
auaguauuuuuaaaua

SEQ ID NO: 527349 - RNA, 13 nt, Chlamydophila pneumoniae J138
auaguauuuuuaa

SEQ ID NO: 527350 - RNA, 20 nt, Chlamydophila pneumoniae J138
auaguauuuuugaaaccaag

SEQ ID NO: 527351 - RNA, 13 nt, Chlamydophila pneumoniae J138
auauauagagcag

SEQ ID NO: 527352 - RNA, 16 nt, Chlamydophila pneumoniae J138
auauagcguacaggaa

SEQ ID NO: 527353 - RNA, 16 nt, Chlamydophila pneumoniae J138
auauagguuaagccaa

SEQ ID NO: 527354 - RNA, 22 nt, Chlamydophila pneumoniae J138
auauagguuuagauugccuuug

SEQ ID NO: 527355 - RNA, 20 nt, Chlamydophila pneumoniae J138
auauagagagcgcagagucu

SEQ ID NO: 527356 - RNA, 15 nt, Chlamydophila pneumoniae J138
auauaccacuacuga

SEQ ID NO: 527357 - RNA, 21 nt, Chlamydophila pneumoniae J138
auauaauaguggcuauacccu

SEQ ID NO: 527358 - RNA, 14 nt, Chlamydophila pneumoniae J138
auaucaucuuccuc

SEQ ID NO: 527359 - RNA, 15 nt, Chlamydophila pneumoniae J138
auaucaucuuccucu

SEQ ID NO: 527360 - RNA, 16 nt, Chlamydophila pneumoniae J138
auaucauuaagaagau

SEQ ID NO: 527361 - RNA, 22 nt, Chlamydophila pneumoniae J138
auauccauggaauggcuacuuu

SEQ ID NO: 527362 - RNA, 20 nt, Chlamydophila pneumoniae J138
auauccguauggauuucucc

SEQ ID NO: 527363 - RNA, 18 nt, Chlamydophila pneumoniae J138
auaucguagacaacaagu

SEQ ID NO: 527364 - RNA, 15 nt, Chlamydophila pneumoniae J138
auaucguaggaccua

SEQ ID NO: 527365 - RNA, 21 nt, Chlamydophila pneumoniae J138
auauggaaggcggcuuuuugc

SEQ ID NO: 527366 - RNA, 18 nt, Chlamydophila pneumoniae J138
auaugcucugccauuucu

SEQ ID NO: 527367 - RNA, 23 nt, Chlamydophila pneumoniae J138
auaugcucgugcgacugcucuuu

SEQ ID NO: 527368 - RNA, 13 nt, Chlamydophila pneumoniae J138
auaugcucucccg

SEQ ID NO: 527369 - RNA, 19 nt, Chlamydophila pneumoniae J138
auaugcuuggcaauagcuu

SEQ ID NO: 527370 - RNA, 17 nt, Chlamydophila pneumoniae J138
auaugaaugacugcaga

SEQ ID NO: 527371 - RNA, 22 nt, Chlamydophila pneumoniae J138
auaugaaugacugcagauugca

SEQ ID NO: 527372 - RNA, 13 nt, Chlamydophila pneumoniae J138
auaugaagagacg

SEQ ID NO: 527373 - RNA, 21 nt, Chlamydophila pneumoniae J138
auaucuccuuuaaauaaaauc

SEQ ID NO: 527374 - RNA, 23 nt, Chlamydophila pneumoniae J138
auaucuccguuaccaaaaacugg

SEQ ID NO: 527375 - RNA, 22 nt, Chlamydophila pneumoniae J138
auaucucuggcauaauccugaa

SEQ ID NO: 527376 - RNA, 20 nt, Chlamydophila pneumoniae J138
auaucucuggcauaauccug

SEQ ID NO: 527377 - RNA, 17 nt, Chlamydophila pneumoniae J138
auaucucuggcauaauc

SEQ ID NO: 527378 - RNA, 14 nt, Chlamydophila pneumoniae J138
auaucugagcauaa

SEQ ID NO: 527379 - RNA, 22 nt, Chlamydophila pneumoniae J138
auaugggacuucaagccaaaac

SEQ ID NO: 527380 - RNA, 22 nt, Chlamydophila pneumoniae J138
auauggguguaaauuuuuccuu

SEQ ID NO: 527381 - RNA, 15 nt, Chlamydophila pneumoniae J138
auaugucgcuuucau

SEQ ID NO: 527382 - RNA, 19 nt, Chlamydophila pneumoniae J138
auauuacagauuucuucuu

SEQ ID NO: 527383 - RNA, 17 nt, Chlamydophila pneumoniae J138
auauucuuucaaaccac

SEQ ID NO: 527384 - RNA, 16 nt, Chlamydophila pneumoniae J138
auauugacaacacgau

SEQ ID NO: 527385 - RNA, 18 nt, Chlamydophila pneumoniae J138
auauuuagagagaaacau

SEQ ID NO: 527386 - RNA, 15 nt, Chlamydophila pneumoniae J138
auauuuagagagaaa

SEQ ID NO: 527387 - RNA, 18 nt, Chlamydophila pneumoniae J138
aucaaauaaggcugcuau

SEQ ID NO: 527388 - RNA, 20 nt, Chlamydophila pneumoniae J138
aucaaauucaaccaaacguc

SEQ ID NO: 527389 - RNA, 17 nt, Chlamydophila pneumoniae J138
aucaaagggucuuuacc

SEQ ID NO: 527390 - RNA, 21 nt, Chlamydophila pneumoniae J138
aucaaaggcaauagcagcagc

SEQ ID NO: 527391 - RNA, 21 nt, Chlamydophila pneumoniae J138
aucaagaguuucgaauucaau

SEQ ID NO: 527392 - RNA, 16 nt, Chlamydophila pneumoniae J138
aucaagauaaaggcau

SEQ ID NO: 527393 - RNA, 16 nt, Chlamydophila pneumoniae J138
aucaagaggagugaaa

SEQ ID NO: 527394 - RNA, 21 nt, Chlamydophila pneumoniae J138
aucaagagcucguaauccuuc

SEQ ID NO: 527395 - RNA, 15 nt, Chlamydophila pneumoniae J138
aucaagagcucguaa

SEQ ID NO: 527396 - RNA, 17 nt, Chlamydophila pneumoniae J138
aucaagaagagaaaaga

SEQ ID NO: 527397 - RNA, 20 nt, Chlamydophila pneumoniae J138
aucaagaagagaaaagauag

SEQ ID NO: 527398 - RNA, 14 nt, Chlamydophila pneumoniae J138
aucaagaagagaaa

SEQ ID NO: 527399 - RNA, 14 nt, Chlamydophila pneumoniae J138
aucaaucacucuau

SEQ ID NO: 527400 - RNA, 18 nt, Chlamydophila pneumoniae J138
aucaacuacaucuccaag

SEQ ID NO: 527401 - RNA, 14 nt, Chlamydophila pneumoniae J138
aucaacucuccauc

SEQ ID NO: 527402 - RNA, 16 nt, Chlamydophila pneumoniae J138
aucaacucuccauccu

SEQ ID NO: 527403 - RNA, 22 nt, Chlamydophila pneumoniae J138
aguaccuucucgucauucugca

SEQ ID NO: 527404 - RNA, 13 nt, Chlamydophila pneumoniae J138
agcuggcaaugau

SEQ ID NO: 527405 - RNA, 14 nt, Chlamydophila pneumoniae J138
aguacgcaaaguac

SEQ ID NO: 527406 - RNA, 17 nt, Chlamydophila pneumoniae J138
aguacgcaaaguacuaa

SEQ ID NO: 527407 - RNA, 18 nt, Chlamydophila pneumoniae J138
aguacgaccaacuccuca

SEQ ID NO: 527408 - RNA, 17 nt, Chlamydophila pneumoniae J138
aguacgugaucucacga

SEQ ID NO: 527409 - RNA, 15 nt, Chlamydophila pneumoniae J138
aguacuacaauaacc

SEQ ID NO: 527410 - RNA, 19 nt, Chlamydophila pneumoniae J138
aguacuuauccugaacauc

SEQ ID NO: 527411 - RNA, 18 nt, Chlamydophila pneumoniae J138
aguacuuauccugaacau

SEQ ID NO: 527412 - RNA, 22 nt, Chlamydophila pneumoniae J138
aguagaucuucugaaaucaaaa

SEQ ID NO: 527413 - RNA, 21 nt, Chlamydophila pneumoniae J138
aguagauuaaaggcauagaua

SEQ ID NO: 527414 - RNA, 17 nt, Chlamydophila pneumoniae J138
aguagaauccuucuccc

SEQ ID NO: 527415 - RNA, 11 nt, Chlamydophila pneumoniae J138
aguauagagaa

SEQ ID NO: 527416 - RNA, 13 nt, Chlamydophila pneumoniae J138
aguauaaucagaa

SEQ ID NO: 527417 - RNA, 17 nt, Chlamydophila pneumoniae J138
aguagucgauugccgug

SEQ ID NO: 527418 - RNA, 20 nt, Chlamydophila pneumoniae J138
aguaggcgaugcaaauucca

SEQ ID NO: 527419 - RNA, 18 nt, Chlamydophila pneumoniae J138
aguaggguguauucugaa

SEQ ID NO: 527420 - RNA, 14 nt, Chlamydophila pneumoniae J138
aguagguaagaagc

SEQ ID NO: 527421 - RNA, 18 nt, Chlamydophila pneumoniae J138
aguagcuauucucaaauu

SEQ ID NO: 527422 - RNA, 15 nt, Chlamydophila pneumoniae J138
aguagcuugugcuaa

SEQ ID NO: 527423 - RNA, 22 nt, Chlamydophila pneumoniae J138
aguagcgaauccagaauuuucu

SEQ ID NO: 527424 - RNA, 17 nt, Chlamydophila pneumoniae J138
aguagcauccuguagag

SEQ ID NO: 527425 - RNA, 21 nt, Chlamydophila pneumoniae J138
aguagccagacuggucuaacu

SEQ ID NO: 527426 - RNA, 21 nt, Chlamydophila pneumoniae J138
aguauuaaagaugaaguuccc

SEQ ID NO: 527427 - RNA, 20 nt, Chlamydophila pneumoniae J138
aguauucccuccgcaguugu

SEQ ID NO: 527428 - RNA, 15 nt, Chlamydophila pneumoniae J138
aguauucccuccgca

SEQ ID NO: 527429 - RNA, 18 nt, Chlamydophila pneumoniae J138
aguauuccaucacaguua

SEQ ID NO: 527430 - RNA, 22 nt, Chlamydophila pneumoniae J138
aguauucuguggaauaucagga

SEQ ID NO: 527431 - RNA, 14 nt, Chlamydophila pneumoniae J138
aguauuuuuaaaua

SEQ ID NO: 527432 - RNA, 21 nt, Chlamydophila pneumoniae J138
aguauuuuuaaauacagauuc

SEQ ID NO: 527433 - RNA, 23 nt, Chlamydophila pneumoniae J138
aguaucgggauuuugucgagaac

SEQ ID NO: 527434 - RNA, 23 nt, Chlamydophila pneumoniae J138
aguauccuccuucugcaugaaua

SEQ ID NO: 527435 - RNA, 16 nt, Chlamydophila pneumoniae J138
aguauggcaaauaaaa

SEQ ID NO: 527436 - RNA, 19 nt, Chlamydophila pneumoniae J138
aguaugaggagauaaagau

SEQ ID NO: 527437 - RNA, 12 nt, Chlamydophila pneumoniae J138
aguaucuagcuu

SEQ ID NO: 527438 - RNA, 17 nt, Chlamydophila pneumoniae J138
aguaucgggauuuuguc

SEQ ID NO: 527439 - RNA, 22 nt, Chlamydophila pneumoniae J138
agucaaauacuucuccugaacc

SEQ ID NO: 527440 - RNA, 12 nt, Chlamydophila pneumoniae J138
agucaaacauca

SEQ ID NO: 527441 - RNA, 13 nt, Chlamydophila pneumoniae J138
agucaaaaauucu

SEQ ID NO: 527442 - RNA, 16 nt, Chlamydophila pneumoniae J138
agucaaaaauucuucg

SEQ ID NO: 527443 - RNA, 15 nt, Chlamydophila pneumoniae J138
agucacacuuuccgu

SEQ ID NO: 527444 - RNA, 13 nt, Chlamydophila pneumoniae J138
agucacacuuucc

SEQ ID NO: 527445 - RNA, 19 nt, Chlamydophila pneumoniae J138
agucacuuucagccuguaa

SEQ ID NO: 527446 - RNA, 16 nt, Chlamydophila pneumoniae J138
agucagccaagacaaa

SEQ ID NO: 527447 - RNA, 22 nt, Chlamydophila pneumoniae J138
agucaugauuuuucaaucaaua

SEQ ID NO: 527448 - RNA, 18 nt, Chlamydophila pneumoniae J138
agucauacauuugauuca

SEQ ID NO: 527449 - RNA, 15 nt, Chlamydophila pneumoniae J138
aguccaguuuguuga

SEQ ID NO: 527450 - RNA, 18 nt, Chlamydophila pneumoniae J138
aguccaugaaucugguuc

SEQ ID NO: 527451 - RNA, 16 nt, Chlamydophila pneumoniae J138
aguccauguacagaaa

SEQ ID NO: 527452 - RNA, 18 nt, Chlamydophila pneumoniae J138
aguccauguacagaaaau

SEQ ID NO: 527453 - RNA, 13 nt, Chlamydophila pneumoniae J138
aguccaagguucu

SEQ ID NO: 527454 - RNA, 15 nt, Chlamydophila pneumoniae J138
aguccucuaugguuu

SEQ ID NO: 527455 - RNA, 21 nt, Chlamydophila pneumoniae J138
aguccuggauuuuaaagcaaa

SEQ ID NO: 527456 - RNA, 18 nt, Chlamydophila pneumoniae J138
aguccuguauauucugaa

SEQ ID NO: 527457 - RNA, 23 nt, Chlamydophila pneumoniae J138
agucccccuaagggcucuagaua

SEQ ID NO: 527458 - RNA, 16 nt, Chlamydophila pneumoniae J138
agucccccuaagggcu

SEQ ID NO: 527459 - RNA, 19 nt, Chlamydophila pneumoniae J138
agucccuugcgggagaagu

SEQ ID NO: 527460 - RNA, 17 nt, Chlamydophila pneumoniae J138
aguccgauagcaaugau

SEQ ID NO: 527461 - RNA, 23 nt, Chlamydophila pneumoniae J138
aguccgcaugaacgugcaucucu

SEQ ID NO: 527462 - RNA, 18 nt, Chlamydophila pneumoniae J138
agucgauuucccagaagg

SEQ ID NO: 527463 - RNA, 22 nt, Chlamydophila pneumoniae J138
agugaaauuuugcaacaaaagg

SEQ ID NO: 527464 - RNA, 23 nt, Chlamydophila pneumoniae J138
agugaagacaaguaaacagcaaa

SEQ ID NO: 527465 - RNA, 22 nt, Chlamydophila pneumoniae J138
agugagcucccugauguugccc

SEQ ID NO: 527466 - RNA, 17 nt, Chlamydophila pneumoniae J138
agugaaugagcuucaca

SEQ ID NO: 527467 - RNA, 19 nt, Chlamydophila pneumoniae J138
agugaucuugagaaaagaa

SEQ ID NO: 527468 - RNA, 16 nt, Chlamydophila pneumoniae J138
agugaucagaaaugaa

SEQ ID NO: 527469 - RNA, 14 nt, Chlamydophila pneumoniae J138
agugauggggauua

SEQ ID NO: 527470 - RNA, 18 nt, Chlamydophila pneumoniae J138
agucuccauaauucugca

SEQ ID NO: 527471 - RNA, 20 nt, Chlamydophila pneumoniae J138
agucucacucuuuucuagaa

SEQ ID NO: 527472 - RNA, 22 nt, Chlamydophila pneumoniae J138
agucuauuugaaaagaaagaau

SEQ ID NO: 527473 - RNA, 17 nt, Chlamydophila pneumoniae J138
agucuauuugaaaagaa

SEQ ID NO: 527474 - RNA, 14 nt, Chlamydophila pneumoniae J138
agucgugcaggaga

SEQ ID NO: 527475 - RNA, 20 nt, Chlamydophila pneumoniae J138
agucguauucagguucugaa

SEQ ID NO: 527476 - RNA, 23 nt, Chlamydophila pneumoniae J138
agucucgguuuccugaagaugag

SEQ ID NO: 527477 - RNA, 18 nt, Chlamydophila pneumoniae J138
agucuccuggaacaguau

SEQ ID NO: 527478 - RNA, 13 nt, Chlamydophila pneumoniae J138
agugcugccauga

SEQ ID NO: 527479 - RNA, 20 nt, Chlamydophila pneumoniae J138
aguggaaauugugaaaaaaa

SEQ ID NO: 527480 - RNA, 19 nt, Chlamydophila pneumoniae J138
aguggaaauugugaaaaaa

SEQ ID NO: 527481 - RNA, 18 nt, Chlamydophila pneumoniae J138
agugccaagagcaucaca

SEQ ID NO: 527482 - RNA, 13 nt, Chlamydophila pneumoniae J138
aguggcgacugca

SEQ ID NO: 527483 - RNA, 22 nt, Chlamydophila pneumoniae J138
aguucacaagugcauuaucuaa

SEQ ID NO: 527484 - RNA, 16 nt, Chlamydophila pneumoniae J138
aguucagcaaggaagu

SEQ ID NO: 527485 - RNA, 19 nt, Chlamydophila pneumoniae J138
aguucauuagcuaaaucaa

SEQ ID NO: 527486 - RNA, 16 nt, Chlamydophila pneumoniae J138
aguucauuagcuaaau

SEQ ID NO: 527487 - RNA, 22 nt, Chlamydophila pneumoniae J138
aguucauguugcucauccuuua

SEQ ID NO: 527488 - RNA, 15 nt, Chlamydophila pneumoniae J138
aguuccgaauaggca

SEQ ID NO: 527489 - RNA, 14 nt, Chlamydophila pneumoniae J138
aguucuucuuuacu

SEQ ID NO: 527490 - RNA, 14 nt, Chlamydophila pneumoniae J138
aguucuuccuucuu

SEQ ID NO: 527491 - RNA, 17 nt, Chlamydophila pneumoniae J138
aguucuuccuucuucuu

SEQ ID NO: 527492 - RNA, 17 nt, Chlamydophila pneumoniae J138
aguucucuaagacugug

SEQ ID NO: 527493 - RNA, 15 nt, Chlamydophila pneumoniae J138
aguucuuguuaaagu

SEQ ID NO: 527494 - RNA, 19 nt, Chlamydophila pneumoniae J138
aguucuuguaauaaaagaa

SEQ ID NO: 527495 - RNA, 21 nt, Chlamydophila pneumoniae J138
aguucuuguaauaaaagaaca

SEQ ID NO: 527496 - RNA, 16 nt, Chlamydophila pneumoniae J138
aguucuuggaaaaaag

SEQ ID NO: 527497 - RNA, 18 nt, Chlamydophila pneumoniae J138
aguucuugccaauguggu

SEQ ID NO: 527498 - RNA, 18 nt, Chlamydophila pneumoniae J138
aguucuuuagcuacagaa

SEQ ID NO: 527499 - RNA, 23 nt, Chlamydophila pneumoniae J138
aguucuuguuaaaguaaaaaaua

SEQ ID NO: 527500 - RNA, 20 nt, Chlamydophila pneumoniae J138
aguucgcggaucuucuucug

SEQ ID NO: 527501 - RNA, 21 nt, Chlamydophila pneumoniae J138
aguucuaggaugcuugugaga

SEQ ID NO: 527502 - RNA, 14 nt, Chlamydophila pneumoniae J138
aguucucaaagaca

SEQ ID NO: 527503 - RNA, 18 nt, Chlamydophila pneumoniae J138
aguuguauccagcucaag

SEQ ID NO: 527504 - RNA, 13 nt, Chlamydophila pneumoniae J138
aguugggcauuua

SEQ ID NO: 527505 - RNA, 21 nt, Chlamydophila pneumoniae J138
aguugcgcaguggacggggag

SEQ ID NO: 527506 - RNA, 19 nt, Chlamydophila pneumoniae J138
aguugcgcgcccucuucua

SEQ ID NO: 527507 - RNA, 16 nt, Chlamydophila pneumoniae J138
aguugaggaaaggagg

SEQ ID NO: 527508 - RNA, 20 nt, Chlamydophila pneumoniae J138
aguugagaaccuucacaaga

SEQ ID NO: 527509 - RNA, 18 nt, Chlamydophila pneumoniae J138
aguugacgcacuucuuca

SEQ ID NO: 527510 - RNA, 16 nt, Chlamydophila pneumoniae J138
aguugaugagaaaaag

SEQ ID NO: 527511 - RNA, 23 nt, Chlamydophila pneumoniae J138
aguuucaaucucuccuugacaaa

SEQ ID NO: 527512 - RNA, 20 nt, Chlamydophila pneumoniae J138
aguuuccaagugaucagaaa

SEQ ID NO: 527513 - RNA, 21 nt, Chlamydophila pneumoniae J138
aguuuguagcauuucuuucuc

SEQ ID NO: 527514 - RNA, 17 nt, Chlamydophila pneumoniae J138
aguuuguagcagcaaga

SEQ ID NO: 527515 - RNA, 16 nt, Chlamydophila pneumoniae J138
aguuuucaagucugua

SEQ ID NO: 527516 - RNA, 13 nt, Chlamydophila pneumoniae J138
aguuuucaaaaau

SEQ ID NO: 527517 - RNA, 16 nt, Chlamydophila pneumoniae J138
aguuuucaaacugauu

SEQ ID NO: 527518 - RNA, 13 nt, Chlamydophila pneumoniae J138
aguuuucauaauc

SEQ ID NO: 527519 - RNA, 19 nt, Chlamydophila pneumoniae J138
aguuuucauaauccaagaa

SEQ ID NO: 527520 - RNA, 16 nt, Chlamydophila pneumoniae J138
aguuuuuauuuuuaaa

SEQ ID NO: 527521 - RNA, 20 nt, Chlamydophila pneumoniae J138
aguuuuuucaauccuuccuu

SEQ ID NO: 527522 - RNA, 16 nt, Chlamydophila pneumoniae J138
aguuuuuucaauccuu

SEQ ID NO: 527523 - RNA, 22 nt, Chlamydophila pneumoniae J138
aguuuuuuaagugcuuuuagau

SEQ ID NO: 527524 - RNA, 21 nt, Chlamydophila pneumoniae J138
auaaccuuugacaacaccaca

SEQ ID NO: 527525 - RNA, 16 nt, Chlamydophila pneumoniae J138
auaacaugcgcagaau

SEQ ID NO: 527526 - RNA, 21 nt, Chlamydophila pneumoniae J138
auaacaugcgcagaauaaaau

SEQ ID NO: 527527 - RNA, 19 nt, Chlamydophila pneumoniae J138
auaaccaggggcuuuccuu

SEQ ID NO: 527528 - RNA, 16 nt, Chlamydophila pneumoniae J138
auaaauuuaucugcuu

SEQ ID NO: 527529 - RNA, 15 nt, Chlamydophila pneumoniae J138
auaaauuuaucugcu

SEQ ID NO: 527530 - RNA, 13 nt, Chlamydophila pneumoniae J138
auaaauacaggag

SEQ ID NO: 527531 - RNA, 16 nt, Chlamydophila pneumoniae J138
auaaauacaggagaau

SEQ ID NO: 527532 - RNA, 19 nt, Chlamydophila pneumoniae J138
auaaauacaggccugaugu

SEQ ID NO: 527533 - RNA, 16 nt, Chlamydophila pneumoniae J138
auaaagaagguugaga

SEQ ID NO: 527534 - RNA, 11 nt, Chlamydophila pneumoniae J138
auaaagaagaa

SEQ ID NO: 527535 - RNA, 13 nt, Chlamydophila pneumoniae J138
auaaagaagaaac

SEQ ID NO: 527536 - RNA, 20 nt, Chlamydophila pneumoniae J138
auaaagaagaaaccccaugu

SEQ ID NO: 527537 - RNA, 16 nt, Chlamydophila pneumoniae J138
auaaagacaucucuuu

SEQ ID NO: 527538 - RNA, 18 nt, Chlamydophila pneumoniae J138
auaaaguuuguaaaaacu

SEQ ID NO: 527539 - RNA, 19 nt, Chlamydophila pneumoniae J138
auaaauucaagacuauaga

SEQ ID NO: 527540 - RNA, 14 nt, Chlamydophila pneumoniae J138
auaaauguagggau

SEQ ID NO: 527541 - RNA, 17 nt, Chlamydophila pneumoniae J138
auaaauggaggauacuc

SEQ ID NO: 527542 - RNA, 21 nt, Chlamydophila pneumoniae J138
auaaauccccaccaacaaugc

SEQ ID NO: 527543 - RNA, 14 nt, Chlamydophila pneumoniae J138
auaaaacauaggcu

SEQ ID NO: 527544 - RNA, 21 nt, Chlamydophila pneumoniae J138
auaaaaauuuucaggaacuuu

SEQ ID NO: 527545 - RNA, 16 nt, Chlamydophila pneumoniae J138
auaaaaauucucauaa

SEQ ID NO: 527546 - RNA, 22 nt, Chlamydophila pneumoniae J138
auaaaacgcuauuguuuguccu

SEQ ID NO: 527547 - RNA, 22 nt, Chlamydophila pneumoniae J138
auaaaacgugauugcugcugcu

SEQ ID NO: 527548 - RNA, 14 nt, Chlamydophila pneumoniae J138
auaaaagaaagaau

SEQ ID NO: 527549 - RNA, 13 nt, Chlamydophila pneumoniae J138
auaaaagaaagaa

SEQ ID NO: 527550 - RNA, 16 nt, Chlamydophila pneumoniae J138
auaaaagaggaagaug

SEQ ID NO: 527551 - RNA, 16 nt, Chlamydophila pneumoniae J138
auaaaaugagcucacg

SEQ ID NO: 527552 - RNA, 13 nt, Chlamydophila pneumoniae J138
auaaaauggccuc

SEQ ID NO: 527553 - RNA, 17 nt, Chlamydophila pneumoniae J138
auaaaauuuaaaaaaau

SEQ ID NO: 527554 - RNA, 13 nt, Chlamydophila pneumoniae J138
auaaaauuggcuu

SEQ ID NO: 527555 - RNA, 21 nt, Chlamydophila pneumoniae J138
auaaaaucaagccacagagaa

SEQ ID NO: 527556 - RNA, 16 nt, Chlamydophila pneumoniae J138
auaaaaucaagccaca

SEQ ID NO: 527557 - RNA, 15 nt, Chlamydophila pneumoniae J138
auaaaaucauguccu

SEQ ID NO: 527558 - RNA, 24 nt, Chlamydophila pneumoniae J138
auaaacagcgguugccuuucucuu

SEQ ID NO: 527559 - RNA, 15 nt, Chlamydophila pneumoniae J138
auaaacauacaugcu

SEQ ID NO: 527560 - RNA, 13 nt, Chlamydophila pneumoniae J138
agccggagcuucu

SEQ ID NO: 527561 - RNA, 22 nt, Chlamydophila pneumoniae J138
agccgaggcgauuuucauggac

SEQ ID NO: 527562 - RNA, 19 nt, Chlamydophila pneumoniae J138
agccgauacccaucuagaa

SEQ ID NO: 527563 - RNA, 12 nt, Chlamydophila pneumoniae J138
agccauuuucua

SEQ ID NO: 527564 - RNA, 14 nt, Chlamydophila pneumoniae J138
agccauuuuccagg

SEQ ID NO: 527565 - RNA, 13 nt, Chlamydophila pneumoniae J138
agcccauuccugc

SEQ ID NO: 527566 - RNA, 12 nt, Chlamydophila pneumoniae J138
agccccacccac

SEQ ID NO: 527567 - RNA, 17 nt, Chlamydophila pneumoniae J138
agcccuagauagcaaau

SEQ ID NO: 527568 - RNA, 23 nt, Chlamydophila pneumoniae J138
agcccuagaguaaagaguagccc

SEQ ID NO: 527569 - RNA, 18 nt, Chlamydophila pneumoniae J138
agcccuaauucauauuua

SEQ ID NO: 527570 - RNA, 14 nt, Chlamydophila pneumoniae J138
agcccuagauagca

SEQ ID NO: 527571 - RNA, 16 nt, Chlamydophila pneumoniae J138
agcccucgguuauuuu

SEQ ID NO: 527572 - RNA, 20 nt, Chlamydophila pneumoniae J138
agccguaggguauccugcuc

SEQ ID NO: 527573 - RNA, 21 nt, Chlamydophila pneumoniae J138
agccguaggguagccauccac

SEQ ID NO: 527574 - RNA, 12 nt, Chlamydophila pneumoniae J138
agccucacagaa

SEQ ID NO: 527575 - RNA, 20 nt, Chlamydophila pneumoniae J138
agccuaugggaggaauuccu

SEQ ID NO: 527576 - RNA, 22 nt, Chlamydophila pneumoniae J138
agccuccucaagauaaauccca

SEQ ID NO: 527577 - RNA, 16 nt, Chlamydophila pneumoniae J138
agccuccuccuucugc

SEQ ID NO: 527578 - RNA, 22 nt, Chlamydophila pneumoniae J138
agccuagcaaaacuguguucaa

SEQ ID NO: 527579 - RNA, 12 nt, Chlamydophila pneumoniae J138
agccuagcaaaa

SEQ ID NO: 527580 - RNA, 17 nt, Chlamydophila pneumoniae J138
agccugcaccagacccu

SEQ ID NO: 527581 - RNA, 14 nt, Chlamydophila pneumoniae J138
agccugcgacuaca

SEQ ID NO: 527582 - RNA, 21 nt, Chlamydophila pneumoniae J138
agccucgauuugaucuugcuc

SEQ ID NO: 527583 - RNA, 18 nt, Chlamydophila pneumoniae J138
agccucugugguuuuuau

SEQ ID NO: 527584 - RNA, 13 nt, Chlamydophila pneumoniae J138
agccuuagcagca

SEQ ID NO: 527585 - RNA, 21 nt, Chlamydophila pneumoniae J138
agccugucuuaucuaaagaaa

SEQ ID NO: 527586 - RNA, 17 nt, Chlamydophila pneumoniae J138
agcgaaagucaaagggc

SEQ ID NO: 527587 - RNA, 22 nt, Chlamydophila pneumoniae J138
agccuuggcucuagaaauauac

SEQ ID NO: 527588 - RNA, 17 nt, Chlamydophila pneumoniae J138
agccuuggcucuagaaa

SEQ ID NO: 527589 - RNA, 20 nt, Chlamydophila pneumoniae J138
agccuugcagcauccugaac

SEQ ID NO: 527590 - RNA, 15 nt, Chlamydophila pneumoniae J138
agccuucuucucgaa

SEQ ID NO: 527591 - RNA, 15 nt, Chlamydophila pneumoniae J138
agcgaaccaaaguca

SEQ ID NO: 527592 - RNA, 20 nt, Chlamydophila pneumoniae J138
agcgaccugcaaaugaaggg

SEQ ID NO: 527593 - RNA, 22 nt, Chlamydophila pneumoniae J138
agcgaucucucuuccugcugcu

SEQ ID NO: 527594 - RNA, 15 nt, Chlamydophila pneumoniae J138
agcgaucacauagaa

SEQ ID NO: 527595 - RNA, 19 nt, Chlamydophila pneumoniae J138
agcgaucacauagaaaaca

SEQ ID NO: 527596 - RNA, 18 nt, Chlamydophila pneumoniae J138
agcgauuucgacagcagc

SEQ ID NO: 527597 - RNA, 12 nt, Chlamydophila pneumoniae J138
agcgcaaaucuu

SEQ ID NO: 527598 - RNA, 14 nt, Chlamydophila pneumoniae J138
agcgcaucacgaaa

SEQ ID NO: 527599 - RNA, 14 nt, Chlamydophila pneumoniae J138
agcgcccgaaucuu

SEQ ID NO: 527600 - RNA, 15 nt, Chlamydophila pneumoniae J138
agcgcguuucaaaua

SEQ ID NO: 527601 - RNA, 23 nt, Chlamydophila pneumoniae J138
agcgcuagugcaagguucugcga

SEQ ID NO: 527602 - RNA, 23 nt, Chlamydophila pneumoniae J138
agcggaguccuucuugcaaagau

SEQ ID NO: 527603 - RNA, 23 nt, Chlamydophila pneumoniae J138
agcgucaauguuaaucuaauuuu

SEQ ID NO: 527604 - RNA, 17 nt, Chlamydophila pneumoniae J138
agcuacagaaagagcua

SEQ ID NO: 527605 - RNA, 16 nt, Chlamydophila pneumoniae J138
agcuacagaaagagcu

SEQ ID NO: 527606 - RNA, 13 nt, Chlamydophila pneumoniae J138
agcuaaaucaaaa

SEQ ID NO: 527607 - RNA, 15 nt, Chlamydophila pneumoniae J138
agcuacaaguccccc

SEQ ID NO: 527608 - RNA, 14 nt, Chlamydophila pneumoniae J138
agcuaaagaaacuu

SEQ ID NO: 527609 - RNA, 19 nt, Chlamydophila pneumoniae J138
agcuagagauccaaugaca

SEQ ID NO: 527610 - RNA, 15 nt, Chlamydophila pneumoniae J138
agcuagagcauuccg

SEQ ID NO: 527611 - RNA, 17 nt, Chlamydophila pneumoniae J138
agcuagucuuucuaaga

SEQ ID NO: 527612 - RNA, 17 nt, Chlamydophila pneumoniae J138
agcuagucuucuuagaa

SEQ ID NO: 527613 - RNA, 14 nt, Chlamydophila pneumoniae J138
agcuagucuucuua

SEQ ID NO: 527614 - RNA, 14 nt, Chlamydophila pneumoniae J138
agcguugcuaagca

SEQ ID NO: 527615 - RNA, 15 nt, Chlamydophila pneumoniae J138
agcgugaauaucauc

SEQ ID NO: 527616 - RNA, 14 nt, Chlamydophila pneumoniae J138
agcuccgcuagagg

SEQ ID NO: 527617 - RNA, 20 nt, Chlamydophila pneumoniae J138
agcuccguaauggagagcuu

SEQ ID NO: 527618 - RNA, 21 nt, Chlamydophila pneumoniae J138
agcucccaacaagggaaagaa

SEQ ID NO: 527619 - RNA, 17 nt, Chlamydophila pneumoniae J138
agcuccauaagcuuuuc

SEQ ID NO: 527620 - RNA, 14 nt, Chlamydophila pneumoniae J138
agcucccucuagag

SEQ ID NO: 527621 - RNA, 16 nt, Chlamydophila pneumoniae J138
agcucccucuagagcu

SEQ ID NO: 527622 - RNA, 23 nt, Chlamydophila pneumoniae J138
agcuauauaggguugugucucug

SEQ ID NO: 527623 - RNA, 20 nt, Chlamydophila pneumoniae J138
agcucauuaucaagaaauuc

SEQ ID NO: 527624 - RNA, 21 nt, Chlamydophila pneumoniae J138
agcucauuaucaagaaauucu

SEQ ID NO: 527625 - RNA, 13 nt, Chlamydophila pneumoniae J138
agcuccaaaauaa

SEQ ID NO: 527626 - RNA, 19 nt, Chlamydophila pneumoniae J138
agcucgagaucuuuuugcc

SEQ ID NO: 527627 - RNA, 16 nt, Chlamydophila pneumoniae J138
agcucuugagaaagcu

SEQ ID NO: 527628 - RNA, 17 nt, Chlamydophila pneumoniae J138
agcucguaauccuucuu

SEQ ID NO: 527629 - RNA, 23 nt, Chlamydophila pneumoniae J138
agcucuggagauugcuaagcauu

SEQ ID NO: 527630 - RNA, 18 nt, Chlamydophila pneumoniae J138
agcucuggauugaaagag

SEQ ID NO: 527631 - RNA, 15 nt, Chlamydophila pneumoniae J138
agcugcaaacacaau

SEQ ID NO: 527632 - RNA, 15 nt, Chlamydophila pneumoniae J138
agcugcaaucucaaa

SEQ ID NO: 527633 - RNA, 15 nt, Chlamydophila pneumoniae J138
agcugcgucaauaag

SEQ ID NO: 527634 - RNA, 19 nt, Chlamydophila pneumoniae J138
agcugagagauuuuuucau

SEQ ID NO: 527635 - RNA, 14 nt, Chlamydophila pneumoniae J138
agcugagagauuuu

SEQ ID NO: 527636 - RNA, 20 nt, Chlamydophila pneumoniae J138
agcugagcuaucuucaaguu

SEQ ID NO: 527637 - RNA, 15 nt, Chlamydophila pneumoniae J138
agcugaggcaucuau

SEQ ID NO: 527638 - RNA, 15 nt, Chlamydophila pneumoniae J138
agcaugaugccauug

SEQ ID NO: 527639 - RNA, 15 nt, Chlamydophila pneumoniae J138
agcaugaagcagaaa

SEQ ID NO: 527640 - RNA, 15 nt, Chlamydophila pneumoniae J138
agcauggagaauaau

SEQ ID NO: 527641 - RNA, 20 nt, Chlamydophila pneumoniae J138
agcauggagaauaaucucuu

SEQ ID NO: 527642 - RNA, 17 nt, Chlamydophila pneumoniae J138
agcauggacuccaagaa

SEQ ID NO: 527643 - RNA, 15 nt, Chlamydophila pneumoniae J138
agcauggacuccaag

SEQ ID NO: 527644 - RNA, 16 nt, Chlamydophila pneumoniae J138
agcaugcuaagcauca

SEQ ID NO: 527645 - RNA, 21 nt, Chlamydophila pneumoniae J138
agcaugcuaagcaucagaauc

SEQ ID NO: 527646 - RNA, 22 nt, Chlamydophila pneumoniae J138
agcauugucgaguauaauugac

SEQ ID NO: 527647 - RNA, 16 nt, Chlamydophila pneumoniae J138
agcauuguuuguccua

SEQ ID NO: 527648 - RNA, 18 nt, Chlamydophila pneumoniae J138
agcauuggacaacgcuuc

SEQ ID NO: 527649 - RNA, 18 nt, Chlamydophila pneumoniae J138
agcauguucgauuuucuc

SEQ ID NO: 527650 - RNA, 14 nt, Chlamydophila pneumoniae J138
agcaugugcagaag

SEQ ID NO: 527651 - RNA, 22 nt, Chlamydophila pneumoniae J138
agcauguuauauagacaaugca

SEQ ID NO: 527652 - RNA, 13 nt, Chlamydophila pneumoniae J138
agcauuuucucug

SEQ ID NO: 527653 - RNA, 16 nt, Chlamydophila pneumoniae J138
agcauuuucucugagc

SEQ ID NO: 527654 - RNA, 23 nt, Chlamydophila pneumoniae J138
agcauuuuacgaaucuuuuucau

SEQ ID NO: 527655 - RNA, 21 nt, Chlamydophila pneumoniae J138
agccaaaaggcacagcaauga

SEQ ID NO: 527656 - RNA, 20 nt, Chlamydophila pneumoniae J138
agccaaaaccaauuucuccg

SEQ ID NO: 527657 - RNA, 13 nt, Chlamydophila pneumoniae J138
agccacagagaau

SEQ ID NO: 527658 - RNA, 15 nt, Chlamydophila pneumoniae J138
agccaagaaaacaua

SEQ ID NO: 527659 - RNA, 15 nt, Chlamydophila pneumoniae J138
agccacuaaguuuag

SEQ ID NO: 527660 - RNA, 23 nt, Chlamydophila pneumoniae J138
agccaguacuaaauuaguaaaug

SEQ ID NO: 527661 - RNA, 14 nt, Chlamydophila pneumoniae J138
agccaguacuaaau

SEQ ID NO: 527662 - RNA, 16 nt, Chlamydophila pneumoniae J138
agccauagaggaauga

SEQ ID NO: 527663 - RNA, 21 nt, Chlamydophila pneumoniae J138
agccauaauuagaacagcaug

SEQ ID NO: 527664 - RNA, 15 nt, Chlamydophila pneumoniae J138
agcagccucuucucu

SEQ ID NO: 527665 - RNA, 18 nt, Chlamydophila pneumoniae J138
agcagcccgcacaucaug

SEQ ID NO: 527666 - RNA, 22 nt, Chlamydophila pneumoniae J138
agcaggauaaccaucaaucacu

SEQ ID NO: 527667 - RNA, 21 nt, Chlamydophila pneumoniae J138
agcaggaguuuucaagucugu

SEQ ID NO: 527668 - RNA, 20 nt, Chlamydophila pneumoniae J138
agcaggaauaaucaaccaaa

SEQ ID NO: 527669 - RNA, 18 nt, Chlamydophila pneumoniae J138
agcaggaaaagcaaaaug

SEQ ID NO: 527670 - RNA, 22 nt, Chlamydophila pneumoniae J138
agcaggaauaaucaaccaaaau

SEQ ID NO: 527671 - RNA, 21 nt, Chlamydophila pneumoniae J138
agcaggaaggaauagagaaag

SEQ ID NO: 527672 - RNA, 15 nt, Chlamydophila pneumoniae J138
agcaggaaaagcaaa

SEQ ID NO: 527673 - RNA, 23 nt, Chlamydophila pneumoniae J138
agcagggaaaaugcgaucuucac

SEQ ID NO: 527674 - RNA, 22 nt, Chlamydophila pneumoniae J138
agcauccaaaaugucuuuuuca

SEQ ID NO: 527675 - RNA, 18 nt, Chlamydophila pneumoniae J138
agcaucauuaauuccauc

SEQ ID NO: 527676 - RNA, 23 nt, Chlamydophila pneumoniae J138
agcaucugagucauaagcucuau

SEQ ID NO: 527677 - RNA, 14 nt, Chlamydophila pneumoniae J138
agcaucucucucca

SEQ ID NO: 527678 - RNA, 13 nt, Chlamydophila pneumoniae J138
agcaucucaagag

SEQ ID NO: 527679 - RNA, 13 nt, Chlamydophila pneumoniae J138
agcagugugccaa

SEQ ID NO: 527680 - RNA, 12 nt, Chlamydophila pneumoniae J138
agcagugugcca

SEQ ID NO: 527681 - RNA, 19 nt, Chlamydophila pneumoniae J138
agcaguauagagaagauuu

SEQ ID NO: 527682 - RNA, 18 nt, Chlamydophila pneumoniae J138
agcauaaggggagucuug

SEQ ID NO: 527683 - RNA, 20 nt, Chlamydophila pneumoniae J138
agcauaaguuagccuggcua

SEQ ID NO: 527684 - RNA, 15 nt, Chlamydophila pneumoniae J138
agcauaaucuuuaac

SEQ ID NO: 527685 - RNA, 19 nt, Chlamydophila pneumoniae J138
agcauaaggauucugagaa

SEQ ID NO: 527686 - RNA, 13 nt, Chlamydophila pneumoniae J138
agcauaacuugaa

SEQ ID NO: 527687 - RNA, 17 nt, Chlamydophila pneumoniae J138
agcauaacuugaagaag

SEQ ID NO: 527688 - RNA, 21 nt, Chlamydophila pneumoniae J138
agcauaacuugaagaaguaca

SEQ ID NO: 527689 - RNA, 22 nt, Chlamydophila pneumoniae J138
agcauaguguauaucagcaaaa

SEQ ID NO: 527690 - RNA, 21 nt, Chlamydophila pneumoniae J138
agcauagagcucuaaaaaaga

SEQ ID NO: 527691 - RNA, 23 nt, Chlamydophila pneumoniae J138
agcauagcccgaaauucauuaaa

SEQ ID NO: 527692 - RNA, 14 nt, Chlamydophila pneumoniae J138
agcauacuuauauu

SEQ ID NO: 527693 - RNA, 20 nt, Chlamydophila pneumoniae J138
agcauagacucuuccuucua

SEQ ID NO: 527694 - RNA, 21 nt, Chlamydophila pneumoniae J138
agcaccuaauaaagaagguug

SEQ ID NO: 527695 - RNA, 14 nt, Chlamydophila pneumoniae J138
agcaccacgaccua

SEQ ID NO: 527696 - RNA, 19 nt, Chlamydophila pneumoniae J138
agcaccacgaccuacacca

SEQ ID NO: 527697 - RNA, 14 nt, Chlamydophila pneumoniae J138
agcacauagagugu

SEQ ID NO: 527698 - RNA, 19 nt, Chlamydophila pneumoniae J138
agcacucuuaauuaaaaac

SEQ ID NO: 527699 - RNA, 21 nt, Chlamydophila pneumoniae J138
agcagaaguccuaucaaagca

SEQ ID NO: 527700 - RNA, 18 nt, Chlamydophila pneumoniae J138
agcagaccucucccuugg

SEQ ID NO: 527701 - RNA, 15 nt, Chlamydophila pneumoniae J138
agcacuucuuuagga

SEQ ID NO: 527702 - RNA, 13 nt, Chlamydophila pneumoniae J138
agcagaaacucca

SEQ ID NO: 527703 - RNA, 18 nt, Chlamydophila pneumoniae J138
agcagaaacuccaaaaua

SEQ ID NO: 527704 - RNA, 14 nt, Chlamydophila pneumoniae J138
agcagcaagaacau

SEQ ID NO: 527705 - RNA, 13 nt, Chlamydophila pneumoniae J138
agcagcagaauca

SEQ ID NO: 527706 - RNA, 16 nt, Chlamydophila pneumoniae J138
agcagauagagcuucu

SEQ ID NO: 527707 - RNA, 13 nt, Chlamydophila pneumoniae J138
agauaauuaugua

SEQ ID NO: 527708 - RNA, 16 nt, Chlamydophila pneumoniae J138
agauuguaauuuccuu

SEQ ID NO: 527709 - RNA, 15 nt, Chlamydophila pneumoniae J138
agauuguaauuuccu

SEQ ID NO: 527710 - RNA, 19 nt, Chlamydophila pneumoniae J138
agauugugcucaauacaga

SEQ ID NO: 527711 - RNA, 17 nt, Chlamydophila pneumoniae J138
agauuguucaaaaauag

SEQ ID NO: 527712 - RNA, 17 nt, Chlamydophila pneumoniae J138
agauaauagagaagaag

SEQ ID NO: 527713 - RNA, 19 nt, Chlamydophila pneumoniae J138
agauaauagagaagaagca

SEQ ID NO: 527714 - RNA, 14 nt, Chlamydophila pneumoniae J138
agauaauagagaag

SEQ ID NO: 527715 - RNA, 20 nt, Chlamydophila pneumoniae J138
agauuuccuuaagcuucuga

SEQ ID NO: 527716 - RNA, 17 nt, Chlamydophila pneumoniae J138
agauuuccuuaagcuuc

SEQ ID NO: 527717 - RNA, 12 nt, Chlamydophila pneumoniae J138
agauuuccuccg

SEQ ID NO: 527718 - RNA, 15 nt, Chlamydophila pneumoniae J138
agauuuauuuugucu

SEQ ID NO: 527719 - RNA, 16 nt, Chlamydophila pneumoniae J138
agauuuauuuugucuu

SEQ ID NO: 527720 - RNA, 20 nt, Chlamydophila pneumoniae J138
agauuucuauagagcaucau

SEQ ID NO: 527721 - RNA, 13 nt, Chlamydophila pneumoniae J138
agauuucuuguug

SEQ ID NO: 527722 - RNA, 19 nt, Chlamydophila pneumoniae J138
agauuucuaauccuccaaa

SEQ ID NO: 527723 - RNA, 22 nt, Chlamydophila pneumoniae J138
agauuuuaggggguuuuucuau

SEQ ID NO: 527724 - RNA, 21 nt, Chlamydophila pneumoniae J138
agauuuuaagaccuucugacg

SEQ ID NO: 527725 - RNA, 20 nt, Chlamydophila pneumoniae J138
agcaaaaugcgaggaaaaag

SEQ ID NO: 527726 - RNA, 15 nt, Chlamydophila pneumoniae J138
agcaaaaauucuagg

SEQ ID NO: 527727 - RNA, 23 nt, Chlamydophila pneumoniae J138
agcaaaacuguguucaauagcaa

SEQ ID NO: 527728 - RNA, 23 nt, Chlamydophila pneumoniae J138
agauuuuguaggaacaugccaaa

SEQ ID NO: 527729 - RNA, 19 nt, Chlamydophila pneumoniae J138
agauuuugagaaugaacaa

SEQ ID NO: 527730 - RNA, 14 nt, Chlamydophila pneumoniae J138
agauuuuuagaaua

SEQ ID NO: 527731 - RNA, 13 nt, Chlamydophila pneumoniae J138
agauuuuucuuuu

SEQ ID NO: 527732 - RNA, 21 nt, Chlamydophila pneumoniae J138
agauuuuucuuuuagagaaau

SEQ ID NO: 527733 - RNA, 14 nt, Chlamydophila pneumoniae J138
agauuuuuucuugg

SEQ ID NO: 527734 - RNA, 22 nt, Chlamydophila pneumoniae J138
agauuuuuuaaccucuuuucuu

SEQ ID NO: 527735 - RNA, 19 nt, Chlamydophila pneumoniae J138
agcaaaucuaaaaccugac

SEQ ID NO: 527736 - RNA, 15 nt, Chlamydophila pneumoniae J138
agcaaagauaaagaa

SEQ ID NO: 527737 - RNA, 16 nt, Chlamydophila pneumoniae J138
agcaaagauaaagaag

SEQ ID NO: 527738 - RNA, 14 nt, Chlamydophila pneumoniae J138
agcaaagcggcucu

SEQ ID NO: 527739 - RNA, 21 nt, Chlamydophila pneumoniae J138
agcaaagaacacccccgcagc

SEQ ID NO: 527740 - RNA, 21 nt, Chlamydophila pneumoniae J138
agcaaagaaaauucucagauu

SEQ ID NO: 527741 - RNA, 18 nt, Chlamydophila pneumoniae J138
agcaaacggaacuaaaga

SEQ ID NO: 527742 - RNA, 15 nt, Chlamydophila pneumoniae J138
agcaaacggagagca

SEQ ID NO: 527743 - RNA, 19 nt, Chlamydophila pneumoniae J138
agcaaacggagagcauuua

SEQ ID NO: 527744 - RNA, 23 nt, Chlamydophila pneumoniae J138
agcaagguaacauccauagagaa

SEQ ID NO: 527745 - RNA, 17 nt, Chlamydophila pneumoniae J138
agcaagguaacauccau

SEQ ID NO: 527746 - RNA, 18 nt, Chlamydophila pneumoniae J138
agcaagguaacauccaua

SEQ ID NO: 527747 - RNA, 19 nt, Chlamydophila pneumoniae J138
agcaagagcucuugagaaa

SEQ ID NO: 527748 - RNA, 18 nt, Chlamydophila pneumoniae J138
agcaagagcuauaccuau

SEQ ID NO: 527749 - RNA, 19 nt, Chlamydophila pneumoniae J138
agcaagauaaucauuaaga

SEQ ID NO: 527750 - RNA, 21 nt, Chlamydophila pneumoniae J138
agcaaucuguauccgacucug

SEQ ID NO: 527751 - RNA, 19 nt, Chlamydophila pneumoniae J138
agcaaucccccagcauuca

SEQ ID NO: 527752 - RNA, 22 nt, Chlamydophila pneumoniae J138
agcaauccauaguccuagcaga

SEQ ID NO: 527753 - RNA, 15 nt, Chlamydophila pneumoniae J138
agcaaucgaauagcu

SEQ ID NO: 527754 - RNA, 22 nt, Chlamydophila pneumoniae J138
agcaaucaguaaacccucagaa

SEQ ID NO: 527755 - RNA, 17 nt, Chlamydophila pneumoniae J138
agcaagaauuucuucua

SEQ ID NO: 527756 - RNA, 14 nt, Chlamydophila pneumoniae J138
agcaagaacauaac

SEQ ID NO: 527757 - RNA, 12 nt, Chlamydophila pneumoniae J138
agcaacucuuca

SEQ ID NO: 527758 - RNA, 14 nt, Chlamydophila pneumoniae J138
agcaacuaaagcau

SEQ ID NO: 527759 - RNA, 15 nt, Chlamydophila pneumoniae J138
agcaacgcaugacgc

SEQ ID NO: 527760 - RNA, 19 nt, Chlamydophila pneumoniae J138
agcaaccuuuccuaaaaua

SEQ ID NO: 527761 - RNA, 14 nt, Chlamydophila pneumoniae J138
agcaaccuuuccua

SEQ ID NO: 527762 - RNA, 13 nt, Chlamydophila pneumoniae J138
agcaacaaccaaa

SEQ ID NO: 527763 - RNA, 19 nt, Chlamydophila pneumoniae J138
agcaacaucguuaauauaa

SEQ ID NO: 527764 - RNA, 16 nt, Chlamydophila pneumoniae J138
agaaugauaagaaagc

SEQ ID NO: 527765 - RNA, 15 nt, Chlamydophila pneumoniae J138
agaaugauaagaaag

SEQ ID NO: 527766 - RNA, 16 nt, Chlamydophila pneumoniae J138
agaaugcaucuugagg

SEQ ID NO: 527767 - RNA, 11 nt, Chlamydophila pneumoniae J138
agaaugaugca

SEQ ID NO: 527768 - RNA, 22 nt, Chlamydophila pneumoniae J138
agaaucauaacaagucuaucga

SEQ ID NO: 527769 - RNA, 15 nt, Chlamydophila pneumoniae J138
agaaucaucugguau

SEQ ID NO: 527770 - RNA, 16 nt, Chlamydophila pneumoniae J138
agaauccauuuugccc

SEQ ID NO: 527771 - RNA, 15 nt, Chlamydophila pneumoniae J138
agaauccauuuugcc

SEQ ID NO: 527772 - RNA, 18 nt, Chlamydophila pneumoniae J138
agaaucauugagaugaaa

SEQ ID NO: 527773 - RNA, 14 nt, Chlamydophila pneumoniae J138
agaauaucaucuuc

SEQ ID NO: 527774 - RNA, 13 nt, Chlamydophila pneumoniae J138
agaauaucaucuu

SEQ ID NO: 527775 - RNA, 21 nt, Chlamydophila pneumoniae J138
agaauagggguagugaucugc

SEQ ID NO: 527776 - RNA, 12 nt, Chlamydophila pneumoniae J138
agaauaaagauu

SEQ ID NO: 527777 - RNA, 14 nt, Chlamydophila pneumoniae J138
agaauaaaauagga

SEQ ID NO: 527778 - RNA, 15 nt, Chlamydophila pneumoniae J138
agaauaaaauggccu

SEQ ID NO: 527779 - RNA, 19 nt, Chlamydophila pneumoniae J138
agaaguuuacaaauaaaau

SEQ ID NO: 527780 - RNA, 14 nt, Chlamydophila pneumoniae J138
agaagaucaaagau

SEQ ID NO: 527781 - RNA, 19 nt, Chlamydophila pneumoniae J138
agaagaugauuggacaagu

SEQ ID NO: 527782 - RNA, 14 nt, Chlamydophila pneumoniae J138
agaagagaaaguag

SEQ ID NO: 527783 - RNA, 21 nt, Chlamydophila pneumoniae J138
agaagacgcucuuagccuagg

SEQ ID NO: 527784 - RNA, 14 nt, Chlamydophila pneumoniae J138
agaagagaaaagau

SEQ ID NO: 527785 - RNA, 10 nt, Chlamydophila pneumoniae J138
agaagacgcu

SEQ ID NO: 527786 - RNA, 14 nt, Chlamydophila pneumoniae J138
agaaauucuaagag

SEQ ID NO: 527787 - RNA, 21 nt, Chlamydophila pneumoniae J138
agaaauucuaagcgcucuuca

SEQ ID NO: 527788 - RNA, 13 nt, Chlamydophila pneumoniae J138
agaaauucuaaga

SEQ ID NO: 527789 - RNA, 21 nt, Chlamydophila pneumoniae J138
agaaaugcaaaccaaaaaagu

SEQ ID NO: 527790 - RNA, 18 nt, Chlamydophila pneumoniae J138
agaaaugaaacgaaagca

SEQ ID NO: 527791 - RNA, 15 nt, Chlamydophila pneumoniae J138
agaaaugaagccaaa

SEQ ID NO: 527792 - RNA, 13 nt, Chlamydophila pneumoniae J138
agaaaugcucuuc

SEQ ID NO: 527793 - RNA, 21 nt, Chlamydophila pneumoniae J138
agaaaugcucuucugcagcgu

SEQ ID NO: 527794 - RNA, 19 nt, Chlamydophila pneumoniae J138
agaaauuccaauuuuugca

SEQ ID NO: 527795 - RNA, 16 nt, Chlamydophila pneumoniae J138
agaaauuaacagagcg

SEQ ID NO: 527796 - RNA, 16 nt, Chlamydophila pneumoniae J138
agaaggaggaguccuu

SEQ ID NO: 527797 - RNA, 11 nt, Chlamydophila pneumoniae J138
agaaggaucug

SEQ ID NO: 527798 - RNA, 15 nt, Chlamydophila pneumoniae J138
agaagccuuccuugu

SEQ ID NO: 527799 - RNA, 19 nt, Chlamydophila pneumoniae J138
agaaggcucucaaggucac

SEQ ID NO: 527800 - RNA, 18 nt, Chlamydophila pneumoniae J138
agaaggcuuguuucuguu

SEQ ID NO: 527801 - RNA, 15 nt, Chlamydophila pneumoniae J138
agaaggcaucccgaa

SEQ ID NO: 527802 - RNA, 13 nt, Chlamydophila pneumoniae J138
agaaggggguucu

SEQ ID NO: 527803 - RNA, 23 nt, Chlamydophila pneumoniae J138
agaaguguauuuaaauucuggaa

SEQ ID NO: 527804 - RNA, 15 nt, Chlamydophila pneumoniae J138
agacaccgaaagaaa

SEQ ID NO: 527805 - RNA, 19 nt, Chlamydophila pneumoniae J138
agacacaaaaagcuuuuuu

SEQ ID NO: 527806 - RNA, 17 nt, Chlamydophila pneumoniae J138
agacaaugacuguagga

SEQ ID NO: 527807 - RNA, 13 nt, Chlamydophila pneumoniae J138
agaauuuguccuu

SEQ ID NO: 527808 - RNA, 22 nt, Chlamydophila pneumoniae J138
agacaaaaaagggaucuccuuc

SEQ ID NO: 527809 - RNA, 13 nt, Chlamydophila pneumoniae J138
agacaaaguuguu

SEQ ID NO: 527810 - RNA, 16 nt, Chlamydophila pneumoniae J138
agacaaagccacagcc

SEQ ID NO: 527811 - RNA, 21 nt, Chlamydophila pneumoniae J138
agaccgagaagcuucaaugau

SEQ ID NO: 527812 - RNA, 13 nt, Chlamydophila pneumoniae J138
agaccuucugacg

SEQ ID NO: 527813 - RNA, 12 nt, Chlamydophila pneumoniae J138
agacauuccaca

SEQ ID NO: 527814 - RNA, 17 nt, Chlamydophila pneumoniae J138
agacaugcgaagggagg

SEQ ID NO: 527815 - RNA, 16 nt, Chlamydophila pneumoniae J138
agaccaaacuuucuuu

SEQ ID NO: 527816 - RNA, 20 nt, Chlamydophila pneumoniae J138
agaccaaacuuucuuuucua

SEQ ID NO: 527817 - RNA, 21 nt, Chlamydophila pneumoniae J138
agaccaaacuuucuuuucuau

SEQ ID NO: 527818 - RNA, 23 nt, Chlamydophila pneumoniae J138
agacauucccuaaagcugccagu

SEQ ID NO: 527819 - RNA, 20 nt, Chlamydophila pneumoniae J138
agaccaauaaauccaaaaaa

SEQ ID NO: 527820 - RNA, 15 nt, Chlamydophila pneumoniae J138
agaccaauaaaucca

SEQ ID NO: 527821 - RNA, 21 nt, Chlamydophila pneumoniae J138
agacccuccguggcggauaau

SEQ ID NO: 527822 - RNA, 19 nt, Chlamydophila pneumoniae J138
agacccuucuuuccauaaa

SEQ ID NO: 527823 - RNA, 13 nt, Chlamydophila pneumoniae J138
agacccuucuuuc

SEQ ID NO: 527824 - RNA, 22 nt, Chlamydophila pneumoniae J138
agacgcuuuuaucuguuaaaaa

SEQ ID NO: 527825 - RNA, 21 nt, Chlamydophila pneumoniae J138
agacucaucuuugaacaacuc

SEQ ID NO: 527826 - RNA, 22 nt, Chlamydophila pneumoniae J138
agacucccaaggaaauuaugga

SEQ ID NO: 527827 - RNA, 22 nt, Chlamydophila pneumoniae J138
agacuguguuuuauccaccaag

SEQ ID NO: 527828 - RNA, 14 nt, Chlamydophila pneumoniae J138
agacucucaucagc

SEQ ID NO: 527829 - RNA, 13 nt, Chlamydophila pneumoniae J138
agacucucaucag

SEQ ID NO: 527830 - RNA, 18 nt, Chlamydophila pneumoniae J138
agacugcaaaggaaggga

SEQ ID NO: 527831 - RNA, 19 nt, Chlamydophila pneumoniae J138
agacucucuuccaaaagua

SEQ ID NO: 527832 - RNA, 17 nt, Chlamydophila pneumoniae J138
agacuuuccucucuuua

SEQ ID NO: 527833 - RNA, 18 nt, Chlamydophila pneumoniae J138
agacuuguauucuugaga

SEQ ID NO: 527834 - RNA, 23 nt, Chlamydophila pneumoniae J138
agacuuguucagcuagagcacau

SEQ ID NO: 527835 - RNA, 18 nt, Chlamydophila pneumoniae J138
agacuuugccauuucuau

SEQ ID NO: 527836 - RNA, 11 nt, Chlamydophila pneumoniae J138
agagaaaauca

SEQ ID NO: 527837 - RNA, 17 nt, Chlamydophila pneumoniae J138
agagaaauuaacagagc

SEQ ID NO: 527838 - RNA, 19 nt, Chlamydophila pneumoniae J138
agagaaaauaucacauucc

SEQ ID NO: 527839 - RNA, 20 nt, Chlamydophila pneumoniae J138
agagaacuuuaacgaagaag

SEQ ID NO: 527840 - RNA, 14 nt, Chlamydophila pneumoniae J138
agagaacuccauuc

SEQ ID NO: 527841 - RNA, 17 nt, Chlamydophila pneumoniae J138
agagaacuccauucaga

SEQ ID NO: 527842 - RNA, 22 nt, Chlamydophila pneumoniae J138
agagaacucuuaaagguaaagc

SEQ ID NO: 527843 - RNA, 21 nt, Chlamydophila pneumoniae J138
agagaagagguguccauaaug

SEQ ID NO: 527844 - RNA, 17 nt, Chlamydophila pneumoniae J138
agagaagauuucuauag

SEQ ID NO: 527845 - RNA, 15 nt, Chlamydophila pneumoniae J138
agagaagcagaaucu

SEQ ID NO: 527846 - RNA, 17 nt, Chlamydophila pneumoniae J138
agagaacuuucgucuuu

SEQ ID NO: 527847 - RNA, 17 nt, Chlamydophila pneumoniae J138
agagaagacaggagcua

SEQ ID NO: 527848 - RNA, 14 nt, Chlamydophila pneumoniae J138
agagaacaggaggu

SEQ ID NO: 527849 - RNA, 15 nt, Chlamydophila pneumoniae J138
agagacacagaagga

SEQ ID NO: 527850 - RNA, 14 nt, Chlamydophila pneumoniae J138
agagacacagaagg

SEQ ID NO: 527851 - RNA, 13 nt, Chlamydophila pneumoniae J138
agagacaagaaaa

SEQ ID NO: 527852 - RNA, 17 nt, Chlamydophila pneumoniae J138
agagacaaagccacagc

SEQ ID NO: 527853 - RNA, 14 nt, Chlamydophila pneumoniae J138
agagacaaagccac

SEQ ID NO: 527854 - RNA, 21 nt, Chlamydophila pneumoniae J138
agagaauuugauauccagggu

SEQ ID NO: 527855 - RNA, 15 nt, Chlamydophila pneumoniae J138
agagaauguucccaa

SEQ ID NO: 527856 - RNA, 22 nt, Chlamydophila pneumoniae J138
agagaauccguuagaacucgaa

SEQ ID NO: 527857 - RNA, 22 nt, Chlamydophila pneumoniae J138
agagaauccuuuuuaggaaagg

SEQ ID NO: 527858 - RNA, 23 nt, Chlamydophila pneumoniae J138
agagaauacauugcugccaggcu

SEQ ID NO: 527859 - RNA, 18 nt, Chlamydophila pneumoniae J138
agagaccuucucuucaga

SEQ ID NO: 527860 - RNA, 15 nt, Chlamydophila pneumoniae J138
agagaccuucucuuc

SEQ ID NO: 527861 - RNA, 20 nt, Chlamydophila pneumoniae J138
agagacccaacaguucuuuc

SEQ ID NO: 527862 - RNA, 20 nt, Chlamydophila pneumoniae J138
agagacagccuguuuucuuc

SEQ ID NO: 527863 - RNA, 22 nt, Chlamydophila pneumoniae J138
agagcacuuuuaauauuugaga

SEQ ID NO: 527864 - RNA, 13 nt, Chlamydophila pneumoniae J138
agagcagaccucu

SEQ ID NO: 527865 - RNA, 15 nt, Chlamydophila pneumoniae J138
agagccggaacuuca

SEQ ID NO: 527866 - RNA, 20 nt, Chlamydophila pneumoniae J138
agagccauuuuccaggacca

SEQ ID NO: 527867 - RNA, 17 nt, Chlamydophila pneumoniae J138
agagcaugcuugaggaa

SEQ ID NO: 527868 - RNA, 18 nt, Chlamydophila pneumoniae J138
agaggccuuuuagaguau

SEQ ID NO: 527869 - RNA, 23 nt, Chlamydophila pneumoniae J138
agaggaucuagaaaaugaagagc

SEQ ID NO: 527870 - RNA, 21 nt, Chlamydophila pneumoniae J138
agaggaccgagaugaacauaa

SEQ ID NO: 527871 - RNA, 15 nt, Chlamydophila pneumoniae J138
agaggagagaauccu

SEQ ID NO: 527872 - RNA, 12 nt, Chlamydophila pneumoniae J138
agaggagauccu

SEQ ID NO: 527873 - RNA, 14 nt, Chlamydophila pneumoniae J138
agaggagccuccau

SEQ ID NO: 527874 - RNA, 15 nt, Chlamydophila pneumoniae J138
agagcuaugaugaga

SEQ ID NO: 527875 - RNA, 21 nt, Chlamydophila pneumoniae J138
agagcuaaagaaacuucugac

SEQ ID NO: 527876 - RNA, 22 nt, Chlamydophila pneumoniae J138
agagcuaaagaaacuucugacc

SEQ ID NO: 527877 - RNA, 18 nt, Chlamydophila pneumoniae J138
agagcuaacagcacguaa

SEQ ID NO: 527878 - RNA, 19 nt, Chlamydophila pneumoniae J138
agagcucguaauccuucuu

SEQ ID NO: 527879 - RNA, 15 nt, Chlamydophila pneumoniae J138
agagccgucuacuuu

SEQ ID NO: 527880 - RNA, 13 nt, Chlamydophila pneumoniae J138
agaguaaagagua

SEQ ID NO: 527881 - RNA, 18 nt, Chlamydophila pneumoniae J138
agagguuagaagggaggu

SEQ ID NO: 527882 - RNA, 14 nt, Chlamydophila pneumoniae J138
agagggaaggaaua

SEQ ID NO: 527883 - RNA, 16 nt, Chlamydophila pneumoniae J138
agaggcuguccuugca

SEQ ID NO: 527884 - RNA, 17 nt, Chlamydophila pneumoniae J138
agaguagacaagagaga

SEQ ID NO: 527885 - RNA, 15 nt, Chlamydophila pneumoniae J138
agagugucuaagaua

SEQ ID NO: 527886 - RNA, 15 nt, Chlamydophila pneumoniae J138
agagugugccagaau

SEQ ID NO: 527887 - RNA, 20 nt, Chlamydophila pneumoniae J138
agaguuccaagacaauaaaa

SEQ ID NO: 527888 - RNA, 14 nt, Chlamydophila pneumoniae J138
agaguuagauguaa

SEQ ID NO: 527889 - RNA, 18 nt, Chlamydophila pneumoniae J138
agauaaacagcacaggca

SEQ ID NO: 527890 - RNA, 23 nt, Chlamydophila pneumoniae J138
agaguucgcacuaauuuccuuca

SEQ ID NO: 527891 - RNA, 21 nt, Chlamydophila pneumoniae J138
agaguucgcacuaauuuccuu

SEQ ID NO: 527892 - RNA, 19 nt, Chlamydophila pneumoniae J138
agauaaagacaucucuuua

SEQ ID NO: 527893 - RNA, 12 nt, Chlamydophila pneumoniae J138
agauaaaggcau

SEQ ID NO: 527894 - RNA, 13 nt, Chlamydophila pneumoniae J138
agauaaaucccac

SEQ ID NO: 527895 - RNA, 13 nt, Chlamydophila pneumoniae J138
agauaagauaaac

SEQ ID NO: 527896 - RNA, 20 nt, Chlamydophila pneumoniae J138
agaaaauaguacgcuuuuua

SEQ ID NO: 527897 - RNA, 14 nt, Chlamydophila pneumoniae J138
agaaacaacugaaa

SEQ ID NO: 527898 - RNA, 13 nt, Chlamydophila pneumoniae J138
agaaaauaagaag

SEQ ID NO: 527899 - RNA, 19 nt, Chlamydophila pneumoniae J138
agaaaauaaagaucuucau

SEQ ID NO: 527900 - RNA, 15 nt, Chlamydophila pneumoniae J138
agaaaauaaagaucu

SEQ ID NO: 527901 - RNA, 14 nt, Chlamydophila pneumoniae J138
agaaaagaaaagug

SEQ ID NO: 527902 - RNA, 16 nt, Chlamydophila pneumoniae J138
agaaaagaacagggga

SEQ ID NO: 527903 - RNA, 14 nt, Chlamydophila pneumoniae J138
agaaaagaaagaag

SEQ ID NO: 527904 - RNA, 15 nt, Chlamydophila pneumoniae J138
agaaaagaacagggg

SEQ ID NO: 527905 - RNA, 22 nt, Chlamydophila pneumoniae J138
acuuuuuuucuucucuaagaaa

SEQ ID NO: 527906 - RNA, 18 nt, Chlamydophila pneumoniae J138
acuuuuuuucuucucuaa

SEQ ID NO: 527907 - RNA, 14 nt, Chlamydophila pneumoniae J138
agaaaacaaaguca

SEQ ID NO: 527908 - RNA, 21 nt, Chlamydophila pneumoniae J138
agaaaacauagagauucuaca

SEQ ID NO: 527909 - RNA, 20 nt, Chlamydophila pneumoniae J138
agaaaucuuuugauuaggcu

SEQ ID NO: 527910 - RNA, 17 nt, Chlamydophila pneumoniae J138
agaaaucugcauuccag

SEQ ID NO: 527911 - RNA, 19 nt, Chlamydophila pneumoniae J138
agaaaucugcauuccagga

SEQ ID NO: 527912 - RNA, 21 nt, Chlamydophila pneumoniae J138
agaaaucuacucuuuaaaaau

SEQ ID NO: 527913 - RNA, 15 nt, Chlamydophila pneumoniae J138
agaaaucaguccuaa

SEQ ID NO: 527914 - RNA, 18 nt, Chlamydophila pneumoniae J138
agaaauauacucuugcuu

SEQ ID NO: 527915 - RNA, 14 nt, Chlamydophila pneumoniae J138
agaaaucacacuua

SEQ ID NO: 527916 - RNA, 15 nt, Chlamydophila pneumoniae J138
agaaaucaaacauua

SEQ ID NO: 527917 - RNA, 18 nt, Chlamydophila pneumoniae J138
agaaauacgcuuuucuuc

SEQ ID NO: 527918 - RNA, 16 nt, Chlamydophila pneumoniae J138
agaaauauacugccag

SEQ ID NO: 527919 - RNA, 14 nt, Chlamydophila pneumoniae J138
agaaauauaacucu

SEQ ID NO: 527920 - RNA, 14 nt, Chlamydophila pneumoniae J138
agaaagacauccuu

SEQ ID NO: 527921 - RNA, 15 nt, Chlamydophila pneumoniae J138
agaaagacaaaaaau

SEQ ID NO: 527922 - RNA, 20 nt, Chlamydophila pneumoniae J138
agaaagaaguccuagggagu

SEQ ID NO: 527923 - RNA, 14 nt, Chlamydophila pneumoniae J138
agaaacuucugacc

SEQ ID NO: 527924 - RNA, 23 nt, Chlamydophila pneumoniae J138
agaaacuucugacccuguagcga

SEQ ID NO: 527925 - RNA, 11 nt, Chlamydophila pneumoniae J138
agaaagaagcc

SEQ ID NO: 527926 - RNA, 17 nt, Chlamydophila pneumoniae J138
agaaagaagccuuccuu

SEQ ID NO: 527927 - RNA, 13 nt, Chlamydophila pneumoniae J138
agaaacacugaac

SEQ ID NO: 527928 - RNA, 20 nt, Chlamydophila pneumoniae J138
agaaagauuuauuuugucuu

SEQ ID NO: 527929 - RNA, 22 nt, Chlamydophila pneumoniae J138
agaaagagucucacucuuuucu

SEQ ID NO: 527930 - RNA, 13 nt, Chlamydophila pneumoniae J138
agaaagauauccc

SEQ ID NO: 527931 - RNA, 20 nt, Chlamydophila pneumoniae J138
agaaagagcuaaagaaacuu

SEQ ID NO: 527932 - RNA, 18 nt, Chlamydophila pneumoniae J138
acuuguucuucauuauua

SEQ ID NO: 527933 - RNA, 21 nt, Chlamydophila pneumoniae J138
acuuguuaggaaaauucuuaa

SEQ ID NO: 527934 - RNA, 22 nt, Chlamydophila pneumoniae J138
acuuuaaucaagccuaaaucua

SEQ ID NO: 527935 - RNA, 12 nt, Chlamydophila pneumoniae J138
acuuuaagaagc

SEQ ID NO: 527936 - RNA, 22 nt, Chlamydophila pneumoniae J138
acuuuaagaagcacuucuuuag

SEQ ID NO: 527937 - RNA, 14 nt, Chlamydophila pneumoniae J138
acuuuaacgaagaa

SEQ ID NO: 527938 - RNA, 20 nt, Chlamydophila pneumoniae J138
acuuuacacuauaagacauu

SEQ ID NO: 527939 - RNA, 23 nt, Chlamydophila pneumoniae J138
acuuuagaaauuccaauuuuugc

SEQ ID NO: 527940 - RNA, 23 nt, Chlamydophila pneumoniae J138
acuuuagggaagaaauuaacaac

SEQ ID NO: 527941 - RNA, 22 nt, Chlamydophila pneumoniae J138
acuuuaggcccugacuuagagu

SEQ ID NO: 527942 - RNA, 16 nt, Chlamydophila pneumoniae J138
acuuuagggaagaaau

SEQ ID NO: 527943 - RNA, 18 nt, Chlamydophila pneumoniae J138
acuuuagggaagaaauua

SEQ ID NO: 527944 - RNA, 12 nt, Chlamydophila pneumoniae J138
acuuuauucucu

SEQ ID NO: 527945 - RNA, 20 nt, Chlamydophila pneumoniae J138
acuuuauucucuucacuauu

SEQ ID NO: 527946 - RNA, 16 nt, Chlamydophila pneumoniae J138
acuuucaagauugugc

SEQ ID NO: 527947 - RNA, 17 nt, Chlamydophila pneumoniae J138
acuuucguguacagacc

SEQ ID NO: 527948 - RNA, 22 nt, Chlamydophila pneumoniae J138
acuuucgaagcgcucuacaaau

SEQ ID NO: 527949 - RNA, 18 nt, Chlamydophila pneumoniae J138
acuuuccuggguaagcau

SEQ ID NO: 527950 - RNA, 14 nt, Chlamydophila pneumoniae J138
acuuuccucaaagc

SEQ ID NO: 527951 - RNA, 22 nt, Chlamydophila pneumoniae J138
acuuucuucucuaggaagauuu

SEQ ID NO: 527952 - RNA, 12 nt, Chlamydophila pneumoniae J138
acuuucuucucu

SEQ ID NO: 527953 - RNA, 21 nt, Chlamydophila pneumoniae J138
acuuucugagccccuugcaaa

SEQ ID NO: 527954 - RNA, 22 nt, Chlamydophila pneumoniae J138
acuuucugagccccuugcaaaa

SEQ ID NO: 527955 - RNA, 23 nt, Chlamydophila pneumoniae J138
acuuucugagccccuugcaaaag

SEQ ID NO: 527956 - RNA, 16 nt, Chlamydophila pneumoniae J138
acuuugccaacagcug

SEQ ID NO: 527957 - RNA, 22 nt, Chlamydophila pneumoniae J138
acuuugaggcaagucucaaagg

SEQ ID NO: 527958 - RNA, 18 nt, Chlamydophila pneumoniae J138
acuuuggucuucuguaau

SEQ ID NO: 527959 - RNA, 15 nt, Chlamydophila pneumoniae J138
acuuuuacugaaauu

SEQ ID NO: 527960 - RNA, 17 nt, Chlamydophila pneumoniae J138
acuuuuaauccuuucac

SEQ ID NO: 527961 - RNA, 22 nt, Chlamydophila pneumoniae J138
acuuuguuaauagaagaucauu

SEQ ID NO: 527962 - RNA, 21 nt, Chlamydophila pneumoniae J138
acuucucagcaucucgaacaa

SEQ ID NO: 527963 - RNA, 15 nt, Chlamydophila pneumoniae J138
acuucucagauaaaa

SEQ ID NO: 527964 - RNA, 12 nt, Chlamydophila pneumoniae J138
acuucucagaua

SEQ ID NO: 527965 - RNA, 14 nt, Chlamydophila pneumoniae J138
acuucucaaagaca

SEQ ID NO: 527966 - RNA, 18 nt, Chlamydophila pneumoniae J138
acuucuaugauaucacca

SEQ ID NO: 527967 - RNA, 23 nt, Chlamydophila pneumoniae J138
acuucguuagaaaccaugaugca

SEQ ID NO: 527968 - RNA, 15 nt, Chlamydophila pneumoniae J138
acuucuaaaagcaag

SEQ ID NO: 527969 - RNA, 13 nt, Chlamydophila pneumoniae J138
acuucuuucuugc

SEQ ID NO: 527970 - RNA, 21 nt, Chlamydophila pneumoniae J138
acuucuugugauccuugcaaa

SEQ ID NO: 527971 - RNA, 18 nt, Chlamydophila pneumoniae J138
acuucuugugauccuugc

SEQ ID NO: 527972 - RNA, 13 nt, Chlamydophila pneumoniae J138
acuucuucuuuuc

SEQ ID NO: 527973 - RNA, 23 nt, Chlamydophila pneumoniae J138
acuucuucucgguuuaaggcaau

SEQ ID NO: 527974 - RNA, 19 nt, Chlamydophila pneumoniae J138
acuucuucguuagagaaga

SEQ ID NO: 527975 - RNA, 22 nt, Chlamydophila pneumoniae J138
acuucuucguuagagaagaggu

SEQ ID NO: 527976 - RNA, 11 nt, Chlamydophila pneumoniae J138
acuucugguuu

SEQ ID NO: 527977 - RNA, 21 nt, Chlamydophila pneumoniae J138
acuucuguaguuuguucacuu

SEQ ID NO: 527978 - RNA, 17 nt, Chlamydophila pneumoniae J138
acuucugcuaguccugu

SEQ ID NO: 527979 - RNA, 19 nt, Chlamydophila pneumoniae J138
acuucugguccaaacccug

SEQ ID NO: 527980 - RNA, 14 nt, Chlamydophila pneumoniae J138
acuucuucaagaaa

SEQ ID NO: 527981 - RNA, 17 nt, Chlamydophila pneumoniae J138
acuugcauuuuuuggaa

SEQ ID NO: 527982 - RNA, 18 nt, Chlamydophila pneumoniae J138
acuugcaagcuucuuguu

SEQ ID NO: 527983 - RNA, 13 nt, Chlamydophila pneumoniae J138
acuugggaugcua

SEQ ID NO: 527984 - RNA, 14 nt, Chlamydophila pneumoniae J138
acuugggagaugcu

SEQ ID NO: 527985 - RNA, 16 nt, Chlamydophila pneumoniae J138
acuuggucauuauagu

SEQ ID NO: 527986 - RNA, 14 nt, Chlamydophila pneumoniae J138
acuugcuuauccaa

SEQ ID NO: 527987 - RNA, 17 nt, Chlamydophila pneumoniae J138
acuugcgauacaauaaa

SEQ ID NO: 527988 - RNA, 17 nt, Chlamydophila pneumoniae J138
acuucaguuguugcuuu

SEQ ID NO: 527989 - RNA, 18 nt, Chlamydophila pneumoniae J138
acuucaacuucuccaacu

SEQ ID NO: 527990 - RNA, 17 nt, Chlamydophila pneumoniae J138
acuucaaaugaaauucu

SEQ ID NO: 527991 - RNA, 22 nt, Chlamydophila pneumoniae J138
acuucaacaaaggcuccaaacg

SEQ ID NO: 527992 - RNA, 14 nt, Chlamydophila pneumoniae J138
acuuauuguucuug

SEQ ID NO: 527993 - RNA, 17 nt, Chlamydophila pneumoniae J138
acuucaacuucuccaac

SEQ ID NO: 527994 - RNA, 21 nt, Chlamydophila pneumoniae J138
acuuccaaaacgauccuguuc

SEQ ID NO: 527995 - RNA, 21 nt, Chlamydophila pneumoniae J138
acuuacuaaaggugaaaguac

SEQ ID NO: 527996 - RNA, 22 nt, Chlamydophila pneumoniae J138
acuuacuaaaggugaaaguaca

SEQ ID NO: 527997 - RNA, 22 nt, Chlamydophila pneumoniae J138
acuuauguacugagguagcaua

SEQ ID NO: 527998 - RNA, 15 nt, Chlamydophila pneumoniae J138
acuuagagucuucga

SEQ ID NO: 527999 - RNA, 20 nt, Chlamydophila pneumoniae J138
acuuagagucuucgacaagg

SEQ ID NO: 528000 - RNA, 19 nt, Chlamydophila pneumoniae J138
acuuagaacuauaggaagc

SEQ ID NO: 528001 - RNA, 13 nt, Chlamydophila pneumoniae J138
acugaccugauac

SEQ ID NO: 528002 - RNA, 13 nt, Chlamydophila pneumoniae J138
acuguacaaaugc

SEQ ID NO: 528003 - RNA, 22 nt, Chlamydophila pneumoniae J138
acuguacaaaugcaucucuagc

SEQ ID NO: 528004 - RNA, 19 nt, Chlamydophila pneumoniae J138
acuguccauccaaauagag

SEQ ID NO: 528005 - RNA, 15 nt, Chlamydophila pneumoniae J138
acuguauagaaacug

SEQ ID NO: 528006 - RNA, 18 nt, Chlamydophila pneumoniae J138
acuguauagaaacuguua

SEQ ID NO: 528007 - RNA, 17 nt, Chlamydophila pneumoniae J138
acugugccauaacgcau

SEQ ID NO: 528008 - RNA, 20 nt, Chlamydophila pneumoniae J138
acuguuguaauaaaaucaug

SEQ ID NO: 528009 - RNA, 14 nt, Chlamydophila pneumoniae J138
acgcaggaagaaca

SEQ ID NO: 528010 - RNA, 20 nt, Chlamydophila pneumoniae J138
acgcagagaugcuaacaacu

SEQ ID NO: 528011 - RNA, 16 nt, Chlamydophila pneumoniae J138
acgcacuucuucaaga

SEQ ID NO: 528012 - RNA, 15 nt, Chlamydophila pneumoniae J138
acgcaugacgcuuuu

SEQ ID NO: 528013 - RNA, 21 nt, Chlamydophila pneumoniae J138
acgcccacggaaagcacauac

SEQ ID NO: 528014 - RNA, 21 nt, Chlamydophila pneumoniae J138
acgccgcucuugauagcuaag

SEQ ID NO: 528015 - RNA, 16 nt, Chlamydophila pneumoniae J138
acgcucuaaacucucu

SEQ ID NO: 528016 - RNA, 21 nt, Chlamydophila pneumoniae J138
acgcucuaaacucucuuccuu

SEQ ID NO: 528017 - RNA, 17 nt, Chlamydophila pneumoniae J138
acgcucuccauggcuuc

SEQ ID NO: 528018 - RNA, 17 nt, Chlamydophila pneumoniae J138
acgcuccucuaacuuca

SEQ ID NO: 528019 - RNA, 10 nt, Chlamydophila pneumoniae J138
acgcuauucu

SEQ ID NO: 528020 - RNA, 13 nt, Chlamydophila pneumoniae J138
acgcuauucuuaa

SEQ ID NO: 528021 - RNA, 14 nt, Chlamydophila pneumoniae J138
acgcuauccuauug

SEQ ID NO: 528022 - RNA, 13 nt, Chlamydophila pneumoniae J138
acgcuaagcucuu

SEQ ID NO: 528023 - RNA, 20 nt, Chlamydophila pneumoniae J138
acgcuaagcucuuaauuucu

SEQ ID NO: 528024 - RNA, 16 nt, Chlamydophila pneumoniae J138
acgcuaaacuaaaaug

SEQ ID NO: 528025 - RNA, 18 nt, Chlamydophila pneumoniae J138
acgcuacgguacuuuaca

SEQ ID NO: 528026 - RNA, 19 nt, Chlamydophila pneumoniae J138
acgcuacgguacuuuacaa

SEQ ID NO: 528027 - RNA, 22 nt, Chlamydophila pneumoniae J138
acgcuugugguuagaggaagca

SEQ ID NO: 528028 - RNA, 23 nt, Chlamydophila pneumoniae J138
acgcuuuuaucuguuaaaaacaa

SEQ ID NO: 528029 - RNA, 19 nt, Chlamydophila pneumoniae J138
acgcuuuuaucuguuaaaa

SEQ ID NO: 528030 - RNA, 17 nt, Chlamydophila pneumoniae J138
acgcuuucgucuaaaau

SEQ ID NO: 528031 - RNA, 18 nt, Chlamydophila pneumoniae J138
acgcuuucgucuaaaaua

SEQ ID NO: 528032 - RNA, 12 nt, Chlamydophila pneumoniae J138
acgcuuuucuaa

SEQ ID NO: 528033 - RNA, 17 nt, Chlamydophila pneumoniae J138
acggcugauucucccaa

SEQ ID NO: 528034 - RNA, 16 nt, Chlamydophila pneumoniae J138
acgggcaauauaucca

SEQ ID NO: 528035 - RNA, 22 nt, Chlamydophila pneumoniae J138
acguagcauaccuuggaaaggu

SEQ ID NO: 528036 - RNA, 14 nt, Chlamydophila pneumoniae J138
acguagcagaggca

SEQ ID NO: 528037 - RNA, 21 nt, Chlamydophila pneumoniae J138
acguauagggaaccuugauac

SEQ ID NO: 528038 - RNA, 14 nt, Chlamydophila pneumoniae J138
acgucagcuguccu

SEQ ID NO: 528039 - RNA, 13 nt, Chlamydophila pneumoniae J138
acgucaucaccau

SEQ ID NO: 528040 - RNA, 23 nt, Chlamydophila pneumoniae J138
acguauccuugauuuuaaaauga

SEQ ID NO: 528041 - RNA, 23 nt, Chlamydophila pneumoniae J138
acgucacuggggcauaagaacuc

SEQ ID NO: 528042 - RNA, 22 nt, Chlamydophila pneumoniae J138
acgucacuggggcauaagaacu

SEQ ID NO: 528043 - RNA, 16 nt, Chlamydophila pneumoniae J138
acgucuuucaccaacu

SEQ ID NO: 528044 - RNA, 14 nt, Chlamydophila pneumoniae J138
acgugaucaaaauu

SEQ ID NO: 528045 - RNA, 15 nt, Chlamydophila pneumoniae J138
acgugcaucucuuca

SEQ ID NO: 528046 - RNA, 23 nt, Chlamydophila pneumoniae J138
acguuaauaaagaggcucccauc

SEQ ID NO: 528047 - RNA, 22 nt, Chlamydophila pneumoniae J138
acguucugcaacaaguugcauu

SEQ ID NO: 528048 - RNA, 21 nt, Chlamydophila pneumoniae J138
acguucgacaacaacauaaag

SEQ ID NO: 528049 - RNA, 22 nt, Chlamydophila pneumoniae J138
acuaaaugacgaguugaaguuu

SEQ ID NO: 528050 - RNA, 16 nt, Chlamydophila pneumoniae J138
acuaacuguaauuuca

SEQ ID NO: 528051 - RNA, 19 nt, Chlamydophila pneumoniae J138
acuaauaccuuucuaagaa

SEQ ID NO: 528052 - RNA, 19 nt, Chlamydophila pneumoniae J138
acuaaguuuaggcaggaag

SEQ ID NO: 528053 - RNA, 19 nt, Chlamydophila pneumoniae J138
acuacagagggcuucauuc

SEQ ID NO: 528054 - RNA, 15 nt, Chlamydophila pneumoniae J138
acuacaauaaccagg

SEQ ID NO: 528055 - RNA, 16 nt, Chlamydophila pneumoniae J138
acuacaagauaguggu

SEQ ID NO: 528056 - RNA, 12 nt, Chlamydophila pneumoniae J138
acuacugaaaca

SEQ ID NO: 528057 - RNA, 16 nt, Chlamydophila pneumoniae J138
acuacugaaacacuuu

SEQ ID NO: 528058 - RNA, 22 nt, Chlamydophila pneumoniae J138
acuagagauucgaaagaacuac

SEQ ID NO: 528059 - RNA, 17 nt, Chlamydophila pneumoniae J138
acuagauaguucacaag

SEQ ID NO: 528060 - RNA, 17 nt, Chlamydophila pneumoniae J138
acuauagggagacucuu

SEQ ID NO: 528061 - RNA, 15 nt, Chlamydophila pneumoniae J138
acuauagaaaaggau

SEQ ID NO: 528062 - RNA, 16 nt, Chlamydophila pneumoniae J138
acuauagaaaaggaug

SEQ ID NO: 528063 - RNA, 18 nt, Chlamydophila pneumoniae J138
acuauagaaaaggaugca

SEQ ID NO: 528064 - RNA, 14 nt, Chlamydophila pneumoniae J138
acuagcuuuucaug

SEQ ID NO: 528065 - RNA, 21 nt, Chlamydophila pneumoniae J138
acuagguuauuaucaaaguga

SEQ ID NO: 528066 - RNA, 23 nt, Chlamydophila pneumoniae J138
acuccaagucagccaagacaaaa

SEQ ID NO: 528067 - RNA, 19 nt, Chlamydophila pneumoniae J138
acuccaagaauagcaggaa

SEQ ID NO: 528068 - RNA, 20 nt, Chlamydophila pneumoniae J138
acuccacgaauucuuuaaaa

SEQ ID NO: 528069 - RNA, 14 nt, Chlamydophila pneumoniae J138
acuccaggguguuu

SEQ ID NO: 528070 - RNA, 15 nt, Chlamydophila pneumoniae J138
acucccaaggaaauu

SEQ ID NO: 528071 - RNA, 13 nt, Chlamydophila pneumoniae J138
acuccaagaauag

SEQ ID NO: 528072 - RNA, 21 nt, Chlamydophila pneumoniae J138
acuccaaaauauucuuucaaa

SEQ ID NO: 528073 - RNA, 13 nt, Chlamydophila pneumoniae J138
acucaucacaauu

SEQ ID NO: 528074 - RNA, 19 nt, Chlamydophila pneumoniae J138
acucaucacaauuuuaaaa

SEQ ID NO: 528075 - RNA, 18 nt, Chlamydophila pneumoniae J138
acucauccuaaauuaaau

SEQ ID NO: 528076 - RNA, 16 nt, Chlamydophila pneumoniae J138
acucaucuugaguaag

SEQ ID NO: 528077 - RNA, 24 nt, Chlamydophila pneumoniae J138
acucacauuugcuuuaacagaagc

SEQ ID NO: 528078 - RNA, 18 nt, Chlamydophila pneumoniae J138
acucacauuugcuuuaac

SEQ ID NO: 528079 - RNA, 14 nt, Chlamydophila pneumoniae J138
acucacauuugcuu

SEQ ID NO: 528080 - RNA, 13 nt, Chlamydophila pneumoniae J138
acucacagaguuc

SEQ ID NO: 528081 - RNA, 17 nt, Chlamydophila pneumoniae J138
acuaucuacacaguagc

SEQ ID NO: 528082 - RNA, 17 nt, Chlamydophila pneumoniae J138
acuaucucuguuuuuug

SEQ ID NO: 528083 - RNA, 18 nt, Chlamydophila pneumoniae J138
acucacaaacaacagaaa

SEQ ID NO: 528084 - RNA, 21 nt, Chlamydophila pneumoniae J138
acucacaaacaacagaaaugu

SEQ ID NO: 528085 - RNA, 21 nt, Chlamydophila pneumoniae J138
acucagcucccaugugcugaa

SEQ ID NO: 528086 - RNA, 22 nt, Chlamydophila pneumoniae J138
acucagcguucgcucucuuuaa

SEQ ID NO: 528087 - RNA, 16 nt, Chlamydophila pneumoniae J138
acucagcgcaucacga

SEQ ID NO: 528088 - RNA, 24 nt, Chlamydophila pneumoniae J138
acucaggcuuuaaguguuucuuca

SEQ ID NO: 528089 - RNA, 20 nt, Chlamydophila pneumoniae J138
acucaggauauauagagcag

SEQ ID NO: 528090 - RNA, 15 nt, Chlamydophila pneumoniae J138
acucucacugagugu

SEQ ID NO: 528091 - RNA, 22 nt, Chlamydophila pneumoniae J138
acucucaguuaaagagcauccu

SEQ ID NO: 528092 - RNA, 16 nt, Chlamydophila pneumoniae J138
acucggugggccucuu

SEQ ID NO: 528093 - RNA, 14 nt, Chlamydophila pneumoniae J138
acucccguuuuguu

SEQ ID NO: 528094 - RNA, 20 nt, Chlamydophila pneumoniae J138
acucgccauaauagucucug

SEQ ID NO: 528095 - RNA, 14 nt, Chlamydophila pneumoniae J138
acucgcgucaugca

SEQ ID NO: 528096 - RNA, 18 nt, Chlamydophila pneumoniae J138
acucgauuauuucuuguu

SEQ ID NO: 528097 - RNA, 14 nt, Chlamydophila pneumoniae J138
acugaagagcaauu

SEQ ID NO: 528098 - RNA, 11 nt, Chlamydophila pneumoniae J138
acugaauauca

SEQ ID NO: 528099 - RNA, 15 nt, Chlamydophila pneumoniae J138
acugaauaguagagu

SEQ ID NO: 528100 - RNA, 17 nt, Chlamydophila pneumoniae J138
acucuuuaaaaauagaa

SEQ ID NO: 528101 - RNA, 22 nt, Chlamydophila pneumoniae J138
acucuuguugucuauggaagcg

SEQ ID NO: 528102 - RNA, 13 nt, Chlamydophila pneumoniae J138
acucuuuaaaaau

SEQ ID NO: 528103 - RNA, 15 nt, Chlamydophila pneumoniae J138
acucuuucagaaaga

SEQ ID NO: 528104 - RNA, 21 nt, Chlamydophila pneumoniae J138
acucuuccuucuacagauuga

SEQ ID NO: 528105 - RNA, 23 nt, Chlamydophila pneumoniae J138
acucucccauguaguaaauuccu

SEQ ID NO: 528106 - RNA, 16 nt, Chlamydophila pneumoniae J138
acucuuauugcagaau

SEQ ID NO: 528107 - RNA, 19 nt, Chlamydophila pneumoniae J138
acucuucaucgauaggaug

SEQ ID NO: 528108 - RNA, 23 nt, Chlamydophila pneumoniae J138
acucuuccaauuguaaaucauug

SEQ ID NO: 528109 - RNA, 17 nt, Chlamydophila pneumoniae J138
aauuugccugaaauccu

SEQ ID NO: 528110 - RNA, 21 nt, Chlamydophila pneumoniae J138
aauuugcaagagccggaacuu

SEQ ID NO: 528111 - RNA, 18 nt, Chlamydophila pneumoniae J138
aauuucuuucacaucuuu

SEQ ID NO: 528112 - RNA, 21 nt, Chlamydophila pneumoniae J138
aauuucuuuuugccaauuuuc

SEQ ID NO: 528113 - RNA, 16 nt, Chlamydophila pneumoniae J138
aauuuuagcuucuuuu

SEQ ID NO: 528114 - RNA, 22 nt, Chlamydophila pneumoniae J138
aauuuuauaggaauaacaccaa

SEQ ID NO: 528115 - RNA, 13 nt, Chlamydophila pneumoniae J138
aauuagagagaau

SEQ ID NO: 528116 - RNA, 17 nt, Chlamydophila pneumoniae J138
aauuagagggauuugua

SEQ ID NO: 528117 - RNA, 15 nt, Chlamydophila pneumoniae J138
aauuaguaaaugccu

SEQ ID NO: 528118 - RNA, 22 nt, Chlamydophila pneumoniae J138
aauuaguaaaugccucuuucau

SEQ ID NO: 528119 - RNA, 22 nt, Chlamydophila pneumoniae J138
aauuaguuucacauaguuuaau

SEQ ID NO: 528120 - RNA, 19 nt, Chlamydophila pneumoniae J138
aauuuccaaucacacuaca

SEQ ID NO: 528121 - RNA, 16 nt, Chlamydophila pneumoniae J138
aauuuccaaaggaaaa

SEQ ID NO: 528122 - RNA, 14 nt, Chlamydophila pneumoniae J138
aauuuccaaaggaa

SEQ ID NO: 528123 - RNA, 18 nt, Chlamydophila pneumoniae J138
aauuuccuaccuauauuu

SEQ ID NO: 528124 - RNA, 19 nt, Chlamydophila pneumoniae J138
aauuucauuugaaauauga

SEQ ID NO: 528125 - RNA, 16 nt, Chlamydophila pneumoniae J138
aauuuccugcauggcu

SEQ ID NO: 528126 - RNA, 14 nt, Chlamydophila pneumoniae J138
aauuucgucuucau

SEQ ID NO: 528127 - RNA, 18 nt, Chlamydophila pneumoniae J138
aauuucggacgauauuua

SEQ ID NO: 528128 - RNA, 14 nt, Chlamydophila pneumoniae J138
aauuucugaaacaa

SEQ ID NO: 528129 - RNA, 15 nt, Chlamydophila pneumoniae J138
aauuucugaaacaau

SEQ ID NO: 528130 - RNA, 15 nt, Chlamydophila pneumoniae J138
aauuucuccuagguc

SEQ ID NO: 528131 - RNA, 20 nt, Chlamydophila pneumoniae J138
aauuucuccaguaucuucuc

SEQ ID NO: 528132 - RNA, 15 nt, Chlamydophila pneumoniae J138
aauuucuauaguuca

SEQ ID NO: 528133 - RNA, 22 nt, Chlamydophila pneumoniae J138
aauuuucagccugucuauaaaa

SEQ ID NO: 528134 - RNA, 14 nt, Chlamydophila pneumoniae J138
aauuuucuaaagau

SEQ ID NO: 528135 - RNA, 16 nt, Chlamydophila pneumoniae J138
aauuuucuaaagauuu

SEQ ID NO: 528136 - RNA, 23 nt, Chlamydophila pneumoniae J138
aauuuucuugcgacauaaccauc

SEQ ID NO: 528137 - RNA, 22 nt, Chlamydophila pneumoniae J138
aauuuugauaccucuccgucau

SEQ ID NO: 528138 - RNA, 20 nt, Chlamydophila pneumoniae J138
aauuuuugcuaaacaaugca

SEQ ID NO: 528139 - RNA, 19 nt, Chlamydophila pneumoniae J138
aauuuuugcuaaacaaugc

SEQ ID NO: 528140 - RNA, 17 nt, Chlamydophila pneumoniae J138
aauuuuuuucaaaggag

SEQ ID NO: 528141 - RNA, 19 nt, Chlamydophila pneumoniae J138
aauuuuuuguuaaauuccc

SEQ ID NO: 528142 - RNA, 21 nt, Chlamydophila pneumoniae J138
acaaaaacugcgcuagcucca

SEQ ID NO: 528143 - RNA, 19 nt, Chlamydophila pneumoniae J138
acaaaaaagggaucuccuu

SEQ ID NO: 528144 - RNA, 20 nt, Chlamydophila pneumoniae J138
acaaaaaagggaucuccuuc

SEQ ID NO: 528145 - RNA, 16 nt, Chlamydophila pneumoniae J138
acaaaacaaaagccau

SEQ ID NO: 528146 - RNA, 23 nt, Chlamydophila pneumoniae J138
acaaaagucucuagggaaaggag

SEQ ID NO: 528147 - RNA, 12 nt, Chlamydophila pneumoniae J138
acaaaauaaaac

SEQ ID NO: 528148 - RNA, 20 nt, Chlamydophila pneumoniae J138
acaaaauccacauccuugua

SEQ ID NO: 528149 - RNA, 17 nt, Chlamydophila pneumoniae J138
acaaacaacagaaaugu

SEQ ID NO: 528150 - RNA, 23 nt, Chlamydophila pneumoniae J138
acaaaucacgacgucaucaccau

SEQ ID NO: 528151 - RNA, 22 nt, Chlamydophila pneumoniae J138
acaaaucauuuaaagcugaaau

SEQ ID NO: 528152 - RNA, 15 nt, Chlamydophila pneumoniae J138
acaaauagcucugcg

SEQ ID NO: 528153 - RNA, 22 nt, Chlamydophila pneumoniae J138
acaaaugugacgcaagagacaa

SEQ ID NO: 528154 - RNA, 19 nt, Chlamydophila pneumoniae J138
acaaauuuuugcagaguug

SEQ ID NO: 528155 - RNA, 15 nt, Chlamydophila pneumoniae J138
acaacaacauaaaga

SEQ ID NO: 528156 - RNA, 19 nt, Chlamydophila pneumoniae J138
acaacaacagcuuuaucuu

SEQ ID NO: 528157 - RNA, 13 nt, Chlamydophila pneumoniae J138
acaaacucuucca

SEQ ID NO: 528158 - RNA, 15 nt, Chlamydophila pneumoniae J138
acaaagaaccauaga

SEQ ID NO: 528159 - RNA, 15 nt, Chlamydophila pneumoniae J138
acaaacuaaaucaac

SEQ ID NO: 528160 - RNA, 13 nt, Chlamydophila pneumoniae J138
acaaacagauuuu

SEQ ID NO: 528161 - RNA, 16 nt, Chlamydophila pneumoniae J138
acaaagcgucuaucua

SEQ ID NO: 528162 - RNA, 13 nt, Chlamydophila pneumoniae J138
acaaagccacagc

SEQ ID NO: 528163 - RNA, 15 nt, Chlamydophila pneumoniae J138
acaaagaucacugag

SEQ ID NO: 528164 - RNA, 15 nt, Chlamydophila pneumoniae J138
acaaaggcauaagau

SEQ ID NO: 528165 - RNA, 20 nt, Chlamydophila pneumoniae J138
acaaaguaggauugauaaau

SEQ ID NO: 528166 - RNA, 18 nt, Chlamydophila pneumoniae J138
acaaaggguuucuuucca

SEQ ID NO: 528167 - RNA, 16 nt, Chlamydophila pneumoniae J138
acaagcauaaacuccu

SEQ ID NO: 528168 - RNA, 21 nt, Chlamydophila pneumoniae J138
acaagcaguaacugcaaagag

SEQ ID NO: 528169 - RNA, 19 nt, Chlamydophila pneumoniae J138
acaagccucccuaugugaa

SEQ ID NO: 528170 - RNA, 23 nt, Chlamydophila pneumoniae J138
acaagauucucagcuucaucaga

SEQ ID NO: 528171 - RNA, 22 nt, Chlamydophila pneumoniae J138
acaagagagagcuggacuucug

SEQ ID NO: 528172 - RNA, 14 nt, Chlamydophila pneumoniae J138
acaagagagagcug

SEQ ID NO: 528173 - RNA, 22 nt, Chlamydophila pneumoniae J138
acaagacgaaagcacauaagau

SEQ ID NO: 528174 - RNA, 16 nt, Chlamydophila pneumoniae J138
acaagaagaucaaaga

SEQ ID NO: 528175 - RNA, 15 nt, Chlamydophila pneumoniae J138
acaacuuugaggcaa

SEQ ID NO: 528176 - RNA, 13 nt, Chlamydophila pneumoniae J138
acaagaaaacaaa

SEQ ID NO: 528177 - RNA, 20 nt, Chlamydophila pneumoniae J138
acaagaaccuguuuuucuaa

SEQ ID NO: 528178 - RNA, 17 nt, Chlamydophila pneumoniae J138
acaacuucugacaauaa

SEQ ID NO: 528179 - RNA, 15 nt, Chlamydophila pneumoniae J138
acaacuucugacaau

SEQ ID NO: 528180 - RNA, 13 nt, Chlamydophila pneumoniae J138
acaacuccuaagu

SEQ ID NO: 528181 - RNA, 22 nt, Chlamydophila pneumoniae J138
acaacgguguucauaaucagaa

SEQ ID NO: 528182 - RNA, 17 nt, Chlamydophila pneumoniae J138
acaacgcugcuucucua

SEQ ID NO: 528183 - RNA, 19 nt, Chlamydophila pneumoniae J138
acaacgcugcuucucuacu

SEQ ID NO: 528184 - RNA, 22 nt, Chlamydophila pneumoniae J138
acaacgcugcuucucuacuaaa

SEQ ID NO: 528185 - RNA, 21 nt, Chlamydophila pneumoniae J138
acaacgccuacauggaucccu

SEQ ID NO: 528186 - RNA, 16 nt, Chlamydophila pneumoniae J138
acaaccgccuuuauau

SEQ ID NO: 528187 - RNA, 18 nt, Chlamydophila pneumoniae J138
acaacauugaguugguuu

SEQ ID NO: 528188 - RNA, 13 nt, Chlamydophila pneumoniae J138
acaaccacuuccu

SEQ ID NO: 528189 - RNA, 17 nt, Chlamydophila pneumoniae J138
acaacauaaagaagguu

SEQ ID NO: 528190 - RNA, 15 nt, Chlamydophila pneumoniae J138
acaacauaacagggu

SEQ ID NO: 528191 - RNA, 15 nt, Chlamydophila pneumoniae J138
acaacaguugcggag

SEQ ID NO: 528192 - RNA, 16 nt, Chlamydophila pneumoniae J138
acaacaucaugaaaua

SEQ ID NO: 528193 - RNA, 14 nt, Chlamydophila pneumoniae J138
acaacaucaugaaa

SEQ ID NO: 528194 - RNA, 15 nt, Chlamydophila pneumoniae J138
acaacaucacuauca

SEQ ID NO: 528195 - RNA, 17 nt, Chlamydophila pneumoniae J138
acaacaucaugaaauac

SEQ ID NO: 528196 - RNA, 16 nt, Chlamydophila pneumoniae J138
acacagagaacaauaa

SEQ ID NO: 528197 - RNA, 17 nt, Chlamydophila pneumoniae J138
acacaguagccuucuuc

SEQ ID NO: 528198 - RNA, 20 nt, Chlamydophila pneumoniae J138
acacagagaugcuucuaaac

SEQ ID NO: 528199 - RNA, 19 nt, Chlamydophila pneumoniae J138
acacaaauagcaagagcua

SEQ ID NO: 528200 - RNA, 13 nt, Chlamydophila pneumoniae J138
acacaacucuuua

SEQ ID NO: 528201 - RNA, 15 nt, Chlamydophila pneumoniae J138
acacaaguucuaccu

SEQ ID NO: 528202 - RNA, 23 nt, Chlamydophila pneumoniae J138
acaauuagagauucauaaaacug

SEQ ID NO: 528203 - RNA, 14 nt, Chlamydophila pneumoniae J138
acaauguuuagaau

SEQ ID NO: 528204 - RNA, 10 nt, Chlamydophila pneumoniae J138
acaauguuua

SEQ ID NO: 528205 - RNA, 12 nt, Chlamydophila pneumoniae J138
acaauggaaaua

SEQ ID NO: 528206 - RNA, 21 nt, Chlamydophila pneumoniae J138
acaauuguaaauacaaaacaa

SEQ ID NO: 528207 - RNA, 16 nt, Chlamydophila pneumoniae J138
acaauuugcuccucca

SEQ ID NO: 528208 - RNA, 18 nt, Chlamydophila pneumoniae J138
acaauuugcuccuccaaa

SEQ ID NO: 528209 - RNA, 16 nt, Chlamydophila pneumoniae J138
acaaucucuuuaaaaa

SEQ ID NO: 528210 - RNA, 22 nt, Chlamydophila pneumoniae J138
acaaucucuuuaaaaauuaaag

SEQ ID NO: 528211 - RNA, 16 nt, Chlamydophila pneumoniae J138
acaaugaucuuucgaa

SEQ ID NO: 528212 - RNA, 22 nt, Chlamydophila pneumoniae J138
acaaugaagaacuacucucauu

SEQ ID NO: 528213 - RNA, 16 nt, Chlamydophila pneumoniae J138
acaaucguagccccau

SEQ ID NO: 528214 - RNA, 20 nt, Chlamydophila pneumoniae J138
acaaucgugauugcugucag

SEQ ID NO: 528215 - RNA, 21 nt, Chlamydophila pneumoniae J138
acaaucuacggcauaaccuuu

SEQ ID NO: 528216 - RNA, 17 nt, Chlamydophila pneumoniae J138
acaauccucacuauuaa

SEQ ID NO: 528217 - RNA, 19 nt, Chlamydophila pneumoniae J138
acaauccucacuauuaaua

SEQ ID NO: 528218 - RNA, 14 nt, Chlamydophila pneumoniae J138
acaauauaaaugcu

SEQ ID NO: 528219 - RNA, 17 nt, Chlamydophila pneumoniae J138
acaauauagagaucuag

SEQ ID NO: 528220 - RNA, 21 nt, Chlamydophila pneumoniae J138
acaauaggcacccaaacugau

SEQ ID NO: 528221 - RNA, 12 nt, Chlamydophila pneumoniae J138
acaagucccccu

SEQ ID NO: 528222 - RNA, 21 nt, Chlamydophila pneumoniae J138
acaaguacgacgaaguuagcu

SEQ ID NO: 528223 - RNA, 22 nt, Chlamydophila pneumoniae J138
acaaguacgacgaaguuagcua

SEQ ID NO: 528224 - RNA, 16 nt, Chlamydophila pneumoniae J138
acaaguaccaagaaaa

SEQ ID NO: 528225 - RNA, 23 nt, Chlamydophila pneumoniae J138
acaagcuucguccugacacaacu

SEQ ID NO: 528226 - RNA, 14 nt, Chlamydophila pneumoniae J138
acaagcuuccuugg

SEQ ID NO: 528227 - RNA, 23 nt, Chlamydophila pneumoniae J138
acaaggauuuugagacgaaagag

SEQ ID NO: 528228 - RNA, 15 nt, Chlamydophila pneumoniae J138
acaagggaaagaaac

SEQ ID NO: 528229 - RNA, 16 nt, Chlamydophila pneumoniae J138
acaagggaaagaaacu

SEQ ID NO: 528230 - RNA, 13 nt, Chlamydophila pneumoniae J138
acaauaaaaaaga

SEQ ID NO: 528231 - RNA, 15 nt, Chlamydophila pneumoniae J138
acaauaaaaaagaga

SEQ ID NO: 528232 - RNA, 17 nt, Chlamydophila pneumoniae J138
acaaguuuuuucaaucc

SEQ ID NO: 528233 - RNA, 19 nt, Chlamydophila pneumoniae J138
acaaguuuuuucaauccuu

SEQ ID NO: 528234 - RNA, 22 nt, Chlamydophila pneumoniae J138
acaauaaccaggggcuuuccuu

SEQ ID NO: 528235 - RNA, 13 nt, Chlamydophila pneumoniae J138
acaauaagaaaau

SEQ ID NO: 528236 - RNA, 15 nt, Chlamydophila pneumoniae J138
acaauacucucugcu

SEQ ID NO: 528237 - RNA, 20 nt, Chlamydophila pneumoniae J138
acacccugacagguagugcu

SEQ ID NO: 528238 - RNA, 20 nt, Chlamydophila pneumoniae J138
acacgaucuaaggcuuugcc

SEQ ID NO: 528239 - RNA, 21 nt, Chlamydophila pneumoniae J138
acaccugcccauuuuuggaaa

SEQ ID NO: 528240 - RNA, 14 nt, Chlamydophila pneumoniae J138
acaccauagaacug

SEQ ID NO: 528241 - RNA, 16 nt, Chlamydophila pneumoniae J138
acaccaucacauccug

SEQ ID NO: 528242 - RNA, 14 nt, Chlamydophila pneumoniae J138
acaccaggaagucc

SEQ ID NO: 528243 - RNA, 13 nt, Chlamydophila pneumoniae J138
acaccauaaaaca

SEQ ID NO: 528244 - RNA, 17 nt, Chlamydophila pneumoniae J138
acacccccgcagcuucu

SEQ ID NO: 528245 - RNA, 16 nt, Chlamydophila pneumoniae J138
acacauugucucuuuu

SEQ ID NO: 528246 - RNA, 20 nt, Chlamydophila pneumoniae J138
acacauugucucuuuuaaag

SEQ ID NO: 528247 - RNA, 16 nt, Chlamydophila pneumoniae J138
acaccaaaagaauacu

SEQ ID NO: 528248 - RNA, 12 nt, Chlamydophila pneumoniae J138
acaccaaauccu

SEQ ID NO: 528249 - RNA, 16 nt, Chlamydophila pneumoniae J138
acacggacacuauuau

SEQ ID NO: 528250 - RNA, 16 nt, Chlamydophila pneumoniae J138
acacgcuauagcaaca

SEQ ID NO: 528251 - RNA, 22 nt, Chlamydophila pneumoniae J138
acacgucacuggggcauaagaa

SEQ ID NO: 528252 - RNA, 16 nt, Chlamydophila pneumoniae J138
acagaaaggcuuuucu

SEQ ID NO: 528253 - RNA, 20 nt, Chlamydophila pneumoniae J138
acagaaaggcuuuucuuuuu

SEQ ID NO: 528254 - RNA, 21 nt, Chlamydophila pneumoniae J138
acacucaaaucuuucaaggaa

SEQ ID NO: 528255 - RNA, 23 nt, Chlamydophila pneumoniae J138
acagaguucgcgaccugugauuu

SEQ ID NO: 528256 - RNA, 21 nt, Chlamydophila pneumoniae J138
acagaguucgcgaccugugau

SEQ ID NO: 528257 - RNA, 16 nt, Chlamydophila pneumoniae J138
acagacugaagucguu

SEQ ID NO: 528258 - RNA, 17 nt, Chlamydophila pneumoniae J138
acagauaagacaauaaa

SEQ ID NO: 528259 - RNA, 20 nt, Chlamydophila pneumoniae J138
acagauaggguaagauugca

SEQ ID NO: 528260 - RNA, 13 nt, Chlamydophila pneumoniae J138
acagaaguacgca

SEQ ID NO: 528261 - RNA, 19 nt, Chlamydophila pneumoniae J138
acagaccguccuccccaua

SEQ ID NO: 528262 - RNA, 16 nt, Chlamydophila pneumoniae J138
acagcaucggcaacca

SEQ ID NO: 528263 - RNA, 13 nt, Chlamydophila pneumoniae J138
acagcaucggcaa

SEQ ID NO: 528264 - RNA, 13 nt, Chlamydophila pneumoniae J138
acagauuuuucaa

SEQ ID NO: 528265 - RNA, 18 nt, Chlamydophila pneumoniae J138
acagcaaaguaaugugcg

SEQ ID NO: 528266 - RNA, 21 nt, Chlamydophila pneumoniae J138
acauaaccucggucucgcugu

SEQ ID NO: 528267 - RNA, 19 nt, Chlamydophila pneumoniae J138
acauaaccucggucucgcu

SEQ ID NO: 528268 - RNA, 18 nt, Chlamydophila pneumoniae J138
acauaacgggguugucuc

SEQ ID NO: 528269 - RNA, 22 nt, Chlamydophila pneumoniae J138
acauaagcacucuuaauuaaaa

SEQ ID NO: 528270 - RNA, 18 nt, Chlamydophila pneumoniae J138
acagcauggacuccaaga

SEQ ID NO: 528271 - RNA, 21 nt, Chlamydophila pneumoniae J138
acauaguuuuuauuuuuaaau

SEQ ID NO: 528272 - RNA, 20 nt, Chlamydophila pneumoniae J138
acauagguaaaaccagcaua

SEQ ID NO: 528273 - RNA, 22 nt, Chlamydophila pneumoniae J138
acauagaaaacauaucccauag

SEQ ID NO: 528274 - RNA, 19 nt, Chlamydophila pneumoniae J138
acauacucgucaaauucau

SEQ ID NO: 528275 - RNA, 18 nt, Chlamydophila pneumoniae J138
acauacucgucaaauuca

SEQ ID NO: 528276 - RNA, 12 nt, Chlamydophila pneumoniae J138
acauccauucuu

SEQ ID NO: 528277 - RNA, 17 nt, Chlamydophila pneumoniae J138
acaucaugaaauacccg

SEQ ID NO: 528278 - RNA, 19 nt, Chlamydophila pneumoniae J138
acaucaucagaagcuccug

SEQ ID NO: 528279 - RNA, 12 nt, Chlamydophila pneumoniae J138
acaucaagaauu

SEQ ID NO: 528280 - RNA, 14 nt, Chlamydophila pneumoniae J138
acaucaccacugcu

SEQ ID NO: 528281 - RNA, 22 nt, Chlamydophila pneumoniae J138
acauaucuccuuuaaauaaaau

SEQ ID NO: 528282 - RNA, 23 nt, Chlamydophila pneumoniae J138
acauaucuccuuuaaauaaaauc

SEQ ID NO: 528283 - RNA, 13 nt, Chlamydophila pneumoniae J138
acauauccaauga

SEQ ID NO: 528284 - RNA, 22 nt, Chlamydophila pneumoniae J138
acauugcugccaggcuuaaaua

SEQ ID NO: 528285 - RNA, 18 nt, Chlamydophila pneumoniae J138
acauugcgggcucaaaga

SEQ ID NO: 528286 - RNA, 23 nt, Chlamydophila pneumoniae J138
acauugcgggcucaaagaaaguc

SEQ ID NO: 528287 - RNA, 20 nt, Chlamydophila pneumoniae J138
acauugaguugguuuuguaa

SEQ ID NO: 528288 - RNA, 18 nt, Chlamydophila pneumoniae J138
acauugaccuaaaggaau

SEQ ID NO: 528289 - RNA, 13 nt, Chlamydophila pneumoniae J138
acauucuucugau

SEQ ID NO: 528290 - RNA, 17 nt, Chlamydophila pneumoniae J138
acauucuucugucugua

SEQ ID NO: 528291 - RNA, 17 nt, Chlamydophila pneumoniae J138
acauucuuaauaucuac

SEQ ID NO: 528292 - RNA, 22 nt, Chlamydophila pneumoniae J138
acauucuccgccagaguuuaaa

SEQ ID NO: 528293 - RNA, 16 nt, Chlamydophila pneumoniae J138
acauucgcaagaauga

SEQ ID NO: 528294 - RNA, 23 nt, Chlamydophila pneumoniae J138
acauucauuuuuuaauaaaauuu

SEQ ID NO: 528295 - RNA, 19 nt, Chlamydophila pneumoniae J138
acauucaggauacucugaa

SEQ ID NO: 528296 - RNA, 19 nt, Chlamydophila pneumoniae J138
acauucacccucauuaaga

SEQ ID NO: 528297 - RNA, 18 nt, Chlamydophila pneumoniae J138
acauuccuuaauuacucg

SEQ ID NO: 528298 - RNA, 16 nt, Chlamydophila pneumoniae J138
acauuccaaugcauga

SEQ ID NO: 528299 - RNA, 13 nt, Chlamydophila pneumoniae J138
acauuagagagug

SEQ ID NO: 528300 - RNA, 17 nt, Chlamydophila pneumoniae J138
acauguugguagaggcu

SEQ ID NO: 528301 - RNA, 13 nt, Chlamydophila pneumoniae J138
acauguuucacuu

SEQ ID NO: 528302 - RNA, 23 nt, Chlamydophila pneumoniae J138
acaugcgcagaauaaaauggccu

SEQ ID NO: 528303 - RNA, 16 nt, Chlamydophila pneumoniae J138
acaugcgcguauaagg

SEQ ID NO: 528304 - RNA, 17 nt, Chlamydophila pneumoniae J138
acaugccuaaauagcuc

SEQ ID NO: 528305 - RNA, 13 nt, Chlamydophila pneumoniae J138
acaugccugaaaa

SEQ ID NO: 528306 - RNA, 22 nt, Chlamydophila pneumoniae J138
acaugccugaaaacaaggcaaa

SEQ ID NO: 528307 - RNA, 14 nt, Chlamydophila pneumoniae J138
acaugccuuaggcu

SEQ ID NO: 528308 - RNA, 23 nt, Chlamydophila pneumoniae J138
acauccuuguagaacuucucaag

SEQ ID NO: 528309 - RNA, 18 nt, Chlamydophila pneumoniae J138
acaucgaaaccacagcaa

SEQ ID NO: 528310 - RNA, 18 nt, Chlamydophila pneumoniae J138
acauccuuguagaacuuc

SEQ ID NO: 528311 - RNA, 21 nt, Chlamydophila pneumoniae J138
acauccuuguagaacuucuca

SEQ ID NO: 528312 - RNA, 13 nt, Chlamydophila pneumoniae J138
acauccuucuuua

SEQ ID NO: 528313 - RNA, 17 nt, Chlamydophila pneumoniae J138
acauccuuguagaacuu

SEQ ID NO: 528314 - RNA, 13 nt, Chlamydophila pneumoniae J138
acaucguauauaa

SEQ ID NO: 528315 - RNA, 15 nt, Chlamydophila pneumoniae J138
acaucuugagcuuca

SEQ ID NO: 528316 - RNA, 23 nt, Chlamydophila pneumoniae J138
acaucuuuguggggcaguaggua

SEQ ID NO: 528317 - RNA, 19 nt, Chlamydophila pneumoniae J138
acaucuuguucugcacgug

SEQ ID NO: 528318 - RNA, 15 nt, Chlamydophila pneumoniae J138
acaucuuuagaauca

SEQ ID NO: 528319 - RNA, 13 nt, Chlamydophila pneumoniae J138
acaucuuucucua

SEQ ID NO: 528320 - RNA, 18 nt, Chlamydophila pneumoniae J138
accaaaauuauguauaaa

SEQ ID NO: 528321 - RNA, 20 nt, Chlamydophila pneumoniae J138
acauuuugccuuuagggaaa

SEQ ID NO: 528322 - RNA, 19 nt, Chlamydophila pneumoniae J138
acauuuuuauuuccuuauc

SEQ ID NO: 528323 - RNA, 22 nt, Chlamydophila pneumoniae J138
accaaaucaucgcaaucaaaga

SEQ ID NO: 528324 - RNA, 22 nt, Chlamydophila pneumoniae J138
acauuuccccaugaaaauacaa

SEQ ID NO: 528325 - RNA, 22 nt, Chlamydophila pneumoniae J138
acauuucucaccacggaagaua

SEQ ID NO: 528326 - RNA, 23 nt, Chlamydophila pneumoniae J138
acauuucuugauccaucugcucu

SEQ ID NO: 528327 - RNA, 19 nt, Chlamydophila pneumoniae J138
acauuuguugucagcuuug

SEQ ID NO: 528328 - RNA, 19 nt, Chlamydophila pneumoniae J138
accaaugaucguagcuaaa

SEQ ID NO: 528329 - RNA, 20 nt, Chlamydophila pneumoniae J138
accaaugauaauuucauuau

SEQ ID NO: 528330 - RNA, 24 nt, Chlamydophila pneumoniae J138
accacaauuccuaaaacaagaaga

SEQ ID NO: 528331 - RNA, 18 nt, Chlamydophila pneumoniae J138
accacaauuccuaaaaca

SEQ ID NO: 528332 - RNA, 20 nt, Chlamydophila pneumoniae J138
accacagaggucgauuugaa

SEQ ID NO: 528333 - RNA, 19 nt, Chlamydophila pneumoniae J138
accacagcuguacagaaca

SEQ ID NO: 528334 - RNA, 19 nt, Chlamydophila pneumoniae J138
accacagaaugauaagaaa

SEQ ID NO: 528335 - RNA, 21 nt, Chlamydophila pneumoniae J138
accacagaaugauaagaaagc

SEQ ID NO: 528336 - RNA, 20 nt, Chlamydophila pneumoniae J138
accaaucuugagcauccaaa

SEQ ID NO: 528337 - RNA, 14 nt, Chlamydophila pneumoniae J138
accaauacagcaua

SEQ ID NO: 528338 - RNA, 21 nt, Chlamydophila pneumoniae J138
accaauaaccgaaacuucuca

SEQ ID NO: 528339 - RNA, 16 nt, Chlamydophila pneumoniae J138
accaagaaaucucagu

SEQ ID NO: 528340 - RNA, 17 nt, Chlamydophila pneumoniae J138
accaagacaauggaaau

SEQ ID NO: 528341 - RNA, 23 nt, Chlamydophila pneumoniae J138
accaagaugucuccaaagauaca

SEQ ID NO: 528342 - RNA, 15 nt, Chlamydophila pneumoniae J138
accaagaugucucca

SEQ ID NO: 528343 - RNA, 19 nt, Chlamydophila pneumoniae J138
accacuaccgaauuuucaa

SEQ ID NO: 528344 - RNA, 23 nt, Chlamydophila pneumoniae J138
accagcucgagaucuuuuugcca

SEQ ID NO: 528345 - RNA, 14 nt, Chlamydophila pneumoniae J138
accaucaagguauu

SEQ ID NO: 528346 - RNA, 22 nt, Chlamydophila pneumoniae J138
accauccgacuuuccucaaagc

SEQ ID NO: 528347 - RNA, 16 nt, Chlamydophila pneumoniae J138
accaucuguugaucuu

SEQ ID NO: 528348 - RNA, 22 nt, Chlamydophila pneumoniae J138
accaugaccuuuagcugcugaa

SEQ ID NO: 528349 - RNA, 22 nt, Chlamydophila pneumoniae J138
accaucgucuccaaaaauuccc

SEQ ID NO: 528350 - RNA, 16 nt, Chlamydophila pneumoniae J138
accauccuguagcuuu

SEQ ID NO: 528351 - RNA, 19 nt, Chlamydophila pneumoniae J138
accaucgucuccaaaaauu

SEQ ID NO: 528352 - RNA, 19 nt, Chlamydophila pneumoniae J138
acccaaacugaugccaaga

SEQ ID NO: 528353 - RNA, 16 nt, Chlamydophila pneumoniae J138
acccaaagaggggagc

SEQ ID NO: 528354 - RNA, 20 nt, Chlamydophila pneumoniae J138
acccacgcaugccucuuggu

SEQ ID NO: 528355 - RNA, 11 nt, Chlamydophila pneumoniae J138
acccagcugcg

SEQ ID NO: 528356 - RNA, 18 nt, Chlamydophila pneumoniae J138
acccauaaugguacaaua

SEQ ID NO: 528357 - RNA, 20 nt, Chlamydophila pneumoniae J138
acccauauuugaauaaagga

SEQ ID NO: 528358 - RNA, 23 nt, Chlamydophila pneumoniae J138
acccaguuguauccagcucaagg

SEQ ID NO: 528359 - RNA, 23 nt, Chlamydophila pneumoniae J138
acccauugaauuuaugggugaga

SEQ ID NO: 528360 - RNA, 13 nt, Chlamydophila pneumoniae J138
acccaucuagaaa

SEQ ID NO: 528361 - RNA, 15 nt, Chlamydophila pneumoniae J138
accgaaacuucucag

SEQ ID NO: 528362 - RNA, 21 nt, Chlamydophila pneumoniae J138
acccuuuauacuguuuuucuu

SEQ ID NO: 528363 - RNA, 13 nt, Chlamydophila pneumoniae J138
accgaaagucccg

SEQ ID NO: 528364 - RNA, 13 nt, Chlamydophila pneumoniae J138
accgaacagagcg

SEQ ID NO: 528365 - RNA, 14 nt, Chlamydophila pneumoniae J138
accgaaucucucca

SEQ ID NO: 528366 - RNA, 12 nt, Chlamydophila pneumoniae J138
accgacaagcau

SEQ ID NO: 528367 - RNA, 19 nt, Chlamydophila pneumoniae J138
accgaauuuucaauuguaa

SEQ ID NO: 528368 - RNA, 17 nt, Chlamydophila pneumoniae J138
accgagaugaacauaau

SEQ ID NO: 528369 - RNA, 13 nt, Chlamydophila pneumoniae J138
accgagacuauuu

SEQ ID NO: 528370 - RNA, 16 nt, Chlamydophila pneumoniae J138
acccucaucauccuca

SEQ ID NO: 528371 - RNA, 15 nt, Chlamydophila pneumoniae J138
acccucaaagaauac

SEQ ID NO: 528372 - RNA, 20 nt, Chlamydophila pneumoniae J138
acccuagguagcucgagauu

SEQ ID NO: 528373 - RNA, 16 nt, Chlamydophila pneumoniae J138
acccucggagacucag

SEQ ID NO: 528374 - RNA, 18 nt, Chlamydophila pneumoniae J138
accgcuaguauuaagaua

SEQ ID NO: 528375 - RNA, 15 nt, Chlamydophila pneumoniae J138
accgcgagugugacu

SEQ ID NO: 528376 - RNA, 15 nt, Chlamydophila pneumoniae J138
aaucaucaaaaagau

SEQ ID NO: 528377 - RNA, 20 nt, Chlamydophila pneumoniae J138
aaucauaaccaaaagaauua

SEQ ID NO: 528378 - RNA, 12 nt, Chlamydophila pneumoniae J138
aaucauaaccaa

SEQ ID NO: 528379 - RNA, 15 nt, Chlamydophila pneumoniae J138
aaucauaaaaaaagc

SEQ ID NO: 528380 - RNA, 15 nt, Chlamydophila pneumoniae J138
aaucagugcugccau

SEQ ID NO: 528381 - RNA, 17 nt, Chlamydophila pneumoniae J138
aaucagcacacugcuua

SEQ ID NO: 528382 - RNA, 20 nt, Chlamydophila pneumoniae J138
aaucacuuaauaauguuuua

SEQ ID NO: 528383 - RNA, 14 nt, Chlamydophila pneumoniae J138
aaucacucuaugau

SEQ ID NO: 528384 - RNA, 18 nt, Chlamydophila pneumoniae J138
aaucacgacgucaucacc

SEQ ID NO: 528385 - RNA, 20 nt, Chlamydophila pneumoniae J138
aaucacgacgucaucaccau

SEQ ID NO: 528386 - RNA, 19 nt, Chlamydophila pneumoniae J138
aaucaccaauuuuuucccc

SEQ ID NO: 528387 - RNA, 15 nt, Chlamydophila pneumoniae J138
aaucacauaaaauaa

SEQ ID NO: 528388 - RNA, 14 nt, Chlamydophila pneumoniae J138
aaucaauccaagaa

SEQ ID NO: 528389 - RNA, 13 nt, Chlamydophila pneumoniae J138
aaucaauccacaa

SEQ ID NO: 528390 - RNA, 17 nt, Chlamydophila pneumoniae J138
aaucaagccacagagaa

SEQ ID NO: 528391 - RNA, 12 nt, Chlamydophila pneumoniae J138
aaucaagaagag

SEQ ID NO: 528392 - RNA, 18 nt, Chlamydophila pneumoniae J138
aaucaagaguuucgaauu

SEQ ID NO: 528393 - RNA, 13 nt, Chlamydophila pneumoniae J138
aaucaagauaaag

SEQ ID NO: 528394 - RNA, 14 nt, Chlamydophila pneumoniae J138
aaucaacaucacaa

SEQ ID NO: 528395 - RNA, 12 nt, Chlamydophila pneumoniae J138
aaucaaauucaa

SEQ ID NO: 528396 - RNA, 20 nt, Chlamydophila pneumoniae J138
aauauuaacccaccagaagg

SEQ ID NO: 528397 - RNA, 18 nt, Chlamydophila pneumoniae J138
aauauugaucuuuccucu

SEQ ID NO: 528398 - RNA, 18 nt, Chlamydophila pneumoniae J138
aauaucgaguucuuuuug

SEQ ID NO: 528399 - RNA, 20 nt, Chlamydophila pneumoniae J138
aauaucaccuacaucagacu

SEQ ID NO: 528400 - RNA, 13 nt, Chlamydophila pneumoniae J138
aauaucacauucc

SEQ ID NO: 528401 - RNA, 23 nt, Chlamydophila pneumoniae J138
aauauaacugcauacaaggcaca

SEQ ID NO: 528402 - RNA, 14 nt, Chlamydophila pneumoniae J138
aauauaacucucua

SEQ ID NO: 528403 - RNA, 15 nt, Chlamydophila pneumoniae J138
aauauaaaagaagac

SEQ ID NO: 528404 - RNA, 19 nt, Chlamydophila pneumoniae J138
aauagcuuacuuucuuuua

SEQ ID NO: 528405 - RNA, 14 nt, Chlamydophila pneumoniae J138
aauagcuaaaguga

SEQ ID NO: 528406 - RNA, 15 nt, Chlamydophila pneumoniae J138
aauaggauaagaaau

SEQ ID NO: 528407 - RNA, 21 nt, Chlamydophila pneumoniae J138
aauaggaauuagagaaauuuu

SEQ ID NO: 528408 - RNA, 22 nt, Chlamydophila pneumoniae J138
aauaguugugagacuuucugag

SEQ ID NO: 528409 - RNA, 21 nt, Chlamydophila pneumoniae J138
aauagagaagaagcaaaagau

SEQ ID NO: 528410 - RNA, 16 nt, Chlamydophila pneumoniae J138
aauagagaaagagugc

SEQ ID NO: 528411 - RNA, 15 nt, Chlamydophila pneumoniae J138
aauagacacuugcuu

SEQ ID NO: 528412 - RNA, 15 nt, Chlamydophila pneumoniae J138
aauagacaggaugga

SEQ ID NO: 528413 - RNA, 18 nt, Chlamydophila pneumoniae J138
aauagcucuuuucaugau

SEQ ID NO: 528414 - RNA, 17 nt, Chlamydophila pneumoniae J138
aauagcucuuuucauga

SEQ ID NO: 528415 - RNA, 15 nt, Chlamydophila pneumoniae J138
aauagcucuggagau

SEQ ID NO: 528416 - RNA, 16 nt, Chlamydophila pneumoniae J138
aauagcucuggagauu

SEQ ID NO: 528417 - RNA, 14 nt, Chlamydophila pneumoniae J138
aauaaaguccucca

SEQ ID NO: 528418 - RNA, 17 nt, Chlamydophila pneumoniae J138
aauacagacagaugcuu

SEQ ID NO: 528419 - RNA, 20 nt, Chlamydophila pneumoniae J138
aauacagccagcagaaggcu

SEQ ID NO: 528420 - RNA, 15 nt, Chlamydophila pneumoniae J138
aauacagccagcaga

SEQ ID NO: 528421 - RNA, 20 nt, Chlamydophila pneumoniae J138
aauacaucaccacugcucca

SEQ ID NO: 528422 - RNA, 15 nt, Chlamydophila pneumoniae J138
aauaccaucucuuuc

SEQ ID NO: 528423 - RNA, 22 nt, Chlamydophila pneumoniae J138
aauaccagauaaagcaaagaua

SEQ ID NO: 528424 - RNA, 18 nt, Chlamydophila pneumoniae J138
aauaccagauaaagcaaa

SEQ ID NO: 528425 - RNA, 13 nt, Chlamydophila pneumoniae J138
aauaccagaagca

SEQ ID NO: 528426 - RNA, 21 nt, Chlamydophila pneumoniae J138
aauaccuuucuaagaauucuu

SEQ ID NO: 528427 - RNA, 23 nt, Chlamydophila pneumoniae J138
aauacguccagccugcaccagac

SEQ ID NO: 528428 - RNA, 15 nt, Chlamydophila pneumoniae J138
aauacguccagccug

SEQ ID NO: 528429 - RNA, 16 nt, Chlamydophila pneumoniae J138
aauacgaucugcuuug

SEQ ID NO: 528430 - RNA, 14 nt, Chlamydophila pneumoniae J138
aauacgaucuuuug

SEQ ID NO: 528431 - RNA, 12 nt, Chlamydophila pneumoniae J138
aauacuaagaag

SEQ ID NO: 528432 - RNA, 17 nt, Chlamydophila pneumoniae J138
aauacguuuuuaggguu

SEQ ID NO: 528433 - RNA, 18 nt, Chlamydophila pneumoniae J138
aauacuuaggaauuuuuc

SEQ ID NO: 528434 - RNA, 19 nt, Chlamydophila pneumoniae J138
aauacuguucgauaagaac

SEQ ID NO: 528435 - RNA, 16 nt, Chlamydophila pneumoniae J138
aauacuuaauccugua

SEQ ID NO: 528436 - RNA, 20 nt, Chlamydophila pneumoniae J138
aauagaagccaccaucuguu

SEQ ID NO: 528437 - RNA, 13 nt, Chlamydophila pneumoniae J138
aauacuucuccuc

SEQ ID NO: 528438 - RNA, 16 nt, Chlamydophila pneumoniae J138
aaugcaagcaacucuu

SEQ ID NO: 528439 - RNA, 14 nt, Chlamydophila pneumoniae J138
aaugauauuacaga

SEQ ID NO: 528440 - RNA, 16 nt, Chlamydophila pneumoniae J138
aaugauacgugcagug

SEQ ID NO: 528441 - RNA, 17 nt, Chlamydophila pneumoniae J138
aaugacuuuagaaauuc

SEQ ID NO: 528442 - RNA, 20 nt, Chlamydophila pneumoniae J138
aaugacuuuagaaauuccaa

SEQ ID NO: 528443 - RNA, 17 nt, Chlamydophila pneumoniae J138
aaugacuuuuuuguuaa

SEQ ID NO: 528444 - RNA, 17 nt, Chlamydophila pneumoniae J138
aaucuuucaaaagaaau

SEQ ID NO: 528445 - RNA, 18 nt, Chlamydophila pneumoniae J138
aaucuuuaagguugcuuu

SEQ ID NO: 528446 - RNA, 14 nt, Chlamydophila pneumoniae J138
aaucuuguaaguua

SEQ ID NO: 528447 - RNA, 18 nt, Chlamydophila pneumoniae J138
aaugaaggccaagauucu

SEQ ID NO: 528448 - RNA, 15 nt, Chlamydophila pneumoniae J138
aaugaagccaaaagg

SEQ ID NO: 528449 - RNA, 21 nt, Chlamydophila pneumoniae J138
aaugacagcugagaaauuccu

SEQ ID NO: 528450 - RNA, 14 nt, Chlamydophila pneumoniae J138
aaugacacagagaa

SEQ ID NO: 528451 - RNA, 13 nt, Chlamydophila pneumoniae J138
aaugacacagaga

SEQ ID NO: 528452 - RNA, 19 nt, Chlamydophila pneumoniae J138
aaucuucuuagccaaaauu

SEQ ID NO: 528453 - RNA, 19 nt, Chlamydophila pneumoniae J138
aaucuugagcauccaaaau

SEQ ID NO: 528454 - RNA, 18 nt, Chlamydophila pneumoniae J138
aaucuugaucagcaauca

SEQ ID NO: 528455 - RNA, 21 nt, Chlamydophila pneumoniae J138
aaucuugauggggaguuagga

SEQ ID NO: 528456 - RNA, 17 nt, Chlamydophila pneumoniae J138
aaucuuccccuaaaaau

SEQ ID NO: 528457 - RNA, 15 nt, Chlamydophila pneumoniae J138
aaucuggaaugacua

SEQ ID NO: 528458 - RNA, 16 nt, Chlamydophila pneumoniae J138
aaucuccucaucagaa

SEQ ID NO: 528459 - RNA, 15 nt, Chlamydophila pneumoniae J138
aaucucgcuauucca

SEQ ID NO: 528460 - RNA, 17 nt, Chlamydophila pneumoniae J138
aaucucuaugcgcucua

SEQ ID NO: 528461 - RNA, 17 nt, Chlamydophila pneumoniae J138
aaucugauucaauugag

SEQ ID NO: 528462 - RNA, 22 nt, Chlamydophila pneumoniae J138
aaucugacgugcauugaauccu

SEQ ID NO: 528463 - RNA, 19 nt, Chlamydophila pneumoniae J138
aaucucuuucauaaauuca

SEQ ID NO: 528464 - RNA, 20 nt, Chlamydophila pneumoniae J138
aaucucuuucauaaauucag

SEQ ID NO: 528465 - RNA, 18 nt, Chlamydophila pneumoniae J138
aaucucauuccagcaucu

SEQ ID NO: 528466 - RNA, 19 nt, Chlamydophila pneumoniae J138
aaucucagugaacucuuca

SEQ ID NO: 528467 - RNA, 22 nt, Chlamydophila pneumoniae J138
aaucuccaaacauuuuuaagga

SEQ ID NO: 528468 - RNA, 22 nt, Chlamydophila pneumoniae J138
aaucucagugaacucuucaaga

SEQ ID NO: 528469 - RNA, 19 nt, Chlamydophila pneumoniae J138
aaucucaaaaucaaauaga

SEQ ID NO: 528470 - RNA, 14 nt, Chlamydophila pneumoniae J138
aaucuaaaaucaca

SEQ ID NO: 528471 - RNA, 18 nt, Chlamydophila pneumoniae J138
aaucguuuuauuuuagga

SEQ ID NO: 528472 - RNA, 19 nt, Chlamydophila pneumoniae J138
aaucuaaaaacuucccauc

SEQ ID NO: 528473 - RNA, 23 nt, Chlamydophila pneumoniae J138
aaucuaaaaacuucccaucuugu

SEQ ID NO: 528474 - RNA, 20 nt, Chlamydophila pneumoniae J138
aaucguuucuauagacucua

SEQ ID NO: 528475 - RNA, 23 nt, Chlamydophila pneumoniae J138
aaucgagagaagaaauucugacu

SEQ ID NO: 528476 - RNA, 22 nt, Chlamydophila pneumoniae J138
aaucgagagaagaaauucugac

SEQ ID NO: 528477 - RNA, 20 nt, Chlamydophila pneumoniae J138
aaucgauaacguugccuguu

SEQ ID NO: 528478 - RNA, 23 nt, Chlamydophila pneumoniae J138
aaucgaauagcucuggagauugc

SEQ ID NO: 528479 - RNA, 18 nt, Chlamydophila pneumoniae J138
aauccuuuggaagcuauc

SEQ ID NO: 528480 - RNA, 16 nt, Chlamydophila pneumoniae J138
aauccuuuauguauaa

SEQ ID NO: 528481 - RNA, 15 nt, Chlamydophila pneumoniae J138
aauccuuuggaagcu

SEQ ID NO: 528482 - RNA, 21 nt, Chlamydophila pneumoniae J138
aaucguucuuagcgcauguau

SEQ ID NO: 528483 - RNA, 22 nt, Chlamydophila pneumoniae J138
aaucguucccaucacauaaauc

SEQ ID NO: 528484 - RNA, 15 nt, Chlamydophila pneumoniae J138
aaucguguuuuccug

SEQ ID NO: 528485 - RNA, 20 nt, Chlamydophila pneumoniae J138
aauggcagcuuggaugggaa

SEQ ID NO: 528486 - RNA, 18 nt, Chlamydophila pneumoniae J138
aaugcuguagauuguuag

SEQ ID NO: 528487 - RNA, 15 nt, Chlamydophila pneumoniae J138
aaugcucuucugcag

SEQ ID NO: 528488 - RNA, 13 nt, Chlamydophila pneumoniae J138
aaugccagcagcg

SEQ ID NO: 528489 - RNA, 16 nt, Chlamydophila pneumoniae J138
aaugcacuuugaauaa

SEQ ID NO: 528490 - RNA, 19 nt, Chlamydophila pneumoniae J138
aaugccauucuuaucugcu

SEQ ID NO: 528491 - RNA, 22 nt, Chlamydophila pneumoniae J138
aaugcuccuugggucuuuuuau

SEQ ID NO: 528492 - RNA, 13 nt, Chlamydophila pneumoniae J138
aaugcuauuuucc

SEQ ID NO: 528493 - RNA, 14 nt, Chlamydophila pneumoniae J138
aaugcucacuucuu

SEQ ID NO: 528494 - RNA, 13 nt, Chlamydophila pneumoniae J138
aaugcuagaguuu

SEQ ID NO: 528495 - RNA, 21 nt, Chlamydophila pneumoniae J138
aauguaucggggauugcaaaa

SEQ ID NO: 528496 - RNA, 24 nt, Chlamydophila pneumoniae J138
aauguauaggcauuaauaacuuua

SEQ ID NO: 528497 - RNA, 22 nt, Chlamydophila pneumoniae J138
aauguagucaugauuuuucaau

SEQ ID NO: 528498 - RNA, 14 nt, Chlamydophila pneumoniae J138
aaugucgucucaga

SEQ ID NO: 528499 - RNA, 15 nt, Chlamydophila pneumoniae J138
aauguauugcaaaua

SEQ ID NO: 528500 - RNA, 17 nt, Chlamydophila pneumoniae J138
aauuagagaaauuuuua

SEQ ID NO: 528501 - RNA, 15 nt, Chlamydophila pneumoniae J138
aauuagaaucagagg

SEQ ID NO: 528502 - RNA, 21 nt, Chlamydophila pneumoniae J138
aauuaccuugagacaaagaau

SEQ ID NO: 528503 - RNA, 13 nt, Chlamydophila pneumoniae J138
aauuaagaaacua

SEQ ID NO: 528504 - RNA, 14 nt, Chlamydophila pneumoniae J138
aauuaauaaaagag

SEQ ID NO: 528505 - RNA, 13 nt, Chlamydophila pneumoniae J138
aauuaaauaucua

SEQ ID NO: 528506 - RNA, 18 nt, Chlamydophila pneumoniae J138
aaugugcucggacagaaa

SEQ ID NO: 528507 - RNA, 15 nt, Chlamydophila pneumoniae J138
aaugugcuuuugguu

SEQ ID NO: 528508 - RNA, 23 nt, Chlamydophila pneumoniae J138
aaugugcaauaggaaaaaauacc

SEQ ID NO: 528509 - RNA, 15 nt, Chlamydophila pneumoniae J138
aauguggugauuucu

SEQ ID NO: 528510 - RNA, 16 nt, Chlamydophila pneumoniae J138
aauguucgaagaucuu

SEQ ID NO: 528511 - RNA, 14 nt, Chlamydophila pneumoniae J138
aagcggagcaucuu

SEQ ID NO: 528512 - RNA, 14 nt, Chlamydophila pneumoniae J138
aagccacagagaau

SEQ ID NO: 528513 - RNA, 15 nt, Chlamydophila pneumoniae J138
aagccaagaagaugu

SEQ ID NO: 528514 - RNA, 14 nt, Chlamydophila pneumoniae J138
aagccaaauaccaa

SEQ ID NO: 528515 - RNA, 16 nt, Chlamydophila pneumoniae J138
aagcuccucacaucuc

SEQ ID NO: 528516 - RNA, 14 nt, Chlamydophila pneumoniae J138
aagcucuuaauuuc

SEQ ID NO: 528517 - RNA, 20 nt, Chlamydophila pneumoniae J138
aagcuaauaagauccaaaaa

SEQ ID NO: 528518 - RNA, 17 nt, Chlamydophila pneumoniae J138
aagcguuaacaacuucu

SEQ ID NO: 528519 - RNA, 15 nt, Chlamydophila pneumoniae J138
aagcugcaaacugau

SEQ ID NO: 528520 - RNA, 17 nt, Chlamydophila pneumoniae J138
aagcugcaaacugaucu

SEQ ID NO: 528521 - RNA, 23 nt, Chlamydophila pneumoniae J138
aagcugccagugacauaaucaca

SEQ ID NO: 528522 - RNA, 17 nt, Chlamydophila pneumoniae J138
aagcugucgcaaaugca

SEQ ID NO: 528523 - RNA, 11 nt, Chlamydophila pneumoniae J138
aagcugcugcu

SEQ ID NO: 528524 - RNA, 23 nt, Chlamydophila pneumoniae J138
aagcugcugcuacgacuacaucu

SEQ ID NO: 528525 - RNA, 21 nt, Chlamydophila pneumoniae J138
aagcugcuucgggaacgugcu

SEQ ID NO: 528526 - RNA, 18 nt, Chlamydophila pneumoniae J138
aagcugugguaucgaugu

SEQ ID NO: 528527 - RNA, 19 nt, Chlamydophila pneumoniae J138
aagcuguggcgauuuuacu

SEQ ID NO: 528528 - RNA, 19 nt, Chlamydophila pneumoniae J138
aagcugugcauuuucuucu

SEQ ID NO: 528529 - RNA, 12 nt, Chlamydophila pneumoniae J138
aagcugugcauu

SEQ ID NO: 528530 - RNA, 11 nt, Chlamydophila pneumoniae J138
aagcugugcau

SEQ ID NO: 528531 - RNA, 22 nt, Chlamydophila pneumoniae J138
aagcuuguuccacuugcucuuu

SEQ ID NO: 528532 - RNA, 19 nt, Chlamydophila pneumoniae J138
aaggaauaugcucuccuug

SEQ ID NO: 528533 - RNA, 18 nt, Chlamydophila pneumoniae J138
aaggaaucccaagggaga

SEQ ID NO: 528534 - RNA, 16 nt, Chlamydophila pneumoniae J138
aaggacaaaucuccca

SEQ ID NO: 528535 - RNA, 15 nt, Chlamydophila pneumoniae J138
aaggacaaaucuccc

SEQ ID NO: 528536 - RNA, 21 nt, Chlamydophila pneumoniae J138
aaggagcggaguaacuaauaa

SEQ ID NO: 528537 - RNA, 18 nt, Chlamydophila pneumoniae J138
aaggagucgugcaggaga

SEQ ID NO: 528538 - RNA, 16 nt, Chlamydophila pneumoniae J138
aaggcaccaacacuuu

SEQ ID NO: 528539 - RNA, 22 nt, Chlamydophila pneumoniae J138
aaggauuugcucuguaguaaag

SEQ ID NO: 528540 - RNA, 18 nt, Chlamydophila pneumoniae J138
aaggauuuugagacgaaa

SEQ ID NO: 528541 - RNA, 14 nt, Chlamydophila pneumoniae J138
aaggcaaaaaguug

SEQ ID NO: 528542 - RNA, 13 nt, Chlamydophila pneumoniae J138
aaggccuaaucuu

SEQ ID NO: 528543 - RNA, 21 nt, Chlamydophila pneumoniae J138
aaggcgaaaucuucaccacaa

SEQ ID NO: 528544 - RNA, 19 nt, Chlamydophila pneumoniae J138
aaggcccccuacagcagaa

SEQ ID NO: 528545 - RNA, 18 nt, Chlamydophila pneumoniae J138
aaggcugcuugagacuug

SEQ ID NO: 528546 - RNA, 17 nt, Chlamydophila pneumoniae J138
aaggcugauugaaaguc

SEQ ID NO: 528547 - RNA, 23 nt, Chlamydophila pneumoniae J138
aaggcugccagagauucuucaca

SEQ ID NO: 528548 - RNA, 20 nt, Chlamydophila pneumoniae J138
aagguaaaacuacaggaaaa

SEQ ID NO: 528549 - RNA, 19 nt, Chlamydophila pneumoniae J138
aaggcugcugauccaaaag

SEQ ID NO: 528550 - RNA, 16 nt, Chlamydophila pneumoniae J138
aaggucugcgucuuua

SEQ ID NO: 528551 - RNA, 22 nt, Chlamydophila pneumoniae J138
aaggucugcgucuuuaauuaaa

SEQ ID NO: 528552 - RNA, 22 nt, Chlamydophila pneumoniae J138
aagguacugcucaaugacacgg

SEQ ID NO: 528553 - RNA, 22 nt, Chlamydophila pneumoniae J138
aagguugagacguaaccacagg

SEQ ID NO: 528554 - RNA, 12 nt, Chlamydophila pneumoniae J138
aagguucucaaa

SEQ ID NO: 528555 - RNA, 13 nt, Chlamydophila pneumoniae J138
aagguuccaaaaa

SEQ ID NO: 528556 - RNA, 19 nt, Chlamydophila pneumoniae J138
aagguucccuacuccauug

SEQ ID NO: 528557 - RNA, 21 nt, Chlamydophila pneumoniae J138
aagguugcuuuucuaggauuu

SEQ ID NO: 528558 - RNA, 19 nt, Chlamydophila pneumoniae J138
aagguuacaccuaaaguuu

SEQ ID NO: 528559 - RNA, 12 nt, Chlamydophila pneumoniae J138
aaguuuugcucu

SEQ ID NO: 528560 - RNA, 15 nt, Chlamydophila pneumoniae J138
aaguuuugaggauuu

SEQ ID NO: 528561 - RNA, 23 nt, Chlamydophila pneumoniae J138
aaguuuugaggauuucuugcaag

SEQ ID NO: 528562 - RNA, 17 nt, Chlamydophila pneumoniae J138
aaguuuucgauacacaa

SEQ ID NO: 528563 - RNA, 19 nt, Chlamydophila pneumoniae J138
aaguuugucguaauugcug

SEQ ID NO: 528564 - RNA, 23 nt, Chlamydophila pneumoniae J138
aaguuucuuuugcaaaucuucga

SEQ ID NO: 528565 - RNA, 14 nt, Chlamydophila pneumoniae J138
aaguuuacaaauaa

SEQ ID NO: 528566 - RNA, 16 nt, Chlamydophila pneumoniae J138
aaguuuacaaauaaaa

SEQ ID NO: 528567 - RNA, 16 nt, Chlamydophila pneumoniae J138
aaguuucaaucucucc

SEQ ID NO: 528568 - RNA, 19 nt, Chlamydophila pneumoniae J138
aaguucggcgccuucaaaa

SEQ ID NO: 528569 - RNA, 21 nt, Chlamydophila pneumoniae J138
aaguucgggucgauguucucg

SEQ ID NO: 528570 - RNA, 17 nt, Chlamydophila pneumoniae J138
aaguucuuggaaaaaag

SEQ ID NO: 528571 - RNA, 13 nt, Chlamydophila pneumoniae J138
aaguucucaaaga

SEQ ID NO: 528572 - RNA, 19 nt, Chlamydophila pneumoniae J138
aaguuguuuauuuagcauu

SEQ ID NO: 528573 - RNA, 14 nt, Chlamydophila pneumoniae J138
aauaaaaaagagag

SEQ ID NO: 528574 - RNA, 16 nt, Chlamydophila pneumoniae J138
aaguuuuuucaauccu

SEQ ID NO: 528575 - RNA, 22 nt, Chlamydophila pneumoniae J138
aauaaaaaaacccucaaagaau

SEQ ID NO: 528576 - RNA, 12 nt, Chlamydophila pneumoniae J138
aauaaaagaaag

SEQ ID NO: 528577 - RNA, 12 nt, Chlamydophila pneumoniae J138
aauaaaaugauu

SEQ ID NO: 528578 - RNA, 14 nt, Chlamydophila pneumoniae J138
aauaaaauguccaa

SEQ ID NO: 528579 - RNA, 12 nt, Chlamydophila pneumoniae J138
aauaaaauuuaa

SEQ ID NO: 528580 - RNA, 14 nt, Chlamydophila pneumoniae J138
aauaaaauuuaaaa

SEQ ID NO: 528581 - RNA, 19 nt, Chlamydophila pneumoniae J138
aagugcucaguaaauauuu

SEQ ID NO: 528582 - RNA, 21 nt, Chlamydophila pneumoniae J138
aagucuucaaugacuucugga

SEQ ID NO: 528583 - RNA, 19 nt, Chlamydophila pneumoniae J138
aagucuucccucuccuuga

SEQ ID NO: 528584 - RNA, 22 nt, Chlamydophila pneumoniae J138
aagucuuggacguuccuuucuc

SEQ ID NO: 528585 - RNA, 19 nt, Chlamydophila pneumoniae J138
aaguccuccauguacaguu

SEQ ID NO: 528586 - RNA, 17 nt, Chlamydophila pneumoniae J138
aagucuccauaauucug

SEQ ID NO: 528587 - RNA, 16 nt, Chlamydophila pneumoniae J138
aaguccaacaucagcu

SEQ ID NO: 528588 - RNA, 19 nt, Chlamydophila pneumoniae J138
aagucagccaagacaaaaa

SEQ ID NO: 528589 - RNA, 21 nt, Chlamydophila pneumoniae J138
aagucagccaagacaaaaaag

SEQ ID NO: 528590 - RNA, 16 nt, Chlamydophila pneumoniae J138
aaguccagacuuuccu

SEQ ID NO: 528591 - RNA, 14 nt, Chlamydophila pneumoniae J138
aaguccacaagccu

SEQ ID NO: 528592 - RNA, 17 nt, Chlamydophila pneumoniae J138
aaguccagacuuuccuc

SEQ ID NO: 528593 - RNA, 16 nt, Chlamydophila pneumoniae J138
aaguaacuaucuacac

SEQ ID NO: 528594 - RNA, 17 nt, Chlamydophila pneumoniae J138
aaguaagguuccaaaaa

SEQ ID NO: 528595 - RNA, 22 nt, Chlamydophila pneumoniae J138
aaguaucuugauguuugucaca

SEQ ID NO: 528596 - RNA, 23 nt, Chlamydophila pneumoniae J138
aaguaucuucaguagaguuagaa

SEQ ID NO: 528597 - RNA, 17 nt, Chlamydophila pneumoniae J138
aagaauguagcuguucc

SEQ ID NO: 528598 - RNA, 16 nt, Chlamydophila pneumoniae J138
aagaauuaagaagaag

SEQ ID NO: 528599 - RNA, 14 nt, Chlamydophila pneumoniae J138
aagaaugacacaga

SEQ ID NO: 528600 - RNA, 14 nt, Chlamydophila pneumoniae J138
aagaaucguucuua

SEQ ID NO: 528601 - RNA, 17 nt, Chlamydophila pneumoniae J138
aagaaucuauaaauuca

SEQ ID NO: 528602 - RNA, 19 nt, Chlamydophila pneumoniae J138
aagaauaucuuuugaaucu

SEQ ID NO: 528603 - RNA, 16 nt, Chlamydophila pneumoniae J138
aaauucuuuucuacau

SEQ ID NO: 528604 - RNA, 22 nt, Chlamydophila pneumoniae J138
aagaauaauagcaaguagcucu

SEQ ID NO: 528605 - RNA, 15 nt, Chlamydophila pneumoniae J138
aagaauagcaggaag

SEQ ID NO: 528606 - RNA, 17 nt, Chlamydophila pneumoniae J138
aagacaauaaaaaagag

SEQ ID NO: 528607 - RNA, 15 nt, Chlamydophila pneumoniae J138
aagacaauaaaaaag

SEQ ID NO: 528608 - RNA, 17 nt, Chlamydophila pneumoniae J138
aagacaccgaaagaaau

SEQ ID NO: 528609 - RNA, 20 nt, Chlamydophila pneumoniae J138
aagacaauggaaauagagaa

SEQ ID NO: 528610 - RNA, 16 nt, Chlamydophila pneumoniae J138
aagacaccgaaagaaa

SEQ ID NO: 528611 - RNA, 17 nt, Chlamydophila pneumoniae J138
aagaauuucauaagaga

SEQ ID NO: 528612 - RNA, 20 nt, Chlamydophila pneumoniae J138
aagaauuucuucuuuccaua

SEQ ID NO: 528613 - RNA, 22 nt, Chlamydophila pneumoniae J138
aagaauucuuugccaaggaccu

SEQ ID NO: 528614 - RNA, 16 nt, Chlamydophila pneumoniae J138
aagacauuauagaggu

SEQ ID NO: 528615 - RNA, 22 nt, Chlamydophila pneumoniae J138
aagacauccuucuuuaccuaug

SEQ ID NO: 528616 - RNA, 15 nt, Chlamydophila pneumoniae J138
aagaccuaacgcaac

SEQ ID NO: 528617 - RNA, 20 nt, Chlamydophila pneumoniae J138
aagaccuaacgcaacaucca

SEQ ID NO: 528618 - RNA, 17 nt, Chlamydophila pneumoniae J138
aagacgcggaacucucu

SEQ ID NO: 528619 - RNA, 14 nt, Chlamydophila pneumoniae J138
aagacuaaaaaaga

SEQ ID NO: 528620 - RNA, 15 nt, Chlamydophila pneumoniae J138
aagacuaaaaaagag

SEQ ID NO: 528621 - RNA, 16 nt, Chlamydophila pneumoniae J138
aagacuaaaaaagaga

SEQ ID NO: 528622 - RNA, 18 nt, Chlamydophila pneumoniae J138
aagacuacgacagaagua

SEQ ID NO: 528623 - RNA, 15 nt, Chlamydophila pneumoniae J138
aagacugucuaugau

SEQ ID NO: 528624 - RNA, 21 nt, Chlamydophila pneumoniae J138
aagacuccaagucagccaaga

SEQ ID NO: 528625 - RNA, 19 nt, Chlamydophila pneumoniae J138
aagacucucaucagcaaaa

SEQ ID NO: 528626 - RNA, 16 nt, Chlamydophila pneumoniae J138
aagacucucaucagca

SEQ ID NO: 528627 - RNA, 17 nt, Chlamydophila pneumoniae J138
aagagaucacagggaca

SEQ ID NO: 528628 - RNA, 22 nt, Chlamydophila pneumoniae J138
aagagauguagguaucagcaag

SEQ ID NO: 528629 - RNA, 16 nt, Chlamydophila pneumoniae J138
aagagcaaacaucaaa

SEQ ID NO: 528630 - RNA, 20 nt, Chlamydophila pneumoniae J138
aagagagcuugucacacugc

SEQ ID NO: 528631 - RNA, 13 nt, Chlamydophila pneumoniae J138
aagacuugcucug

SEQ ID NO: 528632 - RNA, 21 nt, Chlamydophila pneumoniae J138
aagacuucgaugucuuuccag

SEQ ID NO: 528633 - RNA, 20 nt, Chlamydophila pneumoniae J138
aagacuucgaugucuuucca

SEQ ID NO: 528634 - RNA, 15 nt, Chlamydophila pneumoniae J138
aagagaaucuccuca

SEQ ID NO: 528635 - RNA, 17 nt, Chlamydophila pneumoniae J138
aagagacaagaaaauau

SEQ ID NO: 528636 - RNA, 17 nt, Chlamydophila pneumoniae J138
aagagcucguaauccuu

SEQ ID NO: 528637 - RNA, 16 nt, Chlamydophila pneumoniae J138
aagagcuaaagaaacu

SEQ ID NO: 528638 - RNA, 16 nt, Chlamydophila pneumoniae J138
aagagcuaugaugaga

SEQ ID NO: 528639 - RNA, 23 nt, Chlamydophila pneumoniae J138
aagagcucguaauccuucuuucu

SEQ ID NO: 528640 - RNA, 19 nt, Chlamydophila pneumoniae J138
aagagcgcguuucaaauag

SEQ ID NO: 528641 - RNA, 17 nt, Chlamydophila pneumoniae J138
aagagcccccauaggaa

SEQ ID NO: 528642 - RNA, 21 nt, Chlamydophila pneumoniae J138
aagagcaacaguaauuauuuu

SEQ ID NO: 528643 - RNA, 22 nt, Chlamydophila pneumoniae J138
aagagcuuccauuggaauccuu

SEQ ID NO: 528644 - RNA, 20 nt, Chlamydophila pneumoniae J138
aagaggagugaaagcuucuu

SEQ ID NO: 528645 - RNA, 12 nt, Chlamydophila pneumoniae J138
aagaggggagcu

SEQ ID NO: 528646 - RNA, 16 nt, Chlamydophila pneumoniae J138
aagagucccugauucc

SEQ ID NO: 528647 - RNA, 16 nt, Chlamydophila pneumoniae J138
aagagguucuugcuua

SEQ ID NO: 528648 - RNA, 12 nt, Chlamydophila pneumoniae J138
aagagucuugca

SEQ ID NO: 528649 - RNA, 17 nt, Chlamydophila pneumoniae J138
aagagucucacucuuuu

SEQ ID NO: 528650 - RNA, 14 nt, Chlamydophila pneumoniae J138
aagagucucuugcu

SEQ ID NO: 528651 - RNA, 13 nt, Chlamydophila pneumoniae J138
aagagugccaaga

SEQ ID NO: 528652 - RNA, 17 nt, Chlamydophila pneumoniae J138
aagagugccaagagcau

SEQ ID NO: 528653 - RNA, 20 nt, Chlamydophila pneumoniae J138
aagagugguuccugaaaagc

SEQ ID NO: 528654 - RNA, 15 nt, Chlamydophila pneumoniae J138
aagauaaacagcaca

SEQ ID NO: 528655 - RNA, 13 nt, Chlamydophila pneumoniae J138
aagauaaacagca

SEQ ID NO: 528656 - RNA, 16 nt, Chlamydophila pneumoniae J138
aagaguuuuuuagagg

SEQ ID NO: 528657 - RNA, 22 nt, Chlamydophila pneumoniae J138
aagaguuguuguggaaucacgu

SEQ ID NO: 528658 - RNA, 20 nt, Chlamydophila pneumoniae J138
aagaguuccaagacaauaaa

SEQ ID NO: 528659 - RNA, 19 nt, Chlamydophila pneumoniae J138
aagauaaacauuaagugau

SEQ ID NO: 528660 - RNA, 20 nt, Chlamydophila pneumoniae J138
aagauaaggaccagguguag

SEQ ID NO: 528661 - RNA, 13 nt, Chlamydophila pneumoniae J138
aagcaacucuuca

SEQ ID NO: 528662 - RNA, 13 nt, Chlamydophila pneumoniae J138
aagcaauccagua

SEQ ID NO: 528663 - RNA, 21 nt, Chlamydophila pneumoniae J138
aagcaaucccccagcauucac

SEQ ID NO: 528664 - RNA, 20 nt, Chlamydophila pneumoniae J138
aagcaaagauaaagaaguuu

SEQ ID NO: 528665 - RNA, 22 nt, Chlamydophila pneumoniae J138
aagcaaagaaaauucucagauu

SEQ ID NO: 528666 - RNA, 18 nt, Chlamydophila pneumoniae J138
aagcaaaugccuguacua

SEQ ID NO: 528667 - RNA, 18 nt, Chlamydophila pneumoniae J138
aagcacccucuucauccg

SEQ ID NO: 528668 - RNA, 20 nt, Chlamydophila pneumoniae J138
aagcacccucuucauccgaa

SEQ ID NO: 528669 - RNA, 14 nt, Chlamydophila pneumoniae J138
aagcacccucuuca

SEQ ID NO: 528670 - RNA, 21 nt, Chlamydophila pneumoniae J138
aagcacuaaaagggaagcuuc

SEQ ID NO: 528671 - RNA, 22 nt, Chlamydophila pneumoniae J138
aagcacucuuaauuaaaaacug

SEQ ID NO: 528672 - RNA, 20 nt, Chlamydophila pneumoniae J138
aagcacuuguuuuuucuucu

SEQ ID NO: 528673 - RNA, 15 nt, Chlamydophila pneumoniae J138
aagcaucauugaaac

SEQ ID NO: 528674 - RNA, 20 nt, Chlamydophila pneumoniae J138
aagcaucacggacuccgucu

SEQ ID NO: 528675 - RNA, 17 nt, Chlamydophila pneumoniae J138
aagcaucuuucaucaau

SEQ ID NO: 528676 - RNA, 21 nt, Chlamydophila pneumoniae J138
aagcauagcccgaaauucauu

SEQ ID NO: 528677 - RNA, 20 nt, Chlamydophila pneumoniae J138
aagcauagucgucuuuuaaa

SEQ ID NO: 528678 - RNA, 14 nt, Chlamydophila pneumoniae J138
aagcaugaagcaga

SEQ ID NO: 528679 - RNA, 21 nt, Chlamydophila pneumoniae J138
aagcauguuauauagacaaug

SEQ ID NO: 528680 - RNA, 15 nt, Chlamydophila pneumoniae J138
aagccaaaaggcaca

SEQ ID NO: 528681 - RNA, 21 nt, Chlamydophila pneumoniae J138
aagccaaaaggcacagcaaug

SEQ ID NO: 528682 - RNA, 21 nt, Chlamydophila pneumoniae J138
aagcauuuuugggaaaagaaa

SEQ ID NO: 528683 - RNA, 23 nt, Chlamydophila pneumoniae J138
aagcauuuuugggaaaagaaaag

SEQ ID NO: 528684 - RNA, 20 nt, Chlamydophila pneumoniae J138
aagcauugcaaauaagccag

SEQ ID NO: 528685 - RNA, 23 nt, Chlamydophila pneumoniae J138
aagcauucugcuagagcuuucag

SEQ ID NO: 528686 - RNA, 20 nt, Chlamydophila pneumoniae J138
aagcaguaacugcaaagaga

SEQ ID NO: 528687 - RNA, 21 nt, Chlamydophila pneumoniae J138
aagcaggugugugguaaaaau

SEQ ID NO: 528688 - RNA, 12 nt, Chlamydophila pneumoniae J138
aagcagggaaaa

SEQ ID NO: 528689 - RNA, 12 nt, Chlamydophila pneumoniae J138
aagcaggagcau

SEQ ID NO: 528690 - RNA, 23 nt, Chlamydophila pneumoniae J138
aagcagugugccaauuuuuguag

SEQ ID NO: 528691 - RNA, 18 nt, Chlamydophila pneumoniae J138
aagcagaggguuccaaga

SEQ ID NO: 528692 - RNA, 13 nt, Chlamydophila pneumoniae J138
aagcagcgaagau

SEQ ID NO: 528693 - RNA, 18 nt, Chlamydophila pneumoniae J138
aagcagccucuucucuac

SEQ ID NO: 528694 - RNA, 14 nt, Chlamydophila pneumoniae J138
aagauugaaggcac

SEQ ID NO: 528695 - RNA, 16 nt, Chlamydophila pneumoniae J138
aagauucuuuaaucua

SEQ ID NO: 528696 - RNA, 19 nt, Chlamydophila pneumoniae J138
aagauuccuuaccuauaua

SEQ ID NO: 528697 - RNA, 22 nt, Chlamydophila pneumoniae J138
aagauucucagcuucaucagaa

SEQ ID NO: 528698 - RNA, 14 nt, Chlamydophila pneumoniae J138
aagauucaaagaag

SEQ ID NO: 528699 - RNA, 16 nt, Chlamydophila pneumoniae J138
aagauucaaagaaguc

SEQ ID NO: 528700 - RNA, 24 nt, Chlamydophila pneumoniae J138
aagauuauuuguuucuuccauaca

SEQ ID NO: 528701 - RNA, 14 nt, Chlamydophila pneumoniae J138
aagauuauucuaga

SEQ ID NO: 528702 - RNA, 18 nt, Chlamydophila pneumoniae J138
aagauugugcucaauaca

SEQ ID NO: 528703 - RNA, 15 nt, Chlamydophila pneumoniae J138
aagauuuccccaaga

SEQ ID NO: 528704 - RNA, 23 nt, Chlamydophila pneumoniae J138
aagauuuccaauccauucugaga

SEQ ID NO: 528705 - RNA, 23 nt, Chlamydophila pneumoniae J138
aagauuuuaggggguuuuucuau

SEQ ID NO: 528706 - RNA, 15 nt, Chlamydophila pneumoniae J138
aagauuuuuagaaua

SEQ ID NO: 528707 - RNA, 21 nt, Chlamydophila pneumoniae J138
aagauuuuggugagaucaucu

SEQ ID NO: 528708 - RNA, 14 nt, Chlamydophila pneumoniae J138
aagauuuugaaaau

SEQ ID NO: 528709 - RNA, 21 nt, Chlamydophila pneumoniae J138
aagauguauaaggauaucuuc

SEQ ID NO: 528710 - RNA, 17 nt, Chlamydophila pneumoniae J138
aagaugcagauacuaaa

SEQ ID NO: 528711 - RNA, 15 nt, Chlamydophila pneumoniae J138
aagaugagaaaaucu

SEQ ID NO: 528712 - RNA, 15 nt, Chlamydophila pneumoniae J138
aagaugaagaaacuu

SEQ ID NO: 528713 - RNA, 22 nt, Chlamydophila pneumoniae J138
aagaugcugaaccuuugguaga

SEQ ID NO: 528714 - RNA, 22 nt, Chlamydophila pneumoniae J138
aagaugcauucugauccgaaaa

SEQ ID NO: 528715 - RNA, 23 nt, Chlamydophila pneumoniae J138
aagaucgucggaagacuuuuuaa

SEQ ID NO: 528716 - RNA, 22 nt, Chlamydophila pneumoniae J138
aagaucggaguuaucaaaagga

SEQ ID NO: 528717 - RNA, 19 nt, Chlamydophila pneumoniae J138
aagaucuccgccuacaaua

SEQ ID NO: 528718 - RNA, 17 nt, Chlamydophila pneumoniae J138
aagaucuaacuucacca

SEQ ID NO: 528719 - RNA, 17 nt, Chlamydophila pneumoniae J138
aagaucuucauaaccaa

SEQ ID NO: 528720 - RNA, 12 nt, Chlamydophila pneumoniae J138
aagaucucuuuu

SEQ ID NO: 528721 - RNA, 18 nt, Chlamydophila pneumoniae J138
aagaucucuuuuggaaga

SEQ ID NO: 528722 - RNA, 23 nt, Chlamydophila pneumoniae J138
aagaucaauauagagaacuccau

SEQ ID NO: 528723 - RNA, 20 nt, Chlamydophila pneumoniae J138
aagauaaucauuaagacuca

SEQ ID NO: 528724 - RNA, 19 nt, Chlamydophila pneumoniae J138
aagauaauagagaagaagc

SEQ ID NO: 528725 - RNA, 18 nt, Chlamydophila pneumoniae J138
aagauaaucuguaagaaa

SEQ ID NO: 528726 - RNA, 19 nt, Chlamydophila pneumoniae J138
aagauagacucucacugag

SEQ ID NO: 528727 - RNA, 16 nt, Chlamydophila pneumoniae J138
aagauacgaaguccca

SEQ ID NO: 528728 - RNA, 18 nt, Chlamydophila pneumoniae J138
aagauagcgacgucauca

SEQ ID NO: 528729 - RNA, 17 nt, Chlamydophila pneumoniae J138
aagauaucccaaagcua

SEQ ID NO: 528730 - RNA, 15 nt, Chlamydophila pneumoniae J138
aagauauauuuuuaa

SEQ ID NO: 528731 - RNA, 13 nt, Chlamydophila pneumoniae J138
aagauaguauuuu

SEQ ID NO: 528732 - RNA, 19 nt, Chlamydophila pneumoniae J138
aagauaguauuuuugaaac

SEQ ID NO: 528733 - RNA, 17 nt, Chlamydophila pneumoniae J138
aagauaguuauuaauaa

SEQ ID NO: 528734 - RNA, 14 nt, Chlamydophila pneumoniae J138
uuuguaguguugaa

SEQ ID NO: 528735 - RNA, 13 nt, Chlamydophila pneumoniae J138
uuuguagauuagg

SEQ ID NO: 528736 - RNA, 15 nt, Chlamydophila pneumoniae J138
uuuguacacagagau

SEQ ID NO: 528737 - RNA, 20 nt, Chlamydophila pneumoniae J138
uuuguaaaugucgguuuguu

SEQ ID NO: 528738 - RNA, 13 nt, Chlamydophila pneumoniae J138
uuuguaaaugucg

SEQ ID NO: 528739 - RNA, 19 nt, Chlamydophila pneumoniae J138
uuuguuaaacccaauucuu

SEQ ID NO: 528740 - RNA, 22 nt, Chlamydophila pneumoniae J138
uuugugccccuccgauugcuaa

SEQ ID NO: 528741 - RNA, 22 nt, Chlamydophila pneumoniae J138
uuugugauauucuuggaauaua

SEQ ID NO: 528742 - RNA, 16 nt, Chlamydophila pneumoniae J138
uuugucaucacaucag

SEQ ID NO: 528743 - RNA, 18 nt, Chlamydophila pneumoniae J138
uuugucguaauugcugaa

SEQ ID NO: 528744 - RNA, 15 nt, Chlamydophila pneumoniae J138
uuuguccuuugcuaa

SEQ ID NO: 528745 - RNA, 14 nt, Chlamydophila pneumoniae J138
uuuggagaagcuca

SEQ ID NO: 528746 - RNA, 18 nt, Chlamydophila pneumoniae J138
uuuggaaagcucuuucau

SEQ ID NO: 528747 - RNA, 18 nt, Chlamydophila pneumoniae J138
uuugcugcagcaaaacua

SEQ ID NO: 528748 - RNA, 16 nt, Chlamydophila pneumoniae J138
uuugcugcgaaugucg

SEQ ID NO: 528749 - RNA, 20 nt, Chlamydophila pneumoniae J138
uuuggcacaauccucacuau

SEQ ID NO: 528750 - RNA, 17 nt, Chlamydophila pneumoniae J138
uuugggauaaaaaguuu

SEQ ID NO: 528751 - RNA, 15 nt, Chlamydophila pneumoniae J138
uuuuaccauugagau

SEQ ID NO: 528752 - RNA, 22 nt, Chlamydophila pneumoniae J138
uuuuaaguugguccaucgagaa

SEQ ID NO: 528753 - RNA, 13 nt, Chlamydophila pneumoniae J138
uuuuaaccucuuu

SEQ ID NO: 528754 - RNA, 17 nt, Chlamydophila pneumoniae J138
uuuguugggauuuucag

SEQ ID NO: 528755 - RNA, 21 nt, Chlamydophila pneumoniae J138
uuuguuucuucugugcaucag

SEQ ID NO: 528756 - RNA, 22 nt, Chlamydophila pneumoniae J138
uuuuaaagccuccucaagauaa

SEQ ID NO: 528757 - RNA, 16 nt, Chlamydophila pneumoniae J138
uuuuaaagcaaaaauu

SEQ ID NO: 528758 - RNA, 16 nt, Chlamydophila pneumoniae J138
uuuuacugaaauuaag

SEQ ID NO: 528759 - RNA, 12 nt, Chlamydophila pneumoniae J138
uuuuacucccug

SEQ ID NO: 528760 - RNA, 20 nt, Chlamydophila pneumoniae J138
uuuuacuugcccaaaaguuu

SEQ ID NO: 528761 - RNA, 16 nt, Chlamydophila pneumoniae J138
uuuuacguucuuucuu

SEQ ID NO: 528762 - RNA, 15 nt, Chlamydophila pneumoniae J138
uuuuauagcaucgua

SEQ ID NO: 528763 - RNA, 17 nt, Chlamydophila pneumoniae J138
uuuuaugauuacaucua

SEQ ID NO: 528764 - RNA, 13 nt, Chlamydophila pneumoniae J138
uuuuauuuaaaau

SEQ ID NO: 528765 - RNA, 15 nt, Chlamydophila pneumoniae J138
uuuuauuuaaaauuu

SEQ ID NO: 528766 - RNA, 18 nt, Chlamydophila pneumoniae J138
uuuuauuaguuuugaaau

SEQ ID NO: 528767 - RNA, 15 nt, Chlamydophila pneumoniae J138
uuuuccaaauuccuu

SEQ ID NO: 528768 - RNA, 21 nt, Chlamydophila pneumoniae J138
uuuuccaaaaacgauucgaaa

SEQ ID NO: 528769 - RNA, 23 nt, Chlamydophila pneumoniae J138
uuuuccgcaaaggaaaagauaug

SEQ ID NO: 528770 - RNA, 13 nt, Chlamydophila pneumoniae J138
uuuuccucuauau

SEQ ID NO: 528771 - RNA, 21 nt, Chlamydophila pneumoniae J138
uuuuccugugugguuggaucc

SEQ ID NO: 528772 - RNA, 18 nt, Chlamydophila pneumoniae J138
uuuucgaaucguuuuugg

SEQ ID NO: 528773 - RNA, 18 nt, Chlamydophila pneumoniae J138
uuuucaagucuguaagga

SEQ ID NO: 528774 - RNA, 15 nt, Chlamydophila pneumoniae J138
uuuucaauccuuccu

SEQ ID NO: 528775 - RNA, 21 nt, Chlamydophila pneumoniae J138
uuuucaauagcaguaucuaga

SEQ ID NO: 528776 - RNA, 23 nt, Chlamydophila pneumoniae J138
uuuucaaauauugcgaacuuuug

SEQ ID NO: 528777 - RNA, 17 nt, Chlamydophila pneumoniae J138
uuuucaaaucaucaaaa

SEQ ID NO: 528778 - RNA, 22 nt, Chlamydophila pneumoniae J138
uuuucaaaucaucaaaaagauc

SEQ ID NO: 528779 - RNA, 14 nt, Chlamydophila pneumoniae J138
uuuuauuuuuaaau

SEQ ID NO: 528780 - RNA, 22 nt, Chlamydophila pneumoniae J138
uuuucagccugucuauaaaaua

SEQ ID NO: 528781 - RNA, 12 nt, Chlamydophila pneumoniae J138
uuuucagcacug

SEQ ID NO: 528782 - RNA, 22 nt, Chlamydophila pneumoniae J138
uuuucagaaagcgaagagcuca

SEQ ID NO: 528783 - RNA, 22 nt, Chlamydophila pneumoniae J138
uuuucaggaggcgcguagaucc

SEQ ID NO: 528784 - RNA, 15 nt, Chlamydophila pneumoniae J138
uuuucagcuuguuuu

SEQ ID NO: 528785 - RNA, 20 nt, Chlamydophila pneumoniae J138
uuuuuccauuuuuccuccuc

SEQ ID NO: 528786 - RNA, 23 nt, Chlamydophila pneumoniae J138
uuuuucaaucaauaaaaugucca

SEQ ID NO: 528787 - RNA, 14 nt, Chlamydophila pneumoniae J138
uuuuuaucuccuga

SEQ ID NO: 528788 - RNA, 12 nt, Chlamydophila pneumoniae J138
uuuuuaaaacuc

SEQ ID NO: 528789 - RNA, 21 nt, Chlamydophila pneumoniae J138
uuuuuaaccgagcuuuuugcu

SEQ ID NO: 528790 - RNA, 16 nt, Chlamydophila pneumoniae J138
uuuugucgcaauaaca

SEQ ID NO: 528791 - RNA, 20 nt, Chlamydophila pneumoniae J138
uuuuguaaucuaagaaucua

SEQ ID NO: 528792 - RNA, 17 nt, Chlamydophila pneumoniae J138
uuuuguuaaauucccaa

SEQ ID NO: 528793 - RNA, 22 nt, Chlamydophila pneumoniae J138
uuuucuacuucaggaaauaauu

SEQ ID NO: 528794 - RNA, 13 nt, Chlamydophila pneumoniae J138
uuuucuaugaucc

SEQ ID NO: 528795 - RNA, 17 nt, Chlamydophila pneumoniae J138
uuuucucauagcuuccu

SEQ ID NO: 528796 - RNA, 12 nt, Chlamydophila pneumoniae J138
uuuucuaaaaug

SEQ ID NO: 528797 - RNA, 15 nt, Chlamydophila pneumoniae J138
uuuucuaagagaucu

SEQ ID NO: 528798 - RNA, 16 nt, Chlamydophila pneumoniae J138
uuuucuaagagaucua

SEQ ID NO: 528799 - RNA, 18 nt, Chlamydophila pneumoniae J138
uuuucuagaaaagauucu

SEQ ID NO: 528800 - RNA, 14 nt, Chlamydophila pneumoniae J138
uuuucuccuucucc

SEQ ID NO: 528801 - RNA, 12 nt, Chlamydophila pneumoniae J138
uuuucugcuccu

SEQ ID NO: 528802 - RNA, 16 nt, Chlamydophila pneumoniae J138
uuuucuucaacauaca

SEQ ID NO: 528803 - RNA, 21 nt, Chlamydophila pneumoniae J138
uuuucuuauagggaauuuuuu

SEQ ID NO: 528804 - RNA, 13 nt, Chlamydophila pneumoniae J138
uuuucuucuugca

SEQ ID NO: 528805 - RNA, 13 nt, Chlamydophila pneumoniae J138
uuuucuuccaaag

SEQ ID NO: 528806 - RNA, 22 nt, Chlamydophila pneumoniae J138
uuuucuuuucugaagauuuuuu

SEQ ID NO: 528807 - RNA, 19 nt, Chlamydophila pneumoniae J138
uuuucuuucuaagauaucu

SEQ ID NO: 528808 - RNA, 20 nt, Chlamydophila pneumoniae J138
uuuugaaaauugcauuuaaa

SEQ ID NO: 528809 - RNA, 14 nt, Chlamydophila pneumoniae J138
uuuucuuuuuagaa

SEQ ID NO: 528810 - RNA, 14 nt, Chlamydophila pneumoniae J138
uuuugaagugcuuu

SEQ ID NO: 528811 - RNA, 14 nt, Chlamydophila pneumoniae J138
uuuugagauucaaa

SEQ ID NO: 528812 - RNA, 15 nt, Chlamydophila pneumoniae J138
uuuugauuuugcagu

SEQ ID NO: 528813 - RNA, 21 nt, Chlamydophila pneumoniae J138
uuuugauuaggcuucagagau

SEQ ID NO: 528814 - RNA, 16 nt, Chlamydophila pneumoniae J138
uuuugcuaaacaaugc

SEQ ID NO: 528815 - RNA, 21 nt, Chlamydophila pneumoniae J138
uuuugcuaagagcucuuuccc

SEQ ID NO: 528816 - RNA, 22 nt, Chlamydophila pneumoniae J138
uuuugccacaacucauccuaaa

SEQ ID NO: 528817 - RNA, 22 nt, Chlamydophila pneumoniae J138
uuuugccaguucuugaaacucu

SEQ ID NO: 528818 - RNA, 15 nt, Chlamydophila pneumoniae J138
uuuugcuuuucccuu

SEQ ID NO: 528819 - RNA, 18 nt, Chlamydophila pneumoniae J138
uuuugcugaagauuuuuu

SEQ ID NO: 528820 - RNA, 18 nt, Chlamydophila pneumoniae J138
aaauucaaaauagaagcc

SEQ ID NO: 528821 - RNA, 11 nt, Chlamydophila pneumoniae J138
aaauucccaua

SEQ ID NO: 528822 - RNA, 16 nt, Chlamydophila pneumoniae J138
aaauucauuaagaaca

SEQ ID NO: 528823 - RNA, 22 nt, Chlamydophila pneumoniae J138
aaauucaugccuuuggcaauca

SEQ ID NO: 528824 - RNA, 14 nt, Chlamydophila pneumoniae J138
aaauucauuaaaau

SEQ ID NO: 528825 - RNA, 19 nt, Chlamydophila pneumoniae J138
aaauucaguauaagaugcu

SEQ ID NO: 528826 - RNA, 16 nt, Chlamydophila pneumoniae J138
aaauucaggacccuuu

SEQ ID NO: 528827 - RNA, 22 nt, Chlamydophila pneumoniae J138
aaauucuggagucgagcagaaa

SEQ ID NO: 528828 - RNA, 13 nt, Chlamydophila pneumoniae J138
aaauucuaagcgc

SEQ ID NO: 528829 - RNA, 23 nt, Chlamydophila pneumoniae J138
aaauuccgacccagucaaaauau

SEQ ID NO: 528830 - RNA, 17 nt, Chlamydophila pneumoniae J138
aaauuccuucucagaaa

SEQ ID NO: 528831 - RNA, 22 nt, Chlamydophila pneumoniae J138
aaauuccuucucagaaagauau

SEQ ID NO: 528832 - RNA, 18 nt, Chlamydophila pneumoniae J138
aaauucgaauucucagaa

SEQ ID NO: 528833 - RNA, 13 nt, Chlamydophila pneumoniae J138
aaauuacuguggu

SEQ ID NO: 528834 - RNA, 21 nt, Chlamydophila pneumoniae J138
aaauuaccguuuccuccucuu

SEQ ID NO: 528835 - RNA, 11 nt, Chlamydophila pneumoniae J138
uuuuuucuaua

SEQ ID NO: 528836 - RNA, 16 nt, Chlamydophila pneumoniae J138
aaauuaucuccaaaga

SEQ ID NO: 528837 - RNA, 23 nt, Chlamydophila pneumoniae J138
uuuuugcuaagagcucuuucccu

SEQ ID NO: 528838 - RNA, 13 nt, Chlamydophila pneumoniae J138
uuuuuggaaaacc

SEQ ID NO: 528839 - RNA, 17 nt, Chlamydophila pneumoniae J138
uuuuuggaaauccguaa

SEQ ID NO: 528840 - RNA, 17 nt, Chlamydophila pneumoniae J138
uuuuugcugaagauuuu

SEQ ID NO: 528841 - RNA, 12 nt, Chlamydophila pneumoniae J138
uuuuuuaaagug

SEQ ID NO: 528842 - RNA, 18 nt, Chlamydophila pneumoniae J138
uuuuuguucauccagaag

SEQ ID NO: 528843 - RNA, 12 nt, Chlamydophila pneumoniae J138
uuuuucuaguuc

SEQ ID NO: 528844 - RNA, 22 nt, Chlamydophila pneumoniae J138
uuuuucugcuucuccaaauaaa

SEQ ID NO: 528845 - RNA, 22 nt, Chlamydophila pneumoniae J138
uuuuucuguuccugaguacuuu

SEQ ID NO: 528846 - RNA, 12 nt, Chlamydophila pneumoniae J138
uuuuugaaaacu

SEQ ID NO: 528847 - RNA, 20 nt, Chlamydophila pneumoniae J138
uuuuugaauaugauuuccac

SEQ ID NO: 528848 - RNA, 12 nt, Chlamydophila pneumoniae J138
uuuuugaaugau

SEQ ID NO: 528849 - RNA, 23 nt, Chlamydophila pneumoniae J138
aaaugugaaaucguaucuuuuug

SEQ ID NO: 528850 - RNA, 11 nt, Chlamydophila pneumoniae J138
uuuuuuaauuc

SEQ ID NO: 528851 - RNA, 21 nt, Chlamydophila pneumoniae J138
aaauguuuugcgauaucuaua

SEQ ID NO: 528852 - RNA, 12 nt, Chlamydophila pneumoniae J138
aaauuaaauauc

SEQ ID NO: 528853 - RNA, 13 nt, Chlamydophila pneumoniae J138
aaauuaacaacac

SEQ ID NO: 528854 - RNA, 17 nt, Chlamydophila pneumoniae J138
aaauuaagucacacuuu

SEQ ID NO: 528855 - RNA, 20 nt, Chlamydophila pneumoniae J138
uuucccaccauauucucagg

SEQ ID NO: 528856 - RNA, 22 nt, Chlamydophila pneumoniae J138
uuucccgacauuuaacaucuuu

SEQ ID NO: 528857 - RNA, 22 nt, Chlamydophila pneumoniae J138
uuuccauuagggcauucuguaa

SEQ ID NO: 528858 - RNA, 11 nt, Chlamydophila pneumoniae J138
uuuccauccac

SEQ ID NO: 528859 - RNA, 23 nt, Chlamydophila pneumoniae J138
uuuccauacccaaauuucuucug

SEQ ID NO: 528860 - RNA, 19 nt, Chlamydophila pneumoniae J138
uuuccauacccaaauuucu

SEQ ID NO: 528861 - RNA, 21 nt, Chlamydophila pneumoniae J138
uuucccuaagcaaaaacuuuc

SEQ ID NO: 528862 - RNA, 16 nt, Chlamydophila pneumoniae J138
uuucccuccaccagaa

SEQ ID NO: 528863 - RNA, 22 nt, Chlamydophila pneumoniae J138
uuucccgcucuuuauuaacucc

SEQ ID NO: 528864 - RNA, 16 nt, Chlamydophila pneumoniae J138
uuucccucguugcuua

SEQ ID NO: 528865 - RNA, 23 nt, Chlamydophila pneumoniae J138
uuucgaagcguuaacaacuucua

SEQ ID NO: 528866 - RNA, 20 nt, Chlamydophila pneumoniae J138
uuucgacgcuguugaaaugc

SEQ ID NO: 528867 - RNA, 18 nt, Chlamydophila pneumoniae J138
uuuccuggucuccagaag

SEQ ID NO: 528868 - RNA, 23 nt, Chlamydophila pneumoniae J138
uuuccuucuuuuaaaaacucuuu

SEQ ID NO: 528869 - RNA, 15 nt, Chlamydophila pneumoniae J138
uuuccuucuccagag

SEQ ID NO: 528870 - RNA, 21 nt, Chlamydophila pneumoniae J138
uuuccuucaggauuuuccauu

SEQ ID NO: 528871 - RNA, 20 nt, Chlamydophila pneumoniae J138
uuuccugacuauaaaaugcc

SEQ ID NO: 528872 - RNA, 12 nt, Chlamydophila pneumoniae J138
uuuccuaaaaua

SEQ ID NO: 528873 - RNA, 14 nt, Chlamydophila pneumoniae J138
uuuccuccucuucu

SEQ ID NO: 528874 - RNA, 22 nt, Chlamydophila pneumoniae J138
uuucuaggccgggauuuuaauu

SEQ ID NO: 528875 - RNA, 16 nt, Chlamydophila pneumoniae J138
uuucuaggaauugcug

SEQ ID NO: 528876 - RNA, 22 nt, Chlamydophila pneumoniae J138
uuucuagcugcucuuuuagaau

SEQ ID NO: 528877 - RNA, 22 nt, Chlamydophila pneumoniae J138
uuucuaagauuccuaacuucug

SEQ ID NO: 528878 - RNA, 14 nt, Chlamydophila pneumoniae J138
uuucuaauguaggg

SEQ ID NO: 528879 - RNA, 17 nt, Chlamydophila pneumoniae J138
uuucuacugaaaccuuc

SEQ ID NO: 528880 - RNA, 21 nt, Chlamydophila pneumoniae J138
uuucuagaaacugcuccugaa

SEQ ID NO: 528881 - RNA, 22 nt, Chlamydophila pneumoniae J138
uuucuguacaacaaaauuugca

SEQ ID NO: 528882 - RNA, 18 nt, Chlamydophila pneumoniae J138
uuucugaaucuuuuguuu

SEQ ID NO: 528883 - RNA, 18 nt, Chlamydophila pneumoniae J138
uuucugauuuaaaagguu

SEQ ID NO: 528884 - RNA, 17 nt, Chlamydophila pneumoniae J138
uuucuauuauuuuaaag

SEQ ID NO: 528885 - RNA, 15 nt, Chlamydophila pneumoniae J138
uuucucuaaaauaug

SEQ ID NO: 528886 - RNA, 13 nt, Chlamydophila pneumoniae J138
uuucucuccacag

SEQ ID NO: 528887 - RNA, 17 nt, Chlamydophila pneumoniae J138
uuugaacaacuccuuaa

SEQ ID NO: 528888 - RNA, 23 nt, Chlamydophila pneumoniae J138
uuugaagaacaaaaaaucaaucu

SEQ ID NO: 528889 - RNA, 21 nt, Chlamydophila pneumoniae J138
uuugaauauauugugcauuac

SEQ ID NO: 528890 - RNA, 13 nt, Chlamydophila pneumoniae J138
uuugaagauguau

SEQ ID NO: 528891 - RNA, 13 nt, Chlamydophila pneumoniae J138
uuucuuuugcaaa

SEQ ID NO: 528892 - RNA, 14 nt, Chlamydophila pneumoniae J138
uuucuuuuucagcu

SEQ ID NO: 528893 - RNA, 14 nt, Chlamydophila pneumoniae J138
uuugaaaagaaaga

SEQ ID NO: 528894 - RNA, 20 nt, Chlamydophila pneumoniae J138
uuugacaucuaauuuuaaau

SEQ ID NO: 528895 - RNA, 16 nt, Chlamydophila pneumoniae J138
uuugaauuuccaaagg

SEQ ID NO: 528896 - RNA, 23 nt, Chlamydophila pneumoniae J138
uuugaauuuccaaaggaaaauaa

SEQ ID NO: 528897 - RNA, 16 nt, Chlamydophila pneumoniae J138
uuucuuucacaucuuu

SEQ ID NO: 528898 - RNA, 22 nt, Chlamydophila pneumoniae J138
uuucuuguuccaauagagucuc

SEQ ID NO: 528899 - RNA, 13 nt, Chlamydophila pneumoniae J138
uuucuugauuaga

SEQ ID NO: 528900 - RNA, 15 nt, Chlamydophila pneumoniae J138
uuucuugcaaggagc

SEQ ID NO: 528901 - RNA, 17 nt, Chlamydophila pneumoniae J138
uuucuugauauuugucu

SEQ ID NO: 528902 - RNA, 14 nt, Chlamydophila pneumoniae J138
uuucuugaaaaauc

SEQ ID NO: 528903 - RNA, 11 nt, Chlamydophila pneumoniae J138
uuucuucuuuc

SEQ ID NO: 528904 - RNA, 12 nt, Chlamydophila pneumoniae J138
uuucuucuguuu

SEQ ID NO: 528905 - RNA, 17 nt, Chlamydophila pneumoniae J138
uuucuguugcacuuucc

SEQ ID NO: 528906 - RNA, 15 nt, Chlamydophila pneumoniae J138
uuucuuaauuuccuu

SEQ ID NO: 528907 - RNA, 14 nt, Chlamydophila pneumoniae J138
uuucuuaauuuccu

SEQ ID NO: 528908 - RNA, 24 nt, Chlamydophila pneumoniae J138
uuucuuccacacaacucguuucag

SEQ ID NO: 528909 - RNA, 15 nt, Chlamydophila pneumoniae J138
uuucuuccauacagg

SEQ ID NO: 528910 - RNA, 22 nt, Chlamydophila pneumoniae J138
uuucuuccaaagacugagcuuc

SEQ ID NO: 528911 - RNA, 20 nt, Chlamydophila pneumoniae J138
uuucuuauagcuuuggaacg

SEQ ID NO: 528912 - RNA, 16 nt, Chlamydophila pneumoniae J138
uuucuucaacauacac

SEQ ID NO: 528913 - RNA, 13 nt, Chlamydophila pneumoniae J138
uuugcaaaugaaa

SEQ ID NO: 528914 - RNA, 13 nt, Chlamydophila pneumoniae J138
uuugauuuuucaa

SEQ ID NO: 528915 - RNA, 16 nt, Chlamydophila pneumoniae J138
uuugauucauaaagag

SEQ ID NO: 528916 - RNA, 22 nt, Chlamydophila pneumoniae J138
uuugauucccggaggcaaagau

SEQ ID NO: 528917 - RNA, 14 nt, Chlamydophila pneumoniae J138
uuugaucgcuugug

SEQ ID NO: 528918 - RNA, 18 nt, Chlamydophila pneumoniae J138
uuugaucuugcucaggag

SEQ ID NO: 528919 - RNA, 14 nt, Chlamydophila pneumoniae J138
uuugaggauuucuu

SEQ ID NO: 528920 - RNA, 12 nt, Chlamydophila pneumoniae J138
uuugcugaagau

SEQ ID NO: 528921 - RNA, 15 nt, Chlamydophila pneumoniae J138
uuugcucucuagauu

SEQ ID NO: 528922 - RNA, 16 nt, Chlamydophila pneumoniae J138
uuugcuccuccaaaag

SEQ ID NO: 528923 - RNA, 21 nt, Chlamydophila pneumoniae J138
uuugcuacagcuucuuuucca

SEQ ID NO: 528924 - RNA, 17 nt, Chlamydophila pneumoniae J138
uuugcuagaucuggaga

SEQ ID NO: 528925 - RNA, 16 nt, Chlamydophila pneumoniae J138
uuugcuaaacaaugca

SEQ ID NO: 528926 - RNA, 14 nt, Chlamydophila pneumoniae J138
uuugcgauuucagc

SEQ ID NO: 528927 - RNA, 14 nt, Chlamydophila pneumoniae J138
uuugccauuucuau

SEQ ID NO: 528928 - RNA, 15 nt, Chlamydophila pneumoniae J138
uuugccauuucuauc

SEQ ID NO: 528929 - RNA, 19 nt, Chlamydophila pneumoniae J138
uuugccaguucuugaaacu

SEQ ID NO: 528930 - RNA, 13 nt, Chlamydophila pneumoniae J138
uuugccugaaauc

SEQ ID NO: 528931 - RNA, 20 nt, Chlamydophila pneumoniae J138
uuugcaguuccgauaaagau

SEQ ID NO: 528932 - RNA, 13 nt, Chlamydophila pneumoniae J138
uuugcaugaggag

SEQ ID NO: 528933 - RNA, 21 nt, Chlamydophila pneumoniae J138
uuuaaccgagcuuuuugcuuu

SEQ ID NO: 528934 - RNA, 13 nt, Chlamydophila pneumoniae J138
uuuaaaugccuua

SEQ ID NO: 528935 - RNA, 22 nt, Chlamydophila pneumoniae J138
uuuaaauucgccaaacgaauuu

SEQ ID NO: 528936 - RNA, 17 nt, Chlamydophila pneumoniae J138
uuuaaaugccuuaaaug

SEQ ID NO: 528937 - RNA, 19 nt, Chlamydophila pneumoniae J138
uuuaaaugccuuaaaugua

SEQ ID NO: 528938 - RNA, 14 nt, Chlamydophila pneumoniae J138
uuuaaaugccuuaa

SEQ ID NO: 528939 - RNA, 18 nt, Chlamydophila pneumoniae J138
uuuaaaugagcaauguuu

SEQ ID NO: 528940 - RNA, 22 nt, Chlamydophila pneumoniae J138
uuuaaauagcaucccuucuucu

SEQ ID NO: 528941 - RNA, 21 nt, Chlamydophila pneumoniae J138
uuuaaauaaaaccacuucucu

SEQ ID NO: 528942 - RNA, 17 nt, Chlamydophila pneumoniae J138
uuuaaaguguguaaaug

SEQ ID NO: 528943 - RNA, 19 nt, Chlamydophila pneumoniae J138
uuuaaaguguguaaauguu

SEQ ID NO: 528944 - RNA, 12 nt, Chlamydophila pneumoniae J138
uuuaaagccucc

SEQ ID NO: 528945 - RNA, 13 nt, Chlamydophila pneumoniae J138
uugcugauuucuu

SEQ ID NO: 528946 - RNA, 19 nt, Chlamydophila pneumoniae J138
uugcugauuucuuuuucag

SEQ ID NO: 528947 - RNA, 23 nt, Chlamydophila pneumoniae J138
uugcugcgaaugucguuaaaaac

SEQ ID NO: 528948 - RNA, 18 nt, Chlamydophila pneumoniae J138
uuguuaauggcagcuugg

SEQ ID NO: 528949 - RNA, 19 nt, Chlamydophila pneumoniae J138
uuguugucagcuuugcuua

SEQ ID NO: 528950 - RNA, 17 nt, Chlamydophila pneumoniae J138
uuguugcaucgccuuaa

SEQ ID NO: 528951 - RNA, 14 nt, Chlamydophila pneumoniae J138
uuguuguuuuugcu

SEQ ID NO: 528952 - RNA, 15 nt, Chlamydophila pneumoniae J138
uuguuuagaaaaaga

SEQ ID NO: 528953 - RNA, 13 nt, Chlamydophila pneumoniae J138
uuguuucuagaaa

SEQ ID NO: 528954 - RNA, 13 nt, Chlamydophila pneumoniae J138
uuguuucaucuuc

SEQ ID NO: 528955 - RNA, 17 nt, Chlamydophila pneumoniae J138
uuguuucaucuucuuuc

SEQ ID NO: 528956 - RNA, 23 nt, Chlamydophila pneumoniae J138
uuuaaaagauuccuuaccuauau

SEQ ID NO: 528957 - RNA, 16 nt, Chlamydophila pneumoniae J138
uuuaaaaaauucuaau

SEQ ID NO: 528958 - RNA, 21 nt, Chlamydophila pneumoniae J138
uuuauaaagaucgggucuaca

SEQ ID NO: 528959 - RNA, 15 nt, Chlamydophila pneumoniae J138
uuuaguuucccacua

SEQ ID NO: 528960 - RNA, 17 nt, Chlamydophila pneumoniae J138
uuuagcuauuugaaaua

SEQ ID NO: 528961 - RNA, 16 nt, Chlamydophila pneumoniae J138
uuuagcgcuacaguga

SEQ ID NO: 528962 - RNA, 15 nt, Chlamydophila pneumoniae J138
uuuagccuggucuca

SEQ ID NO: 528963 - RNA, 13 nt, Chlamydophila pneumoniae J138
uuuacugaaauua

SEQ ID NO: 528964 - RNA, 15 nt, Chlamydophila pneumoniae J138
uuuaauucaaaaaga

SEQ ID NO: 528965 - RNA, 16 nt, Chlamydophila pneumoniae J138
uuuaacucuagaucuu

SEQ ID NO: 528966 - RNA, 23 nt, Chlamydophila pneumoniae J138
uuuaaccucuuuucuuaucauga

SEQ ID NO: 528967 - RNA, 21 nt, Chlamydophila pneumoniae J138
uuuaacgcuaagcucuuaauu

SEQ ID NO: 528968 - RNA, 18 nt, Chlamydophila pneumoniae J138
uuuaauuuuucuaagaaa

SEQ ID NO: 528969 - RNA, 13 nt, Chlamydophila pneumoniae J138
uuuaauuuuucua

SEQ ID NO: 528970 - RNA, 16 nt, Chlamydophila pneumoniae J138
uuuacaaauaaaauga

SEQ ID NO: 528971 - RNA, 22 nt, Chlamydophila pneumoniae J138
uuuacaaucucugcgagaaucg

SEQ ID NO: 528972 - RNA, 17 nt, Chlamydophila pneumoniae J138
uuuacgaaucuuuuuca

SEQ ID NO: 528973 - RNA, 22 nt, Chlamydophila pneumoniae J138
uuuacgaaaacaucuguauauu

SEQ ID NO: 528974 - RNA, 19 nt, Chlamydophila pneumoniae J138
uuucacauaguuuaauaaa

SEQ ID NO: 528975 - RNA, 18 nt, Chlamydophila pneumoniae J138
uuucacauacauucuauu

SEQ ID NO: 528976 - RNA, 17 nt, Chlamydophila pneumoniae J138
uuucaccaacuccucua

SEQ ID NO: 528977 - RNA, 21 nt, Chlamydophila pneumoniae J138
uuucaccaacuccucuaagga

SEQ ID NO: 528978 - RNA, 16 nt, Chlamydophila pneumoniae J138
uuucaaucucuccuug

SEQ ID NO: 528979 - RNA, 21 nt, Chlamydophila pneumoniae J138
uuucaauagcaguaucuagaa

SEQ ID NO: 528980 - RNA, 18 nt, Chlamydophila pneumoniae J138
uuucaauagcuuccaagg

SEQ ID NO: 528981 - RNA, 15 nt, Chlamydophila pneumoniae J138
uuucaaucucuccuu

SEQ ID NO: 528982 - RNA, 24 nt, Chlamydophila pneumoniae J138
uuucaagauugugcucaauacaga

SEQ ID NO: 528983 - RNA, 11 nt, Chlamydophila pneumoniae J138
uuucaauaaua

SEQ ID NO: 528984 - RNA, 17 nt, Chlamydophila pneumoniae J138
uuucaaaggagaaagaa

SEQ ID NO: 528985 - RNA, 9 nt, Chlamydophila pneumoniae J138
uuucaaagg

SEQ ID NO: 528986 - RNA, 14 nt, Chlamydophila pneumoniae J138
uuucaaacaauagu

SEQ ID NO: 528987 - RNA, 13 nt, Chlamydophila pneumoniae J138
uuucauaagagaa

SEQ ID NO: 528988 - RNA, 19 nt, Chlamydophila pneumoniae J138
uuucaguuguuucuagaaa

SEQ ID NO: 528989 - RNA, 14 nt, Chlamydophila pneumoniae J138
uuucauaaacaauu

SEQ ID NO: 528990 - RNA, 16 nt, Chlamydophila pneumoniae J138
uuucauaaacaauuca

SEQ ID NO: 528991 - RNA, 16 nt, Chlamydophila pneumoniae J138
uuucauacuuauccuu

SEQ ID NO: 528992 - RNA, 16 nt, Chlamydophila pneumoniae J138
uuucaggucagcaagg

SEQ ID NO: 528993 - RNA, 19 nt, Chlamydophila pneumoniae J138
uuucaggaaacucaaucuc

SEQ ID NO: 528994 - RNA, 14 nt, Chlamydophila pneumoniae J138
uuucagucuuccuu

SEQ ID NO: 528995 - RNA, 14 nt, Chlamydophila pneumoniae J138
uuucagaaaagaaa

SEQ ID NO: 528996 - RNA, 24 nt, Chlamydophila pneumoniae J138
uuucagaagucacaaauuuuugca

SEQ ID NO: 528997 - RNA, 22 nt, Chlamydophila pneumoniae J138
uuucagagccgcuagccauagu

SEQ ID NO: 528998 - RNA, 13 nt, Chlamydophila pneumoniae J138
uuucagaagaucu

SEQ ID NO: 528999 - RNA, 22 nt, Chlamydophila pneumoniae J138
uuuccaagacaacaccucccac

SEQ ID NO: 529000 - RNA, 14 nt, Chlamydophila pneumoniae J138
uuuccaagaaguca

SEQ ID NO: 529001 - RNA, 20 nt, Chlamydophila pneumoniae J138
uuucauuuuuaggaucuuug

SEQ ID NO: 529002 - RNA, 12 nt, Chlamydophila pneumoniae J138
uuucauucccuu

SEQ ID NO: 529003 - RNA, 13 nt, Chlamydophila pneumoniae J138
uuuccagcaaagc

SEQ ID NO: 529004 - RNA, 20 nt, Chlamydophila pneumoniae J138
uuuccacguacgagaucaga

SEQ ID NO: 529005 - RNA, 18 nt, Chlamydophila pneumoniae J138
uuucauguaagaauguag

SEQ ID NO: 529006 - RNA, 19 nt, Chlamydophila pneumoniae J138
uuucauucccuuuuuccau

SEQ ID NO: 529007 - RNA, 19 nt, Chlamydophila pneumoniae J138
uuaaccgagcuuuuugcuu

SEQ ID NO: 529008 - RNA, 14 nt, Chlamydophila pneumoniae J138
uuaaccucuuuucu

SEQ ID NO: 529009 - RNA, 18 nt, Chlamydophila pneumoniae J138
uguggaauaucaggacaa

SEQ ID NO: 529010 - RNA, 15 nt, Chlamydophila pneumoniae J138
ugugcuuuugguucu

SEQ ID NO: 529011 - RNA, 21 nt, Chlamydophila pneumoniae J138
uuaagauagacucucacugag

SEQ ID NO: 529012 - RNA, 15 nt, Chlamydophila pneumoniae J138
uuaagauaaacauua

SEQ ID NO: 529013 - RNA, 18 nt, Chlamydophila pneumoniae J138
uuaagauaaacagcacag

SEQ ID NO: 529014 - RNA, 21 nt, Chlamydophila pneumoniae J138
uuaagacucaauacuucagga

SEQ ID NO: 529015 - RNA, 21 nt, Chlamydophila pneumoniae J138
uuaagaagcacuucuuuagga

SEQ ID NO: 529016 - RNA, 15 nt, Chlamydophila pneumoniae J138
uuaagaagaagcuga

SEQ ID NO: 529017 - RNA, 17 nt, Chlamydophila pneumoniae J138
uuaagacaauauaagca

SEQ ID NO: 529018 - RNA, 17 nt, Chlamydophila pneumoniae J138
uuaaguguuucuucaua

SEQ ID NO: 529019 - RNA, 16 nt, Chlamydophila pneumoniae J138
uuaaggaucccaucau

SEQ ID NO: 529020 - RNA, 16 nt, Chlamydophila pneumoniae J138
uuaauauaaaagaaga

SEQ ID NO: 529021 - RNA, 22 nt, Chlamydophila pneumoniae J138
uuaauccuugagggcuauccac

SEQ ID NO: 529022 - RNA, 12 nt, Chlamydophila pneumoniae J138
uuaaucaauccu

SEQ ID NO: 529023 - RNA, 15 nt, Chlamydophila pneumoniae J138
uuacauguaaacaaa

SEQ ID NO: 529024 - RNA, 14 nt, Chlamydophila pneumoniae J138
uuaccaaaaacugg

SEQ ID NO: 529025 - RNA, 19 nt, Chlamydophila pneumoniae J138
uuacaauuuaaaucugcaa

SEQ ID NO: 529026 - RNA, 14 nt, Chlamydophila pneumoniae J138
uuacaauugaaaau

SEQ ID NO: 529027 - RNA, 19 nt, Chlamydophila pneumoniae J138
uuacaauuuuagauacgcu

SEQ ID NO: 529028 - RNA, 14 nt, Chlamydophila pneumoniae J138
uuacagaucugcau

SEQ ID NO: 529029 - RNA, 21 nt, Chlamydophila pneumoniae J138
uuaaugcaagcaacucuucag

SEQ ID NO: 529030 - RNA, 13 nt, Chlamydophila pneumoniae J138
uuaauguuuggcc

SEQ ID NO: 529031 - RNA, 24 nt, Chlamydophila pneumoniae J138
uuaauuccaacuacauaauaagca

SEQ ID NO: 529032 - RNA, 14 nt, Chlamydophila pneumoniae J138
uuaggugaaauauu

SEQ ID NO: 529033 - RNA, 23 nt, Chlamydophila pneumoniae J138
uuagguagauagaaauucuguag

SEQ ID NO: 529034 - RNA, 19 nt, Chlamydophila pneumoniae J138
uuaguauacuaagacuguc

SEQ ID NO: 529035 - RNA, 18 nt, Chlamydophila pneumoniae J138
uuaguuaacuccuucaau

SEQ ID NO: 529036 - RNA, 18 nt, Chlamydophila pneumoniae J138
uuaguuuaccugaaaaaa

SEQ ID NO: 529037 - RNA, 14 nt, Chlamydophila pneumoniae J138
uuaguuuuuucuaa

SEQ ID NO: 529038 - RNA, 22 nt, Chlamydophila pneumoniae J138
uuauaaagaucgggucuacaac

SEQ ID NO: 529039 - RNA, 12 nt, Chlamydophila pneumoniae J138
uuauaaagaaga

SEQ ID NO: 529040 - RNA, 13 nt, Chlamydophila pneumoniae J138
uuauaaagaagaa

SEQ ID NO: 529041 - RNA, 15 nt, Chlamydophila pneumoniae J138
uuauaaagaagaaac

SEQ ID NO: 529042 - RNA, 14 nt, Chlamydophila pneumoniae J138
uuauaaacuucaau

SEQ ID NO: 529043 - RNA, 22 nt, Chlamydophila pneumoniae J138
uuauaaacuucaaugaagaaaa

SEQ ID NO: 529044 - RNA, 18 nt, Chlamydophila pneumoniae J138
uuauaacaucaagaauuu

SEQ ID NO: 529045 - RNA, 23 nt, Chlamydophila pneumoniae J138
uuauacccacaaagaucacugag

SEQ ID NO: 529046 - RNA, 14 nt, Chlamydophila pneumoniae J138
uuauacacuccaau

SEQ ID NO: 529047 - RNA, 20 nt, Chlamydophila pneumoniae J138
uuagaauagaagauccucaa

SEQ ID NO: 529048 - RNA, 23 nt, Chlamydophila pneumoniae J138
uuagagaagagguguccauaaug

SEQ ID NO: 529049 - RNA, 17 nt, Chlamydophila pneumoniae J138
uuagagaaauuuuuaau

SEQ ID NO: 529050 - RNA, 12 nt, Chlamydophila pneumoniae J138
uuagaagagaaa

SEQ ID NO: 529051 - RNA, 13 nt, Chlamydophila pneumoniae J138
uuagaacuucaau

SEQ ID NO: 529052 - RNA, 20 nt, Chlamydophila pneumoniae J138
uuagaagggaaaguaccuuu

SEQ ID NO: 529053 - RNA, 15 nt, Chlamydophila pneumoniae J138
uuagaagggagguuu

SEQ ID NO: 529054 - RNA, 16 nt, Chlamydophila pneumoniae J138
uuagaguuuucuguag

SEQ ID NO: 529055 - RNA, 13 nt, Chlamydophila pneumoniae J138
uuagagugacuca

SEQ ID NO: 529056 - RNA, 17 nt, Chlamydophila pneumoniae J138
uuagcaucaucuccuga

SEQ ID NO: 529057 - RNA, 14 nt, Chlamydophila pneumoniae J138
uuagcaucaucucc

SEQ ID NO: 529058 - RNA, 15 nt, Chlamydophila pneumoniae J138
uuagcauuaggaaag

SEQ ID NO: 529059 - RNA, 13 nt, Chlamydophila pneumoniae J138
uuaccgaagagcc

SEQ ID NO: 529060 - RNA, 22 nt, Chlamydophila pneumoniae J138
uuacuugcgauacaauaaacaa

SEQ ID NO: 529061 - RNA, 16 nt, Chlamydophila pneumoniae J138
uuacugaggaaaucgc

SEQ ID NO: 529062 - RNA, 21 nt, Chlamydophila pneumoniae J138
uuauguagauugauccagccc

SEQ ID NO: 529063 - RNA, 22 nt, Chlamydophila pneumoniae J138
uuauguagaucauaaacagcag

SEQ ID NO: 529064 - RNA, 20 nt, Chlamydophila pneumoniae J138
uuauggaugcuaaauuuguc

SEQ ID NO: 529065 - RNA, 20 nt, Chlamydophila pneumoniae J138
uuauguuuucucgaagaaaa

SEQ ID NO: 529066 - RNA, 22 nt, Chlamydophila pneumoniae J138
uuauguuaaaaauaccaagaug

SEQ ID NO: 529067 - RNA, 12 nt, Chlamydophila pneumoniae J138
uuauuacagaaa

SEQ ID NO: 529068 - RNA, 19 nt, Chlamydophila pneumoniae J138
uuaucgugacucuuaucug

SEQ ID NO: 529069 - RNA, 18 nt, Chlamydophila pneumoniae J138
uuaucgggggugccaaaa

SEQ ID NO: 529070 - RNA, 20 nt, Chlamydophila pneumoniae J138
uuaucgggggugccaaaaaa

SEQ ID NO: 529071 - RNA, 19 nt, Chlamydophila pneumoniae J138
uuaucuagcucuucaaggu

SEQ ID NO: 529072 - RNA, 15 nt, Chlamydophila pneumoniae J138
uuaucuagcucuuca

SEQ ID NO: 529073 - RNA, 14 nt, Chlamydophila pneumoniae J138
uuaucuagcucuuc

SEQ ID NO: 529074 - RNA, 22 nt, Chlamydophila pneumoniae J138
uuaucucccaagacgagaacau

SEQ ID NO: 529075 - RNA, 15 nt, Chlamydophila pneumoniae J138
uuaugaguuuuuaau

SEQ ID NO: 529076 - RNA, 18 nt, Chlamydophila pneumoniae J138
uuaucuuagggaaucucu

SEQ ID NO: 529077 - RNA, 15 nt, Chlamydophila pneumoniae J138
uuaucccaaacuucu

SEQ ID NO: 529078 - RNA, 17 nt, Chlamydophila pneumoniae J138
uuauccaccaagacuga

SEQ ID NO: 529079 - RNA, 21 nt, Chlamydophila pneumoniae J138
uuauccaccaagacugaauau

SEQ ID NO: 529080 - RNA, 19 nt, Chlamydophila pneumoniae J138
uuauccuugaaauugcucu

SEQ ID NO: 529081 - RNA, 18 nt, Chlamydophila pneumoniae J138
uuaucaugagaauuuuca

SEQ ID NO: 529082 - RNA, 16 nt, Chlamydophila pneumoniae J138
uuauauaaagaucuuu

SEQ ID NO: 529083 - RNA, 20 nt, Chlamydophila pneumoniae J138
uuauauagacaaugcaaccu

SEQ ID NO: 529084 - RNA, 20 nt, Chlamydophila pneumoniae J138
uuauaggaauaacaccaaaa

SEQ ID NO: 529085 - RNA, 23 nt, Chlamydophila pneumoniae J138
uuauaggaauaacaccaaaagaa

SEQ ID NO: 529086 - RNA, 11 nt, Chlamydophila pneumoniae J138
uuauauuaaga

SEQ ID NO: 529087 - RNA, 15 nt, Chlamydophila pneumoniae J138
uuaucaaagugaacg

SEQ ID NO: 529088 - RNA, 11 nt, Chlamydophila pneumoniae J138
uucaagaaaaa

SEQ ID NO: 529089 - RNA, 23 nt, Chlamydophila pneumoniae J138
uucaacuuuguuaauagaagauc

SEQ ID NO: 529090 - RNA, 16 nt, Chlamydophila pneumoniae J138
uucaagcaaaucuccg

SEQ ID NO: 529091 - RNA, 12 nt, Chlamydophila pneumoniae J138
uucaaguuucuu

SEQ ID NO: 529092 - RNA, 13 nt, Chlamydophila pneumoniae J138
uucaaguuucuuu

SEQ ID NO: 529093 - RNA, 21 nt, Chlamydophila pneumoniae J138
uucaauaauuucaaagaugca

SEQ ID NO: 529094 - RNA, 22 nt, Chlamydophila pneumoniae J138
uucaaaagaaaucaaacauuac

SEQ ID NO: 529095 - RNA, 15 nt, Chlamydophila pneumoniae J138
uucaaaagaaaucaa

SEQ ID NO: 529096 - RNA, 12 nt, Chlamydophila pneumoniae J138
uuauucuuaaug

SEQ ID NO: 529097 - RNA, 16 nt, Chlamydophila pneumoniae J138
uuauugaauaagcuuu

SEQ ID NO: 529098 - RNA, 12 nt, Chlamydophila pneumoniae J138
uuauuuaaaauu

SEQ ID NO: 529099 - RNA, 22 nt, Chlamydophila pneumoniae J138
uuauuuggacguacuaagauac

SEQ ID NO: 529100 - RNA, 15 nt, Chlamydophila pneumoniae J138
uuauuuuaaagucac

SEQ ID NO: 529101 - RNA, 15 nt, Chlamydophila pneumoniae J138
uucaaaaagagagcc

SEQ ID NO: 529102 - RNA, 20 nt, Chlamydophila pneumoniae J138
uucaauagguaaggaaacga

SEQ ID NO: 529103 - RNA, 22 nt, Chlamydophila pneumoniae J138
uucaauacgcuagcucuuaaau

SEQ ID NO: 529104 - RNA, 21 nt, Chlamydophila pneumoniae J138
uucaauacgcuagcucuuaaa

SEQ ID NO: 529105 - RNA, 16 nt, Chlamydophila pneumoniae J138
uucacgauaucuacca

SEQ ID NO: 529106 - RNA, 16 nt, Chlamydophila pneumoniae J138
uucacaucuuaaaaac

SEQ ID NO: 529107 - RNA, 13 nt, Chlamydophila pneumoniae J138
uucagcacugacu

SEQ ID NO: 529108 - RNA, 23 nt, Chlamydophila pneumoniae J138
uucagagagaacaggagguguau

SEQ ID NO: 529109 - RNA, 21 nt, Chlamydophila pneumoniae J138
uucagcaaggaaguuauaauu

SEQ ID NO: 529110 - RNA, 13 nt, Chlamydophila pneumoniae J138
uucagaauucuca

SEQ ID NO: 529111 - RNA, 15 nt, Chlamydophila pneumoniae J138
uucagaauucucaag

SEQ ID NO: 529112 - RNA, 23 nt, Chlamydophila pneumoniae J138
uucaggagaccagggaucuucau

SEQ ID NO: 529113 - RNA, 15 nt, Chlamydophila pneumoniae J138
uucaggauuuuccau

SEQ ID NO: 529114 - RNA, 16 nt, Chlamydophila pneumoniae J138
uucaggauuuuccauu

SEQ ID NO: 529115 - RNA, 21 nt, Chlamydophila pneumoniae J138
uucaggacgcacauuuagaag

SEQ ID NO: 529116 - RNA, 19 nt, Chlamydophila pneumoniae J138
uucuugaagaucuccgaag

SEQ ID NO: 529117 - RNA, 13 nt, Chlamydophila pneumoniae J138
uucugcaggauuu

SEQ ID NO: 529118 - RNA, 14 nt, Chlamydophila pneumoniae J138
uucuugacggcagg

SEQ ID NO: 529119 - RNA, 19 nt, Chlamydophila pneumoniae J138
uucuuuaucuagcucuuca

SEQ ID NO: 529120 - RNA, 20 nt, Chlamydophila pneumoniae J138
uucuuugaagaacaaaaaau

SEQ ID NO: 529121 - RNA, 12 nt, Chlamydophila pneumoniae J138
uucuuucugcuu

SEQ ID NO: 529122 - RNA, 17 nt, Chlamydophila pneumoniae J138
uucuuucuaggccggga

SEQ ID NO: 529123 - RNA, 19 nt, Chlamydophila pneumoniae J138
uucuuucucggucuuucuu

SEQ ID NO: 529124 - RNA, 14 nt, Chlamydophila pneumoniae J138
uucuuucugcucuu

SEQ ID NO: 529125 - RNA, 13 nt, Chlamydophila pneumoniae J138
uugaaauugcucu

SEQ ID NO: 529126 - RNA, 14 nt, Chlamydophila pneumoniae J138
uugaacaugaggau

SEQ ID NO: 529127 - RNA, 20 nt, Chlamydophila pneumoniae J138
uugaaacuuuuuuucuucuc

SEQ ID NO: 529128 - RNA, 21 nt, Chlamydophila pneumoniae J138
uugaaaccguaacugaggcaa

SEQ ID NO: 529129 - RNA, 12 nt, Chlamydophila pneumoniae J138
uucuuuucuaua

SEQ ID NO: 529130 - RNA, 11 nt, Chlamydophila pneumoniae J138
uucuuuuccug

SEQ ID NO: 529131 - RNA, 21 nt, Chlamydophila pneumoniae J138
uucuuuuagcuacuucuucuu

SEQ ID NO: 529132 - RNA, 23 nt, Chlamydophila pneumoniae J138
uugaaugcagcacggaacaaguc

SEQ ID NO: 529133 - RNA, 17 nt, Chlamydophila pneumoniae J138
uugaaucuauagucugu

SEQ ID NO: 529134 - RNA, 19 nt, Chlamydophila pneumoniae J138
uugaauccuucuauagcaa

SEQ ID NO: 529135 - RNA, 21 nt, Chlamydophila pneumoniae J138
uugaaguuuugcucucuagau

SEQ ID NO: 529136 - RNA, 15 nt, Chlamydophila pneumoniae J138
uugaaguucuucaag

SEQ ID NO: 529137 - RNA, 16 nt, Chlamydophila pneumoniae J138
uugaauaaugcauccc

SEQ ID NO: 529138 - RNA, 20 nt, Chlamydophila pneumoniae J138
uugaagaacaaaaaaucaau

SEQ ID NO: 529139 - RNA, 16 nt, Chlamydophila pneumoniae J138
uugaagagcuugcugu

SEQ ID NO: 529140 - RNA, 15 nt, Chlamydophila pneumoniae J138
uugaagaacaaaaaa

SEQ ID NO: 529141 - RNA, 19 nt, Chlamydophila pneumoniae J138
uugacaauaagaaaauccu

SEQ ID NO: 529142 - RNA, 22 nt, Chlamydophila pneumoniae J138
uugacaacgguguucauaauca

SEQ ID NO: 529143 - RNA, 13 nt, Chlamydophila pneumoniae J138
uugaauuuccaaa

SEQ ID NO: 529144 - RNA, 17 nt, Chlamydophila pneumoniae J138
uugaauuuccaaaggaa

SEQ ID NO: 529145 - RNA, 23 nt, Chlamydophila pneumoniae J138
uugaauucauccagauuagaaaa

SEQ ID NO: 529146 - RNA, 14 nt, Chlamydophila pneumoniae J138
uugaccuuuuucau

SEQ ID NO: 529147 - RNA, 23 nt, Chlamydophila pneumoniae J138
uugacuaaauccaccaaugauaa

SEQ ID NO: 529148 - RNA, 12 nt, Chlamydophila pneumoniae J138
uugacugaaacu

SEQ ID NO: 529149 - RNA, 21 nt, Chlamydophila pneumoniae J138
uugaugagaaaaagaaucucu

SEQ ID NO: 529150 - RNA, 19 nt, Chlamydophila pneumoniae J138
uugaugagaaaaagaaucu

SEQ ID NO: 529151 - RNA, 13 nt, Chlamydophila pneumoniae J138
uugaugagaaaaa

SEQ ID NO: 529152 - RNA, 14 nt, Chlamydophila pneumoniae J138
uugauauuguucuu

SEQ ID NO: 529153 - RNA, 19 nt, Chlamydophila pneumoniae J138
uugauaaauucaucggcau

SEQ ID NO: 529154 - RNA, 16 nt, Chlamydophila pneumoniae J138
uugaguugguuuugua

SEQ ID NO: 529155 - RNA, 15 nt, Chlamydophila pneumoniae J138
uugaguugguuuugu

SEQ ID NO: 529156 - RNA, 22 nt, Chlamydophila pneumoniae J138
uugacuuucauaugaaugacug

SEQ ID NO: 529157 - RNA, 15 nt, Chlamydophila pneumoniae J138
uugagaaaagaacag

SEQ ID NO: 529158 - RNA, 12 nt, Chlamydophila pneumoniae J138
uugacuuguccc

SEQ ID NO: 529159 - RNA, 19 nt, Chlamydophila pneumoniae J138
uugagaaauauaacucucu

SEQ ID NO: 529160 - RNA, 22 nt, Chlamydophila pneumoniae J138
uugagaaugaacaauagaaaga

SEQ ID NO: 529161 - RNA, 15 nt, Chlamydophila pneumoniae J138
uugagacgaaagaga

SEQ ID NO: 529162 - RNA, 14 nt, Chlamydophila pneumoniae J138
uugagacaaagaau

SEQ ID NO: 529163 - RNA, 12 nt, Chlamydophila pneumoniae J138
uugauucaaugc

SEQ ID NO: 529164 - RNA, 12 nt, Chlamydophila pneumoniae J138
uugaugagaaaa

SEQ ID NO: 529165 - RNA, 21 nt, Chlamydophila pneumoniae J138
uugauuuugcagugauaaacc

SEQ ID NO: 529166 - RNA, 21 nt, Chlamydophila pneumoniae J138
uugauuggaucuugauaaaag

SEQ ID NO: 529167 - RNA, 15 nt, Chlamydophila pneumoniae J138
uugauugaaacuuuu

SEQ ID NO: 529168 - RNA, 12 nt, Chlamydophila pneumoniae J138
uugauuuuucaa

SEQ ID NO: 529169 - RNA, 17 nt, Chlamydophila pneumoniae J138
uugcaaaaaugaaagaa

SEQ ID NO: 529170 - RNA, 21 nt, Chlamydophila pneumoniae J138
uugcaagagccggaacuucag

SEQ ID NO: 529171 - RNA, 18 nt, Chlamydophila pneumoniae J138
uugcaacaaucuuucuuc

SEQ ID NO: 529172 - RNA, 14 nt, Chlamydophila pneumoniae J138
uugcaauugccaua

SEQ ID NO: 529173 - RNA, 22 nt, Chlamydophila pneumoniae J138
uugccaaucuuccuuaaccucc

SEQ ID NO: 529174 - RNA, 19 nt, Chlamydophila pneumoniae J138
uugccuggggaucuuagga

SEQ ID NO: 529175 - RNA, 23 nt, Chlamydophila pneumoniae J138
uugcuccuccaaaagaccaaaaa

SEQ ID NO: 529176 - RNA, 23 nt, Chlamydophila pneumoniae J138
uugcugaagauuuuuucuugguc

SEQ ID NO: 529177 - RNA, 12 nt, Chlamydophila pneumoniae J138
uugcugaagauu

SEQ ID NO: 529178 - RNA, 14 nt, Chlamydophila pneumoniae J138
uugcugaagauuuu

SEQ ID NO: 529179 - RNA, 14 nt, Chlamydophila pneumoniae J138
uugcugaaaaugau

SEQ ID NO: 529180 - RNA, 13 nt, Chlamydophila pneumoniae J138
uugcucuuuagga

SEQ ID NO: 529181 - RNA, 20 nt, Chlamydophila pneumoniae J138
uugcucuggauguagaggau

SEQ ID NO: 529182 - RNA, 19 nt, Chlamydophila pneumoniae J138
uuccaaugcaugaaucucu

SEQ ID NO: 529183 - RNA, 13 nt, Chlamydophila pneumoniae J138
uuccagaaaucug

SEQ ID NO: 529184 - RNA, 19 nt, Chlamydophila pneumoniae J138
uuccauagguuagaaauga

SEQ ID NO: 529185 - RNA, 23 nt, Chlamydophila pneumoniae J138
uuccauagccaaggagcuauaga

SEQ ID NO: 529186 - RNA, 22 nt, Chlamydophila pneumoniae J138
uuccauagaguaucuaaaacuu

SEQ ID NO: 529187 - RNA, 21 nt, Chlamydophila pneumoniae J138
uuccauaauuuuagcuucuuu

SEQ ID NO: 529188 - RNA, 23 nt, Chlamydophila pneumoniae J138
uuccauaauuuuagcuucuuuuu

SEQ ID NO: 529189 - RNA, 20 nt, Chlamydophila pneumoniae J138
uuccaucgccgaccaucaua

SEQ ID NO: 529190 - RNA, 20 nt, Chlamydophila pneumoniae J138
uuccauccugucuauuucuu

SEQ ID NO: 529191 - RNA, 21 nt, Chlamydophila pneumoniae J138
uuccauuagggcauucuguaa

SEQ ID NO: 529192 - RNA, 19 nt, Chlamydophila pneumoniae J138
uuccauggauauggaaugg

SEQ ID NO: 529193 - RNA, 17 nt, Chlamydophila pneumoniae J138
uuccauuauacuuuuuu

SEQ ID NO: 529194 - RNA, 19 nt, Chlamydophila pneumoniae J138
uuccauuagggcauucugu

SEQ ID NO: 529195 - RNA, 13 nt, Chlamydophila pneumoniae J138
uuccauguagaag

SEQ ID NO: 529196 - RNA, 15 nt, Chlamydophila pneumoniae J138
uuccaggcucuagga

SEQ ID NO: 529197 - RNA, 23 nt, Chlamydophila pneumoniae J138
uucccgaaggggaagaggaaugc

SEQ ID NO: 529198 - RNA, 17 nt, Chlamydophila pneumoniae J138
uuccccaugaaaauaca

SEQ ID NO: 529199 - RNA, 18 nt, Chlamydophila pneumoniae J138
uucccgacucaaucaaau

SEQ ID NO: 529200 - RNA, 15 nt, Chlamydophila pneumoniae J138
uuccauuuucaggcu

SEQ ID NO: 529201 - RNA, 17 nt, Chlamydophila pneumoniae J138
uucccacuaagaaugag

SEQ ID NO: 529202 - RNA, 12 nt, Chlamydophila pneumoniae J138
uuccauuuuucc

SEQ ID NO: 529203 - RNA, 21 nt, Chlamydophila pneumoniae J138
uuccuccgaggagggaaacac

SEQ ID NO: 529204 - RNA, 22 nt, Chlamydophila pneumoniae J138
uuccuauaugaaugauuuccau

SEQ ID NO: 529205 - RNA, 12 nt, Chlamydophila pneumoniae J138
uuccuagagucg

SEQ ID NO: 529206 - RNA, 20 nt, Chlamydophila pneumoniae J138
uuccuaguccucuaugguuu

SEQ ID NO: 529207 - RNA, 21 nt, Chlamydophila pneumoniae J138
uuccuauaugaaugauuucca

SEQ ID NO: 529208 - RNA, 19 nt, Chlamydophila pneumoniae J138
uuccucauccucaucauca

SEQ ID NO: 529209 - RNA, 18 nt, Chlamydophila pneumoniae J138
uuccuacgacaugccuaa

SEQ ID NO: 529210 - RNA, 21 nt, Chlamydophila pneumoniae J138
uuccuacgacaugccuaaaua

SEQ ID NO: 529211 - RNA, 21 nt, Chlamydophila pneumoniae J138
uuccuacaucugugauuaauc

SEQ ID NO: 529212 - RNA, 13 nt, Chlamydophila pneumoniae J138
uuccucuccaaaa

SEQ ID NO: 529213 - RNA, 17 nt, Chlamydophila pneumoniae J138
uuccucucaugaaauuu

SEQ ID NO: 529214 - RNA, 20 nt, Chlamydophila pneumoniae J138
uuccucuaucagggagcgga

SEQ ID NO: 529215 - RNA, 16 nt, Chlamydophila pneumoniae J138
uuccucucaugaaauu

SEQ ID NO: 529216 - RNA, 19 nt, Chlamydophila pneumoniae J138
uuccugcuugauuuccuga

SEQ ID NO: 529217 - RNA, 15 nt, Chlamydophila pneumoniae J138
uuccuuaagucgucc

SEQ ID NO: 529218 - RNA, 23 nt, Chlamydophila pneumoniae J138
uuccuuaagggaagaucugaaau

SEQ ID NO: 529219 - RNA, 15 nt, Chlamydophila pneumoniae J138
uuccuuaaagaguuu

SEQ ID NO: 529220 - RNA, 20 nt, Chlamydophila pneumoniae J138
uucuauuucgucgucauccc

SEQ ID NO: 529221 - RNA, 15 nt, Chlamydophila pneumoniae J138
uucuauuaaaaauag

SEQ ID NO: 529222 - RNA, 13 nt, Chlamydophila pneumoniae J138
uucuauguguucu

SEQ ID NO: 529223 - RNA, 17 nt, Chlamydophila pneumoniae J138
uucuauguguucucgaa

SEQ ID NO: 529224 - RNA, 23 nt, Chlamydophila pneumoniae J138
uucuauacgcuuaacaugaaaag

SEQ ID NO: 529225 - RNA, 17 nt, Chlamydophila pneumoniae J138
uucuauacgaacacaga

SEQ ID NO: 529226 - RNA, 15 nt, Chlamydophila pneumoniae J138
uucuagguauuuguu

SEQ ID NO: 529227 - RNA, 20 nt, Chlamydophila pneumoniae J138
uucuagggaucccaaaaaau

SEQ ID NO: 529228 - RNA, 15 nt, Chlamydophila pneumoniae J138
uucuagcucauuauc

SEQ ID NO: 529229 - RNA, 16 nt, Chlamydophila pneumoniae J138
uucuaggaaucuuuua

SEQ ID NO: 529230 - RNA, 23 nt, Chlamydophila pneumoniae J138
uucuaauguagggggauugauaa

SEQ ID NO: 529231 - RNA, 18 nt, Chlamydophila pneumoniae J138
uucuacauagauccccuu

SEQ ID NO: 529232 - RNA, 21 nt, Chlamydophila pneumoniae J138
uucuacaucccaagggccaga

SEQ ID NO: 529233 - RNA, 23 nt, Chlamydophila pneumoniae J138
uucuacaaugauauaaaagcuga

SEQ ID NO: 529234 - RNA, 22 nt, Chlamydophila pneumoniae J138
uucucgaacaggagagagaagg

SEQ ID NO: 529235 - RNA, 13 nt, Chlamydophila pneumoniae J138
uucucgaaaaauu

SEQ ID NO: 529236 - RNA, 16 nt, Chlamydophila pneumoniae J138
uucucgaagcuugcug

SEQ ID NO: 529237 - RNA, 19 nt, Chlamydophila pneumoniae J138
uucucauagcuuccuguag

SEQ ID NO: 529238 - RNA, 13 nt, Chlamydophila pneumoniae J138
uucucgguuuaag

SEQ ID NO: 529239 - RNA, 15 nt, Chlamydophila pneumoniae J138
uucucgggucuugga

SEQ ID NO: 529240 - RNA, 19 nt, Chlamydophila pneumoniae J138
uucucuaggaacucuuuaa

SEQ ID NO: 529241 - RNA, 18 nt, Chlamydophila pneumoniae J138
uucucuacuaaaaucuca

SEQ ID NO: 529242 - RNA, 21 nt, Chlamydophila pneumoniae J138
uucucuaugacuucuuguccu

SEQ ID NO: 529243 - RNA, 22 nt, Chlamydophila pneumoniae J138
uucugaugacguuaauaaagag

SEQ ID NO: 529244 - RNA, 19 nt, Chlamydophila pneumoniae J138
uucugauccgaaaagaacc

SEQ ID NO: 529245 - RNA, 21 nt, Chlamydophila pneumoniae J138
uucugcaggauuuguagcucc

SEQ ID NO: 529246 - RNA, 20 nt, Chlamydophila pneumoniae J138
uucugcaaucagugcugcca

SEQ ID NO: 529247 - RNA, 14 nt, Chlamydophila pneumoniae J138
uucucucucugcag

SEQ ID NO: 529248 - RNA, 21 nt, Chlamydophila pneumoniae J138
uucucugaacuugauuuguuu

SEQ ID NO: 529249 - RNA, 14 nt, Chlamydophila pneumoniae J138
uucucugagcagcu

SEQ ID NO: 529250 - RNA, 22 nt, Chlamydophila pneumoniae J138
uucucuccacaggaaugaaacc

SEQ ID NO: 529251 - RNA, 18 nt, Chlamydophila pneumoniae J138
uucucuguugggagcuuc

SEQ ID NO: 529252 - RNA, 22 nt, Chlamydophila pneumoniae J138
uucucuguaucgauaacgauuu

SEQ ID NO: 529253 - RNA, 17 nt, Chlamydophila pneumoniae J138
uuccuuuuucugcuucu

SEQ ID NO: 529254 - RNA, 14 nt, Chlamydophila pneumoniae J138
uuccuuuugauaaa

SEQ ID NO: 529255 - RNA, 22 nt, Chlamydophila pneumoniae J138
uuccuuggauuucuucuucuaa

SEQ ID NO: 529256 - RNA, 15 nt, Chlamydophila pneumoniae J138
uuccuuggucuuauu

SEQ ID NO: 529257 - RNA, 20 nt, Chlamydophila pneumoniae J138
uucgcacuaauuuccuucag

SEQ ID NO: 529258 - RNA, 16 nt, Chlamydophila pneumoniae J138
uucgcacuaauuuccu

SEQ ID NO: 529259 - RNA, 17 nt, Chlamydophila pneumoniae J138
uucgcacuaauuuccuu

SEQ ID NO: 529260 - RNA, 17 nt, Chlamydophila pneumoniae J138
uucgaaaaacgguaaau

SEQ ID NO: 529261 - RNA, 19 nt, Chlamydophila pneumoniae J138
uucgccuuggguuugucuc

SEQ ID NO: 529262 - RNA, 18 nt, Chlamydophila pneumoniae J138
uucguggaacuuucuggg

SEQ ID NO: 529263 - RNA, 22 nt, Chlamydophila pneumoniae J138
uucgugugcacccaaucgguau

SEQ ID NO: 529264 - RNA, 17 nt, Chlamydophila pneumoniae J138
uucguggagugcucuac

SEQ ID NO: 529265 - RNA, 21 nt, Chlamydophila pneumoniae J138
uucuaaaucccgccuuucuac

SEQ ID NO: 529266 - RNA, 12 nt, Chlamydophila pneumoniae J138
uucuaagauucc

SEQ ID NO: 529267 - RNA, 23 nt, Chlamydophila pneumoniae J138
uucuaagauuccuaacuucugaa

SEQ ID NO: 529268 - RNA, 19 nt, Chlamydophila pneumoniae J138
uucuaagcaauauuucugu

SEQ ID NO: 529269 - RNA, 18 nt, Chlamydophila pneumoniae J138
uucuaagcuuauuucugu

SEQ ID NO: 529270 - RNA, 20 nt, Chlamydophila pneumoniae J138
uucuaacuguacacuuucaa

SEQ ID NO: 529271 - RNA, 20 nt, Chlamydophila pneumoniae J138
uucguaacgcuuuucuaaua

SEQ ID NO: 529272 - RNA, 23 nt, Chlamydophila pneumoniae J138
uucguaagcugagguagcaucuc

SEQ ID NO: 529273 - RNA, 12 nt, Chlamydophila pneumoniae J138
uggacuccaaga

SEQ ID NO: 529274 - RNA, 16 nt, Chlamydophila pneumoniae J138
uggacucuagggucaa

SEQ ID NO: 529275 - RNA, 20 nt, Chlamydophila pneumoniae J138
uggacucuagggucaagaac

SEQ ID NO: 529276 - RNA, 21 nt, Chlamydophila pneumoniae J138
uggacugcugacaucuccaag

SEQ ID NO: 529277 - RNA, 21 nt, Chlamydophila pneumoniae J138
uggacuucugguuuuucgauu

SEQ ID NO: 529278 - RNA, 20 nt, Chlamydophila pneumoniae J138
uggagaauaaucucuuucau

SEQ ID NO: 529279 - RNA, 20 nt, Chlamydophila pneumoniae J138
uggagacuaggguaaguccc

SEQ ID NO: 529280 - RNA, 17 nt, Chlamydophila pneumoniae J138
uggacguacuaagauac

SEQ ID NO: 529281 - RNA, 18 nt, Chlamydophila pneumoniae J138
uggacgugguaagguuau

SEQ ID NO: 529282 - RNA, 21 nt, Chlamydophila pneumoniae J138
uggaggcgguggcaugccaua

SEQ ID NO: 529283 - RNA, 15 nt, Chlamydophila pneumoniae J138
uggaggccaaagaac

SEQ ID NO: 529284 - RNA, 16 nt, Chlamydophila pneumoniae J138
uggagcagaaacucca

SEQ ID NO: 529285 - RNA, 16 nt, Chlamydophila pneumoniae J138
uggaugcuaauaaaau

SEQ ID NO: 529286 - RNA, 15 nt, Chlamydophila pneumoniae J138
uggauccuucaucag

SEQ ID NO: 529287 - RNA, 21 nt, Chlamydophila pneumoniae J138
uggauccuucaucagcuuccc

SEQ ID NO: 529288 - RNA, 21 nt, Chlamydophila pneumoniae J138
uggauccaucggcauuucucc

SEQ ID NO: 529289 - RNA, 13 nt, Chlamydophila pneumoniae J138
uggaucauucuuu

SEQ ID NO: 529290 - RNA, 18 nt, Chlamydophila pneumoniae J138
uggaucacguaagcuuua

SEQ ID NO: 529291 - RNA, 22 nt, Chlamydophila pneumoniae J138
uggaguaucuagcuuugucucu

SEQ ID NO: 529292 - RNA, 16 nt, Chlamydophila pneumoniae J138
uggauagaagcaugaa

SEQ ID NO: 529293 - RNA, 18 nt, Chlamydophila pneumoniae J138
uggauacguuuuucccuu

SEQ ID NO: 529294 - RNA, 17 nt, Chlamydophila pneumoniae J138
uggauaccggcaaauaa

SEQ ID NO: 529295 - RNA, 16 nt, Chlamydophila pneumoniae J138
uggauaccggcaaaua

SEQ ID NO: 529296 - RNA, 16 nt, Chlamydophila pneumoniae J138
uggauacguuuuuccc

SEQ ID NO: 529297 - RNA, 18 nt, Chlamydophila pneumoniae J138
uggauaucguagacaaca

SEQ ID NO: 529298 - RNA, 21 nt, Chlamydophila pneumoniae J138
uggauuuuaaagcaaaaauuc

SEQ ID NO: 529299 - RNA, 13 nt, Chlamydophila pneumoniae J138
uggcaaggaaaau

SEQ ID NO: 529300 - RNA, 16 nt, Chlamydophila pneumoniae J138
uggcauaauccugaau

SEQ ID NO: 529301 - RNA, 14 nt, Chlamydophila pneumoniae J138
uggcauagagccua

SEQ ID NO: 529302 - RNA, 14 nt, Chlamydophila pneumoniae J138
uggcaucuaagcca

SEQ ID NO: 529303 - RNA, 18 nt, Chlamydophila pneumoniae J138
uggcauugccauaauaaa

SEQ ID NO: 529304 - RNA, 18 nt, Chlamydophila pneumoniae J138
uggcauucuuuuucuauu

SEQ ID NO: 529305 - RNA, 17 nt, Chlamydophila pneumoniae J138
uggcauucuuuuucuau

SEQ ID NO: 529306 - RNA, 13 nt, Chlamydophila pneumoniae J138
uggcauucuuuuu

SEQ ID NO: 529307 - RNA, 20 nt, Chlamydophila pneumoniae J138
uggcuauagauacuuugcaa

SEQ ID NO: 529308 - RNA, 14 nt, Chlamydophila pneumoniae J138
uggcuauggaagau

SEQ ID NO: 529309 - RNA, 13 nt, Chlamydophila pneumoniae J138
uggcguaauaauu

SEQ ID NO: 529310 - RNA, 21 nt, Chlamydophila pneumoniae J138
uggcguuuucuagaaaagauu

SEQ ID NO: 529311 - RNA, 14 nt, Chlamydophila pneumoniae J138
uggcuaaaggauca

SEQ ID NO: 529312 - RNA, 17 nt, Chlamydophila pneumoniae J138
uggcucuagaaauauac

SEQ ID NO: 529313 - RNA, 14 nt, Chlamydophila pneumoniae J138
uggcucuauagggg

SEQ ID NO: 529314 - RNA, 22 nt, Chlamydophila pneumoniae J138
ugggaauuugauuuuucaaauu

SEQ ID NO: 529315 - RNA, 22 nt, Chlamydophila pneumoniae J138
ugggaaugcgcaggcaauuuuu

SEQ ID NO: 529316 - RNA, 19 nt, Chlamydophila pneumoniae J138
ugggaagacucucaucagc

SEQ ID NO: 529317 - RNA, 12 nt, Chlamydophila pneumoniae J138
ugggaagacucu

SEQ ID NO: 529318 - RNA, 21 nt, Chlamydophila pneumoniae J138
ugggaagccuggaaaugaaua

SEQ ID NO: 529319 - RNA, 15 nt, Chlamydophila pneumoniae J138
uggggaaauuaaauu

SEQ ID NO: 529320 - RNA, 23 nt, Chlamydophila pneumoniae J138
uggggaaauuaaauucuuuucua

SEQ ID NO: 529321 - RNA, 18 nt, Chlamydophila pneumoniae J138
uggguaaggcgaaaucuu

SEQ ID NO: 529322 - RNA, 21 nt, Chlamydophila pneumoniae J138
uggugacucuagccaccaaca

SEQ ID NO: 529323 - RNA, 17 nt, Chlamydophila pneumoniae J138
uggugacucuagccacc

SEQ ID NO: 529324 - RNA, 19 nt, Chlamydophila pneumoniae J138
uggucucuauuuagaccaa

SEQ ID NO: 529325 - RNA, 23 nt, Chlamydophila pneumoniae J138
ugguuaaaacccauguuucuucc

SEQ ID NO: 529326 - RNA, 22 nt, Chlamydophila pneumoniae J138
ugguguucuucagcccacuguu

SEQ ID NO: 529327 - RNA, 20 nt, Chlamydophila pneumoniae J138
ugguguauaguauuuuuaaa

SEQ ID NO: 529328 - RNA, 21 nt, Chlamydophila pneumoniae J138
ugguguauaguauuuuuaaau

SEQ ID NO: 529329 - RNA, 17 nt, Chlamydophila pneumoniae J138
uguaagacuaaaaaaga

SEQ ID NO: 529330 - RNA, 18 nt, Chlamydophila pneumoniae J138
uguaagacuaaaaaagag

SEQ ID NO: 529331 - RNA, 17 nt, Chlamydophila pneumoniae J138
uguaaaugucgguuugu

SEQ ID NO: 529332 - RNA, 13 nt, Chlamydophila pneumoniae J138
uguaauaaaagaa

SEQ ID NO: 529333 - RNA, 18 nt, Chlamydophila pneumoniae J138
uguaauaaaagaacauua

SEQ ID NO: 529334 - RNA, 14 nt, Chlamydophila pneumoniae J138
uguaaguuacggaa

SEQ ID NO: 529335 - RNA, 19 nt, Chlamydophila pneumoniae J138
uguaaguuacggaacucau

SEQ ID NO: 529336 - RNA, 17 nt, Chlamydophila pneumoniae J138
uguaauagcaggaguuu

SEQ ID NO: 529337 - RNA, 22 nt, Chlamydophila pneumoniae J138
uguaauuuccuuagaagggaaa

SEQ ID NO: 529338 - RNA, 21 nt, Chlamydophila pneumoniae J138
uguacuagauaguucacaagu

SEQ ID NO: 529339 - RNA, 21 nt, Chlamydophila pneumoniae J138
uguaaauacaaaacaaaagcc

SEQ ID NO: 529340 - RNA, 21 nt, Chlamydophila pneumoniae J138
ugguugcuucuaagaaacuuc

SEQ ID NO: 529341 - RNA, 21 nt, Chlamydophila pneumoniae J138
uguccuccauggaaagaaaca

SEQ ID NO: 529342 - RNA, 23 nt, Chlamydophila pneumoniae J138
uguccaugcacgagauucuugag

SEQ ID NO: 529343 - RNA, 18 nt, Chlamydophila pneumoniae J138
ugucacaauaccaucucu

SEQ ID NO: 529344 - RNA, 15 nt, Chlamydophila pneumoniae J138
uguauuguacuuuuu

SEQ ID NO: 529345 - RNA, 13 nt, Chlamydophila pneumoniae J138
uguauugggaaug

SEQ ID NO: 529346 - RNA, 18 nt, Chlamydophila pneumoniae J138
uguauucagugucuugaa

SEQ ID NO: 529347 - RNA, 15 nt, Chlamydophila pneumoniae J138
uguauccagcucaag

SEQ ID NO: 529348 - RNA, 18 nt, Chlamydophila pneumoniae J138
uguauccagcucaaggca

SEQ ID NO: 529349 - RNA, 18 nt, Chlamydophila pneumoniae J138
uguauccguagugagguu

SEQ ID NO: 529350 - RNA, 17 nt, Chlamydophila pneumoniae J138
uguaucuagggacuucu

SEQ ID NO: 529351 - RNA, 19 nt, Chlamydophila pneumoniae J138
uguagcauuucuuucucuu

SEQ ID NO: 529352 - RNA, 14 nt, Chlamydophila pneumoniae J138
uguagcagagccuc

SEQ ID NO: 529353 - RNA, 14 nt, Chlamydophila pneumoniae J138
uguagccuuucuuu

SEQ ID NO: 529354 - RNA, 13 nt, Chlamydophila pneumoniae J138
uguagcacuucuc

SEQ ID NO: 529355 - RNA, 12 nt, Chlamydophila pneumoniae J138
uguagauuuucc

SEQ ID NO: 529356 - RNA, 17 nt, Chlamydophila pneumoniae J138
uguccuguuaagaugug

SEQ ID NO: 529357 - RNA, 18 nt, Chlamydophila pneumoniae J138
ugucgcuuuugcuagaga

SEQ ID NO: 529358 - RNA, 12 nt, Chlamydophila pneumoniae J138
ugucgcaaaugc

SEQ ID NO: 529359 - RNA, 13 nt, Chlamydophila pneumoniae J138
ugucgcaaaugca

SEQ ID NO: 529360 - RNA, 13 nt, Chlamydophila pneumoniae J138
ugucguuaaaaac

SEQ ID NO: 529361 - RNA, 14 nt, Chlamydophila pneumoniae J138
ugucuaaagauugg

SEQ ID NO: 529362 - RNA, 22 nt, Chlamydophila pneumoniae J138
ugugcacccaaucgguaugaua

SEQ ID NO: 529363 - RNA, 20 nt, Chlamydophila pneumoniae J138
ugugauccuugcaaaacagc

SEQ ID NO: 529364 - RNA, 15 nt, Chlamydophila pneumoniae J138
ugugauguucugcug

SEQ ID NO: 529365 - RNA, 23 nt, Chlamydophila pneumoniae J138
ugucuugcuuugugaguucuucc

SEQ ID NO: 529366 - RNA, 20 nt, Chlamydophila pneumoniae J138
ugucugauuaguucucuaag

SEQ ID NO: 529367 - RNA, 16 nt, Chlamydophila pneumoniae J138
ugucugaguuagcuuu

SEQ ID NO: 529368 - RNA, 14 nt, Chlamydophila pneumoniae J138
ugugauauucuugg

SEQ ID NO: 529369 - RNA, 23 nt, Chlamydophila pneumoniae J138
ugcucguauuagaguuucuuuug

SEQ ID NO: 529370 - RNA, 15 nt, Chlamydophila pneumoniae J138
ugcucggacagaaag

SEQ ID NO: 529371 - RNA, 15 nt, Chlamydophila pneumoniae J138
ugcucucuaaagcuu

SEQ ID NO: 529372 - RNA, 17 nt, Chlamydophila pneumoniae J138
ugcucucuacuucugua

SEQ ID NO: 529373 - RNA, 22 nt, Chlamydophila pneumoniae J138
ugcucuuuuaacuuaaagacuu

SEQ ID NO: 529374 - RNA, 16 nt, Chlamydophila pneumoniae J138
ugcucuaccaacugag

SEQ ID NO: 529375 - RNA, 16 nt, Chlamydophila pneumoniae J138
ugcucucuucuucuca

SEQ ID NO: 529376 - RNA, 20 nt, Chlamydophila pneumoniae J138
ugcugccaugacauaggcaa

SEQ ID NO: 529377 - RNA, 18 nt, Chlamydophila pneumoniae J138
ugcugauuucuuuuucag

SEQ ID NO: 529378 - RNA, 23 nt, Chlamydophila pneumoniae J138
ugcugcagcaaaacuaggaaaag

SEQ ID NO: 529379 - RNA, 14 nt, Chlamydophila pneumoniae J138
ugcugaagggacag

SEQ ID NO: 529380 - RNA, 14 nt, Chlamydophila pneumoniae J138
ugcucuuuugcaag

SEQ ID NO: 529381 - RNA, 16 nt, Chlamydophila pneumoniae J138
ugcugacaucuccaag

SEQ ID NO: 529382 - RNA, 21 nt, Chlamydophila pneumoniae J138
ugcugaggacgcagagaugcu

SEQ ID NO: 529383 - RNA, 15 nt, Chlamydophila pneumoniae J138
aaauguaagaaggca

SEQ ID NO: 529384 - RNA, 17 nt, Chlamydophila pneumoniae J138
aaauguauaggcauuaa

SEQ ID NO: 529385 - RNA, 10 nt, Chlamydophila pneumoniae J138
aaauguaggg

SEQ ID NO: 529386 - RNA, 21 nt, Chlamydophila pneumoniae J138
ugcugcuuccccuaauagggg

SEQ ID NO: 529387 - RNA, 14 nt, Chlamydophila pneumoniae J138
ugcugcuucagaaa

SEQ ID NO: 529388 - RNA, 13 nt, Chlamydophila pneumoniae J138
ugcugcucuccaa

SEQ ID NO: 529389 - RNA, 17 nt, Chlamydophila pneumoniae J138
ugcugcuaaacagggaa

SEQ ID NO: 529390 - RNA, 18 nt, Chlamydophila pneumoniae J138
ugcugggggagcuagaaa

SEQ ID NO: 529391 - RNA, 12 nt, Chlamydophila pneumoniae J138
ugcugucagaac

SEQ ID NO: 529392 - RNA, 14 nt, Chlamydophila pneumoniae J138
ugcugucagaacaa

SEQ ID NO: 529393 - RNA, 15 nt, Chlamydophila pneumoniae J138
ugcugucagaacaag

SEQ ID NO: 529394 - RNA, 17 nt, Chlamydophila pneumoniae J138
ugcuguuguaauaaaag

SEQ ID NO: 529395 - RNA, 13 nt, Chlamydophila pneumoniae J138
ugcuguuguaaua

SEQ ID NO: 529396 - RNA, 16 nt, Chlamydophila pneumoniae J138
ugcuguuucuauuagc

SEQ ID NO: 529397 - RNA, 17 nt, Chlamydophila pneumoniae J138
ugcuucuauuuuagaau

SEQ ID NO: 529398 - RNA, 23 nt, Chlamydophila pneumoniae J138
ugcuucuccaaauaaagcaacug

SEQ ID NO: 529399 - RNA, 11 nt, Chlamydophila pneumoniae J138
ugcuucuucag

SEQ ID NO: 529400 - RNA, 18 nt, Chlamydophila pneumoniae J138
ugcuucuguaaagauucu

SEQ ID NO: 529401 - RNA, 18 nt, Chlamydophila pneumoniae J138
ugcuucgggaucuaaaag

SEQ ID NO: 529402 - RNA, 22 nt, Chlamydophila pneumoniae J138
ugcuuauuuccccgaacaaauu

SEQ ID NO: 529403 - RNA, 19 nt, Chlamydophila pneumoniae J138
ugcuuaagaguuuuacauc

SEQ ID NO: 529404 - RNA, 15 nt, Chlamydophila pneumoniae J138
ugcuuagcaaaggca

SEQ ID NO: 529405 - RNA, 22 nt, Chlamydophila pneumoniae J138
ugcuuguauaaaugcuguagau

SEQ ID NO: 529406 - RNA, 17 nt, Chlamydophila pneumoniae J138
ugcuuguauaaaugcug

SEQ ID NO: 529407 - RNA, 14 nt, Chlamydophila pneumoniae J138
ugcuuguugguuaa

SEQ ID NO: 529408 - RNA, 20 nt, Chlamydophila pneumoniae J138
ugcuuguugguuaaaauaga

SEQ ID NO: 529409 - RNA, 20 nt, Chlamydophila pneumoniae J138
ugcuuuauggcucaacuuaa

SEQ ID NO: 529410 - RNA, 23 nt, Chlamydophila pneumoniae J138
ugcuuucaggaguucuugauucu

SEQ ID NO: 529411 - RNA, 22 nt, Chlamydophila pneumoniae J138
ugcuuugugaguucuuccuucu

SEQ ID NO: 529412 - RNA, 13 nt, Chlamydophila pneumoniae J138
ugcuuuuccuucu

SEQ ID NO: 529413 - RNA, 12 nt, Chlamydophila pneumoniae J138
ugcuuuucaaau

SEQ ID NO: 529414 - RNA, 15 nt, Chlamydophila pneumoniae J138
ugcuuuuugaaugau

SEQ ID NO: 529415 - RNA, 18 nt, Chlamydophila pneumoniae J138
uggaaacuuuuccaaauu

SEQ ID NO: 529416 - RNA, 23 nt, Chlamydophila pneumoniae J138
uggaaaucaccagcauuaagaua

SEQ ID NO: 529417 - RNA, 15 nt, Chlamydophila pneumoniae J138
uggaaauagagaaac

SEQ ID NO: 529418 - RNA, 16 nt, Chlamydophila pneumoniae J138
uggaaauugugaaaaa

SEQ ID NO: 529419 - RNA, 15 nt, Chlamydophila pneumoniae J138
uggaaauugugaaaa

SEQ ID NO: 529420 - RNA, 22 nt, Chlamydophila pneumoniae J138
uggaacaguauaaucagaagug

SEQ ID NO: 529421 - RNA, 19 nt, Chlamydophila pneumoniae J138
uggaacgcauaagagacau

SEQ ID NO: 529422 - RNA, 18 nt, Chlamydophila pneumoniae J138
uggaagauaaacauacau

SEQ ID NO: 529423 - RNA, 19 nt, Chlamydophila pneumoniae J138
uggaaugccaaauccuccg

SEQ ID NO: 529424 - RNA, 18 nt, Chlamydophila pneumoniae J138
uggaaugacuaaaugcga

SEQ ID NO: 529425 - RNA, 15 nt, Chlamydophila pneumoniae J138
uggaaucuaugaaua

SEQ ID NO: 529426 - RNA, 19 nt, Chlamydophila pneumoniae J138
uggaauucaaacuccuuuu

SEQ ID NO: 529427 - RNA, 23 nt, Chlamydophila pneumoniae J138
uggaauucaaacuccuuuuaaaa

SEQ ID NO: 529428 - RNA, 23 nt, Chlamydophila pneumoniae J138
uggaauggcuuuuguuuuguauu

SEQ ID NO: 529429 - RNA, 13 nt, Chlamydophila pneumoniae J138
uggaauugcauua

SEQ ID NO: 529430 - RNA, 20 nt, Chlamydophila pneumoniae J138
uggaauaucaggacaaugaa

SEQ ID NO: 529431 - RNA, 19 nt, Chlamydophila pneumoniae J138
uggaauauagguuuagauu

SEQ ID NO: 529432 - RNA, 19 nt, Chlamydophila pneumoniae J138
uggaaguaaucuggaagca

SEQ ID NO: 529433 - RNA, 23 nt, Chlamydophila pneumoniae J138
uggacagcggccacaugaagucc

SEQ ID NO: 529434 - RNA, 18 nt, Chlamydophila pneumoniae J138
uggacaacgcuucuuuuu

SEQ ID NO: 529435 - RNA, 15 nt, Chlamydophila pneumoniae J138
ugcggccacauuaag

SEQ ID NO: 529436 - RNA, 15 nt, Chlamydophila pneumoniae J138
ugcggcuaauuucaa

SEQ ID NO: 529437 - RNA, 18 nt, Chlamydophila pneumoniae J138
ugcggcuccuacaguccu

SEQ ID NO: 529438 - RNA, 12 nt, Chlamydophila pneumoniae J138
ugcguuuccaug

SEQ ID NO: 529439 - RNA, 18 nt, Chlamydophila pneumoniae J138
ugcuagagcuuucagaaa

SEQ ID NO: 529440 - RNA, 21 nt, Chlamydophila pneumoniae J138
ugcuagaucuggagagggaag

SEQ ID NO: 529441 - RNA, 12 nt, Chlamydophila pneumoniae J138
ugcuauacagaa

SEQ ID NO: 529442 - RNA, 12 nt, Chlamydophila pneumoniae J138
ugcuaucuccag

SEQ ID NO: 529443 - RNA, 21 nt, Chlamydophila pneumoniae J138
ugcuaucauaacguauuucac

SEQ ID NO: 529444 - RNA, 21 nt, Chlamydophila pneumoniae J138
ugcuauagcuggaucuucuga

SEQ ID NO: 529445 - RNA, 19 nt, Chlamydophila pneumoniae J138
ugcuaagaucuuuagaaua

SEQ ID NO: 529446 - RNA, 17 nt, Chlamydophila pneumoniae J138
ugcuaagccaaauacca

SEQ ID NO: 529447 - RNA, 13 nt, Chlamydophila pneumoniae J138
ugcuaacaacucc

SEQ ID NO: 529448 - RNA, 13 nt, Chlamydophila pneumoniae J138
ugcuaaauuuguc

SEQ ID NO: 529449 - RNA, 20 nt, Chlamydophila pneumoniae J138
ugcuaaacuuuuuuucaaau

SEQ ID NO: 529450 - RNA, 23 nt, Chlamydophila pneumoniae J138
ugcuaaacuuuuuuucaaaucau

SEQ ID NO: 529451 - RNA, 19 nt, Chlamydophila pneumoniae J138
ugcuaaagagucuuccuag

SEQ ID NO: 529452 - RNA, 13 nt, Chlamydophila pneumoniae J138
ugcuaaacaaugc

SEQ ID NO: 529453 - RNA, 17 nt, Chlamydophila pneumoniae J138
ugcuacaaacucuucca

SEQ ID NO: 529454 - RNA, 13 nt, Chlamydophila pneumoniae J138
ugcuacaaacucu

SEQ ID NO: 529455 - RNA, 15 nt, Chlamydophila pneumoniae J138
ugcuacaaacucuuc

SEQ ID NO: 529456 - RNA, 22 nt, Chlamydophila pneumoniae J138
ugcuaauccagcaacaaccaaa

SEQ ID NO: 529457 - RNA, 17 nt, Chlamydophila pneumoniae J138
ugcuacagcuucuuuuc

SEQ ID NO: 529458 - RNA, 21 nt, Chlamydophila pneumoniae J138
ugcuacagcuucuuuuccagc

SEQ ID NO: 529459 - RNA, 20 nt, Chlamydophila pneumoniae J138
ugcucaggagauacaaguaa

SEQ ID NO: 529460 - RNA, 20 nt, Chlamydophila pneumoniae J138
ugcucaauacagauaucaaa

SEQ ID NO: 529461 - RNA, 21 nt, Chlamydophila pneumoniae J138
ugcucccuccuccucgucuaa

SEQ ID NO: 529462 - RNA, 11 nt, Chlamydophila pneumoniae J138
ugcuccugaag

SEQ ID NO: 529463 - RNA, 14 nt, Chlamydophila pneumoniae J138
ugcuccuccaaaag

SEQ ID NO: 529464 - RNA, 14 nt, Chlamydophila pneumoniae J138
ugcuccugaagcug

SEQ ID NO: 529465 - RNA, 22 nt, Chlamydophila pneumoniae J138
ugcuccaauuuucuucagcacu

SEQ ID NO: 529466 - RNA, 16 nt, Chlamydophila pneumoniae J138
ugccuuuagggaaaaa

SEQ ID NO: 529467 - RNA, 15 nt, Chlamydophila pneumoniae J138
ugcgacaaaaaugcc

SEQ ID NO: 529468 - RNA, 22 nt, Chlamydophila pneumoniae J138
ugcgaggaaaaaggaggauguu

SEQ ID NO: 529469 - RNA, 22 nt, Chlamydophila pneumoniae J138
ugcgagguaugaauaggaauga

SEQ ID NO: 529470 - RNA, 16 nt, Chlamydophila pneumoniae J138
ugccagagauucuuca

SEQ ID NO: 529471 - RNA, 13 nt, Chlamydophila pneumoniae J138
ugccuuaugcuca

SEQ ID NO: 529472 - RNA, 13 nt, Chlamydophila pneumoniae J138
ugccuucuucuug

SEQ ID NO: 529473 - RNA, 20 nt, Chlamydophila pneumoniae J138
ugccuuacgaacuauagcaa

SEQ ID NO: 529474 - RNA, 17 nt, Chlamydophila pneumoniae J138
ugccugaagauggcaag

SEQ ID NO: 529475 - RNA, 18 nt, Chlamydophila pneumoniae J138
ugccugccaauccaaugg

SEQ ID NO: 529476 - RNA, 18 nt, Chlamydophila pneumoniae J138
ugccucuuucauacuaaa

SEQ ID NO: 529477 - RNA, 14 nt, Chlamydophila pneumoniae J138
ugauuuuaaaauga

SEQ ID NO: 529478 - RNA, 12 nt, Chlamydophila pneumoniae J138
ugaugagaaaaa

SEQ ID NO: 529479 - RNA, 23 nt, Chlamydophila pneumoniae J138
ugauucccggaggcaaagaucag

SEQ ID NO: 529480 - RNA, 15 nt, Chlamydophila pneumoniae J138
ugauucccuccuucc

SEQ ID NO: 529481 - RNA, 15 nt, Chlamydophila pneumoniae J138
ugauuccgcaaguaa

SEQ ID NO: 529482 - RNA, 14 nt, Chlamydophila pneumoniae J138
ugcaaagcccauac

SEQ ID NO: 529483 - RNA, 19 nt, Chlamydophila pneumoniae J138
ugcaaagcccccuccccca

SEQ ID NO: 529484 - RNA, 16 nt, Chlamydophila pneumoniae J138
ugcaaagcaucuugua

SEQ ID NO: 529485 - RNA, 14 nt, Chlamydophila pneumoniae J138
ugcaaaggaaggga

SEQ ID NO: 529486 - RNA, 11 nt, Chlamydophila pneumoniae J138
ugcaaaguacu

SEQ ID NO: 529487 - RNA, 17 nt, Chlamydophila pneumoniae J138
ugcaaaguacuacaaua

SEQ ID NO: 529488 - RNA, 14 nt, Chlamydophila pneumoniae J138
ugcaaauaagccag

SEQ ID NO: 529489 - RNA, 17 nt, Chlamydophila pneumoniae J138
ugcaaaaaugaaagaaa

SEQ ID NO: 529490 - RNA, 12 nt, Chlamydophila pneumoniae J138
ugcaaaauuuaa

SEQ ID NO: 529491 - RNA, 17 nt, Chlamydophila pneumoniae J138
ugcaaacugaucugaaa

SEQ ID NO: 529492 - RNA, 15 nt, Chlamydophila pneumoniae J138
ugcaaacgcaaugau

SEQ ID NO: 529493 - RNA, 18 nt, Chlamydophila pneumoniae J138
ugcaaacacaauuguaaa

SEQ ID NO: 529494 - RNA, 19 nt, Chlamydophila pneumoniae J138
ugauuuuucaaucaauaaa

SEQ ID NO: 529495 - RNA, 18 nt, Chlamydophila pneumoniae J138
ugauuuuugcuaagagcu

SEQ ID NO: 529496 - RNA, 19 nt, Chlamydophila pneumoniae J138
ugauuuuugcuaagagcuc

SEQ ID NO: 529497 - RNA, 21 nt, Chlamydophila pneumoniae J138
ugauuuuugcuaagagcucuu

SEQ ID NO: 529498 - RNA, 23 nt, Chlamydophila pneumoniae J138
ugcaaaaaaccagccaauaacau

SEQ ID NO: 529499 - RNA, 18 nt, Chlamydophila pneumoniae J138
ugcaaaaaguuucaaucu

SEQ ID NO: 529500 - RNA, 19 nt, Chlamydophila pneumoniae J138
ugauuuuuugaauccuguu

SEQ ID NO: 529501 - RNA, 12 nt, Chlamydophila pneumoniae J138
ugcaaauuucau

SEQ ID NO: 529502 - RNA, 12 nt, Chlamydophila pneumoniae J138
ugcaacaaaagg

SEQ ID NO: 529503 - RNA, 19 nt, Chlamydophila pneumoniae J138
ugcaaccacacaggauugu

SEQ ID NO: 529504 - RNA, 18 nt, Chlamydophila pneumoniae J138
ugcaaccuguaaagacca

SEQ ID NO: 529505 - RNA, 19 nt, Chlamydophila pneumoniae J138
ugcaacggagaaauuugug

SEQ ID NO: 529506 - RNA, 21 nt, Chlamydophila pneumoniae J138
ugcaaggcaagaugugcucga

SEQ ID NO: 529507 - RNA, 14 nt, Chlamydophila pneumoniae J138
ugcaaggcaaugau

SEQ ID NO: 529508 - RNA, 19 nt, Chlamydophila pneumoniae J138
ugcaagcagauagagcuuc

SEQ ID NO: 529509 - RNA, 23 nt, Chlamydophila pneumoniae J138
ugcaagauuaucuuuacgaauca

SEQ ID NO: 529510 - RNA, 20 nt, Chlamydophila pneumoniae J138
ugcaagagcccuugugcauc

SEQ ID NO: 529511 - RNA, 19 nt, Chlamydophila pneumoniae J138
ugcaaguuugaaugcagca

SEQ ID NO: 529512 - RNA, 17 nt, Chlamydophila pneumoniae J138
ugcaagugcuuucagga

SEQ ID NO: 529513 - RNA, 17 nt, Chlamydophila pneumoniae J138
ugcaaggccuaaucuug

SEQ ID NO: 529514 - RNA, 22 nt, Chlamydophila pneumoniae J138
ugcaagguucugcgaaacaacu

SEQ ID NO: 529515 - RNA, 20 nt, Chlamydophila pneumoniae J138
ugcaauucuucaugcugcuu

SEQ ID NO: 529516 - RNA, 15 nt, Chlamydophila pneumoniae J138
ugcacacauccugga

SEQ ID NO: 529517 - RNA, 16 nt, Chlamydophila pneumoniae J138
ugcacaaucgcaucaa

SEQ ID NO: 529518 - RNA, 23 nt, Chlamydophila pneumoniae J138
ugcacuugcgguuuuggauagaa

SEQ ID NO: 529519 - RNA, 13 nt, Chlamydophila pneumoniae J138
ugcagaucauauc

SEQ ID NO: 529520 - RNA, 13 nt, Chlamydophila pneumoniae J138
ugcagaucuuuua

SEQ ID NO: 529521 - RNA, 22 nt, Chlamydophila pneumoniae J138
ugcagcagauaccaaaauacca

SEQ ID NO: 529522 - RNA, 16 nt, Chlamydophila pneumoniae J138
ugcagcagaugaaacu

SEQ ID NO: 529523 - RNA, 16 nt, Chlamydophila pneumoniae J138
ugcaguugaugagaaa

SEQ ID NO: 529524 - RNA, 19 nt, Chlamydophila pneumoniae J138
ugcaguuccgauaaagaua

SEQ ID NO: 529525 - RNA, 20 nt, Chlamydophila pneumoniae J138
ugcauacccuucuucuucag

SEQ ID NO: 529526 - RNA, 20 nt, Chlamydophila pneumoniae J138
ugcauacuggcccagauucu

SEQ ID NO: 529527 - RNA, 16 nt, Chlamydophila pneumoniae J138
ugcauagaauaaagau

SEQ ID NO: 529528 - RNA, 19 nt, Chlamydophila pneumoniae J138
ugcagcuaacgaagccuca

SEQ ID NO: 529529 - RNA, 22 nt, Chlamydophila pneumoniae J138
ugcagucguauucagguucuga

SEQ ID NO: 529530 - RNA, 16 nt, Chlamydophila pneumoniae J138
ugcaucucuuaaaaca

SEQ ID NO: 529531 - RNA, 17 nt, Chlamydophila pneumoniae J138
ugcaucucuuaaaacau

SEQ ID NO: 529532 - RNA, 14 nt, Chlamydophila pneumoniae J138
ugcaucucugcaua

SEQ ID NO: 529533 - RNA, 22 nt, Chlamydophila pneumoniae J138
ugcauuaucuaagaauauggac

SEQ ID NO: 529534 - RNA, 19 nt, Chlamydophila pneumoniae J138
ugcaucuuaucaagagcuc

SEQ ID NO: 529535 - RNA, 15 nt, Chlamydophila pneumoniae J138
ugcauucauaaaaau

SEQ ID NO: 529536 - RNA, 21 nt, Chlamydophila pneumoniae J138
ugccaauguggugauuucuuu

SEQ ID NO: 529537 - RNA, 20 nt, Chlamydophila pneumoniae J138
ugccaauguggugauuucuu

SEQ ID NO: 529538 - RNA, 12 nt, Chlamydophila pneumoniae J138
ugccaaugugca

SEQ ID NO: 529539 - RNA, 16 nt, Chlamydophila pneumoniae J138
ugccaaucuuccuuaa

SEQ ID NO: 529540 - RNA, 17 nt, Chlamydophila pneumoniae J138
ugagauacggaggauua

SEQ ID NO: 529541 - RNA, 18 nt, Chlamydophila pneumoniae J138
ugagauacggaggauuau

SEQ ID NO: 529542 - RNA, 23 nt, Chlamydophila pneumoniae J138
ugagaucaucucccaaauagcua

SEQ ID NO: 529543 - RNA, 22 nt, Chlamydophila pneumoniae J138
ugagcaacaagcugcugagcag

SEQ ID NO: 529544 - RNA, 16 nt, Chlamydophila pneumoniae J138
ugagcaacaagcugcu

SEQ ID NO: 529545 - RNA, 20 nt, Chlamydophila pneumoniae J138
ugaggagcucccucuagagc

SEQ ID NO: 529546 - RNA, 19 nt, Chlamydophila pneumoniae J138
ugaggacgcagagaugcua

SEQ ID NO: 529547 - RNA, 17 nt, Chlamydophila pneumoniae J138
ugaggacacaacucuuu

SEQ ID NO: 529548 - RNA, 20 nt, Chlamydophila pneumoniae J138
ugaggacacaacucuuuaau

SEQ ID NO: 529549 - RNA, 22 nt, Chlamydophila pneumoniae J138
ugaggaaucauaaccaaaagaa

SEQ ID NO: 529550 - RNA, 21 nt, Chlamydophila pneumoniae J138
ugagcugcugguccuaaaaaa

SEQ ID NO: 529551 - RNA, 19 nt, Chlamydophila pneumoniae J138
ugaggauaaguucuuccaa

SEQ ID NO: 529552 - RNA, 16 nt, Chlamydophila pneumoniae J138
ugaggaccuuccuuau

SEQ ID NO: 529553 - RNA, 17 nt, Chlamydophila pneumoniae J138
ugagcuccaaaauaauc

SEQ ID NO: 529554 - RNA, 18 nt, Chlamydophila pneumoniae J138
ugagcgucguguuuucac

SEQ ID NO: 529555 - RNA, 12 nt, Chlamydophila pneumoniae J138
ugagcuacaaga

SEQ ID NO: 529556 - RNA, 17 nt, Chlamydophila pneumoniae J138
ugagggucggauuuaga

SEQ ID NO: 529557 - RNA, 14 nt, Chlamydophila pneumoniae J138
ugaggcuauagaau

SEQ ID NO: 529558 - RNA, 16 nt, Chlamydophila pneumoniae J138
ugagucugaacauucu

SEQ ID NO: 529559 - RNA, 14 nt, Chlamydophila pneumoniae J138
ugauaacuuugcau

SEQ ID NO: 529560 - RNA, 19 nt, Chlamydophila pneumoniae J138
ugauaaaagguauuucucu

SEQ ID NO: 529561 - RNA, 14 nt, Chlamydophila pneumoniae J138
ugauaaaaauuuuc

SEQ ID NO: 529562 - RNA, 17 nt, Chlamydophila pneumoniae J138
ugagugucccauggcug

SEQ ID NO: 529563 - RNA, 17 nt, Chlamydophila pneumoniae J138
ugauaccaccuaaaaug

SEQ ID NO: 529564 - RNA, 13 nt, Chlamydophila pneumoniae J138
ugauaaggaagaa

SEQ ID NO: 529565 - RNA, 22 nt, Chlamydophila pneumoniae J138
ugauaaggaagaauuucgucuu

SEQ ID NO: 529566 - RNA, 12 nt, Chlamydophila pneumoniae J138
ugauacuuuaga

SEQ ID NO: 529567 - RNA, 15 nt, Chlamydophila pneumoniae J138
ugauacuguuuuuua

SEQ ID NO: 529568 - RNA, 22 nt, Chlamydophila pneumoniae J138
ugauagaggaaguguuucuuug

SEQ ID NO: 529569 - RNA, 20 nt, Chlamydophila pneumoniae J138
ugauccgaaaacucuuagag

SEQ ID NO: 529570 - RNA, 18 nt, Chlamydophila pneumoniae J138
ugauccgaaaacucuuag

SEQ ID NO: 529571 - RNA, 19 nt, Chlamydophila pneumoniae J138
ugauccgaaaacucuuaga

SEQ ID NO: 529572 - RNA, 19 nt, Chlamydophila pneumoniae J138
ugauccucggcaucuuugg

SEQ ID NO: 529573 - RNA, 13 nt, Chlamydophila pneumoniae J138
ugaucaggagucu

SEQ ID NO: 529574 - RNA, 17 nt, Chlamydophila pneumoniae J138
ugaucuucuagaugugu

SEQ ID NO: 529575 - RNA, 22 nt, Chlamydophila pneumoniae J138
ugacccagagaauguucccaaa

SEQ ID NO: 529576 - RNA, 23 nt, Chlamydophila pneumoniae J138
ugaccaaacuuggucauuauagu

SEQ ID NO: 529577 - RNA, 20 nt, Chlamydophila pneumoniae J138
ugaccucaucucgcagucca

SEQ ID NO: 529578 - RNA, 16 nt, Chlamydophila pneumoniae J138
ugaccucaucucgcag

SEQ ID NO: 529579 - RNA, 18 nt, Chlamydophila pneumoniae J138
ugacgcuuuuccaaagca

SEQ ID NO: 529580 - RNA, 21 nt, Chlamydophila pneumoniae J138
ugacggcaggacucuuuaagc

SEQ ID NO: 529581 - RNA, 15 nt, Chlamydophila pneumoniae J138
ugacggcaggacucu

SEQ ID NO: 529582 - RNA, 14 nt, Chlamydophila pneumoniae J138
ugacguaaugcaga

SEQ ID NO: 529583 - RNA, 22 nt, Chlamydophila pneumoniae J138
ugacguuaauaaagaggcuccc

SEQ ID NO: 529584 - RNA, 21 nt, Chlamydophila pneumoniae J138
ugacgugcauugaauccuucu

SEQ ID NO: 529585 - RNA, 22 nt, Chlamydophila pneumoniae J138
ugacguugcgaacagcuccugg

SEQ ID NO: 529586 - RNA, 22 nt, Chlamydophila pneumoniae J138
ugacuaauaccuuucuaagaau

SEQ ID NO: 529587 - RNA, 13 nt, Chlamydophila pneumoniae J138
ugacuauaaaaug

SEQ ID NO: 529588 - RNA, 18 nt, Chlamydophila pneumoniae J138
ugacucuagccaccaaca

SEQ ID NO: 529589 - RNA, 14 nt, Chlamydophila pneumoniae J138
ugacucuagccacc

SEQ ID NO: 529590 - RNA, 16 nt, Chlamydophila pneumoniae J138
ugacucuaauucagaa

SEQ ID NO: 529591 - RNA, 17 nt, Chlamydophila pneumoniae J138
ugacuccagaaggugug

SEQ ID NO: 529592 - RNA, 15 nt, Chlamydophila pneumoniae J138
ugacuuccuccaaaa

SEQ ID NO: 529593 - RNA, 18 nt, Chlamydophila pneumoniae J138
ugagaaaucuuuugauua

SEQ ID NO: 529594 - RNA, 18 nt, Chlamydophila pneumoniae J138
ugagaaccuucacaagaa

SEQ ID NO: 529595 - RNA, 21 nt, Chlamydophila pneumoniae J138
ugagaggaucgugaaguacau

SEQ ID NO: 529596 - RNA, 19 nt, Chlamydophila pneumoniae J138
ugagagauuuuuucauacu

SEQ ID NO: 529597 - RNA, 21 nt, Chlamydophila pneumoniae J138
ucgccaaaccaugaggcugcu

SEQ ID NO: 529598 - RNA, 17 nt, Chlamydophila pneumoniae J138
ucucgggagaacaugcc

SEQ ID NO: 529599 - RNA, 21 nt, Chlamydophila pneumoniae J138
ucucgggagaacaugccccca

SEQ ID NO: 529600 - RNA, 18 nt, Chlamydophila pneumoniae J138
ucucuaagcagccucuuc

SEQ ID NO: 529601 - RNA, 21 nt, Chlamydophila pneumoniae J138
ucucuaagcagccucuucucu

SEQ ID NO: 529602 - RNA, 23 nt, Chlamydophila pneumoniae J138
ucucuaagcagccucuucucuac

SEQ ID NO: 529603 - RNA, 17 nt, Chlamydophila pneumoniae J138
ucucguacguggaaagu

SEQ ID NO: 529604 - RNA, 22 nt, Chlamydophila pneumoniae J138
ucgcauuacaaauggcaugaaa

SEQ ID NO: 529605 - RNA, 16 nt, Chlamydophila pneumoniae J138
ucucuaagacuguguu

SEQ ID NO: 529606 - RNA, 20 nt, Chlamydophila pneumoniae J138
ucucuaagacuguguuuuau

SEQ ID NO: 529607 - RNA, 22 nt, Chlamydophila pneumoniae J138
ucucuaccgaacagagcgucua

SEQ ID NO: 529608 - RNA, 15 nt, Chlamydophila pneumoniae J138
ucucuaggaacucuu

SEQ ID NO: 529609 - RNA, 22 nt, Chlamydophila pneumoniae J138
ucucuagccaauauagaagcug

SEQ ID NO: 529610 - RNA, 18 nt, Chlamydophila pneumoniae J138
ucucuguauaguuuucaa

SEQ ID NO: 529611 - RNA, 15 nt, Chlamydophila pneumoniae J138
ucucuguuuuuugaa

SEQ ID NO: 529612 - RNA, 16 nt, Chlamydophila pneumoniae J138
ucucuaguuuuuacau

SEQ ID NO: 529613 - RNA, 22 nt, Chlamydophila pneumoniae J138
ucucuaguucuagaaaggcauu

SEQ ID NO: 529614 - RNA, 13 nt, Chlamydophila pneumoniae J138
ucucuaguuuuua

SEQ ID NO: 529615 - RNA, 15 nt, Chlamydophila pneumoniae J138
ucucuaguucuagaa

SEQ ID NO: 529616 - RNA, 21 nt, Chlamydophila pneumoniae J138
ucucuuaacuggcaaucuaaa

SEQ ID NO: 529617 - RNA, 16 nt, Chlamydophila pneumoniae J138
ucucuagggaaaggag

SEQ ID NO: 529618 - RNA, 19 nt, Chlamydophila pneumoniae J138
ucucuucccuuguuaugaa

SEQ ID NO: 529619 - RNA, 22 nt, Chlamydophila pneumoniae J138
ucucuucgcuggcauguuuaau

SEQ ID NO: 529620 - RNA, 12 nt, Chlamydophila pneumoniae J138
ucucuuccuucu

SEQ ID NO: 529621 - RNA, 14 nt, Chlamydophila pneumoniae J138
ucucuuccuucucc

SEQ ID NO: 529622 - RNA, 22 nt, Chlamydophila pneumoniae J138
ucucuuccuucuccuguaaagc

SEQ ID NO: 529623 - RNA, 22 nt, Chlamydophila pneumoniae J138
ucucuucccuuguuaugaaaau

SEQ ID NO: 529624 - RNA, 20 nt, Chlamydophila pneumoniae J138
ucugaagaccccucuugcuu

SEQ ID NO: 529625 - RNA, 15 nt, Chlamydophila pneumoniae J138
ucugaagagagaaua

SEQ ID NO: 529626 - RNA, 18 nt, Chlamydophila pneumoniae J138
ucugaacaggaauagaaa

SEQ ID NO: 529627 - RNA, 17 nt, Chlamydophila pneumoniae J138
ucugaaaucaaaaaaaa

SEQ ID NO: 529628 - RNA, 18 nt, Chlamydophila pneumoniae J138
aaaugcuauuuuccucua

SEQ ID NO: 529629 - RNA, 15 nt, Chlamydophila pneumoniae J138
ucucuuugacaucua

SEQ ID NO: 529630 - RNA, 19 nt, Chlamydophila pneumoniae J138
ucucuuugacaucuaauuu

SEQ ID NO: 529631 - RNA, 19 nt, Chlamydophila pneumoniae J138
ucucuuugacggauaggau

SEQ ID NO: 529632 - RNA, 15 nt, Chlamydophila pneumoniae J138
ucucuuuuggaagac

SEQ ID NO: 529633 - RNA, 19 nt, Chlamydophila pneumoniae J138
ucugacgucuccaacaguc

SEQ ID NO: 529634 - RNA, 19 nt, Chlamydophila pneumoniae J138
ucugaaucucauaaguaua

SEQ ID NO: 529635 - RNA, 17 nt, Chlamydophila pneumoniae J138
ucugauagaacaggauu

SEQ ID NO: 529636 - RNA, 18 nt, Chlamydophila pneumoniae J138
ucugaugacguuaauaaa

SEQ ID NO: 529637 - RNA, 13 nt, Chlamydophila pneumoniae J138
ucugagaaguuaa

SEQ ID NO: 529638 - RNA, 19 nt, Chlamydophila pneumoniae J138
ucugauuaguucucuaaga

SEQ ID NO: 529639 - RNA, 15 nt, Chlamydophila pneumoniae J138
ucugaugcaccauaa

SEQ ID NO: 529640 - RNA, 23 nt, Chlamydophila pneumoniae J138
ucugcaaacgcaaugauuucucu

SEQ ID NO: 529641 - RNA, 24 nt, Chlamydophila pneumoniae J138
ucugcgugucguugguucaaaucc

SEQ ID NO: 529642 - RNA, 13 nt, Chlamydophila pneumoniae J138
ucugcugaggaga

SEQ ID NO: 529643 - RNA, 16 nt, Chlamydophila pneumoniae J138
ucugcugaggagagua

SEQ ID NO: 529644 - RNA, 15 nt, Chlamydophila pneumoniae J138
ucugcucuauauauc

SEQ ID NO: 529645 - RNA, 12 nt, Chlamydophila pneumoniae J138
ucugcugaaauc

SEQ ID NO: 529646 - RNA, 21 nt, Chlamydophila pneumoniae J138
ucugggugcgucguaaucuuu

SEQ ID NO: 529647 - RNA, 19 nt, Chlamydophila pneumoniae J138
ucuggggcuuccagaaaca

SEQ ID NO: 529648 - RNA, 13 nt, Chlamydophila pneumoniae J138
ucuggaaugacua

SEQ ID NO: 529649 - RNA, 17 nt, Chlamydophila pneumoniae J138
ucuggaccuuauaccca

SEQ ID NO: 529650 - RNA, 17 nt, Chlamydophila pneumoniae J138
ucuggauacguuuuucc

SEQ ID NO: 529651 - RNA, 20 nt, Chlamydophila pneumoniae J138
ucuggauacguuuuucccuu

SEQ ID NO: 529652 - RNA, 18 nt, Chlamydophila pneumoniae J138
ucuucauuauuaaacgaa

SEQ ID NO: 529653 - RNA, 22 nt, Chlamydophila pneumoniae J138
ucuucaugcugcuuugacgacu

SEQ ID NO: 529654 - RNA, 15 nt, Chlamydophila pneumoniae J138
ucuucaucacaaaau

SEQ ID NO: 529655 - RNA, 20 nt, Chlamydophila pneumoniae J138
ucuucauuuucuuuuaagag

SEQ ID NO: 529656 - RNA, 20 nt, Chlamydophila pneumoniae J138
ucuucauugcaaaaaugaaa

SEQ ID NO: 529657 - RNA, 14 nt, Chlamydophila pneumoniae J138
ucuuccgauuaacu

SEQ ID NO: 529658 - RNA, 22 nt, Chlamydophila pneumoniae J138
ucuucagcccacuguuuugcuu

SEQ ID NO: 529659 - RNA, 23 nt, Chlamydophila pneumoniae J138
ucuucagucauucuauggucucc

SEQ ID NO: 529660 - RNA, 23 nt, Chlamydophila pneumoniae J138
ucuucagcuuuaacaugccaaaa

SEQ ID NO: 529661 - RNA, 18 nt, Chlamydophila pneumoniae J138
ucuucauaugcucucccg

SEQ ID NO: 529662 - RNA, 23 nt, Chlamydophila pneumoniae J138
ucuucaaagcuacuaaucaccuu

SEQ ID NO: 529663 - RNA, 22 nt, Chlamydophila pneumoniae J138
ucuucaaagaacuuaaaauuca

SEQ ID NO: 529664 - RNA, 17 nt, Chlamydophila pneumoniae J138
ucuucagaaugcccuuu

SEQ ID NO: 529665 - RNA, 16 nt, Chlamydophila pneumoniae J138
ucugguauagaaacac

SEQ ID NO: 529666 - RNA, 14 nt, Chlamydophila pneumoniae J138
ucuggguucuccac

SEQ ID NO: 529667 - RNA, 14 nt, Chlamydophila pneumoniae J138
ucuguuuuggaaag

SEQ ID NO: 529668 - RNA, 22 nt, Chlamydophila pneumoniae J138
ucuguuuuggaaagaagagaau

SEQ ID NO: 529669 - RNA, 12 nt, Chlamydophila pneumoniae J138
ucuuaaaacugc

SEQ ID NO: 529670 - RNA, 17 nt, Chlamydophila pneumoniae J138
ucuuaagaauaaaauag

SEQ ID NO: 529671 - RNA, 14 nt, Chlamydophila pneumoniae J138
ucuuaagaauaaaa

SEQ ID NO: 529672 - RNA, 16 nt, Chlamydophila pneumoniae J138
ucuuaagaauaaaaua

SEQ ID NO: 529673 - RNA, 17 nt, Chlamydophila pneumoniae J138
ucuuaagagcaaacauc

SEQ ID NO: 529674 - RNA, 24 nt, Chlamydophila pneumoniae J138
ucuuaagcuaccauuaaggaaucc

SEQ ID NO: 529675 - RNA, 17 nt, Chlamydophila pneumoniae J138
ucuuaacgcuuagagaa

SEQ ID NO: 529676 - RNA, 18 nt, Chlamydophila pneumoniae J138
ucuuaacaauauaugcua

SEQ ID NO: 529677 - RNA, 15 nt, Chlamydophila pneumoniae J138
ucuuaaaauuccuga

SEQ ID NO: 529678 - RNA, 18 nt, Chlamydophila pneumoniae J138
ucuuaauauaaaagaaga

SEQ ID NO: 529679 - RNA, 14 nt, Chlamydophila pneumoniae J138
ucuuagaauccucu

SEQ ID NO: 529680 - RNA, 21 nt, Chlamydophila pneumoniae J138
ucuuagccccuccaacaaaca

SEQ ID NO: 529681 - RNA, 20 nt, Chlamydophila pneumoniae J138
ucuuagcguauccgcugccc

SEQ ID NO: 529682 - RNA, 17 nt, Chlamydophila pneumoniae J138
ucuuauucacuggaaug

SEQ ID NO: 529683 - RNA, 15 nt, Chlamydophila pneumoniae J138
ucuucuuagccaaaa

SEQ ID NO: 529684 - RNA, 18 nt, Chlamydophila pneumoniae J138
ucuucuuagccaaaauuu

SEQ ID NO: 529685 - RNA, 16 nt, Chlamydophila pneumoniae J138
ucuucuuagaagagaa

SEQ ID NO: 529686 - RNA, 19 nt, Chlamydophila pneumoniae J138
ucuucuuccaaaaucucua

SEQ ID NO: 529687 - RNA, 15 nt, Chlamydophila pneumoniae J138
ucuucuucaaaguca

SEQ ID NO: 529688 - RNA, 17 nt, Chlamydophila pneumoniae J138
ucuucuucccuuucaaa

SEQ ID NO: 529689 - RNA, 22 nt, Chlamydophila pneumoniae J138
ucuucuucgguguagaucuuuu

SEQ ID NO: 529690 - RNA, 14 nt, Chlamydophila pneumoniae J138
ucuucuugauuaag

SEQ ID NO: 529691 - RNA, 16 nt, Chlamydophila pneumoniae J138
ucuucuguaggaacaa

SEQ ID NO: 529692 - RNA, 21 nt, Chlamydophila pneumoniae J138
ucuucuguaauuuuuuucaaa

SEQ ID NO: 529693 - RNA, 23 nt, Chlamydophila pneumoniae J138
ucuucuggauacguuuuucccuu

SEQ ID NO: 529694 - RNA, 22 nt, Chlamydophila pneumoniae J138
ucuucuggauacguuuuucccu

SEQ ID NO: 529695 - RNA, 11 nt, Chlamydophila pneumoniae J138
ucuucugaaau

SEQ ID NO: 529696 - RNA, 16 nt, Chlamydophila pneumoniae J138
ucuucugaaaucaaaa

SEQ ID NO: 529697 - RNA, 21 nt, Chlamydophila pneumoniae J138
ucuucugauacaucaucagaa

SEQ ID NO: 529698 - RNA, 17 nt, Chlamydophila pneumoniae J138
ucuucucgguuuaaggc

SEQ ID NO: 529699 - RNA, 21 nt, Chlamydophila pneumoniae J138
ucuucucgaacaggagagaga

SEQ ID NO: 529700 - RNA, 13 nt, Chlamydophila pneumoniae J138
ucuucgcaaauau

SEQ ID NO: 529701 - RNA, 20 nt, Chlamydophila pneumoniae J138
ucuucgcccauuaacuaaga

SEQ ID NO: 529702 - RNA, 16 nt, Chlamydophila pneumoniae J138
ucuucuaaaacuucag

SEQ ID NO: 529703 - RNA, 20 nt, Chlamydophila pneumoniae J138
ucuucuaaaacuucaguugu

SEQ ID NO: 529704 - RNA, 19 nt, Chlamydophila pneumoniae J138
ucuucgaggccuaaaauca

SEQ ID NO: 529705 - RNA, 19 nt, Chlamydophila pneumoniae J138
ucuucuacuuuaagaagca

SEQ ID NO: 529706 - RNA, 13 nt, Chlamydophila pneumoniae J138
ucuucuaccugua

SEQ ID NO: 529707 - RNA, 15 nt, Chlamydophila pneumoniae J138
ucuucuacagaauag

SEQ ID NO: 529708 - RNA, 18 nt, Chlamydophila pneumoniae J138
ucuucuagagcuucaagu

SEQ ID NO: 529709 - RNA, 23 nt, Chlamydophila pneumoniae J138
ucuucuagcucauuaucaagaaa

SEQ ID NO: 529710 - RNA, 19 nt, Chlamydophila pneumoniae J138
ucuugacggcaggacucuu

SEQ ID NO: 529711 - RNA, 22 nt, Chlamydophila pneumoniae J138
ucuugacggcaggacucuuuaa

SEQ ID NO: 529712 - RNA, 14 nt, Chlamydophila pneumoniae J138
ucuugacggcagga

SEQ ID NO: 529713 - RNA, 18 nt, Chlamydophila pneumoniae J138
ucuugagccacuuuuaau

SEQ ID NO: 529714 - RNA, 22 nt, Chlamydophila pneumoniae J138
ucuugaaguucuucaagaugau

SEQ ID NO: 529715 - RNA, 19 nt, Chlamydophila pneumoniae J138
ucuugaaguucuucaagau

SEQ ID NO: 529716 - RNA, 14 nt, Chlamydophila pneumoniae J138
ucuugaagaucucc

SEQ ID NO: 529717 - RNA, 11 nt, Chlamydophila pneumoniae J138
ucuugaaaaaa

SEQ ID NO: 529718 - RNA, 13 nt, Chlamydophila pneumoniae J138
ucuucuuuucguu

SEQ ID NO: 529719 - RNA, 15 nt, Chlamydophila pneumoniae J138
ucuucuuuggaugcu

SEQ ID NO: 529720 - RNA, 16 nt, Chlamydophila pneumoniae J138
ucuucuuuggaugcua

SEQ ID NO: 529721 - RNA, 18 nt, Chlamydophila pneumoniae J138
ucuucuuuggaugcuaau

SEQ ID NO: 529722 - RNA, 19 nt, Chlamydophila pneumoniae J138
ucuucuuggcuuucccccu

SEQ ID NO: 529723 - RNA, 20 nt, Chlamydophila pneumoniae J138
ucuucuuuaagauuuccuua

SEQ ID NO: 529724 - RNA, 13 nt, Chlamydophila pneumoniae J138
ucuugccaaugug

SEQ ID NO: 529725 - RNA, 17 nt, Chlamydophila pneumoniae J138
ucuugauguacaguaaa

SEQ ID NO: 529726 - RNA, 13 nt, Chlamydophila pneumoniae J138
ucuugauaaaaga

SEQ ID NO: 529727 - RNA, 15 nt, Chlamydophila pneumoniae J138
ucuugauccaucugc

SEQ ID NO: 529728 - RNA, 20 nt, Chlamydophila pneumoniae J138
ucuugauccaucugcucuuu

SEQ ID NO: 529729 - RNA, 15 nt, Chlamydophila pneumoniae J138
ucuugauuagagaau

SEQ ID NO: 529730 - RNA, 14 nt, Chlamydophila pneumoniae J138
ucuugauuagagaa

SEQ ID NO: 529731 - RNA, 15 nt, Chlamydophila pneumoniae J138
ucuugcugauuuuug

SEQ ID NO: 529732 - RNA, 22 nt, Chlamydophila pneumoniae J138
ucuugcucuagucuuucaaccu

SEQ ID NO: 529733 - RNA, 18 nt, Chlamydophila pneumoniae J138
ucuugguguauaguauuu

SEQ ID NO: 529734 - RNA, 15 nt, Chlamydophila pneumoniae J138
ucuugguguauagua

SEQ ID NO: 529735 - RNA, 17 nt, Chlamydophila pneumoniae J138
ucuuguacauccuuguc

SEQ ID NO: 529736 - RNA, 15 nt, Chlamydophila pneumoniae J138
ucuuguucuaaaaug

SEQ ID NO: 529737 - RNA, 15 nt, Chlamydophila pneumoniae J138
ucuuguuccaauaga

SEQ ID NO: 529738 - RNA, 15 nt, Chlamydophila pneumoniae J138
ucuuguuaaaguaaa

SEQ ID NO: 529739 - RNA, 15 nt, Chlamydophila pneumoniae J138
ucuuuaaaaaauucu

SEQ ID NO: 529740 - RNA, 16 nt, Chlamydophila pneumoniae J138
ucuuuaaaaucuucug

SEQ ID NO: 529741 - RNA, 19 nt, Chlamydophila pneumoniae J138
ucuuuaagguugcuuuucu

SEQ ID NO: 529742 - RNA, 21 nt, Chlamydophila pneumoniae J138
ucuuuaauccaguuuuuuaaa

SEQ ID NO: 529743 - RNA, 13 nt, Chlamydophila pneumoniae J138
ucuuuaccagaaa

SEQ ID NO: 529744 - RNA, 23 nt, Chlamydophila pneumoniae J138
ucuuuacuacaugaggauacacu

SEQ ID NO: 529745 - RNA, 20 nt, Chlamydophila pneumoniae J138
ucuuuagagucugcagcaga

SEQ ID NO: 529746 - RNA, 17 nt, Chlamydophila pneumoniae J138
ucuuuagcaaacauuuu

SEQ ID NO: 529747 - RNA, 16 nt, Chlamydophila pneumoniae J138
ucuuuagcuacagaaa

SEQ ID NO: 529748 - RNA, 22 nt, Chlamydophila pneumoniae J138
ucuuuaggauagaggccuuuua

SEQ ID NO: 529749 - RNA, 18 nt, Chlamydophila pneumoniae J138
ucuuuauuuuuaaaaaua

SEQ ID NO: 529750 - RNA, 15 nt, Chlamydophila pneumoniae J138
ucuuuauuuuuaaaa

SEQ ID NO: 529751 - RNA, 22 nt, Chlamydophila pneumoniae J138
ucuuucaccaacuccucuaagg

SEQ ID NO: 529752 - RNA, 13 nt, Chlamydophila pneumoniae J138
ucuuucacaucuu

SEQ ID NO: 529753 - RNA, 16 nt, Chlamydophila pneumoniae J138
ucuuucaauaacagag

SEQ ID NO: 529754 - RNA, 15 nt, Chlamydophila pneumoniae J138
ucuuucaaggaacau

SEQ ID NO: 529755 - RNA, 24 nt, Chlamydophila pneumoniae J138
ucuuuucggaucagaaugcaucuu

SEQ ID NO: 529756 - RNA, 15 nt, Chlamydophila pneumoniae J138
ucuuuguucgcuccu

SEQ ID NO: 529757 - RNA, 16 nt, Chlamydophila pneumoniae J138
ucuuuuaacuuaaaga

SEQ ID NO: 529758 - RNA, 17 nt, Chlamydophila pneumoniae J138
ucuuuucugaagauuuu

SEQ ID NO: 529759 - RNA, 17 nt, Chlamydophila pneumoniae J138
ucuuuucuacaugcuca

SEQ ID NO: 529760 - RNA, 14 nt, Chlamydophila pneumoniae J138
ucuuuucuagaaaa

SEQ ID NO: 529761 - RNA, 19 nt, Chlamydophila pneumoniae J138
ucuuuucuaagcaauauuu

SEQ ID NO: 529762 - RNA, 12 nt, Chlamydophila pneumoniae J138
ucuuuucuaagc

SEQ ID NO: 529763 - RNA, 16 nt, Chlamydophila pneumoniae J138
ucuuuucuuuuuagaa

SEQ ID NO: 529764 - RNA, 20 nt, Chlamydophila pneumoniae J138
ucuuuuuaagguucucugaa

SEQ ID NO: 529765 - RNA, 18 nt, Chlamydophila pneumoniae J138
ucuuuuguaaucuaagaa

SEQ ID NO: 529766 - RNA, 17 nt, Chlamydophila pneumoniae J138
ucuuuuguuuuagcucu

SEQ ID NO: 529767 - RNA, 15 nt, Chlamydophila pneumoniae J138
ucuuuuucagaaagc

SEQ ID NO: 529768 - RNA, 15 nt, Chlamydophila pneumoniae J138
ucuuucauucccuuu

SEQ ID NO: 529769 - RNA, 19 nt, Chlamydophila pneumoniae J138
ucuuucaucaaugcgauua

SEQ ID NO: 529770 - RNA, 16 nt, Chlamydophila pneumoniae J138
ucuuucauacuaaaau

SEQ ID NO: 529771 - RNA, 12 nt, Chlamydophila pneumoniae J138
ucuuucauaaga

SEQ ID NO: 529772 - RNA, 14 nt, Chlamydophila pneumoniae J138
ucuuucauaagauu

SEQ ID NO: 529773 - RNA, 17 nt, Chlamydophila pneumoniae J138
ucuuucauaagauugcc

SEQ ID NO: 529774 - RNA, 20 nt, Chlamydophila pneumoniae J138
ucuuuccuuagcauuaggaa

SEQ ID NO: 529775 - RNA, 20 nt, Chlamydophila pneumoniae J138
ucuuucuaaaacaucagcaa

SEQ ID NO: 529776 - RNA, 13 nt, Chlamydophila pneumoniae J138
ucuuucuaaaaca

SEQ ID NO: 529777 - RNA, 15 nt, Chlamydophila pneumoniae J138
ucuuucuaagauauc

SEQ ID NO: 529778 - RNA, 12 nt, Chlamydophila pneumoniae J138
ucuuucucuaaa

SEQ ID NO: 529779 - RNA, 15 nt, Chlamydophila pneumoniae J138
ucuuucucuaaaaua

SEQ ID NO: 529780 - RNA, 11 nt, Chlamydophila pneumoniae J138
ucuuucucuaa

SEQ ID NO: 529781 - RNA, 19 nt, Chlamydophila pneumoniae J138
ucuuucuagaaugaugcaa

SEQ ID NO: 529782 - RNA, 21 nt, Chlamydophila pneumoniae J138
ucuuucuaggaucucuaguaa

SEQ ID NO: 529783 - RNA, 22 nt, Chlamydophila pneumoniae J138
ucuuucucgaggggacggaaaa

SEQ ID NO: 529784 - RNA, 17 nt, Chlamydophila pneumoniae J138
ucuuucugauuuaaaag

SEQ ID NO: 529785 - RNA, 20 nt, Chlamydophila pneumoniae J138
ucuuucugauuuaaaagguu

SEQ ID NO: 529786 - RNA, 14 nt, Chlamydophila pneumoniae J138
ucuuucugcucuuc

SEQ ID NO: 529787 - RNA, 15 nt, Chlamydophila pneumoniae J138
ucuuucuucuagagc

SEQ ID NO: 529788 - RNA, 18 nt, Chlamydophila pneumoniae J138
ucuuucuugcucugacaa

SEQ ID NO: 529789 - RNA, 16 nt, Chlamydophila pneumoniae J138
ucuuuggcacaauccu

SEQ ID NO: 529790 - RNA, 16 nt, Chlamydophila pneumoniae J138
ucuuuggguucuucca

SEQ ID NO: 529791 - RNA, 22 nt, Chlamydophila pneumoniae J138
ugaacggcucuuucuaaaacau

SEQ ID NO: 529792 - RNA, 13 nt, Chlamydophila pneumoniae J138
ugaacggcucuuu

SEQ ID NO: 529793 - RNA, 15 nt, Chlamydophila pneumoniae J138
ugaacuaacugagca

SEQ ID NO: 529794 - RNA, 16 nt, Chlamydophila pneumoniae J138
ugaagacaaguaaaca

SEQ ID NO: 529795 - RNA, 22 nt, Chlamydophila pneumoniae J138
ugaagacaaguaaacagcaaag

SEQ ID NO: 529796 - RNA, 19 nt, Chlamydophila pneumoniae J138
ugaagaaguacaagugaag

SEQ ID NO: 529797 - RNA, 18 nt, Chlamydophila pneumoniae J138
ugaagaaguacaagugaa

SEQ ID NO: 529798 - RNA, 17 nt, Chlamydophila pneumoniae J138
ugaagcagcuucugcag

SEQ ID NO: 529799 - RNA, 16 nt, Chlamydophila pneumoniae J138
ugaagcagggaaaaug

SEQ ID NO: 529800 - RNA, 18 nt, Chlamydophila pneumoniae J138
ugaagcagggaaaaugcg

SEQ ID NO: 529801 - RNA, 15 nt, Chlamydophila pneumoniae J138
ugaagauuuuuucuu

SEQ ID NO: 529802 - RNA, 22 nt, Chlamydophila pneumoniae J138
ugaagcugcuucuucagaguug

SEQ ID NO: 529803 - RNA, 13 nt, Chlamydophila pneumoniae J138
ugaagcuucuuua

SEQ ID NO: 529804 - RNA, 14 nt, Chlamydophila pneumoniae J138
ugaagucuucuugc

SEQ ID NO: 529805 - RNA, 15 nt, Chlamydophila pneumoniae J138
ugaagucuucuugcu

SEQ ID NO: 529806 - RNA, 23 nt, Chlamydophila pneumoniae J138
ugaagucguuuagauuuuucuuu

SEQ ID NO: 529807 - RNA, 16 nt, Chlamydophila pneumoniae J138
ugaagucguuuagauu

SEQ ID NO: 529808 - RNA, 13 nt, Chlamydophila pneumoniae J138
ugaaaacuucaaa

SEQ ID NO: 529809 - RNA, 17 nt, Chlamydophila pneumoniae J138
ugaaaacaaggcaaaaa

SEQ ID NO: 529810 - RNA, 16 nt, Chlamydophila pneumoniae J138
ucuuuuuuuauaaaga

SEQ ID NO: 529811 - RNA, 12 nt, Chlamydophila pneumoniae J138
ugaaaucaugga

SEQ ID NO: 529812 - RNA, 14 nt, Chlamydophila pneumoniae J138
ugaaagcuucuucu

SEQ ID NO: 529813 - RNA, 21 nt, Chlamydophila pneumoniae J138
ugaaagauuauucuagaguug

SEQ ID NO: 529814 - RNA, 13 nt, Chlamydophila pneumoniae J138
ugaaaaucuuuaa

SEQ ID NO: 529815 - RNA, 17 nt, Chlamydophila pneumoniae J138
ugaaaaugauucauaac

SEQ ID NO: 529816 - RNA, 22 nt, Chlamydophila pneumoniae J138
ugaaaauucgaauucucagaaa

SEQ ID NO: 529817 - RNA, 14 nt, Chlamydophila pneumoniae J138
ugaaaauuuuccca

SEQ ID NO: 529818 - RNA, 16 nt, Chlamydophila pneumoniae J138
uccaaacccugggcuc

SEQ ID NO: 529819 - RNA, 18 nt, Chlamydophila pneumoniae J138
uccaaacauuuuuaagga

SEQ ID NO: 529820 - RNA, 17 nt, Chlamydophila pneumoniae J138
uccaaagaucaucuuca

SEQ ID NO: 529821 - RNA, 12 nt, Chlamydophila pneumoniae J138
uccaaagacuga

SEQ ID NO: 529822 - RNA, 21 nt, Chlamydophila pneumoniae J138
uccaaacgguuaaugaacuca

SEQ ID NO: 529823 - RNA, 23 nt, Chlamydophila pneumoniae J138
uccaacaaacaauuccguacgcu

SEQ ID NO: 529824 - RNA, 18 nt, Chlamydophila pneumoniae J138
uccaaagccugaaaaaua

SEQ ID NO: 529825 - RNA, 14 nt, Chlamydophila pneumoniae J138
ucauuuucauagca

SEQ ID NO: 529826 - RNA, 15 nt, Chlamydophila pneumoniae J138
ucauucaccuugauu

SEQ ID NO: 529827 - RNA, 15 nt, Chlamydophila pneumoniae J138
ucauuaucaagaaau

SEQ ID NO: 529828 - RNA, 15 nt, Chlamydophila pneumoniae J138
ucauuccagcaucuu

SEQ ID NO: 529829 - RNA, 15 nt, Chlamydophila pneumoniae J138
ucauuccaggauucu

SEQ ID NO: 529830 - RNA, 16 nt, Chlamydophila pneumoniae J138
ucauucccuuuuucca

SEQ ID NO: 529831 - RNA, 17 nt, Chlamydophila pneumoniae J138
ucauguccuucaaaaug

SEQ ID NO: 529832 - RNA, 15 nt, Chlamydophila pneumoniae J138
ucaugucuaagucag

SEQ ID NO: 529833 - RNA, 19 nt, Chlamydophila pneumoniae J138
uccaauccauucugagaaa

SEQ ID NO: 529834 - RNA, 13 nt, Chlamydophila pneumoniae J138
uccaauacuaaaa

SEQ ID NO: 529835 - RNA, 20 nt, Chlamydophila pneumoniae J138
uccaauagccaaagacucuu

SEQ ID NO: 529836 - RNA, 15 nt, Chlamydophila pneumoniae J138
uccaaugcuauugga

SEQ ID NO: 529837 - RNA, 17 nt, Chlamydophila pneumoniae J138
uccaauggcugagagau

SEQ ID NO: 529838 - RNA, 18 nt, Chlamydophila pneumoniae J138
uccaaucugcugaaggga

SEQ ID NO: 529839 - RNA, 16 nt, Chlamydophila pneumoniae J138
uccaaucugcugaagg

SEQ ID NO: 529840 - RNA, 22 nt, Chlamydophila pneumoniae J138
uccaagugaucagaaaugaagc

SEQ ID NO: 529841 - RNA, 19 nt, Chlamydophila pneumoniae J138
uccaagugcucaguaaaua

SEQ ID NO: 529842 - RNA, 16 nt, Chlamydophila pneumoniae J138
uccaacggacauuuuc

SEQ ID NO: 529843 - RNA, 13 nt, Chlamydophila pneumoniae J138
uccaacaucagcu

SEQ ID NO: 529844 - RNA, 22 nt, Chlamydophila pneumoniae J138
uccaacagucugcuuuuuugau

SEQ ID NO: 529845 - RNA, 18 nt, Chlamydophila pneumoniae J138
uccaaccucgagauccuc

SEQ ID NO: 529846 - RNA, 14 nt, Chlamydophila pneumoniae J138
uccaagaguucucu

SEQ ID NO: 529847 - RNA, 15 nt, Chlamydophila pneumoniae J138
uccaagaguucucuu

SEQ ID NO: 529848 - RNA, 12 nt, Chlamydophila pneumoniae J138
uccaagaaguca

SEQ ID NO: 529849 - RNA, 13 nt, Chlamydophila pneumoniae J138
uccaagacaauaa

SEQ ID NO: 529850 - RNA, 22 nt, Chlamydophila pneumoniae J138
uccaagacaacaccucccacca

SEQ ID NO: 529851 - RNA, 20 nt, Chlamydophila pneumoniae J138
uccaagacaacaccucccac

SEQ ID NO: 529852 - RNA, 16 nt, Chlamydophila pneumoniae J138
uccaagaauagccaua

SEQ ID NO: 529853 - RNA, 18 nt, Chlamydophila pneumoniae J138
uccaagaauagccauaau

SEQ ID NO: 529854 - RNA, 13 nt, Chlamydophila pneumoniae J138
uccaacuucaacu

SEQ ID NO: 529855 - RNA, 21 nt, Chlamydophila pneumoniae J138
uccaagaagucaucgcgagag

SEQ ID NO: 529856 - RNA, 16 nt, Chlamydophila pneumoniae J138
uccaacuuuugaagau

SEQ ID NO: 529857 - RNA, 22 nt, Chlamydophila pneumoniae J138
uccaacuuuugaagauccugag

SEQ ID NO: 529858 - RNA, 12 nt, Chlamydophila pneumoniae J138
uccaacuucaac

SEQ ID NO: 529859 - RNA, 20 nt, Chlamydophila pneumoniae J138
uccaccaggagcuccuccuu

SEQ ID NO: 529860 - RNA, 16 nt, Chlamydophila pneumoniae J138
uccacagacugcagga

SEQ ID NO: 529861 - RNA, 17 nt, Chlamydophila pneumoniae J138
uccacagagaccuucuc

SEQ ID NO: 529862 - RNA, 19 nt, Chlamydophila pneumoniae J138
uccacagagaccuucucuu

SEQ ID NO: 529863 - RNA, 21 nt, Chlamydophila pneumoniae J138
uccacagaucguaaucuguau

SEQ ID NO: 529864 - RNA, 16 nt, Chlamydophila pneumoniae J138
uccacacaacucguuu

SEQ ID NO: 529865 - RNA, 14 nt, Chlamydophila pneumoniae J138
uccacaagccuccc

SEQ ID NO: 529866 - RNA, 17 nt, Chlamydophila pneumoniae J138
uccacaagcuuuucgca

SEQ ID NO: 529867 - RNA, 15 nt, Chlamydophila pneumoniae J138
uccacuguucuucuu

SEQ ID NO: 529868 - RNA, 19 nt, Chlamydophila pneumoniae J138
uccacuguucuucuucagu

SEQ ID NO: 529869 - RNA, 19 nt, Chlamydophila pneumoniae J138
uccagaaauacguccagcc

SEQ ID NO: 529870 - RNA, 12 nt, Chlamydophila pneumoniae J138
uccagaaaguau

SEQ ID NO: 529871 - RNA, 19 nt, Chlamydophila pneumoniae J138
uccacuuuuuucccuccac

SEQ ID NO: 529872 - RNA, 17 nt, Chlamydophila pneumoniae J138
uccagaaaaagaacaua

SEQ ID NO: 529873 - RNA, 21 nt, Chlamydophila pneumoniae J138
uccagaaacgcagcuuuccuu

SEQ ID NO: 529874 - RNA, 13 nt, Chlamydophila pneumoniae J138
uccagaagcaaga

SEQ ID NO: 529875 - RNA, 18 nt, Chlamydophila pneumoniae J138
uccaggacguaaaaagaa

SEQ ID NO: 529876 - RNA, 21 nt, Chlamydophila pneumoniae J138
uccagguagcagaguuuuucc

SEQ ID NO: 529877 - RNA, 18 nt, Chlamydophila pneumoniae J138
uccauaggaacaaagcca

SEQ ID NO: 529878 - RNA, 13 nt, Chlamydophila pneumoniae J138
uccauaggaacaa

SEQ ID NO: 529879 - RNA, 18 nt, Chlamydophila pneumoniae J138
uccauaucaaagaucuga

SEQ ID NO: 529880 - RNA, 17 nt, Chlamydophila pneumoniae J138
uccauaucuagaaguuu

SEQ ID NO: 529881 - RNA, 15 nt, Chlamydophila pneumoniae J138
uccauagaguaucua

SEQ ID NO: 529882 - RNA, 13 nt, Chlamydophila pneumoniae J138
uccaguucuucau

SEQ ID NO: 529883 - RNA, 14 nt, Chlamydophila pneumoniae J138
uccauguacagaaa

SEQ ID NO: 529884 - RNA, 16 nt, Chlamydophila pneumoniae J138
uccauguacaguuugu

SEQ ID NO: 529885 - RNA, 22 nt, Chlamydophila pneumoniae J138
uccauguacaguuuguaaaaag

SEQ ID NO: 529886 - RNA, 20 nt, Chlamydophila pneumoniae J138
uccauguagaaggggguucu

SEQ ID NO: 529887 - RNA, 18 nt, Chlamydophila pneumoniae J138
uccaugcuaauaauuccu

SEQ ID NO: 529888 - RNA, 15 nt, Chlamydophila pneumoniae J138
uccauggaauggcua

SEQ ID NO: 529889 - RNA, 22 nt, Chlamydophila pneumoniae J138
uccaucugcucuuuugcaaguu

SEQ ID NO: 529890 - RNA, 13 nt, Chlamydophila pneumoniae J138
uccaucucuuuaa

SEQ ID NO: 529891 - RNA, 21 nt, Chlamydophila pneumoniae J138
uccaucggaauuugccugaaa

SEQ ID NO: 529892 - RNA, 16 nt, Chlamydophila pneumoniae J138
uccaucggcauuucuc

SEQ ID NO: 529893 - RNA, 22 nt, Chlamydophila pneumoniae J138
uccauucuuaauauaaaagaag

SEQ ID NO: 529894 - RNA, 12 nt, Chlamydophila pneumoniae J138
uccauucuuaau

SEQ ID NO: 529895 - RNA, 16 nt, Chlamydophila pneumoniae J138
uccauuucuaggaauu

SEQ ID NO: 529896 - RNA, 14 nt, Chlamydophila pneumoniae J138
ucccaaaaaaugcc

SEQ ID NO: 529897 - RNA, 17 nt, Chlamydophila pneumoniae J138
ucccaaacuucuucucg

SEQ ID NO: 529898 - RNA, 19 nt, Chlamydophila pneumoniae J138
ucccaaucaagauaaaggc

SEQ ID NO: 529899 - RNA, 16 nt, Chlamydophila pneumoniae J138
ucccaauauccagaaa

SEQ ID NO: 529900 - RNA, 18 nt, Chlamydophila pneumoniae J138
ucccaauauccagaaaua

SEQ ID NO: 529901 - RNA, 18 nt, Chlamydophila pneumoniae J138
ucccaagcugaaagaaug

SEQ ID NO: 529902 - RNA, 14 nt, Chlamydophila pneumoniae J138
ucccaagucugcuu

SEQ ID NO: 529903 - RNA, 20 nt, Chlamydophila pneumoniae J138
ucccaccauauucucaggaa

SEQ ID NO: 529904 - RNA, 16 nt, Chlamydophila pneumoniae J138
ucccaccauauucuca

SEQ ID NO: 529905 - RNA, 12 nt, Chlamydophila pneumoniae J138
ucccacagaaau

SEQ ID NO: 529906 - RNA, 16 nt, Chlamydophila pneumoniae J138
ucccauuucuggagaa

SEQ ID NO: 529907 - RNA, 12 nt, Chlamydophila pneumoniae J138
ucccaugggaua

SEQ ID NO: 529908 - RNA, 17 nt, Chlamydophila pneumoniae J138
ucccaugugcugaagac

SEQ ID NO: 529909 - RNA, 17 nt, Chlamydophila pneumoniae J138
ucccccagaccuaaaaa

SEQ ID NO: 529910 - RNA, 12 nt, Chlamydophila pneumoniae J138
ucccccuaaggg

SEQ ID NO: 529911 - RNA, 14 nt, Chlamydophila pneumoniae J138
ucccccauaaaaau

SEQ ID NO: 529912 - RNA, 18 nt, Chlamydophila pneumoniae J138
uccccauucacaaaucuu

SEQ ID NO: 529913 - RNA, 17 nt, Chlamydophila pneumoniae J138
uccccauaaccaauaaa

SEQ ID NO: 529914 - RNA, 16 nt, Chlamydophila pneumoniae J138
ucccagucgugagaag

SEQ ID NO: 529915 - RNA, 18 nt, Chlamydophila pneumoniae J138
ucccauagcaaugccuac

SEQ ID NO: 529916 - RNA, 14 nt, Chlamydophila pneumoniae J138
ucccaucaaaggca

SEQ ID NO: 529917 - RNA, 17 nt, Chlamydophila pneumoniae J138
ucccaucuuguucuaaa

SEQ ID NO: 529918 - RNA, 18 nt, Chlamydophila pneumoniae J138
ucccaucuuguucuaaaa

SEQ ID NO: 529919 - RNA, 19 nt, Chlamydophila pneumoniae J138
ucccaucuuguucuaaaau

SEQ ID NO: 529920 - RNA, 16 nt, Chlamydophila pneumoniae J138
ucccaucgucccuaaa

SEQ ID NO: 529921 - RNA, 18 nt, Chlamydophila pneumoniae J138
ucccagauuuuuuugguu

SEQ ID NO: 529922 - RNA, 15 nt, Chlamydophila pneumoniae J138
ucccacuaagaauga

SEQ ID NO: 529923 - RNA, 22 nt, Chlamydophila pneumoniae J138
ucccacuggacuucguuuugau

SEQ ID NO: 529924 - RNA, 18 nt, Chlamydophila pneumoniae J138
ucccagaagaaauuagag

SEQ ID NO: 529925 - RNA, 20 nt, Chlamydophila pneumoniae J138
ucccagaaggggaauaauau

SEQ ID NO: 529926 - RNA, 21 nt, Chlamydophila pneumoniae J138
uccccucugauuauuucuaaa

SEQ ID NO: 529927 - RNA, 14 nt, Chlamydophila pneumoniae J138
uccccugcaucucu

SEQ ID NO: 529928 - RNA, 17 nt, Chlamydophila pneumoniae J138
ucccgaguccuaaaauu

SEQ ID NO: 529929 - RNA, 17 nt, Chlamydophila pneumoniae J138
ucccgagauaugaagag

SEQ ID NO: 529930 - RNA, 22 nt, Chlamydophila pneumoniae J138
ucccgaacgcuagggaaaccau

SEQ ID NO: 529931 - RNA, 19 nt, Chlamydophila pneumoniae J138
ucccuuagaaauucuaaga

SEQ ID NO: 529932 - RNA, 19 nt, Chlamydophila pneumoniae J138
ucccugauuccauccuguc

SEQ ID NO: 529933 - RNA, 18 nt, Chlamydophila pneumoniae J138
ucccugauuccauccugu

SEQ ID NO: 529934 - RNA, 14 nt, Chlamydophila pneumoniae J138
ucccucacaagaag

SEQ ID NO: 529935 - RNA, 20 nt, Chlamydophila pneumoniae J138
ucccuauaaagcaaaugccu

SEQ ID NO: 529936 - RNA, 21 nt, Chlamydophila pneumoniae J138
ucccuauagaacaugaggcac

SEQ ID NO: 529937 - RNA, 22 nt, Chlamydophila pneumoniae J138
ucccuauaaagcaaaugccugu

SEQ ID NO: 529938 - RNA, 20 nt, Chlamydophila pneumoniae J138
ucccuaagaguuccaagaca

SEQ ID NO: 529939 - RNA, 21 nt, Chlamydophila pneumoniae J138
ucccuacccucaucauccuca

SEQ ID NO: 529940 - RNA, 17 nt, Chlamydophila pneumoniae J138
ucccuaagguagagucc

SEQ ID NO: 529941 - RNA, 14 nt, Chlamydophila pneumoniae J138
ucccugacacagag

SEQ ID NO: 529942 - RNA, 12 nt, Chlamydophila pneumoniae J138
ucccucuucuuc

SEQ ID NO: 529943 - RNA, 14 nt, Chlamydophila pneumoniae J138
ucccucuucuucca

SEQ ID NO: 529944 - RNA, 16 nt, Chlamydophila pneumoniae J138
ucccucuucuuccaau

SEQ ID NO: 529945 - RNA, 23 nt, Chlamydophila pneumoniae J138
uccgacucuguuuccuugugucu

SEQ ID NO: 529946 - RNA, 18 nt, Chlamydophila pneumoniae J138
aaaucugcucuacuuguc

SEQ ID NO: 529947 - RNA, 21 nt, Chlamydophila pneumoniae J138
aaaucugcaagauuaucuuua

SEQ ID NO: 529948 - RNA, 14 nt, Chlamydophila pneumoniae J138
uccgaaaacucuua

SEQ ID NO: 529949 - RNA, 16 nt, Chlamydophila pneumoniae J138
uccgaauggagaagga

SEQ ID NO: 529950 - RNA, 18 nt, Chlamydophila pneumoniae J138
uccgaagacuaccaaucc

SEQ ID NO: 529951 - RNA, 21 nt, Chlamydophila pneumoniae J138
uccgaucauaauuagagagaa

SEQ ID NO: 529952 - RNA, 23 nt, Chlamydophila pneumoniae J138
uccgaucauuuuugcuagaucug

SEQ ID NO: 529953 - RNA, 17 nt, Chlamydophila pneumoniae J138
uccgauuaacuuuauac

SEQ ID NO: 529954 - RNA, 20 nt, Chlamydophila pneumoniae J138
uccgcuagaggaucuucaag

SEQ ID NO: 529955 - RNA, 22 nt, Chlamydophila pneumoniae J138
uccgcccgucuuagaauccaaa

SEQ ID NO: 529956 - RNA, 13 nt, Chlamydophila pneumoniae J138
uccuugaaaauca

SEQ ID NO: 529957 - RNA, 21 nt, Chlamydophila pneumoniae J138
uccuucuuucugcucuucuau

SEQ ID NO: 529958 - RNA, 13 nt, Chlamydophila pneumoniae J138
uccuucuguuuuc

SEQ ID NO: 529959 - RNA, 12 nt, Chlamydophila pneumoniae J138
uccuucuugcaa

SEQ ID NO: 529960 - RNA, 14 nt, Chlamydophila pneumoniae J138
uccuucuucuucaa

SEQ ID NO: 529961 - RNA, 14 nt, Chlamydophila pneumoniae J138
uccuugauuuggga

SEQ ID NO: 529962 - RNA, 19 nt, Chlamydophila pneumoniae J138
uccuugcaaaacagcauca

SEQ ID NO: 529963 - RNA, 17 nt, Chlamydophila pneumoniae J138
uccuuccuuaagggaag

SEQ ID NO: 529964 - RNA, 17 nt, Chlamydophila pneumoniae J138
uccuucgaagcggagca

SEQ ID NO: 529965 - RNA, 16 nt, Chlamydophila pneumoniae J138
uccuucuauagcaaga

SEQ ID NO: 529966 - RNA, 14 nt, Chlamydophila pneumoniae J138
uccuucugcaauca

SEQ ID NO: 529967 - RNA, 20 nt, Chlamydophila pneumoniae J138
uccuucugcaaucagugcug

SEQ ID NO: 529968 - RNA, 12 nt, Chlamydophila pneumoniae J138
uccuucucccuc

SEQ ID NO: 529969 - RNA, 15 nt, Chlamydophila pneumoniae J138
uccuucuggagugac

SEQ ID NO: 529970 - RNA, 20 nt, Chlamydophila pneumoniae J138
uccuucuggagugacaccaa

SEQ ID NO: 529971 - RNA, 17 nt, Chlamydophila pneumoniae J138
uccuuguagaacuucuc

SEQ ID NO: 529972 - RNA, 17 nt, Chlamydophila pneumoniae J138
uccuugcagcccugcau

SEQ ID NO: 529973 - RNA, 17 nt, Chlamydophila pneumoniae J138
uccuuggauuucuucuu

SEQ ID NO: 529974 - RNA, 15 nt, Chlamydophila pneumoniae J138
uccuugggucuuuuu

SEQ ID NO: 529975 - RNA, 17 nt, Chlamydophila pneumoniae J138
ucgaaauccuaaaaagg

SEQ ID NO: 529976 - RNA, 19 nt, Chlamydophila pneumoniae J138
ucgaaacucuuugaggaua

SEQ ID NO: 529977 - RNA, 22 nt, Chlamydophila pneumoniae J138
ucgaaacacucaugaaagugcu

SEQ ID NO: 529978 - RNA, 19 nt, Chlamydophila pneumoniae J138
uccuuugagucuuuuucag

SEQ ID NO: 529979 - RNA, 22 nt, Chlamydophila pneumoniae J138
uccuuugagucuuuuucagaaa

SEQ ID NO: 529980 - RNA, 20 nt, Chlamydophila pneumoniae J138
uccuuucuuuugcuuuuccc

SEQ ID NO: 529981 - RNA, 13 nt, Chlamydophila pneumoniae J138
uccuuuuaaaauu

SEQ ID NO: 529982 - RNA, 17 nt, Chlamydophila pneumoniae J138
uccuuuguauucagugu

SEQ ID NO: 529983 - RNA, 14 nt, Chlamydophila pneumoniae J138
ucgaaaaacgguaa

SEQ ID NO: 529984 - RNA, 14 nt, Chlamydophila pneumoniae J138
ucgaccuauuugca

SEQ ID NO: 529985 - RNA, 21 nt, Chlamydophila pneumoniae J138
ucgacacuauguguuuccuuu

SEQ ID NO: 529986 - RNA, 16 nt, Chlamydophila pneumoniae J138
ucgaagauucaaagaa

SEQ ID NO: 529987 - RNA, 20 nt, Chlamydophila pneumoniae J138
ucgaagauucaaagaagucg

SEQ ID NO: 529988 - RNA, 16 nt, Chlamydophila pneumoniae J138
ucgaagcggagcaucu

SEQ ID NO: 529989 - RNA, 23 nt, Chlamydophila pneumoniae J138
ucgaauuuuuguuuuaacucuag

SEQ ID NO: 529990 - RNA, 15 nt, Chlamydophila pneumoniae J138
ucgaauuuuuguuuu

SEQ ID NO: 529991 - RNA, 16 nt, Chlamydophila pneumoniae J138
ucgacaaccaaaacag

SEQ ID NO: 529992 - RNA, 14 nt, Chlamydophila pneumoniae J138
ucgaaucuuuauuu

SEQ ID NO: 529993 - RNA, 16 nt, Chlamydophila pneumoniae J138
ucgaaucuuuauuucu

SEQ ID NO: 529994 - RNA, 23 nt, Chlamydophila pneumoniae J138
ucgaauccgauagaucacaucaa

SEQ ID NO: 529995 - RNA, 12 nt, Chlamydophila pneumoniae J138
ucgaauuccucc

SEQ ID NO: 529996 - RNA, 20 nt, Chlamydophila pneumoniae J138
ucgaauuguguguuuucaua

SEQ ID NO: 529997 - RNA, 22 nt, Chlamydophila pneumoniae J138
ucgaauuguguguuuucauaaa

SEQ ID NO: 529998 - RNA, 14 nt, Chlamydophila pneumoniae J138
ucgaaugcugcaca

SEQ ID NO: 529999 - RNA, 19 nt, Chlamydophila pneumoniae J138
ucgaaugcugcacaguuca

SEQ ID NO: 530000 - RNA, 17 nt, Chlamydophila pneumoniae J138
ucgagagaagaaauucu

SEQ ID NO: 530001 - RNA, 15 nt, Chlamydophila pneumoniae J138
ucgagagaagaaauu

SEQ ID NO: 530002 - RNA, 21 nt, Chlamydophila pneumoniae J138
ucgagaaaugcucuucugcag

SEQ ID NO: 530003 - RNA, 21 nt, Chlamydophila pneumoniae J138
ucgacuauaagagguucucuu

SEQ ID NO: 530004 - RNA, 12 nt, Chlamydophila pneumoniae J138
ucgacucuucca

SEQ ID NO: 530005 - RNA, 21 nt, Chlamydophila pneumoniae J138
ucgacuuccuucaaucguaau

SEQ ID NO: 530006 - RNA, 21 nt, Chlamydophila pneumoniae J138
ucgagcagaaacuccaaaaua

SEQ ID NO: 530007 - RNA, 16 nt, Chlamydophila pneumoniae J138
ucgagcuuuaagaaga

SEQ ID NO: 530008 - RNA, 12 nt, Chlamydophila pneumoniae J138
ucgauaagaacu

SEQ ID NO: 530009 - RNA, 17 nt, Chlamydophila pneumoniae J138
ucgauaacacuucuuuc

SEQ ID NO: 530010 - RNA, 19 nt, Chlamydophila pneumoniae J138
ucgauaacacuucuuucuu

SEQ ID NO: 530011 - RNA, 20 nt, Chlamydophila pneumoniae J138
ucgauaacacuucuuucuug

SEQ ID NO: 530012 - RNA, 18 nt, Chlamydophila pneumoniae J138
ucgauaagaacuuuaggg

SEQ ID NO: 530013 - RNA, 21 nt, Chlamydophila pneumoniae J138
ucgaguauggcaaauaaaaca

SEQ ID NO: 530014 - RNA, 17 nt, Chlamydophila pneumoniae J138
ucgaguauggcaaauaa

SEQ ID NO: 530015 - RNA, 20 nt, Chlamydophila pneumoniae J138
ucgaguaccgaccgaaucuc

SEQ ID NO: 530016 - RNA, 17 nt, Chlamydophila pneumoniae J138
ucgauaggaagccaguc

SEQ ID NO: 530017 - RNA, 18 nt, Chlamydophila pneumoniae J138
ucgauugagauugaggau

SEQ ID NO: 530018 - RNA, 15 nt, Chlamydophila pneumoniae J138
ucgauuggaagcaaa

SEQ ID NO: 530019 - RNA, 18 nt, Chlamydophila pneumoniae J138
ucgauucucguguagaau

SEQ ID NO: 530020 - RNA, 17 nt, Chlamydophila pneumoniae J138
ucgaugagggaaaugcg

SEQ ID NO: 530021 - RNA, 23 nt, Chlamydophila pneumoniae J138
ucgaucccggcuuugggcaucuc

SEQ ID NO: 530022 - RNA, 22 nt, Chlamydophila pneumoniae J138
ucgaucucugugguuccuggau

SEQ ID NO: 530023 - RNA, 19 nt, Chlamydophila pneumoniae J138
ucgcacacuccauuucagc

SEQ ID NO: 530024 - RNA, 17 nt, Chlamydophila pneumoniae J138
uccucgucuaaagaaga

SEQ ID NO: 530025 - RNA, 14 nt, Chlamydophila pneumoniae J138
uccucgucuucaau

SEQ ID NO: 530026 - RNA, 23 nt, Chlamydophila pneumoniae J138
uccucuaaggacaaaucucccaa

SEQ ID NO: 530027 - RNA, 21 nt, Chlamydophila pneumoniae J138
uccucuaaggacaaaucuccc

SEQ ID NO: 530028 - RNA, 20 nt, Chlamydophila pneumoniae J138
uccucgagaacguagcagag

SEQ ID NO: 530029 - RNA, 16 nt, Chlamydophila pneumoniae J138
uccucgaauggagugc

SEQ ID NO: 530030 - RNA, 14 nt, Chlamydophila pneumoniae J138
uccucaucaucaga

SEQ ID NO: 530031 - RNA, 20 nt, Chlamydophila pneumoniae J138
uccuccaaugagcucuauuu

SEQ ID NO: 530032 - RNA, 15 nt, Chlamydophila pneumoniae J138
uccuccccauacaua

SEQ ID NO: 530033 - RNA, 18 nt, Chlamydophila pneumoniae J138
uccuccuagguucuuuuu

SEQ ID NO: 530034 - RNA, 16 nt, Chlamydophila pneumoniae J138
uccugacacaacucuu

SEQ ID NO: 530035 - RNA, 23 nt, Chlamydophila pneumoniae J138
uccugacgcauagcacuaugaau

SEQ ID NO: 530036 - RNA, 11 nt, Chlamydophila pneumoniae J138
uccugagacca

SEQ ID NO: 530037 - RNA, 14 nt, Chlamydophila pneumoniae J138
uccugaguaaaauc

SEQ ID NO: 530038 - RNA, 22 nt, Chlamydophila pneumoniae J138
uccucuauccaucaucgaagaa

SEQ ID NO: 530039 - RNA, 14 nt, Chlamydophila pneumoniae J138
uccucuauccauca

SEQ ID NO: 530040 - RNA, 22 nt, Chlamydophila pneumoniae J138
uccucuauauuuuuucccacaa

SEQ ID NO: 530041 - RNA, 16 nt, Chlamydophila pneumoniae J138
uccucucaugaaauuu

SEQ ID NO: 530042 - RNA, 22 nt, Chlamydophila pneumoniae J138
uccucuccaaaacaaucuaaag

SEQ ID NO: 530043 - RNA, 15 nt, Chlamydophila pneumoniae J138
uccucugauuccagu

SEQ ID NO: 530044 - RNA, 14 nt, Chlamydophila pneumoniae J138
uccucuuccuuuuu

SEQ ID NO: 530045 - RNA, 17 nt, Chlamydophila pneumoniae J138
uccucuucuauucugau

SEQ ID NO: 530046 - RNA, 20 nt, Chlamydophila pneumoniae J138
uccucuucuucaucuucuaa

SEQ ID NO: 530047 - RNA, 13 nt, Chlamydophila pneumoniae J138
uccugaaaguaca

SEQ ID NO: 530048 - RNA, 19 nt, Chlamydophila pneumoniae J138
uccugaacggcucuuucua

SEQ ID NO: 530049 - RNA, 22 nt, Chlamydophila pneumoniae J138
uccugaagccaugacaaagggu

SEQ ID NO: 530050 - RNA, 13 nt, Chlamydophila pneumoniae J138
uccugaagcagcu

SEQ ID NO: 530051 - RNA, 19 nt, Chlamydophila pneumoniae J138
uccugaagaugagaaaauc

SEQ ID NO: 530052 - RNA, 22 nt, Chlamydophila pneumoniae J138
uccugcagcagccuuggcucua

SEQ ID NO: 530053 - RNA, 19 nt, Chlamydophila pneumoniae J138
uccugcaagcauuguuugu

SEQ ID NO: 530054 - RNA, 17 nt, Chlamydophila pneumoniae J138
uccugcaguauuauaaa

SEQ ID NO: 530055 - RNA, 21 nt, Chlamydophila pneumoniae J138
uccugcagggggcauucccug

SEQ ID NO: 530056 - RNA, 11 nt, Chlamydophila pneumoniae J138
uccugcugcuu

SEQ ID NO: 530057 - RNA, 16 nt, Chlamydophila pneumoniae J138
uccuggagcaugagag

SEQ ID NO: 530058 - RNA, 21 nt, Chlamydophila pneumoniae J138
uccuucauacguuuuuuuccu

SEQ ID NO: 530059 - RNA, 13 nt, Chlamydophila pneumoniae J138
uccuucaggauuu

SEQ ID NO: 530060 - RNA, 19 nt, Chlamydophila pneumoniae J138
uccuucaggauuuuccauu

SEQ ID NO: 530061 - RNA, 20 nt, Chlamydophila pneumoniae J138
uccuucaggauuuuccauua

SEQ ID NO: 530062 - RNA, 14 nt, Chlamydophila pneumoniae J138
uccuucaacacacc

SEQ ID NO: 530063 - RNA, 16 nt, Chlamydophila pneumoniae J138
uccuuauuguagagag

SEQ ID NO: 530064 - RNA, 15 nt, Chlamydophila pneumoniae J138
uccuuaaccuccuca

SEQ ID NO: 530065 - RNA, 22 nt, Chlamydophila pneumoniae J138
uccuuaaugguagcuuaagaau

SEQ ID NO: 530066 - RNA, 22 nt, Chlamydophila pneumoniae J138
uccuuaccaauaugcucugcca

SEQ ID NO: 530067 - RNA, 19 nt, Chlamydophila pneumoniae J138
uccuuaccuauauagcccu

SEQ ID NO: 530068 - RNA, 17 nt, Chlamydophila pneumoniae J138
uccuuauccgucagccu

SEQ ID NO: 530069 - RNA, 20 nt, Chlamydophila pneumoniae J138
uccuuaggggcguugagcaa

SEQ ID NO: 530070 - RNA, 16 nt, Chlamydophila pneumoniae J138
uccugggguucucuaa

SEQ ID NO: 530071 - RNA, 15 nt, Chlamydophila pneumoniae J138
uccuggucuccagaa

SEQ ID NO: 530072 - RNA, 16 nt, Chlamydophila pneumoniae J138
uccuguaguuuuacuu

SEQ ID NO: 530073 - RNA, 20 nt, Chlamydophila pneumoniae J138
uccuguacaucgguguugca

SEQ ID NO: 530074 - RNA, 13 nt, Chlamydophila pneumoniae J138
uccuguagccacu

SEQ ID NO: 530075 - RNA, 23 nt, Chlamydophila pneumoniae J138
uccugucuauuucuuaauuuccu

SEQ ID NO: 530076 - RNA, 15 nt, Chlamydophila pneumoniae J138
uccuguuccauauca

SEQ ID NO: 530077 - RNA, 20 nt, Chlamydophila pneumoniae J138
uccggauucuuuauccccag

SEQ ID NO: 530078 - RNA, 17 nt, Chlamydophila pneumoniae J138
uccggaaggaguucuuu

SEQ ID NO: 530079 - RNA, 18 nt, Chlamydophila pneumoniae J138
uccggaacgcagaguuuu

SEQ ID NO: 530080 - RNA, 16 nt, Chlamydophila pneumoniae J138
uccucacauguuucac

SEQ ID NO: 530081 - RNA, 22 nt, Chlamydophila pneumoniae J138
uccucaaagaguuuuuuagagg

SEQ ID NO: 530082 - RNA, 20 nt, Chlamydophila pneumoniae J138
uccucaagauaaaucccacu

SEQ ID NO: 530083 - RNA, 19 nt, Chlamydophila pneumoniae J138
uccucaagauaaaucccac

SEQ ID NO: 530084 - RNA, 17 nt, Chlamydophila pneumoniae J138
uccucaagaauaugaac

SEQ ID NO: 530085 - RNA, 21 nt, Chlamydophila pneumoniae J138
uccucaagaauaugaacugcc

SEQ ID NO: 530086 - RNA, 23 nt, Chlamydophila pneumoniae J138
uccucaaagccgaggauucgcua

SEQ ID NO: 530087 - RNA, 14 nt, Chlamydophila pneumoniae J138
uccuauuuuuuaag

SEQ ID NO: 530088 - RNA, 19 nt, Chlamydophila pneumoniae J138
uccuaucaaagcaaaaguc

SEQ ID NO: 530089 - RNA, 22 nt, Chlamydophila pneumoniae J138
uccuauaugaaugauuuccaua

SEQ ID NO: 530090 - RNA, 18 nt, Chlamydophila pneumoniae J138
uccuacgagcgcuuucuu

SEQ ID NO: 530091 - RNA, 21 nt, Chlamydophila pneumoniae J138
uccuaccuauauuuuuuacau

SEQ ID NO: 530092 - RNA, 16 nt, Chlamydophila pneumoniae J138
uccuacuucugcagga

SEQ ID NO: 530093 - RNA, 22 nt, Chlamydophila pneumoniae J138
uccuagacagccuugacucuaa

SEQ ID NO: 530094 - RNA, 16 nt, Chlamydophila pneumoniae J138
uccuagacgaucuuca

SEQ ID NO: 530095 - RNA, 21 nt, Chlamydophila pneumoniae J138
uccuagagucgaguuucuagu

SEQ ID NO: 530096 - RNA, 20 nt, Chlamydophila pneumoniae J138
uccuagacagccuugacucu

SEQ ID NO: 530097 - RNA, 19 nt, Chlamydophila pneumoniae J138
uccuaagagauuuuccaua

SEQ ID NO: 530098 - RNA, 18 nt, Chlamydophila pneumoniae J138
uccuaagucguuaacauc

SEQ ID NO: 530099 - RNA, 20 nt, Chlamydophila pneumoniae J138
uccuaagucguuaacaucaa

SEQ ID NO: 530100 - RNA, 16 nt, Chlamydophila pneumoniae J138
uccgucauauuuaaaa

SEQ ID NO: 530101 - RNA, 16 nt, Chlamydophila pneumoniae J138
uccgucaagaacaaga

SEQ ID NO: 530102 - RNA, 14 nt, Chlamydophila pneumoniae J138
uccguauuuuuuac

SEQ ID NO: 530103 - RNA, 19 nt, Chlamydophila pneumoniae J138
uccguagguguuaaguuca

SEQ ID NO: 530104 - RNA, 20 nt, Chlamydophila pneumoniae J138
uccguaaggacuguagugaa

SEQ ID NO: 530105 - RNA, 12 nt, Chlamydophila pneumoniae J138
uccguaaguaac

SEQ ID NO: 530106 - RNA, 18 nt, Chlamydophila pneumoniae J138
uccguuaccaaaaacugg

SEQ ID NO: 530107 - RNA, 23 nt, Chlamydophila pneumoniae J138
uccgugagauacuuuaaagacuu

SEQ ID NO: 530108 - RNA, 14 nt, Chlamydophila pneumoniae J138
uccgugagcaacaa

SEQ ID NO: 530109 - RNA, 17 nt, Chlamydophila pneumoniae J138
uccguugaauuaauaaa

SEQ ID NO: 530110 - RNA, 15 nt, Chlamydophila pneumoniae J138
uccguuuuuucagau

SEQ ID NO: 530111 - RNA, 23 nt, Chlamydophila pneumoniae J138
uccuaaaacaagaagaucaaaga

SEQ ID NO: 530112 - RNA, 15 nt, Chlamydophila pneumoniae J138
uaguaaggagagacu

SEQ ID NO: 530113 - RNA, 14 nt, Chlamydophila pneumoniae J138
uaguaacuaaauuc

SEQ ID NO: 530114 - RNA, 18 nt, Chlamydophila pneumoniae J138
uagguuguuguugaggaa

SEQ ID NO: 530115 - RNA, 22 nt, Chlamydophila pneumoniae J138
uagguucuuuucggaucagaau

SEQ ID NO: 530116 - RNA, 23 nt, Chlamydophila pneumoniae J138
uagguucuuuucggaucagaaug

SEQ ID NO: 530117 - RNA, 12 nt, Chlamydophila pneumoniae J138
uagguucuuuuc

SEQ ID NO: 530118 - RNA, 20 nt, Chlamydophila pneumoniae J138
uaguaauuacagcuuuaauc

SEQ ID NO: 530119 - RNA, 16 nt, Chlamydophila pneumoniae J138
uagucaauguauucuc

SEQ ID NO: 530120 - RNA, 23 nt, Chlamydophila pneumoniae J138
uagugaggccuccauuucuagga

SEQ ID NO: 530121 - RNA, 14 nt, Chlamydophila pneumoniae J138
uagugagauagucu

SEQ ID NO: 530122 - RNA, 17 nt, Chlamydophila pneumoniae J138
uaguggucaucucguug

SEQ ID NO: 530123 - RNA, 14 nt, Chlamydophila pneumoniae J138
uaguuacugaggaa

SEQ ID NO: 530124 - RNA, 12 nt, Chlamydophila pneumoniae J138
uaguuagagaag

SEQ ID NO: 530125 - RNA, 15 nt, Chlamydophila pneumoniae J138
uaguuagcauugcuu

SEQ ID NO: 530126 - RNA, 23 nt, Chlamydophila pneumoniae J138
uaguucucuaagacuguguuuua

SEQ ID NO: 530127 - RNA, 14 nt, Chlamydophila pneumoniae J138
uagucguuuucucg

SEQ ID NO: 530128 - RNA, 16 nt, Chlamydophila pneumoniae J138
uagucuuucuaagaag

SEQ ID NO: 530129 - RNA, 14 nt, Chlamydophila pneumoniae J138
uagucuucuuagaa

SEQ ID NO: 530130 - RNA, 15 nt, Chlamydophila pneumoniae J138
uagucuuucaaccuc

SEQ ID NO: 530131 - RNA, 15 nt, Chlamydophila pneumoniae J138
uagucuuucuaagaa

SEQ ID NO: 530132 - RNA, 13 nt, Chlamydophila pneumoniae J138
uagucuucuuaga

SEQ ID NO: 530133 - RNA, 19 nt, Chlamydophila pneumoniae J138
uagugaagcugcuucuuca

SEQ ID NO: 530134 - RNA, 21 nt, Chlamydophila pneumoniae J138
uagugaacuuuuguacacaga

SEQ ID NO: 530135 - RNA, 15 nt, Chlamydophila pneumoniae J138
uagugacuccugguu

SEQ ID NO: 530136 - RNA, 11 nt, Chlamydophila pneumoniae J138
uaguucuucuu

SEQ ID NO: 530137 - RNA, 18 nt, Chlamydophila pneumoniae J138
uaguugcaugacuauuuu

SEQ ID NO: 530138 - RNA, 17 nt, Chlamydophila pneumoniae J138
uauaaaguuuccaagug

SEQ ID NO: 530139 - RNA, 13 nt, Chlamydophila pneumoniae J138
uauaaagguuaca

SEQ ID NO: 530140 - RNA, 23 nt, Chlamydophila pneumoniae J138
uauaaagauaaucuguaagaaaa

SEQ ID NO: 530141 - RNA, 16 nt, Chlamydophila pneumoniae J138
uauaaagcaaaugccu

SEQ ID NO: 530142 - RNA, 23 nt, Chlamydophila pneumoniae J138
uauaagauaauagagaagaagca

SEQ ID NO: 530143 - RNA, 17 nt, Chlamydophila pneumoniae J138
uauaagggggaucuuca

SEQ ID NO: 530144 - RNA, 23 nt, Chlamydophila pneumoniae J138
uauaagggggaucuucagagaga

SEQ ID NO: 530145 - RNA, 17 nt, Chlamydophila pneumoniae J138
uauaagugacuuuucuu

SEQ ID NO: 530146 - RNA, 18 nt, Chlamydophila pneumoniae J138
uaucagauccaugaacag

SEQ ID NO: 530147 - RNA, 14 nt, Chlamydophila pneumoniae J138
uauauccugaguga

SEQ ID NO: 530148 - RNA, 18 nt, Chlamydophila pneumoniae J138
uauauaaagguuacaagc

SEQ ID NO: 530149 - RNA, 12 nt, Chlamydophila pneumoniae J138
uauaggaaacug

SEQ ID NO: 530150 - RNA, 19 nt, Chlamydophila pneumoniae J138
uauaggcgugugaaaucug

SEQ ID NO: 530151 - RNA, 14 nt, Chlamydophila pneumoniae J138
uauaguagaagaaa

SEQ ID NO: 530152 - RNA, 15 nt, Chlamydophila pneumoniae J138
uaucauaucuucaaa

SEQ ID NO: 530153 - RNA, 22 nt, Chlamydophila pneumoniae J138
uauccagaaauacguccagccu

SEQ ID NO: 530154 - RNA, 18 nt, Chlamydophila pneumoniae J138
uauccagaaauacgucca

SEQ ID NO: 530155 - RNA, 21 nt, Chlamydophila pneumoniae J138
uauccagaaagauucugccca

SEQ ID NO: 530156 - RNA, 14 nt, Chlamydophila pneumoniae J138
uaucaucaaaagau

SEQ ID NO: 530157 - RNA, 17 nt, Chlamydophila pneumoniae J138
uaucccagauaaagaca

SEQ ID NO: 530158 - RNA, 12 nt, Chlamydophila pneumoniae J138
uaucccacagaa

SEQ ID NO: 530159 - RNA, 19 nt, Chlamydophila pneumoniae J138
uauccccagaucucuuuag

SEQ ID NO: 530160 - RNA, 20 nt, Chlamydophila pneumoniae J138
uaucggaccuacguuuucuc

SEQ ID NO: 530161 - RNA, 21 nt, Chlamydophila pneumoniae J138
uaucggaccuacguuuucucu

SEQ ID NO: 530162 - RNA, 17 nt, Chlamydophila pneumoniae J138
uaucggcaauuguuaaa

SEQ ID NO: 530163 - RNA, 14 nt, Chlamydophila pneumoniae J138
uaucgaguucuuuu

SEQ ID NO: 530164 - RNA, 18 nt, Chlamydophila pneumoniae J138
uaucgacuguacaaaugc

SEQ ID NO: 530165 - RNA, 15 nt, Chlamydophila pneumoniae J138
uauccucgucuucaa

SEQ ID NO: 530166 - RNA, 15 nt, Chlamydophila pneumoniae J138
uauccuuaucuugcu

SEQ ID NO: 530167 - RNA, 22 nt, Chlamydophila pneumoniae J138
uaucuuuauuuaaauaaaacca

SEQ ID NO: 530168 - RNA, 15 nt, Chlamydophila pneumoniae J138
uaugaaacccauaau

SEQ ID NO: 530169 - RNA, 19 nt, Chlamydophila pneumoniae J138
uaugaacgauuucuuuuag

SEQ ID NO: 530170 - RNA, 20 nt, Chlamydophila pneumoniae J138
uaucuuuaagauuuuuagaa

SEQ ID NO: 530171 - RNA, 16 nt, Chlamydophila pneumoniae J138
uaucuugaaaguacag

SEQ ID NO: 530172 - RNA, 22 nt, Chlamydophila pneumoniae J138
uaucuucagaaugcccuuuagg

SEQ ID NO: 530173 - RNA, 14 nt, Chlamydophila pneumoniae J138
uaucuguuaaaaac

SEQ ID NO: 530174 - RNA, 16 nt, Chlamydophila pneumoniae J138
uaucugcacuuucuuu

SEQ ID NO: 530175 - RNA, 14 nt, Chlamydophila pneumoniae J138
uaucugcuucuacg

SEQ ID NO: 530176 - RNA, 16 nt, Chlamydophila pneumoniae J138
uaucugcguuucuuuc

SEQ ID NO: 530177 - RNA, 21 nt, Chlamydophila pneumoniae J138
uaucucuguuuuuugaaaacu

SEQ ID NO: 530178 - RNA, 20 nt, Chlamydophila pneumoniae J138
uaucucuggcauaauccuga

SEQ ID NO: 530179 - RNA, 20 nt, Chlamydophila pneumoniae J138
uaucuccggaacgcagaguu

SEQ ID NO: 530180 - RNA, 19 nt, Chlamydophila pneumoniae J138
uaucuccgggaacaacugu

SEQ ID NO: 530181 - RNA, 18 nt, Chlamydophila pneumoniae J138
uaucucccaagacgagaa

SEQ ID NO: 530182 - RNA, 14 nt, Chlamydophila pneumoniae J138
uaucguuucaguuu

SEQ ID NO: 530183 - RNA, 12 nt, Chlamydophila pneumoniae J138
uaucuacagaga

SEQ ID NO: 530184 - RNA, 14 nt, Chlamydophila pneumoniae J138
uaucuaaagaaaug

SEQ ID NO: 530185 - RNA, 22 nt, Chlamydophila pneumoniae J138
uaucuauccuuaggugaaauau

SEQ ID NO: 530186 - RNA, 16 nt, Chlamydophila pneumoniae J138
uaucuauagaaggcau

SEQ ID NO: 530187 - RNA, 21 nt, Chlamydophila pneumoniae J138
uaucuagaaguuuaaacgucu

SEQ ID NO: 530188 - RNA, 15 nt, Chlamydophila pneumoniae J138
uaugaugccucauug

SEQ ID NO: 530189 - RNA, 16 nt, Chlamydophila pneumoniae J138
uaugauguauaaaguu

SEQ ID NO: 530190 - RNA, 21 nt, Chlamydophila pneumoniae J138
uaugauccgaaaacucuuaga

SEQ ID NO: 530191 - RNA, 15 nt, Chlamydophila pneumoniae J138
uaugauuacaucuaa

SEQ ID NO: 530192 - RNA, 20 nt, Chlamydophila pneumoniae J138
uaugacuucuuguccuguua

SEQ ID NO: 530193 - RNA, 15 nt, Chlamydophila pneumoniae J138
uaugacuucuugucc

SEQ ID NO: 530194 - RNA, 16 nt, Chlamydophila pneumoniae J138
uaugaaugauuuccau

SEQ ID NO: 530195 - RNA, 21 nt, Chlamydophila pneumoniae J138
uaugaaugauuuccauagagu

SEQ ID NO: 530196 - RNA, 12 nt, Chlamydophila pneumoniae J138
uaugaaucacau

SEQ ID NO: 530197 - RNA, 19 nt, Chlamydophila pneumoniae J138
uaugacacagcuaaucaau

SEQ ID NO: 530198 - RNA, 15 nt, Chlamydophila pneumoniae J138
uaugaccaagaacau

SEQ ID NO: 530199 - RNA, 23 nt, Chlamydophila pneumoniae J138
uaugcuauagcuggaucuucuga

SEQ ID NO: 530200 - RNA, 20 nt, Chlamydophila pneumoniae J138
uaugcugaauuccucugauu

SEQ ID NO: 530201 - RNA, 17 nt, Chlamydophila pneumoniae J138
uaugccauaaauacagg

SEQ ID NO: 530202 - RNA, 15 nt, Chlamydophila pneumoniae J138
uauggaagauaaaca

SEQ ID NO: 530203 - RNA, 20 nt, Chlamydophila pneumoniae J138
uaugggaggaauuccucuca

SEQ ID NO: 530204 - RNA, 12 nt, Chlamydophila pneumoniae J138
uaugguccuagg

SEQ ID NO: 530205 - RNA, 15 nt, Chlamydophila pneumoniae J138
uaugguaguuugccu

SEQ ID NO: 530206 - RNA, 20 nt, Chlamydophila pneumoniae J138
uauggucucccucacaagaa

SEQ ID NO: 530207 - RNA, 15 nt, Chlamydophila pneumoniae J138
uauucuuuuguaauc

SEQ ID NO: 530208 - RNA, 20 nt, Chlamydophila pneumoniae J138
uauugaaaaaucccuguucu

SEQ ID NO: 530209 - RNA, 17 nt, Chlamydophila pneumoniae J138
uauucuguggaauauca

SEQ ID NO: 530210 - RNA, 18 nt, Chlamydophila pneumoniae J138
uauucuaagcuuauuucu

SEQ ID NO: 530211 - RNA, 22 nt, Chlamydophila pneumoniae J138
uauuguguucccucuucuucca

SEQ ID NO: 530212 - RNA, 13 nt, Chlamydophila pneumoniae J138
uauugcagaaucu

SEQ ID NO: 530213 - RNA, 12 nt, Chlamydophila pneumoniae J138
aaauccuaaaaa

SEQ ID NO: 530214 - RNA, 15 nt, Chlamydophila pneumoniae J138
uauguccguauuuuu

SEQ ID NO: 530215 - RNA, 18 nt, Chlamydophila pneumoniae J138
uaugugaugucgcgaaag

SEQ ID NO: 530216 - RNA, 24 nt, Chlamydophila pneumoniae J138
uaugugaaagauuauucuagaguu

SEQ ID NO: 530217 - RNA, 17 nt, Chlamydophila pneumoniae J138
uaugguccauaauuucu

SEQ ID NO: 530218 - RNA, 13 nt, Chlamydophila pneumoniae J138
uauuaaaaauagc

SEQ ID NO: 530219 - RNA, 15 nt, Chlamydophila pneumoniae J138
uauuaaaaucucuag

SEQ ID NO: 530220 - RNA, 23 nt, Chlamydophila pneumoniae J138
uauguuuucucgaagaaaauaaa

SEQ ID NO: 530221 - RNA, 14 nt, Chlamydophila pneumoniae J138
uauguuaaaaauac

SEQ ID NO: 530222 - RNA, 14 nt, Chlamydophila pneumoniae J138
uauuaaucuuauug

SEQ ID NO: 530223 - RNA, 18 nt, Chlamydophila pneumoniae J138
uauuaauaaauuuaucug

SEQ ID NO: 530224 - RNA, 22 nt, Chlamydophila pneumoniae J138
uauuaagggaagaucuugguua

SEQ ID NO: 530225 - RNA, 17 nt, Chlamydophila pneumoniae J138
uauuaaggauuccuuga

SEQ ID NO: 530226 - RNA, 14 nt, Chlamydophila pneumoniae J138
uauuaacccaccag

SEQ ID NO: 530227 - RNA, 20 nt, Chlamydophila pneumoniae J138
uauuaaagaugaaguuccca

SEQ ID NO: 530228 - RNA, 15 nt, Chlamydophila pneumoniae J138
uauuacagauuucuu

SEQ ID NO: 530229 - RNA, 18 nt, Chlamydophila pneumoniae J138
uauuacagauuucuucuu

SEQ ID NO: 530230 - RNA, 21 nt, Chlamydophila pneumoniae J138
uauuacagaaaggcuuuucuu

SEQ ID NO: 530231 - RNA, 15 nt, Chlamydophila pneumoniae J138
uauuauaaauagaaa

SEQ ID NO: 530232 - RNA, 18 nt, Chlamydophila pneumoniae J138
ucagcaagaaaauaggug

SEQ ID NO: 530233 - RNA, 14 nt, Chlamydophila pneumoniae J138
ucagcaagcccucc

SEQ ID NO: 530234 - RNA, 19 nt, Chlamydophila pneumoniae J138
ucagcaagaucuaacuuca

SEQ ID NO: 530235 - RNA, 15 nt, Chlamydophila pneumoniae J138
ucagcaagucgguaa

SEQ ID NO: 530236 - RNA, 21 nt, Chlamydophila pneumoniae J138
ucagcaccuuguauaagagca

SEQ ID NO: 530237 - RNA, 19 nt, Chlamydophila pneumoniae J138
ucagcaccuuguauaagag

SEQ ID NO: 530238 - RNA, 23 nt, Chlamydophila pneumoniae J138
ucagcacccaccauucuugaaga

SEQ ID NO: 530239 - RNA, 12 nt, Chlamydophila pneumoniae J138
ucagcagcuucu

SEQ ID NO: 530240 - RNA, 17 nt, Chlamydophila pneumoniae J138
ucagcagcuucuauugc

SEQ ID NO: 530241 - RNA, 18 nt, Chlamydophila pneumoniae J138
ucagcagcuucuauugcu

SEQ ID NO: 530242 - RNA, 21 nt, Chlamydophila pneumoniae J138
ucagcagcuucuauugcugua

SEQ ID NO: 530243 - RNA, 20 nt, Chlamydophila pneumoniae J138
ucagcccacuguuuugcuuc

SEQ ID NO: 530244 - RNA, 21 nt, Chlamydophila pneumoniae J138
ucagcccugccucacagcuaa

SEQ ID NO: 530245 - RNA, 21 nt, Chlamydophila pneumoniae J138
ucagcgcaucacgaaaaggag

SEQ ID NO: 530246 - RNA, 22 nt, Chlamydophila pneumoniae J138
ucagcgcaucacgaaaaggaga

SEQ ID NO: 530247 - RNA, 23 nt, Chlamydophila pneumoniae J138
ucaggauacucugaacaggaaua

SEQ ID NO: 530248 - RNA, 23 nt, Chlamydophila pneumoniae J138
ucaggcauucuucauuguagagg

SEQ ID NO: 530249 - RNA, 15 nt, Chlamydophila pneumoniae J138
ucaggcauucuucau

SEQ ID NO: 530250 - RNA, 15 nt, Chlamydophila pneumoniae J138
ucaggacaaugaaga

SEQ ID NO: 530251 - RNA, 15 nt, Chlamydophila pneumoniae J138
ucaggacaugccuua

SEQ ID NO: 530252 - RNA, 12 nt, Chlamydophila pneumoniae J138
ucaggagauaau

SEQ ID NO: 530253 - RNA, 19 nt, Chlamydophila pneumoniae J138
ucaggagauacaaguaauu

SEQ ID NO: 530254 - RNA, 20 nt, Chlamydophila pneumoniae J138
ucaggaggugguggagcuug

SEQ ID NO: 530255 - RNA, 21 nt, Chlamydophila pneumoniae J138
aaaucuacucuuuaaaaauag

SEQ ID NO: 530256 - RNA, 15 nt, Chlamydophila pneumoniae J138
aaaucuacauguaaa

SEQ ID NO: 530257 - RNA, 20 nt, Chlamydophila pneumoniae J138
aaaucuacucuuuaaaaaua

SEQ ID NO: 530258 - RNA, 22 nt, Chlamydophila pneumoniae J138
aaaucuauacccaguuguaucc

SEQ ID NO: 530259 - RNA, 13 nt, Chlamydophila pneumoniae J138
aaaucuaucugca

SEQ ID NO: 530260 - RNA, 23 nt, Chlamydophila pneumoniae J138
aaaucuccguuugucccuuucag

SEQ ID NO: 530261 - RNA, 20 nt, Chlamydophila pneumoniae J138
aaaucuccguuugucccuuu

SEQ ID NO: 530262 - RNA, 21 nt, Chlamydophila pneumoniae J138
aaaucucauuccagcaucuuc

SEQ ID NO: 530263 - RNA, 17 nt, Chlamydophila pneumoniae J138
aaaucucauuucguaga

SEQ ID NO: 530264 - RNA, 15 nt, Chlamydophila pneumoniae J138
ucagucucucuaucu

SEQ ID NO: 530265 - RNA, 20 nt, Chlamydophila pneumoniae J138
ucagucucgugcauaaugau

SEQ ID NO: 530266 - RNA, 15 nt, Chlamydophila pneumoniae J138
ucaguggauucgugc

SEQ ID NO: 530267 - RNA, 18 nt, Chlamydophila pneumoniae J138
ucaggucugcugaggaga

SEQ ID NO: 530268 - RNA, 22 nt, Chlamydophila pneumoniae J138
ucaggcuuuaaguguuucuuca

SEQ ID NO: 530269 - RNA, 17 nt, Chlamydophila pneumoniae J138
ucagagacaaguucauc

SEQ ID NO: 530270 - RNA, 16 nt, Chlamydophila pneumoniae J138
ucagagauugccagga

SEQ ID NO: 530271 - RNA, 19 nt, Chlamydophila pneumoniae J138
ucagagauugccaggagag

SEQ ID NO: 530272 - RNA, 17 nt, Chlamydophila pneumoniae J138
ucagaguugucaaguaa

SEQ ID NO: 530273 - RNA, 16 nt, Chlamydophila pneumoniae J138
ucagauaaaaagaagu

SEQ ID NO: 530274 - RNA, 15 nt, Chlamydophila pneumoniae J138
ucagaggcuagaaaa

SEQ ID NO: 530275 - RNA, 21 nt, Chlamydophila pneumoniae J138
ucagaggaaucuaagaacuag

SEQ ID NO: 530276 - RNA, 17 nt, Chlamydophila pneumoniae J138
ucagaggagccuccaua

SEQ ID NO: 530277 - RNA, 23 nt, Chlamydophila pneumoniae J138
ucagaaggaucugauagaacagg

SEQ ID NO: 530278 - RNA, 21 nt, Chlamydophila pneumoniae J138
ucagaagugaucuugagaaaa

SEQ ID NO: 530279 - RNA, 13 nt, Chlamydophila pneumoniae J138
ucagaagcuauuc

SEQ ID NO: 530280 - RNA, 20 nt, Chlamydophila pneumoniae J138
ucagaauuuuaucagaaacu

SEQ ID NO: 530281 - RNA, 15 nt, Chlamydophila pneumoniae J138
ucagauccaugaaca

SEQ ID NO: 530282 - RNA, 17 nt, Chlamydophila pneumoniae J138
ucagcaaacggagagca

SEQ ID NO: 530283 - RNA, 20 nt, Chlamydophila pneumoniae J138
ucagcaaagacauccaagcc

SEQ ID NO: 530284 - RNA, 18 nt, Chlamydophila pneumoniae J138
ucagcaaaaaacugcaaa

SEQ ID NO: 530285 - RNA, 23 nt, Chlamydophila pneumoniae J138
aaaucgguaaccugugaaaauuu

SEQ ID NO: 530286 - RNA, 19 nt, Chlamydophila pneumoniae J138
aaaucgugcuuagagccuu

SEQ ID NO: 530287 - RNA, 16 nt, Chlamydophila pneumoniae J138
ucacguccacaagcuu

SEQ ID NO: 530288 - RNA, 21 nt, Chlamydophila pneumoniae J138
ucacguauagguugaauaaau

SEQ ID NO: 530289 - RNA, 17 nt, Chlamydophila pneumoniae J138
ucacuagagaaaaagcc

SEQ ID NO: 530290 - RNA, 17 nt, Chlamydophila pneumoniae J138
ucacuaucuucuaaaac

SEQ ID NO: 530291 - RNA, 16 nt, Chlamydophila pneumoniae J138
ucacuucaucgacagu

SEQ ID NO: 530292 - RNA, 20 nt, Chlamydophila pneumoniae J138
ucacuucgacacgaacuuug

SEQ ID NO: 530293 - RNA, 16 nt, Chlamydophila pneumoniae J138
ucacuucugaugacgu

SEQ ID NO: 530294 - RNA, 23 nt, Chlamydophila pneumoniae J138
ucagaacaacgcugcuucucuac

SEQ ID NO: 530295 - RNA, 21 nt, Chlamydophila pneumoniae J138
ucagaacaacgcugcuucucu

SEQ ID NO: 530296 - RNA, 18 nt, Chlamydophila pneumoniae J138
ucagaacaacgcugcuuc

SEQ ID NO: 530297 - RNA, 22 nt, Chlamydophila pneumoniae J138
ucagaaaugaagccaaaaggca

SEQ ID NO: 530298 - RNA, 16 nt, Chlamydophila pneumoniae J138
ucagaaagccuuugcu

SEQ ID NO: 530299 - RNA, 18 nt, Chlamydophila pneumoniae J138
ucaaauacuucuccugaa

SEQ ID NO: 530300 - RNA, 19 nt, Chlamydophila pneumoniae J138
ucaaauacuucuccugaac

SEQ ID NO: 530301 - RNA, 17 nt, Chlamydophila pneumoniae J138
ucaaaggauccauaacc

SEQ ID NO: 530302 - RNA, 22 nt, Chlamydophila pneumoniae J138
ucaaauaggaucucucuuuccu

SEQ ID NO: 530303 - RNA, 16 nt, Chlamydophila pneumoniae J138
ucaaagcaaagagcaa

SEQ ID NO: 530304 - RNA, 12 nt, Chlamydophila pneumoniae J138
ucaaagcaaaga

SEQ ID NO: 530305 - RNA, 18 nt, Chlamydophila pneumoniae J138
ucaaagcaaaagucauaa

SEQ ID NO: 530306 - RNA, 16 nt, Chlamydophila pneumoniae J138
ucaaacugauuaguuu

SEQ ID NO: 530307 - RNA, 18 nt, Chlamydophila pneumoniae J138
ucaaauuccuucucagaa

SEQ ID NO: 530308 - RNA, 17 nt, Chlamydophila pneumoniae J138
ucaaauuugcucuccug

SEQ ID NO: 530309 - RNA, 21 nt, Chlamydophila pneumoniae J138
ucaaaccacggauuuucucua

SEQ ID NO: 530310 - RNA, 17 nt, Chlamydophila pneumoniae J138
ucaaacuccuuuuaaaa

SEQ ID NO: 530311 - RNA, 24 nt, Chlamydophila pneumoniae J138
ucaaaauuuuuaguaauuacagcu

SEQ ID NO: 530312 - RNA, 12 nt, Chlamydophila pneumoniae J138
uauuuaauccaa

SEQ ID NO: 530313 - RNA, 11 nt, Chlamydophila pneumoniae J138
ucaaaagaaga

SEQ ID NO: 530314 - RNA, 16 nt, Chlamydophila pneumoniae J138
ucaaaauuauccagaa

SEQ ID NO: 530315 - RNA, 13 nt, Chlamydophila pneumoniae J138
ucaacauucuucu

SEQ ID NO: 530316 - RNA, 20 nt, Chlamydophila pneumoniae J138
ucaaccaaacgucaggcucc

SEQ ID NO: 530317 - RNA, 21 nt, Chlamydophila pneumoniae J138
ucaacauucuucugucuguau

SEQ ID NO: 530318 - RNA, 19 nt, Chlamydophila pneumoniae J138
ucaacacccggcuuuucca

SEQ ID NO: 530319 - RNA, 19 nt, Chlamydophila pneumoniae J138
ucaacaccucaauacggac

SEQ ID NO: 530320 - RNA, 22 nt, Chlamydophila pneumoniae J138
ucaacaaguucuuggaaaaaag

SEQ ID NO: 530321 - RNA, 23 nt, Chlamydophila pneumoniae J138
ucaacaaguucuuggaaaaaagg

SEQ ID NO: 530322 - RNA, 13 nt, Chlamydophila pneumoniae J138
ucaacccagcugc

SEQ ID NO: 530323 - RNA, 16 nt, Chlamydophila pneumoniae J138
ucaacuacaucuccaa

SEQ ID NO: 530324 - RNA, 13 nt, Chlamydophila pneumoniae J138
ucaacuacaucuc

SEQ ID NO: 530325 - RNA, 21 nt, Chlamydophila pneumoniae J138
ucaacguuuguaguaaggaga

SEQ ID NO: 530326 - RNA, 14 nt, Chlamydophila pneumoniae J138
ucaacuuuguuaau

SEQ ID NO: 530327 - RNA, 13 nt, Chlamydophila pneumoniae J138
ucaauagcaaaga

SEQ ID NO: 530328 - RNA, 16 nt, Chlamydophila pneumoniae J138
ucaauagaagcuuguu

SEQ ID NO: 530329 - RNA, 16 nt, Chlamydophila pneumoniae J138
ucaauacgaucuuuug

SEQ ID NO: 530330 - RNA, 13 nt, Chlamydophila pneumoniae J138
ucaauaauuucaa

SEQ ID NO: 530331 - RNA, 14 nt, Chlamydophila pneumoniae J138
ucaaguuucuuuug

SEQ ID NO: 530332 - RNA, 16 nt, Chlamydophila pneumoniae J138
ucaaguuucuuuugca

SEQ ID NO: 530333 - RNA, 15 nt, Chlamydophila pneumoniae J138
ucaagaaaaaccccu

SEQ ID NO: 530334 - RNA, 13 nt, Chlamydophila pneumoniae J138
ucaauaaguagau

SEQ ID NO: 530335 - RNA, 14 nt, Chlamydophila pneumoniae J138
ucaauaagaucucg

SEQ ID NO: 530336 - RNA, 23 nt, Chlamydophila pneumoniae J138
ucaauaaucggccgaguuucucc

SEQ ID NO: 530337 - RNA, 18 nt, Chlamydophila pneumoniae J138
ucaauguuaaucuaauuu

SEQ ID NO: 530338 - RNA, 19 nt, Chlamydophila pneumoniae J138
ucaaugaagaaaaaucuac

SEQ ID NO: 530339 - RNA, 13 nt, Chlamydophila pneumoniae J138
ucaauccaagaau

SEQ ID NO: 530340 - RNA, 22 nt, Chlamydophila pneumoniae J138
ucaaugagcaucugagucauaa

SEQ ID NO: 530341 - RNA, 16 nt, Chlamydophila pneumoniae J138
ucaaugagaucugcaa

SEQ ID NO: 530342 - RNA, 19 nt, Chlamydophila pneumoniae J138
ucacaucaguuaacugugu

SEQ ID NO: 530343 - RNA, 20 nt, Chlamydophila pneumoniae J138
ucacauaguuuaauaaaucu

SEQ ID NO: 530344 - RNA, 15 nt, Chlamydophila pneumoniae J138
ucacaucuccuuuca

SEQ ID NO: 530345 - RNA, 13 nt, Chlamydophila pneumoniae J138
ucacaucuuucuc

SEQ ID NO: 530346 - RNA, 14 nt, Chlamydophila pneumoniae J138
ucacaucuuucucu

SEQ ID NO: 530347 - RNA, 15 nt, Chlamydophila pneumoniae J138
ucacaucuuucucua

SEQ ID NO: 530348 - RNA, 21 nt, Chlamydophila pneumoniae J138
ucacaucuuucucuaaaauau

SEQ ID NO: 530349 - RNA, 20 nt, Chlamydophila pneumoniae J138
ucaccauauaauagauauac

SEQ ID NO: 530350 - RNA, 22 nt, Chlamydophila pneumoniae J138
ucaccacgaacuucagcaagaa

SEQ ID NO: 530351 - RNA, 13 nt, Chlamydophila pneumoniae J138
ucacauaaaauaa

SEQ ID NO: 530352 - RNA, 14 nt, Chlamydophila pneumoniae J138
ucacauaaaauaau

SEQ ID NO: 530353 - RNA, 14 nt, Chlamydophila pneumoniae J138
ucacagucuuaaau

SEQ ID NO: 530354 - RNA, 11 nt, Chlamydophila pneumoniae J138
ucacaaagaau

SEQ ID NO: 530355 - RNA, 15 nt, Chlamydophila pneumoniae J138
ucacaaacaacagaa

SEQ ID NO: 530356 - RNA, 17 nt, Chlamydophila pneumoniae J138
ucacagcgcugugagga

SEQ ID NO: 530357 - RNA, 18 nt, Chlamydophila pneumoniae J138
ucacagcaugcacggcuu

SEQ ID NO: 530358 - RNA, 20 nt, Chlamydophila pneumoniae J138
ucacaaagaaccauagauuu

SEQ ID NO: 530359 - RNA, 16 nt, Chlamydophila pneumoniae J138
ucacagagucugggau

SEQ ID NO: 530360 - RNA, 15 nt, Chlamydophila pneumoniae J138
ucacagcaaucugca

SEQ ID NO: 530361 - RNA, 16 nt, Chlamydophila pneumoniae J138
ucacagcaaucugcag

SEQ ID NO: 530362 - RNA, 16 nt, Chlamydophila pneumoniae J138
uaaagaucuucauaac

SEQ ID NO: 530363 - RNA, 18 nt, Chlamydophila pneumoniae J138
uaaagaucgugaucaaag

SEQ ID NO: 530364 - RNA, 21 nt, Chlamydophila pneumoniae J138
uaaagauagcgacgucaucau

SEQ ID NO: 530365 - RNA, 15 nt, Chlamydophila pneumoniae J138
uaaagcaucacggac

SEQ ID NO: 530366 - RNA, 17 nt, Chlamydophila pneumoniae J138
uaaagcauuggacaacg

SEQ ID NO: 530367 - RNA, 14 nt, Chlamydophila pneumoniae J138
uaaagcugcuuuuu

SEQ ID NO: 530368 - RNA, 22 nt, Chlamydophila pneumoniae J138
uaaagcuguaaccaacaucaaa

SEQ ID NO: 530369 - RNA, 18 nt, Chlamydophila pneumoniae J138
uaaagcuccgagaaacaa

SEQ ID NO: 530370 - RNA, 15 nt, Chlamydophila pneumoniae J138
uaaagcuugagaaaa

SEQ ID NO: 530371 - RNA, 13 nt, Chlamydophila pneumoniae J138
uaaagcuuuuccg

SEQ ID NO: 530372 - RNA, 22 nt, Chlamydophila pneumoniae J138
uaaagccccacccacuccagaa

SEQ ID NO: 530373 - RNA, 14 nt, Chlamydophila pneumoniae J138
uaaagcuccgagaa

SEQ ID NO: 530374 - RNA, 15 nt, Chlamydophila pneumoniae J138
uaaagcuauuguuuu

SEQ ID NO: 530375 - RNA, 18 nt, Chlamydophila pneumoniae J138
uaaagugucauacgcagc

SEQ ID NO: 530376 - RNA, 17 nt, Chlamydophila pneumoniae J138
uaaaguagaauccuucu

SEQ ID NO: 530377 - RNA, 15 nt, Chlamydophila pneumoniae J138
uaaaggaacugugcc

SEQ ID NO: 530378 - RNA, 13 nt, Chlamydophila pneumoniae J138
uaaaguccaagau

SEQ ID NO: 530379 - RNA, 13 nt, Chlamydophila pneumoniae J138
uaaauaaaaccac

SEQ ID NO: 530380 - RNA, 19 nt, Chlamydophila pneumoniae J138
uaaaguuugagcuaagcug

SEQ ID NO: 530381 - RNA, 21 nt, Chlamydophila pneumoniae J138
uaaauaucuuaacgcuuagag

SEQ ID NO: 530382 - RNA, 19 nt, Chlamydophila pneumoniae J138
uaaacucuccaaaagcucu

SEQ ID NO: 530383 - RNA, 21 nt, Chlamydophila pneumoniae J138
uaaacuccauuguuguugcau

SEQ ID NO: 530384 - RNA, 17 nt, Chlamydophila pneumoniae J138
uaaacggacgcuagaga

SEQ ID NO: 530385 - RNA, 17 nt, Chlamydophila pneumoniae J138
uaaacugcuacuuuaaa

SEQ ID NO: 530386 - RNA, 19 nt, Chlamydophila pneumoniae J138
uaaacugacguuuuucccu

SEQ ID NO: 530387 - RNA, 17 nt, Chlamydophila pneumoniae J138
uaaacucuuguugucua

SEQ ID NO: 530388 - RNA, 21 nt, Chlamydophila pneumoniae J138
uaaacugggaagaccacgaaa

SEQ ID NO: 530389 - RNA, 13 nt, Chlamydophila pneumoniae J138
uaaagaauucucc

SEQ ID NO: 530390 - RNA, 22 nt, Chlamydophila pneumoniae J138
uaaagauaaucuguaagaaaau

SEQ ID NO: 530391 - RNA, 23 nt, Chlamydophila pneumoniae J138
uaaagaguuuguucacauuuuca

SEQ ID NO: 530392 - RNA, 15 nt, Chlamydophila pneumoniae J138
uaaagacaucucuuu

SEQ ID NO: 530393 - RNA, 16 nt, Chlamydophila pneumoniae J138
uaaagaccaaauagag

SEQ ID NO: 530394 - RNA, 22 nt, Chlamydophila pneumoniae J138
guuuugcuuuuugaaugaucca

SEQ ID NO: 530395 - RNA, 18 nt, Chlamydophila pneumoniae J138
guuuugcuguggaauuuu

SEQ ID NO: 530396 - RNA, 16 nt, Chlamydophila pneumoniae J138
guuuuuauuuuuaaau

SEQ ID NO: 530397 - RNA, 19 nt, Chlamydophila pneumoniae J138
guuuuucaauuuggauuua

SEQ ID NO: 530398 - RNA, 20 nt, Chlamydophila pneumoniae J138
uaaacaaagcgucuaucuag

SEQ ID NO: 530399 - RNA, 23 nt, Chlamydophila pneumoniae J138
uaaacagcacaggcauggucucc

SEQ ID NO: 530400 - RNA, 15 nt, Chlamydophila pneumoniae J138
uaaacagcaaaguaa

SEQ ID NO: 530401 - RNA, 12 nt, Chlamydophila pneumoniae J138
uaaacagcacag

SEQ ID NO: 530402 - RNA, 19 nt, Chlamydophila pneumoniae J138
uaaacagaucuuuaucauu

SEQ ID NO: 530403 - RNA, 22 nt, Chlamydophila pneumoniae J138
uaaacagcaguguuauuuggac

SEQ ID NO: 530404 - RNA, 13 nt, Chlamydophila pneumoniae J138
uaaauucuggaau

SEQ ID NO: 530405 - RNA, 19 nt, Chlamydophila pneumoniae J138
uaaauguuuucuaugaucc

SEQ ID NO: 530406 - RNA, 13 nt, Chlamydophila pneumoniae J138
uaaauuaaauauc

SEQ ID NO: 530407 - RNA, 14 nt, Chlamydophila pneumoniae J138
uaaauccaaaaaau

SEQ ID NO: 530408 - RNA, 19 nt, Chlamydophila pneumoniae J138
uaaaugcuauuuuccucua

SEQ ID NO: 530409 - RNA, 22 nt, Chlamydophila pneumoniae J138
uaacaacuagguuauuaucaaa

SEQ ID NO: 530410 - RNA, 18 nt, Chlamydophila pneumoniae J138
uaacaagggaagagaaaa

SEQ ID NO: 530411 - RNA, 15 nt, Chlamydophila pneumoniae J138
uaacaagauucucag

SEQ ID NO: 530412 - RNA, 17 nt, Chlamydophila pneumoniae J138
uaacaaguaccaagaaa

SEQ ID NO: 530413 - RNA, 19 nt, Chlamydophila pneumoniae J138
uaacaaguaccaagaaaau

SEQ ID NO: 530414 - RNA, 17 nt, Chlamydophila pneumoniae J138
uaaccuaaggcauggca

SEQ ID NO: 530415 - RNA, 24 nt, Chlamydophila pneumoniae J138
uaaccuaauacaggagcuaaagcu

SEQ ID NO: 530416 - RNA, 13 nt, Chlamydophila pneumoniae J138
uaacgcugcuaau

SEQ ID NO: 530417 - RNA, 14 nt, Chlamydophila pneumoniae J138
uaacagagcgccuc

SEQ ID NO: 530418 - RNA, 18 nt, Chlamydophila pneumoniae J138
uaacagagcgccuccacc

SEQ ID NO: 530419 - RNA, 17 nt, Chlamydophila pneumoniae J138
uaacauccauagagaac

SEQ ID NO: 530420 - RNA, 19 nt, Chlamydophila pneumoniae J138
uaacaucuaaaaaugcacu

SEQ ID NO: 530421 - RNA, 18 nt, Chlamydophila pneumoniae J138
uaacaugcgcagaauaaa

SEQ ID NO: 530422 - RNA, 13 nt, Chlamydophila pneumoniae J138
uaaccagaagacu

SEQ ID NO: 530423 - RNA, 22 nt, Chlamydophila pneumoniae J138
uaagcauagcccgaaauucauu

SEQ ID NO: 530424 - RNA, 19 nt, Chlamydophila pneumoniae J138
uaagcagugugcugauuuu

SEQ ID NO: 530425 - RNA, 22 nt, Chlamydophila pneumoniae J138
uaagcaagcaacugauguuuua

SEQ ID NO: 530426 - RNA, 22 nt, Chlamydophila pneumoniae J138
uaagauugccauguacaugcag

SEQ ID NO: 530427 - RNA, 15 nt, Chlamydophila pneumoniae J138
uaagauuuuuagaau

SEQ ID NO: 530428 - RNA, 17 nt, Chlamydophila pneumoniae J138
uaagcugcaaucucaaa

SEQ ID NO: 530429 - RNA, 21 nt, Chlamydophila pneumoniae J138
uaagcucaaaauuuccucgac

SEQ ID NO: 530430 - RNA, 15 nt, Chlamydophila pneumoniae J138
uaagcugaaagaaca

SEQ ID NO: 530431 - RNA, 15 nt, Chlamydophila pneumoniae J138
uaagcuuauuucugu

SEQ ID NO: 530432 - RNA, 19 nt, Chlamydophila pneumoniae J138
uaagcuggauucugucuau

SEQ ID NO: 530433 - RNA, 20 nt, Chlamydophila pneumoniae J138
uaagcuggauucugucuaua

SEQ ID NO: 530434 - RNA, 12 nt, Chlamydophila pneumoniae J138
uaagcucaaaau

SEQ ID NO: 530435 - RNA, 20 nt, Chlamydophila pneumoniae J138
uaagcuaauaagauccaaaa

SEQ ID NO: 530436 - RNA, 21 nt, Chlamydophila pneumoniae J138
uaagcuaauaagauccaaaaa

SEQ ID NO: 530437 - RNA, 23 nt, Chlamydophila pneumoniae J138
uaaggaagaauuucgucuucaua

SEQ ID NO: 530438 - RNA, 15 nt, Chlamydophila pneumoniae J138
uaaggacaaaucucc

SEQ ID NO: 530439 - RNA, 18 nt, Chlamydophila pneumoniae J138
uaaggacaaaucucccaa

SEQ ID NO: 530440 - RNA, 19 nt, Chlamydophila pneumoniae J138
uaaggacaaaucucccaaa

SEQ ID NO: 530441 - RNA, 16 nt, Chlamydophila pneumoniae J138
uaaggauguuguggau

SEQ ID NO: 530442 - RNA, 13 nt, Chlamydophila pneumoniae J138
uaaggcuccagca

SEQ ID NO: 530443 - RNA, 14 nt, Chlamydophila pneumoniae J138
uaauaaaagcaccc

SEQ ID NO: 530444 - RNA, 22 nt, Chlamydophila pneumoniae J138
uaauaaaauuuaaaaaaaucuu

SEQ ID NO: 530445 - RNA, 18 nt, Chlamydophila pneumoniae J138
uaaguuuguagcagcaag

SEQ ID NO: 530446 - RNA, 22 nt, Chlamydophila pneumoniae J138
uaauaaagguugcuaagaucuu

SEQ ID NO: 530447 - RNA, 17 nt, Chlamydophila pneumoniae J138
uaagugauaaggaagaa

SEQ ID NO: 530448 - RNA, 17 nt, Chlamydophila pneumoniae J138
uaaguuagagacacaga

SEQ ID NO: 530449 - RNA, 18 nt, Chlamydophila pneumoniae J138
uaaguuacggaacucauu

SEQ ID NO: 530450 - RNA, 20 nt, Chlamydophila pneumoniae J138
uaaguuacggaacucauuaa

SEQ ID NO: 530451 - RNA, 15 nt, Chlamydophila pneumoniae J138
uaaggcuuugccuuu

SEQ ID NO: 530452 - RNA, 12 nt, Chlamydophila pneumoniae J138
uaagggcucuag

SEQ ID NO: 530453 - RNA, 19 nt, Chlamydophila pneumoniae J138
uaagguuuccaugagaaua

SEQ ID NO: 530454 - RNA, 14 nt, Chlamydophila pneumoniae J138
uaagguuccaaaaa

SEQ ID NO: 530455 - RNA, 23 nt, Chlamydophila pneumoniae J138
uaaguaggccuccuucauucaca

SEQ ID NO: 530456 - RNA, 19 nt, Chlamydophila pneumoniae J138
uaaguacacauugucucuu

SEQ ID NO: 530457 - RNA, 15 nt, Chlamydophila pneumoniae J138
uaaguccaacaucag

SEQ ID NO: 530458 - RNA, 16 nt, Chlamydophila pneumoniae J138
uaaguccuucuuccca

SEQ ID NO: 530459 - RNA, 15 nt, Chlamydophila pneumoniae J138
uaaguccuguuugaa

SEQ ID NO: 530460 - RNA, 23 nt, Chlamydophila pneumoniae J138
uaaguccuucuucccagccuuga

SEQ ID NO: 530461 - RNA, 19 nt, Chlamydophila pneumoniae J138
uaagucuugaguucuuuug

SEQ ID NO: 530462 - RNA, 16 nt, Chlamydophila pneumoniae J138
uaagacgugcaucgcu

SEQ ID NO: 530463 - RNA, 18 nt, Chlamydophila pneumoniae J138
uaagacgcagaaacacug

SEQ ID NO: 530464 - RNA, 13 nt, Chlamydophila pneumoniae J138
uaagacuaaaaaa

SEQ ID NO: 530465 - RNA, 16 nt, Chlamydophila pneumoniae J138
uaagacuguguuuuau

SEQ ID NO: 530466 - RNA, 18 nt, Chlamydophila pneumoniae J138
uaagacugucuaugaucc

SEQ ID NO: 530467 - RNA, 22 nt, Chlamydophila pneumoniae J138
uaagacaagguggguagccagg

SEQ ID NO: 530468 - RNA, 19 nt, Chlamydophila pneumoniae J138
uaagacaauaaaauagccc

SEQ ID NO: 530469 - RNA, 19 nt, Chlamydophila pneumoniae J138
uaagacaauauaagcacca

SEQ ID NO: 530470 - RNA, 18 nt, Chlamydophila pneumoniae J138
uaagaccaaacuuucuuu

SEQ ID NO: 530471 - RNA, 20 nt, Chlamydophila pneumoniae J138
uaagagcuacaaucccgagu

SEQ ID NO: 530472 - RNA, 17 nt, Chlamydophila pneumoniae J138
uaagagcaaacaucaaa

SEQ ID NO: 530473 - RNA, 15 nt, Chlamydophila pneumoniae J138
uaagagaacuuuaac

SEQ ID NO: 530474 - RNA, 12 nt, Chlamydophila pneumoniae J138
uaagaggaaagc

SEQ ID NO: 530475 - RNA, 21 nt, Chlamydophila pneumoniae J138
uaagauaauagagaagaagca

SEQ ID NO: 530476 - RNA, 17 nt, Chlamydophila pneumoniae J138
uaagauaauagagaaga

SEQ ID NO: 530477 - RNA, 14 nt, Chlamydophila pneumoniae J138
uaagauaauagaga

SEQ ID NO: 530478 - RNA, 15 nt, Chlamydophila pneumoniae J138
uaagauaaacagcac

SEQ ID NO: 530479 - RNA, 13 nt, Chlamydophila pneumoniae J138
uaagauaauagag

SEQ ID NO: 530480 - RNA, 13 nt, Chlamydophila pneumoniae J138
uaagauaaacauu

SEQ ID NO: 530481 - RNA, 19 nt, Chlamydophila pneumoniae J138
uaagauagacucucacuga

SEQ ID NO: 530482 - RNA, 20 nt, Chlamydophila pneumoniae J138
uaagauacuucuccacagcu

SEQ ID NO: 530483 - RNA, 20 nt, Chlamydophila pneumoniae J138
uaagauaucgaccuuaaaau

SEQ ID NO: 530484 - RNA, 23 nt, Chlamydophila pneumoniae J138
uaagauauguccgugagcaacaa

SEQ ID NO: 530485 - RNA, 17 nt, Chlamydophila pneumoniae J138
uaagauauucaagagga

SEQ ID NO: 530486 - RNA, 22 nt, Chlamydophila pneumoniae J138
uaagauccugagaccauacaca

SEQ ID NO: 530487 - RNA, 14 nt, Chlamydophila pneumoniae J138
uaagaucuuuagaa

SEQ ID NO: 530488 - RNA, 18 nt, Chlamydophila pneumoniae J138
uaagaucuuuagaauaag

SEQ ID NO: 530489 - RNA, 22 nt, Chlamydophila pneumoniae J138
uaagaucuuuagaauaagagcu

SEQ ID NO: 530490 - RNA, 14 nt, Chlamydophila pneumoniae J138
uaagauccaaaaau

SEQ ID NO: 530491 - RNA, 17 nt, Chlamydophila pneumoniae J138
uaagaugcugaaccuuu

SEQ ID NO: 530492 - RNA, 14 nt, Chlamydophila pneumoniae J138
uaagauuauuuguu

SEQ ID NO: 530493 - RNA, 12 nt, Chlamydophila pneumoniae J138
uaagauuccuaa

SEQ ID NO: 530494 - RNA, 22 nt, Chlamydophila pneumoniae J138
uaacuuggugagcagcuuuauc

SEQ ID NO: 530495 - RNA, 17 nt, Chlamydophila pneumoniae J138
uaacuugaagaaguaca

SEQ ID NO: 530496 - RNA, 18 nt, Chlamydophila pneumoniae J138
uaacuuggugagcagcuu

SEQ ID NO: 530497 - RNA, 16 nt, Chlamydophila pneumoniae J138
uaacuuuauguuuucu

SEQ ID NO: 530498 - RNA, 23 nt, Chlamydophila pneumoniae J138
uaagaaacuaguucuucuuuacu

SEQ ID NO: 530499 - RNA, 13 nt, Chlamydophila pneumoniae J138
uaagaaaauccua

SEQ ID NO: 530500 - RNA, 15 nt, Chlamydophila pneumoniae J138
uaagaacuuuaggga

SEQ ID NO: 530501 - RNA, 21 nt, Chlamydophila pneumoniae J138
uaagaacuuuagggaagaaau

SEQ ID NO: 530502 - RNA, 15 nt, Chlamydophila pneumoniae J138
uaagaacuagaaaaa

SEQ ID NO: 530503 - RNA, 19 nt, Chlamydophila pneumoniae J138
uaagaagacuagcuuuuca

SEQ ID NO: 530504 - RNA, 15 nt, Chlamydophila pneumoniae J138
uaagaagcagcacuc

SEQ ID NO: 530505 - RNA, 13 nt, Chlamydophila pneumoniae J138
uaagaaaucccag

SEQ ID NO: 530506 - RNA, 17 nt, Chlamydophila pneumoniae J138
uaagaaagcuugucaua

SEQ ID NO: 530507 - RNA, 20 nt, Chlamydophila pneumoniae J138
uaagaagguuuauuagaagu

SEQ ID NO: 530508 - RNA, 19 nt, Chlamydophila pneumoniae J138
uaagaagcucacucuuuaa

SEQ ID NO: 530509 - RNA, 16 nt, Chlamydophila pneumoniae J138
uaagaaugagaacguc

SEQ ID NO: 530510 - RNA, 15 nt, Chlamydophila pneumoniae J138
uaacguauuucacaa

SEQ ID NO: 530511 - RNA, 21 nt, Chlamydophila pneumoniae J138
uaacguuucaggucagcaagg

SEQ ID NO: 530512 - RNA, 14 nt, Chlamydophila pneumoniae J138
uaacguugccuguu

SEQ ID NO: 530513 - RNA, 18 nt, Chlamydophila pneumoniae J138
uaacuaaauucuuaacaa

SEQ ID NO: 530514 - RNA, 19 nt, Chlamydophila pneumoniae J138
uaacuccaggggauaaaac

SEQ ID NO: 530515 - RNA, 21 nt, Chlamydophila pneumoniae J138
uaacuccaggggauaaaacua

SEQ ID NO: 530516 - RNA, 22 nt, Chlamydophila pneumoniae J138
uaacuccaggggauaaaacuau

SEQ ID NO: 530517 - RNA, 17 nt, Chlamydophila pneumoniae J138
uaacucuagaucuucaa

SEQ ID NO: 530518 - RNA, 17 nt, Chlamydophila pneumoniae J138
uaacucggaaaaaauag

SEQ ID NO: 530519 - RNA, 21 nt, Chlamydophila pneumoniae J138
uaacucggaaaaaauagaucc

SEQ ID NO: 530520 - RNA, 20 nt, Chlamydophila pneumoniae J138
uaacucuuaagaauaaaaua

SEQ ID NO: 530521 - RNA, 22 nt, Chlamydophila pneumoniae J138
uaacugaggcaaagauuuccaa

SEQ ID NO: 530522 - RNA, 19 nt, Chlamydophila pneumoniae J138
uaacugagcaacuucuucg

SEQ ID NO: 530523 - RNA, 20 nt, Chlamydophila pneumoniae J138
aaaucccgaacaaucaacac

SEQ ID NO: 530524 - RNA, 18 nt, Chlamydophila pneumoniae J138
aaaucccuguucuagcaa

SEQ ID NO: 530525 - RNA, 16 nt, Chlamydophila pneumoniae J138
aaauccgauaagauaa

SEQ ID NO: 530526 - RNA, 15 nt, Chlamydophila pneumoniae J138
uaacuggcaaucuaa

SEQ ID NO: 530527 - RNA, 20 nt, Chlamydophila pneumoniae J138
uaacuggcaaucuaaaauca

SEQ ID NO: 530528 - RNA, 21 nt, Chlamydophila pneumoniae J138
uaauuccaacagggaugaggu

SEQ ID NO: 530529 - RNA, 20 nt, Chlamydophila pneumoniae J138
uaauuccaucuggaauggcc

SEQ ID NO: 530530 - RNA, 22 nt, Chlamydophila pneumoniae J138
uaauugacguagacgauuuucu

SEQ ID NO: 530531 - RNA, 16 nt, Chlamydophila pneumoniae J138
uaauuccaucuggaau

SEQ ID NO: 530532 - RNA, 23 nt, Chlamydophila pneumoniae J138
uaauguuuggccaacagcuaaua

SEQ ID NO: 530533 - RNA, 18 nt, Chlamydophila pneumoniae J138
uaauuacagaucugcaua

SEQ ID NO: 530534 - RNA, 17 nt, Chlamydophila pneumoniae J138
uaaugcucacuucuuug

SEQ ID NO: 530535 - RNA, 18 nt, Chlamydophila pneumoniae J138
uaaucgagagaagaaauu

SEQ ID NO: 530536 - RNA, 20 nt, Chlamydophila pneumoniae J138
uaaugauacgugcagugaau

SEQ ID NO: 530537 - RNA, 19 nt, Chlamydophila pneumoniae J138
uaauuuucccaauauccuc

SEQ ID NO: 530538 - RNA, 20 nt, Chlamydophila pneumoniae J138
uaauuuuugcuaaacaaugc

SEQ ID NO: 530539 - RNA, 15 nt, Chlamydophila pneumoniae J138
uaauuuuucuuagua

SEQ ID NO: 530540 - RNA, 16 nt, Chlamydophila pneumoniae J138
uacaaaacaaaagcca

SEQ ID NO: 530541 - RNA, 18 nt, Chlamydophila pneumoniae J138
uacaaaaaauaaaaucaa

SEQ ID NO: 530542 - RNA, 21 nt, Chlamydophila pneumoniae J138
uacaaacccauauuugaauaa

SEQ ID NO: 530543 - RNA, 23 nt, Chlamydophila pneumoniae J138
uacaaauagcucugcgccaugca

SEQ ID NO: 530544 - RNA, 15 nt, Chlamydophila pneumoniae J138
uacaagcuuccuugg

SEQ ID NO: 530545 - RNA, 18 nt, Chlamydophila pneumoniae J138
uacaagcaauacuaagaa

SEQ ID NO: 530546 - RNA, 20 nt, Chlamydophila pneumoniae J138
uacaagacuacgacagaagu

SEQ ID NO: 530547 - RNA, 20 nt, Chlamydophila pneumoniae J138
uacaagacaaaguuguuucu

SEQ ID NO: 530548 - RNA, 22 nt, Chlamydophila pneumoniae J138
uaauccagcaacaaccaaaaga

SEQ ID NO: 530549 - RNA, 14 nt, Chlamydophila pneumoniae J138
uaaucauaucugcg

SEQ ID NO: 530550 - RNA, 12 nt, Chlamydophila pneumoniae J138
uaaucaaccaaa

SEQ ID NO: 530551 - RNA, 19 nt, Chlamydophila pneumoniae J138
uaaucaagccuaaaucuau

SEQ ID NO: 530552 - RNA, 17 nt, Chlamydophila pneumoniae J138
uaaucaaccaaaaugca

SEQ ID NO: 530553 - RNA, 17 nt, Chlamydophila pneumoniae J138
uaauaucgguuccuaua

SEQ ID NO: 530554 - RNA, 16 nt, Chlamydophila pneumoniae J138
uaauaucgguuucuuu

SEQ ID NO: 530555 - RNA, 19 nt, Chlamydophila pneumoniae J138
uaauaucgguuucuuuuuu

SEQ ID NO: 530556 - RNA, 14 nt, Chlamydophila pneumoniae J138
uaauagaagaucau

SEQ ID NO: 530557 - RNA, 23 nt, Chlamydophila pneumoniae J138
uaauacggacuucacaaagaacc

SEQ ID NO: 530558 - RNA, 14 nt, Chlamydophila pneumoniae J138
uaauagcaggaguu

SEQ ID NO: 530559 - RNA, 16 nt, Chlamydophila pneumoniae J138
uaauagcuaaagugau

SEQ ID NO: 530560 - RNA, 17 nt, Chlamydophila pneumoniae J138
uaauagcgacaugagaa

SEQ ID NO: 530561 - RNA, 14 nt, Chlamydophila pneumoniae J138
uaauaggauaagaa

SEQ ID NO: 530562 - RNA, 17 nt, Chlamydophila pneumoniae J138
uaauaacuauaauauaa

SEQ ID NO: 530563 - RNA, 22 nt, Chlamydophila pneumoniae J138
uaauaaugaagcagggaaaaug

SEQ ID NO: 530564 - RNA, 21 nt, Chlamydophila pneumoniae J138
uaauacaaaaaauaaaaucaa

SEQ ID NO: 530565 - RNA, 22 nt, Chlamydophila pneumoniae J138
uacaagugucugaguuagcuuu

SEQ ID NO: 530566 - RNA, 16 nt, Chlamydophila pneumoniae J138
uacaaggucuuuuccu

SEQ ID NO: 530567 - RNA, 14 nt, Chlamydophila pneumoniae J138
uacaauuuaaaucu

SEQ ID NO: 530568 - RNA, 21 nt, Chlamydophila pneumoniae J138
uacaauuuccuugguauccca

SEQ ID NO: 530569 - RNA, 12 nt, Chlamydophila pneumoniae J138
uacaauuugcuc

SEQ ID NO: 530570 - RNA, 17 nt, Chlamydophila pneumoniae J138
uacaauuugcuccucca

SEQ ID NO: 530571 - RNA, 21 nt, Chlamydophila pneumoniae J138
uacaauuugcuccuccaaaag

SEQ ID NO: 530572 - RNA, 17 nt, Chlamydophila pneumoniae J138
uacaguaguaaauaaua

SEQ ID NO: 530573 - RNA, 18 nt, Chlamydophila pneumoniae J138
uacaguaguaaauaauaa

SEQ ID NO: 530574 - RNA, 14 nt, Chlamydophila pneumoniae J138
uacaucaaaaugcu

SEQ ID NO: 530575 - RNA, 15 nt, Chlamydophila pneumoniae J138
uacaucaaaaugcug

SEQ ID NO: 530576 - RNA, 17 nt, Chlamydophila pneumoniae J138
uacagugacauccggau

SEQ ID NO: 530577 - RNA, 20 nt, Chlamydophila pneumoniae J138
uacaucaaugauaucgccuu

SEQ ID NO: 530578 - RNA, 19 nt, Chlamydophila pneumoniae J138
uacaucaucagaagcuccu

SEQ ID NO: 530579 - RNA, 13 nt, Chlamydophila pneumoniae J138
uacaucuaacucu

SEQ ID NO: 530580 - RNA, 18 nt, Chlamydophila pneumoniae J138
uacauccucacuagagau

SEQ ID NO: 530581 - RNA, 14 nt, Chlamydophila pneumoniae J138
uaccaacugagcua

SEQ ID NO: 530582 - RNA, 17 nt, Chlamydophila pneumoniae J138
uacaucuccaagccaug

SEQ ID NO: 530583 - RNA, 17 nt, Chlamydophila pneumoniae J138
uacaucuuaagagcaaa

SEQ ID NO: 530584 - RNA, 15 nt, Chlamydophila pneumoniae J138
uacauucgcaagaau

SEQ ID NO: 530585 - RNA, 23 nt, Chlamydophila pneumoniae J138
uacauucgcaagaaugaugcaua

SEQ ID NO: 530586 - RNA, 21 nt, Chlamydophila pneumoniae J138
uaccacagcuguacagaacaa

SEQ ID NO: 530587 - RNA, 18 nt, Chlamydophila pneumoniae J138
uaccauugagauccauag

SEQ ID NO: 530588 - RNA, 17 nt, Chlamydophila pneumoniae J138
uaccaucgucuccaaaa

SEQ ID NO: 530589 - RNA, 21 nt, Chlamydophila pneumoniae J138
uaccauaaggagauuccuaaa

SEQ ID NO: 530590 - RNA, 16 nt, Chlamydophila pneumoniae J138
uacccaaagaggggag

SEQ ID NO: 530591 - RNA, 13 nt, Chlamydophila pneumoniae J138
uacccuucuucuu

SEQ ID NO: 530592 - RNA, 14 nt, Chlamydophila pneumoniae J138
uacccuucuucuuc

SEQ ID NO: 530593 - RNA, 19 nt, Chlamydophila pneumoniae J138
uacccuucagaauucucaa

SEQ ID NO: 530594 - RNA, 16 nt, Chlamydophila pneumoniae J138
uacccucggagacuca

SEQ ID NO: 530595 - RNA, 14 nt, Chlamydophila pneumoniae J138
uaccgcuguuuuau

SEQ ID NO: 530596 - RNA, 19 nt, Chlamydophila pneumoniae J138
uaccgaccgaaucucucca

SEQ ID NO: 530597 - RNA, 17 nt, Chlamydophila pneumoniae J138
uaccgacaagcaucauu

SEQ ID NO: 530598 - RNA, 19 nt, Chlamydophila pneumoniae J138
uacuucaagaaaaaccccu

SEQ ID NO: 530599 - RNA, 19 nt, Chlamydophila pneumoniae J138
uacuucacucuuucuguag

SEQ ID NO: 530600 - RNA, 13 nt, Chlamydophila pneumoniae J138
uacuuauuguucu

SEQ ID NO: 530601 - RNA, 13 nt, Chlamydophila pneumoniae J138
uacuguuuuucuu

SEQ ID NO: 530602 - RNA, 15 nt, Chlamydophila pneumoniae J138
uacuguuuuucuucc

SEQ ID NO: 530603 - RNA, 21 nt, Chlamydophila pneumoniae J138
uacuucuccucgcaauccagg

SEQ ID NO: 530604 - RNA, 23 nt, Chlamydophila pneumoniae J138
uacuuuaggaggggggauucugu

SEQ ID NO: 530605 - RNA, 14 nt, Chlamydophila pneumoniae J138
uacuagauaguuca

SEQ ID NO: 530606 - RNA, 18 nt, Chlamydophila pneumoniae J138
uacuacuuacaagaacaa

SEQ ID NO: 530607 - RNA, 15 nt, Chlamydophila pneumoniae J138
uacuacuuacaagaa

SEQ ID NO: 530608 - RNA, 17 nt, Chlamydophila pneumoniae J138
uacuacuuacaagaaca

SEQ ID NO: 530609 - RNA, 15 nt, Chlamydophila pneumoniae J138
uacuacucucaucaa

SEQ ID NO: 530610 - RNA, 19 nt, Chlamydophila pneumoniae J138
uacucgucaaauucauuaa

SEQ ID NO: 530611 - RNA, 16 nt, Chlamydophila pneumoniae J138
uacucuuuaaaaauag

SEQ ID NO: 530612 - RNA, 14 nt, Chlamydophila pneumoniae J138
uacucuuuaaaaau

SEQ ID NO: 530613 - RNA, 13 nt, Chlamydophila pneumoniae J138
uacucucugcuuc

SEQ ID NO: 530614 - RNA, 23 nt, Chlamydophila pneumoniae J138
uacucuacaguaguaaauaauaa

SEQ ID NO: 530615 - RNA, 19 nt, Chlamydophila pneumoniae J138
uacucucagcaaagacauc

SEQ ID NO: 530616 - RNA, 19 nt, Chlamydophila pneumoniae J138
uacugagcuucuauuucua

SEQ ID NO: 530617 - RNA, 17 nt, Chlamydophila pneumoniae J138
uacugccagcgaucaca

SEQ ID NO: 530618 - RNA, 19 nt, Chlamydophila pneumoniae J138
uacugaaucccguuaaaaa

SEQ ID NO: 530619 - RNA, 16 nt, Chlamydophila pneumoniae J138
uacguagcauaccuug

SEQ ID NO: 530620 - RNA, 18 nt, Chlamydophila pneumoniae J138
uacguaccguauccucua

SEQ ID NO: 530621 - RNA, 14 nt, Chlamydophila pneumoniae J138
uacgugaucaaaau

SEQ ID NO: 530622 - RNA, 20 nt, Chlamydophila pneumoniae J138
uacuaaaggugaaaguacag

SEQ ID NO: 530623 - RNA, 22 nt, Chlamydophila pneumoniae J138
uacuaaagaaagagucucacuc

SEQ ID NO: 530624 - RNA, 16 nt, Chlamydophila pneumoniae J138
uacuaaaggugaaagu

SEQ ID NO: 530625 - RNA, 16 nt, Chlamydophila pneumoniae J138
uacuaagaagcucacu

SEQ ID NO: 530626 - RNA, 11 nt, Chlamydophila pneumoniae J138
uacuacaugag

SEQ ID NO: 530627 - RNA, 13 nt, Chlamydophila pneumoniae J138
uacuacucucauc

SEQ ID NO: 530628 - RNA, 16 nt, Chlamydophila pneumoniae J138
uacgcaaguaaagaaa

SEQ ID NO: 530629 - RNA, 18 nt, Chlamydophila pneumoniae J138
uacgcaaguaaagaaauu

SEQ ID NO: 530630 - RNA, 20 nt, Chlamydophila pneumoniae J138
uacgcaaguaaagaaauucu

SEQ ID NO: 530631 - RNA, 21 nt, Chlamydophila pneumoniae J138
uaccguagcguacguuuucuc

SEQ ID NO: 530632 - RNA, 13 nt, Chlamydophila pneumoniae J138
uacgacagaagua

SEQ ID NO: 530633 - RNA, 21 nt, Chlamydophila pneumoniae J138
gucaagcucugagaaagaaua

SEQ ID NO: 530634 - RNA, 17 nt, Chlamydophila pneumoniae J138
ggugaagaauaauagca

SEQ ID NO: 530635 - RNA, 15 nt, Chlamydophila pneumoniae J138
ggugaacuaaaucuc

SEQ ID NO: 530636 - RNA, 15 nt, Chlamydophila pneumoniae J138
gucagguaaagagcu

SEQ ID NO: 530637 - RNA, 23 nt, Chlamydophila pneumoniae J138
gucagcccugccucacagcuaau

SEQ ID NO: 530638 - RNA, 19 nt, Chlamydophila pneumoniae J138
gucauguauccgaaaucug

SEQ ID NO: 530639 - RNA, 12 nt, Chlamydophila pneumoniae J138
gucauuaaaaau

SEQ ID NO: 530640 - RNA, 12 nt, Chlamydophila pneumoniae J138
guccaaacccug

SEQ ID NO: 530641 - RNA, 16 nt, Chlamydophila pneumoniae J138
guccacaagccucccu

SEQ ID NO: 530642 - RNA, 18 nt, Chlamydophila pneumoniae J138
guccacagucauaaaaau

SEQ ID NO: 530643 - RNA, 14 nt, Chlamydophila pneumoniae J138
guccauaauuucuu

SEQ ID NO: 530644 - RNA, 14 nt, Chlamydophila pneumoniae J138
guccuaggcugaga

SEQ ID NO: 530645 - RNA, 15 nt, Chlamydophila pneumoniae J138
guccuaggagagcua

SEQ ID NO: 530646 - RNA, 16 nt, Chlamydophila pneumoniae J138
guccuagcagagaaau

SEQ ID NO: 530647 - RNA, 17 nt, Chlamydophila pneumoniae J138
guccuaucaaagcaaaa

SEQ ID NO: 530648 - RNA, 20 nt, Chlamydophila pneumoniae J138
guccuccauggaaagaaaca

SEQ ID NO: 530649 - RNA, 12 nt, Chlamydophila pneumoniae J138
guccuucuuccc

SEQ ID NO: 530650 - RNA, 23 nt, Chlamydophila pneumoniae J138
gucgauacccaaagaggggagcu

SEQ ID NO: 530651 - RNA, 15 nt, Chlamydophila pneumoniae J138
gucgauaaaaacucc

SEQ ID NO: 530652 - RNA, 17 nt, Chlamydophila pneumoniae J138
gucgcgaccgaaagucc

SEQ ID NO: 530653 - RNA, 16 nt, Chlamydophila pneumoniae J138
gucgcgacugaaguca

SEQ ID NO: 530654 - RNA, 14 nt, Chlamydophila pneumoniae J138
gucgucuuuuaaag

SEQ ID NO: 530655 - RNA, 19 nt, Chlamydophila pneumoniae J138
gucuccuggaacaguauaa

SEQ ID NO: 530656 - RNA, 13 nt, Chlamydophila pneumoniae J138
gucuccuugauuu

SEQ ID NO: 530657 - RNA, 14 nt, Chlamydophila pneumoniae J138
gucucuuucagcuc

SEQ ID NO: 530658 - RNA, 17 nt, Chlamydophila pneumoniae J138
gucuccaaaaauuccca

SEQ ID NO: 530659 - RNA, 17 nt, Chlamydophila pneumoniae J138
gucuccauaauucugca

SEQ ID NO: 530660 - RNA, 11 nt, Chlamydophila pneumoniae J138
gucugaacauu

SEQ ID NO: 530661 - RNA, 23 nt, Chlamydophila pneumoniae J138
gucugcaaagagcaaaggagcgg

SEQ ID NO: 530662 - RNA, 19 nt, Chlamydophila pneumoniae J138
gucugauguaggugauauu

SEQ ID NO: 530663 - RNA, 21 nt, Chlamydophila pneumoniae J138
gucugccaucgcccaauuuuu

SEQ ID NO: 530664 - RNA, 22 nt, Chlamydophila pneumoniae J138
gucuuccauaacaguuuguucu

SEQ ID NO: 530665 - RNA, 16 nt, Chlamydophila pneumoniae J138
gucuucccucuccuug

SEQ ID NO: 530666 - RNA, 17 nt, Chlamydophila pneumoniae J138
gucuucuuagaagagaa

SEQ ID NO: 530667 - RNA, 18 nt, Chlamydophila pneumoniae J138
gucuugcugauuuuugcu

SEQ ID NO: 530668 - RNA, 21 nt, Chlamydophila pneumoniae J138
gucuguauuuucuucaacaua

SEQ ID NO: 530669 - RNA, 17 nt, Chlamydophila pneumoniae J138
gucuguuaacucagaga

SEQ ID NO: 530670 - RNA, 15 nt, Chlamydophila pneumoniae J138
gucuguuuuggaaag

SEQ ID NO: 530671 - RNA, 23 nt, Chlamydophila pneumoniae J138
gucuguuuuggaaagaagagaau

SEQ ID NO: 530672 - RNA, 19 nt, Chlamydophila pneumoniae J138
gucuuauugaagucuucuu

SEQ ID NO: 530673 - RNA, 17 nt, Chlamydophila pneumoniae J138
gucuuaucuaaagaaau

SEQ ID NO: 530674 - RNA, 16 nt, Chlamydophila pneumoniae J138
gucuuugcuuucuagg

SEQ ID NO: 530675 - RNA, 18 nt, Chlamydophila pneumoniae J138
gucuuugauuuucaggag

SEQ ID NO: 530676 - RNA, 19 nt, Chlamydophila pneumoniae J138
gucuuucuuuuuuuugccg

SEQ ID NO: 530677 - RNA, 21 nt, Chlamydophila pneumoniae J138
gucuuuaauuaaaaguucagc

SEQ ID NO: 530678 - RNA, 15 nt, Chlamydophila pneumoniae J138
gugaacaaaaacugc

SEQ ID NO: 530679 - RNA, 13 nt, Chlamydophila pneumoniae J138
gugaacacucucu

SEQ ID NO: 530680 - RNA, 17 nt, Chlamydophila pneumoniae J138
aaauaggaucucucuuu

SEQ ID NO: 530681 - RNA, 16 nt, Chlamydophila pneumoniae J138
aaauaguucaucauau

SEQ ID NO: 530682 - RNA, 18 nt, Chlamydophila pneumoniae J138
gugaagaaauuaaguagg

SEQ ID NO: 530683 - RNA, 19 nt, Chlamydophila pneumoniae J138
gugaagccauuuucuaaga

SEQ ID NO: 530684 - RNA, 19 nt, Chlamydophila pneumoniae J138
gugaagauaagaccagaaa

SEQ ID NO: 530685 - RNA, 21 nt, Chlamydophila pneumoniae J138
gugaacuuuuguacacagaga

SEQ ID NO: 530686 - RNA, 19 nt, Chlamydophila pneumoniae J138
aaauagccucuccuugaga

SEQ ID NO: 530687 - RNA, 14 nt, Chlamydophila pneumoniae J138
gugacuuuucuucu

SEQ ID NO: 530688 - RNA, 13 nt, Chlamydophila pneumoniae J138
gugaguugcaauu

SEQ ID NO: 530689 - RNA, 17 nt, Chlamydophila pneumoniae J138
gugcaaggccuaaucuu

SEQ ID NO: 530690 - RNA, 20 nt, Chlamydophila pneumoniae J138
gugauuucuuuauucccuuu

SEQ ID NO: 530691 - RNA, 12 nt, Chlamydophila pneumoniae J138
gugauugcugcu

SEQ ID NO: 530692 - RNA, 16 nt, Chlamydophila pneumoniae J138
gugauugcguauagau

SEQ ID NO: 530693 - RNA, 23 nt, Chlamydophila pneumoniae J138
gugauugcugucagaacaagaag

SEQ ID NO: 530694 - RNA, 18 nt, Chlamydophila pneumoniae J138
gugggauggucaggaaga

SEQ ID NO: 530695 - RNA, 20 nt, Chlamydophila pneumoniae J138
gugggaauguuguuuuugau

SEQ ID NO: 530696 - RNA, 13 nt, Chlamydophila pneumoniae J138
guggagguuagua

SEQ ID NO: 530697 - RNA, 20 nt, Chlamydophila pneumoniae J138
guggagcuugucuaggagcu

SEQ ID NO: 530698 - RNA, 16 nt, Chlamydophila pneumoniae J138
guggaacuuucuggga

SEQ ID NO: 530699 - RNA, 18 nt, Chlamydophila pneumoniae J138
guggaacgcauaagagac

SEQ ID NO: 530700 - RNA, 13 nt, Chlamydophila pneumoniae J138
gugucuugcugau

SEQ ID NO: 530701 - RNA, 22 nt, Chlamydophila pneumoniae J138
gugucuuccuugggaggaggag

SEQ ID NO: 530702 - RNA, 23 nt, Chlamydophila pneumoniae J138
gugucccauggcuggaaagccaa

SEQ ID NO: 530703 - RNA, 15 nt, Chlamydophila pneumoniae J138
guguagccuuucuuu

SEQ ID NO: 530704 - RNA, 16 nt, Chlamydophila pneumoniae J138
gugguuggauccaucg

SEQ ID NO: 530705 - RNA, 16 nt, Chlamydophila pneumoniae J138
guggguagccaggaug

SEQ ID NO: 530706 - RNA, 23 nt, Chlamydophila pneumoniae J138
aaauaucaccuacaucagacuga

SEQ ID NO: 530707 - RNA, 18 nt, Chlamydophila pneumoniae J138
aaauauaucuucagaauu

SEQ ID NO: 530708 - RNA, 18 nt, Chlamydophila pneumoniae J138
aaauauaguuuucauaau

SEQ ID NO: 530709 - RNA, 19 nt, Chlamydophila pneumoniae J138
aaauauaguuuucauaauc

SEQ ID NO: 530710 - RNA, 17 nt, Chlamydophila pneumoniae J138
guguucaauagcaaaga

SEQ ID NO: 530711 - RNA, 23 nt, Chlamydophila pneumoniae J138
guguuaaguucauaaccugggca

SEQ ID NO: 530712 - RNA, 16 nt, Chlamydophila pneumoniae J138
guguggguacaggggg

SEQ ID NO: 530713 - RNA, 16 nt, Chlamydophila pneumoniae J138
gugugugguaaaaaua

SEQ ID NO: 530714 - RNA, 20 nt, Chlamydophila pneumoniae J138
guuaacaagauucucagcuu

SEQ ID NO: 530715 - RNA, 19 nt, Chlamydophila pneumoniae J138
guuaacaaguaccaagaaa

SEQ ID NO: 530716 - RNA, 21 nt, Chlamydophila pneumoniae J138
guuaacaaguaccaagaaaau

SEQ ID NO: 530717 - RNA, 11 nt, Chlamydophila pneumoniae J138
guuaacaucaa

SEQ ID NO: 530718 - RNA, 15 nt, Chlamydophila pneumoniae J138
guuaagcaauaucug

SEQ ID NO: 530719 - RNA, 15 nt, Chlamydophila pneumoniae J138
guuaggauauggugu

SEQ ID NO: 530720 - RNA, 16 nt, Chlamydophila pneumoniae J138
guuagaaaccaugaug

SEQ ID NO: 530721 - RNA, 19 nt, Chlamydophila pneumoniae J138
guuagaaaccaugaugcaa

SEQ ID NO: 530722 - RNA, 13 nt, Chlamydophila pneumoniae J138
guuauauuuuucu

SEQ ID NO: 530723 - RNA, 14 nt, Chlamydophila pneumoniae J138
guuauauuuuucug

SEQ ID NO: 530724 - RNA, 21 nt, Chlamydophila pneumoniae J138
guuaucaaaagguuuuauaaa

SEQ ID NO: 530725 - RNA, 13 nt, Chlamydophila pneumoniae J138
guucagcuagagc

SEQ ID NO: 530726 - RNA, 24 nt, Chlamydophila pneumoniae J138
guuccacagagaccuucucuucag

SEQ ID NO: 530727 - RNA, 23 nt, Chlamydophila pneumoniae J138
guucaccagaagcauugaggaca

SEQ ID NO: 530728 - RNA, 22 nt, Chlamydophila pneumoniae J138
guuccuguaguuugcagagagu

SEQ ID NO: 530729 - RNA, 20 nt, Chlamydophila pneumoniae J138
guuccugcuugauuuccuga

SEQ ID NO: 530730 - RNA, 23 nt, Chlamydophila pneumoniae J138
guuccugaucccuuagaaauucu

SEQ ID NO: 530731 - RNA, 14 nt, Chlamydophila pneumoniae J138
guucgcacuaauuu

SEQ ID NO: 530732 - RNA, 14 nt, Chlamydophila pneumoniae J138
guucgaauccuucu

SEQ ID NO: 530733 - RNA, 18 nt, Chlamydophila pneumoniae J138
guucgcggaucuucuucu

SEQ ID NO: 530734 - RNA, 20 nt, Chlamydophila pneumoniae J138
guucucccgugaacaaaaac

SEQ ID NO: 530735 - RNA, 17 nt, Chlamydophila pneumoniae J138
guucucccgugaacaaa

SEQ ID NO: 530736 - RNA, 17 nt, Chlamydophila pneumoniae J138
guucuagcaaaucuaaa

SEQ ID NO: 530737 - RNA, 13 nt, Chlamydophila pneumoniae J138
guucuaagaaauc

SEQ ID NO: 530738 - RNA, 18 nt, Chlamydophila pneumoniae J138
guucuccacaugcccaaa

SEQ ID NO: 530739 - RNA, 13 nt, Chlamydophila pneumoniae J138
guugcacuuuccg

SEQ ID NO: 530740 - RNA, 23 nt, Chlamydophila pneumoniae J138
guugcgaacagcuccuggauauu

SEQ ID NO: 530741 - RNA, 17 nt, Chlamydophila pneumoniae J138
guugcuaagcgaaccaa

SEQ ID NO: 530742 - RNA, 17 nt, Chlamydophila pneumoniae J138
guuucaaucucuccuug

SEQ ID NO: 530743 - RNA, 15 nt, Chlamydophila pneumoniae J138
guuucaaucucuccu

SEQ ID NO: 530744 - RNA, 14 nt, Chlamydophila pneumoniae J138
guuucaaucucucc

SEQ ID NO: 530745 - RNA, 14 nt, Chlamydophila pneumoniae J138
guuucaacauaaca

SEQ ID NO: 530746 - RNA, 16 nt, Chlamydophila pneumoniae J138
guuucaaauaggaucu

SEQ ID NO: 530747 - RNA, 21 nt, Chlamydophila pneumoniae J138
guuuagaaaaagaucuaaguc

SEQ ID NO: 530748 - RNA, 12 nt, Chlamydophila pneumoniae J138
guuuagaaaaag

SEQ ID NO: 530749 - RNA, 14 nt, Chlamydophila pneumoniae J138
guuuaauacaaaaa

SEQ ID NO: 530750 - RNA, 15 nt, Chlamydophila pneumoniae J138
guuguccuuuauaau

SEQ ID NO: 530751 - RNA, 19 nt, Chlamydophila pneumoniae J138
guugucagcuuugcuuauu

SEQ ID NO: 530752 - RNA, 22 nt, Chlamydophila pneumoniae J138
guuuccaagacaacaccuccca

SEQ ID NO: 530753 - RNA, 23 nt, Chlamydophila pneumoniae J138
guuucagaagucacaaauuuuug

SEQ ID NO: 530754 - RNA, 19 nt, Chlamydophila pneumoniae J138
guuucacaggcuacauagu

SEQ ID NO: 530755 - RNA, 21 nt, Chlamydophila pneumoniae J138
aaauaucuccguuaccaaaaa

SEQ ID NO: 530756 - RNA, 19 nt, Chlamydophila pneumoniae J138
guuuccgaucauuuuugcu

SEQ ID NO: 530757 - RNA, 17 nt, Chlamydophila pneumoniae J138
guuuccuuuucuccuuc

SEQ ID NO: 530758 - RNA, 16 nt, Chlamydophila pneumoniae J138
guuuccuuuucuccuu

SEQ ID NO: 530759 - RNA, 22 nt, Chlamydophila pneumoniae J138
guuucccaccauauucucagga

SEQ ID NO: 530760 - RNA, 21 nt, Chlamydophila pneumoniae J138
guuucgcuuugauaauagucu

SEQ ID NO: 530761 - RNA, 16 nt, Chlamydophila pneumoniae J138
aaaucaacucuccauc

SEQ ID NO: 530762 - RNA, 15 nt, Chlamydophila pneumoniae J138
aaaucaagaagagaa

SEQ ID NO: 530763 - RNA, 13 nt, Chlamydophila pneumoniae J138
aaaucaauaauaa

SEQ ID NO: 530764 - RNA, 16 nt, Chlamydophila pneumoniae J138
aaaucaaucuugaugg

SEQ ID NO: 530765 - RNA, 21 nt, Chlamydophila pneumoniae J138
guuucuaaaacagaaauugcu

SEQ ID NO: 530766 - RNA, 13 nt, Chlamydophila pneumoniae J138
aaaucacacuuaa

SEQ ID NO: 530767 - RNA, 19 nt, Chlamydophila pneumoniae J138
aaaucaccagcauuaagau

SEQ ID NO: 530768 - RNA, 13 nt, Chlamydophila pneumoniae J138
guuucuaaauacu

SEQ ID NO: 530769 - RNA, 16 nt, Chlamydophila pneumoniae J138
guuucucuggcaauga

SEQ ID NO: 530770 - RNA, 13 nt, Chlamydophila pneumoniae J138
guuucuagguucu

SEQ ID NO: 530771 - RNA, 21 nt, Chlamydophila pneumoniae J138
guuuguaguguugaauaagau

SEQ ID NO: 530772 - RNA, 13 nt, Chlamydophila pneumoniae J138
guuugucuuccau

SEQ ID NO: 530773 - RNA, 13 nt, Chlamydophila pneumoniae J138
guuugucgagcuu

SEQ ID NO: 530774 - RNA, 15 nt, Chlamydophila pneumoniae J138
guuugugggcauuua

SEQ ID NO: 530775 - RNA, 19 nt, Chlamydophila pneumoniae J138
guuuuacgaacuaaaggaa

SEQ ID NO: 530776 - RNA, 22 nt, Chlamydophila pneumoniae J138
guuuugauuuugcagugauaaa

SEQ ID NO: 530777 - RNA, 20 nt, Chlamydophila pneumoniae J138
guuuucuuuucugaagauuu

SEQ ID NO: 530778 - RNA, 17 nt, Chlamydophila pneumoniae J138
guuuucuuuucugaaga

SEQ ID NO: 530779 - RNA, 12 nt, Chlamydophila pneumoniae J138
aaaucaucaaaa

SEQ ID NO: 530780 - RNA, 19 nt, Chlamydophila pneumoniae J138
aaauccaaaaaaugcuccu

SEQ ID NO: 530781 - RNA, 16 nt, Chlamydophila pneumoniae J138
aaauccaccaaugaua

SEQ ID NO: 530782 - RNA, 14 nt, Chlamydophila pneumoniae J138
gcucauaagaaauu

SEQ ID NO: 530783 - RNA, 14 nt, Chlamydophila pneumoniae J138
gcucauaacccaaa

SEQ ID NO: 530784 - RNA, 13 nt, Chlamydophila pneumoniae J138
gcucaucuagaaa

SEQ ID NO: 530785 - RNA, 20 nt, Chlamydophila pneumoniae J138
gcucaugaaauuucauucuc

SEQ ID NO: 530786 - RNA, 18 nt, Chlamydophila pneumoniae J138
gcucaucggaucuuuucu

SEQ ID NO: 530787 - RNA, 19 nt, Chlamydophila pneumoniae J138
gcucaucggaucuuuucuu

SEQ ID NO: 530788 - RNA, 17 nt, Chlamydophila pneumoniae J138
gcucaucggaucuuuuc

SEQ ID NO: 530789 - RNA, 17 nt, Chlamydophila pneumoniae J138
gcuccaauuuucuucag

SEQ ID NO: 530790 - RNA, 23 nt, Chlamydophila pneumoniae J138
gcucccaacaagggaaagaaacu

SEQ ID NO: 530791 - RNA, 16 nt, Chlamydophila pneumoniae J138
gcucccguuccuuuag

SEQ ID NO: 530792 - RNA, 13 nt, Chlamydophila pneumoniae J138
gcuccugaagcug

SEQ ID NO: 530793 - RNA, 17 nt, Chlamydophila pneumoniae J138
gcuccugcaaaaaacca

SEQ ID NO: 530794 - RNA, 14 nt, Chlamydophila pneumoniae J138
gcuccugaauaugc

SEQ ID NO: 530795 - RNA, 14 nt, Chlamydophila pneumoniae J138
gcuccuugacuaaa

SEQ ID NO: 530796 - RNA, 20 nt, Chlamydophila pneumoniae J138
gcucgaggucuuuucuuuuu

SEQ ID NO: 530797 - RNA, 15 nt, Chlamydophila pneumoniae J138
gcucgagaucuuuuu

SEQ ID NO: 530798 - RNA, 20 nt, Chlamydophila pneumoniae J138
gcucgagaucuuuuugccag

SEQ ID NO: 530799 - RNA, 22 nt, Chlamydophila pneumoniae J138
gcucuacaagcucgguacgucu

SEQ ID NO: 530800 - RNA, 17 nt, Chlamydophila pneumoniae J138
gcucuaccaacugagcu

SEQ ID NO: 530801 - RNA, 15 nt, Chlamydophila pneumoniae J138
gcucuacaggagaag

SEQ ID NO: 530802 - RNA, 23 nt, Chlamydophila pneumoniae J138
gcucuaccccacgcuaaacuaaa

SEQ ID NO: 530803 - RNA, 15 nt, Chlamydophila pneumoniae J138
gcucuagucuuucaa

SEQ ID NO: 530804 - RNA, 17 nt, Chlamydophila pneumoniae J138
gcucuagcuaacauaaa

SEQ ID NO: 530805 - RNA, 21 nt, Chlamydophila pneumoniae J138
gcucgguacgucuuucaccaa

SEQ ID NO: 530806 - RNA, 14 nt, Chlamydophila pneumoniae J138
gcucucgacacuau

SEQ ID NO: 530807 - RNA, 15 nt, Chlamydophila pneumoniae J138
gcucucgcuaagcaa

SEQ ID NO: 530808 - RNA, 16 nt, Chlamydophila pneumoniae J138
gcucucgcuaagcaaa

SEQ ID NO: 530809 - RNA, 15 nt, Chlamydophila pneumoniae J138
gcucucuccaugagc

SEQ ID NO: 530810 - RNA, 22 nt, Chlamydophila pneumoniae J138
gcugaaaucaugccgagauuuu

SEQ ID NO: 530811 - RNA, 22 nt, Chlamydophila pneumoniae J138
gcugagacauauugaagauauu

SEQ ID NO: 530812 - RNA, 17 nt, Chlamydophila pneumoniae J138
gcugacacucagcuccc

SEQ ID NO: 530813 - RNA, 19 nt, Chlamydophila pneumoniae J138
gcugcagcaaaacuaggaa

SEQ ID NO: 530814 - RNA, 22 nt, Chlamydophila pneumoniae J138
gcugauuucuuuuucagcuucu

SEQ ID NO: 530815 - RNA, 14 nt, Chlamydophila pneumoniae J138
gcugauccaaaagc

SEQ ID NO: 530816 - RNA, 17 nt, Chlamydophila pneumoniae J138
gcugagauggucgagaa

SEQ ID NO: 530817 - RNA, 14 nt, Chlamydophila pneumoniae J138
gcugauucucccaa

SEQ ID NO: 530818 - RNA, 14 nt, Chlamydophila pneumoniae J138
gcugcuagagcagc

SEQ ID NO: 530819 - RNA, 23 nt, Chlamydophila pneumoniae J138
aaaggauauugauaaaucccgaa

SEQ ID NO: 530820 - RNA, 15 nt, Chlamydophila pneumoniae J138
gcuguacuugauauu

SEQ ID NO: 530821 - RNA, 16 nt, Chlamydophila pneumoniae J138
aaaggagaaagaauug

SEQ ID NO: 530822 - RNA, 17 nt, Chlamydophila pneumoniae J138
aaaggaaucucgggaga

SEQ ID NO: 530823 - RNA, 18 nt, Chlamydophila pneumoniae J138
aaaggaaucccuuuuuaa

SEQ ID NO: 530824 - RNA, 17 nt, Chlamydophila pneumoniae J138
aaaggaccacaauuccu

SEQ ID NO: 530825 - RNA, 18 nt, Chlamydophila pneumoniae J138
gcuguauuuucagcacug

SEQ ID NO: 530826 - RNA, 11 nt, Chlamydophila pneumoniae J138
gcuguauuuuc

SEQ ID NO: 530827 - RNA, 20 nt, Chlamydophila pneumoniae J138
gcuguagugauacuuuagaa

SEQ ID NO: 530828 - RNA, 20 nt, Chlamydophila pneumoniae J138
aaaggaacuucguuucgcuu

SEQ ID NO: 530829 - RNA, 15 nt, Chlamydophila pneumoniae J138
gcuguuucuucugaa

SEQ ID NO: 530830 - RNA, 14 nt, Chlamydophila pneumoniae J138
gcuguguaaaaguu

SEQ ID NO: 530831 - RNA, 13 nt, Chlamydophila pneumoniae J138
gcuguggugguga

SEQ ID NO: 530832 - RNA, 14 nt, Chlamydophila pneumoniae J138
gcuuauuauugaau

SEQ ID NO: 530833 - RNA, 16 nt, Chlamydophila pneumoniae J138
gcuucaaaaagcuccc

SEQ ID NO: 530834 - RNA, 23 nt, Chlamydophila pneumoniae J138
gcuuauuucuguaguucuugcca

SEQ ID NO: 530835 - RNA, 19 nt, Chlamydophila pneumoniae J138
gcuucaccauuaagauauc

SEQ ID NO: 530836 - RNA, 15 nt, Chlamydophila pneumoniae J138
gcuucacaucuuucu

SEQ ID NO: 530837 - RNA, 18 nt, Chlamydophila pneumoniae J138
gcuucaaggcaucuucuu

SEQ ID NO: 530838 - RNA, 13 nt, Chlamydophila pneumoniae J138
gcuuauccguggg

SEQ ID NO: 530839 - RNA, 21 nt, Chlamydophila pneumoniae J138
gcuuauagagagaaugacuuu

SEQ ID NO: 530840 - RNA, 15 nt, Chlamydophila pneumoniae J138
gcuuacuuucuuuua

SEQ ID NO: 530841 - RNA, 16 nt, Chlamydophila pneumoniae J138
gcuuacuuucuuuuag

SEQ ID NO: 530842 - RNA, 16 nt, Chlamydophila pneumoniae J138
gcuucaucaaaacaua

SEQ ID NO: 530843 - RNA, 15 nt, Chlamydophila pneumoniae J138
gcuucaucaaaacau

SEQ ID NO: 530844 - RNA, 21 nt, Chlamydophila pneumoniae J138
gcuuccaacuuuugaagaucc

SEQ ID NO: 530845 - RNA, 19 nt, Chlamydophila pneumoniae J138
gcuucauuccuacaucugu

SEQ ID NO: 530846 - RNA, 18 nt, Chlamydophila pneumoniae J138
gcuuccaucguuagauuu

SEQ ID NO: 530847 - RNA, 15 nt, Chlamydophila pneumoniae J138
gcuuccagcuucucc

SEQ ID NO: 530848 - RNA, 19 nt, Chlamydophila pneumoniae J138
gcuuccgugcgauuucccc

SEQ ID NO: 530849 - RNA, 21 nt, Chlamydophila pneumoniae J138
gcuuccuuggucuuauugaag

SEQ ID NO: 530850 - RNA, 16 nt, Chlamydophila pneumoniae J138
gcuucuggagaaaaaa

SEQ ID NO: 530851 - RNA, 20 nt, Chlamydophila pneumoniae J138
gcuucuaagaucuuuuguaa

SEQ ID NO: 530852 - RNA, 14 nt, Chlamydophila pneumoniae J138
gcuucucccauagc

SEQ ID NO: 530853 - RNA, 15 nt, Chlamydophila pneumoniae J138
gcuucuccaacuucc

SEQ ID NO: 530854 - RNA, 14 nt, Chlamydophila pneumoniae J138
gcuucuaucuugaa

SEQ ID NO: 530855 - RNA, 18 nt, Chlamydophila pneumoniae J138
gcuucuacgguaagaucu

SEQ ID NO: 530856 - RNA, 13 nt, Chlamydophila pneumoniae J138
gcuucgcaaucuu

SEQ ID NO: 530857 - RNA, 17 nt, Chlamydophila pneumoniae J138
gcuucgcaaucuuugau

SEQ ID NO: 530858 - RNA, 22 nt, Chlamydophila pneumoniae J138
gcuucuuuaucuagcucuucaa

SEQ ID NO: 530859 - RNA, 15 nt, Chlamydophila pneumoniae J138
gcuucuuucuuacua

SEQ ID NO: 530860 - RNA, 20 nt, Chlamydophila pneumoniae J138
gcuugauuuccugagagcgu

SEQ ID NO: 530861 - RNA, 18 nt, Chlamydophila pneumoniae J138
gcuugggcaaauaggaga

SEQ ID NO: 530862 - RNA, 23 nt, Chlamydophila pneumoniae J138
gcuugcugauuucuuuuucagcu

SEQ ID NO: 530863 - RNA, 17 nt, Chlamydophila pneumoniae J138
gcuugucgcgacaagac

SEQ ID NO: 530864 - RNA, 18 nt, Chlamydophila pneumoniae J138
gcuugugcuaaagcagga

SEQ ID NO: 530865 - RNA, 19 nt, Chlamydophila pneumoniae J138
gcuuucagaaaagaaaagu

SEQ ID NO: 530866 - RNA, 12 nt, Chlamydophila pneumoniae J138
gcuuuaucucua

SEQ ID NO: 530867 - RNA, 16 nt, Chlamydophila pneumoniae J138
gcuuuaaguguuucuu

SEQ ID NO: 530868 - RNA, 16 nt, Chlamydophila pneumoniae J138
ggaacaagucuucaau

SEQ ID NO: 530869 - RNA, 14 nt, Chlamydophila pneumoniae J138
gcuuuccuuuugau

SEQ ID NO: 530870 - RNA, 15 nt, Chlamydophila pneumoniae J138
gcuuuccuaaccauu

SEQ ID NO: 530871 - RNA, 22 nt, Chlamydophila pneumoniae J138
ggaacuaaagagaucacaggga

SEQ ID NO: 530872 - RNA, 19 nt, Chlamydophila pneumoniae J138
ggaacuacaggaauucuca

SEQ ID NO: 530873 - RNA, 18 nt, Chlamydophila pneumoniae J138
ggaacaugccaaauaucu

SEQ ID NO: 530874 - RNA, 18 nt, Chlamydophila pneumoniae J138
ggaauaauaggauaagaa

SEQ ID NO: 530875 - RNA, 19 nt, Chlamydophila pneumoniae J138
ggaauaacaccaaaagaau

SEQ ID NO: 530876 - RNA, 10 nt, Chlamydophila pneumoniae J138
ggaaguguag

SEQ ID NO: 530877 - RNA, 20 nt, Chlamydophila pneumoniae J138
ggaaguccauguacagaaaa

SEQ ID NO: 530878 - RNA, 22 nt, Chlamydophila pneumoniae J138
ggaauuucccauauagcucguu

SEQ ID NO: 530879 - RNA, 22 nt, Chlamydophila pneumoniae J138
ggaauugcagcaaggagagugc

SEQ ID NO: 530880 - RNA, 13 nt, Chlamydophila pneumoniae J138
ggacaacagcaac

SEQ ID NO: 530881 - RNA, 14 nt, Chlamydophila pneumoniae J138
ggacacuagaauac

SEQ ID NO: 530882 - RNA, 19 nt, Chlamydophila pneumoniae J138
ggacacuauuaucugcaga

SEQ ID NO: 530883 - RNA, 18 nt, Chlamydophila pneumoniae J138
ggacaaugcuaucuccag

SEQ ID NO: 530884 - RNA, 16 nt, Chlamydophila pneumoniae J138
ggacaaugcuaucucc

SEQ ID NO: 530885 - RNA, 14 nt, Chlamydophila pneumoniae J138
ggacaaucaacauu

SEQ ID NO: 530886 - RNA, 18 nt, Chlamydophila pneumoniae J138
ggacaccagcuucccaag

SEQ ID NO: 530887 - RNA, 12 nt, Chlamydophila pneumoniae J138
ggacagaaagau

SEQ ID NO: 530888 - RNA, 15 nt, Chlamydophila pneumoniae J138
aaaggcucuuuuaga

SEQ ID NO: 530889 - RNA, 21 nt, Chlamydophila pneumoniae J138
aaaggcucuuuuagagccuuu

SEQ ID NO: 530890 - RNA, 21 nt, Chlamydophila pneumoniae J138
ggaccuguuuucuuuucugaa

SEQ ID NO: 530891 - RNA, 17 nt, Chlamydophila pneumoniae J138
ggaccuguuuucuuuuc

SEQ ID NO: 530892 - RNA, 21 nt, Chlamydophila pneumoniae J138
aaagggucuuuaccagaaaug

SEQ ID NO: 530893 - RNA, 16 nt, Chlamydophila pneumoniae J138
aaaggugaaaguacag

SEQ ID NO: 530894 - RNA, 17 nt, Chlamydophila pneumoniae J138
aaaguaacgauaagaag

SEQ ID NO: 530895 - RNA, 16 nt, Chlamydophila pneumoniae J138
aaaguaacuaucuaca

SEQ ID NO: 530896 - RNA, 19 nt, Chlamydophila pneumoniae J138
ggagagguaaccagagagc

SEQ ID NO: 530897 - RNA, 11 nt, Chlamydophila pneumoniae J138
ggagagguaau

SEQ ID NO: 530898 - RNA, 19 nt, Chlamydophila pneumoniae J138
ggagagcuucuucuguaaa

SEQ ID NO: 530899 - RNA, 19 nt, Chlamydophila pneumoniae J138
ggagcauagacucuuccuu

SEQ ID NO: 530900 - RNA, 23 nt, Chlamydophila pneumoniae J138
ggagcaucuuuucaaaagaaaag

SEQ ID NO: 530901 - RNA, 22 nt, Chlamydophila pneumoniae J138
ggaguuucuuauucacuggaau

SEQ ID NO: 530902 - RNA, 14 nt, Chlamydophila pneumoniae J138
ggaguuuuccuaaa

SEQ ID NO: 530903 - RNA, 18 nt, Chlamydophila pneumoniae J138
ggaguucuugauucucuu

SEQ ID NO: 530904 - RNA, 14 nt, Chlamydophila pneumoniae J138
ggauaaauggagga

SEQ ID NO: 530905 - RNA, 20 nt, Chlamydophila pneumoniae J138
ggauauugucaagaggcugu

SEQ ID NO: 530906 - RNA, 20 nt, Chlamydophila pneumoniae J138
ggauaaugcucacuucuuug

SEQ ID NO: 530907 - RNA, 13 nt, Chlamydophila pneumoniae J138
ggauaauuaaacu

SEQ ID NO: 530908 - RNA, 15 nt, Chlamydophila pneumoniae J138
ggauaaguucuucca

SEQ ID NO: 530909 - RNA, 18 nt, Chlamydophila pneumoniae J138
ggaucccaaaaaaugccc

SEQ ID NO: 530910 - RNA, 17 nt, Chlamydophila pneumoniae J138
ggaucauuaaaguccaa

SEQ ID NO: 530911 - RNA, 15 nt, Chlamydophila pneumoniae J138
ggaucauguagcaga

SEQ ID NO: 530912 - RNA, 18 nt, Chlamydophila pneumoniae J138
ggaucucucuuuccuuag

SEQ ID NO: 530913 - RNA, 16 nt, Chlamydophila pneumoniae J138
ggaucuugauaaaaga

SEQ ID NO: 530914 - RNA, 16 nt, Chlamydophila pneumoniae J138
ggaucuuaggauucuu

SEQ ID NO: 530915 - RNA, 19 nt, Chlamydophila pneumoniae J138
ggaucuuuucuuucuaaga

SEQ ID NO: 530916 - RNA, 18 nt, Chlamydophila pneumoniae J138
ggauggacuacugaaaca

SEQ ID NO: 530917 - RNA, 23 nt, Chlamydophila pneumoniae J138
ggaugcagaucauaucggcagca

SEQ ID NO: 530918 - RNA, 13 nt, Chlamydophila pneumoniae J138
aaaguaccuuuaa

SEQ ID NO: 530919 - RNA, 16 nt, Chlamydophila pneumoniae J138
aaaguacgaccaacuc

SEQ ID NO: 530920 - RNA, 16 nt, Chlamydophila pneumoniae J138
aaaguaccuaggaucu

SEQ ID NO: 530921 - RNA, 18 nt, Chlamydophila pneumoniae J138
aaaguacgcauaggccaa

SEQ ID NO: 530922 - RNA, 15 nt, Chlamydophila pneumoniae J138
aaaguacuacaauaa

SEQ ID NO: 530923 - RNA, 15 nt, Chlamydophila pneumoniae J138
ggauggucaggaaga

SEQ ID NO: 530924 - RNA, 17 nt, Chlamydophila pneumoniae J138
ggaugucuuguugcaug

SEQ ID NO: 530925 - RNA, 18 nt, Chlamydophila pneumoniae J138
ggauucuuuugcaaugcu

SEQ ID NO: 530926 - RNA, 15 nt, Chlamydophila pneumoniae J138
ggauucuaaaaagaa

SEQ ID NO: 530927 - RNA, 20 nt, Chlamydophila pneumoniae J138
ggauucuaaaaagaaaagac

SEQ ID NO: 530928 - RNA, 14 nt, Chlamydophila pneumoniae J138
ggauucuaaaaaga

SEQ ID NO: 530929 - RNA, 20 nt, Chlamydophila pneumoniae J138
ggauucaaauuugcucuccu

SEQ ID NO: 530930 - RNA, 15 nt, Chlamydophila pneumoniae J138
ggauucacaucuuaa

SEQ ID NO: 530931 - RNA, 17 nt, Chlamydophila pneumoniae J138
ggauuaucuuagggaau

SEQ ID NO: 530932 - RNA, 18 nt, Chlamydophila pneumoniae J138
ggauuaucccaaacuucu

SEQ ID NO: 530933 - RNA, 19 nt, Chlamydophila pneumoniae J138
aaaguaggcacaucauuau

SEQ ID NO: 530934 - RNA, 16 nt, Chlamydophila pneumoniae J138
aaaguaggauugauaa

SEQ ID NO: 530935 - RNA, 14 nt, Chlamydophila pneumoniae J138
aaaguagaauccuu

SEQ ID NO: 530936 - RNA, 17 nt, Chlamydophila pneumoniae J138
ggcagguaguaggacaa

SEQ ID NO: 530937 - RNA, 23 nt, Chlamydophila pneumoniae J138
ggcauaguggcucaguguauugu

SEQ ID NO: 530938 - RNA, 13 nt, Chlamydophila pneumoniae J138
ggcaucuaagcca

SEQ ID NO: 530939 - RNA, 14 nt, Chlamydophila pneumoniae J138
ggcaucuagagucu

SEQ ID NO: 530940 - RNA, 15 nt, Chlamydophila pneumoniae J138
aaaguccaagaucaa

SEQ ID NO: 530941 - RNA, 14 nt, Chlamydophila pneumoniae J138
ggccccuggaauuu

SEQ ID NO: 530942 - RNA, 17 nt, Chlamydophila pneumoniae J138
ggcccccuacagcagaa

SEQ ID NO: 530943 - RNA, 20 nt, Chlamydophila pneumoniae J138
aaagugacuuccuccaaaau

SEQ ID NO: 530944 - RNA, 19 nt, Chlamydophila pneumoniae J138
aaagugaugccuggacugc

SEQ ID NO: 530945 - RNA, 16 nt, Chlamydophila pneumoniae J138
aaagugaaaccauuua

SEQ ID NO: 530946 - RNA, 14 nt, Chlamydophila pneumoniae J138
aaagugaaagcaac

SEQ ID NO: 530947 - RNA, 18 nt, Chlamydophila pneumoniae J138
aaagucucuagggaaagg

SEQ ID NO: 530948 - RNA, 20 nt, Chlamydophila pneumoniae J138
aaauaaguccuguuugaaaa

SEQ ID NO: 530949 - RNA, 22 nt, Chlamydophila pneumoniae J138
aaauaauuuuauuaguuacuga

SEQ ID NO: 530950 - RNA, 15 nt, Chlamydophila pneumoniae J138
aaauaauuuuauuag

SEQ ID NO: 530951 - RNA, 17 nt, Chlamydophila pneumoniae J138
aaauacaggccugaugu

SEQ ID NO: 530952 - RNA, 12 nt, Chlamydophila pneumoniae J138
aaauagaaauaa

SEQ ID NO: 530953 - RNA, 14 nt, Chlamydophila pneumoniae J138
aaauagaaaucuua

SEQ ID NO: 530954 - RNA, 14 nt, Chlamydophila pneumoniae J138
aaauacuucuccug

SEQ ID NO: 530955 - RNA, 20 nt, Chlamydophila pneumoniae J138
ggcggagaauaucaucuucc

SEQ ID NO: 530956 - RNA, 23 nt, Chlamydophila pneumoniae J138
ggcucucgacacuauguguuucc

SEQ ID NO: 530957 - RNA, 15 nt, Chlamydophila pneumoniae J138
ggcucuauaggggau

SEQ ID NO: 530958 - RNA, 19 nt, Chlamydophila pneumoniae J138
ggcugagacauauugaaga

SEQ ID NO: 530959 - RNA, 15 nt, Chlamydophila pneumoniae J138
ggcucuuuuagagcc

SEQ ID NO: 530960 - RNA, 16 nt, Chlamydophila pneumoniae J138
ggcugucuugaccaau

SEQ ID NO: 530961 - RNA, 21 nt, Chlamydophila pneumoniae J138
ggcuggaaagccaagcuucca

SEQ ID NO: 530962 - RNA, 22 nt, Chlamydophila pneumoniae J138
ggcugcuuuuguuguuuuugcu

SEQ ID NO: 530963 - RNA, 22 nt, Chlamydophila pneumoniae J138
ggcuucagagauuuuaaagccu

SEQ ID NO: 530964 - RNA, 18 nt, Chlamydophila pneumoniae J138
ggcuucauuccuacaucu

SEQ ID NO: 530965 - RNA, 22 nt, Chlamydophila pneumoniae J138
ggcuucugagcuugccuaccca

SEQ ID NO: 530966 - RNA, 20 nt, Chlamydophila pneumoniae J138
ggcuuuaaguguuucuucau

SEQ ID NO: 530967 - RNA, 20 nt, Chlamydophila pneumoniae J138
ggcuuugccuuuagagacgc

SEQ ID NO: 530968 - RNA, 20 nt, Chlamydophila pneumoniae J138
ggcuuugggcaucucucuuu

SEQ ID NO: 530969 - RNA, 15 nt, Chlamydophila pneumoniae J138
ggcuuuucuaaagcg

SEQ ID NO: 530970 - RNA, 13 nt, Chlamydophila pneumoniae J138
gggaaaagaaaag

SEQ ID NO: 530971 - RNA, 11 nt, Chlamydophila pneumoniae J138
gggaaagaaac

SEQ ID NO: 530972 - RNA, 13 nt, Chlamydophila pneumoniae J138
gggaaagaaacua

SEQ ID NO: 530973 - RNA, 16 nt, Chlamydophila pneumoniae J138
gggaaagacucaucuu

SEQ ID NO: 530974 - RNA, 20 nt, Chlamydophila pneumoniae J138
gggaagccuggaaaugaaua

SEQ ID NO: 530975 - RNA, 17 nt, Chlamydophila pneumoniae J138
gggaagacucucaucag

SEQ ID NO: 530976 - RNA, 16 nt, Chlamydophila pneumoniae J138
gggaaggggagauucc

SEQ ID NO: 530977 - RNA, 23 nt, Chlamydophila pneumoniae J138
gggaauuaaacuuucuucucuag

SEQ ID NO: 530978 - RNA, 22 nt, Chlamydophila pneumoniae J138
gggaauuaaacuuucuucucua

SEQ ID NO: 530979 - RNA, 20 nt, Chlamydophila pneumoniae J138
gggaauuaaacuuucuucuc

SEQ ID NO: 530980 - RNA, 23 nt, Chlamydophila pneumoniae J138
gggaauuugauuuuucaaauucu

SEQ ID NO: 530981 - RNA, 16 nt, Chlamydophila pneumoniae J138
gggaggaauuccucuc

SEQ ID NO: 530982 - RNA, 15 nt, Chlamydophila pneumoniae J138
gggagcuagaaaguc

SEQ ID NO: 530983 - RNA, 20 nt, Chlamydophila pneumoniae J138
gggauaaugcucacuucuuu

SEQ ID NO: 530984 - RNA, 16 nt, Chlamydophila pneumoniae J138
gggauccugcaaagcc

SEQ ID NO: 530985 - RNA, 17 nt, Chlamydophila pneumoniae J138
gggaucuucagagagaa

SEQ ID NO: 530986 - RNA, 16 nt, Chlamydophila pneumoniae J138
gggaucuucagagaga

SEQ ID NO: 530987 - RNA, 17 nt, Chlamydophila pneumoniae J138
gggaucuccuugagaga

SEQ ID NO: 530988 - RNA, 14 nt, Chlamydophila pneumoniae J138
gggauggucaggaa

SEQ ID NO: 530989 - RNA, 18 nt, Chlamydophila pneumoniae J138
gggcaauauauccaggau

SEQ ID NO: 530990 - RNA, 22 nt, Chlamydophila pneumoniae J138
gggcacucuuccacaauguuua

SEQ ID NO: 530991 - RNA, 15 nt, Chlamydophila pneumoniae J138
gggcaggggauaggc

SEQ ID NO: 530992 - RNA, 22 nt, Chlamydophila pneumoniae J138
gggccagcgcauuaacgucauc

SEQ ID NO: 530993 - RNA, 13 nt, Chlamydophila pneumoniae J138
gggcuacaauacg

SEQ ID NO: 530994 - RNA, 21 nt, Chlamydophila pneumoniae J138
gggccugccaugaauccaugg

SEQ ID NO: 530995 - RNA, 18 nt, Chlamydophila pneumoniae J138
gggcggacuauguuuaaa

SEQ ID NO: 530996 - RNA, 15 nt, Chlamydophila pneumoniae J138
ggggcaguuccuaaa

SEQ ID NO: 530997 - RNA, 18 nt, Chlamydophila pneumoniae J138
ggguaaguccacaagccu

SEQ ID NO: 530998 - RNA, 18 nt, Chlamydophila pneumoniae J138
ggguaaggcgaaaucuuc

SEQ ID NO: 530999 - RNA, 22 nt, Chlamydophila pneumoniae J138
gggguucccucuccuugaaaau

SEQ ID NO: 531000 - RNA, 19 nt, Chlamydophila pneumoniae J138
gggguccauucugaccaaa

SEQ ID NO: 531001 - RNA, 15 nt, Chlamydophila pneumoniae J138
gggucuacaacaguu

SEQ ID NO: 531002 - RNA, 13 nt, Chlamydophila pneumoniae J138
ggguguggcaaag

SEQ ID NO: 531003 - RNA, 14 nt, Chlamydophila pneumoniae J138
gguaaaacuacagg

SEQ ID NO: 531004 - RNA, 14 nt, Chlamydophila pneumoniae J138
gguaaagagcuucu

SEQ ID NO: 531005 - RNA, 15 nt, Chlamydophila pneumoniae J138
gguaaauuuuuaaaa

SEQ ID NO: 531006 - RNA, 12 nt, Chlamydophila pneumoniae J138
gguaaggaggaa

SEQ ID NO: 531007 - RNA, 12 nt, Chlamydophila pneumoniae J138
gguagugaucug

SEQ ID NO: 531008 - RNA, 20 nt, Chlamydophila pneumoniae J138
gguagucccuuucuauuuca

SEQ ID NO: 531009 - RNA, 14 nt, Chlamydophila pneumoniae J138
gguagcuuaagaau

SEQ ID NO: 531010 - RNA, 14 nt, Chlamydophila pneumoniae J138
gguauuucucucca

SEQ ID NO: 531011 - RNA, 21 nt, Chlamydophila pneumoniae J138
gguagcccugcaccaauugca

SEQ ID NO: 531012 - RNA, 22 nt, Chlamydophila pneumoniae J138
gguagcgucucuucuuccucua

SEQ ID NO: 531013 - RNA, 19 nt, Chlamydophila pneumoniae J138
gguagcuaaauuuagagaa

SEQ ID NO: 531014 - RNA, 20 nt, Chlamydophila pneumoniae J138
gguagcagaguuuuucccuc

SEQ ID NO: 531015 - RNA, 18 nt, Chlamydophila pneumoniae J138
ggucgauaucccacagaa

SEQ ID NO: 531016 - RNA, 16 nt, Chlamydophila pneumoniae J138
ggucgaucaagguguu

SEQ ID NO: 531017 - RNA, 18 nt, Chlamydophila pneumoniae J138
ggucgcaucaaugacugu

SEQ ID NO: 531018 - RNA, 17 nt, Chlamydophila pneumoniae J138
ggucuaacuuagagcga

SEQ ID NO: 531019 - RNA, 14 nt, Chlamydophila pneumoniae J138
gguccaaacccugg

SEQ ID NO: 531020 - RNA, 15 nt, Chlamydophila pneumoniae J138
ggucacagcauuuuc

SEQ ID NO: 531021 - RNA, 22 nt, Chlamydophila pneumoniae J138
ggucacuauagaucucuugaag

SEQ ID NO: 531022 - RNA, 17 nt, Chlamydophila pneumoniae J138
ggucaggagguggugga

SEQ ID NO: 531023 - RNA, 21 nt, Chlamydophila pneumoniae J138
gccguauagauuuuccgcaaa

SEQ ID NO: 531024 - RNA, 14 nt, Chlamydophila pneumoniae J138
gccgugaagcagag

SEQ ID NO: 531025 - RNA, 20 nt, Chlamydophila pneumoniae J138
gccuacaggcaaggagagcu

SEQ ID NO: 531026 - RNA, 12 nt, Chlamydophila pneumoniae J138
gccuacaauacu

SEQ ID NO: 531027 - RNA, 14 nt, Chlamydophila pneumoniae J138
gccuaaucuuguag

SEQ ID NO: 531028 - RNA, 20 nt, Chlamydophila pneumoniae J138
gccuccaccugcagcgcagc

SEQ ID NO: 531029 - RNA, 15 nt, Chlamydophila pneumoniae J138
gccuccaccugcagc

SEQ ID NO: 531030 - RNA, 17 nt, Chlamydophila pneumoniae J138
gccuauagauuccccaa

SEQ ID NO: 531031 - RNA, 15 nt, Chlamydophila pneumoniae J138
gccuccuucauucac

SEQ ID NO: 531032 - RNA, 17 nt, Chlamydophila pneumoniae J138
gccuccucaagauaaau

SEQ ID NO: 531033 - RNA, 19 nt, Chlamydophila pneumoniae J138
gccuggccaucaucaccag

SEQ ID NO: 531034 - RNA, 22 nt, Chlamydophila pneumoniae J138
gccugucuauaaaauaaauuuu

SEQ ID NO: 531035 - RNA, 13 nt, Chlamydophila pneumoniae J138
gccuuaaauguau

SEQ ID NO: 531036 - RNA, 23 nt, Chlamydophila pneumoniae J138
gccuguuuucuucuaccuguagc

SEQ ID NO: 531037 - RNA, 20 nt, Chlamydophila pneumoniae J138
gccuucagcaacuaaagcau

SEQ ID NO: 531038 - RNA, 11 nt, Chlamydophila pneumoniae J138
gccuuucucuu

SEQ ID NO: 531039 - RNA, 13 nt, Chlamydophila pneumoniae J138
gcgaaccaaaguc

SEQ ID NO: 531040 - RNA, 18 nt, Chlamydophila pneumoniae J138
gcgaagggaggagaacuu

SEQ ID NO: 531041 - RNA, 17 nt, Chlamydophila pneumoniae J138
gcgcacaccagcucgag

SEQ ID NO: 531042 - RNA, 18 nt, Chlamydophila pneumoniae J138
gcgcaguggacggggaga

SEQ ID NO: 531043 - RNA, 12 nt, Chlamydophila pneumoniae J138
gcgcauuuuuuc

SEQ ID NO: 531044 - RNA, 12 nt, Chlamydophila pneumoniae J138
gcgccuccaccu

SEQ ID NO: 531045 - RNA, 15 nt, Chlamydophila pneumoniae J138
gcgccuccaccugca

SEQ ID NO: 531046 - RNA, 18 nt, Chlamydophila pneumoniae J138
gcgccuccaccugcagcg

SEQ ID NO: 531047 - RNA, 14 nt, Chlamydophila pneumoniae J138
gcgcccgagcuucc

SEQ ID NO: 531048 - RNA, 23 nt, Chlamydophila pneumoniae J138
gcgcccgaaucuuucaaaagaaa

SEQ ID NO: 531049 - RNA, 22 nt, Chlamydophila pneumoniae J138
gcggcaacaagagcgcauuuua

SEQ ID NO: 531050 - RNA, 20 nt, Chlamydophila pneumoniae J138
gcggaauacuucuccucgca

SEQ ID NO: 531051 - RNA, 16 nt, Chlamydophila pneumoniae J138
gcggaagcaccgccug

SEQ ID NO: 531052 - RNA, 12 nt, Chlamydophila pneumoniae J138
gcggaacucauc

SEQ ID NO: 531053 - RNA, 14 nt, Chlamydophila pneumoniae J138
gcggcuuuuugcaa

SEQ ID NO: 531054 - RNA, 14 nt, Chlamydophila pneumoniae J138
gccaucaucaccag

SEQ ID NO: 531055 - RNA, 18 nt, Chlamydophila pneumoniae J138
gccaucuucuucuaggau

SEQ ID NO: 531056 - RNA, 14 nt, Chlamydophila pneumoniae J138
gcccaaagcuaaaa

SEQ ID NO: 531057 - RNA, 16 nt, Chlamydophila pneumoniae J138
gcccauaaaggcgucg

SEQ ID NO: 531058 - RNA, 22 nt, Chlamydophila pneumoniae J138
gccccuuccaauacuaaaacua

SEQ ID NO: 531059 - RNA, 22 nt, Chlamydophila pneumoniae J138
gccccuuaaagagaaucuccuc

SEQ ID NO: 531060 - RNA, 17 nt, Chlamydophila pneumoniae J138
gcccauuaacuaagaua

SEQ ID NO: 531061 - RNA, 18 nt, Chlamydophila pneumoniae J138
gcccuugaaucauagaga

SEQ ID NO: 531062 - RNA, 19 nt, Chlamydophila pneumoniae J138
gcccuugcagcgacaacac

SEQ ID NO: 531063 - RNA, 19 nt, Chlamydophila pneumoniae J138
gcccugucacuaucuucua

SEQ ID NO: 531064 - RNA, 20 nt, Chlamydophila pneumoniae J138
gccgacucuacaucuucuug

SEQ ID NO: 531065 - RNA, 16 nt, Chlamydophila pneumoniae J138
aaagcugaauccaggu

SEQ ID NO: 531066 - RNA, 15 nt, Chlamydophila pneumoniae J138
aaagcucuuucauaa

SEQ ID NO: 531067 - RNA, 18 nt, Chlamydophila pneumoniae J138
aaagcucuuucauaagau

SEQ ID NO: 531068 - RNA, 20 nt, Chlamydophila pneumoniae J138
gccaaagucacucaaacccu

SEQ ID NO: 531069 - RNA, 14 nt, Chlamydophila pneumoniae J138
gccaaauaccaagg

SEQ ID NO: 531070 - RNA, 24 nt, Chlamydophila pneumoniae J138
gccacaucaaagcaauuucuccua

SEQ ID NO: 531071 - RNA, 15 nt, Chlamydophila pneumoniae J138
gccacaugaaguccu

SEQ ID NO: 531072 - RNA, 15 nt, Chlamydophila pneumoniae J138
gccaccaacaguccu

SEQ ID NO: 531073 - RNA, 22 nt, Chlamydophila pneumoniae J138
gccagaauguacauagaggaga

SEQ ID NO: 531074 - RNA, 16 nt, Chlamydophila pneumoniae J138
gccagcccaugucuuu

SEQ ID NO: 531075 - RNA, 21 nt, Chlamydophila pneumoniae J138
gccagcgaucacauagaaaac

SEQ ID NO: 531076 - RNA, 23 nt, Chlamydophila pneumoniae J138
gccaggagacuaaaagaauaaua

SEQ ID NO: 531077 - RNA, 20 nt, Chlamydophila pneumoniae J138
gccaggagagcuaacagcac

SEQ ID NO: 531078 - RNA, 18 nt, Chlamydophila pneumoniae J138
gcagcuucccaagcagaa

SEQ ID NO: 531079 - RNA, 15 nt, Chlamydophila pneumoniae J138
gcaggaaaagcaaaa

SEQ ID NO: 531080 - RNA, 13 nt, Chlamydophila pneumoniae J138
gcaggagaacaau

SEQ ID NO: 531081 - RNA, 15 nt, Chlamydophila pneumoniae J138
gcagggggccugcca

SEQ ID NO: 531082 - RNA, 23 nt, Chlamydophila pneumoniae J138
gcaguauagagaagauuucuaua

SEQ ID NO: 531083 - RNA, 20 nt, Chlamydophila pneumoniae J138
gcagucgugauauccaccuu

SEQ ID NO: 531084 - RNA, 16 nt, Chlamydophila pneumoniae J138
gcaguugcaauaccaa

SEQ ID NO: 531085 - RNA, 19 nt, Chlamydophila pneumoniae J138
gcauaaccuuugacaacac

SEQ ID NO: 531086 - RNA, 15 nt, Chlamydophila pneumoniae J138
gcaguggcuuauaga

SEQ ID NO: 531087 - RNA, 20 nt, Chlamydophila pneumoniae J138
gcaguggcuuauagagagaa

SEQ ID NO: 531088 - RNA, 22 nt, Chlamydophila pneumoniae J138
gcaugcaucuuaucaagagcuc

SEQ ID NO: 531089 - RNA, 21 nt, Chlamydophila pneumoniae J138
gcaucuuuggcacaauccuca

SEQ ID NO: 531090 - RNA, 15 nt, Chlamydophila pneumoniae J138
gcaucuuucaucaau

SEQ ID NO: 531091 - RNA, 20 nt, Chlamydophila pneumoniae J138
gcaucuuauggaagagagca

SEQ ID NO: 531092 - RNA, 16 nt, Chlamydophila pneumoniae J138
gcaucuuauggaagag

SEQ ID NO: 531093 - RNA, 17 nt, Chlamydophila pneumoniae J138
gcaucuucgauuucuag

SEQ ID NO: 531094 - RNA, 16 nt, Chlamydophila pneumoniae J138
gcaucuuggcgcacac

SEQ ID NO: 531095 - RNA, 13 nt, Chlamydophila pneumoniae J138
gcaucuucucgaa

SEQ ID NO: 531096 - RNA, 23 nt, Chlamydophila pneumoniae J138
gcauggauccuucaucagcuucc

SEQ ID NO: 531097 - RNA, 22 nt, Chlamydophila pneumoniae J138
gcauggagaauaaucucuuuca

SEQ ID NO: 531098 - RNA, 13 nt, Chlamydophila pneumoniae J138
gcauggucuccca

SEQ ID NO: 531099 - RNA, 13 nt, Chlamydophila pneumoniae J138
gcauuaacgucau

SEQ ID NO: 531100 - RNA, 12 nt, Chlamydophila pneumoniae J138
gcauuaauaacu

SEQ ID NO: 531101 - RNA, 19 nt, Chlamydophila pneumoniae J138
gcauguccauuaauauccc

SEQ ID NO: 531102 - RNA, 22 nt, Chlamydophila pneumoniae J138
gcauuggacaacgcuucuuuuu

SEQ ID NO: 531103 - RNA, 13 nt, Chlamydophila pneumoniae J138
gcauugcaaauaa

SEQ ID NO: 531104 - RNA, 21 nt, Chlamydophila pneumoniae J138
gcauugcaaauaagccaguac

SEQ ID NO: 531105 - RNA, 18 nt, Chlamydophila pneumoniae J138
gcauuacgguuucuggga

SEQ ID NO: 531106 - RNA, 19 nt, Chlamydophila pneumoniae J138
gcauuugccccuaacuggc

SEQ ID NO: 531107 - RNA, 15 nt, Chlamydophila pneumoniae J138
gcauuucuuucucuu

SEQ ID NO: 531108 - RNA, 17 nt, Chlamydophila pneumoniae J138
gcauuuucuucuugcaa

SEQ ID NO: 531109 - RNA, 12 nt, Chlamydophila pneumoniae J138
gcauuuucucug

SEQ ID NO: 531110 - RNA, 17 nt, Chlamydophila pneumoniae J138
gccaaagaacagcacuc

SEQ ID NO: 531111 - RNA, 13 nt, Chlamydophila pneumoniae J138
gcaucuagagucu

SEQ ID NO: 531112 - RNA, 19 nt, Chlamydophila pneumoniae J138
gcaucuagagucucuuuca

SEQ ID NO: 531113 - RNA, 13 nt, Chlamydophila pneumoniae J138
gcaucucucucca

SEQ ID NO: 531114 - RNA, 11 nt, Chlamydophila pneumoniae J138
gcaucucugca

SEQ ID NO: 531115 - RNA, 15 nt, Chlamydophila pneumoniae J138
gcauaugcuccagaa

SEQ ID NO: 531116 - RNA, 16 nt, Chlamydophila pneumoniae J138
gcaucaagagauagag

SEQ ID NO: 531117 - RNA, 21 nt, Chlamydophila pneumoniae J138
gcauagcgagaacaccauaaa

SEQ ID NO: 531118 - RNA, 18 nt, Chlamydophila pneumoniae J138
gcauagcgagaacaccau

SEQ ID NO: 531119 - RNA, 22 nt, Chlamydophila pneumoniae J138
gcauagccuuccauaucuagaa

SEQ ID NO: 531120 - RNA, 15 nt, Chlamydophila pneumoniae J138
gcauagagcucuaaa

SEQ ID NO: 531121 - RNA, 18 nt, Chlamydophila pneumoniae J138
gcauagagcucuaaaaaa

SEQ ID NO: 531122 - RNA, 16 nt, Chlamydophila pneumoniae J138
gcauaggccaaucccu

SEQ ID NO: 531123 - RNA, 16 nt, Chlamydophila pneumoniae J138
gauuuuuagaauagaa

SEQ ID NO: 531124 - RNA, 21 nt, Chlamydophila pneumoniae J138
gauuuuugcuaagagcucuuu

SEQ ID NO: 531125 - RNA, 14 nt, Chlamydophila pneumoniae J138
gauuuuucuuuuag

SEQ ID NO: 531126 - RNA, 13 nt, Chlamydophila pneumoniae J138
gcaaaaagcuucu

SEQ ID NO: 531127 - RNA, 19 nt, Chlamydophila pneumoniae J138
gauuuuuuugguugcuucu

SEQ ID NO: 531128 - RNA, 22 nt, Chlamydophila pneumoniae J138
gcaaaaugguuguuaggacgug

SEQ ID NO: 531129 - RNA, 17 nt, Chlamydophila pneumoniae J138
gcaaacacaauuguaaa

SEQ ID NO: 531130 - RNA, 20 nt, Chlamydophila pneumoniae J138
gcaaaccgagacuauuuugg

SEQ ID NO: 531131 - RNA, 15 nt, Chlamydophila pneumoniae J138
gcaaacggaacuaaa

SEQ ID NO: 531132 - RNA, 12 nt, Chlamydophila pneumoniae J138
gcaaacgcaaug

SEQ ID NO: 531133 - RNA, 21 nt, Chlamydophila pneumoniae J138
gcaaacuccccaguuuuccau

SEQ ID NO: 531134 - RNA, 15 nt, Chlamydophila pneumoniae J138
gcaaagcccccuccc

SEQ ID NO: 531135 - RNA, 21 nt, Chlamydophila pneumoniae J138
gcaaaggaccacaauuccuaa

SEQ ID NO: 531136 - RNA, 23 nt, Chlamydophila pneumoniae J138
gcaaagcugacaacaaaugugac

SEQ ID NO: 531137 - RNA, 15 nt, Chlamydophila pneumoniae J138
gcaaagauaaagaag

SEQ ID NO: 531138 - RNA, 13 nt, Chlamydophila pneumoniae J138
gcaaagauuucca

SEQ ID NO: 531139 - RNA, 14 nt, Chlamydophila pneumoniae J138
gcaaacuccccagu

SEQ ID NO: 531140 - RNA, 18 nt, Chlamydophila pneumoniae J138
gcaaaguacuacaauaac

SEQ ID NO: 531141 - RNA, 13 nt, Chlamydophila pneumoniae J138
gcaaauaaaacaa

SEQ ID NO: 531142 - RNA, 18 nt, Chlamydophila pneumoniae J138
gcaaaucuaaaaccugac

SEQ ID NO: 531143 - RNA, 23 nt, Chlamydophila pneumoniae J138
gcaacauccauucuuaauauaaa

SEQ ID NO: 531144 - RNA, 20 nt, Chlamydophila pneumoniae J138
gcaacaaccaaaagaauucc

SEQ ID NO: 531145 - RNA, 14 nt, Chlamydophila pneumoniae J138
gauucgaaagaacu

SEQ ID NO: 531146 - RNA, 13 nt, Chlamydophila pneumoniae J138
gauuccugaggcu

SEQ ID NO: 531147 - RNA, 22 nt, Chlamydophila pneumoniae J138
gauucgaaaaacgguaaauauc

SEQ ID NO: 531148 - RNA, 16 nt, Chlamydophila pneumoniae J138
gauucccugcggacag

SEQ ID NO: 531149 - RNA, 20 nt, Chlamydophila pneumoniae J138
gauucgcuacauaaaaugag

SEQ ID NO: 531150 - RNA, 14 nt, Chlamydophila pneumoniae J138
gauucuaaaagagc

SEQ ID NO: 531151 - RNA, 14 nt, Chlamydophila pneumoniae J138
gauucguuauccuc

SEQ ID NO: 531152 - RNA, 22 nt, Chlamydophila pneumoniae J138
gauucguuauccucgucuucaa

SEQ ID NO: 531153 - RNA, 11 nt, Chlamydophila pneumoniae J138
gauucaccaag

SEQ ID NO: 531154 - RNA, 19 nt, Chlamydophila pneumoniae J138
gauucacaucuuaaaaacu

SEQ ID NO: 531155 - RNA, 19 nt, Chlamydophila pneumoniae J138
gauucagauccaaagacgu

SEQ ID NO: 531156 - RNA, 22 nt, Chlamydophila pneumoniae J138
gauucaaugcagcuaacgaagc

SEQ ID NO: 531157 - RNA, 23 nt, Chlamydophila pneumoniae J138
gauuccaaugacgggagcucuuu

SEQ ID NO: 531158 - RNA, 19 nt, Chlamydophila pneumoniae J138
gauuccaguagagccucua

SEQ ID NO: 531159 - RNA, 23 nt, Chlamydophila pneumoniae J138
gauugaaacuuuuuuucuucucu

SEQ ID NO: 531160 - RNA, 21 nt, Chlamydophila pneumoniae J138
gauucuuuaaucuaucugcaa

SEQ ID NO: 531161 - RNA, 13 nt, Chlamydophila pneumoniae J138
gauucuucagaau

SEQ ID NO: 531162 - RNA, 18 nt, Chlamydophila pneumoniae J138
gauucucguguagaauuc

SEQ ID NO: 531163 - RNA, 16 nt, Chlamydophila pneumoniae J138
gauucucguguagaau

SEQ ID NO: 531164 - RNA, 20 nt, Chlamydophila pneumoniae J138
gauucucccaauauccagaa

SEQ ID NO: 531165 - RNA, 20 nt, Chlamydophila pneumoniae J138
gauucucacucuaugagaac

SEQ ID NO: 531166 - RNA, 22 nt, Chlamydophila pneumoniae J138
gauucucauaaaggcucuuuua

SEQ ID NO: 531167 - RNA, 15 nt, Chlamydophila pneumoniae J138
gauucugaagagaga

SEQ ID NO: 531168 - RNA, 16 nt, Chlamydophila pneumoniae J138
gauucugcccaaagcu

SEQ ID NO: 531169 - RNA, 16 nt, Chlamydophila pneumoniae J138
gauucuguauaaacaa

SEQ ID NO: 531170 - RNA, 13 nt, Chlamydophila pneumoniae J138
gauugccaggaga

SEQ ID NO: 531171 - RNA, 13 nt, Chlamydophila pneumoniae J138
gauugauaacaau

SEQ ID NO: 531172 - RNA, 13 nt, Chlamydophila pneumoniae J138
gauugcuaagcau

SEQ ID NO: 531173 - RNA, 17 nt, Chlamydophila pneumoniae J138
gauuuccuagguucuuu

SEQ ID NO: 531174 - RNA, 17 nt, Chlamydophila pneumoniae J138
gauuuccccuucagagg

SEQ ID NO: 531175 - RNA, 15 nt, Chlamydophila pneumoniae J138
gauuuagauuaaaga

SEQ ID NO: 531176 - RNA, 19 nt, Chlamydophila pneumoniae J138
gauuuaaaugcaagugcuu

SEQ ID NO: 531177 - RNA, 14 nt, Chlamydophila pneumoniae J138
gauugguaaggaga

SEQ ID NO: 531178 - RNA, 19 nt, Chlamydophila pneumoniae J138
gauuguagagacauagccu

SEQ ID NO: 531179 - RNA, 17 nt, Chlamydophila pneumoniae J138
gauuguauagcuuacuu

SEQ ID NO: 531180 - RNA, 18 nt, Chlamydophila pneumoniae J138
gauuguucaaaaauagau

SEQ ID NO: 531181 - RNA, 18 nt, Chlamydophila pneumoniae J138
gauuuggaagauugaagg

SEQ ID NO: 531182 - RNA, 14 nt, Chlamydophila pneumoniae J138
gauuugcauuaccu

SEQ ID NO: 531183 - RNA, 16 nt, Chlamydophila pneumoniae J138
gauuucuccagcagcu

SEQ ID NO: 531184 - RNA, 19 nt, Chlamydophila pneumoniae J138
gauuucuucuucagagcuc

SEQ ID NO: 531185 - RNA, 13 nt, Chlamydophila pneumoniae J138
gauuucuucuucu

SEQ ID NO: 531186 - RNA, 16 nt, Chlamydophila pneumoniae J138
gauuucuucuucuaaa

SEQ ID NO: 531187 - RNA, 14 nt, Chlamydophila pneumoniae J138
gauuucuucuucag

SEQ ID NO: 531188 - RNA, 15 nt, Chlamydophila pneumoniae J138
gauuuccuuuuggga

SEQ ID NO: 531189 - RNA, 19 nt, Chlamydophila pneumoniae J138
gauuuucgguuacuuuaau

SEQ ID NO: 531190 - RNA, 17 nt, Chlamydophila pneumoniae J138
gauuuucuagaaacaac

SEQ ID NO: 531191 - RNA, 21 nt, Chlamydophila pneumoniae J138
gauuuucuagaaacaacugaa

SEQ ID NO: 531192 - RNA, 13 nt, Chlamydophila pneumoniae J138
gauuuuaaaauga

SEQ ID NO: 531193 - RNA, 18 nt, Chlamydophila pneumoniae J138
gauggcauagcgaaaguc

SEQ ID NO: 531194 - RNA, 17 nt, Chlamydophila pneumoniae J138
gaugcuugugagaugaa

SEQ ID NO: 531195 - RNA, 14 nt, Chlamydophila pneumoniae J138
gaugcuucuuucaa

SEQ ID NO: 531196 - RNA, 22 nt, Chlamydophila pneumoniae J138
gaugucaccacgaacuucagca

SEQ ID NO: 531197 - RNA, 19 nt, Chlamydophila pneumoniae J138
gaugggaucggucuuuucu

SEQ ID NO: 531198 - RNA, 18 nt, Chlamydophila pneumoniae J138
gauuagaaaagauaaaac

SEQ ID NO: 531199 - RNA, 19 nt, Chlamydophila pneumoniae J138
gauuauuuguuucuuccau

SEQ ID NO: 531200 - RNA, 22 nt, Chlamydophila pneumoniae J138
gauuauuuguuucuuccauaca

SEQ ID NO: 531201 - RNA, 20 nt, Chlamydophila pneumoniae J138
gauuaguucucuaagacugu

SEQ ID NO: 531202 - RNA, 15 nt, Chlamydophila pneumoniae J138
gauuaguucucuaag

SEQ ID NO: 531203 - RNA, 14 nt, Chlamydophila pneumoniae J138
gauuaguaacuaaa

SEQ ID NO: 531204 - RNA, 16 nt, Chlamydophila pneumoniae J138
gauuaucccaaacuuc

SEQ ID NO: 531205 - RNA, 15 nt, Chlamydophila pneumoniae J138
gauguuaaggcuucc

SEQ ID NO: 531206 - RNA, 20 nt, Chlamydophila pneumoniae J138
gaugugauguucugcugcuu

SEQ ID NO: 531207 - RNA, 15 nt, Chlamydophila pneumoniae J138
gaugucgcuuuugcu

SEQ ID NO: 531208 - RNA, 20 nt, Chlamydophila pneumoniae J138
gauguuuaauacaaaaaaua

SEQ ID NO: 531209 - RNA, 21 nt, Chlamydophila pneumoniae J138
gauguucucgcaaugcuucuu

SEQ ID NO: 531210 - RNA, 17 nt, Chlamydophila pneumoniae J138
gauguuguggaucagaa

SEQ ID NO: 531211 - RNA, 20 nt, Chlamydophila pneumoniae J138
gauuaaguucgucuaccauu

SEQ ID NO: 531212 - RNA, 18 nt, Chlamydophila pneumoniae J138
gaucuucuauuuuuuugg

SEQ ID NO: 531213 - RNA, 17 nt, Chlamydophila pneumoniae J138
gaucuucugaaaucaaa

SEQ ID NO: 531214 - RNA, 17 nt, Chlamydophila pneumoniae J138
gaucuucagagagaaca

SEQ ID NO: 531215 - RNA, 14 nt, Chlamydophila pneumoniae J138
gaucuucauaacca

SEQ ID NO: 531216 - RNA, 22 nt, Chlamydophila pneumoniae J138
gaucuucaauuggaggauaaau

SEQ ID NO: 531217 - RNA, 16 nt, Chlamydophila pneumoniae J138
gaucuuuguugagaag

SEQ ID NO: 531218 - RNA, 15 nt, Chlamydophila pneumoniae J138
gaucuuuagaauaag

SEQ ID NO: 531219 - RNA, 15 nt, Chlamydophila pneumoniae J138
gaugaacauaauucg

SEQ ID NO: 531220 - RNA, 17 nt, Chlamydophila pneumoniae J138
gaugaacagccucugug

SEQ ID NO: 531221 - RNA, 23 nt, Chlamydophila pneumoniae J138
gaugaauccaaaauaaauagaag

SEQ ID NO: 531222 - RNA, 14 nt, Chlamydophila pneumoniae J138
gaugaauaccagaa

SEQ ID NO: 531223 - RNA, 15 nt, Chlamydophila pneumoniae J138
gaugaccucaucucg

SEQ ID NO: 531224 - RNA, 16 nt, Chlamydophila pneumoniae J138
gaugacuuucagagca

SEQ ID NO: 531225 - RNA, 16 nt, Chlamydophila pneumoniae J138
gaugagguaucccacg

SEQ ID NO: 531226 - RNA, 18 nt, Chlamydophila pneumoniae J138
gaugagguugagcaagaa

SEQ ID NO: 531227 - RNA, 21 nt, Chlamydophila pneumoniae J138
gaugauccacugcuuuaggcc

SEQ ID NO: 531228 - RNA, 15 nt, Chlamydophila pneumoniae J138
aaagccuaugggagg

SEQ ID NO: 531229 - RNA, 22 nt, Chlamydophila pneumoniae J138
gaugaugcccugacguuuugau

SEQ ID NO: 531230 - RNA, 18 nt, Chlamydophila pneumoniae J138
aaagcgaccugcaaauga

SEQ ID NO: 531231 - RNA, 12 nt, Chlamydophila pneumoniae J138
aaagccugucuu

SEQ ID NO: 531232 - RNA, 16 nt, Chlamydophila pneumoniae J138
aaagccuuugcucacu

SEQ ID NO: 531233 - RNA, 23 nt, Chlamydophila pneumoniae J138
gaugcagcauuuguaagaaucau

SEQ ID NO: 531234 - RNA, 17 nt, Chlamydophila pneumoniae J138
gaugcaccauaauauaa

SEQ ID NO: 531235 - RNA, 14 nt, Chlamydophila pneumoniae J138
gaugcaccauaaua

SEQ ID NO: 531236 - RNA, 12 nt, Chlamydophila pneumoniae J138
gaugcagaucau

SEQ ID NO: 531237 - RNA, 20 nt, Chlamydophila pneumoniae J138
gaugcaaauuccagaaaaag

SEQ ID NO: 531238 - RNA, 18 nt, Chlamydophila pneumoniae J138
gaugcaaauccuguagaa

SEQ ID NO: 531239 - RNA, 19 nt, Chlamydophila pneumoniae J138
gaugcaaauuccagaaaaa

SEQ ID NO: 531240 - RNA, 16 nt, Chlamydophila pneumoniae J138
gaugcaaugguugucu

SEQ ID NO: 531241 - RNA, 13 nt, Chlamydophila pneumoniae J138
gaugccaagaaau

SEQ ID NO: 531242 - RNA, 18 nt, Chlamydophila pneumoniae J138
gaugccauuguagagauu

SEQ ID NO: 531243 - RNA, 20 nt, Chlamydophila pneumoniae J138
gaugccauugaucagaaucu

SEQ ID NO: 531244 - RNA, 15 nt, Chlamydophila pneumoniae J138
gaugcuacuuuccac

SEQ ID NO: 531245 - RNA, 19 nt, Chlamydophila pneumoniae J138
gaugcuaaagagucuuccu

SEQ ID NO: 531246 - RNA, 20 nt, Chlamydophila pneumoniae J138
gaugcuccgggaaacaucag

SEQ ID NO: 531247 - RNA, 13 nt, Chlamydophila pneumoniae J138
gauaagauaaaga

SEQ ID NO: 531248 - RNA, 16 nt, Chlamydophila pneumoniae J138
gauaagaccagaaagg

SEQ ID NO: 531249 - RNA, 18 nt, Chlamydophila pneumoniae J138
gauagagcuucuuuaucu

SEQ ID NO: 531250 - RNA, 22 nt, Chlamydophila pneumoniae J138
gauacuucuuccacgagauucu

SEQ ID NO: 531251 - RNA, 19 nt, Chlamydophila pneumoniae J138
gauacuuguaccguaaaga

SEQ ID NO: 531252 - RNA, 20 nt, Chlamydophila pneumoniae J138
gauacuuagcaaucaguaaa

SEQ ID NO: 531253 - RNA, 17 nt, Chlamydophila pneumoniae J138
gauacuguuuuuuaucu

SEQ ID NO: 531254 - RNA, 17 nt, Chlamydophila pneumoniae J138
gauacucucagcaaaga

SEQ ID NO: 531255 - RNA, 15 nt, Chlamydophila pneumoniae J138
gauagcugaugcuga

SEQ ID NO: 531256 - RNA, 21 nt, Chlamydophila pneumoniae J138
gauaggaaccacuuuagaauu

SEQ ID NO: 531257 - RNA, 13 nt, Chlamydophila pneumoniae J138
gauaggaaccacu

SEQ ID NO: 531258 - RNA, 20 nt, Chlamydophila pneumoniae J138
gauaggaucuucuauuuuuu

SEQ ID NO: 531259 - RNA, 22 nt, Chlamydophila pneumoniae J138
gauagaucacaucaagauagag

SEQ ID NO: 531260 - RNA, 23 nt, Chlamydophila pneumoniae J138
gauaggugagguuugugcugcuu

SEQ ID NO: 531261 - RNA, 22 nt, Chlamydophila pneumoniae J138
gauaguauuuuugaaaccaagg

SEQ ID NO: 531262 - RNA, 18 nt, Chlamydophila pneumoniae J138
gauauagauucaugaaau

SEQ ID NO: 531263 - RNA, 20 nt, Chlamydophila pneumoniae J138
gauauagcguacaggaaguc

SEQ ID NO: 531264 - RNA, 21 nt, Chlamydophila pneumoniae J138
gauaucugcucccuccuccuc

SEQ ID NO: 531265 - RNA, 13 nt, Chlamydophila pneumoniae J138
gauaucuuguaca

SEQ ID NO: 531266 - RNA, 13 nt, Chlamydophila pneumoniae J138
gauauuacagauu

SEQ ID NO: 531267 - RNA, 15 nt, Chlamydophila pneumoniae J138
gaucauaaacagcag

SEQ ID NO: 531268 - RNA, 23 nt, Chlamydophila pneumoniae J138
gaucaggauucuaaaaagaaaag

SEQ ID NO: 531269 - RNA, 21 nt, Chlamydophila pneumoniae J138
gaucaucuacgauguuuucuu

SEQ ID NO: 531270 - RNA, 16 nt, Chlamydophila pneumoniae J138
gaucauaccgacaagc

SEQ ID NO: 531271 - RNA, 23 nt, Chlamydophila pneumoniae J138
gaucauuagcaucaucuccugaa

SEQ ID NO: 531272 - RNA, 16 nt, Chlamydophila pneumoniae J138
gaucauucuuuauaaa

SEQ ID NO: 531273 - RNA, 16 nt, Chlamydophila pneumoniae J138
gaucauuuuugcuaga

SEQ ID NO: 531274 - RNA, 18 nt, Chlamydophila pneumoniae J138
gauccagcccccaggcug

SEQ ID NO: 531275 - RNA, 13 nt, Chlamydophila pneumoniae J138
gauccaucugcuc

SEQ ID NO: 531276 - RNA, 20 nt, Chlamydophila pneumoniae J138
gaucccaucaucgagcugau

SEQ ID NO: 531277 - RNA, 17 nt, Chlamydophila pneumoniae J138
gaucccgaagcaaucca

SEQ ID NO: 531278 - RNA, 23 nt, Chlamydophila pneumoniae J138
gaucccuguaguuucuaaaacag

SEQ ID NO: 531279 - RNA, 14 nt, Chlamydophila pneumoniae J138
aaagcccauuccug

SEQ ID NO: 531280 - RNA, 20 nt, Chlamydophila pneumoniae J138
aaagccauuccauauccaug

SEQ ID NO: 531281 - RNA, 22 nt, Chlamydophila pneumoniae J138
aaagcccccucccccaccaaag

SEQ ID NO: 531282 - RNA, 19 nt, Chlamydophila pneumoniae J138
gaucgaaucuuuauuucug

SEQ ID NO: 531283 - RNA, 12 nt, Chlamydophila pneumoniae J138
gaucgaaaaaua

SEQ ID NO: 531284 - RNA, 16 nt, Chlamydophila pneumoniae J138
gauccuuuccaagaag

SEQ ID NO: 531285 - RNA, 18 nt, Chlamydophila pneumoniae J138
gaucgggucuacaacagu

SEQ ID NO: 531286 - RNA, 18 nt, Chlamydophila pneumoniae J138
gaucucaguaggagcagc

SEQ ID NO: 531287 - RNA, 22 nt, Chlamydophila pneumoniae J138
gaucuagaaaaugaagagcuuc

SEQ ID NO: 531288 - RNA, 17 nt, Chlamydophila pneumoniae J138
gaucuagaaaaugaaga

SEQ ID NO: 531289 - RNA, 23 nt, Chlamydophila pneumoniae J138
gaucuacagauaggguaagauug

SEQ ID NO: 531290 - RNA, 14 nt, Chlamydophila pneumoniae J138
gaucuacaaaaacu

SEQ ID NO: 531291 - RNA, 17 nt, Chlamydophila pneumoniae J138
gaucuacaaaaacuaga

SEQ ID NO: 531292 - RNA, 21 nt, Chlamydophila pneumoniae J138
gaucuacagauaggguaagau

SEQ ID NO: 531293 - RNA, 23 nt, Chlamydophila pneumoniae J138
gaucuaaaagcacuuaaaaaacu

SEQ ID NO: 531294 - RNA, 15 nt, Chlamydophila pneumoniae J138
gaucuaaagcaucac

SEQ ID NO: 531295 - RNA, 18 nt, Chlamydophila pneumoniae J138
gaucucucuuccugcugc

SEQ ID NO: 531296 - RNA, 19 nt, Chlamydophila pneumoniae J138
gaucucgucuuggaaugcu

SEQ ID NO: 531297 - RNA, 19 nt, Chlamydophila pneumoniae J138
gaucucuuuuggaagaccu

SEQ ID NO: 531298 - RNA, 19 nt, Chlamydophila pneumoniae J138
gaucugaaguugaaaugag

SEQ ID NO: 531299 - RNA, 14 nt, Chlamydophila pneumoniae J138
gaucugauagaaca

SEQ ID NO: 531300 - RNA, 22 nt, Chlamydophila pneumoniae J138
gaggaagcacaccaaguacagu

SEQ ID NO: 531301 - RNA, 21 nt, Chlamydophila pneumoniae J138
gaggaacuucagcuuugcuua

SEQ ID NO: 531302 - RNA, 15 nt, Chlamydophila pneumoniae J138
gaggaacgcacgcca

SEQ ID NO: 531303 - RNA, 20 nt, Chlamydophila pneumoniae J138
gaggaacguuacgucuuagg

SEQ ID NO: 531304 - RNA, 19 nt, Chlamydophila pneumoniae J138
gagcuccgcuagaggaucu

SEQ ID NO: 531305 - RNA, 23 nt, Chlamydophila pneumoniae J138
gagcuccgcuagaggaucuucaa

SEQ ID NO: 531306 - RNA, 17 nt, Chlamydophila pneumoniae J138
gagcucgcaaaagcugu

SEQ ID NO: 531307 - RNA, 17 nt, Chlamydophila pneumoniae J138
gagcucuacucuacagu

SEQ ID NO: 531308 - RNA, 13 nt, Chlamydophila pneumoniae J138
gaggcccgaagca

SEQ ID NO: 531309 - RNA, 20 nt, Chlamydophila pneumoniae J138
gaggagaauagcaagcacuu

SEQ ID NO: 531310 - RNA, 13 nt, Chlamydophila pneumoniae J138
gaggagauaaaga

SEQ ID NO: 531311 - RNA, 18 nt, Chlamydophila pneumoniae J138
gaggagcgauagcucagc

SEQ ID NO: 531312 - RNA, 21 nt, Chlamydophila pneumoniae J138
gaggcggagguacguaucuuc

SEQ ID NO: 531313 - RNA, 22 nt, Chlamydophila pneumoniae J138
gaggggccuaaagcuccgagaa

SEQ ID NO: 531314 - RNA, 17 nt, Chlamydophila pneumoniae J138
gagguaaccagagagcu

SEQ ID NO: 531315 - RNA, 15 nt, Chlamydophila pneumoniae J138
gaguaaaaucauagg

SEQ ID NO: 531316 - RNA, 16 nt, Chlamydophila pneumoniae J138
gagguaugaauaggaa

SEQ ID NO: 531317 - RNA, 14 nt, Chlamydophila pneumoniae J138
gagguaaccagaga

SEQ ID NO: 531318 - RNA, 16 nt, Chlamydophila pneumoniae J138
gaggguuccaagagcu

SEQ ID NO: 531319 - RNA, 17 nt, Chlamydophila pneumoniae J138
gaguaaggaacaaugua

SEQ ID NO: 531320 - RNA, 19 nt, Chlamydophila pneumoniae J138
gaguaaggaacaauguaaa

SEQ ID NO: 531321 - RNA, 19 nt, Chlamydophila pneumoniae J138
gagucacggcaaugauagg

SEQ ID NO: 531322 - RNA, 23 nt, Chlamydophila pneumoniae J138
gaguccuuuuuguucaaagauug

SEQ ID NO: 531323 - RNA, 13 nt, Chlamydophila pneumoniae J138
gagucgauuuccc

SEQ ID NO: 531324 - RNA, 19 nt, Chlamydophila pneumoniae J138
gaguauuuugcaaaugaaa

SEQ ID NO: 531325 - RNA, 20 nt, Chlamydophila pneumoniae J138
gaguuccgcaaauacagaca

SEQ ID NO: 531326 - RNA, 21 nt, Chlamydophila pneumoniae J138
gagugacaccaacaacaauaa

SEQ ID NO: 531327 - RNA, 15 nt, Chlamydophila pneumoniae J138
gagugaccauagcau

SEQ ID NO: 531328 - RNA, 14 nt, Chlamydophila pneumoniae J138
gauaaacagcacag

SEQ ID NO: 531329 - RNA, 19 nt, Chlamydophila pneumoniae J138
gauaaagacaucucuuuaa

SEQ ID NO: 531330 - RNA, 21 nt, Chlamydophila pneumoniae J138
gauaaagaaguuuacaaauaa

SEQ ID NO: 531331 - RNA, 16 nt, Chlamydophila pneumoniae J138
gauaacguugccuguu

SEQ ID NO: 531332 - RNA, 17 nt, Chlamydophila pneumoniae J138
gauaaaacuauaaaagc

SEQ ID NO: 531333 - RNA, 19 nt, Chlamydophila pneumoniae J138
gaguuucuuauucacugga

SEQ ID NO: 531334 - RNA, 18 nt, Chlamydophila pneumoniae J138
gaguuucgaauucaauga

SEQ ID NO: 531335 - RNA, 17 nt, Chlamydophila pneumoniae J138
gaguucucucuucacuc

SEQ ID NO: 531336 - RNA, 13 nt, Chlamydophila pneumoniae J138
gaguuucuaaugu

SEQ ID NO: 531337 - RNA, 21 nt, Chlamydophila pneumoniae J138
gagccaacagguucacuucau

SEQ ID NO: 531338 - RNA, 18 nt, Chlamydophila pneumoniae J138
gagccuagagaguucuug

SEQ ID NO: 531339 - RNA, 13 nt, Chlamydophila pneumoniae J138
gagcgccuccacc

SEQ ID NO: 531340 - RNA, 21 nt, Chlamydophila pneumoniae J138
gagcgaucgcaaucagcaaca

SEQ ID NO: 531341 - RNA, 12 nt, Chlamydophila pneumoniae J138
gagcuaccagaa

SEQ ID NO: 531342 - RNA, 18 nt, Chlamydophila pneumoniae J138
gagcuacaagaacugaag

SEQ ID NO: 531343 - RNA, 18 nt, Chlamydophila pneumoniae J138
gagcuauuuuacuuacua

SEQ ID NO: 531344 - RNA, 16 nt, Chlamydophila pneumoniae J138
gagcuauuuaggcaug

SEQ ID NO: 531345 - RNA, 12 nt, Chlamydophila pneumoniae J138
gagcuaucuuca

SEQ ID NO: 531346 - RNA, 16 nt, Chlamydophila pneumoniae J138
gagcgcuuucuuuuau

SEQ ID NO: 531347 - RNA, 17 nt, Chlamydophila pneumoniae J138
gagauuuuuucauacuu

SEQ ID NO: 531348 - RNA, 21 nt, Chlamydophila pneumoniae J138
gagauuuuccauaggaacaaa

SEQ ID NO: 531349 - RNA, 15 nt, Chlamydophila pneumoniae J138
gagauugccaggaga

SEQ ID NO: 531350 - RNA, 15 nt, Chlamydophila pneumoniae J138
gagauucauaaaacu

SEQ ID NO: 531351 - RNA, 14 nt, Chlamydophila pneumoniae J138
gagauccuaagaga

SEQ ID NO: 531352 - RNA, 19 nt, Chlamydophila pneumoniae J138
gagaucuuauagacaggua

SEQ ID NO: 531353 - RNA, 22 nt, Chlamydophila pneumoniae J138
gagaucuuauagacagguacau

SEQ ID NO: 531354 - RNA, 21 nt, Chlamydophila pneumoniae J138
gagaucuuugagaucuugaau

SEQ ID NO: 531355 - RNA, 22 nt, Chlamydophila pneumoniae J138
gagagcuugguuuucuccuucu

SEQ ID NO: 531356 - RNA, 19 nt, Chlamydophila pneumoniae J138
gacuccaagaauagcagga

SEQ ID NO: 531357 - RNA, 22 nt, Chlamydophila pneumoniae J138
gagaggaaaucccgagauauga

SEQ ID NO: 531358 - RNA, 20 nt, Chlamydophila pneumoniae J138
gagagcuuuuagguagagaa

SEQ ID NO: 531359 - RNA, 21 nt, Chlamydophila pneumoniae J138
gagagcuuucgcuccuaagcu

SEQ ID NO: 531360 - RNA, 22 nt, Chlamydophila pneumoniae J138
gagagguaaccagagagcuuuu

SEQ ID NO: 531361 - RNA, 15 nt, Chlamydophila pneumoniae J138
gagagguaggcagug

SEQ ID NO: 531362 - RNA, 21 nt, Chlamydophila pneumoniae J138
gacucaugaaauaguguuucu

SEQ ID NO: 531363 - RNA, 18 nt, Chlamydophila pneumoniae J138
gacucagagaaaaucaac

SEQ ID NO: 531364 - RNA, 21 nt, Chlamydophila pneumoniae J138
gagcauuuaaccccacaauca

SEQ ID NO: 531365 - RNA, 11 nt, Chlamydophila pneumoniae J138
aaagcacauac

SEQ ID NO: 531366 - RNA, 17 nt, Chlamydophila pneumoniae J138
gagcagcuguagugaua

SEQ ID NO: 531367 - RNA, 23 nt, Chlamydophila pneumoniae J138
gagcaacuucuucguuagagaag

SEQ ID NO: 531368 - RNA, 14 nt, Chlamydophila pneumoniae J138
gagcaacaguaauu

SEQ ID NO: 531369 - RNA, 23 nt, Chlamydophila pneumoniae J138
cuuuacgaugagguugagcaaga

SEQ ID NO: 531370 - RNA, 21 nt, Chlamydophila pneumoniae J138
cuuuaaucaagccuaaaucua

SEQ ID NO: 531371 - RNA, 16 nt, Chlamydophila pneumoniae J138
aaagacauccuucuuu

SEQ ID NO: 531372 - RNA, 18 nt, Chlamydophila pneumoniae J138
aaagacauccuucuuuac

SEQ ID NO: 531373 - RNA, 16 nt, Chlamydophila pneumoniae J138
aaagaccaaaaauaaa

SEQ ID NO: 531374 - RNA, 16 nt, Chlamydophila pneumoniae J138
cuuuauugauagcuga

SEQ ID NO: 531375 - RNA, 15 nt, Chlamydophila pneumoniae J138
cuuuauuuaaauaaa

SEQ ID NO: 531376 - RNA, 15 nt, Chlamydophila pneumoniae J138
cuuucaauagcuucc

SEQ ID NO: 531377 - RNA, 23 nt, Chlamydophila pneumoniae J138
cuuucacaaaggcgaucuucuuc

SEQ ID NO: 531378 - RNA, 14 nt, Chlamydophila pneumoniae J138
cuuucacaaagaau

SEQ ID NO: 531379 - RNA, 22 nt, Chlamydophila pneumoniae J138
cuuucaagagcagugaaauuuu

SEQ ID NO: 531380 - RNA, 18 nt, Chlamydophila pneumoniae J138
cuuucaauguaauugcgc

SEQ ID NO: 531381 - RNA, 22 nt, Chlamydophila pneumoniae J138
cuuuagcaaucucuuucacaaa

SEQ ID NO: 531382 - RNA, 15 nt, Chlamydophila pneumoniae J138
cuuuaggaacuugaa

SEQ ID NO: 531383 - RNA, 19 nt, Chlamydophila pneumoniae J138
cuuucauucccuuuuucca

SEQ ID NO: 531384 - RNA, 22 nt, Chlamydophila pneumoniae J138
cuuuccauaaagccccacccac

SEQ ID NO: 531385 - RNA, 14 nt, Chlamydophila pneumoniae J138
cuuucuagcugcuc

SEQ ID NO: 531386 - RNA, 13 nt, Chlamydophila pneumoniae J138
cuuucuaggaucu

SEQ ID NO: 531387 - RNA, 22 nt, Chlamydophila pneumoniae J138
cuuucuaggccgggauuuuaau

SEQ ID NO: 531388 - RNA, 23 nt, Chlamydophila pneumoniae J138
cuuucuagaaugaugcaagcaga

SEQ ID NO: 531389 - RNA, 23 nt, Chlamydophila pneumoniae J138
cuuucuaagaauucuuugccaag

SEQ ID NO: 531390 - RNA, 20 nt, Chlamydophila pneumoniae J138
cuuucccuaagcaaaaacuu

SEQ ID NO: 531391 - RNA, 22 nt, Chlamydophila pneumoniae J138
cuuucuauuucgucgucauccc

SEQ ID NO: 531392 - RNA, 20 nt, Chlamydophila pneumoniae J138
cuuucuauuucgucgucauc

SEQ ID NO: 531393 - RNA, 21 nt, Chlamydophila pneumoniae J138
cuuucucggucuuucuuuuuu

SEQ ID NO: 531394 - RNA, 14 nt, Chlamydophila pneumoniae J138
cuuugaauuuccaa

SEQ ID NO: 531395 - RNA, 16 nt, Chlamydophila pneumoniae J138
cuuugaauuuccaaag

SEQ ID NO: 531396 - RNA, 12 nt, Chlamydophila pneumoniae J138
cuuucuuuuagc

SEQ ID NO: 531397 - RNA, 21 nt, Chlamydophila pneumoniae J138
cuuucuucuagagcuucaagu

SEQ ID NO: 531398 - RNA, 18 nt, Chlamydophila pneumoniae J138
cuuuguuaauagaagauc

SEQ ID NO: 531399 - RNA, 19 nt, Chlamydophila pneumoniae J138
cuuugugaguucuuccuuc

SEQ ID NO: 531400 - RNA, 22 nt, Chlamydophila pneumoniae J138
cuuugugaguucuuccuucuuc

SEQ ID NO: 531401 - RNA, 18 nt, Chlamydophila pneumoniae J138
cuuuguugggauuuucag

SEQ ID NO: 531402 - RNA, 22 nt, Chlamydophila pneumoniae J138
cuuugcuuaaaaagucugaauc

SEQ ID NO: 531403 - RNA, 13 nt, Chlamydophila pneumoniae J138
cuuugcuuaaaaa

SEQ ID NO: 531404 - RNA, 13 nt, Chlamydophila pneumoniae J138
cuuugcaugagga

SEQ ID NO: 531405 - RNA, 16 nt, Chlamydophila pneumoniae J138
cuuugcaucccuaggg

SEQ ID NO: 531406 - RNA, 17 nt, Chlamydophila pneumoniae J138
cuuugauuuucaggaga

SEQ ID NO: 531407 - RNA, 15 nt, Chlamydophila pneumoniae J138
cuuugacauugaauc

SEQ ID NO: 531408 - RNA, 15 nt, Chlamydophila pneumoniae J138
cuuuugugauaccuc

SEQ ID NO: 531409 - RNA, 13 nt, Chlamydophila pneumoniae J138
cuuuucuuuuucu

SEQ ID NO: 531410 - RNA, 17 nt, Chlamydophila pneumoniae J138
cuuuucuuuuucuaggg

SEQ ID NO: 531411 - RNA, 21 nt, Chlamydophila pneumoniae J138
cuuuucuuuuuagaauccuga

SEQ ID NO: 531412 - RNA, 14 nt, Chlamydophila pneumoniae J138
cuuuucuucuucgg

SEQ ID NO: 531413 - RNA, 18 nt, Chlamydophila pneumoniae J138
cuuuucuuccaaagacug

SEQ ID NO: 531414 - RNA, 18 nt, Chlamydophila pneumoniae J138
aaagacuucgaugucuuu

SEQ ID NO: 531415 - RNA, 23 nt, Chlamydophila pneumoniae J138
aaagacuagcuuuuuuuaugauu

SEQ ID NO: 531416 - RNA, 13 nt, Chlamydophila pneumoniae J138
aaagacucuugaa

SEQ ID NO: 531417 - RNA, 14 nt, Chlamydophila pneumoniae J138
aaagacugaaaaga

SEQ ID NO: 531418 - RNA, 14 nt, Chlamydophila pneumoniae J138
aaagacucucuucc

SEQ ID NO: 531419 - RNA, 12 nt, Chlamydophila pneumoniae J138
cuuuucuuauca

SEQ ID NO: 531420 - RNA, 19 nt, Chlamydophila pneumoniae J138
cuuuucugaagauuuuuua

SEQ ID NO: 531421 - RNA, 14 nt, Chlamydophila pneumoniae J138
cuuuucugaagauu

SEQ ID NO: 531422 - RNA, 17 nt, Chlamydophila pneumoniae J138
cuuuucugaagauuuuu

SEQ ID NO: 531423 - RNA, 19 nt, Chlamydophila pneumoniae J138
cuuuucggaucagaaugca

SEQ ID NO: 531424 - RNA, 13 nt, Chlamydophila pneumoniae J138
cuuuucuagaaaa

SEQ ID NO: 531425 - RNA, 10 nt, Chlamydophila pneumoniae J138
cuuuucuaga

SEQ ID NO: 531426 - RNA, 22 nt, Chlamydophila pneumoniae J138
cuuuucuaagcaauauuucugu

SEQ ID NO: 531427 - RNA, 19 nt, Chlamydophila pneumoniae J138
cuuuucuccuucuggaugc

SEQ ID NO: 531428 - RNA, 13 nt, Chlamydophila pneumoniae J138
cuuuucuccuucu

SEQ ID NO: 531429 - RNA, 15 nt, Chlamydophila pneumoniae J138
cuuuuccugcagcag

SEQ ID NO: 531430 - RNA, 20 nt, Chlamydophila pneumoniae J138
cuuuuccaaauuccuucaua

SEQ ID NO: 531431 - RNA, 23 nt, Chlamydophila pneumoniae J138
cuuuucagcaaacggagagcauu

SEQ ID NO: 531432 - RNA, 23 nt, Chlamydophila pneumoniae J138
cuuuuacgaaugagaucagcucc

SEQ ID NO: 531433 - RNA, 14 nt, Chlamydophila pneumoniae J138
cuuuuacugaaauu

SEQ ID NO: 531434 - RNA, 20 nt, Chlamydophila pneumoniae J138
cuuuuacuguacuugcuaug

SEQ ID NO: 531435 - RNA, 20 nt, Chlamydophila pneumoniae J138
cuuuuucuugaaaaauccug

SEQ ID NO: 531436 - RNA, 15 nt, Chlamydophila pneumoniae J138
cuuuuguuugucuuc

SEQ ID NO: 531437 - RNA, 18 nt, Chlamydophila pneumoniae J138
gaaaaagccuuucuuauu

SEQ ID NO: 531438 - RNA, 13 nt, Chlamydophila pneumoniae J138
gaaaaaggaggau

SEQ ID NO: 531439 - RNA, 19 nt, Chlamydophila pneumoniae J138
gaaaaaguaguuuuaagaa

SEQ ID NO: 531440 - RNA, 15 nt, Chlamydophila pneumoniae J138
gaaaagaacagggga

SEQ ID NO: 531441 - RNA, 12 nt, Chlamydophila pneumoniae J138
gaaaagaaaaga

SEQ ID NO: 531442 - RNA, 22 nt, Chlamydophila pneumoniae J138
gaaaagauucuaaaucaacuac

SEQ ID NO: 531443 - RNA, 19 nt, Chlamydophila pneumoniae J138
gaaaauacagccagcagaa

SEQ ID NO: 531444 - RNA, 18 nt, Chlamydophila pneumoniae J138
gaaaauacagccagcaga

SEQ ID NO: 531445 - RNA, 16 nt, Chlamydophila pneumoniae J138
gaaaauacagccagca

SEQ ID NO: 531446 - RNA, 19 nt, Chlamydophila pneumoniae J138
gaaaacaaggcaaaaaguu

SEQ ID NO: 531447 - RNA, 13 nt, Chlamydophila pneumoniae J138
gaaaacauagaga

SEQ ID NO: 531448 - RNA, 16 nt, Chlamydophila pneumoniae J138
gaaaacgccaacugua

SEQ ID NO: 531449 - RNA, 20 nt, Chlamydophila pneumoniae J138
gaaaaucucuaagaaucuau

SEQ ID NO: 531450 - RNA, 21 nt, Chlamydophila pneumoniae J138
gaaaaucucuaagaaucuaua

SEQ ID NO: 531451 - RNA, 14 nt, Chlamydophila pneumoniae J138
gaaaaucugcagca

SEQ ID NO: 531452 - RNA, 16 nt, Chlamydophila pneumoniae J138
gaaaaucugcagcaga

SEQ ID NO: 531453 - RNA, 15 nt, Chlamydophila pneumoniae J138
gaaagcaucuuucau

SEQ ID NO: 531454 - RNA, 13 nt, Chlamydophila pneumoniae J138
gaaagcacauaag

SEQ ID NO: 531455 - RNA, 19 nt, Chlamydophila pneumoniae J138
gaaagauucugcccaaagc

SEQ ID NO: 531456 - RNA, 12 nt, Chlamydophila pneumoniae J138
gaaacuucugac

SEQ ID NO: 531457 - RNA, 12 nt, Chlamydophila pneumoniae J138
gaaauccuccua

SEQ ID NO: 531458 - RNA, 15 nt, Chlamydophila pneumoniae J138
gaaaucacacuuaaa

SEQ ID NO: 531459 - RNA, 22 nt, Chlamydophila pneumoniae J138
gaaauacguccagccugcacca

SEQ ID NO: 531460 - RNA, 15 nt, Chlamydophila pneumoniae J138
gaaauacgcuuuucu

SEQ ID NO: 531461 - RNA, 21 nt, Chlamydophila pneumoniae J138
gaaauacgcuuuucuucuuua

SEQ ID NO: 531462 - RNA, 22 nt, Chlamydophila pneumoniae J138
gaaauaauuuguuuagaaaaag

SEQ ID NO: 531463 - RNA, 18 nt, Chlamydophila pneumoniae J138
gaaagcgcgaugaacagc

SEQ ID NO: 531464 - RNA, 18 nt, Chlamydophila pneumoniae J138
gaaaguaaaauuucugua

SEQ ID NO: 531465 - RNA, 14 nt, Chlamydophila pneumoniae J138
gaaagcuguauugg

SEQ ID NO: 531466 - RNA, 23 nt, Chlamydophila pneumoniae J138
gaaaguauagacgggcuuauaaa

SEQ ID NO: 531467 - RNA, 19 nt, Chlamydophila pneumoniae J138
gaaaguagcaucccaaguu

SEQ ID NO: 531468 - RNA, 14 nt, Chlamydophila pneumoniae J138
gaaaguaucuucag

SEQ ID NO: 531469 - RNA, 22 nt, Chlamydophila pneumoniae J138
gaaauccugggcaaugaucaaa

SEQ ID NO: 531470 - RNA, 13 nt, Chlamydophila pneumoniae J138
gaaaugagugaga

SEQ ID NO: 531471 - RNA, 18 nt, Chlamydophila pneumoniae J138
aaagagacuguagccuuu

SEQ ID NO: 531472 - RNA, 22 nt, Chlamydophila pneumoniae J138
aaagagaaucuccucaucagaa

SEQ ID NO: 531473 - RNA, 11 nt, Chlamydophila pneumoniae J138
gaaauucuucc

SEQ ID NO: 531474 - RNA, 22 nt, Chlamydophila pneumoniae J138
gaaauugaauaucgaguucuuu

SEQ ID NO: 531475 - RNA, 12 nt, Chlamydophila pneumoniae J138
gaaauuuucuaa

SEQ ID NO: 531476 - RNA, 19 nt, Chlamydophila pneumoniae J138
gaaauuccgacccagucaa

SEQ ID NO: 531477 - RNA, 23 nt, Chlamydophila pneumoniae J138
aaagagauuucuuguuguaggua

SEQ ID NO: 531478 - RNA, 19 nt, Chlamydophila pneumoniae J138
gaacaauacucucugcuuc

SEQ ID NO: 531479 - RNA, 21 nt, Chlamydophila pneumoniae J138
gaacaaguugacgcacuucuu

SEQ ID NO: 531480 - RNA, 13 nt, Chlamydophila pneumoniae J138
gaacaaaaacugc

SEQ ID NO: 531481 - RNA, 15 nt, Chlamydophila pneumoniae J138
gaacaaaaaaucaau

SEQ ID NO: 531482 - RNA, 15 nt, Chlamydophila pneumoniae J138
gaacaaagcucuccu

SEQ ID NO: 531483 - RNA, 13 nt, Chlamydophila pneumoniae J138
gaacaaggcuccg

SEQ ID NO: 531484 - RNA, 21 nt, Chlamydophila pneumoniae J138
gaacaauguaaauugaguauc

SEQ ID NO: 531485 - RNA, 12 nt, Chlamydophila pneumoniae J138
gaacaggagaga

SEQ ID NO: 531486 - RNA, 22 nt, Chlamydophila pneumoniae J138
gaacaguuugcucuggauguag

SEQ ID NO: 531487 - RNA, 23 nt, Chlamydophila pneumoniae J138
gaacagcauggacuccaagaaua

SEQ ID NO: 531488 - RNA, 22 nt, Chlamydophila pneumoniae J138
gaacagcauggacuccaagaau

SEQ ID NO: 531489 - RNA, 17 nt, Chlamydophila pneumoniae J138
gaacagcacucucugca

SEQ ID NO: 531490 - RNA, 12 nt, Chlamydophila pneumoniae J138
gaacacucucua

SEQ ID NO: 531491 - RNA, 22 nt, Chlamydophila pneumoniae J138
gaacagcacucucugcagggaa

SEQ ID NO: 531492 - RNA, 23 nt, Chlamydophila pneumoniae J138
gaacagcacucucugcagggaau

SEQ ID NO: 531493 - RNA, 19 nt, Chlamydophila pneumoniae J138
gaaccaaaucuaucugcac

SEQ ID NO: 531494 - RNA, 17 nt, Chlamydophila pneumoniae J138
gaacccuggaugaacau

SEQ ID NO: 531495 - RNA, 21 nt, Chlamydophila pneumoniae J138
gaaccuaggaggauuuccuag

SEQ ID NO: 531496 - RNA, 14 nt, Chlamydophila pneumoniae J138
gaaccuaggaggau

SEQ ID NO: 531497 - RNA, 13 nt, Chlamydophila pneumoniae J138
gaacgaagaaaac

SEQ ID NO: 531498 - RNA, 18 nt, Chlamydophila pneumoniae J138
gaacgaagacuuguucuu

SEQ ID NO: 531499 - RNA, 15 nt, Chlamydophila pneumoniae J138
gaacuaaaaguuuuu

SEQ ID NO: 531500 - RNA, 16 nt, Chlamydophila pneumoniae J138
gaacguuacgucuuag

SEQ ID NO: 531501 - RNA, 16 nt, Chlamydophila pneumoniae J138
gaacguacuuagguaa

SEQ ID NO: 531502 - RNA, 23 nt, Chlamydophila pneumoniae J138
gaacgucuaaagacgaagggagu

SEQ ID NO: 531503 - RNA, 21 nt, Chlamydophila pneumoniae J138
gaacggacaaugcuaucucca

SEQ ID NO: 531504 - RNA, 14 nt, Chlamydophila pneumoniae J138
gaacucaucacaau

SEQ ID NO: 531505 - RNA, 21 nt, Chlamydophila pneumoniae J138
gaacuccuuugagucuuuuuc

SEQ ID NO: 531506 - RNA, 19 nt, Chlamydophila pneumoniae J138
gaacuccgcccgucuuaga

SEQ ID NO: 531507 - RNA, 13 nt, Chlamydophila pneumoniae J138
gaacuagaaaaaa

SEQ ID NO: 531508 - RNA, 21 nt, Chlamydophila pneumoniae J138
gaacuacgggcaauauaucca

SEQ ID NO: 531509 - RNA, 16 nt, Chlamydophila pneumoniae J138
gaacuaacuguaauuu

SEQ ID NO: 531510 - RNA, 14 nt, Chlamydophila pneumoniae J138
gaacuauaggaagc

SEQ ID NO: 531511 - RNA, 19 nt, Chlamydophila pneumoniae J138
gaacuauaggaagcucuuc

SEQ ID NO: 531512 - RNA, 23 nt, Chlamydophila pneumoniae J138
gaacucuuaaagguaaagcuucu

SEQ ID NO: 531513 - RNA, 16 nt, Chlamydophila pneumoniae J138
gacagggaaagaacag

SEQ ID NO: 531514 - RNA, 13 nt, Chlamydophila pneumoniae J138
gacagggaaagaa

SEQ ID NO: 531515 - RNA, 19 nt, Chlamydophila pneumoniae J138
gacagacagucugugagaa

SEQ ID NO: 531516 - RNA, 20 nt, Chlamydophila pneumoniae J138
gacagucugugagaaauagg

SEQ ID NO: 531517 - RNA, 14 nt, Chlamydophila pneumoniae J138
gacagucucaugga

SEQ ID NO: 531518 - RNA, 14 nt, Chlamydophila pneumoniae J138
gacagucugugaga

SEQ ID NO: 531519 - RNA, 13 nt, Chlamydophila pneumoniae J138
gacaguauucccu

SEQ ID NO: 531520 - RNA, 20 nt, Chlamydophila pneumoniae J138
gacaugccuaaauagcucag

SEQ ID NO: 531521 - RNA, 15 nt, Chlamydophila pneumoniae J138
gacaugcuuuccuuc

SEQ ID NO: 531522 - RNA, 19 nt, Chlamydophila pneumoniae J138
gacaugagggcaugccuau

SEQ ID NO: 531523 - RNA, 23 nt, Chlamydophila pneumoniae J138
gaccaaaaauaaacauauucucc

SEQ ID NO: 531524 - RNA, 21 nt, Chlamydophila pneumoniae J138
gacauuuucaagcuuucguuu

SEQ ID NO: 531525 - RNA, 13 nt, Chlamydophila pneumoniae J138
gaccgaaucucuc

SEQ ID NO: 531526 - RNA, 19 nt, Chlamydophila pneumoniae J138
gaccgcgagugugacugca

SEQ ID NO: 531527 - RNA, 14 nt, Chlamydophila pneumoniae J138
gaccauaacagcac

SEQ ID NO: 531528 - RNA, 15 nt, Chlamydophila pneumoniae J138
gaccauccuguagcu

SEQ ID NO: 531529 - RNA, 16 nt, Chlamydophila pneumoniae J138
gaccaucgagcuacgu

SEQ ID NO: 531530 - RNA, 23 nt, Chlamydophila pneumoniae J138
gacgacguuuugcuguggaauuu

SEQ ID NO: 531531 - RNA, 18 nt, Chlamydophila pneumoniae J138
gacgaguugaaguuuugc

SEQ ID NO: 531532 - RNA, 23 nt, Chlamydophila pneumoniae J138
gacgaguugaaguuuugcucucu

SEQ ID NO: 531533 - RNA, 18 nt, Chlamydophila pneumoniae J138
gacgauauuuagagagaa

SEQ ID NO: 531534 - RNA, 16 nt, Chlamydophila pneumoniae J138
gaccugcuuuuuuucu

SEQ ID NO: 531535 - RNA, 16 nt, Chlamydophila pneumoniae J138
gaccugugaguaaaau

SEQ ID NO: 531536 - RNA, 15 nt, Chlamydophila pneumoniae J138
gaccuguaguaaaau

SEQ ID NO: 531537 - RNA, 22 nt, Chlamydophila pneumoniae J138
gacgaacaugccugaaaacaag

SEQ ID NO: 531538 - RNA, 17 nt, Chlamydophila pneumoniae J138
gacguacuaagauacgu

SEQ ID NO: 531539 - RNA, 15 nt, Chlamydophila pneumoniae J138
gacgcuuuuaucugu

SEQ ID NO: 531540 - RNA, 18 nt, Chlamydophila pneumoniae J138
gacgugggagacauucca

SEQ ID NO: 531541 - RNA, 14 nt, Chlamydophila pneumoniae J138
gacgugguuuuugc

SEQ ID NO: 531542 - RNA, 14 nt, Chlamydophila pneumoniae J138
gacuaaaagaauaa

SEQ ID NO: 531543 - RNA, 14 nt, Chlamydophila pneumoniae J138
gacguuccuuucuc

SEQ ID NO: 531544 - RNA, 16 nt, Chlamydophila pneumoniae J138
gacuauagaaaaggau

SEQ ID NO: 531545 - RNA, 13 nt, Chlamydophila pneumoniae J138
gacuauaaaaugc

SEQ ID NO: 531546 - RNA, 20 nt, Chlamydophila pneumoniae J138
gacuacaucuuguucugcac

SEQ ID NO: 531547 - RNA, 15 nt, Chlamydophila pneumoniae J138
gacuauagaugccau

SEQ ID NO: 531548 - RNA, 18 nt, Chlamydophila pneumoniae J138
gacuauagaaaaggaugc

SEQ ID NO: 531549 - RNA, 17 nt, Chlamydophila pneumoniae J138
gacuauguuuaaagcau

SEQ ID NO: 531550 - RNA, 14 nt, Chlamydophila pneumoniae J138
gacuauuuuggaaa

SEQ ID NO: 531551 - RNA, 12 nt, Chlamydophila pneumoniae J138
gacuauuuucau

SEQ ID NO: 531552 - RNA, 22 nt, Chlamydophila pneumoniae J138
gaacuguaacuugcauuuuuug

SEQ ID NO: 531553 - RNA, 23 nt, Chlamydophila pneumoniae J138
gaacuucagcuuugcuuaaaaag

SEQ ID NO: 531554 - RNA, 14 nt, Chlamydophila pneumoniae J138
gaacuucagcaaga

SEQ ID NO: 531555 - RNA, 22 nt, Chlamydophila pneumoniae J138
gaacuuuugggcccucucuuga

SEQ ID NO: 531556 - RNA, 22 nt, Chlamydophila pneumoniae J138
gaacuuugaccagaugauuuuu

SEQ ID NO: 531557 - RNA, 21 nt, Chlamydophila pneumoniae J138
gaacuuucgucuuugcuuucu

SEQ ID NO: 531558 - RNA, 14 nt, Chlamydophila pneumoniae J138
gaacuuuagggaag

SEQ ID NO: 531559 - RNA, 14 nt, Chlamydophila pneumoniae J138
gaacuugggaugcu

SEQ ID NO: 531560 - RNA, 14 nt, Chlamydophila pneumoniae J138
gaagacuugcucug

SEQ ID NO: 531561 - RNA, 20 nt, Chlamydophila pneumoniae J138
gaagacucucaucagcaaaa

SEQ ID NO: 531562 - RNA, 24 nt, Chlamydophila pneumoniae J138
gaagacguucgacaacaacauaaa

SEQ ID NO: 531563 - RNA, 23 nt, Chlamydophila pneumoniae J138
gaagaaauuaaguaggccuccuu

SEQ ID NO: 531564 - RNA, 24 nt, Chlamydophila pneumoniae J138
aaagagucucacucuuuucuagaa

SEQ ID NO: 531565 - RNA, 17 nt, Chlamydophila pneumoniae J138
aaagagucucacucuuu

SEQ ID NO: 531566 - RNA, 20 nt, Chlamydophila pneumoniae J138
aaagagucucacucuuuucu

SEQ ID NO: 531567 - RNA, 23 nt, Chlamydophila pneumoniae J138
aaagagucucuugcuuuuguaga

SEQ ID NO: 531568 - RNA, 21 nt, Chlamydophila pneumoniae J138
aaagaguuuguucacauuuuc

SEQ ID NO: 531569 - RNA, 17 nt, Chlamydophila pneumoniae J138
aaagagugccaagagca

SEQ ID NO: 531570 - RNA, 18 nt, Chlamydophila pneumoniae J138
aaagagugccaagagcau

SEQ ID NO: 531571 - RNA, 23 nt, Chlamydophila pneumoniae J138
aaagagugccaagagcaucacaa

SEQ ID NO: 531572 - RNA, 20 nt, Chlamydophila pneumoniae J138
aaagaguuuuuuagaggagc

SEQ ID NO: 531573 - RNA, 16 nt, Chlamydophila pneumoniae J138
aaagauaaagaaguuu

SEQ ID NO: 531574 - RNA, 14 nt, Chlamydophila pneumoniae J138
aaagauaaagaagu

SEQ ID NO: 531575 - RNA, 18 nt, Chlamydophila pneumoniae J138
gaagccauuuucuaagag

SEQ ID NO: 531576 - RNA, 18 nt, Chlamydophila pneumoniae J138
gaagagguguccauaaug

SEQ ID NO: 531577 - RNA, 13 nt, Chlamydophila pneumoniae J138
aaagauaaagaag

SEQ ID NO: 531578 - RNA, 15 nt, Chlamydophila pneumoniae J138
gaagaguuguugugg

SEQ ID NO: 531579 - RNA, 21 nt, Chlamydophila pneumoniae J138
gaagauauuaucgauaggaag

SEQ ID NO: 531580 - RNA, 14 nt, Chlamydophila pneumoniae J138
gaagcaagaaucac

SEQ ID NO: 531581 - RNA, 21 nt, Chlamydophila pneumoniae J138
gaagcccgcaguuuaucucua

SEQ ID NO: 531582 - RNA, 17 nt, Chlamydophila pneumoniae J138
gaagcgcgaggagcgau

SEQ ID NO: 531583 - RNA, 21 nt, Chlamydophila pneumoniae J138
gaagcgccgcauuacagggaa

SEQ ID NO: 531584 - RNA, 12 nt, Chlamydophila pneumoniae J138
gaaggaguucuu

SEQ ID NO: 531585 - RNA, 13 nt, Chlamydophila pneumoniae J138
gaaggaauuugcu

SEQ ID NO: 531586 - RNA, 15 nt, Chlamydophila pneumoniae J138
gaagcuugcugauuu

SEQ ID NO: 531587 - RNA, 14 nt, Chlamydophila pneumoniae J138
gaagcguuaacaac

SEQ ID NO: 531588 - RNA, 18 nt, Chlamydophila pneumoniae J138
gaaggaaaaggcccccua

SEQ ID NO: 531589 - RNA, 18 nt, Chlamydophila pneumoniae J138
gaaggaucugaugcacca

SEQ ID NO: 531590 - RNA, 15 nt, Chlamydophila pneumoniae J138
gaaggcaccaacacu

SEQ ID NO: 531591 - RNA, 21 nt, Chlamydophila pneumoniae J138
gaaggccaagauucucacucu

SEQ ID NO: 531592 - RNA, 14 nt, Chlamydophila pneumoniae J138
gaaggggaagagga

SEQ ID NO: 531593 - RNA, 18 nt, Chlamydophila pneumoniae J138
gaaguaagcgauggcagu

SEQ ID NO: 531594 - RNA, 20 nt, Chlamydophila pneumoniae J138
gaaguacaagugaagacaag

SEQ ID NO: 531595 - RNA, 15 nt, Chlamydophila pneumoniae J138
gaaguuuuuucucuc

SEQ ID NO: 531596 - RNA, 12 nt, Chlamydophila pneumoniae J138
gaaguuuugcuc

SEQ ID NO: 531597 - RNA, 21 nt, Chlamydophila pneumoniae J138
gaaguuccuacuucugcagga

SEQ ID NO: 531598 - RNA, 15 nt, Chlamydophila pneumoniae J138
gaaguuccuucagga

SEQ ID NO: 531599 - RNA, 18 nt, Chlamydophila pneumoniae J138
aaagaucaucuucacuaa

SEQ ID NO: 531600 - RNA, 13 nt, Chlamydophila pneumoniae J138
aaagaucacugag

SEQ ID NO: 531601 - RNA, 20 nt, Chlamydophila pneumoniae J138
aaagaucggaguuaucaaaa

SEQ ID NO: 531602 - RNA, 15 nt, Chlamydophila pneumoniae J138
gaagucgaaagauca

SEQ ID NO: 531603 - RNA, 19 nt, Chlamydophila pneumoniae J138
gaagucgcaguaaugccaa

SEQ ID NO: 531604 - RNA, 20 nt, Chlamydophila pneumoniae J138
aaagauauagauucaugaaa

SEQ ID NO: 531605 - RNA, 22 nt, Chlamydophila pneumoniae J138
gaauaagauuuugaaaauugca

SEQ ID NO: 531606 - RNA, 15 nt, Chlamydophila pneumoniae J138
gaauaaucaaccaaa

SEQ ID NO: 531607 - RNA, 20 nt, Chlamydophila pneumoniae J138
gaauccucuauccaucaucg

SEQ ID NO: 531608 - RNA, 16 nt, Chlamydophila pneumoniae J138
gaauccucuauccauc

SEQ ID NO: 531609 - RNA, 13 nt, Chlamydophila pneumoniae J138
gaaucccaaggga

SEQ ID NO: 531610 - RNA, 17 nt, Chlamydophila pneumoniae J138
gaaucagcuuaucuaua

SEQ ID NO: 531611 - RNA, 12 nt, Chlamydophila pneumoniae J138
gaauagcaggaa

SEQ ID NO: 531612 - RNA, 21 nt, Chlamydophila pneumoniae J138
gaauagaaagacauccuucuu

SEQ ID NO: 531613 - RNA, 17 nt, Chlamydophila pneumoniae J138
aaagauucuaaaucaac

SEQ ID NO: 531614 - RNA, 15 nt, Chlamydophila pneumoniae J138
aaagauucuaaauca

SEQ ID NO: 531615 - RNA, 13 nt, Chlamydophila pneumoniae J138
aaagauucuaaau

SEQ ID NO: 531616 - RNA, 17 nt, Chlamydophila pneumoniae J138
aaagauuauucuagagu

SEQ ID NO: 531617 - RNA, 14 nt, Chlamydophila pneumoniae J138
aaagauuccccaua

SEQ ID NO: 531618 - RNA, 20 nt, Chlamydophila pneumoniae J138
aaagauuccuaagcuauaga

SEQ ID NO: 531619 - RNA, 19 nt, Chlamydophila pneumoniae J138
aaagauuccuuaccuauau

SEQ ID NO: 531620 - RNA, 19 nt, Chlamydophila pneumoniae J138
gaaugaaucgaagaacaga

SEQ ID NO: 531621 - RNA, 20 nt, Chlamydophila pneumoniae J138
gaaugacacagagaacaaua

SEQ ID NO: 531622 - RNA, 14 nt, Chlamydophila pneumoniae J138
gaaugagaacgucu

SEQ ID NO: 531623 - RNA, 19 nt, Chlamydophila pneumoniae J138
gaaucuuuucuagaaaacg

SEQ ID NO: 531624 - RNA, 14 nt, Chlamydophila pneumoniae J138
gaaucuuucaaaag

SEQ ID NO: 531625 - RNA, 13 nt, Chlamydophila pneumoniae J138
gaaucuuuuucau

SEQ ID NO: 531626 - RNA, 20 nt, Chlamydophila pneumoniae J138
gaaucugguuccuuaaagag

SEQ ID NO: 531627 - RNA, 16 nt, Chlamydophila pneumoniae J138
gaaucgaagaacagag

SEQ ID NO: 531628 - RNA, 22 nt, Chlamydophila pneumoniae J138
gaauccuugaaagacucgcucu

SEQ ID NO: 531629 - RNA, 14 nt, Chlamydophila pneumoniae J138
gaauccuucucccu

SEQ ID NO: 531630 - RNA, 21 nt, Chlamydophila pneumoniae J138
gaaugagcuucacaucuuucu

SEQ ID NO: 531631 - RNA, 20 nt, Chlamydophila pneumoniae J138
gaaugacugcagauugcacu

SEQ ID NO: 531632 - RNA, 17 nt, Chlamydophila pneumoniae J138
gaaugcccuuuagggaa

SEQ ID NO: 531633 - RNA, 18 nt, Chlamydophila pneumoniae J138
gaaugcccuuuagggaau

SEQ ID NO: 531634 - RNA, 21 nt, Chlamydophila pneumoniae J138
gaaugccauucuuaucugcug

SEQ ID NO: 531635 - RNA, 17 nt, Chlamydophila pneumoniae J138
gaaugccugccaaucca

SEQ ID NO: 531636 - RNA, 15 nt, Chlamydophila pneumoniae J138
gaaugcggcuaauuu

SEQ ID NO: 531637 - RNA, 13 nt, Chlamydophila pneumoniae J138
gaauguucccaaa

SEQ ID NO: 531638 - RNA, 23 nt, Chlamydophila pneumoniae J138
gaauguugggggagcucgcuaaa

SEQ ID NO: 531639 - RNA, 19 nt, Chlamydophila pneumoniae J138
gaauguacauagaggagau

SEQ ID NO: 531640 - RNA, 21 nt, Chlamydophila pneumoniae J138
gacacaaaaagcuuuuuucuc

SEQ ID NO: 531641 - RNA, 15 nt, Chlamydophila pneumoniae J138
gacaauaaaaaagag

SEQ ID NO: 531642 - RNA, 16 nt, Chlamydophila pneumoniae J138
gacaauaaaaaagaga

SEQ ID NO: 531643 - RNA, 21 nt, Chlamydophila pneumoniae J138
gacaauaccagauaaagcaaa

SEQ ID NO: 531644 - RNA, 23 nt, Chlamydophila pneumoniae J138
gacaaugcaaccuguaaagacca

SEQ ID NO: 531645 - RNA, 14 nt, Chlamydophila pneumoniae J138
gaauugcauuaaga

SEQ ID NO: 531646 - RNA, 14 nt, Chlamydophila pneumoniae J138
gaauuguaguucuu

SEQ ID NO: 531647 - RNA, 18 nt, Chlamydophila pneumoniae J138
gaauuguaguucuuugaa

SEQ ID NO: 531648 - RNA, 15 nt, Chlamydophila pneumoniae J138
gaauuggaagcuuuu

SEQ ID NO: 531649 - RNA, 23 nt, Chlamydophila pneumoniae J138
gaauuguuuuguuuguuuucuau

SEQ ID NO: 531650 - RNA, 17 nt, Chlamydophila pneumoniae J138
gaauuguguguuuucau

SEQ ID NO: 531651 - RNA, 13 nt, Chlamydophila pneumoniae J138
gaauuuuucuagu

SEQ ID NO: 531652 - RNA, 22 nt, Chlamydophila pneumoniae J138
gacaaaaaagggaucuccuuca

SEQ ID NO: 531653 - RNA, 11 nt, Chlamydophila pneumoniae J138
gacaaaaaugc

SEQ ID NO: 531654 - RNA, 19 nt, Chlamydophila pneumoniae J138
gacaaaaaaucugaucuuc

SEQ ID NO: 531655 - RNA, 18 nt, Chlamydophila pneumoniae J138
cugaaucccguuaaaaaa

SEQ ID NO: 531656 - RNA, 23 nt, Chlamydophila pneumoniae J138
cugaauaugcuuuucaaauauug

SEQ ID NO: 531657 - RNA, 15 nt, Chlamydophila pneumoniae J138
cugaauagcucuuuu

SEQ ID NO: 531658 - RNA, 17 nt, Chlamydophila pneumoniae J138
cugaauagcucuuuuca

SEQ ID NO: 531659 - RNA, 23 nt, Chlamydophila pneumoniae J138
cugaauagcucuuuucaugauaa

SEQ ID NO: 531660 - RNA, 17 nt, Chlamydophila pneumoniae J138
cugaauaccguuucagg

SEQ ID NO: 531661 - RNA, 21 nt, Chlamydophila pneumoniae J138
cucuacaguaguaaauaauaa

SEQ ID NO: 531662 - RNA, 16 nt, Chlamydophila pneumoniae J138
cucuaccccacgcuaa

SEQ ID NO: 531663 - RNA, 20 nt, Chlamydophila pneumoniae J138
cucuacccccagcuucuuca

SEQ ID NO: 531664 - RNA, 13 nt, Chlamydophila pneumoniae J138
cucuaccaacuga

SEQ ID NO: 531665 - RNA, 24 nt, Chlamydophila pneumoniae J138
cucuacaguaguaaauaauaaccu

SEQ ID NO: 531666 - RNA, 14 nt, Chlamydophila pneumoniae J138
cucuacucuacagu

SEQ ID NO: 531667 - RNA, 22 nt, Chlamydophila pneumoniae J138
cucuagaaauauacucuugcuu

SEQ ID NO: 531668 - RNA, 19 nt, Chlamydophila pneumoniae J138
cucuagaaaacgcucuccu

SEQ ID NO: 531669 - RNA, 22 nt, Chlamydophila pneumoniae J138
cucuagaggagcgaugacuugg

SEQ ID NO: 531670 - RNA, 23 nt, Chlamydophila pneumoniae J138
cucuagcaccuaauaaagaaggu

SEQ ID NO: 531671 - RNA, 14 nt, Chlamydophila pneumoniae J138
cucuagccaccaac

SEQ ID NO: 531672 - RNA, 19 nt, Chlamydophila pneumoniae J138
cugacagcuccauuuaaau

SEQ ID NO: 531673 - RNA, 16 nt, Chlamydophila pneumoniae J138
cugacgugcauugaau

SEQ ID NO: 531674 - RNA, 18 nt, Chlamydophila pneumoniae J138
cugacgucuccaacaguc

SEQ ID NO: 531675 - RNA, 15 nt, Chlamydophila pneumoniae J138
cugaggacgcagaga

SEQ ID NO: 531676 - RNA, 17 nt, Chlamydophila pneumoniae J138
cugaggacgcagagaug

SEQ ID NO: 531677 - RNA, 23 nt, Chlamydophila pneumoniae J138
cugagcuuuuaguagguaauccc

SEQ ID NO: 531678 - RNA, 17 nt, Chlamydophila pneumoniae J138
cugagcuucuauuucua

SEQ ID NO: 531679 - RNA, 21 nt, Chlamydophila pneumoniae J138
cugagguuauuuaauccaaaa

SEQ ID NO: 531680 - RNA, 16 nt, Chlamydophila pneumoniae J138
cugagguuauuuaauc

SEQ ID NO: 531681 - RNA, 14 nt, Chlamydophila pneumoniae J138
cugagguugggcag

SEQ ID NO: 531682 - RNA, 17 nt, Chlamydophila pneumoniae J138
cugagggaucuucucua

SEQ ID NO: 531683 - RNA, 13 nt, Chlamydophila pneumoniae J138
cugauaaaauaaa

SEQ ID NO: 531684 - RNA, 17 nt, Chlamydophila pneumoniae J138
cugauaaaauaaacucu

SEQ ID NO: 531685 - RNA, 21 nt, Chlamydophila pneumoniae J138
cugaguauuuugcaaaugaaa

SEQ ID NO: 531686 - RNA, 15 nt, Chlamydophila pneumoniae J138
cugaugaccucaucu

SEQ ID NO: 531687 - RNA, 14 nt, Chlamydophila pneumoniae J138
cugaugaccucauc

SEQ ID NO: 531688 - RNA, 16 nt, Chlamydophila pneumoniae J138
cugaugaaaaagcuga

SEQ ID NO: 531689 - RNA, 22 nt, Chlamydophila pneumoniae J138
cugaugcugaggacgcagagau

SEQ ID NO: 531690 - RNA, 23 nt, Chlamydophila pneumoniae J138
cugauuccauccugucuauuucu

SEQ ID NO: 531691 - RNA, 14 nt, Chlamydophila pneumoniae J138
cugauucaauugag

SEQ ID NO: 531692 - RNA, 21 nt, Chlamydophila pneumoniae J138
cugauguaggugauauuuucu

SEQ ID NO: 531693 - RNA, 17 nt, Chlamydophila pneumoniae J138
cugaugucuccauacag

SEQ ID NO: 531694 - RNA, 20 nt, Chlamydophila pneumoniae J138
cugauuaguucucuaagacu

SEQ ID NO: 531695 - RNA, 23 nt, Chlamydophila pneumoniae J138
cugcagcagccuuggcucuagaa

SEQ ID NO: 531696 - RNA, 19 nt, Chlamydophila pneumoniae J138
cugcagcaggugucagacu

SEQ ID NO: 531697 - RNA, 16 nt, Chlamydophila pneumoniae J138
cugcacuuucuuuuuu

SEQ ID NO: 531698 - RNA, 18 nt, Chlamydophila pneumoniae J138
cugcacuuucuuuuuuaa

SEQ ID NO: 531699 - RNA, 12 nt, Chlamydophila pneumoniae J138
cugcagcaaaac

SEQ ID NO: 531700 - RNA, 11 nt, Chlamydophila pneumoniae J138
cugcagaagua

SEQ ID NO: 531701 - RNA, 16 nt, Chlamydophila pneumoniae J138
cugcauaauuuuucuu

SEQ ID NO: 531702 - RNA, 20 nt, Chlamydophila pneumoniae J138
cugcauacccuucuucuuca

SEQ ID NO: 531703 - RNA, 18 nt, Chlamydophila pneumoniae J138
cugcauaaucucaccaga

SEQ ID NO: 531704 - RNA, 15 nt, Chlamydophila pneumoniae J138
cugcccuuucugcaa

SEQ ID NO: 531705 - RNA, 21 nt, Chlamydophila pneumoniae J138
cugcggccacauuaagcaauc

SEQ ID NO: 531706 - RNA, 19 nt, Chlamydophila pneumoniae J138
cugcuagaguccaagguuc

SEQ ID NO: 531707 - RNA, 12 nt, Chlamydophila pneumoniae J138
cugcuagagcuu

SEQ ID NO: 531708 - RNA, 13 nt, Chlamydophila pneumoniae J138
cugcuaccugugu

SEQ ID NO: 531709 - RNA, 14 nt, Chlamydophila pneumoniae J138
cugcuccaaaaugg

SEQ ID NO: 531710 - RNA, 12 nt, Chlamydophila pneumoniae J138
cugcuccaaaau

SEQ ID NO: 531711 - RNA, 14 nt, Chlamydophila pneumoniae J138
aaacuauacucucu

SEQ ID NO: 531712 - RNA, 20 nt, Chlamydophila pneumoniae J138
cugcugaggagaguaagguc

SEQ ID NO: 531713 - RNA, 15 nt, Chlamydophila pneumoniae J138
cugcuucgaccauaa

SEQ ID NO: 531714 - RNA, 15 nt, Chlamydophila pneumoniae J138
cugcuugugaggcua

SEQ ID NO: 531715 - RNA, 12 nt, Chlamydophila pneumoniae J138
cugcuucuccaa

SEQ ID NO: 531716 - RNA, 19 nt, Chlamydophila pneumoniae J138
cuggaaugacauaagcacu

SEQ ID NO: 531717 - RNA, 24 nt, Chlamydophila pneumoniae J138
cuggaggcgguggcaugccauaau

SEQ ID NO: 531718 - RNA, 20 nt, Chlamydophila pneumoniae J138
cuggagggucgcugauaaaa

SEQ ID NO: 531719 - RNA, 16 nt, Chlamydophila pneumoniae J138
cuggaguggaggauac

SEQ ID NO: 531720 - RNA, 14 nt, Chlamydophila pneumoniae J138
cuggcuauggaaga

SEQ ID NO: 531721 - RNA, 13 nt, Chlamydophila pneumoniae J138
cuggcuaaaggau

SEQ ID NO: 531722 - RNA, 20 nt, Chlamydophila pneumoniae J138
aaacuccaaguguugccagc

SEQ ID NO: 531723 - RNA, 12 nt, Chlamydophila pneumoniae J138
aaacuccaaaau

SEQ ID NO: 531724 - RNA, 20 nt, Chlamydophila pneumoniae J138
aaacuccaaaauauucuuuc

SEQ ID NO: 531725 - RNA, 18 nt, Chlamydophila pneumoniae J138
aaacuccccaguuuucca

SEQ ID NO: 531726 - RNA, 21 nt, Chlamydophila pneumoniae J138
aaacuccgcacuugcucuuua

SEQ ID NO: 531727 - RNA, 22 nt, Chlamydophila pneumoniae J138
aaacuccgcacuugcucuuuaa

SEQ ID NO: 531728 - RNA, 16 nt, Chlamydophila pneumoniae J138
aaacuccuuuuaaaau

SEQ ID NO: 531729 - RNA, 15 nt, Chlamydophila pneumoniae J138
aaacuccuuuuaaaa

SEQ ID NO: 531730 - RNA, 18 nt, Chlamydophila pneumoniae J138
aaacuccuaggggaauua

SEQ ID NO: 531731 - RNA, 17 nt, Chlamydophila pneumoniae J138
cugggaagaccacgaaa

SEQ ID NO: 531732 - RNA, 15 nt, Chlamydophila pneumoniae J138
cugggaaaucuaaac

SEQ ID NO: 531733 - RNA, 21 nt, Chlamydophila pneumoniae J138
cugggaauuguucuugaaguu

SEQ ID NO: 531734 - RNA, 20 nt, Chlamydophila pneumoniae J138
cugggaauucuuuuccugca

SEQ ID NO: 531735 - RNA, 18 nt, Chlamydophila pneumoniae J138
cugggaauuguucuugaa

SEQ ID NO: 531736 - RNA, 14 nt, Chlamydophila pneumoniae J138
cugggaauucuuuu

SEQ ID NO: 531737 - RNA, 23 nt, Chlamydophila pneumoniae J138
cugggcauaguggcucaguguau

SEQ ID NO: 531738 - RNA, 19 nt, Chlamydophila pneumoniae J138
cugggauguucaaagccau

SEQ ID NO: 531739 - RNA, 14 nt, Chlamydophila pneumoniae J138
cuggcgacuugcca

SEQ ID NO: 531740 - RNA, 20 nt, Chlamydophila pneumoniae J138
cugggggagcuagaaagucc

SEQ ID NO: 531741 - RNA, 19 nt, Chlamydophila pneumoniae J138
cugggcuuauuauugaaua

SEQ ID NO: 531742 - RNA, 15 nt, Chlamydophila pneumoniae J138
cugggcgucuucuuc

SEQ ID NO: 531743 - RNA, 21 nt, Chlamydophila pneumoniae J138
cuggguaaguccacaagccuc

SEQ ID NO: 531744 - RNA, 23 nt, Chlamydophila pneumoniae J138
cugggugcgucguaaucuuuuuu

SEQ ID NO: 531745 - RNA, 19 nt, Chlamydophila pneumoniae J138
cuggucuguauuuucuuca

SEQ ID NO: 531746 - RNA, 16 nt, Chlamydophila pneumoniae J138
cuggucuccagaagca

SEQ ID NO: 531747 - RNA, 16 nt, Chlamydophila pneumoniae J138
cuggucucaugaccuu

SEQ ID NO: 531748 - RNA, 17 nt, Chlamydophila pneumoniae J138
cugguauagacuccuua

SEQ ID NO: 531749 - RNA, 16 nt, Chlamydophila pneumoniae J138
cugguuccuuaaagag

SEQ ID NO: 531750 - RNA, 21 nt, Chlamydophila pneumoniae J138
cugguuaagcaccauaaugga

SEQ ID NO: 531751 - RNA, 15 nt, Chlamydophila pneumoniae J138
cugguuuuucgauuu

SEQ ID NO: 531752 - RNA, 17 nt, Chlamydophila pneumoniae J138
cugguuuuucuccugac

SEQ ID NO: 531753 - RNA, 18 nt, Chlamydophila pneumoniae J138
cugguuuuucuccugacu

SEQ ID NO: 531754 - RNA, 15 nt, Chlamydophila pneumoniae J138
cuguaaagaccaaau

SEQ ID NO: 531755 - RNA, 21 nt, Chlamydophila pneumoniae J138
cuguaaagaccaaauagagag

SEQ ID NO: 531756 - RNA, 17 nt, Chlamydophila pneumoniae J138
cuguaagaauccuugcu

SEQ ID NO: 531757 - RNA, 18 nt, Chlamydophila pneumoniae J138
cuguaacuugcauuuuuu

SEQ ID NO: 531758 - RNA, 15 nt, Chlamydophila pneumoniae J138
cuguaacacuuccua

SEQ ID NO: 531759 - RNA, 21 nt, Chlamydophila pneumoniae J138
cuguaacacccucccucauaa

SEQ ID NO: 531760 - RNA, 19 nt, Chlamydophila pneumoniae J138
cuguaaccaacaucaaaga

SEQ ID NO: 531761 - RNA, 13 nt, Chlamydophila pneumoniae J138
cuguacagaacaa

SEQ ID NO: 531762 - RNA, 23 nt, Chlamydophila pneumoniae J138
cuguaauuuuuuucaaaggagaa

SEQ ID NO: 531763 - RNA, 21 nt, Chlamydophila pneumoniae J138
cuguaauuuuuuucaaaggag

SEQ ID NO: 531764 - RNA, 21 nt, Chlamydophila pneumoniae J138
cuguaccacauacucuucauc

SEQ ID NO: 531765 - RNA, 15 nt, Chlamydophila pneumoniae J138
cugucacuaucuucu

SEQ ID NO: 531766 - RNA, 16 nt, Chlamydophila pneumoniae J138
cugucacuaucuucua

SEQ ID NO: 531767 - RNA, 15 nt, Chlamydophila pneumoniae J138
cugucagaacaagaa

SEQ ID NO: 531768 - RNA, 14 nt, Chlamydophila pneumoniae J138
cugucauccuugcg

SEQ ID NO: 531769 - RNA, 15 nt, Chlamydophila pneumoniae J138
aaacugcgcuagcuc

SEQ ID NO: 531770 - RNA, 22 nt, Chlamydophila pneumoniae J138
aaacugauuaguuuguuuuaau

SEQ ID NO: 531771 - RNA, 15 nt, Chlamydophila pneumoniae J138
aaacugcaaaaagau

SEQ ID NO: 531772 - RNA, 13 nt, Chlamydophila pneumoniae J138
aaacugaugccaa

SEQ ID NO: 531773 - RNA, 23 nt, Chlamydophila pneumoniae J138
cugucauuaaaaauuuaaaagau

SEQ ID NO: 531774 - RNA, 14 nt, Chlamydophila pneumoniae J138
cugucauuaaaaau

SEQ ID NO: 531775 - RNA, 21 nt, Chlamydophila pneumoniae J138
cuguccaacuaaaacagccua

SEQ ID NO: 531776 - RNA, 14 nt, Chlamydophila pneumoniae J138
cuguccauccaaau

SEQ ID NO: 531777 - RNA, 21 nt, Chlamydophila pneumoniae J138
cuguaucgauaacgauuucuu

SEQ ID NO: 531778 - RNA, 18 nt, Chlamydophila pneumoniae J138
cuguaucgauaguuuuug

SEQ ID NO: 531779 - RNA, 19 nt, Chlamydophila pneumoniae J138
cuguaucgacuguacaaau

SEQ ID NO: 531780 - RNA, 18 nt, Chlamydophila pneumoniae J138
cuguauagaaacuguuaa

SEQ ID NO: 531781 - RNA, 19 nt, Chlamydophila pneumoniae J138
aaacucucuuccuucuccu

SEQ ID NO: 531782 - RNA, 23 nt, Chlamydophila pneumoniae J138
cuguauuuuauagcguugauucc

SEQ ID NO: 531783 - RNA, 19 nt, Chlamydophila pneumoniae J138
cuguaguuagcauugcuug

SEQ ID NO: 531784 - RNA, 22 nt, Chlamydophila pneumoniae J138
cuguagguuuuuccaacuucaa

SEQ ID NO: 531785 - RNA, 18 nt, Chlamydophila pneumoniae J138
cuguaguaaaauaagaaa

SEQ ID NO: 531786 - RNA, 20 nt, Chlamydophila pneumoniae J138
cuguaguuagcauugcuugc

SEQ ID NO: 531787 - RNA, 21 nt, Chlamydophila pneumoniae J138
cuguagguuuuuccaacuuca

SEQ ID NO: 531788 - RNA, 20 nt, Chlamydophila pneumoniae J138
cuguagggaaagacucaucu

SEQ ID NO: 531789 - RNA, 14 nt, Chlamydophila pneumoniae J138
cuguacuuccccaa

SEQ ID NO: 531790 - RNA, 14 nt, Chlamydophila pneumoniae J138
cuguagccuuugau

SEQ ID NO: 531791 - RNA, 17 nt, Chlamydophila pneumoniae J138
cuguagaaacauuuaag

SEQ ID NO: 531792 - RNA, 15 nt, Chlamydophila pneumoniae J138
cuguccuccgagaaa

SEQ ID NO: 531793 - RNA, 14 nt, Chlamydophila pneumoniae J138
cuguccuccgagaa

SEQ ID NO: 531794 - RNA, 17 nt, Chlamydophila pneumoniae J138
cuguccuugcagcccug

SEQ ID NO: 531795 - RNA, 17 nt, Chlamydophila pneumoniae J138
cugucuuaucuaaagaa

SEQ ID NO: 531796 - RNA, 13 nt, Chlamydophila pneumoniae J138
cugugauaguaga

SEQ ID NO: 531797 - RNA, 14 nt, Chlamydophila pneumoniae J138
cugugauaguagaa

SEQ ID NO: 531798 - RNA, 18 nt, Chlamydophila pneumoniae J138
cugugcauuuucuucuug

SEQ ID NO: 531799 - RNA, 13 nt, Chlamydophila pneumoniae J138
cugugcauuuucu

SEQ ID NO: 531800 - RNA, 12 nt, Chlamydophila pneumoniae J138
cugugcauuuuc

SEQ ID NO: 531801 - RNA, 15 nt, Chlamydophila pneumoniae J138
cugugcaucagucag

SEQ ID NO: 531802 - RNA, 23 nt, Chlamydophila pneumoniae J138
cugugcaucagucagacucacau

SEQ ID NO: 531803 - RNA, 16 nt, Chlamydophila pneumoniae J138
cugugcuccauagcau

SEQ ID NO: 531804 - RNA, 14 nt, Chlamydophila pneumoniae J138
cuguggaauuuucc

SEQ ID NO: 531805 - RNA, 14 nt, Chlamydophila pneumoniae J138
cuguggcaauagcg

SEQ ID NO: 531806 - RNA, 19 nt, Chlamydophila pneumoniae J138
cuguggcauacucuuugca

SEQ ID NO: 531807 - RNA, 23 nt, Chlamydophila pneumoniae J138
cuguggcguaagcaauaucuaua

SEQ ID NO: 531808 - RNA, 15 nt, Chlamydophila pneumoniae J138
cugugguuuuuauuc

SEQ ID NO: 531809 - RNA, 14 nt, Chlamydophila pneumoniae J138
cuguuaacaagauu

SEQ ID NO: 531810 - RNA, 13 nt, Chlamydophila pneumoniae J138
cuguuaacucaga

SEQ ID NO: 531811 - RNA, 15 nt, Chlamydophila pneumoniae J138
cuguguuuucuaguc

SEQ ID NO: 531812 - RNA, 14 nt, Chlamydophila pneumoniae J138
cuguguuuucuagu

SEQ ID NO: 531813 - RNA, 16 nt, Chlamydophila pneumoniae J138
cuguucuucuucaguc

SEQ ID NO: 531814 - RNA, 21 nt, Chlamydophila pneumoniae J138
cuguuguacuaucacagccau

SEQ ID NO: 531815 - RNA, 20 nt, Chlamydophila pneumoniae J138
cuguugggagcuuccuccaa

SEQ ID NO: 531816 - RNA, 15 nt, Chlamydophila pneumoniae J138
cuguugcacuuuccg

SEQ ID NO: 531817 - RNA, 21 nt, Chlamydophila pneumoniae J138
cuguuuuggaaagaagagaau

SEQ ID NO: 531818 - RNA, 15 nt, Chlamydophila pneumoniae J138
cuuaaaauucuguaa

SEQ ID NO: 531819 - RNA, 20 nt, Chlamydophila pneumoniae J138
cuuaaaauucuguaaaguga

SEQ ID NO: 531820 - RNA, 16 nt, Chlamydophila pneumoniae J138
aaacuguguuuucuag

SEQ ID NO: 531821 - RNA, 16 nt, Chlamydophila pneumoniae J138
cuuaacuggcaaucua

SEQ ID NO: 531822 - RNA, 21 nt, Chlamydophila pneumoniae J138
cuuaacuggcaaucuaaaauc

SEQ ID NO: 531823 - RNA, 11 nt, Chlamydophila pneumoniae J138
cuuaacaacau

SEQ ID NO: 531824 - RNA, 19 nt, Chlamydophila pneumoniae J138
cuuauagggaauuuuuucu

SEQ ID NO: 531825 - RNA, 16 nt, Chlamydophila pneumoniae J138
cuuaucccauaaaugu

SEQ ID NO: 531826 - RNA, 19 nt, Chlamydophila pneumoniae J138
cuuaucuauagcauuguuu

SEQ ID NO: 531827 - RNA, 20 nt, Chlamydophila pneumoniae J138
cuuaucuuuaaauucgccaa

SEQ ID NO: 531828 - RNA, 19 nt, Chlamydophila pneumoniae J138
cuuauuauugaauaagcuu

SEQ ID NO: 531829 - RNA, 18 nt, Chlamydophila pneumoniae J138
cuuagaaucuaagauccu

SEQ ID NO: 531830 - RNA, 21 nt, Chlamydophila pneumoniae J138
cuuaguccgguuucuucuacc

SEQ ID NO: 531831 - RNA, 20 nt, Chlamydophila pneumoniae J138
cuuauacccacaaagaucac

SEQ ID NO: 531832 - RNA, 17 nt, Chlamydophila pneumoniae J138
cuuauacccacaaagau

SEQ ID NO: 531833 - RNA, 20 nt, Chlamydophila pneumoniae J138
cuuauaaacuucaaugaaga

SEQ ID NO: 531834 - RNA, 21 nt, Chlamydophila pneumoniae J138
cuuacuaaaggugaaaguaca

SEQ ID NO: 531835 - RNA, 16 nt, Chlamydophila pneumoniae J138
cuuacuaaagaaagag

SEQ ID NO: 531836 - RNA, 20 nt, Chlamydophila pneumoniae J138
cuuacuaaagaaagagucuc

SEQ ID NO: 531837 - RNA, 15 nt, Chlamydophila pneumoniae J138
cuuacuaaaggugaa

SEQ ID NO: 531838 - RNA, 17 nt, Chlamydophila pneumoniae J138
cuuacguaaacuauacu

SEQ ID NO: 531839 - RNA, 14 nt, Chlamydophila pneumoniae J138
cuuacagagaaauu

SEQ ID NO: 531840 - RNA, 13 nt, Chlamydophila pneumoniae J138
cuuaauaaacauc

SEQ ID NO: 531841 - RNA, 22 nt, Chlamydophila pneumoniae J138
cuuaagaguuuuacaucaauga

SEQ ID NO: 531842 - RNA, 22 nt, Chlamydophila pneumoniae J138
cuuaagaauaaaauaggaaagu

SEQ ID NO: 531843 - RNA, 20 nt, Chlamydophila pneumoniae J138
cuuaagaauaaaauaggaaa

SEQ ID NO: 531844 - RNA, 16 nt, Chlamydophila pneumoniae J138
cuuaacuuuaggcccu

SEQ ID NO: 531845 - RNA, 17 nt, Chlamydophila pneumoniae J138
cuuaauaauguuuuaau

SEQ ID NO: 531846 - RNA, 15 nt, Chlamydophila pneumoniae J138
cuuaauaauguuuua

SEQ ID NO: 531847 - RNA, 17 nt, Chlamydophila pneumoniae J138
cuucauaugcucucccg

SEQ ID NO: 531848 - RNA, 15 nt, Chlamydophila pneumoniae J138
cuucauaugcucucc

SEQ ID NO: 531849 - RNA, 16 nt, Chlamydophila pneumoniae J138
cuucauaugcucuccc

SEQ ID NO: 531850 - RNA, 19 nt, Chlamydophila pneumoniae J138
cuucaucaaaacauaauga

SEQ ID NO: 531851 - RNA, 21 nt, Chlamydophila pneumoniae J138
cuucauccgaagacucaaaga

SEQ ID NO: 531852 - RNA, 18 nt, Chlamydophila pneumoniae J138
cuucaucuucuaaauccc

SEQ ID NO: 531853 - RNA, 18 nt, Chlamydophila pneumoniae J138
cuucagagagaacaggag

SEQ ID NO: 531854 - RNA, 11 nt, Chlamydophila pneumoniae J138
cuucagagaga

SEQ ID NO: 531855 - RNA, 16 nt, Chlamydophila pneumoniae J138
cuucagaaucuuugug

SEQ ID NO: 531856 - RNA, 17 nt, Chlamydophila pneumoniae J138
cuucagaaucuuuguga

SEQ ID NO: 531857 - RNA, 18 nt, Chlamydophila pneumoniae J138
cuuauugaagucuucuug

SEQ ID NO: 531858 - RNA, 17 nt, Chlamydophila pneumoniae J138
cuuauugaagucuucuu

SEQ ID NO: 531859 - RNA, 15 nt, Chlamydophila pneumoniae J138
cuuauugcagaaucu

SEQ ID NO: 531860 - RNA, 16 nt, Chlamydophila pneumoniae J138
cuucaagguacuuuau

SEQ ID NO: 531861 - RNA, 19 nt, Chlamydophila pneumoniae J138
cuucaaggcaucuucuuug

SEQ ID NO: 531862 - RNA, 23 nt, Chlamydophila pneumoniae J138
cuucaaggcaucuucuuugccaa

SEQ ID NO: 531863 - RNA, 22 nt, Chlamydophila pneumoniae J138
cuucaaguuucuuuugcaaauc

SEQ ID NO: 531864 - RNA, 15 nt, Chlamydophila pneumoniae J138
cuucaagguacuuua

SEQ ID NO: 531865 - RNA, 13 nt, Chlamydophila pneumoniae J138
cuucaaaugaaau

SEQ ID NO: 531866 - RNA, 18 nt, Chlamydophila pneumoniae J138
cuucacuuauaagcugcu

SEQ ID NO: 531867 - RNA, 14 nt, Chlamydophila pneumoniae J138
cuucacucuuucug

SEQ ID NO: 531868 - RNA, 17 nt, Chlamydophila pneumoniae J138
cuucacaucuuucucua

SEQ ID NO: 531869 - RNA, 14 nt, Chlamydophila pneumoniae J138
cuucacaagaaaac

SEQ ID NO: 531870 - RNA, 13 nt, Chlamydophila pneumoniae J138
cuucaauuucuuc

SEQ ID NO: 531871 - RNA, 21 nt, Chlamydophila pneumoniae J138
cuucaauaggaauuagagaaa

SEQ ID NO: 531872 - RNA, 23 nt, Chlamydophila pneumoniae J138
cuuccacaauguuuagaauuugu

SEQ ID NO: 531873 - RNA, 21 nt, Chlamydophila pneumoniae J138
cuuccacacaacucguuucag

SEQ ID NO: 531874 - RNA, 16 nt, Chlamydophila pneumoniae J138
cuuccaacuucuguau

SEQ ID NO: 531875 - RNA, 11 nt, Chlamydophila pneumoniae J138
aaacuucaaaa

SEQ ID NO: 531876 - RNA, 16 nt, Chlamydophila pneumoniae J138
cuuccaagugcucagu

SEQ ID NO: 531877 - RNA, 15 nt, Chlamydophila pneumoniae J138
aaacuuaguuuugaa

SEQ ID NO: 531878 - RNA, 19 nt, Chlamydophila pneumoniae J138
aaacuuaguuuugaaaaga

SEQ ID NO: 531879 - RNA, 16 nt, Chlamydophila pneumoniae J138
cuuccccaaacaugga

SEQ ID NO: 531880 - RNA, 14 nt, Chlamydophila pneumoniae J138
cuucccagccuuga

SEQ ID NO: 531881 - RNA, 13 nt, Chlamydophila pneumoniae J138
cuuccuuuuucug

SEQ ID NO: 531882 - RNA, 14 nt, Chlamydophila pneumoniae J138
cuuccuucuucuuc

SEQ ID NO: 531883 - RNA, 17 nt, Chlamydophila pneumoniae J138
cuuccuucuucuucaaa

SEQ ID NO: 531884 - RNA, 23 nt, Chlamydophila pneumoniae J138
cuuccucuucaauuucuucauca

SEQ ID NO: 531885 - RNA, 18 nt, Chlamydophila pneumoniae J138
cuuccucuucaauuucuu

SEQ ID NO: 531886 - RNA, 17 nt, Chlamydophila pneumoniae J138
cuucgcaaauauaguuu

SEQ ID NO: 531887 - RNA, 14 nt, Chlamydophila pneumoniae J138
cuucgauuucuagu

SEQ ID NO: 531888 - RNA, 18 nt, Chlamydophila pneumoniae J138
cuucgaugucuuuccagg

SEQ ID NO: 531889 - RNA, 21 nt, Chlamydophila pneumoniae J138
cuucgaugucuuuccaggcaa

SEQ ID NO: 531890 - RNA, 15 nt, Chlamydophila pneumoniae J138
cuucgaugucuuucc

SEQ ID NO: 531891 - RNA, 18 nt, Chlamydophila pneumoniae J138
cuucgaagcggagcaucu

SEQ ID NO: 531892 - RNA, 20 nt, Chlamydophila pneumoniae J138
cuucgaagcggagcaucuuu

SEQ ID NO: 531893 - RNA, 22 nt, Chlamydophila pneumoniae J138
cuucgaagcggagcaucuuuuc

SEQ ID NO: 531894 - RNA, 23 nt, Chlamydophila pneumoniae J138
cguaaugcccgauauccucgaga

SEQ ID NO: 531895 - RNA, 19 nt, Chlamydophila pneumoniae J138
cguaaugcuccacggaaau

SEQ ID NO: 531896 - RNA, 15 nt, Chlamydophila pneumoniae J138
cguaaugcagauagc

SEQ ID NO: 531897 - RNA, 20 nt, Chlamydophila pneumoniae J138
cguacaaauaauuucccuaa

SEQ ID NO: 531898 - RNA, 14 nt, Chlamydophila pneumoniae J138
cguacaggacuguu

SEQ ID NO: 531899 - RNA, 19 nt, Chlamydophila pneumoniae J138
cguaccagcugauauccuu

SEQ ID NO: 531900 - RNA, 21 nt, Chlamydophila pneumoniae J138
cguacgagaucagauguaaag

SEQ ID NO: 531901 - RNA, 20 nt, Chlamydophila pneumoniae J138
cguacgcaaguaaagaaauu

SEQ ID NO: 531902 - RNA, 12 nt, Chlamydophila pneumoniae J138
cguacucuucuu

SEQ ID NO: 531903 - RNA, 19 nt, Chlamydophila pneumoniae J138
cguaggcauacaguagaaa

SEQ ID NO: 531904 - RNA, 16 nt, Chlamydophila pneumoniae J138
cguaggguauccugcu

SEQ ID NO: 531905 - RNA, 22 nt, Chlamydophila pneumoniae J138
cguauagguacgcuuuuucuug

SEQ ID NO: 531906 - RNA, 14 nt, Chlamydophila pneumoniae J138
cguauagauuuucc

SEQ ID NO: 531907 - RNA, 18 nt, Chlamydophila pneumoniae J138
cguagcuugcgagcuucu

SEQ ID NO: 531908 - RNA, 19 nt, Chlamydophila pneumoniae J138
cguagaggacgugcuccca

SEQ ID NO: 531909 - RNA, 21 nt, Chlamydophila pneumoniae J138
cguagacgcucuaaacucucu

SEQ ID NO: 531910 - RNA, 24 nt, Chlamydophila pneumoniae J138
cgucaggaacccuggaugaacauc

SEQ ID NO: 531911 - RNA, 21 nt, Chlamydophila pneumoniae J138
cguauuucacaagcauaaacu

SEQ ID NO: 531912 - RNA, 12 nt, Chlamydophila pneumoniae J138
cgucacugcgca

SEQ ID NO: 531913 - RNA, 16 nt, Chlamydophila pneumoniae J138
cguccacaagcuuuuc

SEQ ID NO: 531914 - RNA, 15 nt, Chlamydophila pneumoniae J138
cgucgcuaaugcuau

SEQ ID NO: 531915 - RNA, 16 nt, Chlamydophila pneumoniae J138
cgucgccccaugaauc

SEQ ID NO: 531916 - RNA, 24 nt, Chlamydophila pneumoniae J138
cgucuaaacgcgagcuauuuuacu

SEQ ID NO: 531917 - RNA, 18 nt, Chlamydophila pneumoniae J138
cgucuaagaaucguucuu

SEQ ID NO: 531918 - RNA, 20 nt, Chlamydophila pneumoniae J138
cgucguaaucuuuuuuaaag

SEQ ID NO: 531919 - RNA, 17 nt, Chlamydophila pneumoniae J138
cgucuuugcuuucuagg

SEQ ID NO: 531920 - RNA, 13 nt, Chlamydophila pneumoniae J138
cgucuuuuaaaga

SEQ ID NO: 531921 - RNA, 14 nt, Chlamydophila pneumoniae J138
cgucuuucaccaac

SEQ ID NO: 531922 - RNA, 20 nt, Chlamydophila pneumoniae J138
cgugacucuuaucuggagau

SEQ ID NO: 531923 - RNA, 21 nt, Chlamydophila pneumoniae J138
cgugcucccauuucuggagaa

SEQ ID NO: 531924 - RNA, 16 nt, Chlamydophila pneumoniae J138
cgugcucucuucuucu

SEQ ID NO: 531925 - RNA, 12 nt, Chlamydophila pneumoniae J138
cgugcucuuaug

SEQ ID NO: 531926 - RNA, 20 nt, Chlamydophila pneumoniae J138
cgugcaggagaacaauauca

SEQ ID NO: 531927 - RNA, 12 nt, Chlamydophila pneumoniae J138
cgugcauaauga

SEQ ID NO: 531928 - RNA, 20 nt, Chlamydophila pneumoniae J138
cgugauugcugucagaacaa

SEQ ID NO: 531929 - RNA, 15 nt, Chlamydophila pneumoniae J138
cuaauuuuagaacuu

SEQ ID NO: 531930 - RNA, 12 nt, Chlamydophila pneumoniae J138
cuaauuucaaua

SEQ ID NO: 531931 - RNA, 11 nt, Chlamydophila pneumoniae J138
cuacaacaguu

SEQ ID NO: 531932 - RNA, 22 nt, Chlamydophila pneumoniae J138
cuacaaaauccacauccuugua

SEQ ID NO: 531933 - RNA, 20 nt, Chlamydophila pneumoniae J138
cuaauguugaguagagaagg

SEQ ID NO: 531934 - RNA, 16 nt, Chlamydophila pneumoniae J138
cuaauuccuucaaagc

SEQ ID NO: 531935 - RNA, 18 nt, Chlamydophila pneumoniae J138
cuaauaagauccaaaaau

SEQ ID NO: 531936 - RNA, 21 nt, Chlamydophila pneumoniae J138
cuaauaccuuucuaagaauuc

SEQ ID NO: 531937 - RNA, 20 nt, Chlamydophila pneumoniae J138
cuaauacacccgcaagcacu

SEQ ID NO: 531938 - RNA, 20 nt, Chlamydophila pneumoniae J138
cuaauaggggaccuaucggg

SEQ ID NO: 531939 - RNA, 12 nt, Chlamydophila pneumoniae J138
cuaauauugauu

SEQ ID NO: 531940 - RNA, 17 nt, Chlamydophila pneumoniae J138
cuaaucaauccaagaau

SEQ ID NO: 531941 - RNA, 20 nt, Chlamydophila pneumoniae J138
cuaaucacagcgucagggau

SEQ ID NO: 531942 - RNA, 23 nt, Chlamydophila pneumoniae J138
cuaaucaccuuaggcuuaauaaa

SEQ ID NO: 531943 - RNA, 13 nt, Chlamydophila pneumoniae J138
cuaaucugauuca

SEQ ID NO: 531944 - RNA, 17 nt, Chlamydophila pneumoniae J138
cuaaucucaggcauucu

SEQ ID NO: 531945 - RNA, 15 nt, Chlamydophila pneumoniae J138
cuaaucucaggcauu

SEQ ID NO: 531946 - RNA, 13 nt, Chlamydophila pneumoniae J138
cuaaugacagcug

SEQ ID NO: 531947 - RNA, 20 nt, Chlamydophila pneumoniae J138
cuaaugacagcugagaaauu

SEQ ID NO: 531948 - RNA, 16 nt, Chlamydophila pneumoniae J138
cuaagcgcucuucaau

SEQ ID NO: 531949 - RNA, 15 nt, Chlamydophila pneumoniae J138
cuaagcgaaccaaag

SEQ ID NO: 531950 - RNA, 17 nt, Chlamydophila pneumoniae J138
cuaagcuauaucucaac

SEQ ID NO: 531951 - RNA, 20 nt, Chlamydophila pneumoniae J138
cuaagcugaaagaacacucc

SEQ ID NO: 531952 - RNA, 16 nt, Chlamydophila pneumoniae J138
cuaagccaaauaccaa

SEQ ID NO: 531953 - RNA, 13 nt, Chlamydophila pneumoniae J138
cuaagcauagccc

SEQ ID NO: 531954 - RNA, 14 nt, Chlamydophila pneumoniae J138
cuaagcaucagaau

SEQ ID NO: 531955 - RNA, 17 nt, Chlamydophila pneumoniae J138
cuaagcagccucuucuc

SEQ ID NO: 531956 - RNA, 21 nt, Chlamydophila pneumoniae J138
cuaagcagccucuucucuacc

SEQ ID NO: 531957 - RNA, 17 nt, Chlamydophila pneumoniae J138
cuaagauuccuaacuuc

SEQ ID NO: 531958 - RNA, 14 nt, Chlamydophila pneumoniae J138
cuaagcaaaaacuu

SEQ ID NO: 531959 - RNA, 13 nt, Chlamydophila pneumoniae J138
cuaagcaaaaacu

SEQ ID NO: 531960 - RNA, 15 nt, Chlamydophila pneumoniae J138
cuaagaaucuauaaa

SEQ ID NO: 531961 - RNA, 13 nt, Chlamydophila pneumoniae J138
cuaagaauaugga

SEQ ID NO: 531962 - RNA, 14 nt, Chlamydophila pneumoniae J138
cuaagaauauggac

SEQ ID NO: 531963 - RNA, 18 nt, Chlamydophila pneumoniae J138
cuaagaagcucacucuuu

SEQ ID NO: 531964 - RNA, 20 nt, Chlamydophila pneumoniae J138
cuaagaaaggcacuccaaaa

SEQ ID NO: 531965 - RNA, 17 nt, Chlamydophila pneumoniae J138
cuaagaagcucacucuu

SEQ ID NO: 531966 - RNA, 18 nt, Chlamydophila pneumoniae J138
cuaagagcgucuucuuuu

SEQ ID NO: 531967 - RNA, 19 nt, Chlamydophila pneumoniae J138
cuaagagcaucuuugggaa

SEQ ID NO: 531968 - RNA, 13 nt, Chlamydophila pneumoniae J138
cuaagacuagauc

SEQ ID NO: 531969 - RNA, 17 nt, Chlamydophila pneumoniae J138
cuaagagcccuugaauc

SEQ ID NO: 531970 - RNA, 21 nt, Chlamydophila pneumoniae J138
cuaagaguuccaagacaauaa

SEQ ID NO: 531971 - RNA, 23 nt, Chlamydophila pneumoniae J138
cuaagaucuuuagaauaagagcu

SEQ ID NO: 531972 - RNA, 15 nt, Chlamydophila pneumoniae J138
cuaagcuuauuucug

SEQ ID NO: 531973 - RNA, 19 nt, Chlamydophila pneumoniae J138
cuaaggacaaaucucccaa

SEQ ID NO: 531974 - RNA, 19 nt, Chlamydophila pneumoniae J138
cuaagggcucuagauauuc

SEQ ID NO: 531975 - RNA, 21 nt, Chlamydophila pneumoniae J138
cuaaguaacaguccucucccu

SEQ ID NO: 531976 - RNA, 19 nt, Chlamydophila pneumoniae J138
cuaaguaacaguccucucc

SEQ ID NO: 531977 - RNA, 18 nt, Chlamydophila pneumoniae J138
cuaagucguuaacaucaa

SEQ ID NO: 531978 - RNA, 18 nt, Chlamydophila pneumoniae J138
cuaaguccaacaucagcu

SEQ ID NO: 531979 - RNA, 20 nt, Chlamydophila pneumoniae J138
cuaaguccaacaucagcugu

SEQ ID NO: 531980 - RNA, 21 nt, Chlamydophila pneumoniae J138
cuaagucuccauaauucugca

SEQ ID NO: 531981 - RNA, 17 nt, Chlamydophila pneumoniae J138
cuaagugauaaggaaga

SEQ ID NO: 531982 - RNA, 18 nt, Chlamydophila pneumoniae J138
cuaaguuuaggcaggaag

SEQ ID NO: 531983 - RNA, 15 nt, Chlamydophila pneumoniae J138
cuaacuuaucgaaug

SEQ ID NO: 531984 - RNA, 17 nt, Chlamydophila pneumoniae J138
cuaacuguacacuuuca

SEQ ID NO: 531985 - RNA, 22 nt, Chlamydophila pneumoniae J138
cuaaacccuguccaacuaaaac

SEQ ID NO: 531986 - RNA, 23 nt, Chlamydophila pneumoniae J138
cuaaaccuucaaugauuucuuua

SEQ ID NO: 531987 - RNA, 15 nt, Chlamydophila pneumoniae J138
cuaaaccuucaauga

SEQ ID NO: 531988 - RNA, 17 nt, Chlamydophila pneumoniae J138
cuaaacgacguuuaauu

SEQ ID NO: 531989 - RNA, 18 nt, Chlamydophila pneumoniae J138
cuaaacgacguuuaauuc

SEQ ID NO: 531990 - RNA, 17 nt, Chlamydophila pneumoniae J138
cuaaacgauuguaauuu

SEQ ID NO: 531991 - RNA, 12 nt, Chlamydophila pneumoniae J138
cuaacaacuccu

SEQ ID NO: 531992 - RNA, 20 nt, Chlamydophila pneumoniae J138
cuaacaacuucugacaauaa

SEQ ID NO: 531993 - RNA, 13 nt, Chlamydophila pneumoniae J138
cuaacacaguccc

SEQ ID NO: 531994 - RNA, 22 nt, Chlamydophila pneumoniae J138
cguucgacaacaacauaaagaa

SEQ ID NO: 531995 - RNA, 22 nt, Chlamydophila pneumoniae J138
cguucaacuuuguuaauagaag

SEQ ID NO: 531996 - RNA, 12 nt, Chlamydophila pneumoniae J138
cguuauauuuuu

SEQ ID NO: 531997 - RNA, 14 nt, Chlamydophila pneumoniae J138
cguuaccaaaaacu

SEQ ID NO: 531998 - RNA, 19 nt, Chlamydophila pneumoniae J138
cguuaauaagaaccucuaa

SEQ ID NO: 531999 - RNA, 12 nt, Chlamydophila pneumoniae J138
cguuuccuccuc

SEQ ID NO: 532000 - RNA, 18 nt, Chlamydophila pneumoniae J138
cguuguaucccugugccu

SEQ ID NO: 532001 - RNA, 20 nt, Chlamydophila pneumoniae J138
cguuuuuaggguucaucuga

SEQ ID NO: 532002 - RNA, 18 nt, Chlamydophila pneumoniae J138
cguuuugcuguggaauuu

SEQ ID NO: 532003 - RNA, 12 nt, Chlamydophila pneumoniae J138
cuaaaaccuaga

SEQ ID NO: 532004 - RNA, 13 nt, Chlamydophila pneumoniae J138
cuaaaaccuagac

SEQ ID NO: 532005 - RNA, 16 nt, Chlamydophila pneumoniae J138
cuaaaacuacaacagg

SEQ ID NO: 532006 - RNA, 13 nt, Chlamydophila pneumoniae J138
cuaaacagggaau

SEQ ID NO: 532007 - RNA, 20 nt, Chlamydophila pneumoniae J138
cuaaacaagaaaaagcaucu

SEQ ID NO: 532008 - RNA, 14 nt, Chlamydophila pneumoniae J138
cuaaaaguuuuuua

SEQ ID NO: 532009 - RNA, 19 nt, Chlamydophila pneumoniae J138
cucauuaagaggagucccc

SEQ ID NO: 532010 - RNA, 15 nt, Chlamydophila pneumoniae J138
cucaggauauauaga

SEQ ID NO: 532011 - RNA, 17 nt, Chlamydophila pneumoniae J138
cucauuccagcaucuuc

SEQ ID NO: 532012 - RNA, 16 nt, Chlamydophila pneumoniae J138
cucauuaucaagaaau

SEQ ID NO: 532013 - RNA, 15 nt, Chlamydophila pneumoniae J138
cuccaagauaauuau

SEQ ID NO: 532014 - RNA, 14 nt, Chlamydophila pneumoniae J138
cuccaagaauagca

SEQ ID NO: 532015 - RNA, 13 nt, Chlamydophila pneumoniae J138
cuccaacuuccau

SEQ ID NO: 532016 - RNA, 23 nt, Chlamydophila pneumoniae J138
cuccaacaccgaaggcacuggca

SEQ ID NO: 532017 - RNA, 19 nt, Chlamydophila pneumoniae J138
cuccaacuaaaccuucaau

SEQ ID NO: 532018 - RNA, 18 nt, Chlamydophila pneumoniae J138
cuccaaaagcucuacaag

SEQ ID NO: 532019 - RNA, 14 nt, Chlamydophila pneumoniae J138
cuccaaaauaaucu

SEQ ID NO: 532020 - RNA, 19 nt, Chlamydophila pneumoniae J138
cuccaaaagaccaaaaaua

SEQ ID NO: 532021 - RNA, 20 nt, Chlamydophila pneumoniae J138
cuccaauuuucuucagcacu

SEQ ID NO: 532022 - RNA, 20 nt, Chlamydophila pneumoniae J138
cuccaaugagcucuauuucu

SEQ ID NO: 532023 - RNA, 19 nt, Chlamydophila pneumoniae J138
cuccaagcuuggucgcaag

SEQ ID NO: 532024 - RNA, 18 nt, Chlamydophila pneumoniae J138
cuccaagucagccaagac

SEQ ID NO: 532025 - RNA, 13 nt, Chlamydophila pneumoniae J138
cuccaccaggagc

SEQ ID NO: 532026 - RNA, 14 nt, Chlamydophila pneumoniae J138
cuccacaugccugc

SEQ ID NO: 532027 - RNA, 22 nt, Chlamydophila pneumoniae J138
cuccaccaggagcuccuccuug

SEQ ID NO: 532028 - RNA, 22 nt, Chlamydophila pneumoniae J138
cuccacgccaaaguacucgcuu

SEQ ID NO: 532029 - RNA, 22 nt, Chlamydophila pneumoniae J138
cuccagaaauuuuuacaaucuc

SEQ ID NO: 532030 - RNA, 14 nt, Chlamydophila pneumoniae J138
cuccagaaauuuuu

SEQ ID NO: 532031 - RNA, 17 nt, Chlamydophila pneumoniae J138
cuccagaaacgcagcuu

SEQ ID NO: 532032 - RNA, 18 nt, Chlamydophila pneumoniae J138
cuccagaaacgcagcuuu

SEQ ID NO: 532033 - RNA, 18 nt, Chlamydophila pneumoniae J138
cuccagaaaguauuccuc

SEQ ID NO: 532034 - RNA, 23 nt, Chlamydophila pneumoniae J138
cuccagcauaaggauucugagaa

SEQ ID NO: 532035 - RNA, 14 nt, Chlamydophila pneumoniae J138
cuccagcagcuucc

SEQ ID NO: 532036 - RNA, 17 nt, Chlamydophila pneumoniae J138
cucccauagcaaugccu

SEQ ID NO: 532037 - RNA, 19 nt, Chlamydophila pneumoniae J138
cucccauguaguaaauucc

SEQ ID NO: 532038 - RNA, 14 nt, Chlamydophila pneumoniae J138
cucccauuucugga

SEQ ID NO: 532039 - RNA, 22 nt, Chlamydophila pneumoniae J138
cucccauuucuggagaaugccc

SEQ ID NO: 532040 - RNA, 14 nt, Chlamydophila pneumoniae J138
cuccauuucuagga

SEQ ID NO: 532041 - RNA, 22 nt, Chlamydophila pneumoniae J138
cuccauuggcauagagccuaga

SEQ ID NO: 532042 - RNA, 17 nt, Chlamydophila pneumoniae J138
cuccauuggcauagagc

SEQ ID NO: 532043 - RNA, 21 nt, Chlamydophila pneumoniae J138
cuccauuucuaggaauugcug

SEQ ID NO: 532044 - RNA, 18 nt, Chlamydophila pneumoniae J138
cuccauuuagaaugaccg

SEQ ID NO: 532045 - RNA, 19 nt, Chlamydophila pneumoniae J138
cucccuagguuuuaucuuu

SEQ ID NO: 532046 - RNA, 20 nt, Chlamydophila pneumoniae J138
cucccuagguuuuaucuuua

SEQ ID NO: 532047 - RNA, 15 nt, Chlamydophila pneumoniae J138
cucccauagcaaugc

SEQ ID NO: 532048 - RNA, 13 nt, Chlamydophila pneumoniae J138
cuccccauacaua

SEQ ID NO: 532049 - RNA, 13 nt, Chlamydophila pneumoniae J138
cuccucaaaagau

SEQ ID NO: 532050 - RNA, 23 nt, Chlamydophila pneumoniae J138
cuccucagaauccauuuugccca

SEQ ID NO: 532051 - RNA, 16 nt, Chlamydophila pneumoniae J138
cuccuaaaccaucacu

SEQ ID NO: 532052 - RNA, 12 nt, Chlamydophila pneumoniae J138
cuccuaaagcau

SEQ ID NO: 532053 - RNA, 23 nt, Chlamydophila pneumoniae J138
cuccuaaggaaaccacguccauu

SEQ ID NO: 532054 - RNA, 20 nt, Chlamydophila pneumoniae J138
cuccguccaguucuucauuc

SEQ ID NO: 532055 - RNA, 21 nt, Chlamydophila pneumoniae J138
cuccgucaagaacaagagcuu

SEQ ID NO: 532056 - RNA, 14 nt, Chlamydophila pneumoniae J138
cuccguagucuuag

SEQ ID NO: 532057 - RNA, 21 nt, Chlamydophila pneumoniae J138
cuccgauagagauucuuucuc

SEQ ID NO: 532058 - RNA, 15 nt, Chlamydophila pneumoniae J138
cuccgaggcuucuga

SEQ ID NO: 532059 - RNA, 13 nt, Chlamydophila pneumoniae J138
cuccgaggaggga

SEQ ID NO: 532060 - RNA, 20 nt, Chlamydophila pneumoniae J138
cuccgaauggagaaggacac

SEQ ID NO: 532061 - RNA, 15 nt, Chlamydophila pneumoniae J138
cuccgaagacuacca

SEQ ID NO: 532062 - RNA, 19 nt, Chlamydophila pneumoniae J138
cuccuccaaugagcucuau

SEQ ID NO: 532063 - RNA, 16 nt, Chlamydophila pneumoniae J138
cuccuccaaucugcug

SEQ ID NO: 532064 - RNA, 17 nt, Chlamydophila pneumoniae J138
cuccuccaaucugcuga

SEQ ID NO: 532065 - RNA, 13 nt, Chlamydophila pneumoniae J138
cuccucaucagaa

SEQ ID NO: 532066 - RNA, 22 nt, Chlamydophila pneumoniae J138
cuccucaucagaagccaccaaa

SEQ ID NO: 532067 - RNA, 19 nt, Chlamydophila pneumoniae J138
cucgaacaggagagagaag

SEQ ID NO: 532068 - RNA, 22 nt, Chlamydophila pneumoniae J138
cucgauuaucgggguuguauuu

SEQ ID NO: 532069 - RNA, 14 nt, Chlamydophila pneumoniae J138
cucgauuauuucuu

SEQ ID NO: 532070 - RNA, 19 nt, Chlamydophila pneumoniae J138
cucgcaauccaggaauaga

SEQ ID NO: 532071 - RNA, 22 nt, Chlamydophila pneumoniae J138
cucgcaguccuugagcuaacga

SEQ ID NO: 532072 - RNA, 22 nt, Chlamydophila pneumoniae J138
cucuaaggacaaaucucccaaa

SEQ ID NO: 532073 - RNA, 18 nt, Chlamydophila pneumoniae J138
cucuaaguccaacaucag

SEQ ID NO: 532074 - RNA, 19 nt, Chlamydophila pneumoniae J138
cucuaagcugugcauuuuc

SEQ ID NO: 532075 - RNA, 21 nt, Chlamydophila pneumoniae J138
cucuaagcugugcauuuucuu

SEQ ID NO: 532076 - RNA, 18 nt, Chlamydophila pneumoniae J138
cucuaagcagccucuucu

SEQ ID NO: 532077 - RNA, 17 nt, Chlamydophila pneumoniae J138
cucuaagcgaaacauua

SEQ ID NO: 532078 - RNA, 21 nt, Chlamydophila pneumoniae J138
cucuaaggacaaaucucccaa

SEQ ID NO: 532079 - RNA, 18 nt, Chlamydophila pneumoniae J138
cucuaaacucucuuccuu

SEQ ID NO: 532080 - RNA, 16 nt, Chlamydophila pneumoniae J138
cucuaaacauaaagac

SEQ ID NO: 532081 - RNA, 14 nt, Chlamydophila pneumoniae J138
cucuaaaaaagaua

SEQ ID NO: 532082 - RNA, 23 nt, Chlamydophila pneumoniae J138
cucgugcaaggccuaaucuugua

SEQ ID NO: 532083 - RNA, 15 nt, Chlamydophila pneumoniae J138
cucgucugauagagg

SEQ ID NO: 532084 - RNA, 19 nt, Chlamydophila pneumoniae J138
cuauggaagauaaacauac

SEQ ID NO: 532085 - RNA, 22 nt, Chlamydophila pneumoniae J138
cuauggcagcaggaauaaucaa

SEQ ID NO: 532086 - RNA, 13 nt, Chlamydophila pneumoniae J138
cuaugacuucuug

SEQ ID NO: 532087 - RNA, 23 nt, Chlamydophila pneumoniae J138
cuaugaggaacugggcauagugg

SEQ ID NO: 532088 - RNA, 14 nt, Chlamydophila pneumoniae J138
cuaugggaggaauu

SEQ ID NO: 532089 - RNA, 15 nt, Chlamydophila pneumoniae J138
cuaugguaaucaccu

SEQ ID NO: 532090 - RNA, 16 nt, Chlamydophila pneumoniae J138
cuauuagauuuccucc

SEQ ID NO: 532091 - RNA, 14 nt, Chlamydophila pneumoniae J138
cuauggaaagaguc

SEQ ID NO: 532092 - RNA, 14 nt, Chlamydophila pneumoniae J138
cuauuauuuuaaag

SEQ ID NO: 532093 - RNA, 15 nt, Chlamydophila pneumoniae J138
cuauuauuuuaaagu

SEQ ID NO: 532094 - RNA, 18 nt, Chlamydophila pneumoniae J138
cuauuagcgcggucacuu

SEQ ID NO: 532095 - RNA, 20 nt, Chlamydophila pneumoniae J138
cuauuagcgcggucacuuca

SEQ ID NO: 532096 - RNA, 21 nt, Chlamydophila pneumoniae J138
cuauucccgacucggagacca

SEQ ID NO: 532097 - RNA, 22 nt, Chlamydophila pneumoniae J138
cuauuccauaaaaauguaauuu

SEQ ID NO: 532098 - RNA, 20 nt, Chlamydophila pneumoniae J138
cuauucccgacucggagacc

SEQ ID NO: 532099 - RNA, 12 nt, Chlamydophila pneumoniae J138
cuaucuucaagu

SEQ ID NO: 532100 - RNA, 23 nt, Chlamydophila pneumoniae J138
cuaucugccauaggauccaggag

SEQ ID NO: 532101 - RNA, 18 nt, Chlamydophila pneumoniae J138
cuaucuuuauuuaaauaa

SEQ ID NO: 532102 - RNA, 22 nt, Chlamydophila pneumoniae J138
cuaucuuugguaugcagaguuu

SEQ ID NO: 532103 - RNA, 17 nt, Chlamydophila pneumoniae J138
cuauagauuuaagaguc

SEQ ID NO: 532104 - RNA, 16 nt, Chlamydophila pneumoniae J138
cuauagcaauccauag

SEQ ID NO: 532105 - RNA, 15 nt, Chlamydophila pneumoniae J138
cuauagaucuugaaa

SEQ ID NO: 532106 - RNA, 19 nt, Chlamydophila pneumoniae J138
cuauagaugccauaagucc

SEQ ID NO: 532107 - RNA, 12 nt, Chlamydophila pneumoniae J138
cuauagagacac

SEQ ID NO: 532108 - RNA, 16 nt, Chlamydophila pneumoniae J138
cuauagaacuaacugu

SEQ ID NO: 532109 - RNA, 19 nt, Chlamydophila pneumoniae J138
cuauagaaaaggaugcauc

SEQ ID NO: 532110 - RNA, 19 nt, Chlamydophila pneumoniae J138
cuauagccucuucuacacc

SEQ ID NO: 532111 - RNA, 13 nt, Chlamydophila pneumoniae J138
cuaucuccagaaa

SEQ ID NO: 532112 - RNA, 20 nt, Chlamydophila pneumoniae J138
cuauuucugccuuaugcuca

SEQ ID NO: 532113 - RNA, 12 nt, Chlamydophila pneumoniae J138
cuauuuuuuaag

SEQ ID NO: 532114 - RNA, 14 nt, Chlamydophila pneumoniae J138
cuauuuuugaggaa

SEQ ID NO: 532115 - RNA, 20 nt, Chlamydophila pneumoniae J138
cuauugcugcggccacauua

SEQ ID NO: 532116 - RNA, 22 nt, Chlamydophila pneumoniae J138
cuauucugauuagagccccaac

SEQ ID NO: 532117 - RNA, 14 nt, Chlamydophila pneumoniae J138
cuauuuaaggacgu

SEQ ID NO: 532118 - RNA, 17 nt, Chlamydophila pneumoniae J138
cuauuuacugaaacauu

SEQ ID NO: 532119 - RNA, 15 nt, Chlamydophila pneumoniae J138
cuauuucauauaaag

SEQ ID NO: 532120 - RNA, 15 nt, Chlamydophila pneumoniae J138
cucacaaacaacaga

SEQ ID NO: 532121 - RNA, 16 nt, Chlamydophila pneumoniae J138
cucacaaaagucucua

SEQ ID NO: 532122 - RNA, 17 nt, Chlamydophila pneumoniae J138
cucacaaacaacagaaa

SEQ ID NO: 532123 - RNA, 19 nt, Chlamydophila pneumoniae J138
cucaccagaagcaacuaaa

SEQ ID NO: 532124 - RNA, 23 nt, Chlamydophila pneumoniae J138
cucaccacggaagauaugucgcu

SEQ ID NO: 532125 - RNA, 16 nt, Chlamydophila pneumoniae J138
cucaccagaagcaacu

SEQ ID NO: 532126 - RNA, 13 nt, Chlamydophila pneumoniae J138
cucaaagaauacu

SEQ ID NO: 532127 - RNA, 22 nt, Chlamydophila pneumoniae J138
cucaggaaagguaguuuucuuc

SEQ ID NO: 532128 - RNA, 22 nt, Chlamydophila pneumoniae J138
cucacuguuuuucguaagcuga

SEQ ID NO: 532129 - RNA, 14 nt, Chlamydophila pneumoniae J138
cucacgggauagcc

SEQ ID NO: 532130 - RNA, 21 nt, Chlamydophila pneumoniae J138
cucagaaaaaucuaacacagu

SEQ ID NO: 532131 - RNA, 23 nt, Chlamydophila pneumoniae J138
cucagaaaggagauccacagacu

SEQ ID NO: 532132 - RNA, 24 nt, Chlamydophila pneumoniae J138
cuauacucucuguagcacuucuca

SEQ ID NO: 532133 - RNA, 20 nt, Chlamydophila pneumoniae J138
cuauaagacauuauagaggu

SEQ ID NO: 532134 - RNA, 18 nt, Chlamydophila pneumoniae J138
cuauaagagguucucuua

SEQ ID NO: 532135 - RNA, 12 nt, Chlamydophila pneumoniae J138
cuauaaaauaaa

SEQ ID NO: 532136 - RNA, 16 nt, Chlamydophila pneumoniae J138
cuaguuuuucuuuaga

SEQ ID NO: 532137 - RNA, 13 nt, Chlamydophila pneumoniae J138
cuagucuuucaac

SEQ ID NO: 532138 - RNA, 21 nt, Chlamydophila pneumoniae J138
cuagucuuucaaccuccgcuc

SEQ ID NO: 532139 - RNA, 15 nt, Chlamydophila pneumoniae J138
cuaguccuguacauc

SEQ ID NO: 532140 - RNA, 20 nt, Chlamydophila pneumoniae J138
cuagugaagcugcuucuuca

SEQ ID NO: 532141 - RNA, 21 nt, Chlamydophila pneumoniae J138
cuaggaacucuuuaaaagggc

SEQ ID NO: 532142 - RNA, 15 nt, Chlamydophila pneumoniae J138
cuagcuuuuuuuaug

SEQ ID NO: 532143 - RNA, 12 nt, Chlamydophila pneumoniae J138
cuaggagagcua

SEQ ID NO: 532144 - RNA, 12 nt, Chlamydophila pneumoniae J138
cuaggauaucau

SEQ ID NO: 532145 - RNA, 23 nt, Chlamydophila pneumoniae J138
cuaggacguaauuacgcucucca

SEQ ID NO: 532146 - RNA, 21 nt, Chlamydophila pneumoniae J138
cuacggaugggcacucuucca

SEQ ID NO: 532147 - RNA, 20 nt, Chlamydophila pneumoniae J138
cuacggaacggacaaugcua

SEQ ID NO: 532148 - RNA, 19 nt, Chlamydophila pneumoniae J138
cuacgguuuucugccuuac

SEQ ID NO: 532149 - RNA, 16 nt, Chlamydophila pneumoniae J138
cuagaaacugcuccug

SEQ ID NO: 532150 - RNA, 21 nt, Chlamydophila pneumoniae J138
cuagaaaagauucuaaaucaa

SEQ ID NO: 532151 - RNA, 21 nt, Chlamydophila pneumoniae J138
cuagccaucgcgaagcuuucc

SEQ ID NO: 532152 - RNA, 16 nt, Chlamydophila pneumoniae J138
cuagcaguugcaauac

SEQ ID NO: 532153 - RNA, 14 nt, Chlamydophila pneumoniae J138
cuagagauuuuucu

SEQ ID NO: 532154 - RNA, 17 nt, Chlamydophila pneumoniae J138
cuagagauuuuucuagg

SEQ ID NO: 532155 - RNA, 19 nt, Chlamydophila pneumoniae J138
cuagagaucuuuuuauuaa

SEQ ID NO: 532156 - RNA, 18 nt, Chlamydophila pneumoniae J138
cuagagaaccuccuauuc

SEQ ID NO: 532157 - RNA, 22 nt, Chlamydophila pneumoniae J138
cuagaagaugaguguucucaau

SEQ ID NO: 532158 - RNA, 16 nt, Chlamydophila pneumoniae J138
cuagacacgccuccuu

SEQ ID NO: 532159 - RNA, 22 nt, Chlamydophila pneumoniae J138
cuagaaacugcuccugaagcug

SEQ ID NO: 532160 - RNA, 19 nt, Chlamydophila pneumoniae J138
cuagaaaaucucuaagaau

SEQ ID NO: 532161 - RNA, 20 nt, Chlamydophila pneumoniae J138
cuagaagacauucauuuuuu

SEQ ID NO: 532162 - RNA, 23 nt, Chlamydophila pneumoniae J138
cuagaagagcgucguaacaauuc

SEQ ID NO: 532163 - RNA, 19 nt, Chlamydophila pneumoniae J138
cuagaacuugggaugcuac

SEQ ID NO: 532164 - RNA, 16 nt, Chlamydophila pneumoniae J138
cuagaacuugggaugc

SEQ ID NO: 532165 - RNA, 13 nt, Chlamydophila pneumoniae J138
cuaccgaacagag

SEQ ID NO: 532166 - RNA, 15 nt, Chlamydophila pneumoniae J138
cuacccucaucaucc

SEQ ID NO: 532167 - RNA, 19 nt, Chlamydophila pneumoniae J138
cuaccuguagcuacagauu

SEQ ID NO: 532168 - RNA, 14 nt, Chlamydophila pneumoniae J138
cuaccauuaaggaa

SEQ ID NO: 532169 - RNA, 15 nt, Chlamydophila pneumoniae J138
cuaccauuaaggaau

SEQ ID NO: 532170 - RNA, 20 nt, Chlamydophila pneumoniae J138
cuaccccacgcuaaacuaaa

SEQ ID NO: 532171 - RNA, 19 nt, Chlamydophila pneumoniae J138
cuacccccagcuucuucaa

SEQ ID NO: 532172 - RNA, 22 nt, Chlamydophila pneumoniae J138
cuaccaaagucgauacccaaag

SEQ ID NO: 532173 - RNA, 13 nt, Chlamydophila pneumoniae J138
cuaccaauucucu

SEQ ID NO: 532174 - RNA, 18 nt, Chlamydophila pneumoniae J138
cuacagcuaacgaaguga

SEQ ID NO: 532175 - RNA, 13 nt, Chlamydophila pneumoniae J138
cuacagcuucauu

SEQ ID NO: 532176 - RNA, 12 nt, Chlamydophila pneumoniae J138
cuacagcagaaa

SEQ ID NO: 532177 - RNA, 22 nt, Chlamydophila pneumoniae J138
cuacagaucaggauucuaaaaa

SEQ ID NO: 532178 - RNA, 13 nt, Chlamydophila pneumoniae J138
cuacagauaugcu

SEQ ID NO: 532179 - RNA, 16 nt, Chlamydophila pneumoniae J138
cuacauaaaaugagcu

SEQ ID NO: 532180 - RNA, 14 nt, Chlamydophila pneumoniae J138
cuacagcuucuuuu

SEQ ID NO: 532181 - RNA, 20 nt, Chlamydophila pneumoniae J138
cuacauauucguguaaaucu

SEQ ID NO: 532182 - RNA, 19 nt, Chlamydophila pneumoniae J138
cuacauaguuuuuauuuuu

SEQ ID NO: 532183 - RNA, 15 nt, Chlamydophila pneumoniae J138
cuacauucuaacgcu

SEQ ID NO: 532184 - RNA, 15 nt, Chlamydophila pneumoniae J138
cuacaucuuguucug

SEQ ID NO: 532185 - RNA, 13 nt, Chlamydophila pneumoniae J138
cuacaugaggaua

SEQ ID NO: 532186 - RNA, 13 nt, Chlamydophila pneumoniae J138
cuacaaguugaga

SEQ ID NO: 532187 - RNA, 19 nt, Chlamydophila pneumoniae J138
cuacaaucccgaguccuaa

SEQ ID NO: 532188 - RNA, 14 nt, Chlamydophila pneumoniae J138
cuacaauuuccuug

SEQ ID NO: 532189 - RNA, 23 nt, Chlamydophila pneumoniae J138
cuacacagacuugaggaaucuga

SEQ ID NO: 532190 - RNA, 20 nt, Chlamydophila pneumoniae J138
cuacacacaugacaaauaaa

SEQ ID NO: 532191 - RNA, 14 nt, Chlamydophila pneumoniae J138
cuacaccauagaac

SEQ ID NO: 532192 - RNA, 22 nt, Chlamydophila pneumoniae J138
cuacacaguagccuucuucucg

SEQ ID NO: 532193 - RNA, 23 nt, Chlamydophila pneumoniae J138
cuacagaaagagcuaaagaaacu

SEQ ID NO: 532194 - RNA, 20 nt, Chlamydophila pneumoniae J138
cuacagagggcuucauuccu

SEQ ID NO: 532195 - RNA, 17 nt, Chlamydophila pneumoniae J138
cuacagagggcuucauu

SEQ ID NO: 532196 - RNA, 19 nt, Chlamydophila pneumoniae J138
cuacagagggcuucauucc

SEQ ID NO: 532197 - RNA, 21 nt, Chlamydophila pneumoniae J138
cuacagaggaaucuauccuuc

SEQ ID NO: 532198 - RNA, 17 nt, Chlamydophila pneumoniae J138
cuacagagggaauuuca

SEQ ID NO: 532199 - RNA, 15 nt, Chlamydophila pneumoniae J138
cuacagaggaaucua

SEQ ID NO: 532200 - RNA, 19 nt, Chlamydophila pneumoniae J138
cuacacgcuauagcaacag

SEQ ID NO: 532201 - RNA, 22 nt, Chlamydophila pneumoniae J138
aaaaaaagaccaaauaauuaaa

SEQ ID NO: 532202 - RNA, 18 nt, Chlamydophila pneumoniae J138
aaaaaagaccaaauaauu

SEQ ID NO: 532203 - RNA, 11 nt, Chlamydophila pneumoniae J138
aaaaaagagac

SEQ ID NO: 532204 - RNA, 18 nt, Chlamydophila pneumoniae J138
aaaaaagcuagucuuucu

SEQ ID NO: 532205 - RNA, 23 nt, Chlamydophila pneumoniae J138
aaaaaaugcuccugcaaaaaacc

SEQ ID NO: 532206 - RNA, 11 nt, Chlamydophila pneumoniae J138
aaaaaagccaa

SEQ ID NO: 532207 - RNA, 14 nt, Chlamydophila pneumoniae J138
aaaaaauuuuauag

SEQ ID NO: 532208 - RNA, 17 nt, Chlamydophila pneumoniae J138
aaaacccucaaagaaua

SEQ ID NO: 532209 - RNA, 22 nt, Chlamydophila pneumoniae J138
aaaacccauguuucuuccugaa

SEQ ID NO: 532210 - RNA, 15 nt, Chlamydophila pneumoniae J138
aaaacccauguuucu

SEQ ID NO: 532211 - RNA, 13 nt, Chlamydophila pneumoniae J138
aaaaccacagaau

SEQ ID NO: 532212 - RNA, 15 nt, Chlamydophila pneumoniae J138
aaaaaugcuccugca

SEQ ID NO: 532213 - RNA, 22 nt, Chlamydophila pneumoniae J138
aaaaaugccugaaaauucgaau

SEQ ID NO: 532214 - RNA, 20 nt, Chlamydophila pneumoniae J138
aaaaaucuucuuagccaaaa

SEQ ID NO: 532215 - RNA, 13 nt, Chlamydophila pneumoniae J138
aaaaauucccaua

SEQ ID NO: 532216 - RNA, 16 nt, Chlamydophila pneumoniae J138
aaaaauguaauuuuuu

SEQ ID NO: 532217 - RNA, 14 nt, Chlamydophila pneumoniae J138
aaaaauuuaaaaga

SEQ ID NO: 532218 - RNA, 22 nt, Chlamydophila pneumoniae J138
aaaaauucuucgagagcaugca

SEQ ID NO: 532219 - RNA, 21 nt, Chlamydophila pneumoniae J138
aaaaauucucauaaccuaagg

SEQ ID NO: 532220 - RNA, 19 nt, Chlamydophila pneumoniae J138
aaaaaguugaggaaaggag

SEQ ID NO: 532221 - RNA, 21 nt, Chlamydophila pneumoniae J138
aaaaaguuccauagaguaucu

SEQ ID NO: 532222 - RNA, 13 nt, Chlamydophila pneumoniae J138
aaaaauaucuccg

SEQ ID NO: 532223 - RNA, 22 nt, Chlamydophila pneumoniae J138
aaaaacacugcgcaaagaacuc

SEQ ID NO: 532224 - RNA, 17 nt, Chlamydophila pneumoniae J138
aaaaacgguaaauaucu

SEQ ID NO: 532225 - RNA, 16 nt, Chlamydophila pneumoniae J138
aaaaacgguaaauauc

SEQ ID NO: 532226 - RNA, 18 nt, Chlamydophila pneumoniae J138
aaaaacuguguuuucuag

SEQ ID NO: 532227 - RNA, 19 nt, Chlamydophila pneumoniae J138
aaaaacugcgcuagcucca

SEQ ID NO: 532228 - RNA, 17 nt, Chlamydophila pneumoniae J138
aaaaacucuucaucgau

SEQ ID NO: 532229 - RNA, 21 nt, Chlamydophila pneumoniae J138
aaaaacugcaaaaagaucguu

SEQ ID NO: 532230 - RNA, 13 nt, Chlamydophila pneumoniae J138
aaaaaguaacuau

SEQ ID NO: 532231 - RNA, 18 nt, Chlamydophila pneumoniae J138
aaaaagggaucuccuuca

SEQ ID NO: 532232 - RNA, 12 nt, Chlamydophila pneumoniae J138
aaaaagcuaaac

SEQ ID NO: 532233 - RNA, 18 nt, Chlamydophila pneumoniae J138
aaaaagcuuuuuucucuu

SEQ ID NO: 532234 - RNA, 20 nt, Chlamydophila pneumoniae J138
aaaaagcuuuuuucucuugc

SEQ ID NO: 532235 - RNA, 19 nt, Chlamydophila pneumoniae J138
aaaaagcuucuuucuuacu

SEQ ID NO: 532236 - RNA, 21 nt, Chlamydophila pneumoniae J138
aaaaacuucccaucuuguucu

SEQ ID NO: 532237 - RNA, 16 nt, Chlamydophila pneumoniae J138
aaaaacuguguuuucu

SEQ ID NO: 532238 - RNA, 12 nt, Chlamydophila pneumoniae J138
aaaaagaaagag

SEQ ID NO: 532239 - RNA, 12 nt, Chlamydophila pneumoniae J138
aaaaagaaaaga

SEQ ID NO: 532240 - RNA, 19 nt, Chlamydophila pneumoniae J138
aaaaugauaccaccuaaaa

SEQ ID NO: 532241 - RNA, 17 nt, Chlamydophila pneumoniae J138
aaaaugggauccugcaa

SEQ ID NO: 532242 - RNA, 14 nt, Chlamydophila pneumoniae J138
aaaaugaaagaaac

SEQ ID NO: 532243 - RNA, 17 nt, Chlamydophila pneumoniae J138
aaaaugaggacacaacu

SEQ ID NO: 532244 - RNA, 19 nt, Chlamydophila pneumoniae J138
aaaauuaaagugaaagcaa

SEQ ID NO: 532245 - RNA, 20 nt, Chlamydophila pneumoniae J138
aaaauucucagauugcuuga

SEQ ID NO: 532246 - RNA, 19 nt, Chlamydophila pneumoniae J138
aaaauucuaaugguuuccc

SEQ ID NO: 532247 - RNA, 14 nt, Chlamydophila pneumoniae J138
aaaauucuuaaaac

SEQ ID NO: 532248 - RNA, 15 nt, Chlamydophila pneumoniae J138
aaaauucuuaaaacu

SEQ ID NO: 532249 - RNA, 16 nt, Chlamydophila pneumoniae J138
aaaaucugcagcagau

SEQ ID NO: 532250 - RNA, 22 nt, Chlamydophila pneumoniae J138
aaaaucuucuuagccaaaauuu

SEQ ID NO: 532251 - RNA, 15 nt, Chlamydophila pneumoniae J138
aaaauaucacauucc

SEQ ID NO: 532252 - RNA, 15 nt, Chlamydophila pneumoniae J138
aaaauaucauucacu

SEQ ID NO: 532253 - RNA, 18 nt, Chlamydophila pneumoniae J138
aaaauaucauucacuauu

SEQ ID NO: 532254 - RNA, 18 nt, Chlamydophila pneumoniae J138
aaaauacagccagcagaa

SEQ ID NO: 532255 - RNA, 17 nt, Chlamydophila pneumoniae J138
aaaauacagccagcaga

SEQ ID NO: 532256 - RNA, 15 nt, Chlamydophila pneumoniae J138
aaaauauccuaaaua

SEQ ID NO: 532257 - RNA, 21 nt, Chlamydophila pneumoniae J138
aaaagucucuagggaaaggag

SEQ ID NO: 532258 - RNA, 14 nt, Chlamydophila pneumoniae J138
aaaagucucuaggg

SEQ ID NO: 532259 - RNA, 14 nt, Chlamydophila pneumoniae J138
aaaaguugucuuug

SEQ ID NO: 532260 - RNA, 13 nt, Chlamydophila pneumoniae J138
aaaaguuucaauc

SEQ ID NO: 532261 - RNA, 17 nt, Chlamydophila pneumoniae J138
aaaauaaagaucuucau

SEQ ID NO: 532262 - RNA, 21 nt, Chlamydophila pneumoniae J138
aaaaggcccccuacagcagaa

SEQ ID NO: 532263 - RNA, 17 nt, Chlamydophila pneumoniae J138
aaaaggaggauguuccu

SEQ ID NO: 532264 - RNA, 21 nt, Chlamydophila pneumoniae J138
aaaaggaugcaucucuuaaaa

SEQ ID NO: 532265 - RNA, 17 nt, Chlamydophila pneumoniae J138
aaaaggauucuaugagg

SEQ ID NO: 532266 - RNA, 15 nt, Chlamydophila pneumoniae J138
aaaagucaugaggac

SEQ ID NO: 532267 - RNA, 19 nt, Chlamydophila pneumoniae J138
aaaagcgcaaaucuuacau

SEQ ID NO: 532268 - RNA, 13 nt, Chlamydophila pneumoniae J138
aaaacgcuauugu

SEQ ID NO: 532269 - RNA, 18 nt, Chlamydophila pneumoniae J138
aaaacgccauacugauau

SEQ ID NO: 532270 - RNA, 23 nt, Chlamydophila pneumoniae J138
aaaagcuuaucccauaaauguau

SEQ ID NO: 532271 - RNA, 20 nt, Chlamydophila pneumoniae J138
aaaagcuuaucccauaaaug

SEQ ID NO: 532272 - RNA, 18 nt, Chlamydophila pneumoniae J138
aaaagcuuuuuucucuug

SEQ ID NO: 532273 - RNA, 21 nt, Chlamydophila pneumoniae J138
aaaagcuucuuucuuacuaaa

SEQ ID NO: 532274 - RNA, 12 nt, Chlamydophila pneumoniae J138
aaaagcuaaaca

SEQ ID NO: 532275 - RNA, 16 nt, Chlamydophila pneumoniae J138
aaaaacuucuaacugu

SEQ ID NO: 532276 - RNA, 17 nt, Chlamydophila pneumoniae J138
aaaaagaacauaagaua

SEQ ID NO: 532277 - RNA, 17 nt, Chlamydophila pneumoniae J138
aaacacaaauagcaaga

SEQ ID NO: 532278 - RNA, 11 nt, Chlamydophila pneumoniae J138
aaacacaaaua

SEQ ID NO: 532279 - RNA, 20 nt, Chlamydophila pneumoniae J138
aaacacaaauagcaagagcu

SEQ ID NO: 532280 - RNA, 16 nt, Chlamydophila pneumoniae J138
aaacacucaugaaagu

SEQ ID NO: 532281 - RNA, 18 nt, Chlamydophila pneumoniae J138
aaacacugcgcaaagaac

SEQ ID NO: 532282 - RNA, 19 nt, Chlamydophila pneumoniae J138
aaacacugcgcaaagaacu

SEQ ID NO: 532283 - RNA, 18 nt, Chlamydophila pneumoniae J138
aaaauugcauuuaaacua

SEQ ID NO: 532284 - RNA, 21 nt, Chlamydophila pneumoniae J138
aaaauugcauuuaaacuaaga

SEQ ID NO: 532285 - RNA, 22 nt, Chlamydophila pneumoniae J138
aaaauugauaguguucgagcau

SEQ ID NO: 532286 - RNA, 21 nt, Chlamydophila pneumoniae J138
aaaauugaacguagcuacaaa

SEQ ID NO: 532287 - RNA, 22 nt, Chlamydophila pneumoniae J138
aaacaaucuaaagguuuuaaau

SEQ ID NO: 532288 - RNA, 18 nt, Chlamydophila pneumoniae J138
aaacaaucuaaagguuuu

SEQ ID NO: 532289 - RNA, 17 nt, Chlamydophila pneumoniae J138
aaacaaucuaaagguuu

SEQ ID NO: 532290 - RNA, 23 nt, Chlamydophila pneumoniae J138
aaacagcaucaggauucucucug

SEQ ID NO: 532291 - RNA, 15 nt, Chlamydophila pneumoniae J138
aaacagcaucaggau

SEQ ID NO: 532292 - RNA, 22 nt, Chlamydophila pneumoniae J138
aaacacuuuggauaggauagga

SEQ ID NO: 532293 - RNA, 14 nt, Chlamydophila pneumoniae J138
aaacagaaauugcu

SEQ ID NO: 532294 - RNA, 21 nt, Chlamydophila pneumoniae J138
aaacagauuuuucaagaacuc

SEQ ID NO: 532295 - RNA, 18 nt, Chlamydophila pneumoniae J138
aaacagauuuuucaagaa

SEQ ID NO: 532296 - RNA, 16 nt, Chlamydophila pneumoniae J138
aaacaggaauaggcuc

SEQ ID NO: 532297 - RNA, 19 nt, Chlamydophila pneumoniae J138
aaacaguaggcgaugcaaa

SEQ ID NO: 532298 - RNA, 15 nt, Chlamydophila pneumoniae J138
aaacaucacucagga

SEQ ID NO: 532299 - RNA, 22 nt, Chlamydophila pneumoniae J138
aaacccugggcucacucuaagc

SEQ ID NO: 532300 - RNA, 17 nt, Chlamydophila pneumoniae J138
aaacccucaaagaauac

SEQ ID NO: 532301 - RNA, 19 nt, Chlamydophila pneumoniae J138
aaacccucuccagaagucg

SEQ ID NO: 532302 - RNA, 14 nt, Chlamydophila pneumoniae J138
aaacccauguuucu

SEQ ID NO: 532303 - RNA, 16 nt, Chlamydophila pneumoniae J138
aaaccaggaacaaagg

SEQ ID NO: 532304 - RNA, 13 nt, Chlamydophila pneumoniae J138
aaaccaggaacaa

SEQ ID NO: 532305 - RNA, 17 nt, Chlamydophila pneumoniae J138
aaaccauaagaaugguu

SEQ ID NO: 532306 - RNA, 17 nt, Chlamydophila pneumoniae J138
aaaccaucacuuccugu

SEQ ID NO: 532307 - RNA, 15 nt, Chlamydophila pneumoniae J138
aaacaucagcaacau

SEQ ID NO: 532308 - RNA, 16 nt, Chlamydophila pneumoniae J138
aaacaucgcagcagga

SEQ ID NO: 532309 - RNA, 15 nt, Chlamydophila pneumoniae J138
aaacauuagucaaug

SEQ ID NO: 532310 - RNA, 13 nt, Chlamydophila pneumoniae J138
aaacauuuaaguc

SEQ ID NO: 532311 - RNA, 17 nt, Chlamydophila pneumoniae J138
aaaccaaaaaaguaacu

SEQ ID NO: 532312 - RNA, 14 nt, Chlamydophila pneumoniae J138
aaaccacuucucug

SEQ ID NO: 532313 - RNA, 23 nt, Chlamydophila pneumoniae J138
aaauccacauccuuguagaacuu

SEQ ID NO: 532314 - RNA, 16 nt, Chlamydophila pneumoniae J138
aaaucccgccuuucua

SEQ ID NO: 532315 - RNA, 22 nt, Chlamydophila pneumoniae J138
aaauauuaacccaccagaagga

SEQ ID NO: 532316 - RNA, 13 nt, Chlamydophila pneumoniae J138
aaauccgauaaga

SEQ ID NO: 532317 - RNA, 20 nt, Chlamydophila pneumoniae J138
aaaucccugaugcaguaauu

SEQ ID NO: 532318 - RNA, 14 nt, Chlamydophila pneumoniae J138
aaauccuaaaaagg

SEQ ID NO: 532319 - RNA, 15 nt, Chlamydophila pneumoniae J138
aaaucgacaggggag

SEQ ID NO: 532320 - RNA, 23 nt, Chlamydophila pneumoniae J138
aaauccugggcaaugaucaaaaa

SEQ ID NO: 532321 - RNA, 23 nt, Chlamydophila pneumoniae J138
aaauccugcucguaaaucuggaa

SEQ ID NO: 532322 - RNA, 18 nt, Chlamydophila pneumoniae J138
aaaucuucuggagggagu

SEQ ID NO: 532323 - RNA, 17 nt, Chlamydophila pneumoniae J138
aaaucguacuucacuuc

SEQ ID NO: 532324 - RNA, 22 nt, Chlamydophila pneumoniae J138
aaaucucgagcuaccuaggguc

SEQ ID NO: 532325 - RNA, 23 nt, Chlamydophila pneumoniae J138
aaaucucgagcuaccuagggucu

SEQ ID NO: 532326 - RNA, 15 nt, Chlamydophila pneumoniae J138
aaaucucuaagaauc

SEQ ID NO: 532327 - RNA, 23 nt, Chlamydophila pneumoniae J138
aaaucucuaguuuuuacauguaa

SEQ ID NO: 532328 - RNA, 18 nt, Chlamydophila pneumoniae J138
aaaugaagagcuuccauu

SEQ ID NO: 532329 - RNA, 21 nt, Chlamydophila pneumoniae J138
aaaugagauuccuaugaucag

SEQ ID NO: 532330 - RNA, 18 nt, Chlamydophila pneumoniae J138
aaaugaggacacaacucu

SEQ ID NO: 532331 - RNA, 19 nt, Chlamydophila pneumoniae J138
aaaugaggacacaacucuu

SEQ ID NO: 532332 - RNA, 18 nt, Chlamydophila pneumoniae J138
aaaugugaaaucguaucu

SEQ ID NO: 532333 - RNA, 20 nt, Chlamydophila pneumoniae J138
aaauguuuugcgauaucuau

SEQ ID NO: 532334 - RNA, 20 nt, Chlamydophila pneumoniae J138
aaauuaguaaaugccucuuu

SEQ ID NO: 532335 - RNA, 20 nt, Chlamydophila pneumoniae J138
aaaaagagcccaaaaacacu

SEQ ID NO: 532336 - RNA, 14 nt, Chlamydophila pneumoniae J138
aaaaagagcccaaa

SEQ ID NO: 532337 - RNA, 22 nt, Chlamydophila pneumoniae J138
aaauuaagucacacuuuccguu

SEQ ID NO: 532338 - RNA, 12 nt, Chlamydophila pneumoniae J138
aacaaaguuuau

SEQ ID NO: 532339 - RNA, 14 nt, Chlamydophila pneumoniae J138
aacaacagaaaugu

SEQ ID NO: 532340 - RNA, 23 nt, Chlamydophila pneumoniae J138
aacaacaucacuaucauggacaa

SEQ ID NO: 532341 - RNA, 19 nt, Chlamydophila pneumoniae J138
aacaacauaaagaagguuu

SEQ ID NO: 532342 - RNA, 16 nt, Chlamydophila pneumoniae J138
aacaacauaaagaagg

SEQ ID NO: 532343 - RNA, 14 nt, Chlamydophila pneumoniae J138
aacaacauaaagaa

SEQ ID NO: 532344 - RNA, 21 nt, Chlamydophila pneumoniae J138
aacaacauucguuaggugacc

SEQ ID NO: 532345 - RNA, 12 nt, Chlamydophila pneumoniae J138
aacaaccaaaag

SEQ ID NO: 532346 - RNA, 23 nt, Chlamydophila pneumoniae J138
aacaagauaaccugagaguguug

SEQ ID NO: 532347 - RNA, 16 nt, Chlamydophila pneumoniae J138
aacaagauaaccugag

SEQ ID NO: 532348 - RNA, 12 nt, Chlamydophila pneumoniae J138
aacaacuucuga

SEQ ID NO: 532349 - RNA, 14 nt, Chlamydophila pneumoniae J138
aacaagaagaucaa

SEQ ID NO: 532350 - RNA, 22 nt, Chlamydophila pneumoniae J138
aacaacucucccauguaguaaa

SEQ ID NO: 532351 - RNA, 16 nt, Chlamydophila pneumoniae J138
aacaacugaaaaacca

SEQ ID NO: 532352 - RNA, 11 nt, Chlamydophila pneumoniae J138
aacaacugaaa

SEQ ID NO: 532353 - RNA, 23 nt, Chlamydophila pneumoniae J138
aacaacuuuccggguaaguacac

SEQ ID NO: 532354 - RNA, 21 nt, Chlamydophila pneumoniae J138
aacaacgcugcuucucuacua

SEQ ID NO: 532355 - RNA, 11 nt, Chlamydophila pneumoniae J138
aaauuuucuaa

SEQ ID NO: 532356 - RNA, 15 nt, Chlamydophila pneumoniae J138
aaauuuugcaacaaa

SEQ ID NO: 532357 - RNA, 16 nt, Chlamydophila pneumoniae J138
aacaaaaacugcgcua

SEQ ID NO: 532358 - RNA, 12 nt, Chlamydophila pneumoniae J138
aaauuuuuccuu

SEQ ID NO: 532359 - RNA, 19 nt, Chlamydophila pneumoniae J138
aacaaaaggcccaacucuu

SEQ ID NO: 532360 - RNA, 17 nt, Chlamydophila pneumoniae J138
aacaaagguuauggaug

SEQ ID NO: 532361 - RNA, 21 nt, Chlamydophila pneumoniae J138
aacaaacuuguuuucguaaga

SEQ ID NO: 532362 - RNA, 21 nt, Chlamydophila pneumoniae J138
aaauuccaauuuuugcauaga

SEQ ID NO: 532363 - RNA, 14 nt, Chlamydophila pneumoniae J138
aaauucauuaagaa

SEQ ID NO: 532364 - RNA, 17 nt, Chlamydophila pneumoniae J138
aaauugaauaucgaguu

SEQ ID NO: 532365 - RNA, 20 nt, Chlamydophila pneumoniae J138
aaauugaugagcucuccauu

SEQ ID NO: 532366 - RNA, 17 nt, Chlamydophila pneumoniae J138
aaauugcauuuaaacua

SEQ ID NO: 532367 - RNA, 16 nt, Chlamydophila pneumoniae J138
aaauuggcuuuugaga

SEQ ID NO: 532368 - RNA, 13 nt, Chlamydophila pneumoniae J138
aaauuguuuuugc

SEQ ID NO: 532369 - RNA, 14 nt, Chlamydophila pneumoniae J138
aaauuguuggaauu

SEQ ID NO: 532370 - RNA, 22 nt, Chlamydophila pneumoniae J138
aaauuuaagauaucgaccuuaa

SEQ ID NO: 532371 - RNA, 11 nt, Chlamydophila pneumoniae J138
aaauuucugaa

SEQ ID NO: 532372 - RNA, 18 nt, Chlamydophila pneumoniae J138
aaauuucugaaacaaugc

SEQ ID NO: 532373 - RNA, 14 nt, Chlamydophila pneumoniae J138
aaauuucauuugaa

SEQ ID NO: 532374 - RNA, 23 nt, Chlamydophila pneumoniae J138
aaauuuccuaccuauauuuuuua

SEQ ID NO: 532375 - RNA, 23 nt, Chlamydophila pneumoniae J138
aaauuugcucuccugcaaaaagu

SEQ ID NO: 532376 - RNA, 20 nt, Chlamydophila pneumoniae J138
aaauuugcucuccugcaaaa

SEQ ID NO: 532377 - RNA, 13 nt, Chlamydophila pneumoniae J138
aaauuugucauca

SEQ ID NO: 532378 - RNA, 16 nt, Chlamydophila pneumoniae J138
aaauacagccagcaga

SEQ ID NO: 532379 - RNA, 17 nt, Chlamydophila pneumoniae J138
aaauacagccagcagaa

SEQ ID NO: 532380 - RNA, 12 nt, Chlamydophila pneumoniae J138
aaauacagauuc

SEQ ID NO: 532381 - RNA, 14 nt, Chlamydophila pneumoniae J138
aaauagaaaacaua

SEQ ID NO: 532382 - RNA, 18 nt, Chlamydophila pneumoniae J138
aaauagaaaggaaucccu

SEQ ID NO: 532383 - RNA, 22 nt, Chlamydophila pneumoniae J138
aaauacccucggagacucagag

SEQ ID NO: 532384 - RNA, 16 nt, Chlamydophila pneumoniae J138
aaauaccaagaugucu

SEQ ID NO: 532385 - RNA, 22 nt, Chlamydophila pneumoniae J138
aaauaccacagcuguacagaac

SEQ ID NO: 532386 - RNA, 15 nt, Chlamydophila pneumoniae J138
aaauauacugccagc

SEQ ID NO: 532387 - RNA, 13 nt, Chlamydophila pneumoniae J138
aaauauaacucuc

SEQ ID NO: 532388 - RNA, 20 nt, Chlamydophila pneumoniae J138
aaauagauccugaaaguaca

SEQ ID NO: 532389 - RNA, 14 nt, Chlamydophila pneumoniae J138
aaauagauccugaa

SEQ ID NO: 532390 - RNA, 17 nt, Chlamydophila pneumoniae J138
aaauauaucgcguguaa

SEQ ID NO: 532391 - RNA, 18 nt, Chlamydophila pneumoniae J138
aaauaucacauuccaaug

SEQ ID NO: 532392 - RNA, 21 nt, Chlamydophila pneumoniae J138
aaauaucaccuacaucagacu

SEQ ID NO: 532393 - RNA, 15 nt, Chlamydophila pneumoniae J138
aaauaucacauucca

SEQ ID NO: 532394 - RNA, 14 nt, Chlamydophila pneumoniae J138
aaauauaguuuuca

SEQ ID NO: 532395 - RNA, 14 nt, Chlamydophila pneumoniae J138
aaauaucggaagag

SEQ ID NO: 532396 - RNA, 14 nt, Chlamydophila pneumoniae J138
aaauaucauucacu

SEQ ID NO: 532397 - RNA, 21 nt, Chlamydophila pneumoniae J138
aaauaucucuggcauaauccu

SEQ ID NO: 532398 - RNA, 23 nt, Chlamydophila pneumoniae J138
aaauaucuccguuaccaaaaacu

SEQ ID NO: 532399 - RNA, 22 nt, Chlamydophila pneumoniae J138
aaauaucuccguuaccaaaaac

SEQ ID NO: 532400 - RNA, 12 nt, Chlamydophila pneumoniae J138
aaauaucuuaac

SEQ ID NO: 532401 - RNA, 19 nt, Chlamydophila pneumoniae J138
aaaguggcaaucuuuucuu

SEQ ID NO: 532402 - RNA, 14 nt, Chlamydophila pneumoniae J138
aaaguaaucacuuc

SEQ ID NO: 532403 - RNA, 19 nt, Chlamydophila pneumoniae J138
aaaguagccauuccaugga

SEQ ID NO: 532404 - RNA, 17 nt, Chlamydophila pneumoniae J138
aaaguaggcacaucauu

SEQ ID NO: 532405 - RNA, 20 nt, Chlamydophila pneumoniae J138
aaaguaggggcaguuccuaa

SEQ ID NO: 532406 - RNA, 16 nt, Chlamydophila pneumoniae J138
aaaguaguuuuaagaa

SEQ ID NO: 532407 - RNA, 13 nt, Chlamydophila pneumoniae J138
aaagucucucuaa

SEQ ID NO: 532408 - RNA, 23 nt, Chlamydophila pneumoniae J138
aaagugaaauugaacucucaguu

SEQ ID NO: 532409 - RNA, 21 nt, Chlamydophila pneumoniae J138
aaaguuaaugcaagcaacucu

SEQ ID NO: 532410 - RNA, 15 nt, Chlamydophila pneumoniae J138
aaaguucagcaagga

SEQ ID NO: 532411 - RNA, 19 nt, Chlamydophila pneumoniae J138
aaaguugcaacucucuuua

SEQ ID NO: 532412 - RNA, 19 nt, Chlamydophila pneumoniae J138
aaaguuucaaucucuccuu

SEQ ID NO: 532413 - RNA, 22 nt, Chlamydophila pneumoniae J138
aaauaaaaaaacccucaaagaa

SEQ ID NO: 532414 - RNA, 22 nt, Chlamydophila pneumoniae J138
aaaguuuugaggauuucuugca

SEQ ID NO: 532415 - RNA, 12 nt, Chlamydophila pneumoniae J138
aaauaaaaccac

SEQ ID NO: 532416 - RNA, 14 nt, Chlamydophila pneumoniae J138
aaagguauuucucu

SEQ ID NO: 532417 - RNA, 23 nt, Chlamydophila pneumoniae J138
aaaggucagcccugccucacagc

SEQ ID NO: 532418 - RNA, 22 nt, Chlamydophila pneumoniae J138
aaaggcugauugaaagucagca

SEQ ID NO: 532419 - RNA, 13 nt, Chlamydophila pneumoniae J138
aaaggcuuuucuu

SEQ ID NO: 532420 - RNA, 18 nt, Chlamydophila pneumoniae J138
aaaggguuucuuuccauc

SEQ ID NO: 532421 - RNA, 13 nt, Chlamydophila pneumoniae J138
aaagguaaaacua

SEQ ID NO: 532422 - RNA, 12 nt, Chlamydophila pneumoniae J138
aaaggauauuga

SEQ ID NO: 532423 - RNA, 21 nt, Chlamydophila pneumoniae J138
aaaggagugggcuucaacucu

SEQ ID NO: 532424 - RNA, 17 nt, Chlamydophila pneumoniae J138
aaaggauucuaugagga

SEQ ID NO: 532425 - RNA, 23 nt, Chlamydophila pneumoniae J138
aaagcuuuuccguaaguaaccaa

SEQ ID NO: 532426 - RNA, 16 nt, Chlamydophila pneumoniae J138
aaagcuuuuuucucuu

SEQ ID NO: 532427 - RNA, 19 nt, Chlamydophila pneumoniae J138
aaagcuuuuuucucuugcu

SEQ ID NO: 532428 - RNA, 19 nt, Chlamydophila pneumoniae J138
aaagcugaauccagguugu

SEQ ID NO: 532429 - RNA, 20 nt, Chlamydophila pneumoniae J138
aaagcuauuguuuuucaaua

SEQ ID NO: 532430 - RNA, 23 nt, Chlamydophila pneumoniae J138
aaagcuauuucucuaucaucaau

SEQ ID NO: 532431 - RNA, 14 nt, Chlamydophila pneumoniae J138
aaagcugaaauucu

SEQ ID NO: 532432 - RNA, 22 nt, Chlamydophila pneumoniae J138
aaagcucuccuucagaguugau

SEQ ID NO: 532433 - RNA, 21 nt, Chlamydophila pneumoniae J138
aaagcgcaaaucuuacauaaa

SEQ ID NO: 532434 - RNA, 14 nt, Chlamydophila pneumoniae J138
aaagccuuucuuau

SEQ ID NO: 532435 - RNA, 17 nt, Chlamydophila pneumoniae J138
aaagcaggagcaucauu

SEQ ID NO: 532436 - RNA, 23 nt, Chlamydophila pneumoniae J138
aaagccguguaccucucaucaaa

SEQ ID NO: 532437 - RNA, 14 nt, Chlamydophila pneumoniae J138
aaagcauaguguau

SEQ ID NO: 532438 - RNA, 20 nt, Chlamydophila pneumoniae J138
aaagcaucacggacuccguc

SEQ ID NO: 532439 - RNA, 19 nt, Chlamydophila pneumoniae J138
aaagccuaugauaaagccu

SEQ ID NO: 532440 - RNA, 22 nt, Chlamydophila pneumoniae J138
aaagaagauucaagcaaugccu

SEQ ID NO: 532441 - RNA, 22 nt, Chlamydophila pneumoniae J138
aaagaagacgcucuuagccuag

SEQ ID NO: 532442 - RNA, 22 nt, Chlamydophila pneumoniae J138
aaagaaugccauucuuaucugc

SEQ ID NO: 532443 - RNA, 13 nt, Chlamydophila pneumoniae J138
aaagaaucucuga

SEQ ID NO: 532444 - RNA, 20 nt, Chlamydophila pneumoniae J138
aaagaauuuguaacucuuaa

SEQ ID NO: 532445 - RNA, 13 nt, Chlamydophila pneumoniae J138
aaagaaugccauu

SEQ ID NO: 532446 - RNA, 21 nt, Chlamydophila pneumoniae J138
aaagaauuccuaaaacgagca

SEQ ID NO: 532447 - RNA, 21 nt, Chlamydophila pneumoniae J138
aaagaaauucuggagucgagc

SEQ ID NO: 532448 - RNA, 16 nt, Chlamydophila pneumoniae J138
aaagaaaucaaacauu

SEQ ID NO: 532449 - RNA, 16 nt, Chlamydophila pneumoniae J138
aaagaaauguaagaag

SEQ ID NO: 532450 - RNA, 19 nt, Chlamydophila pneumoniae J138
aaagaaagugaaaccauuu

SEQ ID NO: 532451 - RNA, 23 nt, Chlamydophila pneumoniae J138
aaagaaauauuaacccaccagaa

SEQ ID NO: 532452 - RNA, 24 nt, Chlamydophila pneumoniae J138
aaagaacagcacucucugcaggga

SEQ ID NO: 532453 - RNA, 11 nt, Chlamydophila pneumoniae J138
aaagaagaaac

SEQ ID NO: 532454 - RNA, 18 nt, Chlamydophila pneumoniae J138
aaacuuuuuuucuucucu

SEQ ID NO: 532455 - RNA, 22 nt, Chlamydophila pneumoniae J138
aaacuuuuuuucaaaucaucaa

SEQ ID NO: 532456 - RNA, 13 nt, Chlamydophila pneumoniae J138
aaagaaagaauau

SEQ ID NO: 532457 - RNA, 13 nt, Chlamydophila pneumoniae J138
aaagaaagaagcc

SEQ ID NO: 532458 - RNA, 15 nt, Chlamydophila pneumoniae J138
aaagauucugcccaa

SEQ ID NO: 532459 - RNA, 19 nt, Chlamydophila pneumoniae J138
aaagauucuaaaucaacua

SEQ ID NO: 532460 - RNA, 14 nt, Chlamydophila pneumoniae J138
aaagcaaccuuaaa

SEQ ID NO: 532461 - RNA, 21 nt, Chlamydophila pneumoniae J138
aaagcacauaagaugaaguuu

SEQ ID NO: 532462 - RNA, 12 nt, Chlamydophila pneumoniae J138
aaagauuccuaa

SEQ ID NO: 532463 - RNA, 11 nt, Chlamydophila pneumoniae J138
aaagauuaagg

SEQ ID NO: 532464 - RNA, 23 nt, Chlamydophila pneumoniae J138
aaagagcuuugauucacguauag

SEQ ID NO: 532465 - RNA, 15 nt, Chlamydophila pneumoniae J138
aaagagcuuugauuc

SEQ ID NO: 532466 - RNA, 21 nt, Chlamydophila pneumoniae J138
aaagacccuucuuuccauaaa

SEQ ID NO: 532467 - RNA, 15 nt, Chlamydophila pneumoniae J138
aaagacaucucuuua

SEQ ID NO: 532468 - RNA, 22 nt, Chlamydophila pneumoniae J138
aaagaucgggucuacaacaguu

SEQ ID NO: 532469 - RNA, 14 nt, Chlamydophila pneumoniae J138
aaagagugccaaga

SEQ ID NO: 532470 - RNA, 12 nt, Chlamydophila pneumoniae J138
aaagaucugaau

SEQ ID NO: 532471 - RNA, 21 nt, Chlamydophila pneumoniae J138
aaagaucgugaucaaagaaca

SEQ ID NO: 532472 - RNA, 19 nt, Chlamydophila pneumoniae J138
aaagaucguuagagaccca

SEQ ID NO: 532473 - RNA, 18 nt, Chlamydophila pneumoniae J138
aaagaguccuuuuuguuc

SEQ ID NO: 532474 - RNA, 13 nt, Chlamydophila pneumoniae J138
aaagaggggagcu

SEQ ID NO: 532475 - RNA, 20 nt, Chlamydophila pneumoniae J138
caaagcgucuaucuagauuu

SEQ ID NO: 532476 - RNA, 22 nt, Chlamydophila pneumoniae J138
caaagcuuguuccacuugcucu

SEQ ID NO: 532477 - RNA, 19 nt, Chlamydophila pneumoniae J138
caaagcaucuuguauugcu

SEQ ID NO: 532478 - RNA, 15 nt, Chlamydophila pneumoniae J138
caaagccaaauucuc

SEQ ID NO: 532479 - RNA, 16 nt, Chlamydophila pneumoniae J138
caaagcccccuccccc

SEQ ID NO: 532480 - RNA, 19 nt, Chlamydophila pneumoniae J138
caaagcagauccugcuucu

SEQ ID NO: 532481 - RNA, 13 nt, Chlamydophila pneumoniae J138
caaagauauaagg

SEQ ID NO: 532482 - RNA, 20 nt, Chlamydophila pneumoniae J138
caaacugaugccaagaaaua

SEQ ID NO: 532483 - RNA, 21 nt, Chlamydophila pneumoniae J138
caaacugauuaguuuguuuua

SEQ ID NO: 532484 - RNA, 17 nt, Chlamydophila pneumoniae J138
caaacugaugccaagaa

SEQ ID NO: 532485 - RNA, 16 nt, Chlamydophila pneumoniae J138
caaacuccuuuuaaaa

SEQ ID NO: 532486 - RNA, 22 nt, Chlamydophila pneumoniae J138
caaagagucucuugcuuuugua

SEQ ID NO: 532487 - RNA, 15 nt, Chlamydophila pneumoniae J138
caaagagcaaaggag

SEQ ID NO: 532488 - RNA, 23 nt, Chlamydophila pneumoniae J138
caaagaguuuuuuagaggagcuu

SEQ ID NO: 532489 - RNA, 14 nt, Chlamydophila pneumoniae J138
caaagaguuuuuua

SEQ ID NO: 532490 - RNA, 16 nt, Chlamydophila pneumoniae J138
caaagauaaagaaguu

SEQ ID NO: 532491 - RNA, 14 nt, Chlamydophila pneumoniae J138
caaauaaagcaacu

SEQ ID NO: 532492 - RNA, 12 nt, Chlamydophila pneumoniae J138
caaaguuuauga

SEQ ID NO: 532493 - RNA, 19 nt, Chlamydophila pneumoniae J138
caaaguuuaugacacagcu

SEQ ID NO: 532494 - RNA, 20 nt, Chlamydophila pneumoniae J138
caaaguuaaugcaagcaacu

SEQ ID NO: 532495 - RNA, 23 nt, Chlamydophila pneumoniae J138
caaaguaaugugcgcacaaggga

SEQ ID NO: 532496 - RNA, 18 nt, Chlamydophila pneumoniae J138
caaagugacuuccuccaa

SEQ ID NO: 532497 - RNA, 20 nt, Chlamydophila pneumoniae J138
caaauaagccaguacuaaau

SEQ ID NO: 532498 - RNA, 13 nt, Chlamydophila pneumoniae J138
caaauaaggcugc

SEQ ID NO: 532499 - RNA, 12 nt, Chlamydophila pneumoniae J138
caaauaauuaaa

SEQ ID NO: 532500 - RNA, 17 nt, Chlamydophila pneumoniae J138
caaaauaaaaaaacccu

SEQ ID NO: 532501 - RNA, 15 nt, Chlamydophila pneumoniae J138
caaaauaaaaggagc

SEQ ID NO: 532502 - RNA, 24 nt, Chlamydophila pneumoniae J138
caaaauaaaaaaacccucaaagaa

SEQ ID NO: 532503 - RNA, 12 nt, Chlamydophila pneumoniae J138
caaaauaaaaaa

SEQ ID NO: 532504 - RNA, 21 nt, Chlamydophila pneumoniae J138
caaaauccacauccuuguaga

SEQ ID NO: 532505 - RNA, 17 nt, Chlamydophila pneumoniae J138
caaaaugcgaggaaaaa

SEQ ID NO: 532506 - RNA, 21 nt, Chlamydophila pneumoniae J138
caaacagauuuuucaagaacu

SEQ ID NO: 532507 - RNA, 16 nt, Chlamydophila pneumoniae J138
caaacagauuuuucaa

SEQ ID NO: 532508 - RNA, 19 nt, Chlamydophila pneumoniae J138
caaacauuaccguucccua

SEQ ID NO: 532509 - RNA, 18 nt, Chlamydophila pneumoniae J138
caaacaucauuguugcug

SEQ ID NO: 532510 - RNA, 12 nt, Chlamydophila pneumoniae J138
caaacaucaaag

SEQ ID NO: 532511 - RNA, 20 nt, Chlamydophila pneumoniae J138
caaacgcaaugauuucucua

SEQ ID NO: 532512 - RNA, 21 nt, Chlamydophila pneumoniae J138
caaacccauauuugaauaaag

SEQ ID NO: 532513 - RNA, 20 nt, Chlamydophila pneumoniae J138
caaacccucuccagaagucg

SEQ ID NO: 532514 - RNA, 16 nt, Chlamydophila pneumoniae J138
caaacccucuccagaa

SEQ ID NO: 532515 - RNA, 21 nt, Chlamydophila pneumoniae J138
caaacccugggcucacucuaa

SEQ ID NO: 532516 - RNA, 20 nt, Chlamydophila pneumoniae J138
caaacccugggcucacucua

SEQ ID NO: 532517 - RNA, 22 nt, Chlamydophila pneumoniae J138
caacacggacacuauuaucugc

SEQ ID NO: 532518 - RNA, 16 nt, Chlamydophila pneumoniae J138
caacacgcacaaacua

SEQ ID NO: 532519 - RNA, 14 nt, Chlamydophila pneumoniae J138
caacagaaauguug

SEQ ID NO: 532520 - RNA, 21 nt, Chlamydophila pneumoniae J138
caacaagcugcugagcagcaa

SEQ ID NO: 532521 - RNA, 15 nt, Chlamydophila pneumoniae J138
caacaagggaaagaa

SEQ ID NO: 532522 - RNA, 22 nt, Chlamydophila pneumoniae J138
caacaaguucuuggaaaaaagg

SEQ ID NO: 532523 - RNA, 17 nt, Chlamydophila pneumoniae J138
caacaacgcucccuaug

SEQ ID NO: 532524 - RNA, 14 nt, Chlamydophila pneumoniae J138
caaauagauuuuua

SEQ ID NO: 532525 - RNA, 19 nt, Chlamydophila pneumoniae J138
caaauagauuuuuacuugc

SEQ ID NO: 532526 - RNA, 21 nt, Chlamydophila pneumoniae J138
caaauaggaucucucuuuccu

SEQ ID NO: 532527 - RNA, 15 nt, Chlamydophila pneumoniae J138
caaauaggagagcac

SEQ ID NO: 532528 - RNA, 19 nt, Chlamydophila pneumoniae J138
caaaugcagucucaggaaa

SEQ ID NO: 532529 - RNA, 12 nt, Chlamydophila pneumoniae J138
caaauugagaaa

SEQ ID NO: 532530 - RNA, 14 nt, Chlamydophila pneumoniae J138
caaauugagaaaua

SEQ ID NO: 532531 - RNA, 19 nt, Chlamydophila pneumoniae J138
caaauugagaaauauaacu

SEQ ID NO: 532532 - RNA, 16 nt, Chlamydophila pneumoniae J138
caaauucaaaauagaa

SEQ ID NO: 532533 - RNA, 13 nt, Chlamydophila pneumoniae J138
caacaucaaagaa

SEQ ID NO: 532534 - RNA, 14 nt, Chlamydophila pneumoniae J138
caacaucaaagaau

SEQ ID NO: 532535 - RNA, 18 nt, Chlamydophila pneumoniae J138
caacagguaagacgagca

SEQ ID NO: 532536 - RNA, 17 nt, Chlamydophila pneumoniae J138
caacauaacaugagaaa

SEQ ID NO: 532537 - RNA, 22 nt, Chlamydophila pneumoniae J138
caacauaaucauuauccauauc

SEQ ID NO: 532538 - RNA, 15 nt, Chlamydophila pneumoniae J138
caacccgaauuccuc

SEQ ID NO: 532539 - RNA, 16 nt, Chlamydophila pneumoniae J138
caacccgaauuccucu

SEQ ID NO: 532540 - RNA, 18 nt, Chlamydophila pneumoniae J138
caacccgaauuccucucc

SEQ ID NO: 532541 - RNA, 18 nt, Chlamydophila pneumoniae J138
caaccacacaggauuguu

SEQ ID NO: 532542 - RNA, 20 nt, Chlamydophila pneumoniae J138
caaccgccuuuauauaaagg

SEQ ID NO: 532543 - RNA, 16 nt, Chlamydophila pneumoniae J138
caaccuuuccuaaaau

SEQ ID NO: 532544 - RNA, 18 nt, Chlamydophila pneumoniae J138
caaccuuuccuaaaauaa

SEQ ID NO: 532545 - RNA, 16 nt, Chlamydophila pneumoniae J138
caacgaucgucaguaa

SEQ ID NO: 532546 - RNA, 13 nt, Chlamydophila pneumoniae J138
caacuccucaaaa

SEQ ID NO: 532547 - RNA, 21 nt, Chlamydophila pneumoniae J138
caacuacagagggcuucauuc

SEQ ID NO: 532548 - RNA, 23 nt, Chlamydophila pneumoniae J138
caacuacauaauaagcaggaaaa

SEQ ID NO: 532549 - RNA, 17 nt, Chlamydophila pneumoniae J138
caacuacuguagaguuu

SEQ ID NO: 532550 - RNA, 13 nt, Chlamydophila pneumoniae J138
caacuaaagcaua

SEQ ID NO: 532551 - RNA, 12 nt, Chlamydophila pneumoniae J138
caacuaaacucu

SEQ ID NO: 532552 - RNA, 19 nt, Chlamydophila pneumoniae J138
caacugauguuuuauagau

SEQ ID NO: 532553 - RNA, 20 nt, Chlamydophila pneumoniae J138
caacugauguuuuauagaua

SEQ ID NO: 532554 - RNA, 14 nt, Chlamydophila pneumoniae J138
caacuucuucguua

SEQ ID NO: 532555 - RNA, 14 nt, Chlamydophila pneumoniae J138
caacuucuccaacu

SEQ ID NO: 532556 - RNA, 16 nt, Chlamydophila pneumoniae J138
caagaaaauaucaccu

SEQ ID NO: 532557 - RNA, 16 nt, Chlamydophila pneumoniae J138
caagaaaacaaaguca

SEQ ID NO: 532558 - RNA, 14 nt, Chlamydophila pneumoniae J138
caagaaaaaccccu

SEQ ID NO: 532559 - RNA, 22 nt, Chlamydophila pneumoniae J138
caagaacauaaccucggucucg

SEQ ID NO: 532560 - RNA, 14 nt, Chlamydophila pneumoniae J138
caagaacauaaccu

SEQ ID NO: 532561 - RNA, 17 nt, Chlamydophila pneumoniae J138
caagaaccuguuuuucu

SEQ ID NO: 532562 - RNA, 20 nt, Chlamydophila pneumoniae J138
caagaaccuguuuuucuaaa

SEQ ID NO: 532563 - RNA, 23 nt, Chlamydophila pneumoniae J138
caagaaccuguuuuucuaaaaug

SEQ ID NO: 532564 - RNA, 14 nt, Chlamydophila pneumoniae J138
caagaacugaagag

SEQ ID NO: 532565 - RNA, 18 nt, Chlamydophila pneumoniae J138
caagaacuugagcacaaa

SEQ ID NO: 532566 - RNA, 16 nt, Chlamydophila pneumoniae J138
caagaacaauaaguag

SEQ ID NO: 532567 - RNA, 14 nt, Chlamydophila pneumoniae J138
caagaacaauaagu

SEQ ID NO: 532568 - RNA, 14 nt, Chlamydophila pneumoniae J138
caagaaaugcccug

SEQ ID NO: 532569 - RNA, 18 nt, Chlamydophila pneumoniae J138
caagaaauauacugccag

SEQ ID NO: 532570 - RNA, 12 nt, Chlamydophila pneumoniae J138
caagacgacacu

SEQ ID NO: 532571 - RNA, 15 nt, Chlamydophila pneumoniae J138
caagacgaaagcaca

SEQ ID NO: 532572 - RNA, 16 nt, Chlamydophila pneumoniae J138
caagacgaaagcacau

SEQ ID NO: 532573 - RNA, 18 nt, Chlamydophila pneumoniae J138
caagaagagaaaagauag

SEQ ID NO: 532574 - RNA, 17 nt, Chlamydophila pneumoniae J138
caagacuacgacagaag

SEQ ID NO: 532575 - RNA, 18 nt, Chlamydophila pneumoniae J138
caagacuacgacagaagu

SEQ ID NO: 532576 - RNA, 20 nt, Chlamydophila pneumoniae J138
caagacuauagaaaaggaug

SEQ ID NO: 532577 - RNA, 13 nt, Chlamydophila pneumoniae J138
caagcaacucuuc

SEQ ID NO: 532578 - RNA, 23 nt, Chlamydophila pneumoniae J138
caagcaauacuaagaagcucacu

SEQ ID NO: 532579 - RNA, 17 nt, Chlamydophila pneumoniae J138
caagagcucuugagaaa

SEQ ID NO: 532580 - RNA, 15 nt, Chlamydophila pneumoniae J138
caagagcccuugugc

SEQ ID NO: 532581 - RNA, 21 nt, Chlamydophila pneumoniae J138
caagaggucgaagauucaaag

SEQ ID NO: 532582 - RNA, 23 nt, Chlamydophila pneumoniae J138
caagauucucacucuaugagaac

SEQ ID NO: 532583 - RNA, 21 nt, Chlamydophila pneumoniae J138
caagcagauagagcuucuuua

SEQ ID NO: 532584 - RNA, 22 nt, Chlamydophila pneumoniae J138
caaggagagcuucuucuguaaa

SEQ ID NO: 532585 - RNA, 11 nt, Chlamydophila pneumoniae J138
caaggaaaauu

SEQ ID NO: 532586 - RNA, 23 nt, Chlamydophila pneumoniae J138
caaggaagccugcggcaaguauc

SEQ ID NO: 532587 - RNA, 18 nt, Chlamydophila pneumoniae J138
caaggccuaaucuuguag

SEQ ID NO: 532588 - RNA, 19 nt, Chlamydophila pneumoniae J138
caaggcugcugauccaaaa

SEQ ID NO: 532589 - RNA, 18 nt, Chlamydophila pneumoniae J138
caagggagaggucugcuc

SEQ ID NO: 532590 - RNA, 15 nt, Chlamydophila pneumoniae J138
caagguacuuuauag

SEQ ID NO: 532591 - RNA, 22 nt, Chlamydophila pneumoniae J138
caagguaacauccauagagaac

SEQ ID NO: 532592 - RNA, 15 nt, Chlamydophila pneumoniae J138
caagguaacauccau

SEQ ID NO: 532593 - RNA, 23 nt, Chlamydophila pneumoniae J138
caaggucacagcauuuucucuga

SEQ ID NO: 532594 - RNA, 15 nt, Chlamydophila pneumoniae J138
caaucucuagggaua

SEQ ID NO: 532595 - RNA, 19 nt, Chlamydophila pneumoniae J138
caaucucuagggauaauua

SEQ ID NO: 532596 - RNA, 20 nt, Chlamydophila pneumoniae J138
caaucucgcuauuccauaaa

SEQ ID NO: 532597 - RNA, 19 nt, Chlamydophila pneumoniae J138
caaucucgcuauuccauaa

SEQ ID NO: 532598 - RNA, 19 nt, Chlamydophila pneumoniae J138
caauccuauggcagcagga

SEQ ID NO: 532599 - RNA, 14 nt, Chlamydophila pneumoniae J138
caaucccucuaccc

SEQ ID NO: 532600 - RNA, 15 nt, Chlamydophila pneumoniae J138
caaugauauaaaagc

SEQ ID NO: 532601 - RNA, 14 nt, Chlamydophila pneumoniae J138
caaugauaauuuca

SEQ ID NO: 532602 - RNA, 20 nt, Chlamydophila pneumoniae J138
caaugauaauuucauuauag

SEQ ID NO: 532603 - RNA, 16 nt, Chlamydophila pneumoniae J138
caaugagcucuauuuc

SEQ ID NO: 532604 - RNA, 18 nt, Chlamydophila pneumoniae J138
caaugagcaucugaguca

SEQ ID NO: 532605 - RNA, 19 nt, Chlamydophila pneumoniae J138
caaucuuucauucccuuuu

SEQ ID NO: 532606 - RNA, 17 nt, Chlamydophila pneumoniae J138
caaucucuuucacaaag

SEQ ID NO: 532607 - RNA, 10 nt, Chlamydophila pneumoniae J138
caaucuuuga

SEQ ID NO: 532608 - RNA, 14 nt, Chlamydophila pneumoniae J138
caaucuuucuucua

SEQ ID NO: 532609 - RNA, 20 nt, Chlamydophila pneumoniae J138
caaucuuucuucuagagcuu

SEQ ID NO: 532610 - RNA, 15 nt, Chlamydophila pneumoniae J138
caaugaaggccaaga

SEQ ID NO: 532611 - RNA, 12 nt, Chlamydophila pneumoniae J138
caaugaagaaaa

SEQ ID NO: 532612 - RNA, 12 nt, Chlamydophila pneumoniae J138
caaugcgauacg

SEQ ID NO: 532613 - RNA, 23 nt, Chlamydophila pneumoniae J138
caauaccagauaaagcaaagaua

SEQ ID NO: 532614 - RNA, 18 nt, Chlamydophila pneumoniae J138
caauagaagcuuguugag

SEQ ID NO: 532615 - RNA, 23 nt, Chlamydophila pneumoniae J138
caauacuucaggacgcacauuua

SEQ ID NO: 532616 - RNA, 19 nt, Chlamydophila pneumoniae J138
caauagcaaagauuucugc

SEQ ID NO: 532617 - RNA, 18 nt, Chlamydophila pneumoniae J138
caauaggaauuagagaaa

SEQ ID NO: 532618 - RNA, 22 nt, Chlamydophila pneumoniae J138
caauauuaaaccguaggauucu

SEQ ID NO: 532619 - RNA, 14 nt, Chlamydophila pneumoniae J138
caauauaagcacca

SEQ ID NO: 532620 - RNA, 22 nt, Chlamydophila pneumoniae J138
caauaacaaacgccgcucuuga

SEQ ID NO: 532621 - RNA, 18 nt, Chlamydophila pneumoniae J138
caauaaauccaaaaaaug

SEQ ID NO: 532622 - RNA, 14 nt, Chlamydophila pneumoniae J138
caaguugagagaga

SEQ ID NO: 532623 - RNA, 18 nt, Chlamydophila pneumoniae J138
caaguaccuucucgucau

SEQ ID NO: 532624 - RNA, 18 nt, Chlamydophila pneumoniae J138
caaguaaucaugauaaaa

SEQ ID NO: 532625 - RNA, 17 nt, Chlamydophila pneumoniae J138
caauaagaaaauccuaa

SEQ ID NO: 532626 - RNA, 21 nt, Chlamydophila pneumoniae J138
caauaaccgaaacuucucaga

SEQ ID NO: 532627 - RNA, 18 nt, Chlamydophila pneumoniae J138
caauaaccagaagacucc

SEQ ID NO: 532628 - RNA, 22 nt, Chlamydophila pneumoniae J138
caauaaccaggggcuuuccuuc

SEQ ID NO: 532629 - RNA, 22 nt, Chlamydophila pneumoniae J138
caauaacaugcgcagaauaaaa

SEQ ID NO: 532630 - RNA, 14 nt, Chlamydophila pneumoniae J138
caauaaauccaaaa

SEQ ID NO: 532631 - RNA, 18 nt, Chlamydophila pneumoniae J138
caauuuucuucagcacuu

SEQ ID NO: 532632 - RNA, 14 nt, Chlamydophila pneumoniae J138
caauuuuaaaaucu

SEQ ID NO: 532633 - RNA, 16 nt, Chlamydophila pneumoniae J138
caauugagcucucuag

SEQ ID NO: 532634 - RNA, 21 nt, Chlamydophila pneumoniae J138
cacaaaaagcuuuuuucucuu

SEQ ID NO: 532635 - RNA, 17 nt, Chlamydophila pneumoniae J138
caauuuuuguagacaau

SEQ ID NO: 532636 - RNA, 21 nt, Chlamydophila pneumoniae J138
caauuuuuguagacaauacca

SEQ ID NO: 532637 - RNA, 12 nt, Chlamydophila pneumoniae J138
cacaaaauuugu

SEQ ID NO: 532638 - RNA, 20 nt, Chlamydophila pneumoniae J138
caauguuuagaauuuguccu

SEQ ID NO: 532639 - RNA, 22 nt, Chlamydophila pneumoniae J138
caauugaaucagauuagaguua

SEQ ID NO: 532640 - RNA, 13 nt, Chlamydophila pneumoniae J138
caauugaaaauuc

SEQ ID NO: 532641 - RNA, 22 nt, Chlamydophila pneumoniae J138
cacacugcuuacaauugaaaau

SEQ ID NO: 532642 - RNA, 17 nt, Chlamydophila pneumoniae J138
cacaauuguaaauacaa

SEQ ID NO: 532643 - RNA, 18 nt, Chlamydophila pneumoniae J138
cacaauuguaaauacaaa

SEQ ID NO: 532644 - RNA, 20 nt, Chlamydophila pneumoniae J138
cacaaaucauuuaaagcuga

SEQ ID NO: 532645 - RNA, 15 nt, Chlamydophila pneumoniae J138
cacagugacacgcuu

SEQ ID NO: 532646 - RNA, 18 nt, Chlamydophila pneumoniae J138
cacaggaaugaaaccuuc

SEQ ID NO: 532647 - RNA, 17 nt, Chlamydophila pneumoniae J138
cacaggcauggucuccc

SEQ ID NO: 532648 - RNA, 22 nt, Chlamydophila pneumoniae J138
cacagagaugcuucuaaacaau

SEQ ID NO: 532649 - RNA, 23 nt, Chlamydophila pneumoniae J138
cacagagcuucuaaaaacucuuc

SEQ ID NO: 532650 - RNA, 21 nt, Chlamydophila pneumoniae J138
cacagacuugaggaaucugaa

SEQ ID NO: 532651 - RNA, 13 nt, Chlamydophila pneumoniae J138
caccaagggaugc

SEQ ID NO: 532652 - RNA, 21 nt, Chlamydophila pneumoniae J138
caccaaggggcguucuugaaa

SEQ ID NO: 532653 - RNA, 23 nt, Chlamydophila pneumoniae J138
cacauuguuuaaguccuucuucc

SEQ ID NO: 532654 - RNA, 17 nt, Chlamydophila pneumoniae J138
cacauuguuuaaguccu

SEQ ID NO: 532655 - RNA, 19 nt, Chlamydophila pneumoniae J138
cacauuuagaaguaauccu

SEQ ID NO: 532656 - RNA, 21 nt, Chlamydophila pneumoniae J138
cacauuuagaaguaauccuaa

SEQ ID NO: 532657 - RNA, 12 nt, Chlamydophila pneumoniae J138
caccaagacuga

SEQ ID NO: 532658 - RNA, 19 nt, Chlamydophila pneumoniae J138
cacauugcgggcucaaaga

SEQ ID NO: 532659 - RNA, 21 nt, Chlamydophila pneumoniae J138
cacaugacaaauaaacugacg

SEQ ID NO: 532660 - RNA, 23 nt, Chlamydophila pneumoniae J138
cacaucuuucucuaaaauaugcu

SEQ ID NO: 532661 - RNA, 13 nt, Chlamydophila pneumoniae J138
caccaauuuuuuc

SEQ ID NO: 532662 - RNA, 17 nt, Chlamydophila pneumoniae J138
caccaaugauaauuuca

SEQ ID NO: 532663 - RNA, 21 nt, Chlamydophila pneumoniae J138
caccauccaaagcuauuucuc

SEQ ID NO: 532664 - RNA, 18 nt, Chlamydophila pneumoniae J138
caccagggguuucuaaau

SEQ ID NO: 532665 - RNA, 15 nt, Chlamydophila pneumoniae J138
caccagguccuucug

SEQ ID NO: 532666 - RNA, 16 nt, Chlamydophila pneumoniae J138
caccagguccuucugg

SEQ ID NO: 532667 - RNA, 16 nt, Chlamydophila pneumoniae J138
caccagggguuucuaa

SEQ ID NO: 532668 - RNA, 13 nt, Chlamydophila pneumoniae J138
caccauaauauaa

SEQ ID NO: 532669 - RNA, 22 nt, Chlamydophila pneumoniae J138
aaaaguuuuuguucauccagaa

SEQ ID NO: 532670 - RNA, 18 nt, Chlamydophila pneumoniae J138
caccagaagcauugagga

SEQ ID NO: 532671 - RNA, 14 nt, Chlamydophila pneumoniae J138
caccagaaggaagg

SEQ ID NO: 532672 - RNA, 14 nt, Chlamydophila pneumoniae J138
aaaaguugaggaaa

SEQ ID NO: 532673 - RNA, 22 nt, Chlamydophila pneumoniae J138
aaaaguuccccaauuucuuuuu

SEQ ID NO: 532674 - RNA, 14 nt, Chlamydophila pneumoniae J138
caccagaagcaacu

SEQ ID NO: 532675 - RNA, 22 nt, Chlamydophila pneumoniae J138
caccagacccucgaguaccgac

SEQ ID NO: 532676 - RNA, 22 nt, Chlamydophila pneumoniae J138
caccgcgcauagcaacuacaga

SEQ ID NO: 532677 - RNA, 17 nt, Chlamydophila pneumoniae J138
caccauuuuugaauaug

SEQ ID NO: 532678 - RNA, 11 nt, Chlamydophila pneumoniae J138
caccugaagag

SEQ ID NO: 532679 - RNA, 15 nt, Chlamydophila pneumoniae J138
caccucuucaaagac

SEQ ID NO: 532680 - RNA, 22 nt, Chlamydophila pneumoniae J138
aaaauaaccccuccaaaaucau

SEQ ID NO: 532681 - RNA, 19 nt, Chlamydophila pneumoniae J138
caccuugaaguuuuuucuc

SEQ ID NO: 532682 - RNA, 20 nt, Chlamydophila pneumoniae J138
cacgaccucgaauuccuccc

SEQ ID NO: 532683 - RNA, 21 nt, Chlamydophila pneumoniae J138
cacgaccuacaccaucuuuaa

SEQ ID NO: 532684 - RNA, 14 nt, Chlamydophila pneumoniae J138
cacgacgucaucac

SEQ ID NO: 532685 - RNA, 18 nt, Chlamydophila pneumoniae J138
cacgaacuucagcaagaa

SEQ ID NO: 532686 - RNA, 14 nt, Chlamydophila pneumoniae J138
cacgccaaaguacu

SEQ ID NO: 532687 - RNA, 21 nt, Chlamydophila pneumoniae J138
cacgcacaaacuaacauagau

SEQ ID NO: 532688 - RNA, 17 nt, Chlamydophila pneumoniae J138
cacggacuccgucuccu

SEQ ID NO: 532689 - RNA, 17 nt, Chlamydophila pneumoniae J138
cacggacacuauuaucu

SEQ ID NO: 532690 - RNA, 23 nt, Chlamydophila pneumoniae J138
cacgcuugugguuagaggaagca

SEQ ID NO: 532691 - RNA, 13 nt, Chlamydophila pneumoniae J138
cacggaaauauuc

SEQ ID NO: 532692 - RNA, 21 nt, Chlamydophila pneumoniae J138
cacguaggcauacaguagaaa

SEQ ID NO: 532693 - RNA, 16 nt, Chlamydophila pneumoniae J138
aaaauaucaccuacau

SEQ ID NO: 532694 - RNA, 18 nt, Chlamydophila pneumoniae J138
aaaauaucaccuacauca

SEQ ID NO: 532695 - RNA, 18 nt, Chlamydophila pneumoniae J138
auuuaggucgacuuccuu

SEQ ID NO: 532696 - RNA, 16 nt, Chlamydophila pneumoniae J138
auuuagggaagaguuc

SEQ ID NO: 532697 - RNA, 15 nt, Chlamydophila pneumoniae J138
auuucauguccucca

SEQ ID NO: 532698 - RNA, 22 nt, Chlamydophila pneumoniae J138
auuucuaggacagcacauagag

SEQ ID NO: 532699 - RNA, 13 nt, Chlamydophila pneumoniae J138
auuucuauuauuu

SEQ ID NO: 532700 - RNA, 16 nt, Chlamydophila pneumoniae J138
auuuccuuaagcuucu

SEQ ID NO: 532701 - RNA, 19 nt, Chlamydophila pneumoniae J138
auuucuaacuuaauagauu

SEQ ID NO: 532702 - RNA, 14 nt, Chlamydophila pneumoniae J138
auuucuaacuuaau

SEQ ID NO: 532703 - RNA, 19 nt, Chlamydophila pneumoniae J138
auuuccaauccauucugag

SEQ ID NO: 532704 - RNA, 14 nt, Chlamydophila pneumoniae J138
auuuccaguauucu

SEQ ID NO: 532705 - RNA, 21 nt, Chlamydophila pneumoniae J138
auuuccuaccuauauuuuuua

SEQ ID NO: 532706 - RNA, 20 nt, Chlamydophila pneumoniae J138
auuuccauaggaucugcaug

SEQ ID NO: 532707 - RNA, 19 nt, Chlamydophila pneumoniae J138
auuuccuaccuauauuuuu

SEQ ID NO: 532708 - RNA, 18 nt, Chlamydophila pneumoniae J138
auuuccugacuauaaaau

SEQ ID NO: 532709 - RNA, 19 nt, Chlamydophila pneumoniae J138
auuuguaagaaucauaaca

SEQ ID NO: 532710 - RNA, 12 nt, Chlamydophila pneumoniae J138
auuugucaucac

SEQ ID NO: 532711 - RNA, 21 nt, Chlamydophila pneumoniae J138
auuuguagcucccauaaguuc

SEQ ID NO: 532712 - RNA, 22 nt, Chlamydophila pneumoniae J138
auuucuccgucaagaacaagag

SEQ ID NO: 532713 - RNA, 16 nt, Chlamydophila pneumoniae J138
auuucuccaguaucuu

SEQ ID NO: 532714 - RNA, 15 nt, Chlamydophila pneumoniae J138
auuucuccagcagcu

SEQ ID NO: 532715 - RNA, 18 nt, Chlamydophila pneumoniae J138
auuucuccgucaagaaca

SEQ ID NO: 532716 - RNA, 22 nt, Chlamydophila pneumoniae J138
auuucuuucacaucuuuagaau

SEQ ID NO: 532717 - RNA, 23 nt, Chlamydophila pneumoniae J138
auuugaauaguugugagacuuuc

SEQ ID NO: 532718 - RNA, 20 nt, Chlamydophila pneumoniae J138
auuugacguuguguugcaag

SEQ ID NO: 532719 - RNA, 19 nt, Chlamydophila pneumoniae J138
auuugcaacaaucuuucuu

SEQ ID NO: 532720 - RNA, 22 nt, Chlamydophila pneumoniae J138
auuugcaacaaucuuucuucua

SEQ ID NO: 532721 - RNA, 13 nt, Chlamydophila pneumoniae J138
auuugauuuuuca

SEQ ID NO: 532722 - RNA, 15 nt, Chlamydophila pneumoniae J138
auuugauuuuucaaa

SEQ ID NO: 532723 - RNA, 19 nt, Chlamydophila pneumoniae J138
caaaacauaaccuccucuu

SEQ ID NO: 532724 - RNA, 20 nt, Chlamydophila pneumoniae J138
caaaacagcaucaggauucu

SEQ ID NO: 532725 - RNA, 16 nt, Chlamydophila pneumoniae J138
caaaacauaaccuccu

SEQ ID NO: 532726 - RNA, 17 nt, Chlamydophila pneumoniae J138
caaaaauucuucgugag

SEQ ID NO: 532727 - RNA, 19 nt, Chlamydophila pneumoniae J138
caaaaacgauucgaaaaac

SEQ ID NO: 532728 - RNA, 15 nt, Chlamydophila pneumoniae J138
caaaaaggacucuuu

SEQ ID NO: 532729 - RNA, 21 nt, Chlamydophila pneumoniae J138
caaaaaggacucuuucuauag

SEQ ID NO: 532730 - RNA, 17 nt, Chlamydophila pneumoniae J138
caaaaagcuucuuucuu

SEQ ID NO: 532731 - RNA, 16 nt, Chlamydophila pneumoniae J138
caaaaaguuucaaucu

SEQ ID NO: 532732 - RNA, 18 nt, Chlamydophila pneumoniae J138
caaaaaguuccauagagu

SEQ ID NO: 532733 - RNA, 18 nt, Chlamydophila pneumoniae J138
auuuuugcuaagagcucu

SEQ ID NO: 532734 - RNA, 13 nt, Chlamydophila pneumoniae J138
auuuuuauuuccu

SEQ ID NO: 532735 - RNA, 14 nt, Chlamydophila pneumoniae J138
auuuuuauuuaaaa

SEQ ID NO: 532736 - RNA, 16 nt, Chlamydophila pneumoniae J138
auuuuuguagacaaua

SEQ ID NO: 532737 - RNA, 18 nt, Chlamydophila pneumoniae J138
auuuuuuaauaaaauuua

SEQ ID NO: 532738 - RNA, 16 nt, Chlamydophila pneumoniae J138
auuuuuugagaaauau

SEQ ID NO: 532739 - RNA, 15 nt, Chlamydophila pneumoniae J138
auuuuuugagaaaua

SEQ ID NO: 532740 - RNA, 19 nt, Chlamydophila pneumoniae J138
caaaaaagagcccaaaaac

SEQ ID NO: 532741 - RNA, 17 nt, Chlamydophila pneumoniae J138
auuuucucugagcagcu

SEQ ID NO: 532742 - RNA, 15 nt, Chlamydophila pneumoniae J138
auuuucucaauagug

SEQ ID NO: 532743 - RNA, 17 nt, Chlamydophila pneumoniae J138
auuuuccgcaaaggaaa

SEQ ID NO: 532744 - RNA, 20 nt, Chlamydophila pneumoniae J138
auuuucuggugccuguaauu

SEQ ID NO: 532745 - RNA, 16 nt, Chlamydophila pneumoniae J138
auuuucagucguuuag

SEQ ID NO: 532746 - RNA, 17 nt, Chlamydophila pneumoniae J138
auuuucagccugucuau

SEQ ID NO: 532747 - RNA, 21 nt, Chlamydophila pneumoniae J138
auuuucagccugucuauaaaa

SEQ ID NO: 532748 - RNA, 16 nt, Chlamydophila pneumoniae J138
auuuuccaggaccaaa

SEQ ID NO: 532749 - RNA, 17 nt, Chlamydophila pneumoniae J138
auuuucccauuacagcc

SEQ ID NO: 532750 - RNA, 17 nt, Chlamydophila pneumoniae J138
auuuuaaagcaaaaauu

SEQ ID NO: 532751 - RNA, 22 nt, Chlamydophila pneumoniae J138
auuuguugucagcuuugcuuau

SEQ ID NO: 532752 - RNA, 14 nt, Chlamydophila pneumoniae J138
auuuguuuagcaua

SEQ ID NO: 532753 - RNA, 16 nt, Chlamydophila pneumoniae J138
auuuuaaaaucuccuc

SEQ ID NO: 532754 - RNA, 20 nt, Chlamydophila pneumoniae J138
auuuguugucagcuuugcuu

SEQ ID NO: 532755 - RNA, 13 nt, Chlamydophila pneumoniae J138
auuuuaaagucac

SEQ ID NO: 532756 - RNA, 17 nt, Chlamydophila pneumoniae J138
auuuucuugucucuugc

SEQ ID NO: 532757 - RNA, 16 nt, Chlamydophila pneumoniae J138
auuuugacguaaugca

SEQ ID NO: 532758 - RNA, 18 nt, Chlamydophila pneumoniae J138
auuuugacguaaugcaga

SEQ ID NO: 532759 - RNA, 19 nt, Chlamydophila pneumoniae J138
auuuugcaaaugaaaagag

SEQ ID NO: 532760 - RNA, 16 nt, Chlamydophila pneumoniae J138
auuuuggugagaucau

SEQ ID NO: 532761 - RNA, 11 nt, Chlamydophila pneumoniae J138
auuuuggugag

SEQ ID NO: 532762 - RNA, 16 nt, Chlamydophila pneumoniae J138
auuuuuagaauagaag

SEQ ID NO: 532763 - RNA, 15 nt, Chlamydophila pneumoniae J138
auuuuuaauuuuucu

SEQ ID NO: 532764 - RNA, 20 nt, Chlamydophila pneumoniae J138
auuuacaauuguguuugcag

SEQ ID NO: 532765 - RNA, 21 nt, Chlamydophila pneumoniae J138
auuuagauaaagaaagcgcuc

SEQ ID NO: 532766 - RNA, 12 nt, Chlamydophila pneumoniae J138
auugucuucagu

SEQ ID NO: 532767 - RNA, 12 nt, Chlamydophila pneumoniae J138
auugucuuaaaa

SEQ ID NO: 532768 - RNA, 16 nt, Chlamydophila pneumoniae J138
auuguuuguaucaaag

SEQ ID NO: 532769 - RNA, 20 nt, Chlamydophila pneumoniae J138
auuguggaacgcauaagaga

SEQ ID NO: 532770 - RNA, 17 nt, Chlamydophila pneumoniae J138
auugugcucaauacaga

SEQ ID NO: 532771 - RNA, 14 nt, Chlamydophila pneumoniae J138
auuguuuuugcaaa

SEQ ID NO: 532772 - RNA, 21 nt, Chlamydophila pneumoniae J138
auuuaaaagguuuugaagcuc

SEQ ID NO: 532773 - RNA, 18 nt, Chlamydophila pneumoniae J138
auugcuacuguccaucca

SEQ ID NO: 532774 - RNA, 13 nt, Chlamydophila pneumoniae J138
auuggaucuugau

SEQ ID NO: 532775 - RNA, 12 nt, Chlamydophila pneumoniae J138
auuggagucuaa

SEQ ID NO: 532776 - RNA, 13 nt, Chlamydophila pneumoniae J138
auuggaagcaaag

SEQ ID NO: 532777 - RNA, 20 nt, Chlamydophila pneumoniae J138
auuggcauagagccuagaga

SEQ ID NO: 532778 - RNA, 15 nt, Chlamydophila pneumoniae J138
aaaagguuuugaagc

SEQ ID NO: 532779 - RNA, 13 nt, Chlamydophila pneumoniae J138
aaaagguuuugaa

SEQ ID NO: 532780 - RNA, 21 nt, Chlamydophila pneumoniae J138
aaaaguacgaccaacuccuca

SEQ ID NO: 532781 - RNA, 23 nt, Chlamydophila pneumoniae J138
auuccaggauucuauaacuacaa

SEQ ID NO: 532782 - RNA, 14 nt, Chlamydophila pneumoniae J138
auuccaggcucuag

SEQ ID NO: 532783 - RNA, 18 nt, Chlamydophila pneumoniae J138
auuccccagggagaucua

SEQ ID NO: 532784 - RNA, 17 nt, Chlamydophila pneumoniae J138
auucauaaagaggaaug

SEQ ID NO: 532785 - RNA, 21 nt, Chlamydophila pneumoniae J138
auuccagaaaaagaacauaag

SEQ ID NO: 532786 - RNA, 21 nt, Chlamydophila pneumoniae J138
auuccgaauugcgaauccuga

SEQ ID NO: 532787 - RNA, 20 nt, Chlamydophila pneumoniae J138
auucccuuuuuccauaccca

SEQ ID NO: 532788 - RNA, 14 nt, Chlamydophila pneumoniae J138
auuccucuugaucu

SEQ ID NO: 532789 - RNA, 17 nt, Chlamydophila pneumoniae J138
auuccucucacauuugc

SEQ ID NO: 532790 - RNA, 17 nt, Chlamydophila pneumoniae J138
auucuagaccugccaag

SEQ ID NO: 532791 - RNA, 16 nt, Chlamydophila pneumoniae J138
auucuaaaagagcaag

SEQ ID NO: 532792 - RNA, 15 nt, Chlamydophila pneumoniae J138
auucuaaaaagaaaa

SEQ ID NO: 532793 - RNA, 12 nt, Chlamydophila pneumoniae J138
auucuaaaaaga

SEQ ID NO: 532794 - RNA, 11 nt, Chlamydophila pneumoniae J138
auucuaaaaag

SEQ ID NO: 532795 - RNA, 22 nt, Chlamydophila pneumoniae J138
auucggcagaaggcuuguuucu

SEQ ID NO: 532796 - RNA, 16 nt, Chlamydophila pneumoniae J138
auucgagauauggaag

SEQ ID NO: 532797 - RNA, 19 nt, Chlamydophila pneumoniae J138
auucgauuccugaggcuau

SEQ ID NO: 532798 - RNA, 20 nt, Chlamydophila pneumoniae J138
auucgccaaacgaauuucuu

SEQ ID NO: 532799 - RNA, 19 nt, Chlamydophila pneumoniae J138
auugacuaucgcaaauuuc

SEQ ID NO: 532800 - RNA, 15 nt, Chlamydophila pneumoniae J138
auugacugcuagagu

SEQ ID NO: 532801 - RNA, 20 nt, Chlamydophila pneumoniae J138
auugaggauaaguucuucca

SEQ ID NO: 532802 - RNA, 16 nt, Chlamydophila pneumoniae J138
auugaggauaaguucu

SEQ ID NO: 532803 - RNA, 23 nt, Chlamydophila pneumoniae J138
auugaggacaacagcaacacucg

SEQ ID NO: 532804 - RNA, 12 nt, Chlamydophila pneumoniae J138
auugaguguugu

SEQ ID NO: 532805 - RNA, 20 nt, Chlamydophila pneumoniae J138
auugacuagcucucuugcua

SEQ ID NO: 532806 - RNA, 21 nt, Chlamydophila pneumoniae J138
auugacgacgacgucuucuua

SEQ ID NO: 532807 - RNA, 19 nt, Chlamydophila pneumoniae J138
auugacaacacgaucuaag

SEQ ID NO: 532808 - RNA, 23 nt, Chlamydophila pneumoniae J138
auugaacagucuugcgccagcaa

SEQ ID NO: 532809 - RNA, 21 nt, Chlamydophila pneumoniae J138
auucuuuaugagagagcucuu

SEQ ID NO: 532810 - RNA, 22 nt, Chlamydophila pneumoniae J138
auucuucagaaucuuugugaua

SEQ ID NO: 532811 - RNA, 22 nt, Chlamydophila pneumoniae J138
auucuucacaaucuaaauaaga

SEQ ID NO: 532812 - RNA, 12 nt, Chlamydophila pneumoniae J138
auucuuaauaua

SEQ ID NO: 532813 - RNA, 19 nt, Chlamydophila pneumoniae J138
auucuuaauauaaaagaag

SEQ ID NO: 532814 - RNA, 15 nt, Chlamydophila pneumoniae J138
auucuuaacaauaua

SEQ ID NO: 532815 - RNA, 19 nt, Chlamydophila pneumoniae J138
auucucccaauauccagaa

SEQ ID NO: 532816 - RNA, 16 nt, Chlamydophila pneumoniae J138
auucuguauaaacaau

SEQ ID NO: 532817 - RNA, 20 nt, Chlamydophila pneumoniae J138
auucuguauaaacaauaaga

SEQ ID NO: 532818 - RNA, 18 nt, Chlamydophila pneumoniae J138
auucuaggccuaaagaau

SEQ ID NO: 532819 - RNA, 19 nt, Chlamydophila pneumoniae J138
auucuaggccuaaagaauu

SEQ ID NO: 532820 - RNA, 17 nt, Chlamydophila pneumoniae J138
auucuauaacuacaaaa

SEQ ID NO: 532821 - RNA, 14 nt, Chlamydophila pneumoniae J138
auucucacucuaug

SEQ ID NO: 532822 - RNA, 18 nt, Chlamydophila pneumoniae J138
auucucaugucuaaguca

SEQ ID NO: 532823 - RNA, 15 nt, Chlamydophila pneumoniae J138
augcaggccaggaga

SEQ ID NO: 532824 - RNA, 17 nt, Chlamydophila pneumoniae J138
augaucgggguuucaga

SEQ ID NO: 532825 - RNA, 21 nt, Chlamydophila pneumoniae J138
augcacgcuuucgucuaaaau

SEQ ID NO: 532826 - RNA, 22 nt, Chlamydophila pneumoniae J138
augcacgcuuucgucuaaaaua

SEQ ID NO: 532827 - RNA, 16 nt, Chlamydophila pneumoniae J138
augaucuacagauagg

SEQ ID NO: 532828 - RNA, 19 nt, Chlamydophila pneumoniae J138
augcauacguuaacaagga

SEQ ID NO: 532829 - RNA, 18 nt, Chlamydophila pneumoniae J138
augcauagaauaaagauu

SEQ ID NO: 532830 - RNA, 13 nt, Chlamydophila pneumoniae J138
augcaucaagaga

SEQ ID NO: 532831 - RNA, 18 nt, Chlamydophila pneumoniae J138
augcauauugccuucuuc

SEQ ID NO: 532832 - RNA, 21 nt, Chlamydophila pneumoniae J138
augcauagaauaaagauuuua

SEQ ID NO: 532833 - RNA, 15 nt, Chlamydophila pneumoniae J138
augcaucucuuaaaa

SEQ ID NO: 532834 - RNA, 22 nt, Chlamydophila pneumoniae J138
augcauucugauccgaaaagaa

SEQ ID NO: 532835 - RNA, 11 nt, Chlamydophila pneumoniae J138
augcccaaaca

SEQ ID NO: 532836 - RNA, 12 nt, Chlamydophila pneumoniae J138
augcccuguucu

SEQ ID NO: 532837 - RNA, 19 nt, Chlamydophila pneumoniae J138
augcgcacggauucuaaaa

SEQ ID NO: 532838 - RNA, 12 nt, Chlamydophila pneumoniae J138
augcgcucuaag

SEQ ID NO: 532839 - RNA, 22 nt, Chlamydophila pneumoniae J138
augcucauuaauaauaucuaac

SEQ ID NO: 532840 - RNA, 12 nt, Chlamydophila pneumoniae J138
augcuaucccac

SEQ ID NO: 532841 - RNA, 18 nt, Chlamydophila pneumoniae J138
aaaagauaaaacauucuc

SEQ ID NO: 532842 - RNA, 12 nt, Chlamydophila pneumoniae J138
augcuaauaaaa

SEQ ID NO: 532843 - RNA, 15 nt, Chlamydophila pneumoniae J138
augcuaauaaaaugc

SEQ ID NO: 532844 - RNA, 23 nt, Chlamydophila pneumoniae J138
augcuaaauuugucaucacauca

SEQ ID NO: 532845 - RNA, 13 nt, Chlamydophila pneumoniae J138
aaaagacaagaga

SEQ ID NO: 532846 - RNA, 14 nt, Chlamydophila pneumoniae J138
aaaagacaagagaa

SEQ ID NO: 532847 - RNA, 20 nt, Chlamydophila pneumoniae J138
aaaagagcucaaaaaguucc

SEQ ID NO: 532848 - RNA, 15 nt, Chlamydophila pneumoniae J138
aaaagagcucaaaaa

SEQ ID NO: 532849 - RNA, 15 nt, Chlamydophila pneumoniae J138
auggcggucuuuguu

SEQ ID NO: 532850 - RNA, 11 nt, Chlamydophila pneumoniae J138
augggaauuug

SEQ ID NO: 532851 - RNA, 23 nt, Chlamydophila pneumoniae J138
augguauucccuaacaggaaaga

SEQ ID NO: 532852 - RNA, 22 nt, Chlamydophila pneumoniae J138
augggugagauuauaaagauaa

SEQ ID NO: 532853 - RNA, 19 nt, Chlamydophila pneumoniae J138
auggucagucucgugcaua

SEQ ID NO: 532854 - RNA, 16 nt, Chlamydophila pneumoniae J138
auggucaggaagaaag

SEQ ID NO: 532855 - RNA, 19 nt, Chlamydophila pneumoniae J138
auggucuuggguuuuaaau

SEQ ID NO: 532856 - RNA, 13 nt, Chlamydophila pneumoniae J138
auggucuuccccc

SEQ ID NO: 532857 - RNA, 18 nt, Chlamydophila pneumoniae J138
auggucucccucacaaga

SEQ ID NO: 532858 - RNA, 22 nt, Chlamydophila pneumoniae J138
auggucucgaaauccuaaaaag

SEQ ID NO: 532859 - RNA, 20 nt, Chlamydophila pneumoniae J138
auguaguaaauuccucuuga

SEQ ID NO: 532860 - RNA, 16 nt, Chlamydophila pneumoniae J138
auguagcuguuccaag

SEQ ID NO: 532861 - RNA, 12 nt, Chlamydophila pneumoniae J138
auguaguaaauu

SEQ ID NO: 532862 - RNA, 23 nt, Chlamydophila pneumoniae J138
auguagguaugacucguguggau

SEQ ID NO: 532863 - RNA, 24 nt, Chlamydophila pneumoniae J138
auguagaaggggguucuaagaaau

SEQ ID NO: 532864 - RNA, 22 nt, Chlamydophila pneumoniae J138
auguagaaggggguucuaagaa

SEQ ID NO: 532865 - RNA, 15 nt, Chlamydophila pneumoniae J138
auguacugaugugaa

SEQ ID NO: 532866 - RNA, 23 nt, Chlamydophila pneumoniae J138
auguauggugcgcgucuccuuga

SEQ ID NO: 532867 - RNA, 23 nt, Chlamydophila pneumoniae J138
auguaucggggauugcaaaauuu

SEQ ID NO: 532868 - RNA, 18 nt, Chlamydophila pneumoniae J138
aaaagcaaccuuaaagau

SEQ ID NO: 532869 - RNA, 16 nt, Chlamydophila pneumoniae J138
aaaagauucuaaauca

SEQ ID NO: 532870 - RNA, 13 nt, Chlamydophila pneumoniae J138
aaaagauucuaaa

SEQ ID NO: 532871 - RNA, 22 nt, Chlamydophila pneumoniae J138
aaaagauuugcgaaucuaagau

SEQ ID NO: 532872 - RNA, 21 nt, Chlamydophila pneumoniae J138
auguaguuugggaugacuggc

SEQ ID NO: 532873 - RNA, 15 nt, Chlamydophila pneumoniae J138
auguaguuagagaag

SEQ ID NO: 532874 - RNA, 21 nt, Chlamydophila pneumoniae J138
aaaagauaguuauuaauaaau

SEQ ID NO: 532875 - RNA, 23 nt, Chlamydophila pneumoniae J138
aaaagaucggaguuaucaaaagg

SEQ ID NO: 532876 - RNA, 13 nt, Chlamydophila pneumoniae J138
aaaagaucuaagu

SEQ ID NO: 532877 - RNA, 22 nt, Chlamydophila pneumoniae J138
aaaagaucggaguuaucaaaag

SEQ ID NO: 532878 - RNA, 21 nt, Chlamydophila pneumoniae J138
auuaucagagacaaguucauc

SEQ ID NO: 532879 - RNA, 14 nt, Chlamydophila pneumoniae J138
auuaucagagacaa

SEQ ID NO: 532880 - RNA, 19 nt, Chlamydophila pneumoniae J138
auuaucaagaaauucuucc

SEQ ID NO: 532881 - RNA, 13 nt, Chlamydophila pneumoniae J138
auuaucaagaaau

SEQ ID NO: 532882 - RNA, 17 nt, Chlamydophila pneumoniae J138
auuaucaagaaauucuu

SEQ ID NO: 532883 - RNA, 16 nt, Chlamydophila pneumoniae J138
auuaucccaaacuucu

SEQ ID NO: 532884 - RNA, 19 nt, Chlamydophila pneumoniae J138
auuaucuucguaauaacua

SEQ ID NO: 532885 - RNA, 22 nt, Chlamydophila pneumoniae J138
aaaagcuagucuuucuaagaag

SEQ ID NO: 532886 - RNA, 13 nt, Chlamydophila pneumoniae J138
auuagcuaaauca

SEQ ID NO: 532887 - RNA, 14 nt, Chlamydophila pneumoniae J138
auuaguaacuaaau

SEQ ID NO: 532888 - RNA, 20 nt, Chlamydophila pneumoniae J138
auuaguaaaugccucuuuca

SEQ ID NO: 532889 - RNA, 14 nt, Chlamydophila pneumoniae J138
auuauaaauagaaa

SEQ ID NO: 532890 - RNA, 18 nt, Chlamydophila pneumoniae J138
auucaggauacucugaac

SEQ ID NO: 532891 - RNA, 17 nt, Chlamydophila pneumoniae J138
auucaggacccuuuucc

SEQ ID NO: 532892 - RNA, 16 nt, Chlamydophila pneumoniae J138
auucaguuccucaucc

SEQ ID NO: 532893 - RNA, 16 nt, Chlamydophila pneumoniae J138
auucagugucuugaag

SEQ ID NO: 532894 - RNA, 18 nt, Chlamydophila pneumoniae J138
auucacguauagguugaa

SEQ ID NO: 532895 - RNA, 18 nt, Chlamydophila pneumoniae J138
auucacgccuauagauuc

SEQ ID NO: 532896 - RNA, 17 nt, Chlamydophila pneumoniae J138
auucagauccaaagacg

SEQ ID NO: 532897 - RNA, 12 nt, Chlamydophila pneumoniae J138
auucagagaaag

SEQ ID NO: 532898 - RNA, 17 nt, Chlamydophila pneumoniae J138
auucaacacggacacua

SEQ ID NO: 532899 - RNA, 15 nt, Chlamydophila pneumoniae J138
auuauucuagaguug

SEQ ID NO: 532900 - RNA, 12 nt, Chlamydophila pneumoniae J138
auuauucccuaa

SEQ ID NO: 532901 - RNA, 12 nt, Chlamydophila pneumoniae J138
auuauucuagag

SEQ ID NO: 532902 - RNA, 16 nt, Chlamydophila pneumoniae J138
auucacaucuuaaaaa

SEQ ID NO: 532903 - RNA, 19 nt, Chlamydophila pneumoniae J138
auucacaucuuaaaaacua

SEQ ID NO: 532904 - RNA, 23 nt, Chlamydophila pneumoniae J138
auuaauccuugagggcuauccac

SEQ ID NO: 532905 - RNA, 18 nt, Chlamydophila pneumoniae J138
auuaauccuugagggcua

SEQ ID NO: 532906 - RNA, 22 nt, Chlamydophila pneumoniae J138
auuaauccuugagggcuaucca

SEQ ID NO: 532907 - RNA, 15 nt, Chlamydophila pneumoniae J138
aaaagcagacgaaua

SEQ ID NO: 532908 - RNA, 23 nt, Chlamydophila pneumoniae J138
aaaagcauagucgucuuuuaaag

SEQ ID NO: 532909 - RNA, 16 nt, Chlamydophila pneumoniae J138
auuaauaucccaguuu

SEQ ID NO: 532910 - RNA, 20 nt, Chlamydophila pneumoniae J138
auuaauaucccaguuuuccc

SEQ ID NO: 532911 - RNA, 21 nt, Chlamydophila pneumoniae J138
auuaacagagcgccuccaccu

SEQ ID NO: 532912 - RNA, 18 nt, Chlamydophila pneumoniae J138
auuaaauucuuuucuaca

SEQ ID NO: 532913 - RNA, 15 nt, Chlamydophila pneumoniae J138
auuaagucaccuuaa

SEQ ID NO: 532914 - RNA, 13 nt, Chlamydophila pneumoniae J138
auuaagucaccuu

SEQ ID NO: 532915 - RNA, 12 nt, Chlamydophila pneumoniae J138
auuacagaaagg

SEQ ID NO: 532916 - RNA, 18 nt, Chlamydophila pneumoniae J138
auuacagaaaggcuuuuc

SEQ ID NO: 532917 - RNA, 22 nt, Chlamydophila pneumoniae J138
auuacagcaucuauagaauuuc

SEQ ID NO: 532918 - RNA, 22 nt, Chlamydophila pneumoniae J138
auuaaauuguauggaauucaaa

SEQ ID NO: 532919 - RNA, 19 nt, Chlamydophila pneumoniae J138
auuaaauuguauggaauuc

SEQ ID NO: 532920 - RNA, 18 nt, Chlamydophila pneumoniae J138
auuaaauauauaaagaac

SEQ ID NO: 532921 - RNA, 23 nt, Chlamydophila pneumoniae J138
auuaaaguccaagaucaaacgaa

SEQ ID NO: 532922 - RNA, 17 nt, Chlamydophila pneumoniae J138
auuaaagugaaagcaac

SEQ ID NO: 532923 - RNA, 23 nt, Chlamydophila pneumoniae J138
auuaaaaguucagcaaggaaguu

SEQ ID NO: 532924 - RNA, 14 nt, Chlamydophila pneumoniae J138
auguuuaaagcaua

SEQ ID NO: 532925 - RNA, 17 nt, Chlamydophila pneumoniae J138
auguccuccauggaaag

SEQ ID NO: 532926 - RNA, 19 nt, Chlamydophila pneumoniae J138
auguccuucaaaauguuua

SEQ ID NO: 532927 - RNA, 17 nt, Chlamydophila pneumoniae J138
auguccauuaauauccc

SEQ ID NO: 532928 - RNA, 13 nt, Chlamydophila pneumoniae J138
aucuuccucuuuu

SEQ ID NO: 532929 - RNA, 19 nt, Chlamydophila pneumoniae J138
aucuuuauuuuuaaaaaua

SEQ ID NO: 532930 - RNA, 14 nt, Chlamydophila pneumoniae J138
aucuuucaucaaug

SEQ ID NO: 532931 - RNA, 15 nt, Chlamydophila pneumoniae J138
aucuuuguugagaag

SEQ ID NO: 532932 - RNA, 21 nt, Chlamydophila pneumoniae J138
augaaagugcucuuuuaacuu

SEQ ID NO: 532933 - RNA, 17 nt, Chlamydophila pneumoniae J138
augaaauacuccacuuu

SEQ ID NO: 532934 - RNA, 18 nt, Chlamydophila pneumoniae J138
augaaauaguguuucuuu

SEQ ID NO: 532935 - RNA, 16 nt, Chlamydophila pneumoniae J138
aucuuuuacagacuga

SEQ ID NO: 532936 - RNA, 14 nt, Chlamydophila pneumoniae J138
augaacgauuucuu

SEQ ID NO: 532937 - RNA, 19 nt, Chlamydophila pneumoniae J138
augaacucaggcuuuaagu

SEQ ID NO: 532938 - RNA, 20 nt, Chlamydophila pneumoniae J138
augaacugccugagaaaagu

SEQ ID NO: 532939 - RNA, 22 nt, Chlamydophila pneumoniae J138
augaagccaaaaggcacagcaa

SEQ ID NO: 532940 - RNA, 22 nt, Chlamydophila pneumoniae J138
augaacagccucugugguuuuu

SEQ ID NO: 532941 - RNA, 17 nt, Chlamydophila pneumoniae J138
augaaucacagcgcugu

SEQ ID NO: 532942 - RNA, 17 nt, Chlamydophila pneumoniae J138
augaaucacaucuaaag

SEQ ID NO: 532943 - RNA, 20 nt, Chlamydophila pneumoniae J138
augaaucacaucuaaagauu

SEQ ID NO: 532944 - RNA, 14 nt, Chlamydophila pneumoniae J138
augaaugacugcag

SEQ ID NO: 532945 - RNA, 15 nt, Chlamydophila pneumoniae J138
augaaugauuuccau

SEQ ID NO: 532946 - RNA, 12 nt, Chlamydophila pneumoniae J138
augacucuagag

SEQ ID NO: 532947 - RNA, 18 nt, Chlamydophila pneumoniae J138
augacuggcgacuugcca

SEQ ID NO: 532948 - RNA, 20 nt, Chlamydophila pneumoniae J138
augacugcagauugcacuug

SEQ ID NO: 532949 - RNA, 17 nt, Chlamydophila pneumoniae J138
augacaguguccacugc

SEQ ID NO: 532950 - RNA, 22 nt, Chlamydophila pneumoniae J138
augacauugcaauacaucuuaa

SEQ ID NO: 532951 - RNA, 16 nt, Chlamydophila pneumoniae J138
augacauugcaauaca

SEQ ID NO: 532952 - RNA, 17 nt, Chlamydophila pneumoniae J138
augacauugcaauacau

SEQ ID NO: 532953 - RNA, 15 nt, Chlamydophila pneumoniae J138
augagcucuauuucu

SEQ ID NO: 532954 - RNA, 20 nt, Chlamydophila pneumoniae J138
augagcuccaaaauaaucuc

SEQ ID NO: 532955 - RNA, 21 nt, Chlamydophila pneumoniae J138
augagcucacgcaccauuccu

SEQ ID NO: 532956 - RNA, 18 nt, Chlamydophila pneumoniae J138
augagcucaggcaacaac

SEQ ID NO: 532957 - RNA, 21 nt, Chlamydophila pneumoniae J138
augaggagcucccucuagagc

SEQ ID NO: 532958 - RNA, 20 nt, Chlamydophila pneumoniae J138
augagcgagguauucucugg

SEQ ID NO: 532959 - RNA, 19 nt, Chlamydophila pneumoniae J138
augacuugacacaggaggu

SEQ ID NO: 532960 - RNA, 20 nt, Chlamydophila pneumoniae J138
augacuugacacaggagguu

SEQ ID NO: 532961 - RNA, 22 nt, Chlamydophila pneumoniae J138
augacuuuuguugcaauuccau

SEQ ID NO: 532962 - RNA, 13 nt, Chlamydophila pneumoniae J138
augagggaaaugc

SEQ ID NO: 532963 - RNA, 17 nt, Chlamydophila pneumoniae J138
augaggcacauguagga

SEQ ID NO: 532964 - RNA, 18 nt, Chlamydophila pneumoniae J138
augauauuuuuauuuaaa

SEQ ID NO: 532965 - RNA, 19 nt, Chlamydophila pneumoniae J138
augauauuuuuauuuaaaa

SEQ ID NO: 532966 - RNA, 21 nt, Chlamydophila pneumoniae J138
augauauuuuuauuuaaaauu

SEQ ID NO: 532967 - RNA, 13 nt, Chlamydophila pneumoniae J138
augaucagagaga

SEQ ID NO: 532968 - RNA, 19 nt, Chlamydophila pneumoniae J138
augaucagagagaggggag

SEQ ID NO: 532969 - RNA, 21 nt, Chlamydophila pneumoniae J138
augaucagagagaggggaguc

SEQ ID NO: 532970 - RNA, 17 nt, Chlamydophila pneumoniae J138
augauaaagccugcacg

SEQ ID NO: 532971 - RNA, 20 nt, Chlamydophila pneumoniae J138
augaguggguucacuccuga

SEQ ID NO: 532972 - RNA, 18 nt, Chlamydophila pneumoniae J138
augauaccaccuaaaaug

SEQ ID NO: 532973 - RNA, 20 nt, Chlamydophila pneumoniae J138
augauaccaagaugaagaaa

SEQ ID NO: 532974 - RNA, 13 nt, Chlamydophila pneumoniae J138
augauaauuucau

SEQ ID NO: 532975 - RNA, 21 nt, Chlamydophila pneumoniae J138
aucuacacgcuauagcaacag

SEQ ID NO: 532976 - RNA, 22 nt, Chlamydophila pneumoniae J138
aucuacacacaugacaaauaaa

SEQ ID NO: 532977 - RNA, 17 nt, Chlamydophila pneumoniae J138
aucuacaaaaacuagaa

SEQ ID NO: 532978 - RNA, 19 nt, Chlamydophila pneumoniae J138
aucuacaaaaacuagaaua

SEQ ID NO: 532979 - RNA, 20 nt, Chlamydophila pneumoniae J138
aucuaauuuuagaacuucaa

SEQ ID NO: 532980 - RNA, 18 nt, Chlamydophila pneumoniae J138
aucuacaaacagauuuuu

SEQ ID NO: 532981 - RNA, 20 nt, Chlamydophila pneumoniae J138
aucuacaaacagauuuuuca

SEQ ID NO: 532982 - RNA, 13 nt, Chlamydophila pneumoniae J138
aucuacagagaga

SEQ ID NO: 532983 - RNA, 14 nt, Chlamydophila pneumoniae J138
aucuacagagagaa

SEQ ID NO: 532984 - RNA, 18 nt, Chlamydophila pneumoniae J138
aucuacagagagaaacuu

SEQ ID NO: 532985 - RNA, 16 nt, Chlamydophila pneumoniae J138
aucuagagucucuuuc

SEQ ID NO: 532986 - RNA, 15 nt, Chlamydophila pneumoniae J138
aucguaucuuuuugc

SEQ ID NO: 532987 - RNA, 13 nt, Chlamydophila pneumoniae J138
aucuagcucuuca

SEQ ID NO: 532988 - RNA, 20 nt, Chlamydophila pneumoniae J138
aucuagauuuugagaaugaa

SEQ ID NO: 532989 - RNA, 15 nt, Chlamydophila pneumoniae J138
aucuaggucgauauc

SEQ ID NO: 532990 - RNA, 19 nt, Chlamydophila pneumoniae J138
aucuauagaauuuccaauc

SEQ ID NO: 532991 - RNA, 18 nt, Chlamydophila pneumoniae J138
aucuauaggauuugcaua

SEQ ID NO: 532992 - RNA, 13 nt, Chlamydophila pneumoniae J138
aucuauaaaugua

SEQ ID NO: 532993 - RNA, 10 nt, Chlamydophila pneumoniae J138
aucucaguag

SEQ ID NO: 532994 - RNA, 20 nt, Chlamydophila pneumoniae J138
aucuauccuuaggugaaaua

SEQ ID NO: 532995 - RNA, 18 nt, Chlamydophila pneumoniae J138
aucucugacuugcaagcu

SEQ ID NO: 532996 - RNA, 19 nt, Chlamydophila pneumoniae J138
aucucucuuccugcugcuu

SEQ ID NO: 532997 - RNA, 22 nt, Chlamydophila pneumoniae J138
aucucugacuugcaagcuucuu

SEQ ID NO: 532998 - RNA, 14 nt, Chlamydophila pneumoniae J138
aucucucuuuaaaa

SEQ ID NO: 532999 - RNA, 14 nt, Chlamydophila pneumoniae J138
aucucgcaguccuu

SEQ ID NO: 533000 - RNA, 18 nt, Chlamydophila pneumoniae J138
aucucuggaauacauucc

SEQ ID NO: 533001 - RNA, 21 nt, Chlamydophila pneumoniae J138
aucucugcccccuguuugaac

SEQ ID NO: 533002 - RNA, 16 nt, Chlamydophila pneumoniae J138
aucucuggaauacauu

SEQ ID NO: 533003 - RNA, 20 nt, Chlamydophila pneumoniae J138
aucucuggcauaauccugaa

SEQ ID NO: 533004 - RNA, 14 nt, Chlamydophila pneumoniae J138
aucucuuucacaaa

SEQ ID NO: 533005 - RNA, 18 nt, Chlamydophila pneumoniae J138
aucucuuucauaaauuca

SEQ ID NO: 533006 - RNA, 17 nt, Chlamydophila pneumoniae J138
aucucauuccagcaucu

SEQ ID NO: 533007 - RNA, 21 nt, Chlamydophila pneumoniae J138
aucucaucacguaaggugucu

SEQ ID NO: 533008 - RNA, 21 nt, Chlamydophila pneumoniae J138
aucuccaaacauuuuuaagga

SEQ ID NO: 533009 - RNA, 19 nt, Chlamydophila pneumoniae J138
aucuccaaacauuuuuaag

SEQ ID NO: 533010 - RNA, 19 nt, Chlamydophila pneumoniae J138
aucuccaagccaugcaaug

SEQ ID NO: 533011 - RNA, 14 nt, Chlamydophila pneumoniae J138
aucuccaaagauca

SEQ ID NO: 533012 - RNA, 17 nt, Chlamydophila pneumoniae J138
aucuccagaaauuuuua

SEQ ID NO: 533013 - RNA, 18 nt, Chlamydophila pneumoniae J138
aucuccagaaauuuuuac

SEQ ID NO: 533014 - RNA, 21 nt, Chlamydophila pneumoniae J138
aucuccaagccaugcaaugaa

SEQ ID NO: 533015 - RNA, 14 nt, Chlamydophila pneumoniae J138
aucuccucaucaga

SEQ ID NO: 533016 - RNA, 15 nt, Chlamydophila pneumoniae J138
aucuccucaucagaa

SEQ ID NO: 533017 - RNA, 21 nt, Chlamydophila pneumoniae J138
aucuccugaagccaugacaaa

SEQ ID NO: 533018 - RNA, 15 nt, Chlamydophila pneumoniae J138
aucuccugaagccau

SEQ ID NO: 533019 - RNA, 12 nt, Chlamydophila pneumoniae J138
aucuccucucuc

SEQ ID NO: 533020 - RNA, 15 nt, Chlamydophila pneumoniae J138
aucuuaugggagaag

SEQ ID NO: 533021 - RNA, 12 nt, Chlamydophila pneumoniae J138
aucuuauagaca

SEQ ID NO: 533022 - RNA, 16 nt, Chlamydophila pneumoniae J138
aucuuauagacaggua

SEQ ID NO: 533023 - RNA, 11 nt, Chlamydophila pneumoniae J138
aucuucaaaag

SEQ ID NO: 533024 - RNA, 12 nt, Chlamydophila pneumoniae J138
aucuucaaaaga

SEQ ID NO: 533025 - RNA, 13 nt, Chlamydophila pneumoniae J138
aucuucagagaga

SEQ ID NO: 533026 - RNA, 16 nt, Chlamydophila pneumoniae J138
aucuucagaauuuuau

SEQ ID NO: 533027 - RNA, 22 nt, Chlamydophila pneumoniae J138
aucuucagagagaacaggaggu

SEQ ID NO: 533028 - RNA, 15 nt, Chlamydophila pneumoniae J138
aucuuccccuaaaaa

SEQ ID NO: 533029 - RNA, 20 nt, Chlamydophila pneumoniae J138
aucuguauaugcuuggcaau

SEQ ID NO: 533030 - RNA, 17 nt, Chlamydophila pneumoniae J138
aucuguauccuuccuua

SEQ ID NO: 533031 - RNA, 17 nt, Chlamydophila pneumoniae J138
aucugucauuaaaaauu

SEQ ID NO: 533032 - RNA, 23 nt, Chlamydophila pneumoniae J138
aucugucauuaaaaauuuaaaag

SEQ ID NO: 533033 - RNA, 18 nt, Chlamydophila pneumoniae J138
aucuguaguaggcacuua

SEQ ID NO: 533034 - RNA, 16 nt, Chlamydophila pneumoniae J138
aucugaauuuuagcuc

SEQ ID NO: 533035 - RNA, 19 nt, Chlamydophila pneumoniae J138
aucugcguuucuuucugau

SEQ ID NO: 533036 - RNA, 22 nt, Chlamydophila pneumoniae J138
aucauuuaaagcugaaauucuu

SEQ ID NO: 533037 - RNA, 12 nt, Chlamydophila pneumoniae J138
aucauuguugcu

SEQ ID NO: 533038 - RNA, 12 nt, Chlamydophila pneumoniae J138
aaaagaaaagac

SEQ ID NO: 533039 - RNA, 20 nt, Chlamydophila pneumoniae J138
aaaagaaagaauaucuuuug

SEQ ID NO: 533040 - RNA, 12 nt, Chlamydophila pneumoniae J138
aucauuagcauc

SEQ ID NO: 533041 - RNA, 18 nt, Chlamydophila pneumoniae J138
aucauuagcaucaucucc

SEQ ID NO: 533042 - RNA, 19 nt, Chlamydophila pneumoniae J138
aucauuaaggugugcuccu

SEQ ID NO: 533043 - RNA, 16 nt, Chlamydophila pneumoniae J138
aucauuaagaagauuc

SEQ ID NO: 533044 - RNA, 19 nt, Chlamydophila pneumoniae J138
aucauuaagaagauucuuu

SEQ ID NO: 533045 - RNA, 14 nt, Chlamydophila pneumoniae J138
aaaacuucaaaagu

SEQ ID NO: 533046 - RNA, 22 nt, Chlamydophila pneumoniae J138
aaaacuucccaucuuguucuaa

SEQ ID NO: 533047 - RNA, 18 nt, Chlamydophila pneumoniae J138
aaaacuuucgaagcgcuc

SEQ ID NO: 533048 - RNA, 16 nt, Chlamydophila pneumoniae J138
auccacugcuuuaggc

SEQ ID NO: 533049 - RNA, 13 nt, Chlamydophila pneumoniae J138
aucauuuuugcua

SEQ ID NO: 533050 - RNA, 21 nt, Chlamydophila pneumoniae J138
auccaaaaaagagcccaaaaa

SEQ ID NO: 533051 - RNA, 21 nt, Chlamydophila pneumoniae J138
auccaaaaaaugcuccugcaa

SEQ ID NO: 533052 - RNA, 17 nt, Chlamydophila pneumoniae J138
auccaagaauagccaua

SEQ ID NO: 533053 - RNA, 13 nt, Chlamydophila pneumoniae J138
auccaaaagcggc

SEQ ID NO: 533054 - RNA, 18 nt, Chlamydophila pneumoniae J138
auccaaaaugucuuuuuc

SEQ ID NO: 533055 - RNA, 15 nt, Chlamydophila pneumoniae J138
auccaccaagacuga

SEQ ID NO: 533056 - RNA, 14 nt, Chlamydophila pneumoniae J138
auccaauagccaaa

SEQ ID NO: 533057 - RNA, 13 nt, Chlamydophila pneumoniae J138
auccaagaaugaa

SEQ ID NO: 533058 - RNA, 15 nt, Chlamydophila pneumoniae J138
auccagguuguccua

SEQ ID NO: 533059 - RNA, 19 nt, Chlamydophila pneumoniae J138
auccaggaauagaaagaca

SEQ ID NO: 533060 - RNA, 20 nt, Chlamydophila pneumoniae J138
auccaggaauagaaagacau

SEQ ID NO: 533061 - RNA, 22 nt, Chlamydophila pneumoniae J138
aucccagauuuuuuugguugcu

SEQ ID NO: 533062 - RNA, 23 nt, Chlamydophila pneumoniae J138
aucccagauaaagacaucucuuu

SEQ ID NO: 533063 - RNA, 21 nt, Chlamydophila pneumoniae J138
aucccauaaauguauaggcau

SEQ ID NO: 533064 - RNA, 21 nt, Chlamydophila pneumoniae J138
aucccuguaguuucuaaaaca

SEQ ID NO: 533065 - RNA, 23 nt, Chlamydophila pneumoniae J138
aucccugcacucuuucagaaaga

SEQ ID NO: 533066 - RNA, 14 nt, Chlamydophila pneumoniae J138
aucccuucuucuuu

SEQ ID NO: 533067 - RNA, 15 nt, Chlamydophila pneumoniae J138
auccgaucauaauua

SEQ ID NO: 533068 - RNA, 18 nt, Chlamydophila pneumoniae J138
auccgcacuuacauuggc

SEQ ID NO: 533069 - RNA, 17 nt, Chlamydophila pneumoniae J138
auccgaaucuauccaua

SEQ ID NO: 533070 - RNA, 22 nt, Chlamydophila pneumoniae J138
auccgacuuuccucaaagccga

SEQ ID NO: 533071 - RNA, 18 nt, Chlamydophila pneumoniae J138
aucgcuaucagcugggua

SEQ ID NO: 533072 - RNA, 20 nt, Chlamydophila pneumoniae J138
aucggcuucuccaacuucca

SEQ ID NO: 533073 - RNA, 18 nt, Chlamydophila pneumoniae J138
aucguaauagcgacauga

SEQ ID NO: 533074 - RNA, 15 nt, Chlamydophila pneumoniae J138
aucguacaggacugu

SEQ ID NO: 533075 - RNA, 15 nt, Chlamydophila pneumoniae J138
auccugcuccaaaau

SEQ ID NO: 533076 - RNA, 18 nt, Chlamydophila pneumoniae J138
auccugcauacccuucuu

SEQ ID NO: 533077 - RNA, 20 nt, Chlamydophila pneumoniae J138
aucgaagaacuuagcaauga

SEQ ID NO: 533078 - RNA, 17 nt, Chlamydophila pneumoniae J138
aucgaacagagaugcaa

SEQ ID NO: 533079 - RNA, 19 nt, Chlamydophila pneumoniae J138
auccuugcaaaacagcauc

SEQ ID NO: 533080 - RNA, 14 nt, Chlamydophila pneumoniae J138
auccuugcaaaaca

SEQ ID NO: 533081 - RNA, 15 nt, Chlamydophila pneumoniae J138
auccuugcaaaacag

SEQ ID NO: 533082 - RNA, 12 nt, Chlamydophila pneumoniae J138
auccugucuauu

SEQ ID NO: 533083 - RNA, 23 nt, Chlamydophila pneumoniae J138
auccuguaacacccucccucaua

SEQ ID NO: 533084 - RNA, 16 nt, Chlamydophila pneumoniae J138
auccuucgaccuauuu

SEQ ID NO: 533085 - RNA, 17 nt, Chlamydophila pneumoniae J138
auccuuccuuauuggua

SEQ ID NO: 533086 - RNA, 16 nt, Chlamydophila pneumoniae J138
auccuuccuuacaagc

SEQ ID NO: 533087 - RNA, 14 nt, Chlamydophila pneumoniae J138
auccuucucccucu

SEQ ID NO: 533088 - RNA, 11 nt, Chlamydophila pneumoniae J138
auccuuccuua

SEQ ID NO: 533089 - RNA, 19 nt, Chlamydophila pneumoniae J138
aucgaccauccuguagcuu

SEQ ID NO: 533090 - RNA, 15 nt, Chlamydophila pneumoniae J138
aucgaccuuaaaauu

SEQ ID NO: 533091 - RNA, 13 nt, Chlamydophila pneumoniae J138
aucgacucuucca

SEQ ID NO: 533092 - RNA, 22 nt, Chlamydophila pneumoniae J138
aucgacucuuccaauuguaaau

SEQ ID NO: 533093 - RNA, 17 nt, Chlamydophila pneumoniae J138
aucgacucuucgcccau

SEQ ID NO: 533094 - RNA, 12 nt, Chlamydophila pneumoniae J138
auacuuauacca

SEQ ID NO: 533095 - RNA, 18 nt, Chlamydophila pneumoniae J138
auacugcugcuaagccaa

SEQ ID NO: 533096 - RNA, 15 nt, Chlamydophila pneumoniae J138
auacuucuccacagc

SEQ ID NO: 533097 - RNA, 17 nt, Chlamydophila pneumoniae J138
auacuucaggacgcaca

SEQ ID NO: 533098 - RNA, 15 nt, Chlamydophila pneumoniae J138
auacuucaggacgca

SEQ ID NO: 533099 - RNA, 16 nt, Chlamydophila pneumoniae J138
auacuuauauuggcuu

SEQ ID NO: 533100 - RNA, 20 nt, Chlamydophila pneumoniae J138
auacuucuuccacgagauuc

SEQ ID NO: 533101 - RNA, 18 nt, Chlamydophila pneumoniae J138
auacgcuagcucuuaaau

SEQ ID NO: 533102 - RNA, 22 nt, Chlamydophila pneumoniae J138
auacuccacuuuuuucccucca

SEQ ID NO: 533103 - RNA, 15 nt, Chlamydophila pneumoniae J138
auacucuauuaagga

SEQ ID NO: 533104 - RNA, 19 nt, Chlamydophila pneumoniae J138
auacgccaaggucuucccg

SEQ ID NO: 533105 - RNA, 23 nt, Chlamydophila pneumoniae J138
auaccggcaaauaaaguccucca

SEQ ID NO: 533106 - RNA, 14 nt, Chlamydophila pneumoniae J138
auaccuccuccaau

SEQ ID NO: 533107 - RNA, 18 nt, Chlamydophila pneumoniae J138
auaccuccuccaaucugc

SEQ ID NO: 533108 - RNA, 19 nt, Chlamydophila pneumoniae J138
auaccuccuccaaucugcu

SEQ ID NO: 533109 - RNA, 23 nt, Chlamydophila pneumoniae J138
auacagcuguuuacuuuucucuu

SEQ ID NO: 533110 - RNA, 13 nt, Chlamydophila pneumoniae J138
auagacucuuccu

SEQ ID NO: 533111 - RNA, 15 nt, Chlamydophila pneumoniae J138
auagacuccuuaaca

SEQ ID NO: 533112 - RNA, 15 nt, Chlamydophila pneumoniae J138
auagacuuugaguuc

SEQ ID NO: 533113 - RNA, 15 nt, Chlamydophila pneumoniae J138
auagaaaaucuuguu

SEQ ID NO: 533114 - RNA, 16 nt, Chlamydophila pneumoniae J138
auagaaaacauauccc

SEQ ID NO: 533115 - RNA, 16 nt, Chlamydophila pneumoniae J138
auagauucaugaaaug

SEQ ID NO: 533116 - RNA, 13 nt, Chlamydophila pneumoniae J138
auagauaugccuc

SEQ ID NO: 533117 - RNA, 16 nt, Chlamydophila pneumoniae J138
auagaucacaucaaga

SEQ ID NO: 533118 - RNA, 21 nt, Chlamydophila pneumoniae J138
auagauccugaaaguacagaa

SEQ ID NO: 533119 - RNA, 18 nt, Chlamydophila pneumoniae J138
auagauccaagaaugaau

SEQ ID NO: 533120 - RNA, 19 nt, Chlamydophila pneumoniae J138
auagaguucgcacuaauuu

SEQ ID NO: 533121 - RNA, 13 nt, Chlamydophila pneumoniae J138
auagagucucuug

SEQ ID NO: 533122 - RNA, 14 nt, Chlamydophila pneumoniae J138
auagagucucuuga

SEQ ID NO: 533123 - RNA, 17 nt, Chlamydophila pneumoniae J138
auagcauggagaauaau

SEQ ID NO: 533124 - RNA, 18 nt, Chlamydophila pneumoniae J138
auagcaucccuucuucuu

SEQ ID NO: 533125 - RNA, 20 nt, Chlamydophila pneumoniae J138
auagcauggagaauaaucuc

SEQ ID NO: 533126 - RNA, 23 nt, Chlamydophila pneumoniae J138
auagcaggaaggaauagagaaag

SEQ ID NO: 533127 - RNA, 17 nt, Chlamydophila pneumoniae J138
auagcaaagauuucugc

SEQ ID NO: 533128 - RNA, 17 nt, Chlamydophila pneumoniae J138
auagcaagcacuuucgc

SEQ ID NO: 533129 - RNA, 17 nt, Chlamydophila pneumoniae J138
auagcaauggcuuuuuu

SEQ ID NO: 533130 - RNA, 19 nt, Chlamydophila pneumoniae J138
auagccucuucuacaccau

SEQ ID NO: 533131 - RNA, 20 nt, Chlamydophila pneumoniae J138
auagcggucacugugauuuu

SEQ ID NO: 533132 - RNA, 19 nt, Chlamydophila pneumoniae J138
auagcgacaugagaaaucu

SEQ ID NO: 533133 - RNA, 13 nt, Chlamydophila pneumoniae J138
auagcgagaacac

SEQ ID NO: 533134 - RNA, 17 nt, Chlamydophila pneumoniae J138
auaguuuuuauuuuuaa

SEQ ID NO: 533135 - RNA, 13 nt, Chlamydophila pneumoniae J138
auauaaaagaaga

SEQ ID NO: 533136 - RNA, 13 nt, Chlamydophila pneumoniae J138
auagcucagcucu

SEQ ID NO: 533137 - RNA, 17 nt, Chlamydophila pneumoniae J138
auagcuccuuggcuaug

SEQ ID NO: 533138 - RNA, 17 nt, Chlamydophila pneumoniae J138
auagcuaugaguugcuu

SEQ ID NO: 533139 - RNA, 19 nt, Chlamydophila pneumoniae J138
auagcuaagagcaucuuug

SEQ ID NO: 533140 - RNA, 19 nt, Chlamydophila pneumoniae J138
auagucuucuacuaggcgc

SEQ ID NO: 533141 - RNA, 19 nt, Chlamydophila pneumoniae J138
auaguuauuaauaaauuua

SEQ ID NO: 533142 - RNA, 22 nt, Chlamydophila pneumoniae J138
auaguggcgaauccuagagaac

SEQ ID NO: 533143 - RNA, 12 nt, Chlamydophila pneumoniae J138
auauauccugag

SEQ ID NO: 533144 - RNA, 13 nt, Chlamydophila pneumoniae J138
auauauccugagu

SEQ ID NO: 533145 - RNA, 22 nt, Chlamydophila pneumoniae J138
auauacugccagcgaucacaua

SEQ ID NO: 533146 - RNA, 22 nt, Chlamydophila pneumoniae J138
auauaagauaauagagaagaag

SEQ ID NO: 533147 - RNA, 21 nt, Chlamydophila pneumoniae J138
auauaagggggaucuucagag

SEQ ID NO: 533148 - RNA, 11 nt, Chlamydophila pneumoniae J138
auauaccacua

SEQ ID NO: 533149 - RNA, 15 nt, Chlamydophila pneumoniae J138
auauaaucguuuuuu

SEQ ID NO: 533150 - RNA, 19 nt, Chlamydophila pneumoniae J138
auaucauauuuuuguccug

SEQ ID NO: 533151 - RNA, 14 nt, Chlamydophila pneumoniae J138
auaucaucaaaaga

SEQ ID NO: 533152 - RNA, 14 nt, Chlamydophila pneumoniae J138
auaucaucacuaag

SEQ ID NO: 533153 - RNA, 14 nt, Chlamydophila pneumoniae J138
auauauuuuuaaag

SEQ ID NO: 533154 - RNA, 23 nt, Chlamydophila pneumoniae J138
auaucaguauggcguuuuuuuug

SEQ ID NO: 533155 - RNA, 18 nt, Chlamydophila pneumoniae J138
auaucgaguucuuuuugc

SEQ ID NO: 533156 - RNA, 13 nt, Chlamydophila pneumoniae J138
auaucccaaagcu

SEQ ID NO: 533157 - RNA, 22 nt, Chlamydophila pneumoniae J138
auaucgccuuccuuaacaacau

SEQ ID NO: 533158 - RNA, 19 nt, Chlamydophila pneumoniae J138
auaucgccguuaaagacuu

SEQ ID NO: 533159 - RNA, 19 nt, Chlamydophila pneumoniae J138
auaucgcguguaaaagcuu

SEQ ID NO: 533160 - RNA, 16 nt, Chlamydophila pneumoniae J138
auaucgcguguaaaag

SEQ ID NO: 533161 - RNA, 23 nt, Chlamydophila pneumoniae J138
auaucuucuggguucuccacaug

SEQ ID NO: 533162 - RNA, 21 nt, Chlamydophila pneumoniae J138
auaucucuaccgaacagagcg

SEQ ID NO: 533163 - RNA, 19 nt, Chlamydophila pneumoniae J138
auaucuccuuuaaauaaaa

SEQ ID NO: 533164 - RNA, 22 nt, Chlamydophila pneumoniae J138
auaucugcgccagcucucuuga

SEQ ID NO: 533165 - RNA, 20 nt, Chlamydophila pneumoniae J138
auaucgguuucuuuuuuuug

SEQ ID NO: 533166 - RNA, 21 nt, Chlamydophila pneumoniae J138
auaucuauagaaggcaucccg

SEQ ID NO: 533167 - RNA, 17 nt, Chlamydophila pneumoniae J138
auauugugcauuaccuc

SEQ ID NO: 533168 - RNA, 16 nt, Chlamydophila pneumoniae J138
auauuuccaguauucu

SEQ ID NO: 533169 - RNA, 14 nt, Chlamydophila pneumoniae J138
auauugcucuugua

SEQ ID NO: 533170 - RNA, 12 nt, Chlamydophila pneumoniae J138
auauugcucuug

SEQ ID NO: 533171 - RNA, 13 nt, Chlamydophila pneumoniae J138
auauugaucuuuc

SEQ ID NO: 533172 - RNA, 19 nt, Chlamydophila pneumoniae J138
auauugcaaagcaucuugu

SEQ ID NO: 533173 - RNA, 15 nt, Chlamydophila pneumoniae J138
auaugauuuccacuu

SEQ ID NO: 533174 - RNA, 15 nt, Chlamydophila pneumoniae J138
aucaaaaugcugcuu

SEQ ID NO: 533175 - RNA, 18 nt, Chlamydophila pneumoniae J138
aucaagaagagaaaagau

SEQ ID NO: 533176 - RNA, 14 nt, Chlamydophila pneumoniae J138
aucaagaggaguga

SEQ ID NO: 533177 - RNA, 17 nt, Chlamydophila pneumoniae J138
aucaagacgacacucaa

SEQ ID NO: 533178 - RNA, 17 nt, Chlamydophila pneumoniae J138
aucaaugagaucugcaa

SEQ ID NO: 533179 - RNA, 14 nt, Chlamydophila pneumoniae J138
aucaaugccuugcg

SEQ ID NO: 533180 - RNA, 18 nt, Chlamydophila pneumoniae J138
aucauagccaucauagca

SEQ ID NO: 533181 - RNA, 17 nt, Chlamydophila pneumoniae J138
aucauaaccaaaagaau

SEQ ID NO: 533182 - RNA, 15 nt, Chlamydophila pneumoniae J138
aaaacgccauacuga

SEQ ID NO: 533183 - RNA, 12 nt, Chlamydophila pneumoniae J138
aucaucagaaau

SEQ ID NO: 533184 - RNA, 15 nt, Chlamydophila pneumoniae J138
aucaucagaaaucaa

SEQ ID NO: 533185 - RNA, 13 nt, Chlamydophila pneumoniae J138
aucauaucuucaa

SEQ ID NO: 533186 - RNA, 17 nt, Chlamydophila pneumoniae J138
aucauauuuuucuugaa

SEQ ID NO: 533187 - RNA, 19 nt, Chlamydophila pneumoniae J138
aucauauuuuuguccugca

SEQ ID NO: 533188 - RNA, 18 nt, Chlamydophila pneumoniae J138
aucaucaaugguuaaaac

SEQ ID NO: 533189 - RNA, 15 nt, Chlamydophila pneumoniae J138
aucaucgaagaacuu

SEQ ID NO: 533190 - RNA, 16 nt, Chlamydophila pneumoniae J138
aucacgacgucaucac

SEQ ID NO: 533191 - RNA, 20 nt, Chlamydophila pneumoniae J138
aucagaaaaaaugcguuuug

SEQ ID NO: 533192 - RNA, 15 nt, Chlamydophila pneumoniae J138
aucacguccuucuau

SEQ ID NO: 533193 - RNA, 16 nt, Chlamydophila pneumoniae J138
aucacggaugguugcu

SEQ ID NO: 533194 - RNA, 18 nt, Chlamydophila pneumoniae J138
aucacggaugguugcuuc

SEQ ID NO: 533195 - RNA, 17 nt, Chlamydophila pneumoniae J138
aucagacugaagagcaa

SEQ ID NO: 533196 - RNA, 16 nt, Chlamydophila pneumoniae J138
aucagacugaagagca

SEQ ID NO: 533197 - RNA, 19 nt, Chlamydophila pneumoniae J138
aucagauccaugaacagca

SEQ ID NO: 533198 - RNA, 16 nt, Chlamydophila pneumoniae J138
aucagaggagccucca

SEQ ID NO: 533199 - RNA, 14 nt, Chlamydophila pneumoniae J138
aucagcaacauaaa

SEQ ID NO: 533200 - RNA, 17 nt, Chlamydophila pneumoniae J138
aucagcaacauaaaguu

SEQ ID NO: 533201 - RNA, 16 nt, Chlamydophila pneumoniae J138
aucagauccaugaaca

SEQ ID NO: 533202 - RNA, 18 nt, Chlamydophila pneumoniae J138
aucagauguaaagagcaa

SEQ ID NO: 533203 - RNA, 19 nt, Chlamydophila pneumoniae J138
aucagauguaaagagcaac

SEQ ID NO: 533204 - RNA, 20 nt, Chlamydophila pneumoniae J138
aucagauguaaagagcaaca

SEQ ID NO: 533205 - RNA, 14 nt, Chlamydophila pneumoniae J138
aucagcuguugcgu

SEQ ID NO: 533206 - RNA, 22 nt, Chlamydophila pneumoniae J138
auaaagguuacaagcaauacua

SEQ ID NO: 533207 - RNA, 17 nt, Chlamydophila pneumoniae J138
auaaagguuacaagcaa

SEQ ID NO: 533208 - RNA, 21 nt, Chlamydophila pneumoniae J138
auaaagcccuuuugaauaucc

SEQ ID NO: 533209 - RNA, 19 nt, Chlamydophila pneumoniae J138
auaaagcaacuguaaauuu

SEQ ID NO: 533210 - RNA, 14 nt, Chlamydophila pneumoniae J138
auaaaccuuugguu

SEQ ID NO: 533211 - RNA, 14 nt, Chlamydophila pneumoniae J138
aguuuuccauccac

SEQ ID NO: 533212 - RNA, 12 nt, Chlamydophila pneumoniae J138
auaaaauaggaa

SEQ ID NO: 533213 - RNA, 23 nt, Chlamydophila pneumoniae J138
auaaaaucguuuuauuuuaggag

SEQ ID NO: 533214 - RNA, 14 nt, Chlamydophila pneumoniae J138
auaaaauuggcuuu

SEQ ID NO: 533215 - RNA, 13 nt, Chlamydophila pneumoniae J138
auaaccugggcaa

SEQ ID NO: 533216 - RNA, 15 nt, Chlamydophila pneumoniae J138
auaaccagaagacuc

SEQ ID NO: 533217 - RNA, 17 nt, Chlamydophila pneumoniae J138
auaaauccccaccaaca

SEQ ID NO: 533218 - RNA, 15 nt, Chlamydophila pneumoniae J138
auaaauccaaaaaau

SEQ ID NO: 533219 - RNA, 16 nt, Chlamydophila pneumoniae J138
auaacaaucagaugag

SEQ ID NO: 533220 - RNA, 17 nt, Chlamydophila pneumoniae J138
auaacaaacgccgcucu

SEQ ID NO: 533221 - RNA, 15 nt, Chlamydophila pneumoniae J138
auaacaccaaaagaa

SEQ ID NO: 533222 - RNA, 16 nt, Chlamydophila pneumoniae J138
auaacacuucuuucuu

SEQ ID NO: 533223 - RNA, 23 nt, Chlamydophila pneumoniae J138
auaacagagauggucuuggguuu

SEQ ID NO: 533224 - RNA, 16 nt, Chlamydophila pneumoniae J138
auaacauugcuugcua

SEQ ID NO: 533225 - RNA, 16 nt, Chlamydophila pneumoniae J138
auaacauuuagauaaa

SEQ ID NO: 533226 - RNA, 20 nt, Chlamydophila pneumoniae J138
auaacauuuagauaaagaaa

SEQ ID NO: 533227 - RNA, 20 nt, Chlamydophila pneumoniae J138
auaacauuucguuuuuucuu

SEQ ID NO: 533228 - RNA, 21 nt, Chlamydophila pneumoniae J138
auaaccaaaagaauuaagaag

SEQ ID NO: 533229 - RNA, 16 nt, Chlamydophila pneumoniae J138
auaacaucaagaauuu

SEQ ID NO: 533230 - RNA, 12 nt, Chlamydophila pneumoniae J138
auaacaucaaga

SEQ ID NO: 533231 - RNA, 14 nt, Chlamydophila pneumoniae J138
auaacaucaagaau

SEQ ID NO: 533232 - RNA, 21 nt, Chlamydophila pneumoniae J138
auaacaucuaaaaaugcacuu

SEQ ID NO: 533233 - RNA, 21 nt, Chlamydophila pneumoniae J138
auaaucagaggagccuccaua

SEQ ID NO: 533234 - RNA, 20 nt, Chlamydophila pneumoniae J138
auaaucagaacaacgcugcu

SEQ ID NO: 533235 - RNA, 19 nt, Chlamydophila pneumoniae J138
auaauaggauaagaaauua

SEQ ID NO: 533236 - RNA, 14 nt, Chlamydophila pneumoniae J138
auaauagugagcuc

SEQ ID NO: 533237 - RNA, 16 nt, Chlamydophila pneumoniae J138
auaauagucucuguaa

SEQ ID NO: 533238 - RNA, 22 nt, Chlamydophila pneumoniae J138
auaaucuucaaaagacuuaccg

SEQ ID NO: 533239 - RNA, 14 nt, Chlamydophila pneumoniae J138
auaaucuucaaaag

SEQ ID NO: 533240 - RNA, 20 nt, Chlamydophila pneumoniae J138
auaaucuguaagaaaaugag

SEQ ID NO: 533241 - RNA, 21 nt, Chlamydophila pneumoniae J138
auaaucugcgugucguugguu

SEQ ID NO: 533242 - RNA, 13 nt, Chlamydophila pneumoniae J138
auaaugaagcagg

SEQ ID NO: 533243 - RNA, 19 nt, Chlamydophila pneumoniae J138
auaaugauuccuagaaucu

SEQ ID NO: 533244 - RNA, 20 nt, Chlamydophila pneumoniae J138
auaagucgaaucuaaaaacu

SEQ ID NO: 533245 - RNA, 20 nt, Chlamydophila pneumoniae J138
auaagaaugguuauuucuug

SEQ ID NO: 533246 - RNA, 16 nt, Chlamydophila pneumoniae J138
auaagugacuuuucuu

SEQ ID NO: 533247 - RNA, 17 nt, Chlamydophila pneumoniae J138
auaagaacuuuagggaa

SEQ ID NO: 533248 - RNA, 18 nt, Chlamydophila pneumoniae J138
auaagaacuuuagggaag

SEQ ID NO: 533249 - RNA, 18 nt, Chlamydophila pneumoniae J138
auaagaaaucaguccuaa

SEQ ID NO: 533250 - RNA, 14 nt, Chlamydophila pneumoniae J138
auaagaacucuauu

SEQ ID NO: 533251 - RNA, 19 nt, Chlamydophila pneumoniae J138
auaacugugcuccauagca

SEQ ID NO: 533252 - RNA, 20 nt, Chlamydophila pneumoniae J138
auaauaagcaggaaaagcaa

SEQ ID NO: 533253 - RNA, 17 nt, Chlamydophila pneumoniae J138
auaauaggauaagaaau

SEQ ID NO: 533254 - RNA, 16 nt, Chlamydophila pneumoniae J138
auaauaggauaagaaa

SEQ ID NO: 533255 - RNA, 15 nt, Chlamydophila pneumoniae J138
auaauaggauaagaa

SEQ ID NO: 533256 - RNA, 19 nt, Chlamydophila pneumoniae J138
auacaacgguauguauggu

SEQ ID NO: 533257 - RNA, 18 nt, Chlamydophila pneumoniae J138
auacaauccagaaucucc

SEQ ID NO: 533258 - RNA, 19 nt, Chlamydophila pneumoniae J138
auacaauccagaaucucca

SEQ ID NO: 533259 - RNA, 17 nt, Chlamydophila pneumoniae J138
auacaaguaauuccccu

SEQ ID NO: 533260 - RNA, 22 nt, Chlamydophila pneumoniae J138
auacacaaaucauuuaaagcug

SEQ ID NO: 533261 - RNA, 15 nt, Chlamydophila pneumoniae J138
auacagcauaaaaau

SEQ ID NO: 533262 - RNA, 14 nt, Chlamydophila pneumoniae J138
auacagccagcaga

SEQ ID NO: 533263 - RNA, 19 nt, Chlamydophila pneumoniae J138
auacagauaucaaagcauu

SEQ ID NO: 533264 - RNA, 23 nt, Chlamydophila pneumoniae J138
auaauuuguuuagaaaaagaucu

SEQ ID NO: 533265 - RNA, 16 nt, Chlamydophila pneumoniae J138
auaauuuguuuagaaa

SEQ ID NO: 533266 - RNA, 21 nt, Chlamydophila pneumoniae J138
auacaaaacaaaagccauucc

SEQ ID NO: 533267 - RNA, 14 nt, Chlamydophila pneumoniae J138
auacaaaaaauaaa

SEQ ID NO: 533268 - RNA, 13 nt, Chlamydophila pneumoniae J138
auaauuuucaguc

SEQ ID NO: 533269 - RNA, 14 nt, Chlamydophila pneumoniae J138
aguuacgugagaac

SEQ ID NO: 533270 - RNA, 14 nt, Chlamydophila pneumoniae J138
agugucccauggcu

SEQ ID NO: 533271 - RNA, 19 nt, Chlamydophila pneumoniae J138
aguguccuggcgaugccag

SEQ ID NO: 533272 - RNA, 20 nt, Chlamydophila pneumoniae J138
agugucaucggcuucuccaa

SEQ ID NO: 533273 - RNA, 18 nt, Chlamydophila pneumoniae J138
aguuagagacacagaagg

SEQ ID NO: 533274 - RNA, 13 nt, Chlamydophila pneumoniae J138
aguuaucaaaagg

SEQ ID NO: 533275 - RNA, 23 nt, Chlamydophila pneumoniae J138
aguuagccuggcuaaaggaucau

SEQ ID NO: 533276 - RNA, 14 nt, Chlamydophila pneumoniae J138
aguuauuaauaaau

SEQ ID NO: 533277 - RNA, 15 nt, Chlamydophila pneumoniae J138
aguucaugggguuuc

SEQ ID NO: 533278 - RNA, 20 nt, Chlamydophila pneumoniae J138
aguucaugggguuucuuuuu

SEQ ID NO: 533279 - RNA, 22 nt, Chlamydophila pneumoniae J138
aguucucccgugaacaaaaacu

SEQ ID NO: 533280 - RNA, 20 nt, Chlamydophila pneumoniae J138
aguucucccgugaacaaaaa

SEQ ID NO: 533281 - RNA, 15 nt, Chlamydophila pneumoniae J138
aguucucucuucacu

SEQ ID NO: 533282 - RNA, 13 nt, Chlamydophila pneumoniae J138
aguucuuccuucu

SEQ ID NO: 533283 - RNA, 13 nt, Chlamydophila pneumoniae J138
aguucuucauucc

SEQ ID NO: 533284 - RNA, 23 nt, Chlamydophila pneumoniae J138
aguucuucauuccaggauucuau

SEQ ID NO: 533285 - RNA, 13 nt, Chlamydophila pneumoniae J138
aguucuugaaacu

SEQ ID NO: 533286 - RNA, 21 nt, Chlamydophila pneumoniae J138
aguucuucuuuacucaagugu

SEQ ID NO: 533287 - RNA, 17 nt, Chlamydophila pneumoniae J138
aguucuugaaacucuau

SEQ ID NO: 533288 - RNA, 18 nt, Chlamydophila pneumoniae J138
aguucuugauucucuucc

SEQ ID NO: 533289 - RNA, 17 nt, Chlamydophila pneumoniae J138
aguucgggcuaaucauu

SEQ ID NO: 533290 - RNA, 18 nt, Chlamydophila pneumoniae J138
aguuccauagaguaucua

SEQ ID NO: 533291 - RNA, 21 nt, Chlamydophila pneumoniae J138
aguuccaagacaauaaaaaag

SEQ ID NO: 533292 - RNA, 18 nt, Chlamydophila pneumoniae J138
aguuccaagacaauaaaa

SEQ ID NO: 533293 - RNA, 17 nt, Chlamydophila pneumoniae J138
aguucauuuuaguuuuc

SEQ ID NO: 533294 - RNA, 14 nt, Chlamydophila pneumoniae J138
aguugcgcagugga

SEQ ID NO: 533295 - RNA, 22 nt, Chlamydophila pneumoniae J138
aguuguacaauuugcuccucca

SEQ ID NO: 533296 - RNA, 18 nt, Chlamydophila pneumoniae J138
aguuguagugaaugagcu

SEQ ID NO: 533297 - RNA, 19 nt, Chlamydophila pneumoniae J138
aguuguuguggaaucacgu

SEQ ID NO: 533298 - RNA, 19 nt, Chlamydophila pneumoniae J138
aguuguuuuuugagauaca

SEQ ID NO: 533299 - RNA, 18 nt, Chlamydophila pneumoniae J138
aguuuacaaauaaaauga

SEQ ID NO: 533300 - RNA, 21 nt, Chlamydophila pneumoniae J138
aguuuaccugaaaaaacagua

SEQ ID NO: 533301 - RNA, 18 nt, Chlamydophila pneumoniae J138
aguuuaugacacagcuaa

SEQ ID NO: 533302 - RNA, 23 nt, Chlamydophila pneumoniae J138
aguuucuaaaacagaaauugcuu

SEQ ID NO: 533303 - RNA, 18 nt, Chlamydophila pneumoniae J138
aguuucacauaguuuaau

SEQ ID NO: 533304 - RNA, 17 nt, Chlamydophila pneumoniae J138
aguuucaaucucuccuu

SEQ ID NO: 533305 - RNA, 21 nt, Chlamydophila pneumoniae J138
aguuuguagcagcaagaacau

SEQ ID NO: 533306 - RNA, 16 nt, Chlamydophila pneumoniae J138
aguuugccuucuuauc

SEQ ID NO: 533307 - RNA, 18 nt, Chlamydophila pneumoniae J138
aguuugcaugcaacggag

SEQ ID NO: 533308 - RNA, 21 nt, Chlamydophila pneumoniae J138
aguuucuuuugcaaaucuucg

SEQ ID NO: 533309 - RNA, 22 nt, Chlamydophila pneumoniae J138
agugaaugagcuucacaucuuu

SEQ ID NO: 533310 - RNA, 13 nt, Chlamydophila pneumoniae J138
agugaucagaaau

SEQ ID NO: 533311 - RNA, 17 nt, Chlamydophila pneumoniae J138
aguguauaucagcaaaa

SEQ ID NO: 533312 - RNA, 19 nt, Chlamydophila pneumoniae J138
agucgggaccauaaagaau

SEQ ID NO: 533313 - RNA, 19 nt, Chlamydophila pneumoniae J138
agucuccauaauucugcac

SEQ ID NO: 533314 - RNA, 18 nt, Chlamydophila pneumoniae J138
agucucuuucagcucaag

SEQ ID NO: 533315 - RNA, 12 nt, Chlamydophila pneumoniae J138
agucugaacauu

SEQ ID NO: 533316 - RNA, 17 nt, Chlamydophila pneumoniae J138
agucugcagcagaugaa

SEQ ID NO: 533317 - RNA, 15 nt, Chlamydophila pneumoniae J138
agucugauguaggug

SEQ ID NO: 533318 - RNA, 22 nt, Chlamydophila pneumoniae J138
agugaacuuuuguacacagaga

SEQ ID NO: 533319 - RNA, 16 nt, Chlamydophila pneumoniae J138
agugaagacaaguaaa

SEQ ID NO: 533320 - RNA, 20 nt, Chlamydophila pneumoniae J138
agugaagcugcuucuucaga

SEQ ID NO: 533321 - RNA, 14 nt, Chlamydophila pneumoniae J138
agucuuuuucagaa

SEQ ID NO: 533322 - RNA, 17 nt, Chlamydophila pneumoniae J138
agucuuucuaagaagac

SEQ ID NO: 533323 - RNA, 20 nt, Chlamydophila pneumoniae J138
agucaaaggauccauaaccu

SEQ ID NO: 533324 - RNA, 20 nt, Chlamydophila pneumoniae J138
agucaaauacuucuccugaa

SEQ ID NO: 533325 - RNA, 17 nt, Chlamydophila pneumoniae J138
agucaaaggauccauaa

SEQ ID NO: 533326 - RNA, 19 nt, Chlamydophila pneumoniae J138
aguccugcaggcuucacca

SEQ ID NO: 533327 - RNA, 15 nt, Chlamydophila pneumoniae J138
aguccugauuuuuca

SEQ ID NO: 533328 - RNA, 20 nt, Chlamydophila pneumoniae J138
aguccucucccuuaaggaaa

SEQ ID NO: 533329 - RNA, 13 nt, Chlamydophila pneumoniae J138
agucgagaaacaa

SEQ ID NO: 533330 - RNA, 21 nt, Chlamydophila pneumoniae J138
agucgagaaacaaaaucuuuu

SEQ ID NO: 533331 - RNA, 22 nt, Chlamydophila pneumoniae J138
agucgauacccaaagaggggag

SEQ ID NO: 533332 - RNA, 15 nt, Chlamydophila pneumoniae J138
agucgcuagaucaca

SEQ ID NO: 533333 - RNA, 20 nt, Chlamydophila pneumoniae J138
aguaaagaaauucuggaguc

SEQ ID NO: 533334 - RNA, 23 nt, Chlamydophila pneumoniae J138
aguaaccaauacagcauaaaaau

SEQ ID NO: 533335 - RNA, 23 nt, Chlamydophila pneumoniae J138
aguaauaucuccgccauaacacu

SEQ ID NO: 533336 - RNA, 17 nt, Chlamydophila pneumoniae J138
aguaaucacuucagcac

SEQ ID NO: 533337 - RNA, 22 nt, Chlamydophila pneumoniae J138
aguaauuccaaaauaaaaggag

SEQ ID NO: 533338 - RNA, 23 nt, Chlamydophila pneumoniae J138
aguaauuccaaaauaaaaggagc

SEQ ID NO: 533339 - RNA, 15 nt, Chlamydophila pneumoniae J138
agguugcuuuucuag

SEQ ID NO: 533340 - RNA, 21 nt, Chlamydophila pneumoniae J138
agguuugggugcuaaguuguu

SEQ ID NO: 533341 - RNA, 15 nt, Chlamydophila pneumoniae J138
aguaaaauuucugua

SEQ ID NO: 533342 - RNA, 22 nt, Chlamydophila pneumoniae J138
aguaaaauuucuguagugagau

SEQ ID NO: 533343 - RNA, 15 nt, Chlamydophila pneumoniae J138
aguaaaacacaaaua

SEQ ID NO: 533344 - RNA, 13 nt, Chlamydophila pneumoniae J138
aguaaaacacaaa

SEQ ID NO: 533345 - RNA, 22 nt, Chlamydophila pneumoniae J138
aguaaaagcccuaauucauauu

SEQ ID NO: 533346 - RNA, 20 nt, Chlamydophila pneumoniae J138
aguagcucucuccuggagag

SEQ ID NO: 533347 - RNA, 20 nt, Chlamydophila pneumoniae J138
aguagcuugugcuaaagcag

SEQ ID NO: 533348 - RNA, 12 nt, Chlamydophila pneumoniae J138
aguaggaauuuu

SEQ ID NO: 533349 - RNA, 15 nt, Chlamydophila pneumoniae J138
aguaggcgaugcaaa

SEQ ID NO: 533350 - RNA, 13 nt, Chlamydophila pneumoniae J138
aguaggagcagcg

SEQ ID NO: 533351 - RNA, 18 nt, Chlamydophila pneumoniae J138
aguaggucucccuggucu

SEQ ID NO: 533352 - RNA, 19 nt, Chlamydophila pneumoniae J138
aguagagccucuaagaaaa

SEQ ID NO: 533353 - RNA, 15 nt, Chlamydophila pneumoniae J138
aguaccaagaaaaua

SEQ ID NO: 533354 - RNA, 15 nt, Chlamydophila pneumoniae J138
aguacccagucaucg

SEQ ID NO: 533355 - RNA, 21 nt, Chlamydophila pneumoniae J138
aguagaucuucugaaaucaaa

SEQ ID NO: 533356 - RNA, 18 nt, Chlamydophila pneumoniae J138
aguagaggaauucuggaa

SEQ ID NO: 533357 - RNA, 15 nt, Chlamydophila pneumoniae J138
aguagaucuucugaa

SEQ ID NO: 533358 - RNA, 20 nt, Chlamydophila pneumoniae J138
aguauagcuuuuaguuuccc

SEQ ID NO: 533359 - RNA, 14 nt, Chlamydophila pneumoniae J138
aguauagucugguu

SEQ ID NO: 533360 - RNA, 22 nt, Chlamydophila pneumoniae J138
aguauaauagugagcucccuga

SEQ ID NO: 533361 - RNA, 15 nt, Chlamydophila pneumoniae J138
aguauacaagcgaaa

SEQ ID NO: 533362 - RNA, 17 nt, Chlamydophila pneumoniae J138
aguaucuaaaacuucuu

SEQ ID NO: 533363 - RNA, 17 nt, Chlamydophila pneumoniae J138
aguaucuagcuuugucu

SEQ ID NO: 533364 - RNA, 17 nt, Chlamydophila pneumoniae J138
aguaugaggagauaaag

SEQ ID NO: 533365 - RNA, 19 nt, Chlamydophila pneumoniae J138
aguauucgauuccugaggc

SEQ ID NO: 533366 - RNA, 21 nt, Chlamydophila pneumoniae J138
aguauucuguggaauaucagg

SEQ ID NO: 533367 - RNA, 22 nt, Chlamydophila pneumoniae J138
aguauggcguuuuuuuugauuu

SEQ ID NO: 533368 - RNA, 14 nt, Chlamydophila pneumoniae J138
aguauggcauucuu

SEQ ID NO: 533369 - RNA, 18 nt, Chlamydophila pneumoniae J138
aguauuauaaauagaaau

SEQ ID NO: 533370 - RNA, 15 nt, Chlamydophila pneumoniae J138
aguauuaaucuuauu

SEQ ID NO: 533371 - RNA, 20 nt, Chlamydophila pneumoniae J138
aggcuuuaaguguuucuuca

SEQ ID NO: 533372 - RNA, 14 nt, Chlamydophila pneumoniae J138
aggcggaaaggaag

SEQ ID NO: 533373 - RNA, 23 nt, Chlamydophila pneumoniae J138
agggaaaccauauugcaaagcau

SEQ ID NO: 533374 - RNA, 13 nt, Chlamydophila pneumoniae J138
agggaaacaccgu

SEQ ID NO: 533375 - RNA, 22 nt, Chlamydophila pneumoniae J138
agggaaaggagcgcuacuguau

SEQ ID NO: 533376 - RNA, 22 nt, Chlamydophila pneumoniae J138
agggaaauccacagauacguuu

SEQ ID NO: 533377 - RNA, 16 nt, Chlamydophila pneumoniae J138
aggcuuuucuuuuucu

SEQ ID NO: 533378 - RNA, 14 nt, Chlamydophila pneumoniae J138
aggcuuuuuucuau

SEQ ID NO: 533379 - RNA, 19 nt, Chlamydophila pneumoniae J138
agggaauccccaauguuuu

SEQ ID NO: 533380 - RNA, 23 nt, Chlamydophila pneumoniae J138
agggaauuuucucauagcuuccu

SEQ ID NO: 533381 - RNA, 15 nt, Chlamydophila pneumoniae J138
agggaagaaauuaac

SEQ ID NO: 533382 - RNA, 23 nt, Chlamydophila pneumoniae J138
agggacagucuccuggaacagua

SEQ ID NO: 533383 - RNA, 17 nt, Chlamydophila pneumoniae J138
agggagacucuugaggc

SEQ ID NO: 533384 - RNA, 19 nt, Chlamydophila pneumoniae J138
agggacguuguaucccugu

SEQ ID NO: 533385 - RNA, 22 nt, Chlamydophila pneumoniae J138
agggauucuuguuggauugaaa

SEQ ID NO: 533386 - RNA, 19 nt, Chlamydophila pneumoniae J138
agggauucuuguuggauug

SEQ ID NO: 533387 - RNA, 23 nt, Chlamydophila pneumoniae J138
aggggcgcauggcggucuuuguu

SEQ ID NO: 533388 - RNA, 18 nt, Chlamydophila pneumoniae J138
aggguaaagaaauauuaa

SEQ ID NO: 533389 - RNA, 14 nt, Chlamydophila pneumoniae J138
aggguaaagaaaua

SEQ ID NO: 533390 - RNA, 19 nt, Chlamydophila pneumoniae J138
agggguucccucuccuuga

SEQ ID NO: 533391 - RNA, 14 nt, Chlamydophila pneumoniae J138
agguaucuccuuga

SEQ ID NO: 533392 - RNA, 16 nt, Chlamydophila pneumoniae J138
aggucgcaucaaugac

SEQ ID NO: 533393 - RNA, 21 nt, Chlamydophila pneumoniae J138
agguacuuuauagaaaguaca

SEQ ID NO: 533394 - RNA, 20 nt, Chlamydophila pneumoniae J138
agguacgcuuuuucuugaaa

SEQ ID NO: 533395 - RNA, 18 nt, Chlamydophila pneumoniae J138
agguaaugucguaccccg

SEQ ID NO: 533396 - RNA, 16 nt, Chlamydophila pneumoniae J138
agguaauccucgauac

SEQ ID NO: 533397 - RNA, 23 nt, Chlamydophila pneumoniae J138
agguagaguccacagucauaaaa

SEQ ID NO: 533398 - RNA, 14 nt, Chlamydophila pneumoniae J138
agguagagugucuu

SEQ ID NO: 533399 - RNA, 16 nt, Chlamydophila pneumoniae J138
agguagaguccacagu

SEQ ID NO: 533400 - RNA, 20 nt, Chlamydophila pneumoniae J138
agguagcagaguuuuucccu

SEQ ID NO: 533401 - RNA, 20 nt, Chlamydophila pneumoniae J138
agguagcauaggcuaagacu

SEQ ID NO: 533402 - RNA, 17 nt, Chlamydophila pneumoniae J138
agguaguuuucuucuuu

SEQ ID NO: 533403 - RNA, 20 nt, Chlamydophila pneumoniae J138
aggguauccugcuccaaaau

SEQ ID NO: 533404 - RNA, 20 nt, Chlamydophila pneumoniae J138
aggguagcgcuuuuuuaaag

SEQ ID NO: 533405 - RNA, 22 nt, Chlamydophila pneumoniae J138
agguaagggaugcucuagaaaa

SEQ ID NO: 533406 - RNA, 21 nt, Chlamydophila pneumoniae J138
agguaaccagagagcuuuuag

SEQ ID NO: 533407 - RNA, 19 nt, Chlamydophila pneumoniae J138
aggcauuacacaacucuuu

SEQ ID NO: 533408 - RNA, 12 nt, Chlamydophila pneumoniae J138
aggcauuaauaa

SEQ ID NO: 533409 - RNA, 16 nt, Chlamydophila pneumoniae J138
aggcauuaauaacuuu

SEQ ID NO: 533410 - RNA, 17 nt, Chlamydophila pneumoniae J138
aggcaucuucuuugcca

SEQ ID NO: 533411 - RNA, 20 nt, Chlamydophila pneumoniae J138
aggcaucuagagucucuuuc

SEQ ID NO: 533412 - RNA, 18 nt, Chlamydophila pneumoniae J138
aggccaaagaacagcacu

SEQ ID NO: 533413 - RNA, 14 nt, Chlamydophila pneumoniae J138
aggccaaagaacag

SEQ ID NO: 533414 - RNA, 17 nt, Chlamydophila pneumoniae J138
aggccaaagaacagcac

SEQ ID NO: 533415 - RNA, 16 nt, Chlamydophila pneumoniae J138
aggcauuggaaaucuu

SEQ ID NO: 533416 - RNA, 16 nt, Chlamydophila pneumoniae J138
aggcaaggagagcuuc

SEQ ID NO: 533417 - RNA, 14 nt, Chlamydophila pneumoniae J138
aggcacauguagga

SEQ ID NO: 533418 - RNA, 13 nt, Chlamydophila pneumoniae J138
aggauuuuccauu

SEQ ID NO: 533419 - RNA, 13 nt, Chlamydophila pneumoniae J138
aggauucucucug

SEQ ID NO: 533420 - RNA, 19 nt, Chlamydophila pneumoniae J138
aggauucuaaaaagaaaag

SEQ ID NO: 533421 - RNA, 18 nt, Chlamydophila pneumoniae J138
aggauucuaaaaagaaaa

SEQ ID NO: 533422 - RNA, 21 nt, Chlamydophila pneumoniae J138
aggauuucuugcaaggagcuu

SEQ ID NO: 533423 - RNA, 17 nt, Chlamydophila pneumoniae J138
aggauucucucugccua

SEQ ID NO: 533424 - RNA, 15 nt, Chlamydophila pneumoniae J138
aggauucuuuuugau

SEQ ID NO: 533425 - RNA, 13 nt, Chlamydophila pneumoniae J138
aggauuuagacua

SEQ ID NO: 533426 - RNA, 16 nt, Chlamydophila pneumoniae J138
aggagcuccuccuuga

SEQ ID NO: 533427 - RNA, 17 nt, Chlamydophila pneumoniae J138
aggagcucccuaagauu

SEQ ID NO: 533428 - RNA, 15 nt, Chlamydophila pneumoniae J138
aggagcuuuuaccuu

SEQ ID NO: 533429 - RNA, 15 nt, Chlamydophila pneumoniae J138
aggagcgauagcuca

SEQ ID NO: 533430 - RNA, 16 nt, Chlamydophila pneumoniae J138
aggagccuccauaaug

SEQ ID NO: 533431 - RNA, 15 nt, Chlamydophila pneumoniae J138
aggagcauagacucu

SEQ ID NO: 533432 - RNA, 23 nt, Chlamydophila pneumoniae J138
aggccuaaaaucaccauauccau

SEQ ID NO: 533433 - RNA, 18 nt, Chlamydophila pneumoniae J138
aggccuccauuucuagga

SEQ ID NO: 533434 - RNA, 23 nt, Chlamydophila pneumoniae J138
aggccuccauuucuaggaauugc

SEQ ID NO: 533435 - RNA, 14 nt, Chlamydophila pneumoniae J138
agcuccauuuaaau

SEQ ID NO: 533436 - RNA, 18 nt, Chlamydophila pneumoniae J138
agcuccauuuaaauggau

SEQ ID NO: 533437 - RNA, 19 nt, Chlamydophila pneumoniae J138
agcugcucuuuuagaaugu

SEQ ID NO: 533438 - RNA, 18 nt, Chlamydophila pneumoniae J138
agcugcugagcagcaaaa

SEQ ID NO: 533439 - RNA, 22 nt, Chlamydophila pneumoniae J138
agcuguaaccaacaucaaagaa

SEQ ID NO: 533440 - RNA, 15 nt, Chlamydophila pneumoniae J138
agcugcuucuucaga

SEQ ID NO: 533441 - RNA, 14 nt, Chlamydophila pneumoniae J138
agcugugcauuuuc

SEQ ID NO: 533442 - RNA, 18 nt, Chlamydophila pneumoniae J138
agcuguggcgauuuuacu

SEQ ID NO: 533443 - RNA, 15 nt, Chlamydophila pneumoniae J138
agcuguccagucuau

SEQ ID NO: 533444 - RNA, 20 nt, Chlamydophila pneumoniae J138
agcugucaauccaacaaaga

SEQ ID NO: 533445 - RNA, 17 nt, Chlamydophila pneumoniae J138
agcuuccugcuccucuu

SEQ ID NO: 533446 - RNA, 12 nt, Chlamydophila pneumoniae J138
agcuucuaaaaa

SEQ ID NO: 533447 - RNA, 13 nt, Chlamydophila pneumoniae J138
agcuucuaaaaac

SEQ ID NO: 533448 - RNA, 15 nt, Chlamydophila pneumoniae J138
agcuucccaauugua

SEQ ID NO: 533449 - RNA, 16 nt, Chlamydophila pneumoniae J138
agcuucccaauuguau

SEQ ID NO: 533450 - RNA, 23 nt, Chlamydophila pneumoniae J138
agcuuccggcuuguaggaucuga

SEQ ID NO: 533451 - RNA, 12 nt, Chlamydophila pneumoniae J138
agcuucaucaaa

SEQ ID NO: 533452 - RNA, 20 nt, Chlamydophila pneumoniae J138
agcuucaucagaagguaaau

SEQ ID NO: 533453 - RNA, 22 nt, Chlamydophila pneumoniae J138
agcuugccagcagaaguuccuu

SEQ ID NO: 533454 - RNA, 13 nt, Chlamydophila pneumoniae J138
agcuugguuuucu

SEQ ID NO: 533455 - RNA, 19 nt, Chlamydophila pneumoniae J138
agcuugguuuucuccuucu

SEQ ID NO: 533456 - RNA, 23 nt, Chlamydophila pneumoniae J138
agcuugucacacugcgagagaaa

SEQ ID NO: 533457 - RNA, 14 nt, Chlamydophila pneumoniae J138
aggaauuuuucuag

SEQ ID NO: 533458 - RNA, 20 nt, Chlamydophila pneumoniae J138
aggaauucuuuaugagagag

SEQ ID NO: 533459 - RNA, 15 nt, Chlamydophila pneumoniae J138
aggaauuuucagccu

SEQ ID NO: 533460 - RNA, 21 nt, Chlamydophila pneumoniae J138
aggacaaucaacauucuucug

SEQ ID NO: 533461 - RNA, 15 nt, Chlamydophila pneumoniae J138
aggacagcacauaga

SEQ ID NO: 533462 - RNA, 15 nt, Chlamydophila pneumoniae J138
aggaauuagagaaau

SEQ ID NO: 533463 - RNA, 20 nt, Chlamydophila pneumoniae J138
aggaauuagagaaauuuuua

SEQ ID NO: 533464 - RNA, 16 nt, Chlamydophila pneumoniae J138
aggaauuccucucaca

SEQ ID NO: 533465 - RNA, 19 nt, Chlamydophila pneumoniae J138
aggaaguaguggacuauag

SEQ ID NO: 533466 - RNA, 12 nt, Chlamydophila pneumoniae J138
aggaagcucuuc

SEQ ID NO: 533467 - RNA, 16 nt, Chlamydophila pneumoniae J138
aggaagcucuucuacu

SEQ ID NO: 533468 - RNA, 14 nt, Chlamydophila pneumoniae J138
aggaaggaauagag

SEQ ID NO: 533469 - RNA, 17 nt, Chlamydophila pneumoniae J138
aggaccacaauuccuaa

SEQ ID NO: 533470 - RNA, 23 nt, Chlamydophila pneumoniae J138
aggacuguuuguuuauuaucuac

SEQ ID NO: 533471 - RNA, 22 nt, Chlamydophila pneumoniae J138
aggacuguuuguuuauuaucua

SEQ ID NO: 533472 - RNA, 17 nt, Chlamydophila pneumoniae J138
aggacuucgcaaauuuu

SEQ ID NO: 533473 - RNA, 17 nt, Chlamydophila pneumoniae J138
aggagagcuagugguau

SEQ ID NO: 533474 - RNA, 21 nt, Chlamydophila pneumoniae J138
aggagagcuugguuuucuccu

SEQ ID NO: 533475 - RNA, 16 nt, Chlamydophila pneumoniae J138
aggagauccacagacu

SEQ ID NO: 533476 - RNA, 19 nt, Chlamydophila pneumoniae J138
aggagaauacaaacaagaa

SEQ ID NO: 533477 - RNA, 21 nt, Chlamydophila pneumoniae J138
aggagacucuaguuuuucuuu

SEQ ID NO: 533478 - RNA, 22 nt, Chlamydophila pneumoniae J138
aggagaacaauaucagcagcuu

SEQ ID NO: 533479 - RNA, 21 nt, Chlamydophila pneumoniae J138
aggagaacaauaucagcagcu

SEQ ID NO: 533480 - RNA, 12 nt, Chlamydophila pneumoniae J138
aggagaacaaua

SEQ ID NO: 533481 - RNA, 21 nt, Chlamydophila pneumoniae J138
agcuuugucucuauagugcau

SEQ ID NO: 533482 - RNA, 21 nt, Chlamydophila pneumoniae J138
agcuuucuuggagaagaggua

SEQ ID NO: 533483 - RNA, 18 nt, Chlamydophila pneumoniae J138
agcuuuggcgucugcccu

SEQ ID NO: 533484 - RNA, 20 nt, Chlamydophila pneumoniae J138
aggaacaaagcucuccuuca

SEQ ID NO: 533485 - RNA, 14 nt, Chlamydophila pneumoniae J138
aggaacaaagccaa

SEQ ID NO: 533486 - RNA, 21 nt, Chlamydophila pneumoniae J138
aggaaaucccgagauaugaag

SEQ ID NO: 533487 - RNA, 22 nt, Chlamydophila pneumoniae J138
aggaaaucccgagauaugaaga

SEQ ID NO: 533488 - RNA, 21 nt, Chlamydophila pneumoniae J138
aggaaaguugcaacucucuuu

SEQ ID NO: 533489 - RNA, 18 nt, Chlamydophila pneumoniae J138
aggaaaguucacaagcag

SEQ ID NO: 533490 - RNA, 17 nt, Chlamydophila pneumoniae J138
aggaacgcacgccaaga

SEQ ID NO: 533491 - RNA, 14 nt, Chlamydophila pneumoniae J138
aggaagccugcggc

SEQ ID NO: 533492 - RNA, 22 nt, Chlamydophila pneumoniae J138
aggaagaugaauaccagaagca

SEQ ID NO: 533493 - RNA, 15 nt, Chlamydophila pneumoniae J138
aggaagauaguauuu

SEQ ID NO: 533494 - RNA, 19 nt, Chlamydophila pneumoniae J138
aggaagauauccuuuugaa

SEQ ID NO: 533495 - RNA, 15 nt, Chlamydophila pneumoniae J138
agaaaagauaaaaca

SEQ ID NO: 533496 - RNA, 13 nt, Chlamydophila pneumoniae J138
agaaaagauaaaa

SEQ ID NO: 533497 - RNA, 18 nt, Chlamydophila pneumoniae J138
agaaaacgccaacuguau

SEQ ID NO: 533498 - RNA, 17 nt, Chlamydophila pneumoniae J138
agaaaagaaaaguguga

SEQ ID NO: 533499 - RNA, 18 nt, Chlamydophila pneumoniae J138
agaaaagaaaagugugag

SEQ ID NO: 533500 - RNA, 13 nt, Chlamydophila pneumoniae J138
agaaaacauagag

SEQ ID NO: 533501 - RNA, 14 nt, Chlamydophila pneumoniae J138
agaaaacauagaga

SEQ ID NO: 533502 - RNA, 12 nt, Chlamydophila pneumoniae J138
agaaacaucgga

SEQ ID NO: 533503 - RNA, 15 nt, Chlamydophila pneumoniae J138
acuuuuguacacaga

SEQ ID NO: 533504 - RNA, 22 nt, Chlamydophila pneumoniae J138
acuuuuguacacagagaugcuu

SEQ ID NO: 533505 - RNA, 18 nt, Chlamydophila pneumoniae J138
acuuuuguugcaauucca

SEQ ID NO: 533506 - RNA, 14 nt, Chlamydophila pneumoniae J138
agaaaaagaaucuc

SEQ ID NO: 533507 - RNA, 13 nt, Chlamydophila pneumoniae J138
agaaaaagaacau

SEQ ID NO: 533508 - RNA, 19 nt, Chlamydophila pneumoniae J138
agaaaaaccccuagaacuu

SEQ ID NO: 533509 - RNA, 21 nt, Chlamydophila pneumoniae J138
agaaaaauucuuuagggaggc

SEQ ID NO: 533510 - RNA, 13 nt, Chlamydophila pneumoniae J138
agaaaaaucuaac

SEQ ID NO: 533511 - RNA, 20 nt, Chlamydophila pneumoniae J138
agaaaaaucuaacacagucc

SEQ ID NO: 533512 - RNA, 19 nt, Chlamydophila pneumoniae J138
agaaacccgcaacucuuua

SEQ ID NO: 533513 - RNA, 17 nt, Chlamydophila pneumoniae J138
agaaacccgcaacucuu

SEQ ID NO: 533514 - RNA, 14 nt, Chlamydophila pneumoniae J138
agaaacuccaaaau

SEQ ID NO: 533515 - RNA, 17 nt, Chlamydophila pneumoniae J138
agaaacuccaaaauauu

SEQ ID NO: 533516 - RNA, 13 nt, Chlamydophila pneumoniae J138
agaaacuucucua

SEQ ID NO: 533517 - RNA, 14 nt, Chlamydophila pneumoniae J138
agaaacugcuccug

SEQ ID NO: 533518 - RNA, 21 nt, Chlamydophila pneumoniae J138
agaaacugcuccugaagcuga

SEQ ID NO: 533519 - RNA, 13 nt, Chlamydophila pneumoniae J138
agaaacuuuaaaa

SEQ ID NO: 533520 - RNA, 17 nt, Chlamydophila pneumoniae J138
agaaacuuaguuuugaa

SEQ ID NO: 533521 - RNA, 20 nt, Chlamydophila pneumoniae J138
agaaagaaugacacagagaa

SEQ ID NO: 533522 - RNA, 22 nt, Chlamydophila pneumoniae J138
agaaagaaugacacagagaaca

SEQ ID NO: 533523 - RNA, 18 nt, Chlamydophila pneumoniae J138
agaaagacaaaaaaucug

SEQ ID NO: 533524 - RNA, 22 nt, Chlamydophila pneumoniae J138
agaaagauucugcccaaagcua

SEQ ID NO: 533525 - RNA, 11 nt, Chlamydophila pneumoniae J138
agaaagauauc

SEQ ID NO: 533526 - RNA, 21 nt, Chlamydophila pneumoniae J138
agaaagagucucacucuuuuc

SEQ ID NO: 533527 - RNA, 23 nt, Chlamydophila pneumoniae J138
agaaagagucucacucuuuucua

SEQ ID NO: 533528 - RNA, 20 nt, Chlamydophila pneumoniae J138
agaaaggagauccacagacu

SEQ ID NO: 533529 - RNA, 19 nt, Chlamydophila pneumoniae J138
agaaaggcuuuuuccaaaa

SEQ ID NO: 533530 - RNA, 22 nt, Chlamydophila pneumoniae J138
agaaaggcuuuucuuuuucuag

SEQ ID NO: 533531 - RNA, 21 nt, Chlamydophila pneumoniae J138
agaaauacgcuuuucuucuuu

SEQ ID NO: 533532 - RNA, 17 nt, Chlamydophila pneumoniae J138
agaaauacgcuuuucuu

SEQ ID NO: 533533 - RNA, 17 nt, Chlamydophila pneumoniae J138
agaaauauaacucucua

SEQ ID NO: 533534 - RNA, 19 nt, Chlamydophila pneumoniae J138
agaaauaggucucuugcca

SEQ ID NO: 533535 - RNA, 22 nt, Chlamydophila pneumoniae J138
agaaauauacucuugcuugcua

SEQ ID NO: 533536 - RNA, 21 nt, Chlamydophila pneumoniae J138
agaaauuccaauuuuugcaua

SEQ ID NO: 533537 - RNA, 20 nt, Chlamydophila pneumoniae J138
agaaauuccaauuuuugcau

SEQ ID NO: 533538 - RNA, 14 nt, Chlamydophila pneumoniae J138
agaaauuccaauuu

SEQ ID NO: 533539 - RNA, 13 nt, Chlamydophila pneumoniae J138
agaaauucugacu

SEQ ID NO: 533540 - RNA, 13 nt, Chlamydophila pneumoniae J138
aaaacaauuuccu

SEQ ID NO: 533541 - RNA, 16 nt, Chlamydophila pneumoniae J138
agaacaauaucagcag

SEQ ID NO: 533542 - RNA, 13 nt, Chlamydophila pneumoniae J138
agaacaccaucac

SEQ ID NO: 533543 - RNA, 21 nt, Chlamydophila pneumoniae J138
agaacacucagagauguggca

SEQ ID NO: 533544 - RNA, 17 nt, Chlamydophila pneumoniae J138
agaacacucagagaugu

SEQ ID NO: 533545 - RNA, 24 nt, Chlamydophila pneumoniae J138
agaacagaggaucuagaaaaugaa

SEQ ID NO: 533546 - RNA, 18 nt, Chlamydophila pneumoniae J138
agaacagaggaucuagaa

SEQ ID NO: 533547 - RNA, 21 nt, Chlamydophila pneumoniae J138
agaacagaggaucuagaaaau

SEQ ID NO: 533548 - RNA, 13 nt, Chlamydophila pneumoniae J138
agaacagcagaaa

SEQ ID NO: 533549 - RNA, 21 nt, Chlamydophila pneumoniae J138
agaacagcauggacuccaaga

SEQ ID NO: 533550 - RNA, 16 nt, Chlamydophila pneumoniae J138
agaacauaaccucggu

SEQ ID NO: 533551 - RNA, 21 nt, Chlamydophila pneumoniae J138
agaacauagucguuuucucga

SEQ ID NO: 533552 - RNA, 18 nt, Chlamydophila pneumoniae J138
agaacucuuaaagguaaa

SEQ ID NO: 533553 - RNA, 20 nt, Chlamydophila pneumoniae J138
agaacucuauuuggcucgcu

SEQ ID NO: 533554 - RNA, 14 nt, Chlamydophila pneumoniae J138
agaacuccuuugag

SEQ ID NO: 533555 - RNA, 16 nt, Chlamydophila pneumoniae J138
agaacuccauucagau

SEQ ID NO: 533556 - RNA, 23 nt, Chlamydophila pneumoniae J138
agaacugcauaaucucaccagaa

SEQ ID NO: 533557 - RNA, 19 nt, Chlamydophila pneumoniae J138
agaacugcuuggucacacc

SEQ ID NO: 533558 - RNA, 16 nt, Chlamydophila pneumoniae J138
agaacuucaaugaaag

SEQ ID NO: 533559 - RNA, 12 nt, Chlamydophila pneumoniae J138
agaacuucaaca

SEQ ID NO: 533560 - RNA, 14 nt, Chlamydophila pneumoniae J138
agaagcaagaauca

SEQ ID NO: 533561 - RNA, 16 nt, Chlamydophila pneumoniae J138
agaagcggaagcaccg

SEQ ID NO: 533562 - RNA, 23 nt, Chlamydophila pneumoniae J138
agaagaucucgucuuggaaugcu

SEQ ID NO: 533563 - RNA, 13 nt, Chlamydophila pneumoniae J138
agaacuucuccaa

SEQ ID NO: 533564 - RNA, 15 nt, Chlamydophila pneumoniae J138
agaagauucaagcaa

SEQ ID NO: 533565 - RNA, 14 nt, Chlamydophila pneumoniae J138
agaagauucuuuaa

SEQ ID NO: 533566 - RNA, 16 nt, Chlamydophila pneumoniae J138
agaaggccaguuacug

SEQ ID NO: 533567 - RNA, 22 nt, Chlamydophila pneumoniae J138
agaagcugacaaauagaaagga

SEQ ID NO: 533568 - RNA, 21 nt, Chlamydophila pneumoniae J138
agaagcucuaucuuugguaug

SEQ ID NO: 533569 - RNA, 22 nt, Chlamydophila pneumoniae J138
agaagcuccugaguauccgaau

SEQ ID NO: 533570 - RNA, 13 nt, Chlamydophila pneumoniae J138
agaagggacuugu

SEQ ID NO: 533571 - RNA, 23 nt, Chlamydophila pneumoniae J138
agaagguccaugucuaaagauug

SEQ ID NO: 533572 - RNA, 12 nt, Chlamydophila pneumoniae J138
agaagguuucua

SEQ ID NO: 533573 - RNA, 19 nt, Chlamydophila pneumoniae J138
agaauccacuacugucaau

SEQ ID NO: 533574 - RNA, 17 nt, Chlamydophila pneumoniae J138
agaauccauuuugccca

SEQ ID NO: 533575 - RNA, 23 nt, Chlamydophila pneumoniae J138
agaauccauuuugcccacuucua

SEQ ID NO: 533576 - RNA, 14 nt, Chlamydophila pneumoniae J138
agaagucacaaauu

SEQ ID NO: 533577 - RNA, 17 nt, Chlamydophila pneumoniae J138
agaauccugaguaaaau

SEQ ID NO: 533578 - RNA, 20 nt, Chlamydophila pneumoniae J138
agaauccugaguaaaaucau

SEQ ID NO: 533579 - RNA, 21 nt, Chlamydophila pneumoniae J138
agaauccugaguaaaaucaua

SEQ ID NO: 533580 - RNA, 12 nt, Chlamydophila pneumoniae J138
agaauccuuuuu

SEQ ID NO: 533581 - RNA, 23 nt, Chlamydophila pneumoniae J138
agaaugacacagagaacaauaaa

SEQ ID NO: 533582 - RNA, 20 nt, Chlamydophila pneumoniae J138
agaaugacacagagaacaau

SEQ ID NO: 533583 - RNA, 17 nt, Chlamydophila pneumoniae J138
agaauguaugugaaaga

SEQ ID NO: 533584 - RNA, 14 nt, Chlamydophila pneumoniae J138
agaauguaugugaa

SEQ ID NO: 533585 - RNA, 14 nt, Chlamydophila pneumoniae J138
agaaugaugcaagc

SEQ ID NO: 533586 - RNA, 19 nt, Chlamydophila pneumoniae J138
agaauguucccaaauagaa

SEQ ID NO: 533587 - RNA, 20 nt, Chlamydophila pneumoniae J138
agaauuaagaagaagcugac

SEQ ID NO: 533588 - RNA, 15 nt, Chlamydophila pneumoniae J138
agaauugcaaaguac

SEQ ID NO: 533589 - RNA, 20 nt, Chlamydophila pneumoniae J138
agaauuuucuuuugcagcaa

SEQ ID NO: 533590 - RNA, 14 nt, Chlamydophila pneumoniae J138
agaauuuucaugau

SEQ ID NO: 533591 - RNA, 13 nt, Chlamydophila pneumoniae J138
agacaaagccaca

SEQ ID NO: 533592 - RNA, 14 nt, Chlamydophila pneumoniae J138
agaauuuucugcga

SEQ ID NO: 533593 - RNA, 22 nt, Chlamydophila pneumoniae J138
agacaaagaauccccccuucua

SEQ ID NO: 533594 - RNA, 20 nt, Chlamydophila pneumoniae J138
agacaauaccagauaaagca

SEQ ID NO: 533595 - RNA, 22 nt, Chlamydophila pneumoniae J138
agacaaugcaaccuguaaagac

SEQ ID NO: 533596 - RNA, 16 nt, Chlamydophila pneumoniae J138
agacaaguucaucaaa

SEQ ID NO: 533597 - RNA, 14 nt, Chlamydophila pneumoniae J138
agacaauaaaaaag

SEQ ID NO: 533598 - RNA, 23 nt, Chlamydophila pneumoniae J138
agacaaguaaacagcaaaguaau

SEQ ID NO: 533599 - RNA, 18 nt, Chlamydophila pneumoniae J138
agacaaccuagaaucaca

SEQ ID NO: 533600 - RNA, 19 nt, Chlamydophila pneumoniae J138
agacaacgcaggaagaaca

SEQ ID NO: 533601 - RNA, 21 nt, Chlamydophila pneumoniae J138
agacaacuauguuauccauac

SEQ ID NO: 533602 - RNA, 13 nt, Chlamydophila pneumoniae J138
agacaagaaaaua

SEQ ID NO: 533603 - RNA, 22 nt, Chlamydophila pneumoniae J138
agacacaggggaacgcucucua

SEQ ID NO: 533604 - RNA, 23 nt, Chlamydophila pneumoniae J138
agacaaugucgucucagaaaaau

SEQ ID NO: 533605 - RNA, 20 nt, Chlamydophila pneumoniae J138
agacacuugcuuaaggaaac

SEQ ID NO: 533606 - RNA, 22 nt, Chlamydophila pneumoniae J138
agacagaugcuucaaggcaucu

SEQ ID NO: 533607 - RNA, 20 nt, Chlamydophila pneumoniae J138
agacagccuguuuucuucua

SEQ ID NO: 533608 - RNA, 21 nt, Chlamydophila pneumoniae J138
agacauuucuugauccaucug

SEQ ID NO: 533609 - RNA, 17 nt, Chlamydophila pneumoniae J138
agacauucauuuuuuaa

SEQ ID NO: 533610 - RNA, 19 nt, Chlamydophila pneumoniae J138
agacauauccaaugagaga

SEQ ID NO: 533611 - RNA, 22 nt, Chlamydophila pneumoniae J138
agacaggagcuacugaaagaug

SEQ ID NO: 533612 - RNA, 21 nt, Chlamydophila pneumoniae J138
agaccaaaucaucgcaaucaa

SEQ ID NO: 533613 - RNA, 19 nt, Chlamydophila pneumoniae J138
agaccaauugguggagcuc

SEQ ID NO: 533614 - RNA, 19 nt, Chlamydophila pneumoniae J138
agaccacgaaauguuaaag

SEQ ID NO: 533615 - RNA, 14 nt, Chlamydophila pneumoniae J138
agaccacgaaaugu

SEQ ID NO: 533616 - RNA, 22 nt, Chlamydophila pneumoniae J138
agaccacgaaauguuaaaggaa

SEQ ID NO: 533617 - RNA, 23 nt, Chlamydophila pneumoniae J138
agaccauaaaaucaacaaguucu

SEQ ID NO: 533618 - RNA, 15 nt, Chlamydophila pneumoniae J138
agaccauacacaaau

SEQ ID NO: 533619 - RNA, 14 nt, Chlamydophila pneumoniae J138
agaccauaaaauca

SEQ ID NO: 533620 - RNA, 13 nt, Chlamydophila pneumoniae J138
agaccagggaucu

SEQ ID NO: 533621 - RNA, 15 nt, Chlamydophila pneumoniae J138
agaccugccaagaua

SEQ ID NO: 533622 - RNA, 22 nt, Chlamydophila pneumoniae J138
agaccggaucccguaaaagaac

SEQ ID NO: 533623 - RNA, 23 nt, Chlamydophila pneumoniae J138
agaccggaucccguaaaagaacg

SEQ ID NO: 533624 - RNA, 18 nt, Chlamydophila pneumoniae J138
agacccaacaguucuuuc

SEQ ID NO: 533625 - RNA, 13 nt, Chlamydophila pneumoniae J138
aaaacauauccca

SEQ ID NO: 533626 - RNA, 23 nt, Chlamydophila pneumoniae J138
agagcagcuuccugcuccucuuc

SEQ ID NO: 533627 - RNA, 16 nt, Chlamydophila pneumoniae J138
agagcgaucgcaauca

SEQ ID NO: 533628 - RNA, 15 nt, Chlamydophila pneumoniae J138
agagccuuuucagau

SEQ ID NO: 533629 - RNA, 18 nt, Chlamydophila pneumoniae J138
agagccuuuucagauuuu

SEQ ID NO: 533630 - RNA, 22 nt, Chlamydophila pneumoniae J138
agagcuggggauggucuucccc

SEQ ID NO: 533631 - RNA, 21 nt, Chlamydophila pneumoniae J138
agacguucgacaacaacauaa

SEQ ID NO: 533632 - RNA, 21 nt, Chlamydophila pneumoniae J138
agacgugcucucuacuucugu

SEQ ID NO: 533633 - RNA, 19 nt, Chlamydophila pneumoniae J138
agacguaggugccugaaga

SEQ ID NO: 533634 - RNA, 20 nt, Chlamydophila pneumoniae J138
agacuaaaugacgaguugaa

SEQ ID NO: 533635 - RNA, 15 nt, Chlamydophila pneumoniae J138
agacuaaaaaagaga

SEQ ID NO: 533636 - RNA, 17 nt, Chlamydophila pneumoniae J138
agagauccaaugacaau

SEQ ID NO: 533637 - RNA, 19 nt, Chlamydophila pneumoniae J138
agagauuaccgaagagccc

SEQ ID NO: 533638 - RNA, 16 nt, Chlamydophila pneumoniae J138
agagauucauaaaacu

SEQ ID NO: 533639 - RNA, 20 nt, Chlamydophila pneumoniae J138
agagcaagauucuucagaau

SEQ ID NO: 533640 - RNA, 19 nt, Chlamydophila pneumoniae J138
agagcuugguuuucuccuu

SEQ ID NO: 533641 - RNA, 16 nt, Chlamydophila pneumoniae J138
agagcuugguuuucuc

SEQ ID NO: 533642 - RNA, 18 nt, Chlamydophila pneumoniae J138
agaggaaugaagagaguu

SEQ ID NO: 533643 - RNA, 13 nt, Chlamydophila pneumoniae J138
agaggaaugaaga

SEQ ID NO: 533644 - RNA, 18 nt, Chlamydophila pneumoniae J138
agaggaagcacaccaagu

SEQ ID NO: 533645 - RNA, 19 nt, Chlamydophila pneumoniae J138
agagcuuuuagguagagaa

SEQ ID NO: 533646 - RNA, 13 nt, Chlamydophila pneumoniae J138
agaggcaauugag

SEQ ID NO: 533647 - RNA, 17 nt, Chlamydophila pneumoniae J138
agaggagauccuaagag

SEQ ID NO: 533648 - RNA, 16 nt, Chlamydophila pneumoniae J138
agaggaucuagaaaau

SEQ ID NO: 533649 - RNA, 22 nt, Chlamydophila pneumoniae J138
agaggagacucuaguuuuucuu

SEQ ID NO: 533650 - RNA, 17 nt, Chlamydophila pneumoniae J138
agaggcuuuaaauuuuu

SEQ ID NO: 533651 - RNA, 20 nt, Chlamydophila pneumoniae J138
agagggaucauguagcagag

SEQ ID NO: 533652 - RNA, 21 nt, Chlamydophila pneumoniae J138
agagggaucauguagcagagc

SEQ ID NO: 533653 - RNA, 16 nt, Chlamydophila pneumoniae J138
agagggauuuguagga

SEQ ID NO: 533654 - RNA, 23 nt, Chlamydophila pneumoniae J138
agaggguuuuuuugcugcgaaug

SEQ ID NO: 533655 - RNA, 17 nt, Chlamydophila pneumoniae J138
agaggucacuauagauc

SEQ ID NO: 533656 - RNA, 16 nt, Chlamydophila pneumoniae J138
agagguaaccagagag

SEQ ID NO: 533657 - RNA, 20 nt, Chlamydophila pneumoniae J138
agaggguuuuuuugcugcga

SEQ ID NO: 533658 - RNA, 22 nt, Chlamydophila pneumoniae J138
agagguucuugcuuauugucuu

SEQ ID NO: 533659 - RNA, 15 nt, Chlamydophila pneumoniae J138
agauacgcuuacaaa

SEQ ID NO: 533660 - RNA, 15 nt, Chlamydophila pneumoniae J138
agauacgaaguccca

SEQ ID NO: 533661 - RNA, 15 nt, Chlamydophila pneumoniae J138
agauacggaggauua

SEQ ID NO: 533662 - RNA, 15 nt, Chlamydophila pneumoniae J138
agauacguuuccccc

SEQ ID NO: 533663 - RNA, 12 nt, Chlamydophila pneumoniae J138
agauagagcgac

SEQ ID NO: 533664 - RNA, 18 nt, Chlamydophila pneumoniae J138
agauacuucuccacagcu

SEQ ID NO: 533665 - RNA, 23 nt, Chlamydophila pneumoniae J138
agauaaauccccaccaacaaugc

SEQ ID NO: 533666 - RNA, 17 nt, Chlamydophila pneumoniae J138
agauaaagcaaagauaa

SEQ ID NO: 533667 - RNA, 14 nt, Chlamydophila pneumoniae J138
agauaaaggcauaa

SEQ ID NO: 533668 - RNA, 21 nt, Chlamydophila pneumoniae J138
agaguuggaucauucuuuaua

SEQ ID NO: 533669 - RNA, 23 nt, Chlamydophila pneumoniae J138
agaguugcuuuauggcucaacuu

SEQ ID NO: 533670 - RNA, 14 nt, Chlamydophila pneumoniae J138
agaguugauaaaua

SEQ ID NO: 533671 - RNA, 13 nt, Chlamydophila pneumoniae J138
agauaaacauaca

SEQ ID NO: 533672 - RNA, 13 nt, Chlamydophila pneumoniae J138
agauaaagaauuc

SEQ ID NO: 533673 - RNA, 21 nt, Chlamydophila pneumoniae J138
agaguguuguuggagcagaaa

SEQ ID NO: 533674 - RNA, 20 nt, Chlamydophila pneumoniae J138
agaguguuguuggagcagaa

SEQ ID NO: 533675 - RNA, 17 nt, Chlamydophila pneumoniae J138
agaguuccgcaaauaca

SEQ ID NO: 533676 - RNA, 20 nt, Chlamydophila pneumoniae J138
agaguacgugaucucacgaa

SEQ ID NO: 533677 - RNA, 16 nt, Chlamydophila pneumoniae J138
agauauauuuuuaaag

SEQ ID NO: 533678 - RNA, 14 nt, Chlamydophila pneumoniae J138
agauagcaaaucaa

SEQ ID NO: 533679 - RNA, 23 nt, Chlamydophila pneumoniae J138
agauauuaucgauaggaagccag

SEQ ID NO: 533680 - RNA, 19 nt, Chlamydophila pneumoniae J138
agauauucaagaggaccga

SEQ ID NO: 533681 - RNA, 12 nt, Chlamydophila pneumoniae J138
agauaucuugua

SEQ ID NO: 533682 - RNA, 13 nt, Chlamydophila pneumoniae J138
agauaugaagaga

SEQ ID NO: 533683 - RNA, 19 nt, Chlamydophila pneumoniae J138
agauaugccucaggucugc

SEQ ID NO: 533684 - RNA, 23 nt, Chlamydophila pneumoniae J138
agauaugccucaggucugcugag

SEQ ID NO: 533685 - RNA, 20 nt, Chlamydophila pneumoniae J138
agaucagaggaaucuaagaa

SEQ ID NO: 533686 - RNA, 13 nt, Chlamydophila pneumoniae J138
agaucauaucuua

SEQ ID NO: 533687 - RNA, 15 nt, Chlamydophila pneumoniae J138
agaucauaaacagca

SEQ ID NO: 533688 - RNA, 13 nt, Chlamydophila pneumoniae J138
agauccaaaaauu

SEQ ID NO: 533689 - RNA, 15 nt, Chlamydophila pneumoniae J138
agauccaaagacgua

SEQ ID NO: 533690 - RNA, 21 nt, Chlamydophila pneumoniae J138
agauccuauaguaauuucucc

SEQ ID NO: 533691 - RNA, 20 nt, Chlamydophila pneumoniae J138
agauccucaaagaguuuuuu

SEQ ID NO: 533692 - RNA, 19 nt, Chlamydophila pneumoniae J138
agauccuaagagauuuucc

SEQ ID NO: 533693 - RNA, 21 nt, Chlamydophila pneumoniae J138
agauccucuauagauugguaa

SEQ ID NO: 533694 - RNA, 17 nt, Chlamydophila pneumoniae J138
agauccugaaaguacag

SEQ ID NO: 533695 - RNA, 16 nt, Chlamydophila pneumoniae J138
aaaacccucaaagaau

SEQ ID NO: 533696 - RNA, 20 nt, Chlamydophila pneumoniae J138
agaugagaaaaucugcagca

SEQ ID NO: 533697 - RNA, 21 nt, Chlamydophila pneumoniae J138
agauguagguaucagcaagau

SEQ ID NO: 533698 - RNA, 21 nt, Chlamydophila pneumoniae J138
agauguguacggguaaccuga

SEQ ID NO: 533699 - RNA, 20 nt, Chlamydophila pneumoniae J138
agauuaccgaagagccccca

SEQ ID NO: 533700 - RNA, 17 nt, Chlamydophila pneumoniae J138
agauucaagcaaugccu

SEQ ID NO: 533701 - RNA, 15 nt, Chlamydophila pneumoniae J138
agauucaagcaaugc

SEQ ID NO: 533702 - RNA, 16 nt, Chlamydophila pneumoniae J138
agauucauaaaacugu

SEQ ID NO: 533703 - RNA, 21 nt, Chlamydophila pneumoniae J138
agauucaugaaaugcuuucag

SEQ ID NO: 533704 - RNA, 15 nt, Chlamydophila pneumoniae J138
agauucauuaauguu

SEQ ID NO: 533705 - RNA, 16 nt, Chlamydophila pneumoniae J138
agauucuucagaaucu

SEQ ID NO: 533706 - RNA, 14 nt, Chlamydophila pneumoniae J138
agauucugaagaga

SEQ ID NO: 533707 - RNA, 12 nt, Chlamydophila pneumoniae J138
agauucuacaaa

SEQ ID NO: 533708 - RNA, 20 nt, Chlamydophila pneumoniae J138
agauucuaaaucaacuacac

SEQ ID NO: 533709 - RNA, 16 nt, Chlamydophila pneumoniae J138
agauucuaaaucaacu

SEQ ID NO: 533710 - RNA, 21 nt, Chlamydophila pneumoniae J138
agauuccuaugaucagagaga

SEQ ID NO: 533711 - RNA, 23 nt, Chlamydophila pneumoniae J138
agauugaugcugacagcuccauu

SEQ ID NO: 533712 - RNA, 17 nt, Chlamydophila pneumoniae J138
agauugaggauaaguuc

SEQ ID NO: 533713 - RNA, 22 nt, Chlamydophila pneumoniae J138
agauugaggauaaguucuucca

SEQ ID NO: 533714 - RNA, 15 nt, Chlamydophila pneumoniae J138
agauugaaucccauc

SEQ ID NO: 533715 - RNA, 19 nt, Chlamydophila pneumoniae J138
agauugccaggagagcuaa

SEQ ID NO: 533716 - RNA, 17 nt, Chlamydophila pneumoniae J138
agauugauuucuugcuu

SEQ ID NO: 533717 - RNA, 23 nt, Chlamydophila pneumoniae J138
agauuguucaaaaauagauaaga

SEQ ID NO: 533718 - RNA, 18 nt, Chlamydophila pneumoniae J138
agauuguucaaaaauaga

SEQ ID NO: 533719 - RNA, 16 nt, Chlamydophila pneumoniae J138
agauuguuagugagau

SEQ ID NO: 533720 - RNA, 18 nt, Chlamydophila pneumoniae J138
agauuguuucaggccugg

SEQ ID NO: 533721 - RNA, 21 nt, Chlamydophila pneumoniae J138
agauuggaauauaaucguuuu

SEQ ID NO: 533722 - RNA, 16 nt, Chlamydophila pneumoniae J138
agauuuaguucaccac

SEQ ID NO: 533723 - RNA, 14 nt, Chlamydophila pneumoniae J138
agauuucuaauccu

SEQ ID NO: 533724 - RNA, 17 nt, Chlamydophila pneumoniae J138
agauuucuaauccucca

SEQ ID NO: 533725 - RNA, 16 nt, Chlamydophila pneumoniae J138
agauuuguuagagcuu

SEQ ID NO: 533726 - RNA, 14 nt, Chlamydophila pneumoniae J138
agauuuuaaagccu

SEQ ID NO: 533727 - RNA, 22 nt, Chlamydophila pneumoniae J138
agauuuuaaagccuccucaaga

SEQ ID NO: 533728 - RNA, 21 nt, Chlamydophila pneumoniae J138
agauuuuucaagaacuccuuu

SEQ ID NO: 533729 - RNA, 18 nt, Chlamydophila pneumoniae J138
agauuuuaagaccuucug

SEQ ID NO: 533730 - RNA, 20 nt, Chlamydophila pneumoniae J138
agcaaagcggcucuuacuuc

SEQ ID NO: 533731 - RNA, 16 nt, Chlamydophila pneumoniae J138
agcaaagagcaaggaa

SEQ ID NO: 533732 - RNA, 13 nt, Chlamydophila pneumoniae J138
agcaaagaaaauu

SEQ ID NO: 533733 - RNA, 19 nt, Chlamydophila pneumoniae J138
agcaaagaaaauucucaga

SEQ ID NO: 533734 - RNA, 17 nt, Chlamydophila pneumoniae J138
agcaaagauaaagaagu

SEQ ID NO: 533735 - RNA, 17 nt, Chlamydophila pneumoniae J138
agcaaacaucaaagaga

SEQ ID NO: 533736 - RNA, 17 nt, Chlamydophila pneumoniae J138
agcaaaaauuguuuuug

SEQ ID NO: 533737 - RNA, 13 nt, Chlamydophila pneumoniae J138
agcaaaacuagga

SEQ ID NO: 533738 - RNA, 14 nt, Chlamydophila pneumoniae J138
agcaacaaccaaaa

SEQ ID NO: 533739 - RNA, 15 nt, Chlamydophila pneumoniae J138
agcaacaaccaaaag

SEQ ID NO: 533740 - RNA, 17 nt, Chlamydophila pneumoniae J138
agcaaagguaaauugac

SEQ ID NO: 533741 - RNA, 22 nt, Chlamydophila pneumoniae J138
agcaaaguuaaugcaagcaacu

SEQ ID NO: 533742 - RNA, 14 nt, Chlamydophila pneumoniae J138
agccugcaccagac

SEQ ID NO: 533743 - RNA, 18 nt, Chlamydophila pneumoniae J138
agccugcgacuacaagau

SEQ ID NO: 533744 - RNA, 14 nt, Chlamydophila pneumoniae J138
agccuggaaagcuu

SEQ ID NO: 533745 - RNA, 14 nt, Chlamydophila pneumoniae J138
agccuggaaaugaa

SEQ ID NO: 533746 - RNA, 16 nt, Chlamydophila pneumoniae J138
agccuggcuaaaggau

SEQ ID NO: 533747 - RNA, 12 nt, Chlamydophila pneumoniae J138
agccugucuaua

SEQ ID NO: 533748 - RNA, 19 nt, Chlamydophila pneumoniae J138
agccugucuuaucuaaaga

SEQ ID NO: 533749 - RNA, 11 nt, Chlamydophila pneumoniae J138
agccuuuccua

SEQ ID NO: 533750 - RNA, 17 nt, Chlamydophila pneumoniae J138
agcgaaagcagcgaaga

SEQ ID NO: 533751 - RNA, 19 nt, Chlamydophila pneumoniae J138
agccuuuucagauuuuuua

SEQ ID NO: 533752 - RNA, 13 nt, Chlamydophila pneumoniae J138
agccuuuucagau

SEQ ID NO: 533753 - RNA, 12 nt, Chlamydophila pneumoniae J138
agcgaaugaaaa

SEQ ID NO: 533754 - RNA, 22 nt, Chlamydophila pneumoniae J138
agcgagaacaccauaaaacaau

SEQ ID NO: 533755 - RNA, 20 nt, Chlamydophila pneumoniae J138
agcgaucgcaaucagcaaca

SEQ ID NO: 533756 - RNA, 21 nt, Chlamydophila pneumoniae J138
agcgaucgcaaucagcaacau

SEQ ID NO: 533757 - RNA, 13 nt, Chlamydophila pneumoniae J138
agcgauagcuaaa

SEQ ID NO: 533758 - RNA, 17 nt, Chlamydophila pneumoniae J138
agcgaucucucuuccug

SEQ ID NO: 533759 - RNA, 14 nt, Chlamydophila pneumoniae J138
agcgauagcuaaac

SEQ ID NO: 533760 - RNA, 20 nt, Chlamydophila pneumoniae J138
agcgcaucacgaaaaggaga

SEQ ID NO: 533761 - RNA, 22 nt, Chlamydophila pneumoniae J138
agcgccuccaccugcagcgcag

SEQ ID NO: 533762 - RNA, 22 nt, Chlamydophila pneumoniae J138
agcgcuacuguauucuguaaga

SEQ ID NO: 533763 - RNA, 12 nt, Chlamydophila pneumoniae J138
agcguuaacaac

SEQ ID NO: 533764 - RNA, 19 nt, Chlamydophila pneumoniae J138
agcuaaagaaacuucugac

SEQ ID NO: 533765 - RNA, 12 nt, Chlamydophila pneumoniae J138
agcuaagagcau

SEQ ID NO: 533766 - RNA, 12 nt, Chlamydophila pneumoniae J138
agcuaaaucaaa

SEQ ID NO: 533767 - RNA, 19 nt, Chlamydophila pneumoniae J138
agcguucgcucucuuuaaa

SEQ ID NO: 533768 - RNA, 19 nt, Chlamydophila pneumoniae J138
agcuacagaaagagcuaaa

SEQ ID NO: 533769 - RNA, 21 nt, Chlamydophila pneumoniae J138
agcuacggagagguuauguac

SEQ ID NO: 533770 - RNA, 20 nt, Chlamydophila pneumoniae J138
agcuaccuagggucuucucg

SEQ ID NO: 533771 - RNA, 17 nt, Chlamydophila pneumoniae J138
agcuacuaaucaccuua

SEQ ID NO: 533772 - RNA, 20 nt, Chlamydophila pneumoniae J138
agcuagagcacauagaaaca

SEQ ID NO: 533773 - RNA, 13 nt, Chlamydophila pneumoniae J138
agcuagaagagcg

SEQ ID NO: 533774 - RNA, 12 nt, Chlamydophila pneumoniae J138
agcuacuucuuc

SEQ ID NO: 533775 - RNA, 13 nt, Chlamydophila pneumoniae J138
agcuagaaagucc

SEQ ID NO: 533776 - RNA, 19 nt, Chlamydophila pneumoniae J138
agcuaggcgauaguaaaca

SEQ ID NO: 533777 - RNA, 18 nt, Chlamydophila pneumoniae J138
agcuaaucaauccaagaa

SEQ ID NO: 533778 - RNA, 16 nt, Chlamydophila pneumoniae J138
agcuaaucaauccaag

SEQ ID NO: 533779 - RNA, 17 nt, Chlamydophila pneumoniae J138
agcuaauaagauccaaa

SEQ ID NO: 533780 - RNA, 20 nt, Chlamydophila pneumoniae J138
agcuaagggaaauccacaga

SEQ ID NO: 533781 - RNA, 17 nt, Chlamydophila pneumoniae J138
agcuaaguaacaguccu

SEQ ID NO: 533782 - RNA, 20 nt, Chlamydophila pneumoniae J138
agcuacaagaacugaagagu

SEQ ID NO: 533783 - RNA, 17 nt, Chlamydophila pneumoniae J138
agcuaauuuaaaugccu

SEQ ID NO: 533784 - RNA, 18 nt, Chlamydophila pneumoniae J138
agcuagucuuucuaagaa

SEQ ID NO: 533785 - RNA, 14 nt, Chlamydophila pneumoniae J138
agcuauagaaagag

SEQ ID NO: 533786 - RNA, 17 nt, Chlamydophila pneumoniae J138
agcuaugaugagaacgu

SEQ ID NO: 533787 - RNA, 22 nt, Chlamydophila pneumoniae J138
agcuaucuugagcaucacggag

SEQ ID NO: 533788 - RNA, 20 nt, Chlamydophila pneumoniae J138
agcuauuuuacuuacuaaag

SEQ ID NO: 533789 - RNA, 15 nt, Chlamydophila pneumoniae J138
agcuauuucucuauc

SEQ ID NO: 533790 - RNA, 13 nt, Chlamydophila pneumoniae J138
agcuauuucucua

SEQ ID NO: 533791 - RNA, 14 nt, Chlamydophila pneumoniae J138
agcuauuugaaaua

SEQ ID NO: 533792 - RNA, 12 nt, Chlamydophila pneumoniae J138
agcuauuuuuga

SEQ ID NO: 533793 - RNA, 12 nt, Chlamydophila pneumoniae J138
agcucaaaaagu

SEQ ID NO: 533794 - RNA, 14 nt, Chlamydophila pneumoniae J138
agcucaaaaaguuc

SEQ ID NO: 533795 - RNA, 18 nt, Chlamydophila pneumoniae J138
agcucacucuuuaaaaac

SEQ ID NO: 533796 - RNA, 19 nt, Chlamydophila pneumoniae J138
agcucacgcaccauuccuu

SEQ ID NO: 533797 - RNA, 17 nt, Chlamydophila pneumoniae J138
agcucaucuagaaagau

SEQ ID NO: 533798 - RNA, 17 nt, Chlamydophila pneumoniae J138
agcucauuaucaagaaa

SEQ ID NO: 533799 - RNA, 22 nt, Chlamydophila pneumoniae J138
agccagacuggucuaacuuaga

SEQ ID NO: 533800 - RNA, 17 nt, Chlamydophila pneumoniae J138
agcaugcuaagcaucag

SEQ ID NO: 533801 - RNA, 23 nt, Chlamydophila pneumoniae J138
agcauggagaauaaucucuuuca

SEQ ID NO: 533802 - RNA, 19 nt, Chlamydophila pneumoniae J138
agcauggacuccaagaaua

SEQ ID NO: 533803 - RNA, 13 nt, Chlamydophila pneumoniae J138
agcaugaagcaga

SEQ ID NO: 533804 - RNA, 23 nt, Chlamydophila pneumoniae J138
agccaagaaaacauaaaguuaua

SEQ ID NO: 533805 - RNA, 21 nt, Chlamydophila pneumoniae J138
agccaagaagauguagagucg

SEQ ID NO: 533806 - RNA, 15 nt, Chlamydophila pneumoniae J138
agccaccaucuguug

SEQ ID NO: 533807 - RNA, 16 nt, Chlamydophila pneumoniae J138
agccaugacaaagggu

SEQ ID NO: 533808 - RNA, 15 nt, Chlamydophila pneumoniae J138
agccauuuucuaaga

SEQ ID NO: 533809 - RNA, 20 nt, Chlamydophila pneumoniae J138
agccauuuucuaagagaucu

SEQ ID NO: 533810 - RNA, 15 nt, Chlamydophila pneumoniae J138
agccauuuuccagga

SEQ ID NO: 533811 - RNA, 20 nt, Chlamydophila pneumoniae J138
agccauaauuagaacagcau

SEQ ID NO: 533812 - RNA, 18 nt, Chlamydophila pneumoniae J138
agccaucgcgaagcuuuc

SEQ ID NO: 533813 - RNA, 23 nt, Chlamydophila pneumoniae J138
agccaucgguucggucucuucuc

SEQ ID NO: 533814 - RNA, 13 nt, Chlamydophila pneumoniae J138
agccccagcaacc

SEQ ID NO: 533815 - RNA, 14 nt, Chlamydophila pneumoniae J138
agcccgaaauucau

SEQ ID NO: 533816 - RNA, 18 nt, Chlamydophila pneumoniae J138
agcaccuaauaaagaagg

SEQ ID NO: 533817 - RNA, 16 nt, Chlamydophila pneumoniae J138
agcaacccgaauuccu

SEQ ID NO: 533818 - RNA, 18 nt, Chlamydophila pneumoniae J138
agcaacaucguuaauaua

SEQ ID NO: 533819 - RNA, 22 nt, Chlamydophila pneumoniae J138
agcaacaucguuaauauaauug

SEQ ID NO: 533820 - RNA, 19 nt, Chlamydophila pneumoniae J138
agcaacaguaauuauuuuc

SEQ ID NO: 533821 - RNA, 18 nt, Chlamydophila pneumoniae J138
agcacguagguuguacuu

SEQ ID NO: 533822 - RNA, 19 nt, Chlamydophila pneumoniae J138
agcacucacgcucucgcua

SEQ ID NO: 533823 - RNA, 20 nt, Chlamydophila pneumoniae J138
agcacucacgcucucgcuaa

SEQ ID NO: 533824 - RNA, 23 nt, Chlamydophila pneumoniae J138
agcacuaaaagggaagcuuccau

SEQ ID NO: 533825 - RNA, 22 nt, Chlamydophila pneumoniae J138
agcacuuguuuuuucuucuguu

SEQ ID NO: 533826 - RNA, 18 nt, Chlamydophila pneumoniae J138
agcacucuuuuucuaaga

SEQ ID NO: 533827 - RNA, 17 nt, Chlamydophila pneumoniae J138
agcacuucuuuaggagc

SEQ ID NO: 533828 - RNA, 12 nt, Chlamydophila pneumoniae J138
agcacugaugaa

SEQ ID NO: 533829 - RNA, 15 nt, Chlamydophila pneumoniae J138
agcagaaacuccaaa

SEQ ID NO: 533830 - RNA, 17 nt, Chlamydophila pneumoniae J138
agcagaguuuuucccuc

SEQ ID NO: 533831 - RNA, 13 nt, Chlamydophila pneumoniae J138
agcagcaaaaauu

SEQ ID NO: 533832 - RNA, 13 nt, Chlamydophila pneumoniae J138
agcagcaagaaca

SEQ ID NO: 533833 - RNA, 18 nt, Chlamydophila pneumoniae J138
agcagcaaauacuccagg

SEQ ID NO: 533834 - RNA, 13 nt, Chlamydophila pneumoniae J138
agcaggagcauca

SEQ ID NO: 533835 - RNA, 19 nt, Chlamydophila pneumoniae J138
agcaucgcuuaacaaacuu

SEQ ID NO: 533836 - RNA, 23 nt, Chlamydophila pneumoniae J138
agcaucacggaguguuugaagau

SEQ ID NO: 533837 - RNA, 17 nt, Chlamydophila pneumoniae J138
agcaucuuucaucaaug

SEQ ID NO: 533838 - RNA, 13 nt, Chlamydophila pneumoniae J138
agcauagagagaa

SEQ ID NO: 533839 - RNA, 14 nt, Chlamydophila pneumoniae J138
agcauagagagaag

SEQ ID NO: 533840 - RNA, 13 nt, Chlamydophila pneumoniae J138
accaugaggcugc

SEQ ID NO: 533841 - RNA, 16 nt, Chlamydophila pneumoniae J138
accauccgacuuuccu

SEQ ID NO: 533842 - RNA, 18 nt, Chlamydophila pneumoniae J138
accaucaagguauuggaa

SEQ ID NO: 533843 - RNA, 16 nt, Chlamydophila pneumoniae J138
accagaagacucccaa

SEQ ID NO: 533844 - RNA, 18 nt, Chlamydophila pneumoniae J138
accauaaggagauuccua

SEQ ID NO: 533845 - RNA, 17 nt, Chlamydophila pneumoniae J138
accauaaggagauuccu

SEQ ID NO: 533846 - RNA, 17 nt, Chlamydophila pneumoniae J138
accauucuugaagaucu

SEQ ID NO: 533847 - RNA, 14 nt, Chlamydophila pneumoniae J138
accauuaaauugua

SEQ ID NO: 533848 - RNA, 23 nt, Chlamydophila pneumoniae J138
accauuuaccccaggaaucacug

SEQ ID NO: 533849 - RNA, 16 nt, Chlamydophila pneumoniae J138
acccaccauucuugaa

SEQ ID NO: 533850 - RNA, 22 nt, Chlamydophila pneumoniae J138
acccaccauucuugaagaucuc

SEQ ID NO: 533851 - RNA, 22 nt, Chlamydophila pneumoniae J138
accccacgcuaaacuaaaaugg

SEQ ID NO: 533852 - RNA, 17 nt, Chlamydophila pneumoniae J138
accccaucagcaaugau

SEQ ID NO: 533853 - RNA, 14 nt, Chlamydophila pneumoniae J138
acccuccuuuguau

SEQ ID NO: 533854 - RNA, 15 nt, Chlamydophila pneumoniae J138
acccucgaaccacug

SEQ ID NO: 533855 - RNA, 22 nt, Chlamydophila pneumoniae J138
accgaucucaguaggagcagcg

SEQ ID NO: 533856 - RNA, 18 nt, Chlamydophila pneumoniae J138
accgcgagugugacugca

SEQ ID NO: 533857 - RNA, 21 nt, Chlamydophila pneumoniae J138
accuccucuucuucaucuucu

SEQ ID NO: 533858 - RNA, 19 nt, Chlamydophila pneumoniae J138
accucaagaugcauucuga

SEQ ID NO: 533859 - RNA, 21 nt, Chlamydophila pneumoniae J138
accuaggagaaaucacacuua

SEQ ID NO: 533860 - RNA, 17 nt, Chlamydophila pneumoniae J138
accuaggagaaaucaca

SEQ ID NO: 533861 - RNA, 16 nt, Chlamydophila pneumoniae J138
accuagggucuucucg

SEQ ID NO: 533862 - RNA, 18 nt, Chlamydophila pneumoniae J138
accucucaucaaagcaaa

SEQ ID NO: 533863 - RNA, 12 nt, Chlamydophila pneumoniae J138
accucuaauuug

SEQ ID NO: 533864 - RNA, 16 nt, Chlamydophila pneumoniae J138
accugagaguguuguu

SEQ ID NO: 533865 - RNA, 22 nt, Chlamydophila pneumoniae J138
accugaaagcgcguuccuguag

SEQ ID NO: 533866 - RNA, 22 nt, Chlamydophila pneumoniae J138
accucucccuugggauuccuua

SEQ ID NO: 533867 - RNA, 23 nt, Chlamydophila pneumoniae J138
accucuuuucuuaucaugaaaag

SEQ ID NO: 533868 - RNA, 15 nt, Chlamydophila pneumoniae J138
accucuucaaagaca

SEQ ID NO: 533869 - RNA, 14 nt, Chlamydophila pneumoniae J138
accuuccuuaucuu

SEQ ID NO: 533870 - RNA, 18 nt, Chlamydophila pneumoniae J138
accuucgauuccaggcuc

SEQ ID NO: 533871 - RNA, 23 nt, Chlamydophila pneumoniae J138
accuuuaggaagcuguacuugau

SEQ ID NO: 533872 - RNA, 17 nt, Chlamydophila pneumoniae J138
accuuuaggaagcugua

SEQ ID NO: 533873 - RNA, 12 nt, Chlamydophila pneumoniae J138
accuuuaggaac

SEQ ID NO: 533874 - RNA, 15 nt, Chlamydophila pneumoniae J138
accuuuaggaagcug

SEQ ID NO: 533875 - RNA, 14 nt, Chlamydophila pneumoniae J138
acgaaaacaucugu

SEQ ID NO: 533876 - RNA, 13 nt, Chlamydophila pneumoniae J138
acgaaaaggagaa

SEQ ID NO: 533877 - RNA, 14 nt, Chlamydophila pneumoniae J138
accugugugcuuua

SEQ ID NO: 533878 - RNA, 17 nt, Chlamydophila pneumoniae J138
accuguguaaugagcug

SEQ ID NO: 533879 - RNA, 18 nt, Chlamydophila pneumoniae J138
accuguguaaugagcugg

SEQ ID NO: 533880 - RNA, 19 nt, Chlamydophila pneumoniae J138
accuguguaaugagcugga

SEQ ID NO: 533881 - RNA, 13 nt, Chlamydophila pneumoniae J138
accuguuuucuuu

SEQ ID NO: 533882 - RNA, 21 nt, Chlamydophila pneumoniae J138
accugggggacuucaaaugaa

SEQ ID NO: 533883 - RNA, 16 nt, Chlamydophila pneumoniae J138
accuuagagugacuca

SEQ ID NO: 533884 - RNA, 19 nt, Chlamydophila pneumoniae J138
accuuaguuuuuucuaagg

SEQ ID NO: 533885 - RNA, 20 nt, Chlamydophila pneumoniae J138
accuuacauccaauuuuguu

SEQ ID NO: 533886 - RNA, 18 nt, Chlamydophila pneumoniae J138
accuucaaugauuucuuu

SEQ ID NO: 533887 - RNA, 15 nt, Chlamydophila pneumoniae J138
acgaacuaaaggaac

SEQ ID NO: 533888 - RNA, 14 nt, Chlamydophila pneumoniae J138
acgaacuaaaggaa

SEQ ID NO: 533889 - RNA, 19 nt, Chlamydophila pneumoniae J138
acgaagaaaacgcaccuua

SEQ ID NO: 533890 - RNA, 21 nt, Chlamydophila pneumoniae J138
acgagaacaugaccuuuagga

SEQ ID NO: 533891 - RNA, 19 nt, Chlamydophila pneumoniae J138
acgagaaguuugauaagcu

SEQ ID NO: 533892 - RNA, 19 nt, Chlamydophila pneumoniae J138
acgaaguuagcuaacucgg

SEQ ID NO: 533893 - RNA, 21 nt, Chlamydophila pneumoniae J138
acgagaccucaccuggaucua

SEQ ID NO: 533894 - RNA, 13 nt, Chlamydophila pneumoniae J138
acgagcuguccag

SEQ ID NO: 533895 - RNA, 20 nt, Chlamydophila pneumoniae J138
acgaggagaagucgaaagau

SEQ ID NO: 533896 - RNA, 17 nt, Chlamydophila pneumoniae J138
acgaucgcgauaagaag

SEQ ID NO: 533897 - RNA, 21 nt, Chlamydophila pneumoniae J138
acgaucgucaguaaaacacaa

SEQ ID NO: 533898 - RNA, 22 nt, Chlamydophila pneumoniae J138
acgaucuacguuggacugcaag

SEQ ID NO: 533899 - RNA, 20 nt, Chlamydophila pneumoniae J138
acgauuucuuuuaguuguga

SEQ ID NO: 533900 - RNA, 21 nt, Chlamydophila pneumoniae J138
acgauucuaggccuaaagaau

SEQ ID NO: 533901 - RNA, 13 nt, Chlamydophila pneumoniae J138
acgcacuucuuca

SEQ ID NO: 533902 - RNA, 13 nt, Chlamydophila pneumoniae J138
acgcacgccaaga

SEQ ID NO: 533903 - RNA, 15 nt, Chlamydophila pneumoniae J138
acgcacauuuagaag

SEQ ID NO: 533904 - RNA, 18 nt, Chlamydophila pneumoniae J138
acgcaagagacaagaaaa

SEQ ID NO: 533905 - RNA, 15 nt, Chlamydophila pneumoniae J138
acgcaaguaaagaaa

SEQ ID NO: 533906 - RNA, 16 nt, Chlamydophila pneumoniae J138
acgcaaguaaagaaau

SEQ ID NO: 533907 - RNA, 17 nt, Chlamydophila pneumoniae J138
acgcaaugauuucucua

SEQ ID NO: 533908 - RNA, 22 nt, Chlamydophila pneumoniae J138
acgccaaugggaauuugauuuu

SEQ ID NO: 533909 - RNA, 18 nt, Chlamydophila pneumoniae J138
acgcauagcacuaugaau

SEQ ID NO: 533910 - RNA, 21 nt, Chlamydophila pneumoniae J138
acgcauaagagacauuucuug

SEQ ID NO: 533911 - RNA, 22 nt, Chlamydophila pneumoniae J138
acgcaguaucguaacuuccuuu

SEQ ID NO: 533912 - RNA, 16 nt, Chlamydophila pneumoniae J138
acgccauacugauaua

SEQ ID NO: 533913 - RNA, 14 nt, Chlamydophila pneumoniae J138
acggaaagcacaua

SEQ ID NO: 533914 - RNA, 21 nt, Chlamydophila pneumoniae J138
acggaaaauacagccagcaga

SEQ ID NO: 533915 - RNA, 18 nt, Chlamydophila pneumoniae J138
acgcuuuuucuugaaaaa

SEQ ID NO: 533916 - RNA, 14 nt, Chlamydophila pneumoniae J138
acggaacuaaagag

SEQ ID NO: 533917 - RNA, 19 nt, Chlamydophila pneumoniae J138
acgcuucuuuuuggauauc

SEQ ID NO: 533918 - RNA, 16 nt, Chlamydophila pneumoniae J138
acgcuuuucuucuuua

SEQ ID NO: 533919 - RNA, 20 nt, Chlamydophila pneumoniae J138
acggacaaugcuaucuccag

SEQ ID NO: 533920 - RNA, 14 nt, Chlamydophila pneumoniae J138
acggagagagauuc

SEQ ID NO: 533921 - RNA, 17 nt, Chlamydophila pneumoniae J138
acggauucuaaaagagc

SEQ ID NO: 533922 - RNA, 21 nt, Chlamydophila pneumoniae J138
acggauaggaucauugaguuc

SEQ ID NO: 533923 - RNA, 15 nt, Chlamydophila pneumoniae J138
acguaauccagauug

SEQ ID NO: 533924 - RNA, 14 nt, Chlamydophila pneumoniae J138
acguaacguaguca

SEQ ID NO: 533925 - RNA, 12 nt, Chlamydophila pneumoniae J138
acguaagguguc

SEQ ID NO: 533926 - RNA, 14 nt, Chlamydophila pneumoniae J138
acguaaaaagaaag

SEQ ID NO: 533927 - RNA, 22 nt, Chlamydophila pneumoniae J138
acgguuuucugccuuaccacuu

SEQ ID NO: 533928 - RNA, 21 nt, Chlamydophila pneumoniae J138
acgguuucugggaugcacacg

SEQ ID NO: 533929 - RNA, 17 nt, Chlamydophila pneumoniae J138
acgguaaugccagcagc

SEQ ID NO: 533930 - RNA, 21 nt, Chlamydophila pneumoniae J138
acggugcuguuguaauaaaag

SEQ ID NO: 533931 - RNA, 22 nt, Chlamydophila pneumoniae J138
acgguaagaucucguagcucag

SEQ ID NO: 533932 - RNA, 23 nt, Chlamydophila pneumoniae J138
acgguaaggaggaaucuugauga

SEQ ID NO: 533933 - RNA, 17 nt, Chlamydophila pneumoniae J138
acuauagaucucuugaa

SEQ ID NO: 533934 - RNA, 17 nt, Chlamydophila pneumoniae J138
acuauagcaauccauag

SEQ ID NO: 533935 - RNA, 23 nt, Chlamydophila pneumoniae J138
acuauuaggcuuuuuucuauuuu

SEQ ID NO: 533936 - RNA, 13 nt, Chlamydophila pneumoniae J138
acuagaauaccgu

SEQ ID NO: 533937 - RNA, 15 nt, Chlamydophila pneumoniae J138
acuacauaauaagca

SEQ ID NO: 533938 - RNA, 17 nt, Chlamydophila pneumoniae J138
acuacaggaauucucau

SEQ ID NO: 533939 - RNA, 13 nt, Chlamydophila pneumoniae J138
acuagagaaaaag

SEQ ID NO: 533940 - RNA, 22 nt, Chlamydophila pneumoniae J138
acuacacgcacuugcuuaucca

SEQ ID NO: 533941 - RNA, 12 nt, Chlamydophila pneumoniae J138
acuacagaggga

SEQ ID NO: 533942 - RNA, 17 nt, Chlamydophila pneumoniae J138
acuacacgcacuugcuu

SEQ ID NO: 533943 - RNA, 20 nt, Chlamydophila pneumoniae J138
acuaaucaccuuaggcuuaa

SEQ ID NO: 533944 - RNA, 12 nt, Chlamydophila pneumoniae J138
acuaacauagau

SEQ ID NO: 533945 - RNA, 21 nt, Chlamydophila pneumoniae J138
acuaagaagcucacucuuuaa

SEQ ID NO: 533946 - RNA, 17 nt, Chlamydophila pneumoniae J138
acuaagauaucuccagg

SEQ ID NO: 533947 - RNA, 19 nt, Chlamydophila pneumoniae J138
acgugcucucuucuucuca

SEQ ID NO: 533948 - RNA, 18 nt, Chlamydophila pneumoniae J138
acgugcucucuacuucug

SEQ ID NO: 533949 - RNA, 16 nt, Chlamydophila pneumoniae J138
acgugcucucuacuuc

SEQ ID NO: 533950 - RNA, 13 nt, Chlamydophila pneumoniae J138
acguucugcaaca

SEQ ID NO: 533951 - RNA, 18 nt, Chlamydophila pneumoniae J138
acguagcuacaaaauuau

SEQ ID NO: 533952 - RNA, 17 nt, Chlamydophila pneumoniae J138
acguagcuacaaaauua

SEQ ID NO: 533953 - RNA, 18 nt, Chlamydophila pneumoniae J138
acgucuucuuagaagaga

SEQ ID NO: 533954 - RNA, 13 nt, Chlamydophila pneumoniae J138
acgucuuaugaaa

SEQ ID NO: 533955 - RNA, 17 nt, Chlamydophila pneumoniae J138
acgucuuucaccaacuc

SEQ ID NO: 533956 - RNA, 19 nt, Chlamydophila pneumoniae J138
acguugcgaacagcuccug

SEQ ID NO: 533957 - RNA, 15 nt, Chlamydophila pneumoniae J138
acguuguugcaauuc

SEQ ID NO: 533958 - RNA, 15 nt, Chlamydophila pneumoniae J138
acguuugaucuucuc

SEQ ID NO: 533959 - RNA, 14 nt, Chlamydophila pneumoniae J138
acuaaaaucucauu

SEQ ID NO: 533960 - RNA, 19 nt, Chlamydophila pneumoniae J138
acuaaagauacuuaucuuu

SEQ ID NO: 533961 - RNA, 18 nt, Chlamydophila pneumoniae J138
acuaaagauacuuaucuu

SEQ ID NO: 533962 - RNA, 23 nt, Chlamydophila pneumoniae J138
acuaaacuccauuguuguugcau

SEQ ID NO: 533963 - RNA, 16 nt, Chlamydophila pneumoniae J138
acuaaacgaucaaauu

SEQ ID NO: 533964 - RNA, 17 nt, Chlamydophila pneumoniae J138
acuaaaccuucaaugau

SEQ ID NO: 533965 - RNA, 22 nt, Chlamydophila pneumoniae J138
acuguucgauaagaacuuuagg

SEQ ID NO: 533966 - RNA, 18 nt, Chlamydophila pneumoniae J138
acuguugauccuucuuau

SEQ ID NO: 533967 - RNA, 23 nt, Chlamydophila pneumoniae J138
acuguugauccuucuuaugguca

SEQ ID NO: 533968 - RNA, 15 nt, Chlamydophila pneumoniae J138
acuguucauaaucca

SEQ ID NO: 533969 - RNA, 19 nt, Chlamydophila pneumoniae J138
acuuaaagcuugagaaaag

SEQ ID NO: 533970 - RNA, 17 nt, Chlamydophila pneumoniae J138
acuuaaagguaaaacua

SEQ ID NO: 533971 - RNA, 14 nt, Chlamydophila pneumoniae J138
acuuacgaaucuua

SEQ ID NO: 533972 - RNA, 23 nt, Chlamydophila pneumoniae J138
acuucaccuugaaguuuuuucuc

SEQ ID NO: 533973 - RNA, 16 nt, Chlamydophila pneumoniae J138
acuucacguugcaaug

SEQ ID NO: 533974 - RNA, 16 nt, Chlamydophila pneumoniae J138
acuucagcaagaaaau

SEQ ID NO: 533975 - RNA, 19 nt, Chlamydophila pneumoniae J138
acuucaggaaauaauuugu

SEQ ID NO: 533976 - RNA, 15 nt, Chlamydophila pneumoniae J138
acuucagcuuugcuu

SEQ ID NO: 533977 - RNA, 19 nt, Chlamydophila pneumoniae J138
acuucaaugaaagcuguau

SEQ ID NO: 533978 - RNA, 16 nt, Chlamydophila pneumoniae J138
acuucaaugaagaaaa

SEQ ID NO: 533979 - RNA, 16 nt, Chlamydophila pneumoniae J138
acuucacaaagaacca

SEQ ID NO: 533980 - RNA, 21 nt, Chlamydophila pneumoniae J138
acuucaacaaaggcuccaaac

SEQ ID NO: 533981 - RNA, 14 nt, Chlamydophila pneumoniae J138
acuucaaaugaaau

SEQ ID NO: 533982 - RNA, 16 nt, Chlamydophila pneumoniae J138
acuucaaaugaaauuc

SEQ ID NO: 533983 - RNA, 16 nt, Chlamydophila pneumoniae J138
acuucaacuucuccaa

SEQ ID NO: 533984 - RNA, 23 nt, Chlamydophila pneumoniae J138
acuuauuguucuugguguauagu

SEQ ID NO: 533985 - RNA, 22 nt, Chlamydophila pneumoniae J138
acuuauguucuaugagauagga

SEQ ID NO: 533986 - RNA, 20 nt, Chlamydophila pneumoniae J138
acuuagaucuuuucuacuuc

SEQ ID NO: 533987 - RNA, 18 nt, Chlamydophila pneumoniae J138
acuuaucgaaugcugcac

SEQ ID NO: 533988 - RNA, 17 nt, Chlamydophila pneumoniae J138
acuuccccaaacaugga

SEQ ID NO: 533989 - RNA, 19 nt, Chlamydophila pneumoniae J138
acuucccgaacagcggcaa

SEQ ID NO: 533990 - RNA, 15 nt, Chlamydophila pneumoniae J138
acuucccucaugaag

SEQ ID NO: 533991 - RNA, 17 nt, Chlamydophila pneumoniae J138
acuucaucgacaguauu

SEQ ID NO: 533992 - RNA, 14 nt, Chlamydophila pneumoniae J138
acuucgaugucuuu

SEQ ID NO: 533993 - RNA, 21 nt, Chlamydophila pneumoniae J138
acuucgaugucuuuccaggca

SEQ ID NO: 533994 - RNA, 19 nt, Chlamydophila pneumoniae J138
acuuccuccaauaaucacu

SEQ ID NO: 533995 - RNA, 22 nt, Chlamydophila pneumoniae J138
acuuccuacgacaugccuaaau

SEQ ID NO: 533996 - RNA, 18 nt, Chlamydophila pneumoniae J138
acuuccucuucaauuucu

SEQ ID NO: 533997 - RNA, 23 nt, Chlamydophila pneumoniae J138
acuucuuuaggagcauagacucu

SEQ ID NO: 533998 - RNA, 15 nt, Chlamydophila pneumoniae J138
acuucuuucuugcuc

SEQ ID NO: 533999 - RNA, 22 nt, Chlamydophila pneumoniae J138
acuucuuugccguauagauuuu

SEQ ID NO: 534000 - RNA, 17 nt, Chlamydophila pneumoniae J138
acuucuucucgguuuaa

SEQ ID NO: 534001 - RNA, 16 nt, Chlamydophila pneumoniae J138
acuucuuccacgagau

SEQ ID NO: 534002 - RNA, 14 nt, Chlamydophila pneumoniae J138
acuucuaacuguac

SEQ ID NO: 534003 - RNA, 22 nt, Chlamydophila pneumoniae J138
acuucguuucgcuuugauaaua

SEQ ID NO: 534004 - RNA, 16 nt, Chlamydophila pneumoniae J138
acuucucaaagacaau

SEQ ID NO: 534005 - RNA, 12 nt, Chlamydophila pneumoniae J138
acuucucaaaga

SEQ ID NO: 534006 - RNA, 19 nt, Chlamydophila pneumoniae J138
acuucuaugauaucaccag

SEQ ID NO: 534007 - RNA, 14 nt, Chlamydophila pneumoniae J138
acuucugaaggaaa

SEQ ID NO: 534008 - RNA, 20 nt, Chlamydophila pneumoniae J138
acuucugguccaaacccugg

SEQ ID NO: 534009 - RNA, 13 nt, Chlamydophila pneumoniae J138
acuucuucaagaa

SEQ ID NO: 534010 - RNA, 15 nt, Chlamydophila pneumoniae J138
acuucuucaagaaau

SEQ ID NO: 534011 - RNA, 19 nt, Chlamydophila pneumoniae J138
acuucuucaagaaaugccc

SEQ ID NO: 534012 - RNA, 16 nt, Chlamydophila pneumoniae J138
acugcauaaucucacc

SEQ ID NO: 534013 - RNA, 21 nt, Chlamydophila pneumoniae J138
acugcaaaggaagggauguuu

SEQ ID NO: 534014 - RNA, 23 nt, Chlamydophila pneumoniae J138
acucuuuaaaagggcgcuucccu

SEQ ID NO: 534015 - RNA, 19 nt, Chlamydophila pneumoniae J138
acucuuuuauuuuaggaag

SEQ ID NO: 534016 - RNA, 16 nt, Chlamydophila pneumoniae J138
acucuuuucuagaaac

SEQ ID NO: 534017 - RNA, 19 nt, Chlamydophila pneumoniae J138
acugagcuucuaucuugaa

SEQ ID NO: 534018 - RNA, 14 nt, Chlamydophila pneumoniae J138
acugaggcaaagau

SEQ ID NO: 534019 - RNA, 14 nt, Chlamydophila pneumoniae J138
acugagaguuccuu

SEQ ID NO: 534020 - RNA, 12 nt, Chlamydophila pneumoniae J138
acugaaagaugu

SEQ ID NO: 534021 - RNA, 22 nt, Chlamydophila pneumoniae J138
acugcgaaggguuguugccagu

SEQ ID NO: 534022 - RNA, 15 nt, Chlamydophila pneumoniae J138
acugcgagagaaagu

SEQ ID NO: 534023 - RNA, 21 nt, Chlamydophila pneumoniae J138
acuggaggcuguguaaaaguu

SEQ ID NO: 534024 - RNA, 14 nt, Chlamydophila pneumoniae J138
acuggacuucguuu

SEQ ID NO: 534025 - RNA, 17 nt, Chlamydophila pneumoniae J138
acugcugacaucuccaa

SEQ ID NO: 534026 - RNA, 13 nt, Chlamydophila pneumoniae J138
acuccucagaauc

SEQ ID NO: 534027 - RNA, 13 nt, Chlamydophila pneumoniae J138
acuccuuuuaaaa

SEQ ID NO: 534028 - RNA, 22 nt, Chlamydophila pneumoniae J138
acucccuagguuuuaucuuuag

SEQ ID NO: 534029 - RNA, 15 nt, Chlamydophila pneumoniae J138
acucccguuuuguug

SEQ ID NO: 534030 - RNA, 23 nt, Chlamydophila pneumoniae J138
acucccuagguuuuaucuuuaga

SEQ ID NO: 534031 - RNA, 22 nt, Chlamydophila pneumoniae J138
acuccuaagucguuaacaucaa

SEQ ID NO: 534032 - RNA, 18 nt, Chlamydophila pneumoniae J138
acuauuuuggaaagcucu

SEQ ID NO: 534033 - RNA, 20 nt, Chlamydophila pneumoniae J138
acucucuuccuucuccugua

SEQ ID NO: 534034 - RNA, 17 nt, Chlamydophila pneumoniae J138
acucucuuccuucuccu

SEQ ID NO: 534035 - RNA, 14 nt, Chlamydophila pneumoniae J138
acucucuuccuucu

SEQ ID NO: 534036 - RNA, 18 nt, Chlamydophila pneumoniae J138
acucugaaguacacuaca

SEQ ID NO: 534037 - RNA, 22 nt, Chlamydophila pneumoniae J138
acucuaaucugauucaauugag

SEQ ID NO: 534038 - RNA, 18 nt, Chlamydophila pneumoniae J138
acucuaaucugauucaau

SEQ ID NO: 534039 - RNA, 15 nt, Chlamydophila pneumoniae J138
acucuacaucuucuu

SEQ ID NO: 534040 - RNA, 21 nt, Chlamydophila pneumoniae J138
acucuacaguaguaaauaaua

SEQ ID NO: 534041 - RNA, 17 nt, Chlamydophila pneumoniae J138
acucuccaaaagcucua

SEQ ID NO: 534042 - RNA, 18 nt, Chlamydophila pneumoniae J138
acucuccauccucagucu

SEQ ID NO: 534043 - RNA, 20 nt, Chlamydophila pneumoniae J138
acucuccauccucagucucu

SEQ ID NO: 534044 - RNA, 17 nt, Chlamydophila pneumoniae J138
acucugggaauuguucu

SEQ ID NO: 534045 - RNA, 14 nt, Chlamydophila pneumoniae J138
acucuuuaaaaaua

SEQ ID NO: 534046 - RNA, 14 nt, Chlamydophila pneumoniae J138
acucuucuuuuuau

SEQ ID NO: 534047 - RNA, 16 nt, Chlamydophila pneumoniae J138
acucuuccacaauguu

SEQ ID NO: 534048 - RNA, 22 nt, Chlamydophila pneumoniae J138
acucuuccacaauguuuagaau

SEQ ID NO: 534049 - RNA, 23 nt, Chlamydophila pneumoniae J138
acucuuccacaauguuuagaauu

SEQ ID NO: 534050 - RNA, 22 nt, Chlamydophila pneumoniae J138
acucuucaucgauaggaugaca

SEQ ID NO: 534051 - RNA, 22 nt, Chlamydophila pneumoniae J138
acucuuccaauuguaaaucauu

SEQ ID NO: 534052 - RNA, 16 nt, Chlamydophila pneumoniae J138
acucuuccuucuacag

SEQ ID NO: 534053 - RNA, 13 nt, Chlamydophila pneumoniae J138
aaucaguccuaaa

SEQ ID NO: 534054 - RNA, 21 nt, Chlamydophila pneumoniae J138
aaucauagccaucauagcaaa

SEQ ID NO: 534055 - RNA, 23 nt, Chlamydophila pneumoniae J138
aaucauaacaagucuaucgacac

SEQ ID NO: 534056 - RNA, 18 nt, Chlamydophila pneumoniae J138
aaucauaaccaaaagaau

SEQ ID NO: 534057 - RNA, 15 nt, Chlamydophila pneumoniae J138
aaaaauuaagaaccc

SEQ ID NO: 534058 - RNA, 13 nt, Chlamydophila pneumoniae J138
aaaaauucucaua

SEQ ID NO: 534059 - RNA, 13 nt, Chlamydophila pneumoniae J138
aauccaagaauag

SEQ ID NO: 534060 - RNA, 17 nt, Chlamydophila pneumoniae J138
aauccaaggggcuccca

SEQ ID NO: 534061 - RNA, 21 nt, Chlamydophila pneumoniae J138
aauccaccaaugauaauuuca

SEQ ID NO: 534062 - RNA, 14 nt, Chlamydophila pneumoniae J138
aauccaccaaugau

SEQ ID NO: 534063 - RNA, 12 nt, Chlamydophila pneumoniae J138
aauccacauccu

SEQ ID NO: 534064 - RNA, 13 nt, Chlamydophila pneumoniae J138
aauccaguuuuuu

SEQ ID NO: 534065 - RNA, 16 nt, Chlamydophila pneumoniae J138
aaucgcuguaaauuca

SEQ ID NO: 534066 - RNA, 23 nt, Chlamydophila pneumoniae J138
aaucguuucucuggcaaugacuu

SEQ ID NO: 534067 - RNA, 16 nt, Chlamydophila pneumoniae J138
aaucuaaaaucacacu

SEQ ID NO: 534068 - RNA, 15 nt, Chlamydophila pneumoniae J138
aaucuaacucuugua

SEQ ID NO: 534069 - RNA, 14 nt, Chlamydophila pneumoniae J138
aaucuaaaaccuga

SEQ ID NO: 534070 - RNA, 13 nt, Chlamydophila pneumoniae J138
aaucuaagaacua

SEQ ID NO: 534071 - RNA, 17 nt, Chlamydophila pneumoniae J138
aaucuauccuucgaccu

SEQ ID NO: 534072 - RNA, 21 nt, Chlamydophila pneumoniae J138
aaucuaucugcacuuucuuuu

SEQ ID NO: 534073 - RNA, 11 nt, Chlamydophila pneumoniae J138
aaucuaugaga

SEQ ID NO: 534074 - RNA, 15 nt, Chlamydophila pneumoniae J138
aaucuauagucuguu

SEQ ID NO: 534075 - RNA, 16 nt, Chlamydophila pneumoniae J138
aaucuauagucuguuu

SEQ ID NO: 534076 - RNA, 14 nt, Chlamydophila pneumoniae J138
aaucucgcuauucc

SEQ ID NO: 534077 - RNA, 23 nt, Chlamydophila pneumoniae J138
aaucucgcuauuccauaaaaaug

SEQ ID NO: 534078 - RNA, 16 nt, Chlamydophila pneumoniae J138
aaucucgggagaacau

SEQ ID NO: 534079 - RNA, 14 nt, Chlamydophila pneumoniae J138
aaucuccucucuca

SEQ ID NO: 534080 - RNA, 19 nt, Chlamydophila pneumoniae J138
aaucgccuuacaauuuaaa

SEQ ID NO: 534081 - RNA, 16 nt, Chlamydophila pneumoniae J138
aaaaauuucaugagga

SEQ ID NO: 534082 - RNA, 22 nt, Chlamydophila pneumoniae J138
aaaaauuuuauaggaauaacac

SEQ ID NO: 534083 - RNA, 23 nt, Chlamydophila pneumoniae J138
aaaaauuugcgaaguccuggauu

SEQ ID NO: 534084 - RNA, 17 nt, Chlamydophila pneumoniae J138
aaucccccagcauucac

SEQ ID NO: 534085 - RNA, 19 nt, Chlamydophila pneumoniae J138
aauccccgggauuguucuu

SEQ ID NO: 534086 - RNA, 22 nt, Chlamydophila pneumoniae J138
aauccccgggauuguucuuuac

SEQ ID NO: 534087 - RNA, 16 nt, Chlamydophila pneumoniae J138
aauccugaguaaaauc

SEQ ID NO: 534088 - RNA, 20 nt, Chlamydophila pneumoniae J138
aauccucugaaggauuugcu

SEQ ID NO: 534089 - RNA, 16 nt, Chlamydophila pneumoniae J138
aaucccgugcuaggaa

SEQ ID NO: 534090 - RNA, 20 nt, Chlamydophila pneumoniae J138
aauccuccuagguucuuuuu

SEQ ID NO: 534091 - RNA, 20 nt, Chlamydophila pneumoniae J138
aauccugcauacccuucuuc

SEQ ID NO: 534092 - RNA, 21 nt, Chlamydophila pneumoniae J138
aauccugcauacccuucuucu

SEQ ID NO: 534093 - RNA, 16 nt, Chlamydophila pneumoniae J138
aauccugggcaaugau

SEQ ID NO: 534094 - RNA, 22 nt, Chlamydophila pneumoniae J138
aauccugggcaaugaucaaaaa

SEQ ID NO: 534095 - RNA, 21 nt, Chlamydophila pneumoniae J138
aauccuguaacacccucccuc

SEQ ID NO: 534096 - RNA, 18 nt, Chlamydophila pneumoniae J138
aauccuuucacaaagaau

SEQ ID NO: 534097 - RNA, 21 nt, Chlamydophila pneumoniae J138
aauccuuuuuaggaaaggaua

SEQ ID NO: 534098 - RNA, 17 nt, Chlamydophila pneumoniae J138
aaugaauggguuuuguu

SEQ ID NO: 534099 - RNA, 16 nt, Chlamydophila pneumoniae J138
aaugaaucgaagaaca

SEQ ID NO: 534100 - RNA, 20 nt, Chlamydophila pneumoniae J138
aaugaagccaaaaggcacag

SEQ ID NO: 534101 - RNA, 15 nt, Chlamydophila pneumoniae J138
aaucuuucaauguaa

SEQ ID NO: 534102 - RNA, 23 nt, Chlamydophila pneumoniae J138
aaucucuagggauaauuaaacuc

SEQ ID NO: 534103 - RNA, 13 nt, Chlamydophila pneumoniae J138
aaucucuaagaau

SEQ ID NO: 534104 - RNA, 21 nt, Chlamydophila pneumoniae J138
aaucuuguagcaauuaccugc

SEQ ID NO: 534105 - RNA, 20 nt, Chlamydophila pneumoniae J138
aaucuuugaagcucgaccuc

SEQ ID NO: 534106 - RNA, 17 nt, Chlamydophila pneumoniae J138
aaucuuugaacaaaaag

SEQ ID NO: 534107 - RNA, 14 nt, Chlamydophila pneumoniae J138
aaucuuugaagcuc

SEQ ID NO: 534108 - RNA, 19 nt, Chlamydophila pneumoniae J138
aaucuuugaucgcuugugc

SEQ ID NO: 534109 - RNA, 21 nt, Chlamydophila pneumoniae J138
aaugaaaccuucagaucgaau

SEQ ID NO: 534110 - RNA, 18 nt, Chlamydophila pneumoniae J138
aaugaaaagagacuguag

SEQ ID NO: 534111 - RNA, 16 nt, Chlamydophila pneumoniae J138
aaugacagcugagaaa

SEQ ID NO: 534112 - RNA, 17 nt, Chlamydophila pneumoniae J138
aaugacuaaaugcgagg

SEQ ID NO: 534113 - RNA, 16 nt, Chlamydophila pneumoniae J138
aaugacgggagcucuu

SEQ ID NO: 534114 - RNA, 19 nt, Chlamydophila pneumoniae J138
aaugacucuagaguacccc

SEQ ID NO: 534115 - RNA, 14 nt, Chlamydophila pneumoniae J138
aaugagaucugcaa

SEQ ID NO: 534116 - RNA, 22 nt, Chlamydophila pneumoniae J138
aaugaggguggaacuauccugu

SEQ ID NO: 534117 - RNA, 12 nt, Chlamydophila pneumoniae J138
aaugauaagaaa

SEQ ID NO: 534118 - RNA, 17 nt, Chlamydophila pneumoniae J138
aaugccgaguaguccug

SEQ ID NO: 534119 - RNA, 16 nt, Chlamydophila pneumoniae J138
aaugcccuuuagggaa

SEQ ID NO: 534120 - RNA, 23 nt, Chlamydophila pneumoniae J138
aaugcccuuuagggaauccccaa

SEQ ID NO: 534121 - RNA, 20 nt, Chlamydophila pneumoniae J138
aaugauucauaacauugcuu

SEQ ID NO: 534122 - RNA, 15 nt, Chlamydophila pneumoniae J138
aaugcaugaaucucu

SEQ ID NO: 534123 - RNA, 13 nt, Chlamydophila pneumoniae J138
aaugauagggaau

SEQ ID NO: 534124 - RNA, 17 nt, Chlamydophila pneumoniae J138
aaugauauaaaagcuga

SEQ ID NO: 534125 - RNA, 17 nt, Chlamydophila pneumoniae J138
aaugaucaaaaaugaua

SEQ ID NO: 534126 - RNA, 22 nt, Chlamydophila pneumoniae J138
aaugccucuuucauacuaaaau

SEQ ID NO: 534127 - RNA, 20 nt, Chlamydophila pneumoniae J138
aaugcuacgguuuucugccu

SEQ ID NO: 534128 - RNA, 19 nt, Chlamydophila pneumoniae J138
aaugcugagggaucuucuc

SEQ ID NO: 534129 - RNA, 21 nt, Chlamydophila pneumoniae J138
aauggcuuuuuuugucccaac

SEQ ID NO: 534130 - RNA, 23 nt, Chlamydophila pneumoniae J138
aauggauuccauaggggaugauu

SEQ ID NO: 534131 - RNA, 21 nt, Chlamydophila pneumoniae J138
aauggcagcuuggaugggaau

SEQ ID NO: 534132 - RNA, 15 nt, Chlamydophila pneumoniae J138
aauuuguuuagaaaa

SEQ ID NO: 534133 - RNA, 23 nt, Chlamydophila pneumoniae J138
aauuucuuguuccaauagagucu

SEQ ID NO: 534134 - RNA, 20 nt, Chlamydophila pneumoniae J138
aauuugauuuuucaaauucu

SEQ ID NO: 534135 - RNA, 15 nt, Chlamydophila pneumoniae J138
aauuugccugaaauc

SEQ ID NO: 534136 - RNA, 18 nt, Chlamydophila pneumoniae J138
aauuugccugaaauccug

SEQ ID NO: 534137 - RNA, 14 nt, Chlamydophila pneumoniae J138
aauuugauuuuuca

SEQ ID NO: 534138 - RNA, 16 nt, Chlamydophila pneumoniae J138
aauuugcuaugucugu

SEQ ID NO: 534139 - RNA, 14 nt, Chlamydophila pneumoniae J138
aauuugcgaagucc

SEQ ID NO: 534140 - RNA, 15 nt, Chlamydophila pneumoniae J138
aauuugcucuccugc

SEQ ID NO: 534141 - RNA, 23 nt, Chlamydophila pneumoniae J138
aauuugcguugcauguccauuaa

SEQ ID NO: 534142 - RNA, 17 nt, Chlamydophila pneumoniae J138
aauuuggauuuauguuu

SEQ ID NO: 534143 - RNA, 20 nt, Chlamydophila pneumoniae J138
aauuuuauaggaauaacacc

SEQ ID NO: 534144 - RNA, 18 nt, Chlamydophila pneumoniae J138
aauuuuauuaguuacuga

SEQ ID NO: 534145 - RNA, 23 nt, Chlamydophila pneumoniae J138
aauuuucagccugucuauaaaau

SEQ ID NO: 534146 - RNA, 18 nt, Chlamydophila pneumoniae J138
aauuuucagucuuccuuu

SEQ ID NO: 534147 - RNA, 12 nt, Chlamydophila pneumoniae J138
aauuuucccauu

SEQ ID NO: 534148 - RNA, 15 nt, Chlamydophila pneumoniae J138
aauuuucccauuaca

SEQ ID NO: 534149 - RNA, 19 nt, Chlamydophila pneumoniae J138
aauuuuuccuucaacacac

SEQ ID NO: 534150 - RNA, 15 nt, Chlamydophila pneumoniae J138
aauuuuucgagaaua

SEQ ID NO: 534151 - RNA, 15 nt, Chlamydophila pneumoniae J138
aauuuuucuaagaaa

SEQ ID NO: 534152 - RNA, 16 nt, Chlamydophila pneumoniae J138
aauuuaaaucugcaag

SEQ ID NO: 534153 - RNA, 22 nt, Chlamydophila pneumoniae J138
aauuucaaagaugcagauacua

SEQ ID NO: 534154 - RNA, 11 nt, Chlamydophila pneumoniae J138
aauuuccaaag

SEQ ID NO: 534155 - RNA, 17 nt, Chlamydophila pneumoniae J138
aauuucauguccuccau

SEQ ID NO: 534156 - RNA, 20 nt, Chlamydophila pneumoniae J138
aauuucggacgauauuuaga

SEQ ID NO: 534157 - RNA, 21 nt, Chlamydophila pneumoniae J138
aauuuccuucaggauuuucca

SEQ ID NO: 534158 - RNA, 14 nt, Chlamydophila pneumoniae J138
aauuuccuuagaag

SEQ ID NO: 534159 - RNA, 21 nt, Chlamydophila pneumoniae J138
aauuuccuuagaagggaaagu

SEQ ID NO: 534160 - RNA, 22 nt, Chlamydophila pneumoniae J138
aauuucuccaguaucuucucuu

SEQ ID NO: 534161 - RNA, 15 nt, Chlamydophila pneumoniae J138
aauuucuaggacagc

SEQ ID NO: 534162 - RNA, 17 nt, Chlamydophila pneumoniae J138
aauuucugaaacaaugc

SEQ ID NO: 534163 - RNA, 18 nt, Chlamydophila pneumoniae J138
aauuucugaaacaaugca

SEQ ID NO: 534164 - RNA, 13 nt, Chlamydophila pneumoniae J138
aauuucuucauca

SEQ ID NO: 534165 - RNA, 21 nt, Chlamydophila pneumoniae J138
aauguauccuucuacaaugau

SEQ ID NO: 534166 - RNA, 18 nt, Chlamydophila pneumoniae J138
aauuaccuugagacaaag

SEQ ID NO: 534167 - RNA, 15 nt, Chlamydophila pneumoniae J138
aauuaccauuuugca

SEQ ID NO: 534168 - RNA, 20 nt, Chlamydophila pneumoniae J138
aauuacucgcucugcacgga

SEQ ID NO: 534169 - RNA, 15 nt, Chlamydophila pneumoniae J138
aauuagaacagcaug

SEQ ID NO: 534170 - RNA, 14 nt, Chlamydophila pneumoniae J138
aauuacuuggauaa

SEQ ID NO: 534171 - RNA, 23 nt, Chlamydophila pneumoniae J138
aauuacuuggauaacacgaguuu

SEQ ID NO: 534172 - RNA, 15 nt, Chlamydophila pneumoniae J138
aauuagaguaugagg

SEQ ID NO: 534173 - RNA, 19 nt, Chlamydophila pneumoniae J138
aauuagagaaauuuuuaau

SEQ ID NO: 534174 - RNA, 13 nt, Chlamydophila pneumoniae J138
aauuauuaaacuc

SEQ ID NO: 534175 - RNA, 12 nt, Chlamydophila pneumoniae J138
aauuaguaaaug

SEQ ID NO: 534176 - RNA, 17 nt, Chlamydophila pneumoniae J138
aauuagggcuuuuacuc

SEQ ID NO: 534177 - RNA, 22 nt, Chlamydophila pneumoniae J138
aauugacugcuagaguccaagg

SEQ ID NO: 534178 - RNA, 23 nt, Chlamydophila pneumoniae J138
aauugagaaauauaacucucuag

SEQ ID NO: 534179 - RNA, 23 nt, Chlamydophila pneumoniae J138
aauucuuuaugagagagcucuuc

SEQ ID NO: 534180 - RNA, 16 nt, Chlamydophila pneumoniae J138
aauucuuugccaagga

SEQ ID NO: 534181 - RNA, 15 nt, Chlamydophila pneumoniae J138
aauugcaaaguacua

SEQ ID NO: 534182 - RNA, 16 nt, Chlamydophila pneumoniae J138
aauugagcucucuagc

SEQ ID NO: 534183 - RNA, 20 nt, Chlamydophila pneumoniae J138
aauugagcucucuagcuguu

SEQ ID NO: 534184 - RNA, 23 nt, Chlamydophila pneumoniae J138
aauucgauguuaaggcuuccaau

SEQ ID NO: 534185 - RNA, 20 nt, Chlamydophila pneumoniae J138
aauucccguagguagagcug

SEQ ID NO: 534186 - RNA, 13 nt, Chlamydophila pneumoniae J138
aauucaaaaagag

SEQ ID NO: 534187 - RNA, 13 nt, Chlamydophila pneumoniae J138
aauucaaaucccu

SEQ ID NO: 534188 - RNA, 13 nt, Chlamydophila pneumoniae J138
aauucuuaaaaag

SEQ ID NO: 534189 - RNA, 16 nt, Chlamydophila pneumoniae J138
aauucggcagaaggcu

SEQ ID NO: 534190 - RNA, 14 nt, Chlamydophila pneumoniae J138
acaagacgaaagca

SEQ ID NO: 534191 - RNA, 19 nt, Chlamydophila pneumoniae J138
acaagagcgcauuuuacag

SEQ ID NO: 534192 - RNA, 13 nt, Chlamydophila pneumoniae J138
acaagauaguggu

SEQ ID NO: 534193 - RNA, 18 nt, Chlamydophila pneumoniae J138
acaagacaccgaaagaaa

SEQ ID NO: 534194 - RNA, 23 nt, Chlamydophila pneumoniae J138
acaagacaaugacuguaggaccu

SEQ ID NO: 534195 - RNA, 21 nt, Chlamydophila pneumoniae J138
acaagaagaucaaagauuccu

SEQ ID NO: 534196 - RNA, 15 nt, Chlamydophila pneumoniae J138
acaagaacugaagag

SEQ ID NO: 534197 - RNA, 20 nt, Chlamydophila pneumoniae J138
acaagcaauacuaagaagcu

SEQ ID NO: 534198 - RNA, 23 nt, Chlamydophila pneumoniae J138
acaagcaguaacugcaaagagaa

SEQ ID NO: 534199 - RNA, 15 nt, Chlamydophila pneumoniae J138
acaaguaccaagaaa

SEQ ID NO: 534200 - RNA, 18 nt, Chlamydophila pneumoniae J138
acaauaaacgagacugca

SEQ ID NO: 534201 - RNA, 21 nt, Chlamydophila pneumoniae J138
acaagugcauuaucuaagaau

SEQ ID NO: 534202 - RNA, 16 nt, Chlamydophila pneumoniae J138
acaauaagaaaauccu

SEQ ID NO: 534203 - RNA, 14 nt, Chlamydophila pneumoniae J138
acaauauaagcacc

SEQ ID NO: 534204 - RNA, 21 nt, Chlamydophila pneumoniae J138
acaauauaagcaccacgaccu

SEQ ID NO: 534205 - RNA, 23 nt, Chlamydophila pneumoniae J138
acaacgcugcuucucuacuaaaa

SEQ ID NO: 534206 - RNA, 17 nt, Chlamydophila pneumoniae J138
aauuuuuguagacaaua

SEQ ID NO: 534207 - RNA, 17 nt, Chlamydophila pneumoniae J138
aauuuuugcuaaacaau

SEQ ID NO: 534208 - RNA, 22 nt, Chlamydophila pneumoniae J138
acaacuagaccaauaaauccaa

SEQ ID NO: 534209 - RNA, 15 nt, Chlamydophila pneumoniae J138
acaacuagaccaaua

SEQ ID NO: 534210 - RNA, 22 nt, Chlamydophila pneumoniae J138
acaacuagguuauuaucaaagu

SEQ ID NO: 534211 - RNA, 19 nt, Chlamydophila pneumoniae J138
acaacugugguuuuaaaaa

SEQ ID NO: 534212 - RNA, 14 nt, Chlamydophila pneumoniae J138
acaagaaaacaaag

SEQ ID NO: 534213 - RNA, 22 nt, Chlamydophila pneumoniae J138
acaacuucuaucuuacugaaga

SEQ ID NO: 534214 - RNA, 17 nt, Chlamydophila pneumoniae J138
acaauguuuagaauuug

SEQ ID NO: 534215 - RNA, 12 nt, Chlamydophila pneumoniae J138
acaauguuuaga

SEQ ID NO: 534216 - RNA, 23 nt, Chlamydophila pneumoniae J138
acaauuuccuugguaucccaauc

SEQ ID NO: 534217 - RNA, 15 nt, Chlamydophila pneumoniae J138
acaauuuaaaucugc

SEQ ID NO: 534218 - RNA, 19 nt, Chlamydophila pneumoniae J138
acaauuuaaaucugcaaga

SEQ ID NO: 534219 - RNA, 17 nt, Chlamydophila pneumoniae J138
acacacaugacaaauaa

SEQ ID NO: 534220 - RNA, 17 nt, Chlamydophila pneumoniae J138
acaauggaaauagagaa

SEQ ID NO: 534221 - RNA, 21 nt, Chlamydophila pneumoniae J138
acaauggaaauagagaaacuu

SEQ ID NO: 534222 - RNA, 14 nt, Chlamydophila pneumoniae J138
acaaugcuaucucc

SEQ ID NO: 534223 - RNA, 15 nt, Chlamydophila pneumoniae J138
acaaugcuaucucca

SEQ ID NO: 534224 - RNA, 22 nt, Chlamydophila pneumoniae J138
acaaucucuagggauaauuaaa

SEQ ID NO: 534225 - RNA, 15 nt, Chlamydophila pneumoniae J138
acaccauagaacugc

SEQ ID NO: 534226 - RNA, 20 nt, Chlamydophila pneumoniae J138
acaccaggaguuggagaauu

SEQ ID NO: 534227 - RNA, 22 nt, Chlamydophila pneumoniae J138
acaccaggaaguccgauagcaa

SEQ ID NO: 534228 - RNA, 17 nt, Chlamydophila pneumoniae J138
acaccagcucgagaucu

SEQ ID NO: 534229 - RNA, 11 nt, Chlamydophila pneumoniae J138
acacagagaac

SEQ ID NO: 534230 - RNA, 17 nt, Chlamydophila pneumoniae J138
acacagagaacaauaaa

SEQ ID NO: 534231 - RNA, 23 nt, Chlamydophila pneumoniae J138
acacagacuugaggaaucugaau

SEQ ID NO: 534232 - RNA, 21 nt, Chlamydophila pneumoniae J138
acacaggggaacgcucucuag

SEQ ID NO: 534233 - RNA, 14 nt, Chlamydophila pneumoniae J138
acaccgaaagaaau

SEQ ID NO: 534234 - RNA, 21 nt, Chlamydophila pneumoniae J138
acacccucggauaggcuggaa

SEQ ID NO: 534235 - RNA, 22 nt, Chlamydophila pneumoniae J138
acacuauguguuuccuuuucuc

SEQ ID NO: 534236 - RNA, 21 nt, Chlamydophila pneumoniae J138
acacugaacgccaucuccaca

SEQ ID NO: 534237 - RNA, 17 nt, Chlamydophila pneumoniae J138
acacucagcucccaugu

SEQ ID NO: 534238 - RNA, 22 nt, Chlamydophila pneumoniae J138
acacucaaauucaaaauagaag

SEQ ID NO: 534239 - RNA, 17 nt, Chlamydophila pneumoniae J138
acacugcgcaaagaacu

SEQ ID NO: 534240 - RNA, 13 nt, Chlamydophila pneumoniae J138
acacugcgagaga

SEQ ID NO: 534241 - RNA, 19 nt, Chlamydophila pneumoniae J138
acacuuaaagguaaaacua

SEQ ID NO: 534242 - RNA, 14 nt, Chlamydophila pneumoniae J138
acagacuugaggaa

SEQ ID NO: 534243 - RNA, 20 nt, Chlamydophila pneumoniae J138
acagaaguuccuacuucugc

SEQ ID NO: 534244 - RNA, 21 nt, Chlamydophila pneumoniae J138
acagaagucuuggacguuccu

SEQ ID NO: 534245 - RNA, 16 nt, Chlamydophila pneumoniae J138
acagaaugauaagaaa

SEQ ID NO: 534246 - RNA, 17 nt, Chlamydophila pneumoniae J138
acagaaugauaagaaag

SEQ ID NO: 534247 - RNA, 14 nt, Chlamydophila pneumoniae J138
acacuuuguuuuuc

SEQ ID NO: 534248 - RNA, 23 nt, Chlamydophila pneumoniae J138
acacuuuuaaagauaaggaccag

SEQ ID NO: 534249 - RNA, 17 nt, Chlamydophila pneumoniae J138
acacuugcuuaaggaaa

SEQ ID NO: 534250 - RNA, 19 nt, Chlamydophila pneumoniae J138
acagaaaagaaugugcuuu

SEQ ID NO: 534251 - RNA, 20 nt, Chlamydophila pneumoniae J138
acacuuccuacggcaagaau

SEQ ID NO: 534252 - RNA, 20 nt, Chlamydophila pneumoniae J138
acagaaauugcuucuuccaa

SEQ ID NO: 534253 - RNA, 20 nt, Chlamydophila pneumoniae J138
acagaaagagcuaaagaaac

SEQ ID NO: 534254 - RNA, 15 nt, Chlamydophila pneumoniae J138
acagaaagauugugc

SEQ ID NO: 534255 - RNA, 16 nt, Chlamydophila pneumoniae J138
acagauaggaaccacu

SEQ ID NO: 534256 - RNA, 21 nt, Chlamydophila pneumoniae J138
acagauaugcugaauuccucu

SEQ ID NO: 534257 - RNA, 20 nt, Chlamydophila pneumoniae J138
acagagcgccuccaccugca

SEQ ID NO: 534258 - RNA, 18 nt, Chlamydophila pneumoniae J138
acagagucagaagcuauu

SEQ ID NO: 534259 - RNA, 12 nt, Chlamydophila pneumoniae J138
acagagucuggg

SEQ ID NO: 534260 - RNA, 19 nt, Chlamydophila pneumoniae J138
acagcaucggcaaccaguu

SEQ ID NO: 534261 - RNA, 22 nt, Chlamydophila pneumoniae J138
acagcaucaggauucucucugc

SEQ ID NO: 534262 - RNA, 14 nt, Chlamydophila pneumoniae J138
acagcauaaaaauu

SEQ ID NO: 534263 - RNA, 16 nt, Chlamydophila pneumoniae J138
acagcauaaaaauucu

SEQ ID NO: 534264 - RNA, 15 nt, Chlamydophila pneumoniae J138
acagauuucuucuuc

SEQ ID NO: 534265 - RNA, 21 nt, Chlamydophila pneumoniae J138
acagcauggacuccaagaaua

SEQ ID NO: 534266 - RNA, 19 nt, Chlamydophila pneumoniae J138
acagcgcgaucacuuuccu

SEQ ID NO: 534267 - RNA, 19 nt, Chlamydophila pneumoniae J138
acagcugggaucuggcuca

SEQ ID NO: 534268 - RNA, 20 nt, Chlamydophila pneumoniae J138
acaggaauucucaucggcau

SEQ ID NO: 534269 - RNA, 15 nt, Chlamydophila pneumoniae J138
acaggagagagaagg

SEQ ID NO: 534270 - RNA, 16 nt, Chlamydophila pneumoniae J138
acaggagcuagaagag

SEQ ID NO: 534271 - RNA, 14 nt, Chlamydophila pneumoniae J138
acagcguauaggaa

SEQ ID NO: 534272 - RNA, 18 nt, Chlamydophila pneumoniae J138
acaucagcuguugcguuu

SEQ ID NO: 534273 - RNA, 16 nt, Chlamydophila pneumoniae J138
acauccauucuuaaua

SEQ ID NO: 534274 - RNA, 16 nt, Chlamydophila pneumoniae J138
acaucaaauaguucau

SEQ ID NO: 534275 - RNA, 19 nt, Chlamydophila pneumoniae J138
acaucaaauaguucaucau

SEQ ID NO: 534276 - RNA, 18 nt, Chlamydophila pneumoniae J138
acaucagacugaagagca

SEQ ID NO: 534277 - RNA, 13 nt, Chlamydophila pneumoniae J138
acauauucuccuu

SEQ ID NO: 534278 - RNA, 22 nt, Chlamydophila pneumoniae J138
acauauucuccuuaccaauaug

SEQ ID NO: 534279 - RNA, 18 nt, Chlamydophila pneumoniae J138
acauauacguggcuucca

SEQ ID NO: 534280 - RNA, 18 nt, Chlamydophila pneumoniae J138
acauauccaaugagagag

SEQ ID NO: 534281 - RNA, 20 nt, Chlamydophila pneumoniae J138
acauaucgauaggauucgga

SEQ ID NO: 534282 - RNA, 15 nt, Chlamydophila pneumoniae J138
acauagacuuugagu

SEQ ID NO: 534283 - RNA, 24 nt, Chlamydophila pneumoniae J138
acauagagauucuacaaauuaccu

SEQ ID NO: 534284 - RNA, 18 nt, Chlamydophila pneumoniae J138
acauaguuuaauaaaucu

SEQ ID NO: 534285 - RNA, 18 nt, Chlamydophila pneumoniae J138
acauagggaaaguucagu

SEQ ID NO: 534286 - RNA, 14 nt, Chlamydophila pneumoniae J138
acauagggaaaguu

SEQ ID NO: 534287 - RNA, 18 nt, Chlamydophila pneumoniae J138
acaggcaggccacuuccu

SEQ ID NO: 534288 - RNA, 16 nt, Chlamydophila pneumoniae J138
acauacauucuauucu

SEQ ID NO: 534289 - RNA, 12 nt, Chlamydophila pneumoniae J138
acauacaucaaa

SEQ ID NO: 534290 - RNA, 18 nt, Chlamydophila pneumoniae J138
acauacaucaaaaugcug

SEQ ID NO: 534291 - RNA, 18 nt, Chlamydophila pneumoniae J138
acaucuugagcuucaaaa

SEQ ID NO: 534292 - RNA, 21 nt, Chlamydophila pneumoniae J138
acaucccccgggaagcugucg

SEQ ID NO: 534293 - RNA, 14 nt, Chlamydophila pneumoniae J138
acaugccaaaaguu

SEQ ID NO: 534294 - RNA, 14 nt, Chlamydophila pneumoniae J138
acaugcuuuccuuc

SEQ ID NO: 534295 - RNA, 23 nt, Chlamydophila pneumoniae J138
acauugcugccaggcuuaaauau

SEQ ID NO: 534296 - RNA, 21 nt, Chlamydophila pneumoniae J138
acauugcugccaggcuuaaau

SEQ ID NO: 534297 - RNA, 21 nt, Chlamydophila pneumoniae J138
acauucccuaaagcugccagu

SEQ ID NO: 534298 - RNA, 13 nt, Chlamydophila pneumoniae J138
acauuaagaggaa

SEQ ID NO: 534299 - RNA, 21 nt, Chlamydophila pneumoniae J138
acauucauuuuuuaauaaaau

SEQ ID NO: 534300 - RNA, 14 nt, Chlamydophila pneumoniae J138
acauucauuuuuua

SEQ ID NO: 534301 - RNA, 22 nt, Chlamydophila pneumoniae J138
acauuccaagaaaaauucuucg

SEQ ID NO: 534302 - RNA, 21 nt, Chlamydophila pneumoniae J138
accacagcuguacagaacaau

SEQ ID NO: 534303 - RNA, 22 nt, Chlamydophila pneumoniae J138
accacaauuccuaaaacaagaa

SEQ ID NO: 534304 - RNA, 15 nt, Chlamydophila pneumoniae J138
accaauaugcucugc

SEQ ID NO: 534305 - RNA, 14 nt, Chlamydophila pneumoniae J138
accaauaugcucug

SEQ ID NO: 534306 - RNA, 23 nt, Chlamydophila pneumoniae J138
accaaucuugagcauccaaaaug

SEQ ID NO: 534307 - RNA, 20 nt, Chlamydophila pneumoniae J138
accaauccggcauaaaaaag

SEQ ID NO: 534308 - RNA, 23 nt, Chlamydophila pneumoniae J138
accaauaaccgaaacuucucaga

SEQ ID NO: 534309 - RNA, 19 nt, Chlamydophila pneumoniae J138
accaaccuuguugaaaggc

SEQ ID NO: 534310 - RNA, 16 nt, Chlamydophila pneumoniae J138
acauuuccccaugaaa

SEQ ID NO: 534311 - RNA, 15 nt, Chlamydophila pneumoniae J138
acauuucguuuuuuc

SEQ ID NO: 534312 - RNA, 17 nt, Chlamydophila pneumoniae J138
accaccccaaagcagau

SEQ ID NO: 534313 - RNA, 15 nt, Chlamydophila pneumoniae J138
accacgaaauguuaa

SEQ ID NO: 534314 - RNA, 19 nt, Chlamydophila pneumoniae J138
accacuuaggguucucaaa

SEQ ID NO: 534315 - RNA, 17 nt, Chlamydophila pneumoniae J138
accacuucauauaaaac

SEQ ID NO: 534316 - RNA, 20 nt, Chlamydophila pneumoniae J138
accacuuuagaauuuucuuu

SEQ ID NO: 534317 - RNA, 20 nt, Chlamydophila pneumoniae J138
accacuaccgaauuuucaau

SEQ ID NO: 534318 - RNA, 21 nt, Chlamydophila pneumoniae J138
accacuacugagcuucuauuu

SEQ ID NO: 534319 - RNA, 15 nt, Chlamydophila pneumoniae J138
accacguccauuuca

SEQ ID NO: 534320 - RNA, 23 nt, Chlamydophila pneumoniae J138
aauagugaggccuccauuucuag

SEQ ID NO: 534321 - RNA, 22 nt, Chlamydophila pneumoniae J138
aauagcuucugacucuguugca

SEQ ID NO: 534322 - RNA, 14 nt, Chlamydophila pneumoniae J138
aauaggagaagccc

SEQ ID NO: 534323 - RNA, 14 nt, Chlamydophila pneumoniae J138
aauaggcacccaaa

SEQ ID NO: 534324 - RNA, 16 nt, Chlamydophila pneumoniae J138
aauaggauaagaaauu

SEQ ID NO: 534325 - RNA, 17 nt, Chlamydophila pneumoniae J138
aauaggcucuuuagcaa

SEQ ID NO: 534326 - RNA, 18 nt, Chlamydophila pneumoniae J138
aauaggcacccaaacuga

SEQ ID NO: 534327 - RNA, 14 nt, Chlamydophila pneumoniae J138
aauaguacgcuuuu

SEQ ID NO: 534328 - RNA, 15 nt, Chlamydophila pneumoniae J138
aauagguuucaauag

SEQ ID NO: 534329 - RNA, 15 nt, Chlamydophila pneumoniae J138
aauagcuaaagugau

SEQ ID NO: 534330 - RNA, 14 nt, Chlamydophila pneumoniae J138
aauagcucuuuuca

SEQ ID NO: 534331 - RNA, 15 nt, Chlamydophila pneumoniae J138
aauagcucuuuucau

SEQ ID NO: 534332 - RNA, 21 nt, Chlamydophila pneumoniae J138
aauagcucugcgccaugcaca

SEQ ID NO: 534333 - RNA, 16 nt, Chlamydophila pneumoniae J138
aauagccucuccuuga

SEQ ID NO: 534334 - RNA, 23 nt, Chlamydophila pneumoniae J138
aauagcgacaugagaaaucuuuu

SEQ ID NO: 534335 - RNA, 22 nt, Chlamydophila pneumoniae J138
aauagcaaagacaucuccugca

SEQ ID NO: 534336 - RNA, 14 nt, Chlamydophila pneumoniae J138
aauagcaagcacuu

SEQ ID NO: 534337 - RNA, 16 nt, Chlamydophila pneumoniae J138
aauagcaaguagcucu

SEQ ID NO: 534338 - RNA, 18 nt, Chlamydophila pneumoniae J138
aauagauucguuauccuc

SEQ ID NO: 534339 - RNA, 21 nt, Chlamydophila pneumoniae J138
aauaccuguacgguaaaucca

SEQ ID NO: 534340 - RNA, 22 nt, Chlamydophila pneumoniae J138
aauaccuguacgguaaauccau

SEQ ID NO: 534341 - RNA, 21 nt, Chlamydophila pneumoniae J138
aauauaauuccaauugccaug

SEQ ID NO: 534342 - RNA, 17 nt, Chlamydophila pneumoniae J138
aauauacucuugcuugc

SEQ ID NO: 534343 - RNA, 18 nt, Chlamydophila pneumoniae J138
aauauagagaacuccauu

SEQ ID NO: 534344 - RNA, 20 nt, Chlamydophila pneumoniae J138
aauauaguuuucauaaucca

SEQ ID NO: 534345 - RNA, 21 nt, Chlamydophila pneumoniae J138
aauauauccaggaucugugug

SEQ ID NO: 534346 - RNA, 12 nt, Chlamydophila pneumoniae J138
aauauauaaaga

SEQ ID NO: 534347 - RNA, 20 nt, Chlamydophila pneumoniae J138
aauauaucgcguguaaaagc

SEQ ID NO: 534348 - RNA, 15 nt, Chlamydophila pneumoniae J138
aauaucaggacaaug

SEQ ID NO: 534349 - RNA, 17 nt, Chlamydophila pneumoniae J138
aauaucaggacaaugaa

SEQ ID NO: 534350 - RNA, 14 nt, Chlamydophila pneumoniae J138
aauauccagaaaua

SEQ ID NO: 534351 - RNA, 16 nt, Chlamydophila pneumoniae J138
aauauccuaaauauau

SEQ ID NO: 534352 - RNA, 22 nt, Chlamydophila pneumoniae J138
aauaucgaguucuuuuugcaga

SEQ ID NO: 534353 - RNA, 21 nt, Chlamydophila pneumoniae J138
aauaucuccgccauaacacuu

SEQ ID NO: 534354 - RNA, 18 nt, Chlamydophila pneumoniae J138
aauaucuccgccauaaca

SEQ ID NO: 534355 - RNA, 22 nt, Chlamydophila pneumoniae J138
aauaucuguggcguaagcaaua

SEQ ID NO: 534356 - RNA, 22 nt, Chlamydophila pneumoniae J138
aauaagcuugccagcagaaguu

SEQ ID NO: 534357 - RNA, 16 nt, Chlamydophila pneumoniae J138
aauaagcaggaaaagc

SEQ ID NO: 534358 - RNA, 18 nt, Chlamydophila pneumoniae J138
aaaaaguugaggaaagga

SEQ ID NO: 534359 - RNA, 21 nt, Chlamydophila pneumoniae J138
aauaagcuuuccucuccaaaa

SEQ ID NO: 534360 - RNA, 14 nt, Chlamydophila pneumoniae J138
aauaaguccuguuu

SEQ ID NO: 534361 - RNA, 15 nt, Chlamydophila pneumoniae J138
aaguugauacuugua

SEQ ID NO: 534362 - RNA, 15 nt, Chlamydophila pneumoniae J138
aaguugaguugcgua

SEQ ID NO: 534363 - RNA, 18 nt, Chlamydophila pneumoniae J138
aaguugacgcacuucuuc

SEQ ID NO: 534364 - RNA, 17 nt, Chlamydophila pneumoniae J138
aaguuguugauaauuac

SEQ ID NO: 534365 - RNA, 20 nt, Chlamydophila pneumoniae J138
aaguuguagugaaugagcuu

SEQ ID NO: 534366 - RNA, 17 nt, Chlamydophila pneumoniae J138
aaguuguagugaaugag

SEQ ID NO: 534367 - RNA, 22 nt, Chlamydophila pneumoniae J138
aaguuguuucuuguagcucccg

SEQ ID NO: 534368 - RNA, 16 nt, Chlamydophila pneumoniae J138
aauaaauccaaaaaau

SEQ ID NO: 534369 - RNA, 17 nt, Chlamydophila pneumoniae J138
aauaagauccaaaaauu

SEQ ID NO: 534370 - RNA, 13 nt, Chlamydophila pneumoniae J138
aauaagauccaaa

SEQ ID NO: 534371 - RNA, 16 nt, Chlamydophila pneumoniae J138
aauaauggcaugacgg

SEQ ID NO: 534372 - RNA, 12 nt, Chlamydophila pneumoniae J138
aauaauagcaag

SEQ ID NO: 534373 - RNA, 17 nt, Chlamydophila pneumoniae J138
aauaauaggauaagaaa

SEQ ID NO: 534374 - RNA, 22 nt, Chlamydophila pneumoniae J138
aaaaaucccuguucuagcaaau

SEQ ID NO: 534375 - RNA, 16 nt, Chlamydophila pneumoniae J138
aaaaauccgauaagau

SEQ ID NO: 534376 - RNA, 17 nt, Chlamydophila pneumoniae J138
aaaaauccgauaagaua

SEQ ID NO: 534377 - RNA, 21 nt, Chlamydophila pneumoniae J138
aaaaaucccagauuacaagag

SEQ ID NO: 534378 - RNA, 20 nt, Chlamydophila pneumoniae J138
aaaaaucuaacacagucccu

SEQ ID NO: 534379 - RNA, 20 nt, Chlamydophila pneumoniae J138
aaaaauccugagagauaggu

SEQ ID NO: 534380 - RNA, 12 nt, Chlamydophila pneumoniae J138
aauacaaaaaau

SEQ ID NO: 534381 - RNA, 12 nt, Chlamydophila pneumoniae J138
aauaauuuuccc

SEQ ID NO: 534382 - RNA, 22 nt, Chlamydophila pneumoniae J138
aauaauuuguuuagaaaaagau

SEQ ID NO: 534383 - RNA, 17 nt, Chlamydophila pneumoniae J138
aauaccagauaaagcaa

SEQ ID NO: 534384 - RNA, 13 nt, Chlamydophila pneumoniae J138
aauaccagauaaa

SEQ ID NO: 534385 - RNA, 19 nt, Chlamydophila pneumoniae J138
aauaccagaagcaaaggua

SEQ ID NO: 534386 - RNA, 14 nt, Chlamydophila pneumoniae J138
aauaccagaagcaa

SEQ ID NO: 534387 - RNA, 21 nt, Chlamydophila pneumoniae J138
aauaccaauugggcuaggguu

SEQ ID NO: 534388 - RNA, 21 nt, Chlamydophila pneumoniae J138
aauaccaucucuuucuauuuc

SEQ ID NO: 534389 - RNA, 13 nt, Chlamydophila pneumoniae J138
aaggcuuugccuu

SEQ ID NO: 534390 - RNA, 23 nt, Chlamydophila pneumoniae J138
aaggcuuuucuuuuucuagggau

SEQ ID NO: 534391 - RNA, 15 nt, Chlamydophila pneumoniae J138
aaguaaaacugcgcu

SEQ ID NO: 534392 - RNA, 16 nt, Chlamydophila pneumoniae J138
aaguaaaauuucugua

SEQ ID NO: 534393 - RNA, 15 nt, Chlamydophila pneumoniae J138
aagguuuugaagcuc

SEQ ID NO: 534394 - RNA, 17 nt, Chlamydophila pneumoniae J138
aaggggcguucuugaaa

SEQ ID NO: 534395 - RNA, 18 nt, Chlamydophila pneumoniae J138
aagguuuuauaaagaucg

SEQ ID NO: 534396 - RNA, 22 nt, Chlamydophila pneumoniae J138
aaguacaagugaagacaaguaa

SEQ ID NO: 534397 - RNA, 22 nt, Chlamydophila pneumoniae J138
aaguacauuaucacagcaaucu

SEQ ID NO: 534398 - RNA, 15 nt, Chlamydophila pneumoniae J138
aaguacugggguagu

SEQ ID NO: 534399 - RNA, 17 nt, Chlamydophila pneumoniae J138
aagucaccuuacaucca

SEQ ID NO: 534400 - RNA, 18 nt, Chlamydophila pneumoniae J138
aagucacggcgaaagcua

SEQ ID NO: 534401 - RNA, 17 nt, Chlamydophila pneumoniae J138
aagucacggcgaaagcu

SEQ ID NO: 534402 - RNA, 18 nt, Chlamydophila pneumoniae J138
aagucaaauacuucuccu

SEQ ID NO: 534403 - RNA, 14 nt, Chlamydophila pneumoniae J138
aagucacaaauuuu

SEQ ID NO: 534404 - RNA, 16 nt, Chlamydophila pneumoniae J138
aagucacaaauuuuug

SEQ ID NO: 534405 - RNA, 21 nt, Chlamydophila pneumoniae J138
aaguauuccucuuaggagagc

SEQ ID NO: 534406 - RNA, 23 nt, Chlamydophila pneumoniae J138
aagucaaacaucacucaggauau

SEQ ID NO: 534407 - RNA, 11 nt, Chlamydophila pneumoniae J138
aagucaaaaug

SEQ ID NO: 534408 - RNA, 22 nt, Chlamydophila pneumoniae J138
aaguaggauugauaaauuugcu

SEQ ID NO: 534409 - RNA, 18 nt, Chlamydophila pneumoniae J138
aaguagggaacaaaaaag

SEQ ID NO: 534410 - RNA, 21 nt, Chlamydophila pneumoniae J138
aaguaguggacuauagaugcc

SEQ ID NO: 534411 - RNA, 15 nt, Chlamydophila pneumoniae J138
aaguaggauugauaa

SEQ ID NO: 534412 - RNA, 23 nt, Chlamydophila pneumoniae J138
aaguauagacgggcuuauaaacu

SEQ ID NO: 534413 - RNA, 16 nt, Chlamydophila pneumoniae J138
aaguaucucaucacgu

SEQ ID NO: 534414 - RNA, 13 nt, Chlamydophila pneumoniae J138
aagucuccauaau

SEQ ID NO: 534415 - RNA, 20 nt, Chlamydophila pneumoniae J138
aaguccgauagcaaugaugu

SEQ ID NO: 534416 - RNA, 22 nt, Chlamydophila pneumoniae J138
aaguccuggauuuuaaagcaaa

SEQ ID NO: 534417 - RNA, 23 nt, Chlamydophila pneumoniae J138
aaguccagacuuuccucucuuua

SEQ ID NO: 534418 - RNA, 13 nt, Chlamydophila pneumoniae J138
aagucaugaggac

SEQ ID NO: 534419 - RNA, 15 nt, Chlamydophila pneumoniae J138
aagugacuuccucca

SEQ ID NO: 534420 - RNA, 22 nt, Chlamydophila pneumoniae J138
aagugcgagguaugaauaggaa

SEQ ID NO: 534421 - RNA, 13 nt, Chlamydophila pneumoniae J138
aaguucacaagca

SEQ ID NO: 534422 - RNA, 17 nt, Chlamydophila pneumoniae J138
aaguugaccuuuuucau

SEQ ID NO: 534423 - RNA, 20 nt, Chlamydophila pneumoniae J138
aaguucagacgugcucucua

SEQ ID NO: 534424 - RNA, 15 nt, Chlamydophila pneumoniae J138
aaguucaucaaauaa

SEQ ID NO: 534425 - RNA, 21 nt, Chlamydophila pneumoniae J138
aaggaauaugcucuccuugua

SEQ ID NO: 534426 - RNA, 20 nt, Chlamydophila pneumoniae J138
aaggaagaucuugaacagag

SEQ ID NO: 534427 - RNA, 13 nt, Chlamydophila pneumoniae J138
aaggaaguuauaa

SEQ ID NO: 534428 - RNA, 15 nt, Chlamydophila pneumoniae J138
aaggaagguucucaa

SEQ ID NO: 534429 - RNA, 21 nt, Chlamydophila pneumoniae J138
aaggaagggauguuuaauaca

SEQ ID NO: 534430 - RNA, 22 nt, Chlamydophila pneumoniae J138
aaggaagggauguuuaauacaa

SEQ ID NO: 534431 - RNA, 14 nt, Chlamydophila pneumoniae J138
aaggacucuuucua

SEQ ID NO: 534432 - RNA, 24 nt, Chlamydophila pneumoniae J138
aaggaugcaucucuuaaaacauga

SEQ ID NO: 534433 - RNA, 20 nt, Chlamydophila pneumoniae J138
aagcuguaaccaacaucaaa

SEQ ID NO: 534434 - RNA, 20 nt, Chlamydophila pneumoniae J138
aagcuuccaucguuagauuu

SEQ ID NO: 534435 - RNA, 23 nt, Chlamydophila pneumoniae J138
aagcuuccggcuuguaggaucug

SEQ ID NO: 534436 - RNA, 22 nt, Chlamydophila pneumoniae J138
aagcuucggggaagcguagcaa

SEQ ID NO: 534437 - RNA, 17 nt, Chlamydophila pneumoniae J138
aagcuucuuuaauucca

SEQ ID NO: 534438 - RNA, 20 nt, Chlamydophila pneumoniae J138
aagcuucuuuaauuccaacu

SEQ ID NO: 534439 - RNA, 22 nt, Chlamydophila pneumoniae J138
aagcuucguccugacacaacuc

SEQ ID NO: 534440 - RNA, 15 nt, Chlamydophila pneumoniae J138
aagcuugccagcaga

SEQ ID NO: 534441 - RNA, 19 nt, Chlamydophila pneumoniae J138
aaggcacagcaaugacauu

SEQ ID NO: 534442 - RNA, 17 nt, Chlamydophila pneumoniae J138
aaggcaauagcagcagc

SEQ ID NO: 534443 - RNA, 22 nt, Chlamydophila pneumoniae J138
aaggcagagaacuuucgucuuu

SEQ ID NO: 534444 - RNA, 19 nt, Chlamydophila pneumoniae J138
aaggcacuccaaaacucaa

SEQ ID NO: 534445 - RNA, 15 nt, Chlamydophila pneumoniae J138
aaggcaccaacacuu

SEQ ID NO: 534446 - RNA, 19 nt, Chlamydophila pneumoniae J138
aaggcaugccuacaggcaa

SEQ ID NO: 534447 - RNA, 16 nt, Chlamydophila pneumoniae J138
aaggcaucuucuuugc

SEQ ID NO: 534448 - RNA, 14 nt, Chlamydophila pneumoniae J138
aaggcauagauaca

SEQ ID NO: 534449 - RNA, 13 nt, Chlamydophila pneumoniae J138
aaggcauaacugu

SEQ ID NO: 534450 - RNA, 22 nt, Chlamydophila pneumoniae J138
aaggcguuuuuuaauucucuga

SEQ ID NO: 534451 - RNA, 18 nt, Chlamydophila pneumoniae J138
aaggccuaaucuuguagc

SEQ ID NO: 534452 - RNA, 14 nt, Chlamydophila pneumoniae J138
aaggccuauagauu

SEQ ID NO: 534453 - RNA, 21 nt, Chlamydophila pneumoniae J138
aaggcguuuuuuaauucucug

SEQ ID NO: 534454 - RNA, 21 nt, Chlamydophila pneumoniae J138
aaggcucucaaggucacagca

SEQ ID NO: 534455 - RNA, 19 nt, Chlamydophila pneumoniae J138
aaggcuuguuucuguuuuc

SEQ ID NO: 534456 - RNA, 14 nt, Chlamydophila pneumoniae J138
aaggcuugaggauu

SEQ ID NO: 534457 - RNA, 19 nt, Chlamydophila pneumoniae J138
aagcgauuucgacagcagc

SEQ ID NO: 534458 - RNA, 21 nt, Chlamydophila pneumoniae J138
aagcgcaaaucuuacauaaac

SEQ ID NO: 534459 - RNA, 16 nt, Chlamydophila pneumoniae J138
aagcuagucuucuuag

SEQ ID NO: 534460 - RNA, 16 nt, Chlamydophila pneumoniae J138
aagcucacucuuuaaa

SEQ ID NO: 534461 - RNA, 14 nt, Chlamydophila pneumoniae J138
aagcucauaagaaa

SEQ ID NO: 534462 - RNA, 15 nt, Chlamydophila pneumoniae J138
aagcuauuguuuuuc

SEQ ID NO: 534463 - RNA, 18 nt, Chlamydophila pneumoniae J138
aagcucaagagcaugcuu

SEQ ID NO: 534464 - RNA, 21 nt, Chlamydophila pneumoniae J138
aagcuacggaugggcacucuu

SEQ ID NO: 534465 - RNA, 23 nt, Chlamydophila pneumoniae J138
aagccggcccacucaaaagaaga

SEQ ID NO: 534466 - RNA, 22 nt, Chlamydophila pneumoniae J138
aagccggcccacucaaaagaag

SEQ ID NO: 534467 - RNA, 22 nt, Chlamydophila pneumoniae J138
aagaucuaacuucaccauauaa

SEQ ID NO: 534468 - RNA, 23 nt, Chlamydophila pneumoniae J138
aagaucgcucgaucgugcucugc

SEQ ID NO: 534469 - RNA, 14 nt, Chlamydophila pneumoniae J138
aagaucauaugcac

SEQ ID NO: 534470 - RNA, 15 nt, Chlamydophila pneumoniae J138
aagaucaguuuuuuc

SEQ ID NO: 534471 - RNA, 22 nt, Chlamydophila pneumoniae J138
aagaucauggauucacaucuua

SEQ ID NO: 534472 - RNA, 12 nt, Chlamydophila pneumoniae J138
aagccuuccuug

SEQ ID NO: 534473 - RNA, 14 nt, Chlamydophila pneumoniae J138
aagccuucauucca

SEQ ID NO: 534474 - RNA, 18 nt, Chlamydophila pneumoniae J138
aagccugucuuaucuaaa

SEQ ID NO: 534475 - RNA, 20 nt, Chlamydophila pneumoniae J138
aagccuuucuuauuacagaa

SEQ ID NO: 534476 - RNA, 20 nt, Chlamydophila pneumoniae J138
aacaguucgggcuaaucauu

SEQ ID NO: 534477 - RNA, 15 nt, Chlamydophila pneumoniae J138
aacauaacaugagaa

SEQ ID NO: 534478 - RNA, 19 nt, Chlamydophila pneumoniae J138
aacauaaccuccucuucuu

SEQ ID NO: 534479 - RNA, 13 nt, Chlamydophila pneumoniae J138
aacauaaagaagg

SEQ ID NO: 534480 - RNA, 22 nt, Chlamydophila pneumoniae J138
aacagugguaugcuuuuccuuc

SEQ ID NO: 534481 - RNA, 15 nt, Chlamydophila pneumoniae J138
aacaguccucucccu

SEQ ID NO: 534482 - RNA, 18 nt, Chlamydophila pneumoniae J138
aacaucggagaacuuccu

SEQ ID NO: 534483 - RNA, 14 nt, Chlamydophila pneumoniae J138
aacaucagcuguug

SEQ ID NO: 534484 - RNA, 18 nt, Chlamydophila pneumoniae J138
aacaucacuuauauuuuc

SEQ ID NO: 534485 - RNA, 16 nt, Chlamydophila pneumoniae J138
aacaucagagaacucu

SEQ ID NO: 534486 - RNA, 12 nt, Chlamydophila pneumoniae J138
aacaucaagaau

SEQ ID NO: 534487 - RNA, 14 nt, Chlamydophila pneumoniae J138
aacaucaaagaauu

SEQ ID NO: 534488 - RNA, 13 nt, Chlamydophila pneumoniae J138
aacaucaaagaga

SEQ ID NO: 534489 - RNA, 15 nt, Chlamydophila pneumoniae J138
aacauagauaaggua

SEQ ID NO: 534490 - RNA, 16 nt, Chlamydophila pneumoniae J138
aacaggauugauaaau

SEQ ID NO: 534491 - RNA, 17 nt, Chlamydophila pneumoniae J138
aacaggaauagaaaauc

SEQ ID NO: 534492 - RNA, 16 nt, Chlamydophila pneumoniae J138
aacaggaauaggcucu

SEQ ID NO: 534493 - RNA, 14 nt, Chlamydophila pneumoniae J138
aacagguucacuuc

SEQ ID NO: 534494 - RNA, 13 nt, Chlamydophila pneumoniae J138
aacagcuucagga

SEQ ID NO: 534495 - RNA, 22 nt, Chlamydophila pneumoniae J138
aacagcuccuggauauugucaa

SEQ ID NO: 534496 - RNA, 21 nt, Chlamydophila pneumoniae J138
aacagcgguugccuuucucuu

SEQ ID NO: 534497 - RNA, 15 nt, Chlamydophila pneumoniae J138
aacaaggauuaugaa

SEQ ID NO: 534498 - RNA, 19 nt, Chlamydophila pneumoniae J138
aacaagggaagagaaaacg

SEQ ID NO: 534499 - RNA, 18 nt, Chlamydophila pneumoniae J138
aacaagggaaagaaacua

SEQ ID NO: 534500 - RNA, 16 nt, Chlamydophila pneumoniae J138
aacaagggaaagaaac

SEQ ID NO: 534501 - RNA, 13 nt, Chlamydophila pneumoniae J138
aaccaaaaugcau

SEQ ID NO: 534502 - RNA, 11 nt, Chlamydophila pneumoniae J138
aaccacagaau

SEQ ID NO: 534503 - RNA, 17 nt, Chlamydophila pneumoniae J138
aacauuuuuauuuccuu

SEQ ID NO: 534504 - RNA, 23 nt, Chlamydophila pneumoniae J138
aacauuuuucaauaaccagaaga

SEQ ID NO: 534505 - RNA, 13 nt, Chlamydophila pneumoniae J138
aacaucuaaaaau

SEQ ID NO: 534506 - RNA, 15 nt, Chlamydophila pneumoniae J138
aacaucuccagcagc

SEQ ID NO: 534507 - RNA, 15 nt, Chlamydophila pneumoniae J138
aacaucguuaauaua

SEQ ID NO: 534508 - RNA, 17 nt, Chlamydophila pneumoniae J138
aacaugcgcagaauaaa

SEQ ID NO: 534509 - RNA, 14 nt, Chlamydophila pneumoniae J138
aacauggacaauau

SEQ ID NO: 534510 - RNA, 11 nt, Chlamydophila pneumoniae J138
aaccagagagc

SEQ ID NO: 534511 - RNA, 14 nt, Chlamydophila pneumoniae J138
aaccauagagagcc

SEQ ID NO: 534512 - RNA, 13 nt, Chlamydophila pneumoniae J138
aaccauaaagaau

SEQ ID NO: 534513 - RNA, 13 nt, Chlamydophila pneumoniae J138
aaccccuccaaaa

SEQ ID NO: 534514 - RNA, 20 nt, Chlamydophila pneumoniae J138
aaccggguguggcaaaggac

SEQ ID NO: 534515 - RNA, 21 nt, Chlamydophila pneumoniae J138
aaccgucacuguuuuccagaa

SEQ ID NO: 534516 - RNA, 21 nt, Chlamydophila pneumoniae J138
aaccuagaaucacauaaaaua

SEQ ID NO: 534517 - RNA, 23 nt, Chlamydophila pneumoniae J138
aaccuccaccaggagcuccuccu

SEQ ID NO: 534518 - RNA, 16 nt, Chlamydophila pneumoniae J138
aaccuccgcucuaagc

SEQ ID NO: 534519 - RNA, 17 nt, Chlamydophila pneumoniae J138
aaccugggcaauauuuu

SEQ ID NO: 534520 - RNA, 22 nt, Chlamydophila pneumoniae J138
aaccuggcauugccauaauaaa

SEQ ID NO: 534521 - RNA, 14 nt, Chlamydophila pneumoniae J138
aaccucuuuucuua

SEQ ID NO: 534522 - RNA, 13 nt, Chlamydophila pneumoniae J138
aaccucuuuucuu

SEQ ID NO: 534523 - RNA, 22 nt, Chlamydophila pneumoniae J138
aaccuuugguagaaagacaaaa

SEQ ID NO: 534524 - RNA, 13 nt, Chlamydophila pneumoniae J138
aaccuucaaugau

SEQ ID NO: 534525 - RNA, 14 nt, Chlamydophila pneumoniae J138
aaccuucucucuua

SEQ ID NO: 534526 - RNA, 16 nt, Chlamydophila pneumoniae J138
aacgcauaagagacau

SEQ ID NO: 534527 - RNA, 20 nt, Chlamydophila pneumoniae J138
aacgcaggaagaacaaguuu

SEQ ID NO: 534528 - RNA, 15 nt, Chlamydophila pneumoniae J138
aacgcaggaagaaca

SEQ ID NO: 534529 - RNA, 22 nt, Chlamydophila pneumoniae J138
aacgcagcuuuccuuuugauaa

SEQ ID NO: 534530 - RNA, 23 nt, Chlamydophila pneumoniae J138
aacgcaugacgcuuuuccaaagc

SEQ ID NO: 534531 - RNA, 16 nt, Chlamydophila pneumoniae J138
aacgcacgccaagaga

SEQ ID NO: 534532 - RNA, 17 nt, Chlamydophila pneumoniae J138
aacgagaaguuugauaa

SEQ ID NO: 534533 - RNA, 22 nt, Chlamydophila pneumoniae J138
aacgagacugcaaaggaaggga

SEQ ID NO: 534534 - RNA, 22 nt, Chlamydophila pneumoniae J138
aacgaagugaggagaauagcaa

SEQ ID NO: 534535 - RNA, 13 nt, Chlamydophila pneumoniae J138
aacgaauuucaac

SEQ ID NO: 534536 - RNA, 18 nt, Chlamydophila pneumoniae J138
aacgcgagcuauuuuacu

SEQ ID NO: 534537 - RNA, 22 nt, Chlamydophila pneumoniae J138
aacgcucucuagcaccuaauaa

SEQ ID NO: 534538 - RNA, 21 nt, Chlamydophila pneumoniae J138
aagaaaauucucagauugcuu

SEQ ID NO: 534539 - RNA, 20 nt, Chlamydophila pneumoniae J138
aagaaaauccuaacaaaagg

SEQ ID NO: 534540 - RNA, 15 nt, Chlamydophila pneumoniae J138
aagaaaauaaagauc

SEQ ID NO: 534541 - RNA, 22 nt, Chlamydophila pneumoniae J138
aacuuuuuuacuaucuccuaga

SEQ ID NO: 534542 - RNA, 18 nt, Chlamydophila pneumoniae J138
aacuuugaggcaagucuc

SEQ ID NO: 534543 - RNA, 19 nt, Chlamydophila pneumoniae J138
aacuuguuuucguaagaga

SEQ ID NO: 534544 - RNA, 12 nt, Chlamydophila pneumoniae J138
aacuucucuagg

SEQ ID NO: 534545 - RNA, 17 nt, Chlamydophila pneumoniae J138
aacuuuaggauucaguu

SEQ ID NO: 534546 - RNA, 20 nt, Chlamydophila pneumoniae J138
aacuuuaggauucaguuccu

SEQ ID NO: 534547 - RNA, 17 nt, Chlamydophila pneumoniae J138
aacuuuagggaagaaau

SEQ ID NO: 534548 - RNA, 22 nt, Chlamydophila pneumoniae J138
aacuuucgaagcgcucuacaaa

SEQ ID NO: 534549 - RNA, 23 nt, Chlamydophila pneumoniae J138
aacuuucgaagcgcucuacaaau

SEQ ID NO: 534550 - RNA, 20 nt, Chlamydophila pneumoniae J138
aacuuuccggguaaguacac

SEQ ID NO: 534551 - RNA, 17 nt, Chlamydophila pneumoniae J138
aacuuucugggagaaag

SEQ ID NO: 534552 - RNA, 13 nt, Chlamydophila pneumoniae J138
aacuuucuucucu

SEQ ID NO: 534553 - RNA, 23 nt, Chlamydophila pneumoniae J138
aacuuugaccagaugauuuuuug

SEQ ID NO: 534554 - RNA, 16 nt, Chlamydophila pneumoniae J138
aacuuugaggcaaguc

SEQ ID NO: 534555 - RNA, 13 nt, Chlamydophila pneumoniae J138
aacuucuaacugu

SEQ ID NO: 534556 - RNA, 16 nt, Chlamydophila pneumoniae J138
aacuucucagauaaaa

SEQ ID NO: 534557 - RNA, 14 nt, Chlamydophila pneumoniae J138
aacuucuaaaagca

SEQ ID NO: 534558 - RNA, 17 nt, Chlamydophila pneumoniae J138
aacuucguuagaaacca

SEQ ID NO: 534559 - RNA, 16 nt, Chlamydophila pneumoniae J138
aacuuccugauucugu

SEQ ID NO: 534560 - RNA, 13 nt, Chlamydophila pneumoniae J138
aacuguguuuucu

SEQ ID NO: 534561 - RNA, 12 nt, Chlamydophila pneumoniae J138
aacuccacgcca

SEQ ID NO: 534562 - RNA, 13 nt, Chlamydophila pneumoniae J138
aacuccaaaauau

SEQ ID NO: 534563 - RNA, 20 nt, Chlamydophila pneumoniae J138
aacucaucacaauuuuaaaa

SEQ ID NO: 534564 - RNA, 20 nt, Chlamydophila pneumoniae J138
aacucauccuaaauuaaaua

SEQ ID NO: 534565 - RNA, 15 nt, Chlamydophila pneumoniae J138
aacucacaaacaaca

SEQ ID NO: 534566 - RNA, 17 nt, Chlamydophila pneumoniae J138
aacuauguuauccauac

SEQ ID NO: 534567 - RNA, 19 nt, Chlamydophila pneumoniae J138
aacgggagcguuuuuugaa

SEQ ID NO: 534568 - RNA, 13 nt, Chlamydophila pneumoniae J138
aacuccuuuuaaa

SEQ ID NO: 534569 - RNA, 23 nt, Chlamydophila pneumoniae J138
aacuccucuaaggacaaaucucc

SEQ ID NO: 534570 - RNA, 14 nt, Chlamydophila pneumoniae J138
aacuccucaaaaga

SEQ ID NO: 534571 - RNA, 18 nt, Chlamydophila pneumoniae J138
aacuccgcccgucuuaga

SEQ ID NO: 534572 - RNA, 17 nt, Chlamydophila pneumoniae J138
aacuccaggggauaaaa

SEQ ID NO: 534573 - RNA, 23 nt, Chlamydophila pneumoniae J138
aacuccacgaauucuuuaaaauc

SEQ ID NO: 534574 - RNA, 15 nt, Chlamydophila pneumoniae J138
aacucccguuuuguu

SEQ ID NO: 534575 - RNA, 23 nt, Chlamydophila pneumoniae J138
aacuccgcacuugcucuuuaaua

SEQ ID NO: 534576 - RNA, 18 nt, Chlamydophila pneumoniae J138
aacucugaaguacacuac

SEQ ID NO: 534577 - RNA, 14 nt, Chlamydophila pneumoniae J138
aacucucaguuaaa

SEQ ID NO: 534578 - RNA, 19 nt, Chlamydophila pneumoniae J138
aacucuuaagaauaaaaua

SEQ ID NO: 534579 - RNA, 23 nt, Chlamydophila pneumoniae J138
aacucuuaaagguaaagcuucuu

SEQ ID NO: 534580 - RNA, 19 nt, Chlamydophila pneumoniae J138
aacucuuaaagguaaagcu

SEQ ID NO: 534581 - RNA, 22 nt, Chlamydophila pneumoniae J138
aacugagcaacuucuucguuag

SEQ ID NO: 534582 - RNA, 23 nt, Chlamydophila pneumoniae J138
aacugaggcaaagauuuccaauc

SEQ ID NO: 534583 - RNA, 18 nt, Chlamydophila pneumoniae J138
aagaaucuauagaacuaa

SEQ ID NO: 534584 - RNA, 22 nt, Chlamydophila pneumoniae J138
aagaaucgccgcuugaggagga

SEQ ID NO: 534585 - RNA, 16 nt, Chlamydophila pneumoniae J138
aagaaugacacagaga

SEQ ID NO: 534586 - RNA, 17 nt, Chlamydophila pneumoniae J138
aagaaugagaacgucua

SEQ ID NO: 534587 - RNA, 17 nt, Chlamydophila pneumoniae J138
aagaauucuuugccaag

SEQ ID NO: 534588 - RNA, 16 nt, Chlamydophila pneumoniae J138
aagaaaucaaacauua

SEQ ID NO: 534589 - RNA, 23 nt, Chlamydophila pneumoniae J138
aagaaauauuaacccaccagaag

SEQ ID NO: 534590 - RNA, 20 nt, Chlamydophila pneumoniae J138
aagaaauauacugccagcga

SEQ ID NO: 534591 - RNA, 22 nt, Chlamydophila pneumoniae J138
aagaaaugcaaaccaaaaaagu

SEQ ID NO: 534592 - RNA, 18 nt, Chlamydophila pneumoniae J138
aagaaaugcaaaccaaaa

SEQ ID NO: 534593 - RNA, 19 nt, Chlamydophila pneumoniae J138
aagacaggcucaugaaauu

SEQ ID NO: 534594 - RNA, 17 nt, Chlamydophila pneumoniae J138
aagacauucauuuuuua

SEQ ID NO: 534595 - RNA, 20 nt, Chlamydophila pneumoniae J138
aagacauucauuuuuuaaua

SEQ ID NO: 534596 - RNA, 22 nt, Chlamydophila pneumoniae J138
aagaauuuguaacucuuaagaa

SEQ ID NO: 534597 - RNA, 13 nt, Chlamydophila pneumoniae J138
aagacaagagaag

SEQ ID NO: 534598 - RNA, 16 nt, Chlamydophila pneumoniae J138
aagacaauaaaaaaga

SEQ ID NO: 534599 - RNA, 18 nt, Chlamydophila pneumoniae J138
aagacaauaaaaaagaga

SEQ ID NO: 534600 - RNA, 20 nt, Chlamydophila pneumoniae J138
aagacaaugucgucucagaa

SEQ ID NO: 534601 - RNA, 16 nt, Chlamydophila pneumoniae J138
aagacgagaacaugac

SEQ ID NO: 534602 - RNA, 14 nt, Chlamydophila pneumoniae J138
aagacccuucuuuc

SEQ ID NO: 534603 - RNA, 15 nt, Chlamydophila pneumoniae J138
aagacuguguuuuau

SEQ ID NO: 534604 - RNA, 14 nt, Chlamydophila pneumoniae J138
aagacugucuauga

SEQ ID NO: 534605 - RNA, 19 nt, Chlamydophila pneumoniae J138
aagacuuguucuucauuau

SEQ ID NO: 534606 - RNA, 23 nt, Chlamydophila pneumoniae J138
aagacuuuuuaguauacuaagac

SEQ ID NO: 534607 - RNA, 14 nt, Chlamydophila pneumoniae J138
aagagaaaagauag

SEQ ID NO: 534608 - RNA, 23 nt, Chlamydophila pneumoniae J138
aagacuuuuuaaauagcaucccu

SEQ ID NO: 534609 - RNA, 13 nt, Chlamydophila pneumoniae J138
aagacuaaaaaag

SEQ ID NO: 534610 - RNA, 20 nt, Chlamydophila pneumoniae J138
aagacuagcuuuuuuuauga

SEQ ID NO: 534611 - RNA, 17 nt, Chlamydophila pneumoniae J138
aagacuacgacagaagu

SEQ ID NO: 534612 - RNA, 16 nt, Chlamydophila pneumoniae J138
aagacugaaaagaucg

SEQ ID NO: 534613 - RNA, 14 nt, Chlamydophila pneumoniae J138
aagacucucaucag

SEQ ID NO: 534614 - RNA, 19 nt, Chlamydophila pneumoniae J138
aagacucaugaaauagugu

SEQ ID NO: 534615 - RNA, 17 nt, Chlamydophila pneumoniae J138
aagacucccaaggaaau

SEQ ID NO: 534616 - RNA, 15 nt, Chlamydophila pneumoniae J138
aagacucaaagaacu

SEQ ID NO: 534617 - RNA, 18 nt, Chlamydophila pneumoniae J138
aagagcucuugagaaagc

SEQ ID NO: 534618 - RNA, 22 nt, Chlamydophila pneumoniae J138
aagagcucaucggaucuuuucu

SEQ ID NO: 534619 - RNA, 14 nt, Chlamydophila pneumoniae J138
aagagcucuugaga

SEQ ID NO: 534620 - RNA, 16 nt, Chlamydophila pneumoniae J138
aagagcucuugagaaa

SEQ ID NO: 534621 - RNA, 17 nt, Chlamydophila pneumoniae J138
aagagcuaaagaaacuu

SEQ ID NO: 534622 - RNA, 15 nt, Chlamydophila pneumoniae J138
aagagcuaaagaaac

SEQ ID NO: 534623 - RNA, 21 nt, Chlamydophila pneumoniae J138
aagagcuugucuuccacgaag

SEQ ID NO: 534624 - RNA, 22 nt, Chlamydophila pneumoniae J138
aagagcuuguucuguaacacuu

SEQ ID NO: 534625 - RNA, 14 nt, Chlamydophila pneumoniae J138
aagaggaagaugau

SEQ ID NO: 534626 - RNA, 14 nt, Chlamydophila pneumoniae J138
aagagcgcauuuua

SEQ ID NO: 534627 - RNA, 15 nt, Chlamydophila pneumoniae J138
aagagcccuugaauc

SEQ ID NO: 534628 - RNA, 20 nt, Chlamydophila pneumoniae J138
aagaggcucccaucgucccu

SEQ ID NO: 534629 - RNA, 17 nt, Chlamydophila pneumoniae J138
aagaggcuuuaaauuuu

SEQ ID NO: 534630 - RNA, 18 nt, Chlamydophila pneumoniae J138
aagagguaauaauaguga

SEQ ID NO: 534631 - RNA, 18 nt, Chlamydophila pneumoniae J138
aagaguagccccagcaac

SEQ ID NO: 534632 - RNA, 21 nt, Chlamydophila pneumoniae J138
aagagaaucuccucaucagaa

SEQ ID NO: 534633 - RNA, 15 nt, Chlamydophila pneumoniae J138
aagagacaagaaaau

SEQ ID NO: 534634 - RNA, 16 nt, Chlamydophila pneumoniae J138
aagagacaagaaaaua

SEQ ID NO: 534635 - RNA, 22 nt, Chlamydophila pneumoniae J138
aagagagcuugucacacugcga

SEQ ID NO: 534636 - RNA, 23 nt, Chlamydophila pneumoniae J138
aagagauugauuucuugcuuuua

SEQ ID NO: 534637 - RNA, 21 nt, Chlamydophila pneumoniae J138
aagagcaaacaucaaagagag

SEQ ID NO: 534638 - RNA, 16 nt, Chlamydophila pneumoniae J138
aagagcaucuuuggga

SEQ ID NO: 534639 - RNA, 22 nt, Chlamydophila pneumoniae J138
aagagcaagguaacauccauag

SEQ ID NO: 534640 - RNA, 14 nt, Chlamydophila pneumoniae J138
aagauagacucuca

SEQ ID NO: 534641 - RNA, 17 nt, Chlamydophila pneumoniae J138
aagauaaugucuccauc

SEQ ID NO: 534642 - RNA, 18 nt, Chlamydophila pneumoniae J138
aagauaguauuuuugaaa

SEQ ID NO: 534643 - RNA, 18 nt, Chlamydophila pneumoniae J138
aagauauagauucaugaa

SEQ ID NO: 534644 - RNA, 13 nt, Chlamydophila pneumoniae J138
aagauauccuuuu

SEQ ID NO: 534645 - RNA, 21 nt, Chlamydophila pneumoniae J138
aagauauauuuuuaaagagag

SEQ ID NO: 534646 - RNA, 15 nt, Chlamydophila pneumoniae J138
aagauauguccguga

SEQ ID NO: 534647 - RNA, 12 nt, Chlamydophila pneumoniae J138
aagauaucugcu

SEQ ID NO: 534648 - RNA, 19 nt, Chlamydophila pneumoniae J138
aagaucaauauagagaacu

SEQ ID NO: 534649 - RNA, 12 nt, Chlamydophila pneumoniae J138
aagauaaauccc

SEQ ID NO: 534650 - RNA, 15 nt, Chlamydophila pneumoniae J138
aagauaaagaauucu

SEQ ID NO: 534651 - RNA, 13 nt, Chlamydophila pneumoniae J138
aagauaaacauua

SEQ ID NO: 534652 - RNA, 12 nt, Chlamydophila pneumoniae J138
aagauaaagaag

SEQ ID NO: 534653 - RNA, 13 nt, Chlamydophila pneumoniae J138
aagauaaagaagu

SEQ ID NO: 534654 - RNA, 13 nt, Chlamydophila pneumoniae J138
aagauaaacauac

SEQ ID NO: 534655 - RNA, 17 nt, Chlamydophila pneumoniae J138
aagauaaacagcacagg

SEQ ID NO: 534656 - RNA, 14 nt, Chlamydophila pneumoniae J138
aagauaagaccaga

SEQ ID NO: 534657 - RNA, 20 nt, Chlamydophila pneumoniae J138
aagauaaucuguaagaaaau

SEQ ID NO: 534658 - RNA, 15 nt, Chlamydophila pneumoniae J138
aagagugucuaagau

SEQ ID NO: 534659 - RNA, 22 nt, Chlamydophila pneumoniae J138
aagagucuuugaugcuaaacga

SEQ ID NO: 534660 - RNA, 18 nt, Chlamydophila pneumoniae J138
aagaguccgaagccuuca

SEQ ID NO: 534661 - RNA, 12 nt, Chlamydophila pneumoniae J138
cgcuugcaucuu

SEQ ID NO: 534662 - RNA, 18 nt, Chlamydophila pneumoniae J138
cggccaucauuaaguacu

SEQ ID NO: 534663 - RNA, 21 nt, Chlamydophila pneumoniae J138
cgccuauagauuccccaaacu

SEQ ID NO: 534664 - RNA, 13 nt, Chlamydophila pneumoniae J138
cgccuagaauggc

SEQ ID NO: 534665 - RNA, 23 nt, Chlamydophila pneumoniae J138
cgcgagcuauuuuacuuacuaaa

SEQ ID NO: 534666 - RNA, 21 nt, Chlamydophila pneumoniae J138
cgcuagaggaucuucaaggua

SEQ ID NO: 534667 - RNA, 22 nt, Chlamydophila pneumoniae J138
cgcuagagacagccuguuuucu

SEQ ID NO: 534668 - RNA, 17 nt, Chlamydophila pneumoniae J138
cgcuagaggaucuucaa

SEQ ID NO: 534669 - RNA, 21 nt, Chlamydophila pneumoniae J138
cgcuauccaugcuagaagaca

SEQ ID NO: 534670 - RNA, 17 nt, Chlamydophila pneumoniae J138
cgcuauagccuuguaaa

SEQ ID NO: 534671 - RNA, 20 nt, Chlamydophila pneumoniae J138
cgcucuaagcugugcauuuu

SEQ ID NO: 534672 - RNA, 14 nt, Chlamydophila pneumoniae J138
cgcucguauugaua

SEQ ID NO: 534673 - RNA, 14 nt, Chlamydophila pneumoniae J138
cgcucucuuuaaaa

SEQ ID NO: 534674 - RNA, 14 nt, Chlamydophila pneumoniae J138
cgcucucuccauga

SEQ ID NO: 534675 - RNA, 19 nt, Chlamydophila pneumoniae J138
cgcucuaaacucucuuccu

SEQ ID NO: 534676 - RNA, 22 nt, Chlamydophila pneumoniae J138
cgcuguaaauucagugauuccu

SEQ ID NO: 534677 - RNA, 14 nt, Chlamydophila pneumoniae J138
cgcugugaggaaaa

SEQ ID NO: 534678 - RNA, 14 nt, Chlamydophila pneumoniae J138
cgcuuccagcuucu

SEQ ID NO: 534679 - RNA, 14 nt, Chlamydophila pneumoniae J138
cgcuuaaaaucagc

SEQ ID NO: 534680 - RNA, 21 nt, Chlamydophila pneumoniae J138
cgcuguugaaaugcaguucuu

SEQ ID NO: 534681 - RNA, 21 nt, Chlamydophila pneumoniae J138
cgcuuagagaauuggaagcuu

SEQ ID NO: 534682 - RNA, 23 nt, Chlamydophila pneumoniae J138
cgcugcuucucuacuaaaaucuc

SEQ ID NO: 534683 - RNA, 14 nt, Chlamydophila pneumoniae J138
cgccagcaaagauu

SEQ ID NO: 534684 - RNA, 18 nt, Chlamydophila pneumoniae J138
cgcauaagagacauuucu

SEQ ID NO: 534685 - RNA, 12 nt, Chlamydophila pneumoniae J138
cgccccaugaau

SEQ ID NO: 534686 - RNA, 20 nt, Chlamydophila pneumoniae J138
cgauacccaucuagaaacau

SEQ ID NO: 534687 - RNA, 17 nt, Chlamydophila pneumoniae J138
cgauaccgcuguuuuau

SEQ ID NO: 534688 - RNA, 13 nt, Chlamydophila pneumoniae J138
cgauacgaaggau

SEQ ID NO: 534689 - RNA, 15 nt, Chlamydophila pneumoniae J138
cgauaggaucuucua

SEQ ID NO: 534690 - RNA, 18 nt, Chlamydophila pneumoniae J138
cgaucgcaaucagcaaca

SEQ ID NO: 534691 - RNA, 15 nt, Chlamydophila pneumoniae J138
cgaugacuuggcugg

SEQ ID NO: 534692 - RNA, 18 nt, Chlamydophila pneumoniae J138
cgaugacagggaaagaac

SEQ ID NO: 534693 - RNA, 19 nt, Chlamydophila pneumoniae J138
cgaugaaacugaagguaaa

SEQ ID NO: 534694 - RNA, 20 nt, Chlamydophila pneumoniae J138
cgaucucucuuccugcugcu

SEQ ID NO: 534695 - RNA, 14 nt, Chlamydophila pneumoniae J138
cgaugccagccaua

SEQ ID NO: 534696 - RNA, 20 nt, Chlamydophila pneumoniae J138
cgauuuagccguagauagua

SEQ ID NO: 534697 - RNA, 15 nt, Chlamydophila pneumoniae J138
cgauuccugaggcua

SEQ ID NO: 534698 - RNA, 21 nt, Chlamydophila pneumoniae J138
cgauucgaaaaacgguaaaua

SEQ ID NO: 534699 - RNA, 20 nt, Chlamydophila pneumoniae J138
cgcaguggacggggagagcc

SEQ ID NO: 534700 - RNA, 15 nt, Chlamydophila pneumoniae J138
cgcaccauuccuuag

SEQ ID NO: 534701 - RNA, 14 nt, Chlamydophila pneumoniae J138
cgcaaucagcaaca

SEQ ID NO: 534702 - RNA, 13 nt, Chlamydophila pneumoniae J138
cgauuucccagaa

SEQ ID NO: 534703 - RNA, 16 nt, Chlamydophila pneumoniae J138
ccagggguuucuaaau

SEQ ID NO: 534704 - RNA, 23 nt, Chlamydophila pneumoniae J138
ccaguagaucuucugaaaucaaa

SEQ ID NO: 534705 - RNA, 15 nt, Chlamydophila pneumoniae J138
ccaguuacugucugc

SEQ ID NO: 534706 - RNA, 18 nt, Chlamydophila pneumoniae J138
ccaguuuuccauccacga

SEQ ID NO: 534707 - RNA, 19 nt, Chlamydophila pneumoniae J138
ccaguuguauccagcucaa

SEQ ID NO: 534708 - RNA, 18 nt, Chlamydophila pneumoniae J138
ccauaauuucuuucacau

SEQ ID NO: 534709 - RNA, 19 nt, Chlamydophila pneumoniae J138
ccauaauuuuagcuucuuu

SEQ ID NO: 534710 - RNA, 22 nt, Chlamydophila pneumoniae J138
ccauaaaaauguaauuuuuuca

SEQ ID NO: 534711 - RNA, 21 nt, Chlamydophila pneumoniae J138
ccauaaaaauguaauuuuuuc

SEQ ID NO: 534712 - RNA, 12 nt, Chlamydophila pneumoniae J138
ccauacccaaau

SEQ ID NO: 534713 - RNA, 15 nt, Chlamydophila pneumoniae J138
ccauaggaucugcau

SEQ ID NO: 534714 - RNA, 14 nt, Chlamydophila pneumoniae J138
ccauccucagucuc

SEQ ID NO: 534715 - RNA, 22 nt, Chlamydophila pneumoniae J138
aaacaaucuuguaaguuacgga

SEQ ID NO: 534716 - RNA, 17 nt, Chlamydophila pneumoniae J138
ccauauuugaauaaagg

SEQ ID NO: 534717 - RNA, 16 nt, Chlamydophila pneumoniae J138
ccaucuuguucuaaaa

SEQ ID NO: 534718 - RNA, 15 nt, Chlamydophila pneumoniae J138
ccaugagaugggcua

SEQ ID NO: 534719 - RNA, 16 nt, Chlamydophila pneumoniae J138
ccauggauauggaaug

SEQ ID NO: 534720 - RNA, 20 nt, Chlamydophila pneumoniae J138
ccauggaauggcuacuuuaa

SEQ ID NO: 534721 - RNA, 17 nt, Chlamydophila pneumoniae J138
ccaugucuaaaggagug

SEQ ID NO: 534722 - RNA, 14 nt, Chlamydophila pneumoniae J138
ccauggcuggaaag

SEQ ID NO: 534723 - RNA, 12 nt, Chlamydophila pneumoniae J138
ccauuaaggaau

SEQ ID NO: 534724 - RNA, 23 nt, Chlamydophila pneumoniae J138
ccauuaaauuguauggaauucaa

SEQ ID NO: 534725 - RNA, 17 nt, Chlamydophila pneumoniae J138
ccauuagggcauucugu

SEQ ID NO: 534726 - RNA, 15 nt, Chlamydophila pneumoniae J138
ccauuccuuaggaug

SEQ ID NO: 534727 - RNA, 14 nt, Chlamydophila pneumoniae J138
ccauucugaccaaa

SEQ ID NO: 534728 - RNA, 14 nt, Chlamydophila pneumoniae J138
ccauuuggagagcu

SEQ ID NO: 534729 - RNA, 13 nt, Chlamydophila pneumoniae J138
ccauuuucuaaga

SEQ ID NO: 534730 - RNA, 15 nt, Chlamydophila pneumoniae J138
ccauuuuuccuccuc

SEQ ID NO: 534731 - RNA, 22 nt, Chlamydophila pneumoniae J138
ccauuuuugaauaugauuucca

SEQ ID NO: 534732 - RNA, 18 nt, Chlamydophila pneumoniae J138
ccauuuuuggaaaaccau

SEQ ID NO: 534733 - RNA, 16 nt, Chlamydophila pneumoniae J138
cccaagcaagaagugu

SEQ ID NO: 534734 - RNA, 13 nt, Chlamydophila pneumoniae J138
cccaagggccaga

SEQ ID NO: 534735 - RNA, 20 nt, Chlamydophila pneumoniae J138
cccaagggccgaaccaaaau

SEQ ID NO: 534736 - RNA, 17 nt, Chlamydophila pneumoniae J138
cccagauuuuuuugguu

SEQ ID NO: 534737 - RNA, 14 nt, Chlamydophila pneumoniae J138
cccauagagccuug

SEQ ID NO: 534738 - RNA, 22 nt, Chlamydophila pneumoniae J138
aaacaauuuccugcauggcuuu

SEQ ID NO: 534739 - RNA, 19 nt, Chlamydophila pneumoniae J138
aaacacaaauagcaagagc

SEQ ID NO: 534740 - RNA, 23 nt, Chlamydophila pneumoniae J138
cccauacauagggaaaguucagu

SEQ ID NO: 534741 - RNA, 19 nt, Chlamydophila pneumoniae J138
cccaguuuuccauccacga

SEQ ID NO: 534742 - RNA, 14 nt, Chlamydophila pneumoniae J138
cccauaaaaauuaa

SEQ ID NO: 534743 - RNA, 17 nt, Chlamydophila pneumoniae J138
cccaguuguauccagcu

SEQ ID NO: 534744 - RNA, 12 nt, Chlamydophila pneumoniae J138
aaacaauuucaa

SEQ ID NO: 534745 - RNA, 14 nt, Chlamydophila pneumoniae J138
ccccacccacucca

SEQ ID NO: 534746 - RNA, 15 nt, Chlamydophila pneumoniae J138
ccccaucuaauccug

SEQ ID NO: 534747 - RNA, 17 nt, Chlamydophila pneumoniae J138
cccccugcugccaugca

SEQ ID NO: 534748 - RNA, 13 nt, Chlamydophila pneumoniae J138
cccgagcuuccau

SEQ ID NO: 534749 - RNA, 17 nt, Chlamydophila pneumoniae J138
ccccuucuaauacuuua

SEQ ID NO: 534750 - RNA, 22 nt, Chlamydophila pneumoniae J138
cccgaguccuaaaauuucuagg

SEQ ID NO: 534751 - RNA, 14 nt, Chlamydophila pneumoniae J138
cccuacagcagaaa

SEQ ID NO: 534752 - RNA, 19 nt, Chlamydophila pneumoniae J138
cccuccaaaaucaucagcu

SEQ ID NO: 534753 - RNA, 21 nt, Chlamydophila pneumoniae J138
cccucauaagauuuccccaag

SEQ ID NO: 534754 - RNA, 23 nt, Chlamydophila pneumoniae J138
cccucacaagaagcaaacccaca

SEQ ID NO: 534755 - RNA, 15 nt, Chlamydophila pneumoniae J138
cccucagaaaggaga

SEQ ID NO: 534756 - RNA, 19 nt, Chlamydophila pneumoniae J138
cccucacaauauaaaugcu

SEQ ID NO: 534757 - RNA, 13 nt, Chlamydophila pneumoniae J138
cccucgaaccacu

SEQ ID NO: 534758 - RNA, 22 nt, Chlamydophila pneumoniae J138
cccucuaaugacagcugagaaa

SEQ ID NO: 534759 - RNA, 11 nt, Chlamydophila pneumoniae J138
cccucuccuug

SEQ ID NO: 534760 - RNA, 21 nt, Chlamydophila pneumoniae J138
cccugauuccauccugucuau

SEQ ID NO: 534761 - RNA, 15 nt, Chlamydophila pneumoniae J138
cccugagccugugau

SEQ ID NO: 534762 - RNA, 18 nt, Chlamydophila pneumoniae J138
cccucuugcuuuuccguu

SEQ ID NO: 534763 - RNA, 12 nt, Chlamydophila pneumoniae J138
cccucuucaucc

SEQ ID NO: 534764 - RNA, 18 nt, Chlamydophila pneumoniae J138
cccucugauuauuucuaa

SEQ ID NO: 534765 - RNA, 22 nt, Chlamydophila pneumoniae J138
aaacagcgguugccuuucucuu

SEQ ID NO: 534766 - RNA, 17 nt, Chlamydophila pneumoniae J138
aaacaggaauaggcucu

SEQ ID NO: 534767 - RNA, 14 nt, Chlamydophila pneumoniae J138
aaacagcaaaguaa

SEQ ID NO: 534768 - RNA, 23 nt, Chlamydophila pneumoniae J138
cccuuaaagagaaucuccucauc

SEQ ID NO: 534769 - RNA, 15 nt, Chlamydophila pneumoniae J138
aaacaucagagaacu

SEQ ID NO: 534770 - RNA, 21 nt, Chlamydophila pneumoniae J138
ccgaagccuucauuccaugag

SEQ ID NO: 534771 - RNA, 22 nt, Chlamydophila pneumoniae J138
ccgaagacaaugucgucucaga

SEQ ID NO: 534772 - RNA, 15 nt, Chlamydophila pneumoniae J138
ccgaagacuaccaau

SEQ ID NO: 534773 - RNA, 15 nt, Chlamydophila pneumoniae J138
ccgaauaggcauuac

SEQ ID NO: 534774 - RNA, 13 nt, Chlamydophila pneumoniae J138
ccgaaucucucca

SEQ ID NO: 534775 - RNA, 15 nt, Chlamydophila pneumoniae J138
ccgaaucucuccagc

SEQ ID NO: 534776 - RNA, 19 nt, Chlamydophila pneumoniae J138
aaacauuaccguucccuaa

SEQ ID NO: 534777 - RNA, 13 nt, Chlamydophila pneumoniae J138
ccgagaauacaga

SEQ ID NO: 534778 - RNA, 15 nt, Chlamydophila pneumoniae J138
ccgacuuuccucaaa

SEQ ID NO: 534779 - RNA, 14 nt, Chlamydophila pneumoniae J138
ccgacauuuaacau

SEQ ID NO: 534780 - RNA, 19 nt, Chlamydophila pneumoniae J138
aaaccacggauuuucucua

SEQ ID NO: 534781 - RNA, 13 nt, Chlamydophila pneumoniae J138
ccgcagcuucucu

SEQ ID NO: 534782 - RNA, 19 nt, Chlamydophila pneumoniae J138
ccgcaggucgcaucaauga

SEQ ID NO: 534783 - RNA, 21 nt, Chlamydophila pneumoniae J138
aaaccauauugcaaagcaucu

SEQ ID NO: 534784 - RNA, 17 nt, Chlamydophila pneumoniae J138
ccgccauaacacuuugc

SEQ ID NO: 534785 - RNA, 15 nt, Chlamydophila pneumoniae J138
aaacccgcaacucuu

SEQ ID NO: 534786 - RNA, 18 nt, Chlamydophila pneumoniae J138
aaacccaauucuuaaaaa

SEQ ID NO: 534787 - RNA, 14 nt, Chlamydophila pneumoniae J138
ccgcuguauuuuca

SEQ ID NO: 534788 - RNA, 21 nt, Chlamydophila pneumoniae J138
ccgcuguauuuucagcacuga

SEQ ID NO: 534789 - RNA, 19 nt, Chlamydophila pneumoniae J138
aaacgagacugcaaaggaa

SEQ ID NO: 534790 - RNA, 17 nt, Chlamydophila pneumoniae J138
aaacgaucccuacacug

SEQ ID NO: 534791 - RNA, 14 nt, Chlamydophila pneumoniae J138
ccguuaauuuuugc

SEQ ID NO: 534792 - RNA, 13 nt, Chlamydophila pneumoniae J138
ccguucgagaggu

SEQ ID NO: 534793 - RNA, 23 nt, Chlamydophila pneumoniae J138
ccguuucaggaaacucaaucucu

SEQ ID NO: 534794 - RNA, 13 nt, Chlamydophila pneumoniae J138
ccguuuccuccuc

SEQ ID NO: 534795 - RNA, 19 nt, Chlamydophila pneumoniae J138
ccuaaaaaggucagcccug

SEQ ID NO: 534796 - RNA, 20 nt, Chlamydophila pneumoniae J138
ccuaaaaaggucagcccugc

SEQ ID NO: 534797 - RNA, 21 nt, Chlamydophila pneumoniae J138
ccuaaagaauuuguaacucuu

SEQ ID NO: 534798 - RNA, 20 nt, Chlamydophila pneumoniae J138
ccuaaaauggugaagaauaa

SEQ ID NO: 534799 - RNA, 20 nt, Chlamydophila pneumoniae J138
ccuaaaguaacgauaagaag

SEQ ID NO: 534800 - RNA, 23 nt, Chlamydophila pneumoniae J138
ccuaaaguuugagcuaagcugaa

SEQ ID NO: 534801 - RNA, 16 nt, Chlamydophila pneumoniae J138
ccuaaauuaaauaucu

SEQ ID NO: 534802 - RNA, 16 nt, Chlamydophila pneumoniae J138
ccuaaauucauaacac

SEQ ID NO: 534803 - RNA, 18 nt, Chlamydophila pneumoniae J138
ccuaagagauuuuccaua

SEQ ID NO: 534804 - RNA, 17 nt, Chlamydophila pneumoniae J138
ccuaagcucauaagaaa

SEQ ID NO: 534805 - RNA, 13 nt, Chlamydophila pneumoniae J138
ccuaauaaagaag

SEQ ID NO: 534806 - RNA, 15 nt, Chlamydophila pneumoniae J138
ccuacgaauccaaaa

SEQ ID NO: 534807 - RNA, 15 nt, Chlamydophila pneumoniae J138
ccuaccugaggagcg

SEQ ID NO: 534808 - RNA, 18 nt, Chlamydophila pneumoniae J138
ccuagaaucacauaaaau

SEQ ID NO: 534809 - RNA, 14 nt, Chlamydophila pneumoniae J138
ccuagaauaggaau

SEQ ID NO: 534810 - RNA, 21 nt, Chlamydophila pneumoniae J138
ccuagagaguucuuguaauaa

SEQ ID NO: 534811 - RNA, 17 nt, Chlamydophila pneumoniae J138
ccuagauagcaaaucaa

SEQ ID NO: 534812 - RNA, 20 nt, Chlamydophila pneumoniae J138
ccuaccaaaguuuguagcau

SEQ ID NO: 534813 - RNA, 23 nt, Chlamydophila pneumoniae J138
ccuacagaucaggauucuaaaaa

SEQ ID NO: 534814 - RNA, 23 nt, Chlamydophila pneumoniae J138
ccuacacugguagcuaaauuuag

SEQ ID NO: 534815 - RNA, 24 nt, Chlamydophila pneumoniae J138
ccuaauuccuucaaagcuuguucc

SEQ ID NO: 534816 - RNA, 14 nt, Chlamydophila pneumoniae J138
ccuaucaaagcaaa

SEQ ID NO: 534817 - RNA, 15 nt, Chlamydophila pneumoniae J138
ccuauaguaauuucu

SEQ ID NO: 534818 - RNA, 21 nt, Chlamydophila pneumoniae J138
ccuauaguauaauagugagcu

SEQ ID NO: 534819 - RNA, 21 nt, Chlamydophila pneumoniae J138
ccuauauuuuuuacauaacac

SEQ ID NO: 534820 - RNA, 21 nt, Chlamydophila pneumoniae J138
ccuauaaagcaaaugccugua

SEQ ID NO: 534821 - RNA, 16 nt, Chlamydophila pneumoniae J138
ccuaggagaaaucaca

SEQ ID NO: 534822 - RNA, 16 nt, Chlamydophila pneumoniae J138
ccuagggucuucucga

SEQ ID NO: 534823 - RNA, 23 nt, Chlamydophila pneumoniae J138
ccuauuuucuuaugaccaagaac

SEQ ID NO: 534824 - RNA, 22 nt, Chlamydophila pneumoniae J138
ccuauuugcaacaaucuuucuu

SEQ ID NO: 534825 - RNA, 13 nt, Chlamydophila pneumoniae J138
ccucacaagaagc

SEQ ID NO: 534826 - RNA, 15 nt, Chlamydophila pneumoniae J138
ccucacaucuccuuu

SEQ ID NO: 534827 - RNA, 17 nt, Chlamydophila pneumoniae J138
ccucacauguuucacuu

SEQ ID NO: 534828 - RNA, 17 nt, Chlamydophila pneumoniae J138
ccucauccucaucauca

SEQ ID NO: 534829 - RNA, 14 nt, Chlamydophila pneumoniae J138
ccucaucagaagcc

SEQ ID NO: 534830 - RNA, 20 nt, Chlamydophila pneumoniae J138
ccucaucagaagccaccaaa

SEQ ID NO: 534831 - RNA, 21 nt, Chlamydophila pneumoniae J138
ccucaucagaagccaccaaaa

SEQ ID NO: 534832 - RNA, 17 nt, Chlamydophila pneumoniae J138
ccucaucaucagaaauc

SEQ ID NO: 534833 - RNA, 19 nt, Chlamydophila pneumoniae J138
aaacgcaaugauuucucua

SEQ ID NO: 534834 - RNA, 15 nt, Chlamydophila pneumoniae J138
ccuccaaauacgaac

SEQ ID NO: 534835 - RNA, 14 nt, Chlamydophila pneumoniae J138
aaacgcaccuuagc

SEQ ID NO: 534836 - RNA, 15 nt, Chlamydophila pneumoniae J138
ccuccaccaggagcu

SEQ ID NO: 534837 - RNA, 17 nt, Chlamydophila pneumoniae J138
ccuccuucugcaugaau

SEQ ID NO: 534838 - RNA, 16 nt, Chlamydophila pneumoniae J138
ccuccauggaaagaaa

SEQ ID NO: 534839 - RNA, 17 nt, Chlamydophila pneumoniae J138
ccucgaauuccucccag

SEQ ID NO: 534840 - RNA, 14 nt, Chlamydophila pneumoniae J138
ccucgacuuccucc

SEQ ID NO: 534841 - RNA, 20 nt, Chlamydophila pneumoniae J138
ccucgagcagaaacuccaaa

SEQ ID NO: 534842 - RNA, 19 nt, Chlamydophila pneumoniae J138
ccugcccauuuuuggaaaa

SEQ ID NO: 534843 - RNA, 17 nt, Chlamydophila pneumoniae J138
ccugcaccagacccucg

SEQ ID NO: 534844 - RNA, 12 nt, Chlamydophila pneumoniae J138
ccugcugcuuca

SEQ ID NO: 534845 - RNA, 16 nt, Chlamydophila pneumoniae J138
ccugcuccucuucuuc

SEQ ID NO: 534846 - RNA, 16 nt, Chlamydophila pneumoniae J138
ccugccucacagcuaa

SEQ ID NO: 534847 - RNA, 18 nt, Chlamydophila pneumoniae J138
ccuggacgauauaaucac

SEQ ID NO: 534848 - RNA, 22 nt, Chlamydophila pneumoniae J138
ccuggacugcugacaucuccaa

SEQ ID NO: 534849 - RNA, 16 nt, Chlamydophila pneumoniae J138
ccuggaugaacuccag

SEQ ID NO: 534850 - RNA, 21 nt, Chlamydophila pneumoniae J138
ccugcuucuauagagacacga

SEQ ID NO: 534851 - RNA, 20 nt, Chlamydophila pneumoniae J138
ccuggaacaguauaaucaga

SEQ ID NO: 534852 - RNA, 17 nt, Chlamydophila pneumoniae J138
ccuggaaagcuucugga

SEQ ID NO: 534853 - RNA, 23 nt, Chlamydophila pneumoniae J138
ccuggaaaugaauauaauuccaa

SEQ ID NO: 534854 - RNA, 18 nt, Chlamydophila pneumoniae J138
ccuggauugauccacaga

SEQ ID NO: 534855 - RNA, 21 nt, Chlamydophila pneumoniae J138
ccugggggacuucaaaugaaa

SEQ ID NO: 534856 - RNA, 17 nt, Chlamydophila pneumoniae J138
ccuguacgguaaaucca

SEQ ID NO: 534857 - RNA, 15 nt, Chlamydophila pneumoniae J138
ccuguacuaucuuuu

SEQ ID NO: 534858 - RNA, 17 nt, Chlamydophila pneumoniae J138
ccuuacaagcuuccuug

SEQ ID NO: 534859 - RNA, 11 nt, Chlamydophila pneumoniae J138
ccuucagaucg

SEQ ID NO: 534860 - RNA, 12 nt, Chlamydophila pneumoniae J138
ccuucaacacac

SEQ ID NO: 534861 - RNA, 16 nt, Chlamydophila pneumoniae J138
ccuucaagucgagaaa

SEQ ID NO: 534862 - RNA, 24 nt, Chlamydophila pneumoniae J138
ccuucaauacgcuagcucuuaaau

SEQ ID NO: 534863 - RNA, 23 nt, Chlamydophila pneumoniae J138
ccuucgaagcggagcaucuuuuc

SEQ ID NO: 534864 - RNA, 22 nt, Chlamydophila pneumoniae J138
ccuucauacguuuuuuuccuuu

SEQ ID NO: 534865 - RNA, 12 nt, Chlamydophila pneumoniae J138
ccuucuucuuca

SEQ ID NO: 534866 - RNA, 13 nt, Chlamydophila pneumoniae J138
ccuucuucuucag

SEQ ID NO: 534867 - RNA, 16 nt, Chlamydophila pneumoniae J138
ccuucuguuuucacau

SEQ ID NO: 534868 - RNA, 19 nt, Chlamydophila pneumoniae J138
ccuugaaauugcucuugcu

SEQ ID NO: 534869 - RNA, 21 nt, Chlamydophila pneumoniae J138
ccuucuuucaauagcuuccaa

SEQ ID NO: 534870 - RNA, 18 nt, Chlamydophila pneumoniae J138
ccuucuuucaauagcuuc

SEQ ID NO: 534871 - RNA, 15 nt, Chlamydophila pneumoniae J138
ccuucuuucaauagc

SEQ ID NO: 534872 - RNA, 23 nt, Chlamydophila pneumoniae J138
ccuuggauuucuucuucuaaagc

SEQ ID NO: 534873 - RNA, 18 nt, Chlamydophila pneumoniae J138
ccuuggauuucuucuucu

SEQ ID NO: 534874 - RNA, 13 nt, Chlamydophila pneumoniae J138
ccuuggaaaucag

SEQ ID NO: 534875 - RNA, 16 nt, Chlamydophila pneumoniae J138
ccuugagacaaagaau

SEQ ID NO: 534876 - RNA, 15 nt, Chlamydophila pneumoniae J138
ccuugacuaaaucca

SEQ ID NO: 534877 - RNA, 22 nt, Chlamydophila pneumoniae J138
ccuugcuaauaccucaaagcca

SEQ ID NO: 534878 - RNA, 22 nt, Chlamydophila pneumoniae J138
ccuuguuguauggcagccugga

SEQ ID NO: 534879 - RNA, 16 nt, Chlamydophila pneumoniae J138
ccuugugucuuaaagc

SEQ ID NO: 534880 - RNA, 22 nt, Chlamydophila pneumoniae J138
ccuuugguagaaagacaaaaaa

SEQ ID NO: 534881 - RNA, 16 nt, Chlamydophila pneumoniae J138
ccuuuaguuaacuccu

SEQ ID NO: 534882 - RNA, 18 nt, Chlamydophila pneumoniae J138
ccuuuagggaaaaaguag

SEQ ID NO: 534883 - RNA, 20 nt, Chlamydophila pneumoniae J138
ccuuucacaaagaauucaga

SEQ ID NO: 534884 - RNA, 12 nt, Chlamydophila pneumoniae J138
ccuuguuuuccu

SEQ ID NO: 534885 - RNA, 20 nt, Chlamydophila pneumoniae J138
cgaccucgaauuccucccag

SEQ ID NO: 534886 - RNA, 17 nt, Chlamydophila pneumoniae J138
cgaccucgaauuccucc

SEQ ID NO: 534887 - RNA, 19 nt, Chlamydophila pneumoniae J138
cgaccugcaaacuccccag

SEQ ID NO: 534888 - RNA, 22 nt, Chlamydophila pneumoniae J138
cgacgacgucuucuuagaagag

SEQ ID NO: 534889 - RNA, 16 nt, Chlamydophila pneumoniae J138
cgacaugcuuuccuuc

SEQ ID NO: 534890 - RNA, 15 nt, Chlamydophila pneumoniae J138
cgacaugagaaaucu

SEQ ID NO: 534891 - RNA, 15 nt, Chlamydophila pneumoniae J138
cgaccaacuccucaa

SEQ ID NO: 534892 - RNA, 17 nt, Chlamydophila pneumoniae J138
cgaccuaggagaaauca

SEQ ID NO: 534893 - RNA, 19 nt, Chlamydophila pneumoniae J138
cgaacuaaaggaacugugc

SEQ ID NO: 534894 - RNA, 13 nt, Chlamydophila pneumoniae J138
ccuuuuuaggaaa

SEQ ID NO: 534895 - RNA, 16 nt, Chlamydophila pneumoniae J138
ccuuuucuccuucugg

SEQ ID NO: 534896 - RNA, 20 nt, Chlamydophila pneumoniae J138
cgaacuucagcaagaaaaua

SEQ ID NO: 534897 - RNA, 17 nt, Chlamydophila pneumoniae J138
cgaacuguacgaauuuc

SEQ ID NO: 534898 - RNA, 16 nt, Chlamydophila pneumoniae J138
cgaagaacagaggauc

SEQ ID NO: 534899 - RNA, 20 nt, Chlamydophila pneumoniae J138
cgaagcauucccgacucaau

SEQ ID NO: 534900 - RNA, 19 nt, Chlamydophila pneumoniae J138
cgaagauuuagggaagagu

SEQ ID NO: 534901 - RNA, 21 nt, Chlamydophila pneumoniae J138
cgaaguugauuguagagacau

SEQ ID NO: 534902 - RNA, 23 nt, Chlamydophila pneumoniae J138
cgaagcuugcugauuucuuuuuc

SEQ ID NO: 534903 - RNA, 18 nt, Chlamydophila pneumoniae J138
cgaagcuugcugauuucu

SEQ ID NO: 534904 - RNA, 11 nt, Chlamydophila pneumoniae J138
cgaauaacuac

SEQ ID NO: 534905 - RNA, 17 nt, Chlamydophila pneumoniae J138
cgaaucuuucaaaagaa

SEQ ID NO: 534906 - RNA, 12 nt, Chlamydophila pneumoniae J138
cgaaucucucca

SEQ ID NO: 534907 - RNA, 16 nt, Chlamydophila pneumoniae J138
cgaaucuuuauuucug

SEQ ID NO: 534908 - RNA, 13 nt, Chlamydophila pneumoniae J138
cgaaucucuccag

SEQ ID NO: 534909 - RNA, 13 nt, Chlamydophila pneumoniae J138
cgaaucuaaaaac

SEQ ID NO: 534910 - RNA, 21 nt, Chlamydophila pneumoniae J138
cgaaucccuguguguuuuuuc

SEQ ID NO: 534911 - RNA, 21 nt, Chlamydophila pneumoniae J138
cgaauccuagagaaccuccua

SEQ ID NO: 534912 - RNA, 16 nt, Chlamydophila pneumoniae J138
cgaauccugaggaugc

SEQ ID NO: 534913 - RNA, 20 nt, Chlamydophila pneumoniae J138
cgaaugucguuaaaaacuau

SEQ ID NO: 534914 - RNA, 20 nt, Chlamydophila pneumoniae J138
cgaaugcugcacaguucaca

SEQ ID NO: 534915 - RNA, 13 nt, Chlamydophila pneumoniae J138
cgacacgaauuuc

SEQ ID NO: 534916 - RNA, 14 nt, Chlamydophila pneumoniae J138
cgaauuucuuguuc

SEQ ID NO: 534917 - RNA, 14 nt, Chlamydophila pneumoniae J138
cgacauacaucaaa

SEQ ID NO: 534918 - RNA, 22 nt, Chlamydophila pneumoniae J138
cgacauacaucaaaaugcugcu

SEQ ID NO: 534919 - RNA, 21 nt, Chlamydophila pneumoniae J138
cgacacuauguguuuccuuuu

SEQ ID NO: 534920 - RNA, 14 nt, Chlamydophila pneumoniae J138
cauacugauauaca

SEQ ID NO: 534921 - RNA, 18 nt, Chlamydophila pneumoniae J138
cauacucuucauccugau

SEQ ID NO: 534922 - RNA, 15 nt, Chlamydophila pneumoniae J138
cauacucgucaaauu

SEQ ID NO: 534923 - RNA, 15 nt, Chlamydophila pneumoniae J138
cauacuuauccuuuu

SEQ ID NO: 534924 - RNA, 16 nt, Chlamydophila pneumoniae J138
cauacuuauccuuuuc

SEQ ID NO: 534925 - RNA, 18 nt, Chlamydophila pneumoniae J138
cauagagugugccagaau

SEQ ID NO: 534926 - RNA, 20 nt, Chlamydophila pneumoniae J138
cauagaguucgcacuaauuu

SEQ ID NO: 534927 - RNA, 15 nt, Chlamydophila pneumoniae J138
cauagagauucuaca

SEQ ID NO: 534928 - RNA, 18 nt, Chlamydophila pneumoniae J138
cauagagauaucaucaaa

SEQ ID NO: 534929 - RNA, 15 nt, Chlamydophila pneumoniae J138
cauagagauaucauc

SEQ ID NO: 534930 - RNA, 23 nt, Chlamydophila pneumoniae J138
cauagagagaaggaauuaaaaua

SEQ ID NO: 534931 - RNA, 20 nt, Chlamydophila pneumoniae J138
cauauagcucguuauauuuu

SEQ ID NO: 534932 - RNA, 21 nt, Chlamydophila pneumoniae J138
cauaguuuuuauuuuuaaaua

SEQ ID NO: 534933 - RNA, 22 nt, Chlamydophila pneumoniae J138
cauaguuuuuauuuuuaaauaa

SEQ ID NO: 534934 - RNA, 18 nt, Chlamydophila pneumoniae J138
cauaguuuuuauuuuuaa

SEQ ID NO: 534935 - RNA, 20 nt, Chlamydophila pneumoniae J138
cauaguuuuuauuuuuaaau

SEQ ID NO: 534936 - RNA, 20 nt, Chlamydophila pneumoniae J138
cauagguaaaaccagcauaa

SEQ ID NO: 534937 - RNA, 19 nt, Chlamydophila pneumoniae J138
cauagguaauacgagagga

SEQ ID NO: 534938 - RNA, 19 nt, Chlamydophila pneumoniae J138
cauagggaugacccaaaaa

SEQ ID NO: 534939 - RNA, 18 nt, Chlamydophila pneumoniae J138
cauagggaugacccaaaa

SEQ ID NO: 534940 - RNA, 20 nt, Chlamydophila pneumoniae J138
cauagcgaaagucaaagggc

SEQ ID NO: 534941 - RNA, 19 nt, Chlamydophila pneumoniae J138
cauagccuuccuguuaagg

SEQ ID NO: 534942 - RNA, 14 nt, Chlamydophila pneumoniae J138
cauagcgaaaguca

SEQ ID NO: 534943 - RNA, 17 nt, Chlamydophila pneumoniae J138
cauagcguauuccccac

SEQ ID NO: 534944 - RNA, 18 nt, Chlamydophila pneumoniae J138
cauagccaucauagcaaa

SEQ ID NO: 534945 - RNA, 23 nt, Chlamydophila pneumoniae J138
cauagccaucauagcaaacggaa

SEQ ID NO: 534946 - RNA, 22 nt, Chlamydophila pneumoniae J138
cauagcuaaguaacaguccucu

SEQ ID NO: 534947 - RNA, 21 nt, Chlamydophila pneumoniae J138
cauaggaaugccaaaccucuu

SEQ ID NO: 534948 - RNA, 17 nt, Chlamydophila pneumoniae J138
cauaggauccaggaguu

SEQ ID NO: 534949 - RNA, 14 nt, Chlamydophila pneumoniae J138
caucaaagaauuau

SEQ ID NO: 534950 - RNA, 23 nt, Chlamydophila pneumoniae J138
caucaaagaauuauugauauuau

SEQ ID NO: 534951 - RNA, 13 nt, Chlamydophila pneumoniae J138
caucaaggccuau

SEQ ID NO: 534952 - RNA, 19 nt, Chlamydophila pneumoniae J138
caucaaauaaggcugcuau

SEQ ID NO: 534953 - RNA, 20 nt, Chlamydophila pneumoniae J138
caucaaauaguucaucauau

SEQ ID NO: 534954 - RNA, 13 nt, Chlamydophila pneumoniae J138
cauauucuccuua

SEQ ID NO: 534955 - RNA, 15 nt, Chlamydophila pneumoniae J138
cauauugcaaagcau

SEQ ID NO: 534956 - RNA, 15 nt, Chlamydophila pneumoniae J138
cauaucggcagcagc

SEQ ID NO: 534957 - RNA, 18 nt, Chlamydophila pneumoniae J138
caucacgaaaaggagaau

SEQ ID NO: 534958 - RNA, 14 nt, Chlamydophila pneumoniae J138
caucacuaaucuca

SEQ ID NO: 534959 - RNA, 16 nt, Chlamydophila pneumoniae J138
caucacaauuuuaaaa

SEQ ID NO: 534960 - RNA, 19 nt, Chlamydophila pneumoniae J138
caucacaaacuaaaucaac

SEQ ID NO: 534961 - RNA, 23 nt, Chlamydophila pneumoniae J138
caucaaugguuaaaacccauguu

SEQ ID NO: 534962 - RNA, 20 nt, Chlamydophila pneumoniae J138
caucaaugguuaaaacccau

SEQ ID NO: 534963 - RNA, 21 nt, Chlamydophila pneumoniae J138
caucagcagcugucaauccaa

SEQ ID NO: 534964 - RNA, 16 nt, Chlamydophila pneumoniae J138
cauccaaauagaguga

SEQ ID NO: 534965 - RNA, 12 nt, Chlamydophila pneumoniae J138
cauccuucuuua

SEQ ID NO: 534966 - RNA, 18 nt, Chlamydophila pneumoniae J138
cauccuuguagaacuucu

SEQ ID NO: 534967 - RNA, 13 nt, Chlamydophila pneumoniae J138
caucgaagaacuu

SEQ ID NO: 534968 - RNA, 21 nt, Chlamydophila pneumoniae J138
caucgaaaccacagcaaagac

SEQ ID NO: 534969 - RNA, 23 nt, Chlamydophila pneumoniae J138
caucgagaaaugcucuucugcag

SEQ ID NO: 534970 - RNA, 18 nt, Chlamydophila pneumoniae J138
caucggagaacuuccuga

SEQ ID NO: 534971 - RNA, 19 nt, Chlamydophila pneumoniae J138
caucgucuccaaaaauucc

SEQ ID NO: 534972 - RNA, 17 nt, Chlamydophila pneumoniae J138
caucuucuuggcuuucc

SEQ ID NO: 534973 - RNA, 21 nt, Chlamydophila pneumoniae J138
caucuucucgaacaggagaga

SEQ ID NO: 534974 - RNA, 13 nt, Chlamydophila pneumoniae J138
caucuuucaucaa

SEQ ID NO: 534975 - RNA, 12 nt, Chlamydophila pneumoniae J138
caucuuguucug

SEQ ID NO: 534976 - RNA, 21 nt, Chlamydophila pneumoniae J138
caugaaauaguguuucuuuau

SEQ ID NO: 534977 - RNA, 21 nt, Chlamydophila pneumoniae J138
caugaaaagcuagucuucuua

SEQ ID NO: 534978 - RNA, 19 nt, Chlamydophila pneumoniae J138
caugaaauaguguuucuuu

SEQ ID NO: 534979 - RNA, 16 nt, Chlamydophila pneumoniae J138
caugaaauuucauucu

SEQ ID NO: 534980 - RNA, 16 nt, Chlamydophila pneumoniae J138
caugaacgugcaucuc

SEQ ID NO: 534981 - RNA, 21 nt, Chlamydophila pneumoniae J138
caugaacgugcaucucuucag

SEQ ID NO: 534982 - RNA, 18 nt, Chlamydophila pneumoniae J138
caugaaaauacaacggau

SEQ ID NO: 534983 - RNA, 16 nt, Chlamydophila pneumoniae J138
caucuuuucaaaagaa

SEQ ID NO: 534984 - RNA, 15 nt, Chlamydophila pneumoniae J138
caugaaucucuucug

SEQ ID NO: 534985 - RNA, 18 nt, Chlamydophila pneumoniae J138
caugaagcagaaacuuua

SEQ ID NO: 534986 - RNA, 22 nt, Chlamydophila pneumoniae J138
caugaccuuuaggaacuugaau

SEQ ID NO: 534987 - RNA, 21 nt, Chlamydophila pneumoniae J138
caugaccuuuaggaacuugaa

SEQ ID NO: 534988 - RNA, 19 nt, Chlamydophila pneumoniae J138
caugacgcuuuuccaaagc

SEQ ID NO: 534989 - RNA, 15 nt, Chlamydophila pneumoniae J138
caugacuauuuucau

SEQ ID NO: 534990 - RNA, 20 nt, Chlamydophila pneumoniae J138
caugaccuuuagcugcugaa

SEQ ID NO: 534991 - RNA, 21 nt, Chlamydophila pneumoniae J138
caugagagucgaaacacucau

SEQ ID NO: 534992 - RNA, 23 nt, Chlamydophila pneumoniae J138
caugagagucgaaacacucauga

SEQ ID NO: 534993 - RNA, 23 nt, Chlamydophila pneumoniae J138
caugagggcaugccuaucuaucu

SEQ ID NO: 534994 - RNA, 12 nt, Chlamydophila pneumoniae J138
caugaggcugcu

SEQ ID NO: 534995 - RNA, 17 nt, Chlamydophila pneumoniae J138
caugaggagaccuuuau

SEQ ID NO: 534996 - RNA, 21 nt, Chlamydophila pneumoniae J138
caugagccgauguugcagaau

SEQ ID NO: 534997 - RNA, 21 nt, Chlamydophila pneumoniae J138
caugauaaaaauuuucaggaa

SEQ ID NO: 534998 - RNA, 14 nt, Chlamydophila pneumoniae J138
caugaguuuuucag

SEQ ID NO: 534999 - RNA, 16 nt, Chlamydophila pneumoniae J138
caugcauagaauaaag

SEQ ID NO: 535000 - RNA, 22 nt, Chlamydophila pneumoniae J138
caugcacgagagccucggaagu

SEQ ID NO: 535001 - RNA, 22 nt, Chlamydophila pneumoniae J138
caugcccccacaaaaccuggau

SEQ ID NO: 535002 - RNA, 19 nt, Chlamydophila pneumoniae J138
caugccaaauaucucuggc

SEQ ID NO: 535003 - RNA, 19 nt, Chlamydophila pneumoniae J138
caugcgcagaauaaaaugg

SEQ ID NO: 535004 - RNA, 16 nt, Chlamydophila pneumoniae J138
caugccugaaaacaag

SEQ ID NO: 535005 - RNA, 22 nt, Chlamydophila pneumoniae J138
caugccuggccaucaucaccag

SEQ ID NO: 535006 - RNA, 23 nt, Chlamydophila pneumoniae J138
caugcuaauccagcaacaaccaa

SEQ ID NO: 535007 - RNA, 12 nt, Chlamydophila pneumoniae J138
caugcucaagaa

SEQ ID NO: 535008 - RNA, 17 nt, Chlamydophila pneumoniae J138
caugcucaagaagauga

SEQ ID NO: 535009 - RNA, 14 nt, Chlamydophila pneumoniae J138
cauggcgaggggcc

SEQ ID NO: 535010 - RNA, 16 nt, Chlamydophila pneumoniae J138
caugcggacuuuauuc

SEQ ID NO: 535011 - RNA, 14 nt, Chlamydophila pneumoniae J138
cauguugcaaagca

SEQ ID NO: 535012 - RNA, 13 nt, Chlamydophila pneumoniae J138
cauguuucacuua

SEQ ID NO: 535013 - RNA, 20 nt, Chlamydophila pneumoniae J138
cauguaggaugugaaggauc

SEQ ID NO: 535014 - RNA, 16 nt, Chlamydophila pneumoniae J138
cauguaguaaauuccu

SEQ ID NO: 535015 - RNA, 19 nt, Chlamydophila pneumoniae J138
cauguauccgaaaucugac

SEQ ID NO: 535016 - RNA, 12 nt, Chlamydophila pneumoniae J138
cauuaagcaauc

SEQ ID NO: 535017 - RNA, 13 nt, Chlamydophila pneumoniae J138
cauuaagaacauc

SEQ ID NO: 535018 - RNA, 15 nt, Chlamydophila pneumoniae J138
cauuaucacagcaau

SEQ ID NO: 535019 - RNA, 17 nt, Chlamydophila pneumoniae J138
cauuauuaaacgaauac

SEQ ID NO: 535020 - RNA, 16 nt, Chlamydophila pneumoniae J138
cauuccaagaaaaauu

SEQ ID NO: 535021 - RNA, 13 nt, Chlamydophila pneumoniae J138
cauucauuuuuua

SEQ ID NO: 535022 - RNA, 22 nt, Chlamydophila pneumoniae J138
cauucacagcagucgugauauc

SEQ ID NO: 535023 - RNA, 18 nt, Chlamydophila pneumoniae J138
cauugaauccuucuauag

SEQ ID NO: 535024 - RNA, 22 nt, Chlamydophila pneumoniae J138
cauugaagagcuugcuguacga

SEQ ID NO: 535025 - RNA, 22 nt, Chlamydophila pneumoniae J138
cauugacgcuuaaaaucagcac

SEQ ID NO: 535026 - RNA, 17 nt, Chlamydophila pneumoniae J138
cauucuugaagaucucc

SEQ ID NO: 535027 - RNA, 18 nt, Chlamydophila pneumoniae J138
cauucccuaaagcugcca

SEQ ID NO: 535028 - RNA, 19 nt, Chlamydophila pneumoniae J138
cauucccuaaagcugccag

SEQ ID NO: 535029 - RNA, 15 nt, Chlamydophila pneumoniae J138
cauucccuaaagcug

SEQ ID NO: 535030 - RNA, 15 nt, Chlamydophila pneumoniae J138
cauucucaauucugu

SEQ ID NO: 535031 - RNA, 15 nt, Chlamydophila pneumoniae J138
cauucucacagcaug

SEQ ID NO: 535032 - RNA, 14 nt, Chlamydophila pneumoniae J138
cauuuuuaaggaaa

SEQ ID NO: 535033 - RNA, 14 nt, Chlamydophila pneumoniae J138
cauuuuuccuccuc

SEQ ID NO: 535034 - RNA, 15 nt, Chlamydophila pneumoniae J138
cauuuucuuuuaaga

SEQ ID NO: 535035 - RNA, 14 nt, Chlamydophila pneumoniae J138
cauugaucagaauc

SEQ ID NO: 535036 - RNA, 17 nt, Chlamydophila pneumoniae J138
cauugaugcuuaagagu

SEQ ID NO: 535037 - RNA, 19 nt, Chlamydophila pneumoniae J138
ccaaacuuggucauuauag

SEQ ID NO: 535038 - RNA, 20 nt, Chlamydophila pneumoniae J138
ccaaacggcugauucuccca

SEQ ID NO: 535039 - RNA, 20 nt, Chlamydophila pneumoniae J138
ccaaacgaauuucuuguucc

SEQ ID NO: 535040 - RNA, 22 nt, Chlamydophila pneumoniae J138
ccaaacccugggcucacucuaa

SEQ ID NO: 535041 - RNA, 23 nt, Chlamydophila pneumoniae J138
ccaaaauuaccguuuccuccucu

SEQ ID NO: 535042 - RNA, 22 nt, Chlamydophila pneumoniae J138
ccaaaauuaccguuuccuccuc

SEQ ID NO: 535043 - RNA, 21 nt, Chlamydophila pneumoniae J138
ccaaacauggacaauauagag

SEQ ID NO: 535044 - RNA, 23 nt, Chlamydophila pneumoniae J138
ccaaaagaauuccuaaaacgagc

SEQ ID NO: 535045 - RNA, 15 nt, Chlamydophila pneumoniae J138
ccaaaauaaaaggag

SEQ ID NO: 535046 - RNA, 15 nt, Chlamydophila pneumoniae J138
ccaaaaauucccaua

SEQ ID NO: 535047 - RNA, 18 nt, Chlamydophila pneumoniae J138
ccaacuuuugaagauccu

SEQ ID NO: 535048 - RNA, 13 nt, Chlamydophila pneumoniae J138
ccaacuccucuaa

SEQ ID NO: 535049 - RNA, 14 nt, Chlamydophila pneumoniae J138
ccaacuaaaacagc

SEQ ID NO: 535050 - RNA, 13 nt, Chlamydophila pneumoniae J138
ccaacccuauuua

SEQ ID NO: 535051 - RNA, 16 nt, Chlamydophila pneumoniae J138
ccaagacaauggaaau

SEQ ID NO: 535052 - RNA, 17 nt, Chlamydophila pneumoniae J138
ccaagaaaucucaguga

SEQ ID NO: 535053 - RNA, 13 nt, Chlamydophila pneumoniae J138
ccaagacgcggaa

SEQ ID NO: 535054 - RNA, 19 nt, Chlamydophila pneumoniae J138
ccaagggagaggucugcuc

SEQ ID NO: 535055 - RNA, 14 nt, Chlamydophila pneumoniae J138
ccaaauguucucuc

SEQ ID NO: 535056 - RNA, 20 nt, Chlamydophila pneumoniae J138
ccaacacuuuuaaagauaag

SEQ ID NO: 535057 - RNA, 14 nt, Chlamydophila pneumoniae J138
ccaaaguuuguagc

SEQ ID NO: 535058 - RNA, 18 nt, Chlamydophila pneumoniae J138
ccaaagcagauccugcuu

SEQ ID NO: 535059 - RNA, 16 nt, Chlamydophila pneumoniae J138
ccaaagcauauacugu

SEQ ID NO: 535060 - RNA, 21 nt, Chlamydophila pneumoniae J138
ccaaagaacagcacucucugc

SEQ ID NO: 535061 - RNA, 14 nt, Chlamydophila pneumoniae J138
ccaaagaacagcac

SEQ ID NO: 535062 - RNA, 13 nt, Chlamydophila pneumoniae J138
ccaaauaaagcaa

SEQ ID NO: 535063 - RNA, 15 nt, Chlamydophila pneumoniae J138
ccacaacauaacagg

SEQ ID NO: 535064 - RNA, 23 nt, Chlamydophila pneumoniae J138
ccacaaguuauccuuaucuugcu

SEQ ID NO: 535065 - RNA, 17 nt, Chlamydophila pneumoniae J138
ccacaaaccucuaaaaa

SEQ ID NO: 535066 - RNA, 16 nt, Chlamydophila pneumoniae J138
ccaaugagcucuauuu

SEQ ID NO: 535067 - RNA, 18 nt, Chlamydophila pneumoniae J138
ccaaugagcucuauuucu

SEQ ID NO: 535068 - RNA, 21 nt, Chlamydophila pneumoniae J138
ccaaugcaugaaucucuucug

SEQ ID NO: 535069 - RNA, 18 nt, Chlamydophila pneumoniae J138
ccaauaaauccaaaaaau

SEQ ID NO: 535070 - RNA, 13 nt, Chlamydophila pneumoniae J138
ccaaucuuccuua

SEQ ID NO: 535071 - RNA, 19 nt, Chlamydophila pneumoniae J138
ccacaauuccuaaaacaag

SEQ ID NO: 535072 - RNA, 13 nt, Chlamydophila pneumoniae J138
ccacaauuccuaa

SEQ ID NO: 535073 - RNA, 14 nt, Chlamydophila pneumoniae J138
ccacaauuccuaaa

SEQ ID NO: 535074 - RNA, 22 nt, Chlamydophila pneumoniae J138
ccacaucaaagcaauuucuccu

SEQ ID NO: 535075 - RNA, 16 nt, Chlamydophila pneumoniae J138
ccacaugcccaaacau

SEQ ID NO: 535076 - RNA, 20 nt, Chlamydophila pneumoniae J138
ccacauugcgggcucaaaga

SEQ ID NO: 535077 - RNA, 15 nt, Chlamydophila pneumoniae J138
ccacaugaaguccug

SEQ ID NO: 535078 - RNA, 22 nt, Chlamydophila pneumoniae J138
ccaccaaagugacuuccuccaa

SEQ ID NO: 535079 - RNA, 19 nt, Chlamydophila pneumoniae J138
ccaccaaagugacuuccuc

SEQ ID NO: 535080 - RNA, 16 nt, Chlamydophila pneumoniae J138
ccaccaacaaugcgau

SEQ ID NO: 535081 - RNA, 15 nt, Chlamydophila pneumoniae J138
ccacuggacuucguu

SEQ ID NO: 535082 - RNA, 15 nt, Chlamydophila pneumoniae J138
ccacuugcauggauc

SEQ ID NO: 535083 - RNA, 19 nt, Chlamydophila pneumoniae J138
ccagaauauagacuuguau

SEQ ID NO: 535084 - RNA, 12 nt, Chlamydophila pneumoniae J138
ccagaaggaagg

SEQ ID NO: 535085 - RNA, 21 nt, Chlamydophila pneumoniae J138
ccagaaucuccauuuagaaug

SEQ ID NO: 535086 - RNA, 14 nt, Chlamydophila pneumoniae J138
ccagaaauuacugu

SEQ ID NO: 535087 - RNA, 18 nt, Chlamydophila pneumoniae J138
ccagagacaaagccacag

SEQ ID NO: 535088 - RNA, 14 nt, Chlamydophila pneumoniae J138
ccagagagcuuuua

SEQ ID NO: 535089 - RNA, 18 nt, Chlamydophila pneumoniae J138
ccagauucugaagagaga

SEQ ID NO: 535090 - RNA, 18 nt, Chlamydophila pneumoniae J138
ccagaugauuuuuugaau

SEQ ID NO: 535091 - RNA, 16 nt, Chlamydophila pneumoniae J138
ccagaugauuuuuuga

SEQ ID NO: 535092 - RNA, 13 nt, Chlamydophila pneumoniae J138
ccagaugccuuga

SEQ ID NO: 535093 - RNA, 18 nt, Chlamydophila pneumoniae J138
ccagauaaagcaaagaua

SEQ ID NO: 535094 - RNA, 20 nt, Chlamydophila pneumoniae J138
ccagcaccuuuaggaagcug

SEQ ID NO: 535095 - RNA, 23 nt, Chlamydophila pneumoniae J138
ccagcaccuuuaggaagcuguac

SEQ ID NO: 535096 - RNA, 23 nt, Chlamydophila pneumoniae J138
ccagcauuaagauaaacagcaca

SEQ ID NO: 535097 - RNA, 18 nt, Chlamydophila pneumoniae J138
cagcucccaugugcugaa

SEQ ID NO: 535098 - RNA, 20 nt, Chlamydophila pneumoniae J138
cagcucccaugugcugaaga

SEQ ID NO: 535099 - RNA, 14 nt, Chlamydophila pneumoniae J138
cagcucccaugugc

SEQ ID NO: 535100 - RNA, 16 nt, Chlamydophila pneumoniae J138
cagcuccauuuaaaug

SEQ ID NO: 535101 - RNA, 12 nt, Chlamydophila pneumoniae J138
cagcuccauaag

SEQ ID NO: 535102 - RNA, 13 nt, Chlamydophila pneumoniae J138
cagcuccuggaua

SEQ ID NO: 535103 - RNA, 14 nt, Chlamydophila pneumoniae J138
cagcucggaaugcu

SEQ ID NO: 535104 - RNA, 19 nt, Chlamydophila pneumoniae J138
cagcuaauuuaaaugccuu

SEQ ID NO: 535105 - RNA, 22 nt, Chlamydophila pneumoniae J138
cagcuaauuuaaaugccuuaaa

SEQ ID NO: 535106 - RNA, 22 nt, Chlamydophila pneumoniae J138
aaaauuguuuguaucaaagaaa

SEQ ID NO: 535107 - RNA, 13 nt, Chlamydophila pneumoniae J138
aaaauuguuggaa

SEQ ID NO: 535108 - RNA, 22 nt, Chlamydophila pneumoniae J138
aaaauugcccauugaccugcuu

SEQ ID NO: 535109 - RNA, 21 nt, Chlamydophila pneumoniae J138
cagcgcugugaggaaaauucc

SEQ ID NO: 535110 - RNA, 19 nt, Chlamydophila pneumoniae J138
cagcuaaucauagccauca

SEQ ID NO: 535111 - RNA, 12 nt, Chlamydophila pneumoniae J138
caggaaauuccg

SEQ ID NO: 535112 - RNA, 13 nt, Chlamydophila pneumoniae J138
caggaacaaaggu

SEQ ID NO: 535113 - RNA, 23 nt, Chlamydophila pneumoniae J138
cagcuuugcuuaaaaagucugaa

SEQ ID NO: 535114 - RNA, 17 nt, Chlamydophila pneumoniae J138
cagcuuuuucaauagca

SEQ ID NO: 535115 - RNA, 14 nt, Chlamydophila pneumoniae J138
cagcuucuuuucca

SEQ ID NO: 535116 - RNA, 13 nt, Chlamydophila pneumoniae J138
cagcuucccaagc

SEQ ID NO: 535117 - RNA, 23 nt, Chlamydophila pneumoniae J138
cagcuucccaagcagaagacccu

SEQ ID NO: 535118 - RNA, 17 nt, Chlamydophila pneumoniae J138
cagcuucaggauuagua

SEQ ID NO: 535119 - RNA, 13 nt, Chlamydophila pneumoniae J138
cagcuguacagaa

SEQ ID NO: 535120 - RNA, 13 nt, Chlamydophila pneumoniae J138
caggaaguccaug

SEQ ID NO: 535121 - RNA, 19 nt, Chlamydophila pneumoniae J138
caggaaguccgauagcaau

SEQ ID NO: 535122 - RNA, 19 nt, Chlamydophila pneumoniae J138
caggaauaaucaaccaaaa

SEQ ID NO: 535123 - RNA, 17 nt, Chlamydophila pneumoniae J138
aaaauuuucaggaacuu

SEQ ID NO: 535124 - RNA, 12 nt, Chlamydophila pneumoniae J138
aaaauuuuccca

SEQ ID NO: 535125 - RNA, 16 nt, Chlamydophila pneumoniae J138
caggacgcacauuuag

SEQ ID NO: 535126 - RNA, 23 nt, Chlamydophila pneumoniae J138
caggacuguuuguuuauuaucua

SEQ ID NO: 535127 - RNA, 23 nt, Chlamydophila pneumoniae J138
caggagagagaaggcucucaagg

SEQ ID NO: 535128 - RNA, 14 nt, Chlamydophila pneumoniae J138
cagggaauagguag

SEQ ID NO: 535129 - RNA, 13 nt, Chlamydophila pneumoniae J138
caggcuucaccau

SEQ ID NO: 535130 - RNA, 21 nt, Chlamydophila pneumoniae J138
caggcuccaucacgaggagcu

SEQ ID NO: 535131 - RNA, 14 nt, Chlamydophila pneumoniae J138
caggcucaugaaau

SEQ ID NO: 535132 - RNA, 23 nt, Chlamydophila pneumoniae J138
cagggagaucuacgccuucaagu

SEQ ID NO: 535133 - RNA, 18 nt, Chlamydophila pneumoniae J138
caggccuggugcuuaaaa

SEQ ID NO: 535134 - RNA, 14 nt, Chlamydophila pneumoniae J138
caggccugaugucu

SEQ ID NO: 535135 - RNA, 13 nt, Chlamydophila pneumoniae J138
caggcauucuuca

SEQ ID NO: 535136 - RNA, 15 nt, Chlamydophila pneumoniae J138
caggcaucacuaauc

SEQ ID NO: 535137 - RNA, 15 nt, Chlamydophila pneumoniae J138
caggucugcugagga

SEQ ID NO: 535138 - RNA, 18 nt, Chlamydophila pneumoniae J138
cagguccuucuggaguga

SEQ ID NO: 535139 - RNA, 20 nt, Chlamydophila pneumoniae J138
caggucguaaacggacgcua

SEQ ID NO: 535140 - RNA, 18 nt, Chlamydophila pneumoniae J138
aaacaacugaaaaaccau

SEQ ID NO: 535141 - RNA, 23 nt, Chlamydophila pneumoniae J138
aaacaacgaucgucaguaaaaca

SEQ ID NO: 535142 - RNA, 16 nt, Chlamydophila pneumoniae J138
aaacaacuugguaagc

SEQ ID NO: 535143 - RNA, 14 nt, Chlamydophila pneumoniae J138
aaacaacaaacuac

SEQ ID NO: 535144 - RNA, 22 nt, Chlamydophila pneumoniae J138
caguaaaagacugaaaagaucg

SEQ ID NO: 535145 - RNA, 19 nt, Chlamydophila pneumoniae J138
caguaaaaggucugcgucu

SEQ ID NO: 535146 - RNA, 16 nt, Chlamydophila pneumoniae J138
caguaaaacacaaaua

SEQ ID NO: 535147 - RNA, 22 nt, Chlamydophila pneumoniae J138
caguaggcgaugcaaauuccag

SEQ ID NO: 535148 - RNA, 16 nt, Chlamydophila pneumoniae J138
caguauaaucagaagu

SEQ ID NO: 535149 - RNA, 17 nt, Chlamydophila pneumoniae J138
caguauaagaugcugaa

SEQ ID NO: 535150 - RNA, 13 nt, Chlamydophila pneumoniae J138
caguauagagaag

SEQ ID NO: 535151 - RNA, 14 nt, Chlamydophila pneumoniae J138
caguaguguaucua

SEQ ID NO: 535152 - RNA, 17 nt, Chlamydophila pneumoniae J138
caguagaggaauucugg

SEQ ID NO: 535153 - RNA, 16 nt, Chlamydophila pneumoniae J138
caguagaucuucugaa

SEQ ID NO: 535154 - RNA, 18 nt, Chlamydophila pneumoniae J138
caguacuaaauuaguaaa

SEQ ID NO: 535155 - RNA, 23 nt, Chlamydophila pneumoniae J138
caguauuccaucacaguuaagac

SEQ ID NO: 535156 - RNA, 18 nt, Chlamydophila pneumoniae J138
caguauucccuccgcagu

SEQ ID NO: 535157 - RNA, 15 nt, Chlamydophila pneumoniae J138
caguauuauaaauag

SEQ ID NO: 535158 - RNA, 23 nt, Chlamydophila pneumoniae J138
caguauuauaaauagaaaucuua

SEQ ID NO: 535159 - RNA, 17 nt, Chlamydophila pneumoniae J138
caguauggcguuuuuuu

SEQ ID NO: 535160 - RNA, 19 nt, Chlamydophila pneumoniae J138
cagugaacucuucaagagc

SEQ ID NO: 535161 - RNA, 15 nt, Chlamydophila pneumoniae J138
cagugaauccuucca

SEQ ID NO: 535162 - RNA, 15 nt, Chlamydophila pneumoniae J138
cagucugugagaaau

SEQ ID NO: 535163 - RNA, 14 nt, Chlamydophila pneumoniae J138
caguccucucccuu

SEQ ID NO: 535164 - RNA, 13 nt, Chlamydophila pneumoniae J138
caguccucucccu

SEQ ID NO: 535165 - RNA, 16 nt, Chlamydophila pneumoniae J138
cagucucgaguccagu

SEQ ID NO: 535166 - RNA, 22 nt, Chlamydophila pneumoniae J138
cagucuccuggaacaguauaau

SEQ ID NO: 535167 - RNA, 22 nt, Chlamydophila pneumoniae J138
cagucucauggauuacugaaga

SEQ ID NO: 535168 - RNA, 14 nt, Chlamydophila pneumoniae J138
cagucuccuggaac

SEQ ID NO: 535169 - RNA, 16 nt, Chlamydophila pneumoniae J138
cagcagcguccccccc

SEQ ID NO: 535170 - RNA, 20 nt, Chlamydophila pneumoniae J138
cagcagcgucccccccgggu

SEQ ID NO: 535171 - RNA, 15 nt, Chlamydophila pneumoniae J138
cagcagaaucauaau

SEQ ID NO: 535172 - RNA, 22 nt, Chlamydophila pneumoniae J138
cagcagcugucaauccaacaaa

SEQ ID NO: 535173 - RNA, 18 nt, Chlamydophila pneumoniae J138
cagcagcugucaauccaa

SEQ ID NO: 535174 - RNA, 18 nt, Chlamydophila pneumoniae J138
cagcauaaaaauucucau

SEQ ID NO: 535175 - RNA, 18 nt, Chlamydophila pneumoniae J138
cagcaucaggauucucuc

SEQ ID NO: 535176 - RNA, 19 nt, Chlamydophila pneumoniae J138
cagcauggacuccaagaau

SEQ ID NO: 535177 - RNA, 15 nt, Chlamydophila pneumoniae J138
cagcauggacuccaa

SEQ ID NO: 535178 - RNA, 20 nt, Chlamydophila pneumoniae J138
cagcauuaagauaaacagca

SEQ ID NO: 535179 - RNA, 19 nt, Chlamydophila pneumoniae J138
cagcaugugcagaagguuc

SEQ ID NO: 535180 - RNA, 22 nt, Chlamydophila pneumoniae J138
cagcauuaagauaaacagcaca

SEQ ID NO: 535181 - RNA, 23 nt, Chlamydophila pneumoniae J138
cagcauuaagauaaacagcacag

SEQ ID NO: 535182 - RNA, 17 nt, Chlamydophila pneumoniae J138
cagcauugccuggggau

SEQ ID NO: 535183 - RNA, 12 nt, Chlamydophila pneumoniae J138
cagcccugccuc

SEQ ID NO: 535184 - RNA, 15 nt, Chlamydophila pneumoniae J138
cagccugcaccagac

SEQ ID NO: 535185 - RNA, 22 nt, Chlamydophila pneumoniae J138
cagccuggaaagcuucuggauu

SEQ ID NO: 535186 - RNA, 22 nt, Chlamydophila pneumoniae J138
cagccuguaaagaaggaggucc

SEQ ID NO: 535187 - RNA, 13 nt, Chlamydophila pneumoniae J138
cagccugucuaua

SEQ ID NO: 535188 - RNA, 24 nt, Chlamydophila pneumoniae J138
cagcgacaacacgcccacggaaag

SEQ ID NO: 535189 - RNA, 20 nt, Chlamydophila pneumoniae J138
cacgucuaagaaucguucuu

SEQ ID NO: 535190 - RNA, 17 nt, Chlamydophila pneumoniae J138
cacuuucuuuuuuaauc

SEQ ID NO: 535191 - RNA, 14 nt, Chlamydophila pneumoniae J138
cagaaaaagaacau

SEQ ID NO: 535192 - RNA, 18 nt, Chlamydophila pneumoniae J138
cagaaacacugaacgcca

SEQ ID NO: 535193 - RNA, 20 nt, Chlamydophila pneumoniae J138
cagaaauggcauagggauga

SEQ ID NO: 535194 - RNA, 13 nt, Chlamydophila pneumoniae J138
cagaacaacgcug

SEQ ID NO: 535195 - RNA, 19 nt, Chlamydophila pneumoniae J138
cagaacaacgcugcuucuc

SEQ ID NO: 535196 - RNA, 20 nt, Chlamydophila pneumoniae J138
cagaacaacgcugcuucucu

SEQ ID NO: 535197 - RNA, 21 nt, Chlamydophila pneumoniae J138
cagaacaacgcugcuucucua

SEQ ID NO: 535198 - RNA, 22 nt, Chlamydophila pneumoniae J138
cagaacaccaucacauccugua

SEQ ID NO: 535199 - RNA, 21 nt, Chlamydophila pneumoniae J138
cagaagcaacuaaacucucca

SEQ ID NO: 535200 - RNA, 13 nt, Chlamydophila pneumoniae J138
cagaagcaaaggu

SEQ ID NO: 535201 - RNA, 20 nt, Chlamydophila pneumoniae J138
cagaagcauugaggacaaca

SEQ ID NO: 535202 - RNA, 17 nt, Chlamydophila pneumoniae J138
cagaauugcaaaguacu

SEQ ID NO: 535203 - RNA, 16 nt, Chlamydophila pneumoniae J138
cagacuugaggaaucu

SEQ ID NO: 535204 - RNA, 17 nt, Chlamydophila pneumoniae J138
aaaaucaagaagagaaa

SEQ ID NO: 535205 - RNA, 14 nt, Chlamydophila pneumoniae J138
aaaaucaaauagau

SEQ ID NO: 535206 - RNA, 18 nt, Chlamydophila pneumoniae J138
cagagaauguucccaaau

SEQ ID NO: 535207 - RNA, 19 nt, Chlamydophila pneumoniae J138
cagagaaauuaacagagcg

SEQ ID NO: 535208 - RNA, 14 nt, Chlamydophila pneumoniae J138
cagagaacaauaaa

SEQ ID NO: 535209 - RNA, 16 nt, Chlamydophila pneumoniae J138
cagaggaaucuaagaa

SEQ ID NO: 535210 - RNA, 18 nt, Chlamydophila pneumoniae J138
cagagcuucuaaaaacuc

SEQ ID NO: 535211 - RNA, 19 nt, Chlamydophila pneumoniae J138
cagagcuucuaaaaacucu

SEQ ID NO: 535212 - RNA, 18 nt, Chlamydophila pneumoniae J138
cagaguggucauugccuu

SEQ ID NO: 535213 - RNA, 13 nt, Chlamydophila pneumoniae J138
cagagucugggau

SEQ ID NO: 535214 - RNA, 20 nt, Chlamydophila pneumoniae J138
cagagucagaagcuauucca

SEQ ID NO: 535215 - RNA, 15 nt, Chlamydophila pneumoniae J138
cagaguccuucuuuu

SEQ ID NO: 535216 - RNA, 14 nt, Chlamydophila pneumoniae J138
cagagagaacagga

SEQ ID NO: 535217 - RNA, 17 nt, Chlamydophila pneumoniae J138
cagagaccuucucuuca

SEQ ID NO: 535218 - RNA, 16 nt, Chlamydophila pneumoniae J138
cagagacuuccucuuc

SEQ ID NO: 535219 - RNA, 20 nt, Chlamydophila pneumoniae J138
aaaaucauaggcuauaauua

SEQ ID NO: 535220 - RNA, 11 nt, Chlamydophila pneumoniae J138
aaaaugaccgc

SEQ ID NO: 535221 - RNA, 17 nt, Chlamydophila pneumoniae J138
cagcaagaucuaacuuc

SEQ ID NO: 535222 - RNA, 23 nt, Chlamydophila pneumoniae J138
cagcacaagaaccuguuuuucua

SEQ ID NO: 535223 - RNA, 12 nt, Chlamydophila pneumoniae J138
cagcaaggaagu

SEQ ID NO: 535224 - RNA, 21 nt, Chlamydophila pneumoniae J138
aaaaucuccucucucaauaag

SEQ ID NO: 535225 - RNA, 16 nt, Chlamydophila pneumoniae J138
cagauguuuucguaaa

SEQ ID NO: 535226 - RNA, 22 nt, Chlamydophila pneumoniae J138
cagauguuuucguaaauaugaa

SEQ ID NO: 535227 - RNA, 19 nt, Chlamydophila pneumoniae J138
aaaaucucuaagaaucuau

SEQ ID NO: 535228 - RNA, 19 nt, Chlamydophila pneumoniae J138
aaaaucugcagcagauacc

SEQ ID NO: 535229 - RNA, 14 nt, Chlamydophila pneumoniae J138
cagaugcuucaagg

SEQ ID NO: 535230 - RNA, 19 nt, Chlamydophila pneumoniae J138
cagaugcuucaaggcaucu

SEQ ID NO: 535231 - RNA, 16 nt, Chlamydophila pneumoniae J138
cagauggucagucucg

SEQ ID NO: 535232 - RNA, 16 nt, Chlamydophila pneumoniae J138
cagauuguucaaaaau

SEQ ID NO: 535233 - RNA, 18 nt, Chlamydophila pneumoniae J138
cagauuagaguuagaugu

SEQ ID NO: 535234 - RNA, 18 nt, Chlamydophila pneumoniae J138
cagauuagaaaagauaaa

SEQ ID NO: 535235 - RNA, 13 nt, Chlamydophila pneumoniae J138
aaaaugaaagaaa

SEQ ID NO: 535236 - RNA, 16 nt, Chlamydophila pneumoniae J138
cagaucugcauaauuu

SEQ ID NO: 535237 - RNA, 20 nt, Chlamydophila pneumoniae J138
cagaucugcauaauuuuucu

SEQ ID NO: 535238 - RNA, 17 nt, Chlamydophila pneumoniae J138
cagaucuuuuaugcgag

SEQ ID NO: 535239 - RNA, 15 nt, Chlamydophila pneumoniae J138
cagaugauuuuaucu

SEQ ID NO: 535240 - RNA, 23 nt, Chlamydophila pneumoniae J138
cagaugagagguguacaguugcg

SEQ ID NO: 535241 - RNA, 12 nt, Chlamydophila pneumoniae J138
uuuuuuaaccuc

SEQ ID NO: 535242 - RNA, 19 nt, Chlamydophila pneumoniae J138
uuuuuuaaagcuauuguuu

SEQ ID NO: 535243 - RNA, 17 nt, Chlamydophila pneumoniae J138
uuuuuguuaaauuccca

SEQ ID NO: 535244 - RNA, 13 nt, Chlamydophila pneumoniae J138
uuuuucuuaguau

SEQ ID NO: 535245 - RNA, 20 nt, Chlamydophila pneumoniae J138
uuuuucuugaaaaauccuga

SEQ ID NO: 535246 - RNA, 14 nt, Chlamydophila pneumoniae J138
uuuuugaaaacuuc

SEQ ID NO: 535247 - RNA, 13 nt, Chlamydophila pneumoniae J138
uuuuugaaaauuu

SEQ ID NO: 535248 - RNA, 19 nt, Chlamydophila pneumoniae J138
uuuugauucccuccuuccu

SEQ ID NO: 535249 - RNA, 17 nt, Chlamydophila pneumoniae J138
uuuuuccaacuucaacu

SEQ ID NO: 535250 - RNA, 15 nt, Chlamydophila pneumoniae J138
uuuuuccaacuucaa

SEQ ID NO: 535251 - RNA, 18 nt, Chlamydophila pneumoniae J138
uuuuucccuuuaaaagua

SEQ ID NO: 535252 - RNA, 19 nt, Chlamydophila pneumoniae J138
uuuuucccuuuaaaaguac

SEQ ID NO: 535253 - RNA, 16 nt, Chlamydophila pneumoniae J138
uuuuucccucgcuaaa

SEQ ID NO: 535254 - RNA, 14 nt, Chlamydophila pneumoniae J138
uuuuucccucgcua

SEQ ID NO: 535255 - RNA, 10 nt, Chlamydophila pneumoniae J138
uuuuucucuu

SEQ ID NO: 535256 - RNA, 18 nt, Chlamydophila pneumoniae J138
uuuuaagugcuuuuagau

SEQ ID NO: 535257 - RNA, 14 nt, Chlamydophila pneumoniae J138
uuuuaauaaaauuu

SEQ ID NO: 535258 - RNA, 20 nt, Chlamydophila pneumoniae J138
uuuuaaagcaaaaauucuag

SEQ ID NO: 535259 - RNA, 18 nt, Chlamydophila pneumoniae J138
uuuuaaagcaaaaauucu

SEQ ID NO: 535260 - RNA, 19 nt, Chlamydophila pneumoniae J138
uuuuaaagauaaggaccag

SEQ ID NO: 535261 - RNA, 16 nt, Chlamydophila pneumoniae J138
uuuuaaaaugugucuu

SEQ ID NO: 535262 - RNA, 16 nt, Chlamydophila pneumoniae J138
uuuguuuuuccauuuu

SEQ ID NO: 535263 - RNA, 18 nt, Chlamydophila pneumoniae J138
uuuguuaauagaagauca

SEQ ID NO: 535264 - RNA, 18 nt, Chlamydophila pneumoniae J138
uuugugaagauaagacca

SEQ ID NO: 535265 - RNA, 17 nt, Chlamydophila pneumoniae J138
uuuggcaguucacugag

SEQ ID NO: 535266 - RNA, 22 nt, Chlamydophila pneumoniae J138
uuuggauagaagcaugaagcag

SEQ ID NO: 535267 - RNA, 14 nt, Chlamydophila pneumoniae J138
uuuggaaagaagag

SEQ ID NO: 535268 - RNA, 14 nt, Chlamydophila pneumoniae J138
uuuggaaaugagag

SEQ ID NO: 535269 - RNA, 17 nt, Chlamydophila pneumoniae J138
uuugcuacagcuucuuu

SEQ ID NO: 535270 - RNA, 17 nt, Chlamydophila pneumoniae J138
uuugcuggagacaacua

SEQ ID NO: 535271 - RNA, 14 nt, Chlamydophila pneumoniae J138
uuugcugcucucca

SEQ ID NO: 535272 - RNA, 18 nt, Chlamydophila pneumoniae J138
uuugcugaagauuuuuuc

SEQ ID NO: 535273 - RNA, 14 nt, Chlamydophila pneumoniae J138
uuugcugaagauuu

SEQ ID NO: 535274 - RNA, 14 nt, Chlamydophila pneumoniae J138
uuugcuccuccaaa

SEQ ID NO: 535275 - RNA, 23 nt, Chlamydophila pneumoniae J138
uuugggauaaaaaguuuuuguuc

SEQ ID NO: 535276 - RNA, 17 nt, Chlamydophila pneumoniae J138
uuuguaaucguuucaua

SEQ ID NO: 535277 - RNA, 14 nt, Chlamydophila pneumoniae J138
uuuguagcauuucu

SEQ ID NO: 535278 - RNA, 16 nt, Chlamydophila pneumoniae J138
uuuucuuccaaagacu

SEQ ID NO: 535279 - RNA, 12 nt, Chlamydophila pneumoniae J138
uuuucuuccaaa

SEQ ID NO: 535280 - RNA, 17 nt, Chlamydophila pneumoniae J138
uuuucuuccacacaacu

SEQ ID NO: 535281 - RNA, 13 nt, Chlamydophila pneumoniae J138
uuuucuucucuaa

SEQ ID NO: 535282 - RNA, 21 nt, Chlamydophila pneumoniae J138
uuuucuucugacauuccuuaa

SEQ ID NO: 535283 - RNA, 22 nt, Chlamydophila pneumoniae J138
uuuucuuauagggaauuuuuuc

SEQ ID NO: 535284 - RNA, 16 nt, Chlamydophila pneumoniae J138
uuuucuuaucaugaaa

SEQ ID NO: 535285 - RNA, 11 nt, Chlamydophila pneumoniae J138
uuuucuagaaa

SEQ ID NO: 535286 - RNA, 13 nt, Chlamydophila pneumoniae J138
uuuugaagugcuu

SEQ ID NO: 535287 - RNA, 13 nt, Chlamydophila pneumoniae J138
uuuugauaccucu

SEQ ID NO: 535288 - RNA, 13 nt, Chlamydophila pneumoniae J138
uuuugaaaauuuu

SEQ ID NO: 535289 - RNA, 23 nt, Chlamydophila pneumoniae J138
uuuuccauacccaaauuucuucu

SEQ ID NO: 535290 - RNA, 16 nt, Chlamydophila pneumoniae J138
uuuucccacagcuugc

SEQ ID NO: 535291 - RNA, 21 nt, Chlamydophila pneumoniae J138
uuuuccccuuggaaaucagaa

SEQ ID NO: 535292 - RNA, 16 nt, Chlamydophila pneumoniae J138
uuuucccuuuuuagaa

SEQ ID NO: 535293 - RNA, 23 nt, Chlamydophila pneumoniae J138
uuuucuagaaacugcuccugaag

SEQ ID NO: 535294 - RNA, 22 nt, Chlamydophila pneumoniae J138
uuuucuagcauaguguuccaaa

SEQ ID NO: 535295 - RNA, 21 nt, Chlamydophila pneumoniae J138
uuuucuagaaaagauucuaaa

SEQ ID NO: 535296 - RNA, 22 nt, Chlamydophila pneumoniae J138
uuuucuagaaaagauucuaaau

SEQ ID NO: 535297 - RNA, 22 nt, Chlamydophila pneumoniae J138
uuuucuagucgugccaaugugc

SEQ ID NO: 535298 - RNA, 22 nt, Chlamydophila pneumoniae J138
uuuucuaagauuccuaacuucu

SEQ ID NO: 535299 - RNA, 14 nt, Chlamydophila pneumoniae J138
uuuucuaagagauc

SEQ ID NO: 535300 - RNA, 20 nt, Chlamydophila pneumoniae J138
uuuuccauacccaaauuucu

SEQ ID NO: 535301 - RNA, 20 nt, Chlamydophila pneumoniae J138
uuuuccaggaccaaacuucg

SEQ ID NO: 535302 - RNA, 17 nt, Chlamydophila pneumoniae J138
uuuucaauaaccagaag

SEQ ID NO: 535303 - RNA, 13 nt, Chlamydophila pneumoniae J138
uuuucaauaacca

SEQ ID NO: 535304 - RNA, 16 nt, Chlamydophila pneumoniae J138
uuuuauuuccuuaucc

SEQ ID NO: 535305 - RNA, 14 nt, Chlamydophila pneumoniae J138
uuuuauugauaaug

SEQ ID NO: 535306 - RNA, 20 nt, Chlamydophila pneumoniae J138
uuuuaggaguugguugcagu

SEQ ID NO: 535307 - RNA, 23 nt, Chlamydophila pneumoniae J138
uuuuaggaucuuuguugagaagg

SEQ ID NO: 535308 - RNA, 20 nt, Chlamydophila pneumoniae J138
uuuuaggacgcuauccuauu

SEQ ID NO: 535309 - RNA, 16 nt, Chlamydophila pneumoniae J138
uuuuauaggaauaaca

SEQ ID NO: 535310 - RNA, 17 nt, Chlamydophila pneumoniae J138
uuuuauccaccaagacu

SEQ ID NO: 535311 - RNA, 22 nt, Chlamydophila pneumoniae J138
uuuuaccaauaaggauagcauu

SEQ ID NO: 535312 - RNA, 13 nt, Chlamydophila pneumoniae J138
uuuuaauucaaaa

SEQ ID NO: 535313 - RNA, 17 nt, Chlamydophila pneumoniae J138
uuuuaauucaaaaagag

SEQ ID NO: 535314 - RNA, 22 nt, Chlamydophila pneumoniae J138
uuuuagcauaaucuuuaacaaa

SEQ ID NO: 535315 - RNA, 23 nt, Chlamydophila pneumoniae J138
uuuuagacgugcucucuucuucu

SEQ ID NO: 535316 - RNA, 15 nt, Chlamydophila pneumoniae J138
uuuuagagccuuuuc

SEQ ID NO: 535317 - RNA, 14 nt, Chlamydophila pneumoniae J138
uuuuagaacuucaa

SEQ ID NO: 535318 - RNA, 14 nt, Chlamydophila pneumoniae J138
uuuuacgaauuuca

SEQ ID NO: 535319 - RNA, 15 nt, Chlamydophila pneumoniae J138
uuuuacgaaucuuuu

SEQ ID NO: 535320 - RNA, 14 nt, Chlamydophila pneumoniae J138
uuuuacuaucuccu

SEQ ID NO: 535321 - RNA, 13 nt, Chlamydophila pneumoniae J138
uuuuacuaucucc

SEQ ID NO: 535322 - RNA, 15 nt, Chlamydophila pneumoniae J138
uuuccaggaccaaac

SEQ ID NO: 535323 - RNA, 18 nt, Chlamydophila pneumoniae J138
uuuccauaggaucugcau

SEQ ID NO: 535324 - RNA, 14 nt, Chlamydophila pneumoniae J138
uuuccauaggaucu

SEQ ID NO: 535325 - RNA, 20 nt, Chlamydophila pneumoniae J138
uuuccauacccaaauuucuu

SEQ ID NO: 535326 - RNA, 22 nt, Chlamydophila pneumoniae J138
uuuccauacccaaauuucuucu

SEQ ID NO: 535327 - RNA, 12 nt, Chlamydophila pneumoniae J138
uuucccacagcu

SEQ ID NO: 535328 - RNA, 22 nt, Chlamydophila pneumoniae J138
uuucccccugaaugcaacagag

SEQ ID NO: 535329 - RNA, 19 nt, Chlamydophila pneumoniae J138
uuuccccuuggaaaucaga

SEQ ID NO: 535330 - RNA, 17 nt, Chlamydophila pneumoniae J138
uuucccuccaccagaag

SEQ ID NO: 535331 - RNA, 23 nt, Chlamydophila pneumoniae J138
uuucccuaaaaugagauuccuau

SEQ ID NO: 535332 - RNA, 15 nt, Chlamydophila pneumoniae J138
uuucccuucuaagga

SEQ ID NO: 535333 - RNA, 18 nt, Chlamydophila pneumoniae J138
uuuccuaccuauauuuuu

SEQ ID NO: 535334 - RNA, 19 nt, Chlamydophila pneumoniae J138
uuuccggggagaacuucaa

SEQ ID NO: 535335 - RNA, 14 nt, Chlamydophila pneumoniae J138
uuuccuaguccucu

SEQ ID NO: 535336 - RNA, 22 nt, Chlamydophila pneumoniae J138
uuuccucuaucagggagcggaa

SEQ ID NO: 535337 - RNA, 16 nt, Chlamydophila pneumoniae J138
uuuccucucaugaaau

SEQ ID NO: 535338 - RNA, 16 nt, Chlamydophila pneumoniae J138
uuucgcagauacuucu

SEQ ID NO: 535339 - RNA, 17 nt, Chlamydophila pneumoniae J138
uuuccuugguaucccaa

SEQ ID NO: 535340 - RNA, 23 nt, Chlamydophila pneumoniae J138
uuucgaagcgcucuacaaaugcg

SEQ ID NO: 535341 - RNA, 14 nt, Chlamydophila pneumoniae J138
uuucgaagcgcucu

SEQ ID NO: 535342 - RNA, 22 nt, Chlamydophila pneumoniae J138
uuucgaagcgcucuacaaaugc

SEQ ID NO: 535343 - RNA, 22 nt, Chlamydophila pneumoniae J138
uuucgaacacgucgaacaugac

SEQ ID NO: 535344 - RNA, 17 nt, Chlamydophila pneumoniae J138
uuuccuuuucuccuucu

SEQ ID NO: 535345 - RNA, 18 nt, Chlamydophila pneumoniae J138
uuuccuuuucuccuucug

SEQ ID NO: 535346 - RNA, 19 nt, Chlamydophila pneumoniae J138
uuuccuuuucuccuucugg

SEQ ID NO: 535347 - RNA, 20 nt, Chlamydophila pneumoniae J138
uuucuacugaaaccuucucu

SEQ ID NO: 535348 - RNA, 19 nt, Chlamydophila pneumoniae J138
uuucuacuucaggaaauaa

SEQ ID NO: 535349 - RNA, 21 nt, Chlamydophila pneumoniae J138
uuucuagaaaagauucuaaau

SEQ ID NO: 535350 - RNA, 22 nt, Chlamydophila pneumoniae J138
uuucuagaaaacgccaacugua

SEQ ID NO: 535351 - RNA, 18 nt, Chlamydophila pneumoniae J138
uuucuaggaaucuuuuag

SEQ ID NO: 535352 - RNA, 22 nt, Chlamydophila pneumoniae J138
uuucuaggacagcacauagagu

SEQ ID NO: 535353 - RNA, 23 nt, Chlamydophila pneumoniae J138
uuucuaguucguucaucugucau

SEQ ID NO: 535354 - RNA, 20 nt, Chlamydophila pneumoniae J138
uuucuaagauuccuaacuuc

SEQ ID NO: 535355 - RNA, 20 nt, Chlamydophila pneumoniae J138
uuucuaagcaauauuucugu

SEQ ID NO: 535356 - RNA, 18 nt, Chlamydophila pneumoniae J138
uuucuaagauuccuaacu

SEQ ID NO: 535357 - RNA, 19 nt, Chlamydophila pneumoniae J138
uuucuaagagaucuacaaa

SEQ ID NO: 535358 - RNA, 19 nt, Chlamydophila pneumoniae J138
uuucuaaauagaaaacaua

SEQ ID NO: 535359 - RNA, 14 nt, Chlamydophila pneumoniae J138
uuucuaaauacuua

SEQ ID NO: 535360 - RNA, 14 nt, Chlamydophila pneumoniae J138
uuucguuuuuucuu

SEQ ID NO: 535361 - RNA, 15 nt, Chlamydophila pneumoniae J138
uuucgugaacaaaau

SEQ ID NO: 535362 - RNA, 14 nt, Chlamydophila pneumoniae J138
uuucgucuaaaaua

SEQ ID NO: 535363 - RNA, 22 nt, Chlamydophila pneumoniae J138
uuucuauuucgucgucauccca

SEQ ID NO: 535364 - RNA, 12 nt, Chlamydophila pneumoniae J138
uuucuauuuuca

SEQ ID NO: 535365 - RNA, 17 nt, Chlamydophila pneumoniae J138
uuucucaauaguguaac

SEQ ID NO: 535366 - RNA, 16 nt, Chlamydophila pneumoniae J138
uuucucauagguaaua

SEQ ID NO: 535367 - RNA, 15 nt, Chlamydophila pneumoniae J138
uuucucauagcuucc

SEQ ID NO: 535368 - RNA, 22 nt, Chlamydophila pneumoniae J138
uuucucaccacggaagauaugu

SEQ ID NO: 535369 - RNA, 16 nt, Chlamydophila pneumoniae J138
uuucuccuucucccug

SEQ ID NO: 535370 - RNA, 21 nt, Chlamydophila pneumoniae J138
uuucucuaagcagccucuucu

SEQ ID NO: 535371 - RNA, 20 nt, Chlamydophila pneumoniae J138
uuucucucuuuaucuuuaag

SEQ ID NO: 535372 - RNA, 16 nt, Chlamydophila pneumoniae J138
uuucugaaacaaugca

SEQ ID NO: 535373 - RNA, 13 nt, Chlamydophila pneumoniae J138
uuucugaagauuu

SEQ ID NO: 535374 - RNA, 13 nt, Chlamydophila pneumoniae J138
uuucugcucuucu

SEQ ID NO: 535375 - RNA, 14 nt, Chlamydophila pneumoniae J138
uuugaagcuccuca

SEQ ID NO: 535376 - RNA, 23 nt, Chlamydophila pneumoniae J138
uuugaaauaauuuucagucuucc

SEQ ID NO: 535377 - RNA, 21 nt, Chlamydophila pneumoniae J138
uuucuuuuagcuacuucuucu

SEQ ID NO: 535378 - RNA, 14 nt, Chlamydophila pneumoniae J138
uuucuuuccaucau

SEQ ID NO: 535379 - RNA, 14 nt, Chlamydophila pneumoniae J138
uuucuuuauucccu

SEQ ID NO: 535380 - RNA, 13 nt, Chlamydophila pneumoniae J138
uuucuuucuaaga

SEQ ID NO: 535381 - RNA, 19 nt, Chlamydophila pneumoniae J138
uuucuuuucugaagauuuu

SEQ ID NO: 535382 - RNA, 14 nt, Chlamydophila pneumoniae J138
uuugaaaauauccu

SEQ ID NO: 535383 - RNA, 15 nt, Chlamydophila pneumoniae J138
uuugacuugucccaa

SEQ ID NO: 535384 - RNA, 18 nt, Chlamydophila pneumoniae J138
uuugacuuucauaugaau

SEQ ID NO: 535385 - RNA, 23 nt, Chlamydophila pneumoniae J138
uuugaccagaugauuuuuugaau

SEQ ID NO: 535386 - RNA, 15 nt, Chlamydophila pneumoniae J138
uuugaauucugauga

SEQ ID NO: 535387 - RNA, 14 nt, Chlamydophila pneumoniae J138
uuugacaaauuuau

SEQ ID NO: 535388 - RNA, 13 nt, Chlamydophila pneumoniae J138
uuugacaacacca

SEQ ID NO: 535389 - RNA, 20 nt, Chlamydophila pneumoniae J138
uuucuuguaagacuaaaaaa

SEQ ID NO: 535390 - RNA, 11 nt, Chlamydophila pneumoniae J138
uuucuuguucc

SEQ ID NO: 535391 - RNA, 22 nt, Chlamydophila pneumoniae J138
uuucuugugguuuuucuccucu

SEQ ID NO: 535392 - RNA, 15 nt, Chlamydophila pneumoniae J138
uuucuuuauucccuu

SEQ ID NO: 535393 - RNA, 12 nt, Chlamydophila pneumoniae J138
uuucuuguugca

SEQ ID NO: 535394 - RNA, 18 nt, Chlamydophila pneumoniae J138
uuucuucucuaagaaauu

SEQ ID NO: 535395 - RNA, 20 nt, Chlamydophila pneumoniae J138
uuucuucucuaggaagauuu

SEQ ID NO: 535396 - RNA, 14 nt, Chlamydophila pneumoniae J138
uuucuucuucuaaa

SEQ ID NO: 535397 - RNA, 16 nt, Chlamydophila pneumoniae J138
uuucuguucugcuucu

SEQ ID NO: 535398 - RNA, 20 nt, Chlamydophila pneumoniae J138
uuucuguucugcuucuguaa

SEQ ID NO: 535399 - RNA, 13 nt, Chlamydophila pneumoniae J138
uuucuguuccuga

SEQ ID NO: 535400 - RNA, 20 nt, Chlamydophila pneumoniae J138
uuucuguacaacaaaauuug

SEQ ID NO: 535401 - RNA, 22 nt, Chlamydophila pneumoniae J138
uuugagacgaaagagauuucuu

SEQ ID NO: 535402 - RNA, 13 nt, Chlamydophila pneumoniae J138
uuugagaaugaac

SEQ ID NO: 535403 - RNA, 14 nt, Chlamydophila pneumoniae J138
uuugaucuucucua

SEQ ID NO: 535404 - RNA, 18 nt, Chlamydophila pneumoniae J138
uuugaugaucgaucccuu

SEQ ID NO: 535405 - RNA, 17 nt, Chlamydophila pneumoniae J138
uuugaugcuucuuucaa

SEQ ID NO: 535406 - RNA, 18 nt, Chlamydophila pneumoniae J138
uuugaugcuucuuucaaa

SEQ ID NO: 535407 - RNA, 13 nt, Chlamydophila pneumoniae J138
uuugauucauaaa

SEQ ID NO: 535408 - RNA, 13 nt, Chlamydophila pneumoniae J138
uuugcaaaucuuc

SEQ ID NO: 535409 - RNA, 18 nt, Chlamydophila pneumoniae J138
uuugcaaaugaaaagaga

SEQ ID NO: 535410 - RNA, 18 nt, Chlamydophila pneumoniae J138
uuugcaacaaucuuucuu

SEQ ID NO: 535411 - RNA, 21 nt, Chlamydophila pneumoniae J138
uuugccuuuagggaaaaagua

SEQ ID NO: 535412 - RNA, 20 nt, Chlamydophila pneumoniae J138
uuucacaagcauaaacuccu

SEQ ID NO: 535413 - RNA, 20 nt, Chlamydophila pneumoniae J138
uuucaacauaacaugagaaa

SEQ ID NO: 535414 - RNA, 16 nt, Chlamydophila pneumoniae J138
uuucaacaccucaaua

SEQ ID NO: 535415 - RNA, 20 nt, Chlamydophila pneumoniae J138
uuucaagcuuucguuuucua

SEQ ID NO: 535416 - RNA, 16 nt, Chlamydophila pneumoniae J138
uuucaagaacuccuuu

SEQ ID NO: 535417 - RNA, 19 nt, Chlamydophila pneumoniae J138
uuucaagauugugcucaau

SEQ ID NO: 535418 - RNA, 12 nt, Chlamydophila pneumoniae J138
uuucaauagcuu

SEQ ID NO: 535419 - RNA, 21 nt, Chlamydophila pneumoniae J138
uuucaauaaccagaagacucc

SEQ ID NO: 535420 - RNA, 15 nt, Chlamydophila pneumoniae J138
uuucaauccuuccuu

SEQ ID NO: 535421 - RNA, 21 nt, Chlamydophila pneumoniae J138
uuuauuuaaauaaaaccacuu

SEQ ID NO: 535422 - RNA, 16 nt, Chlamydophila pneumoniae J138
uuuauuagaaguaucu

SEQ ID NO: 535423 - RNA, 22 nt, Chlamydophila pneumoniae J138
uuucaaaggcaacgcgauuuuc

SEQ ID NO: 535424 - RNA, 14 nt, Chlamydophila pneumoniae J138
uuucaaauucugaa

SEQ ID NO: 535425 - RNA, 22 nt, Chlamydophila pneumoniae J138
uuuauuuuaggaagcuuaucaa

SEQ ID NO: 535426 - RNA, 19 nt, Chlamydophila pneumoniae J138
uuuauuuugaugcuucuuu

SEQ ID NO: 535427 - RNA, 22 nt, Chlamydophila pneumoniae J138
uuucaggaaacucaaucucuuu

SEQ ID NO: 535428 - RNA, 18 nt, Chlamydophila pneumoniae J138
uuucagcaugugcagaag

SEQ ID NO: 535429 - RNA, 14 nt, Chlamydophila pneumoniae J138
uuucagauguacaa

SEQ ID NO: 535430 - RNA, 12 nt, Chlamydophila pneumoniae J138
uuucagauuuuu

SEQ ID NO: 535431 - RNA, 14 nt, Chlamydophila pneumoniae J138
uuucagauuuuuua

SEQ ID NO: 535432 - RNA, 22 nt, Chlamydophila pneumoniae J138
uuucaguuguuucuagaaaauc

SEQ ID NO: 535433 - RNA, 16 nt, Chlamydophila pneumoniae J138
uuucagucuuccuuua

SEQ ID NO: 535434 - RNA, 21 nt, Chlamydophila pneumoniae J138
uuucaguuuuaucggcaauug

SEQ ID NO: 535435 - RNA, 21 nt, Chlamydophila pneumoniae J138
uuucauauaaaguuuccaagu

SEQ ID NO: 535436 - RNA, 15 nt, Chlamydophila pneumoniae J138
uuucaucuucuuucu

SEQ ID NO: 535437 - RNA, 17 nt, Chlamydophila pneumoniae J138
uuucauuugaaauauga

SEQ ID NO: 535438 - RNA, 18 nt, Chlamydophila pneumoniae J138
uuucauucccuuuuucca

SEQ ID NO: 535439 - RNA, 13 nt, Chlamydophila pneumoniae J138
uuucauucccuuu

SEQ ID NO: 535440 - RNA, 23 nt, Chlamydophila pneumoniae J138
uuucauucccuuuuuccauaccc

SEQ ID NO: 535441 - RNA, 23 nt, Chlamydophila pneumoniae J138
uuuccaagugaucagaaaugaag

SEQ ID NO: 535442 - RNA, 13 nt, Chlamydophila pneumoniae J138
uuuccaacuucaa

SEQ ID NO: 535443 - RNA, 17 nt, Chlamydophila pneumoniae J138
uuuccaaagaucgaucu

SEQ ID NO: 535444 - RNA, 15 nt, Chlamydophila pneumoniae J138
uuuacgaugagguug

SEQ ID NO: 535445 - RNA, 21 nt, Chlamydophila pneumoniae J138
uuuagaagguguuuuggcugc

SEQ ID NO: 535446 - RNA, 13 nt, Chlamydophila pneumoniae J138
uuuagaacuucaa

SEQ ID NO: 535447 - RNA, 17 nt, Chlamydophila pneumoniae J138
uuuagagccuuuucaga

SEQ ID NO: 535448 - RNA, 21 nt, Chlamydophila pneumoniae J138
uuuagaguacacagcacaaga

SEQ ID NO: 535449 - RNA, 19 nt, Chlamydophila pneumoniae J138
uuuagacgaggagaagucg

SEQ ID NO: 535450 - RNA, 13 nt, Chlamydophila pneumoniae J138
uuuagagaaaucu

SEQ ID NO: 535451 - RNA, 20 nt, Chlamydophila pneumoniae J138
uuuagaaucuuuucuagaaa

SEQ ID NO: 535452 - RNA, 18 nt, Chlamydophila pneumoniae J138
uuuagcaugacuuuuuca

SEQ ID NO: 535453 - RNA, 16 nt, Chlamydophila pneumoniae J138
uuuagcuacagaaaga

SEQ ID NO: 535454 - RNA, 23 nt, Chlamydophila pneumoniae J138
uuuaggagcauagacucuuccuu

SEQ ID NO: 535455 - RNA, 15 nt, Chlamydophila pneumoniae J138
uuuaguucaccacua

SEQ ID NO: 535456 - RNA, 19 nt, Chlamydophila pneumoniae J138
uuuaguggaaauugugaaa

SEQ ID NO: 535457 - RNA, 16 nt, Chlamydophila pneumoniae J138
uuuauauaaagaucuu

SEQ ID NO: 535458 - RNA, 14 nt, Chlamydophila pneumoniae J138
uuuauauuaagaau

SEQ ID NO: 535459 - RNA, 18 nt, Chlamydophila pneumoniae J138
uuuauagcggaguguuuu

SEQ ID NO: 535460 - RNA, 22 nt, Chlamydophila pneumoniae J138
uuuaugacacagcuaaucaauc

SEQ ID NO: 535461 - RNA, 21 nt, Chlamydophila pneumoniae J138
uuuaucuguuaaaaacaagau

SEQ ID NO: 535462 - RNA, 14 nt, Chlamydophila pneumoniae J138
uuuaucauugcuau

SEQ ID NO: 535463 - RNA, 22 nt, Chlamydophila pneumoniae J138
uuuaucccagauaaagacaucu

SEQ ID NO: 535464 - RNA, 18 nt, Chlamydophila pneumoniae J138
uugcaugaugcuguugau

SEQ ID NO: 535465 - RNA, 22 nt, Chlamydophila pneumoniae J138
uugcauucagggggaaagccaa

SEQ ID NO: 535466 - RNA, 21 nt, Chlamydophila pneumoniae J138
uugcauuaaaucguacuucac

SEQ ID NO: 535467 - RNA, 21 nt, Chlamydophila pneumoniae J138
uugcagaucccgggaguuuuc

SEQ ID NO: 535468 - RNA, 16 nt, Chlamydophila pneumoniae J138
uugcagcaaggagagu

SEQ ID NO: 535469 - RNA, 14 nt, Chlamydophila pneumoniae J138
uugcagaagcauug

SEQ ID NO: 535470 - RNA, 20 nt, Chlamydophila pneumoniae J138
uugcagaagcauuguauucc

SEQ ID NO: 535471 - RNA, 15 nt, Chlamydophila pneumoniae J138
uugccaaucuuucau

SEQ ID NO: 535472 - RNA, 22 nt, Chlamydophila pneumoniae J138
uugccaauguggugauuucuuu

SEQ ID NO: 535473 - RNA, 19 nt, Chlamydophila pneumoniae J138
uugcccauugaccugcuuu

SEQ ID NO: 535474 - RNA, 19 nt, Chlamydophila pneumoniae J138
uugcgaacagcuccuggau

SEQ ID NO: 535475 - RNA, 12 nt, Chlamydophila pneumoniae J138
uugccuuucucu

SEQ ID NO: 535476 - RNA, 14 nt, Chlamydophila pneumoniae J138
uugcgacauaacca

SEQ ID NO: 535477 - RNA, 14 nt, Chlamydophila pneumoniae J138
uugccuucuuaucu

SEQ ID NO: 535478 - RNA, 12 nt, Chlamydophila pneumoniae J138
uugccuucuucu

SEQ ID NO: 535479 - RNA, 18 nt, Chlamydophila pneumoniae J138
uugcuguuucuucugaau

SEQ ID NO: 535480 - RNA, 19 nt, Chlamydophila pneumoniae J138
uugcuuaaaaagucugaau

SEQ ID NO: 535481 - RNA, 14 nt, Chlamydophila pneumoniae J138
uugcuguggaauuu

SEQ ID NO: 535482 - RNA, 11 nt, Chlamydophila pneumoniae J138
uugcuuucuag

SEQ ID NO: 535483 - RNA, 15 nt, Chlamydophila pneumoniae J138
uugcugaagauuuuu

SEQ ID NO: 535484 - RNA, 20 nt, Chlamydophila pneumoniae J138
uugcugaagauuuuuucuug

SEQ ID NO: 535485 - RNA, 14 nt, Chlamydophila pneumoniae J138
uugcuuuucauuuu

SEQ ID NO: 535486 - RNA, 15 nt, Chlamydophila pneumoniae J138
uugcuuuucuaggau

SEQ ID NO: 535487 - RNA, 19 nt, Chlamydophila pneumoniae J138
uuggacguacuaagauacg

SEQ ID NO: 535488 - RNA, 14 nt, Chlamydophila pneumoniae J138
uuggugcuuugccu

SEQ ID NO: 535489 - RNA, 21 nt, Chlamydophila pneumoniae J138
uugguaugccgcaucuagaag

SEQ ID NO: 535490 - RNA, 20 nt, Chlamydophila pneumoniae J138
uugguaugcagaguuuuaaa

SEQ ID NO: 535491 - RNA, 17 nt, Chlamydophila pneumoniae J138
uugggcaucucucuuua

SEQ ID NO: 535492 - RNA, 21 nt, Chlamydophila pneumoniae J138
uugguagagcaacacauucgu

SEQ ID NO: 535493 - RNA, 23 nt, Chlamydophila pneumoniae J138
uugggaugacuggcgacuugcca

SEQ ID NO: 535494 - RNA, 23 nt, Chlamydophila pneumoniae J138
uuggcuccuguuauuguuucuau

SEQ ID NO: 535495 - RNA, 15 nt, Chlamydophila pneumoniae J138
uuuaacuuaaagacu

SEQ ID NO: 535496 - RNA, 21 nt, Chlamydophila pneumoniae J138
uuuaacucuagaucuucaauc

SEQ ID NO: 535497 - RNA, 17 nt, Chlamydophila pneumoniae J138
uuuaaccucuuuucuua

SEQ ID NO: 535498 - RNA, 20 nt, Chlamydophila pneumoniae J138
uuuaagucacuaaagauacu

SEQ ID NO: 535499 - RNA, 16 nt, Chlamydophila pneumoniae J138
uuuaaguccuucuucc

SEQ ID NO: 535500 - RNA, 13 nt, Chlamydophila pneumoniae J138
uuuaauaaaauuu

SEQ ID NO: 535501 - RNA, 18 nt, Chlamydophila pneumoniae J138
uuuaauaaaauuuaaaaa

SEQ ID NO: 535502 - RNA, 19 nt, Chlamydophila pneumoniae J138
uuuaauaaaauuuaaaaaa

SEQ ID NO: 535503 - RNA, 16 nt, Chlamydophila pneumoniae J138
uuuaauacaaaaaaua

SEQ ID NO: 535504 - RNA, 19 nt, Chlamydophila pneumoniae J138
uuguuuugcuuuuugaaug

SEQ ID NO: 535505 - RNA, 13 nt, Chlamydophila pneumoniae J138
uuguuuguuuucu

SEQ ID NO: 535506 - RNA, 22 nt, Chlamydophila pneumoniae J138
uuguucuuccaacuucuguauc

SEQ ID NO: 535507 - RNA, 22 nt, Chlamydophila pneumoniae J138
uuguuggcauagcgagaacacc

SEQ ID NO: 535508 - RNA, 19 nt, Chlamydophila pneumoniae J138
uuuaacaugccaaaaguuu

SEQ ID NO: 535509 - RNA, 21 nt, Chlamydophila pneumoniae J138
uuuaaauacagauucaccaag

SEQ ID NO: 535510 - RNA, 14 nt, Chlamydophila pneumoniae J138
uuuaaauagcaucc

SEQ ID NO: 535511 - RNA, 22 nt, Chlamydophila pneumoniae J138
uuuaaaacuccacgccaaagua

SEQ ID NO: 535512 - RNA, 21 nt, Chlamydophila pneumoniae J138
uuuaaaaguacgaccaacucc

SEQ ID NO: 535513 - RNA, 21 nt, Chlamydophila pneumoniae J138
uuguauauccacgaucuagaa

SEQ ID NO: 535514 - RNA, 19 nt, Chlamydophila pneumoniae J138
uuguauaagagcaagguaa

SEQ ID NO: 535515 - RNA, 14 nt, Chlamydophila pneumoniae J138
uuguauaagagcaa

SEQ ID NO: 535516 - RNA, 21 nt, Chlamydophila pneumoniae J138
uugucacacugcgagagaaag

SEQ ID NO: 535517 - RNA, 23 nt, Chlamydophila pneumoniae J138
uugucagcuuugcuuauuucccc

SEQ ID NO: 535518 - RNA, 18 nt, Chlamydophila pneumoniae J138
uuguacuuuuacugaaau

SEQ ID NO: 535519 - RNA, 14 nt, Chlamydophila pneumoniae J138
uuguaauuuccuua

SEQ ID NO: 535520 - RNA, 23 nt, Chlamydophila pneumoniae J138
uugguucuuggaguuaggaaaau

SEQ ID NO: 535521 - RNA, 14 nt, Chlamydophila pneumoniae J138
uuguucuaaaauga

SEQ ID NO: 535522 - RNA, 19 nt, Chlamydophila pneumoniae J138
uuguuccaauagagucucu

SEQ ID NO: 535523 - RNA, 12 nt, Chlamydophila pneumoniae J138
uuguggaaguaa

SEQ ID NO: 535524 - RNA, 21 nt, Chlamydophila pneumoniae J138
uugugcuaggcucucgacacu

SEQ ID NO: 535525 - RNA, 19 nt, Chlamydophila pneumoniae J138
uugugcuagguaguguggu

SEQ ID NO: 535526 - RNA, 19 nt, Chlamydophila pneumoniae J138
uugugcuaaagcaggagca

SEQ ID NO: 535527 - RNA, 16 nt, Chlamydophila pneumoniae J138
uuguuaaauucccaaa

SEQ ID NO: 535528 - RNA, 21 nt, Chlamydophila pneumoniae J138
uuguuaaaguaaaaaauacag

SEQ ID NO: 535529 - RNA, 22 nt, Chlamydophila pneumoniae J138
uugugcuaaagcaggagcauca

SEQ ID NO: 535530 - RNA, 14 nt, Chlamydophila pneumoniae J138
uugucccaaucaag

SEQ ID NO: 535531 - RNA, 20 nt, Chlamydophila pneumoniae J138
uugucucgaaacucuuugag

SEQ ID NO: 535532 - RNA, 19 nt, Chlamydophila pneumoniae J138
uugucucaauugaaucaga

SEQ ID NO: 535533 - RNA, 19 nt, Chlamydophila pneumoniae J138
uugucuacagaggaaucua

SEQ ID NO: 535534 - RNA, 19 nt, Chlamydophila pneumoniae J138
uugaaaauauccuaaauau

SEQ ID NO: 535535 - RNA, 13 nt, Chlamydophila pneumoniae J138
uugaaaucuaccg

SEQ ID NO: 535536 - RNA, 21 nt, Chlamydophila pneumoniae J138
uugaaaagaaagaauaucuuu

SEQ ID NO: 535537 - RNA, 23 nt, Chlamydophila pneumoniae J138
uucuuucuaggaucucuaguaag

SEQ ID NO: 535538 - RNA, 14 nt, Chlamydophila pneumoniae J138
uucuuuuccugcag

SEQ ID NO: 535539 - RNA, 15 nt, Chlamydophila pneumoniae J138
uucuucuucagagcu

SEQ ID NO: 535540 - RNA, 20 nt, Chlamydophila pneumoniae J138
uucuucuggcugagagaagc

SEQ ID NO: 535541 - RNA, 22 nt, Chlamydophila pneumoniae J138
uucuucuggauacguuuuuccc

SEQ ID NO: 535542 - RNA, 12 nt, Chlamydophila pneumoniae J138
uucuucuucuaa

SEQ ID NO: 535543 - RNA, 18 nt, Chlamydophila pneumoniae J138
uucuuuaggguaaagaaa

SEQ ID NO: 535544 - RNA, 19 nt, Chlamydophila pneumoniae J138
uucuuuauccccagaucuc

SEQ ID NO: 535545 - RNA, 14 nt, Chlamydophila pneumoniae J138
uugaaauugcucuu

SEQ ID NO: 535546 - RNA, 20 nt, Chlamydophila pneumoniae J138
uugaacaacuccuuaaacuu

SEQ ID NO: 535547 - RNA, 18 nt, Chlamydophila pneumoniae J138
uugaagcuccucacaucu

SEQ ID NO: 535548 - RNA, 14 nt, Chlamydophila pneumoniae J138
uugaaguucucaaa

SEQ ID NO: 535549 - RNA, 19 nt, Chlamydophila pneumoniae J138
uugaauaagauuuugaaaa

SEQ ID NO: 535550 - RNA, 14 nt, Chlamydophila pneumoniae J138
uugacaucuguagu

SEQ ID NO: 535551 - RNA, 24 nt, Chlamydophila pneumoniae J138
uugaaucauagagauaucaucaaa

SEQ ID NO: 535552 - RNA, 16 nt, Chlamydophila pneumoniae J138
uugaaucccaucaaag

SEQ ID NO: 535553 - RNA, 14 nt, Chlamydophila pneumoniae J138
uugacuagcucucu

SEQ ID NO: 535554 - RNA, 16 nt, Chlamydophila pneumoniae J138
uugacuagcucucuug

SEQ ID NO: 535555 - RNA, 15 nt, Chlamydophila pneumoniae J138
uugacuauugggagg

SEQ ID NO: 535556 - RNA, 14 nt, Chlamydophila pneumoniae J138
uugaggaaaggagg

SEQ ID NO: 535557 - RNA, 14 nt, Chlamydophila pneumoniae J138
uugagcacauuguu

SEQ ID NO: 535558 - RNA, 20 nt, Chlamydophila pneumoniae J138
uugaggaaucugaaucucau

SEQ ID NO: 535559 - RNA, 17 nt, Chlamydophila pneumoniae J138
uugaggcaagucucaaa

SEQ ID NO: 535560 - RNA, 19 nt, Chlamydophila pneumoniae J138
uugaggcaagucucaaagg

SEQ ID NO: 535561 - RNA, 16 nt, Chlamydophila pneumoniae J138
uugauaauuacagaag

SEQ ID NO: 535562 - RNA, 14 nt, Chlamydophila pneumoniae J138
uugauagaccggau

SEQ ID NO: 535563 - RNA, 17 nt, Chlamydophila pneumoniae J138
uugauagcuaagagcau

SEQ ID NO: 535564 - RNA, 17 nt, Chlamydophila pneumoniae J138
uugauaguguucgagca

SEQ ID NO: 535565 - RNA, 21 nt, Chlamydophila pneumoniae J138
uugauaguguucgagcaucuc

SEQ ID NO: 535566 - RNA, 10 nt, Chlamydophila pneumoniae J138
uugcaacucu

SEQ ID NO: 535567 - RNA, 22 nt, Chlamydophila pneumoniae J138
uugcaacaaaaggcccaacucu

SEQ ID NO: 535568 - RNA, 12 nt, Chlamydophila pneumoniae J138
uugauucauaaa

SEQ ID NO: 535569 - RNA, 14 nt, Chlamydophila pneumoniae J138
uugauuauucccaa

SEQ ID NO: 535570 - RNA, 13 nt, Chlamydophila pneumoniae J138
uugcaaaugaaaa

SEQ ID NO: 535571 - RNA, 17 nt, Chlamydophila pneumoniae J138
uugcaaaugaaaagaga

SEQ ID NO: 535572 - RNA, 19 nt, Chlamydophila pneumoniae J138
uugauguacaguaaaguau

SEQ ID NO: 535573 - RNA, 14 nt, Chlamydophila pneumoniae J138
uugauccagccccc

SEQ ID NO: 535574 - RNA, 13 nt, Chlamydophila pneumoniae J138
uucuucgagagca

SEQ ID NO: 535575 - RNA, 15 nt, Chlamydophila pneumoniae J138
uucuuauuacagaaa

SEQ ID NO: 535576 - RNA, 11 nt, Chlamydophila pneumoniae J138
uucuuaucugc

SEQ ID NO: 535577 - RNA, 18 nt, Chlamydophila pneumoniae J138
uucuuaucacaaauuguc

SEQ ID NO: 535578 - RNA, 14 nt, Chlamydophila pneumoniae J138
uucuuaguaaagaa

SEQ ID NO: 535579 - RNA, 18 nt, Chlamydophila pneumoniae J138
uucuucguuagagaagag

SEQ ID NO: 535580 - RNA, 19 nt, Chlamydophila pneumoniae J138
uucuucugaauagcucuuu

SEQ ID NO: 535581 - RNA, 17 nt, Chlamydophila pneumoniae J138
uucuucugauacaucau

SEQ ID NO: 535582 - RNA, 11 nt, Chlamydophila pneumoniae J138
uucuucuaaag

SEQ ID NO: 535583 - RNA, 17 nt, Chlamydophila pneumoniae J138
uucuucuauagaaucca

SEQ ID NO: 535584 - RNA, 16 nt, Chlamydophila pneumoniae J138
uucugccuuaugcuca

SEQ ID NO: 535585 - RNA, 23 nt, Chlamydophila pneumoniae J138
uucugucuauaagauagcucuug

SEQ ID NO: 535586 - RNA, 19 nt, Chlamydophila pneumoniae J138
uucuguaguuuguucacuu

SEQ ID NO: 535587 - RNA, 21 nt, Chlamydophila pneumoniae J138
uucuccaguaucuucucuuau

SEQ ID NO: 535588 - RNA, 15 nt, Chlamydophila pneumoniae J138
uucucccauagcaau

SEQ ID NO: 535589 - RNA, 12 nt, Chlamydophila pneumoniae J138
uucucagaaaga

SEQ ID NO: 535590 - RNA, 20 nt, Chlamydophila pneumoniae J138
uucucccgcuaauuaccauu

SEQ ID NO: 535591 - RNA, 18 nt, Chlamydophila pneumoniae J138
uucucccgugaacaaaaa

SEQ ID NO: 535592 - RNA, 15 nt, Chlamydophila pneumoniae J138
uucugcaaucugaau

SEQ ID NO: 535593 - RNA, 21 nt, Chlamydophila pneumoniae J138
uucucugagcagcuucgcaau

SEQ ID NO: 535594 - RNA, 18 nt, Chlamydophila pneumoniae J138
uucucugauucucauaaa

SEQ ID NO: 535595 - RNA, 20 nt, Chlamydophila pneumoniae J138
uuaucaggaacuaaaaguuu

SEQ ID NO: 535596 - RNA, 15 nt, Chlamydophila pneumoniae J138
uucuaaaaacucuuc

SEQ ID NO: 535597 - RNA, 22 nt, Chlamydophila pneumoniae J138
uucuaaaacagaaauugcuucu

SEQ ID NO: 535598 - RNA, 13 nt, Chlamydophila pneumoniae J138
uucguuucgcuuu

SEQ ID NO: 535599 - RNA, 19 nt, Chlamydophila pneumoniae J138
uucguagacgcucuaaacu

SEQ ID NO: 535600 - RNA, 22 nt, Chlamydophila pneumoniae J138
uucguagacgcucuaaacucuc

SEQ ID NO: 535601 - RNA, 18 nt, Chlamydophila pneumoniae J138
uucguauagcuggcaaug

SEQ ID NO: 535602 - RNA, 17 nt, Chlamydophila pneumoniae J138
uucguauagcuggcaau

SEQ ID NO: 535603 - RNA, 12 nt, Chlamydophila pneumoniae J138
uucuauuaaaaa

SEQ ID NO: 535604 - RNA, 22 nt, Chlamydophila pneumoniae J138
uucuauucgcugucuagaacac

SEQ ID NO: 535605 - RNA, 13 nt, Chlamydophila pneumoniae J138
uucuauuucauau

SEQ ID NO: 535606 - RNA, 14 nt, Chlamydophila pneumoniae J138
uucucaaagaucau

SEQ ID NO: 535607 - RNA, 17 nt, Chlamydophila pneumoniae J138
uucuauauguaauuucc

SEQ ID NO: 535608 - RNA, 13 nt, Chlamydophila pneumoniae J138
uucuauaguucau

SEQ ID NO: 535609 - RNA, 20 nt, Chlamydophila pneumoniae J138
uucuaugccauaaauacagg

SEQ ID NO: 535610 - RNA, 14 nt, Chlamydophila pneumoniae J138
uucuaaaagagcaa

SEQ ID NO: 535611 - RNA, 16 nt, Chlamydophila pneumoniae J138
uucuaaaagagcaaga

SEQ ID NO: 535612 - RNA, 23 nt, Chlamydophila pneumoniae J138
uucuaccaauaaccgaaacuucu

SEQ ID NO: 535613 - RNA, 13 nt, Chlamydophila pneumoniae J138
uucuaccaauucu

SEQ ID NO: 535614 - RNA, 19 nt, Chlamydophila pneumoniae J138
uucuaccuguagcuacaga

SEQ ID NO: 535615 - RNA, 16 nt, Chlamydophila pneumoniae J138
uucuacacgacgagga

SEQ ID NO: 535616 - RNA, 22 nt, Chlamydophila pneumoniae J138
uucuacacuguuguaauaaaau

SEQ ID NO: 535617 - RNA, 17 nt, Chlamydophila pneumoniae J138
ugacaaguguguuucaa

SEQ ID NO: 535618 - RNA, 16 nt, Chlamydophila pneumoniae J138
ugacacaggagguuca

SEQ ID NO: 535619 - RNA, 16 nt, Chlamydophila pneumoniae J138
ugacaauaacaugcgc

SEQ ID NO: 535620 - RNA, 16 nt, Chlamydophila pneumoniae J138
ugacaaauaaguccug

SEQ ID NO: 535621 - RNA, 22 nt, Chlamydophila pneumoniae J138
ugacaaauaaguccuguuugaa

SEQ ID NO: 535622 - RNA, 13 nt, Chlamydophila pneumoniae J138
ugacaaauagaaa

SEQ ID NO: 535623 - RNA, 17 nt, Chlamydophila pneumoniae J138
ugacaaauagaaaggaa

SEQ ID NO: 535624 - RNA, 12 nt, Chlamydophila pneumoniae J138
ugaaugauuucc

SEQ ID NO: 535625 - RNA, 13 nt, Chlamydophila pneumoniae J138
ugaaugauuucca

SEQ ID NO: 535626 - RNA, 14 nt, Chlamydophila pneumoniae J138
ugaauuuaugggug

SEQ ID NO: 535627 - RNA, 12 nt, Chlamydophila pneumoniae J138
ugaauauguacu

SEQ ID NO: 535628 - RNA, 17 nt, Chlamydophila pneumoniae J138
ugaauaucaucacuaag

SEQ ID NO: 535629 - RNA, 18 nt, Chlamydophila pneumoniae J138
ugaauauaguuuaaaugu

SEQ ID NO: 535630 - RNA, 20 nt, Chlamydophila pneumoniae J138
ugaauaugauuuccacuugu

SEQ ID NO: 535631 - RNA, 20 nt, Chlamydophila pneumoniae J138
ugaaucucuucuguaggaac

SEQ ID NO: 535632 - RNA, 21 nt, Chlamydophila pneumoniae J138
ugaaucucuucuguaggaaca

SEQ ID NO: 535633 - RNA, 22 nt, Chlamydophila pneumoniae J138
ugaaugaggguggaacuauccu

SEQ ID NO: 535634 - RNA, 12 nt, Chlamydophila pneumoniae J138
ucuuucaaaaga

SEQ ID NO: 535635 - RNA, 15 nt, Chlamydophila pneumoniae J138
ucuuuauuuaaauaa

SEQ ID NO: 535636 - RNA, 22 nt, Chlamydophila pneumoniae J138
ucuuucaaccuccgcucuaagc

SEQ ID NO: 535637 - RNA, 21 nt, Chlamydophila pneumoniae J138
ucuuuauaaauacaggagaau

SEQ ID NO: 535638 - RNA, 12 nt, Chlamydophila pneumoniae J138
ucuuuauuuaaa

SEQ ID NO: 535639 - RNA, 14 nt, Chlamydophila pneumoniae J138
ugaauaccaaaauu

SEQ ID NO: 535640 - RNA, 19 nt, Chlamydophila pneumoniae J138
ugaauaccguuucaggaaa

SEQ ID NO: 535641 - RNA, 21 nt, Chlamydophila pneumoniae J138
ugaauaccguuucaggaaacu

SEQ ID NO: 535642 - RNA, 12 nt, Chlamydophila pneumoniae J138
ugaauaaugcau

SEQ ID NO: 535643 - RNA, 23 nt, Chlamydophila pneumoniae J138
ucuuucacauacauucuauucua

SEQ ID NO: 535644 - RNA, 17 nt, Chlamydophila pneumoniae J138
ugacacucagcucccau

SEQ ID NO: 535645 - RNA, 22 nt, Chlamydophila pneumoniae J138
ugacacucagcucccaugugcu

SEQ ID NO: 535646 - RNA, 18 nt, Chlamydophila pneumoniae J138
ugacagaccuugcauuag

SEQ ID NO: 535647 - RNA, 22 nt, Chlamydophila pneumoniae J138
ugacagggaaagaacagcagaa

SEQ ID NO: 535648 - RNA, 20 nt, Chlamydophila pneumoniae J138
ugaccaucaaugagaucugc

SEQ ID NO: 535649 - RNA, 18 nt, Chlamydophila pneumoniae J138
ugacauaagcacucuuaa

SEQ ID NO: 535650 - RNA, 11 nt, Chlamydophila pneumoniae J138
ugaccaagaac

SEQ ID NO: 535651 - RNA, 23 nt, Chlamydophila pneumoniae J138
ugaccaucaaugagaucugcaaa

SEQ ID NO: 535652 - RNA, 15 nt, Chlamydophila pneumoniae J138
ugacugcuagagucc

SEQ ID NO: 535653 - RNA, 19 nt, Chlamydophila pneumoniae J138
ugacugcagauugcacuug

SEQ ID NO: 535654 - RNA, 13 nt, Chlamydophila pneumoniae J138
ugacugcagagaa

SEQ ID NO: 535655 - RNA, 23 nt, Chlamydophila pneumoniae J138
ugacugcagagaaauucaugccu

SEQ ID NO: 535656 - RNA, 14 nt, Chlamydophila pneumoniae J138
ugacucuagaguac

SEQ ID NO: 535657 - RNA, 17 nt, Chlamydophila pneumoniae J138
ugacucuaauucagaaa

SEQ ID NO: 535658 - RNA, 12 nt, Chlamydophila pneumoniae J138
ugacucuagagu

SEQ ID NO: 535659 - RNA, 17 nt, Chlamydophila pneumoniae J138
ugacgcuuuuccaaagc

SEQ ID NO: 535660 - RNA, 14 nt, Chlamydophila pneumoniae J138
ugacuauuuucauu

SEQ ID NO: 535661 - RNA, 16 nt, Chlamydophila pneumoniae J138
ugagaaaagguaacau

SEQ ID NO: 535662 - RNA, 22 nt, Chlamydophila pneumoniae J138
ugagaaaaguugccuaaagaga

SEQ ID NO: 535663 - RNA, 20 nt, Chlamydophila pneumoniae J138
ugacuuuuguugcaauucca

SEQ ID NO: 535664 - RNA, 23 nt, Chlamydophila pneumoniae J138
ugacuuuuucaagguucucuaug

SEQ ID NO: 535665 - RNA, 19 nt, Chlamydophila pneumoniae J138
ugacuuuggucuucuguaa

SEQ ID NO: 535666 - RNA, 17 nt, Chlamydophila pneumoniae J138
ugacuuuaugaucuccc

SEQ ID NO: 535667 - RNA, 16 nt, Chlamydophila pneumoniae J138
ugacuuggcuggcauc

SEQ ID NO: 535668 - RNA, 22 nt, Chlamydophila pneumoniae J138
ugagauccaaagccugaaaaau

SEQ ID NO: 535669 - RNA, 22 nt, Chlamydophila pneumoniae J138
ugagauggucgagaaccuccac

SEQ ID NO: 535670 - RNA, 13 nt, Chlamydophila pneumoniae J138
ugagauucaaaag

SEQ ID NO: 535671 - RNA, 20 nt, Chlamydophila pneumoniae J138
ugagaauacaacccuuuaua

SEQ ID NO: 535672 - RNA, 19 nt, Chlamydophila pneumoniae J138
ugagaacucagcgcaucac

SEQ ID NO: 535673 - RNA, 13 nt, Chlamydophila pneumoniae J138
ugagauagucuug

SEQ ID NO: 535674 - RNA, 17 nt, Chlamydophila pneumoniae J138
ugagcagcuuuaucagg

SEQ ID NO: 535675 - RNA, 20 nt, Chlamydophila pneumoniae J138
ugagcagcaaaaauuguuuu

SEQ ID NO: 535676 - RNA, 14 nt, Chlamydophila pneumoniae J138
ugagcuaagucucc

SEQ ID NO: 535677 - RNA, 16 nt, Chlamydophila pneumoniae J138
ugagcgacgacaagga

SEQ ID NO: 535678 - RNA, 13 nt, Chlamydophila pneumoniae J138
ugagcucucuagc

SEQ ID NO: 535679 - RNA, 20 nt, Chlamydophila pneumoniae J138
ugagcuucacaucuuucucu

SEQ ID NO: 535680 - RNA, 19 nt, Chlamydophila pneumoniae J138
ugagcuucacaucuuucuc

SEQ ID NO: 535681 - RNA, 18 nt, Chlamydophila pneumoniae J138
ugaggauacgaauaaguu

SEQ ID NO: 535682 - RNA, 18 nt, Chlamydophila pneumoniae J138
ugaggauaaguucuucca

SEQ ID NO: 535683 - RNA, 15 nt, Chlamydophila pneumoniae J138
ugaggaaaggagggc

SEQ ID NO: 535684 - RNA, 20 nt, Chlamydophila pneumoniae J138
ugaggaacgcacgccaagag

SEQ ID NO: 535685 - RNA, 22 nt, Chlamydophila pneumoniae J138
ugaggaacgcacgccaagagag

SEQ ID NO: 535686 - RNA, 13 nt, Chlamydophila pneumoniae J138
ugaggaaaggagg

SEQ ID NO: 535687 - RNA, 22 nt, Chlamydophila pneumoniae J138
ugagcuuugguuucguacaguu

SEQ ID NO: 535688 - RNA, 18 nt, Chlamydophila pneumoniae J138
ugaggaaucauaaccaaa

SEQ ID NO: 535689 - RNA, 16 nt, Chlamydophila pneumoniae J138
ugaggcacauguagga

SEQ ID NO: 535690 - RNA, 14 nt, Chlamydophila pneumoniae J138
ugaggcaagucuca

SEQ ID NO: 535691 - RNA, 20 nt, Chlamydophila pneumoniae J138
ugaguaaaaucauaggcuau

SEQ ID NO: 535692 - RNA, 18 nt, Chlamydophila pneumoniae J138
ugaguggguucacuccug

SEQ ID NO: 535693 - RNA, 13 nt, Chlamydophila pneumoniae J138
ugauauuccuuga

SEQ ID NO: 535694 - RNA, 15 nt, Chlamydophila pneumoniae J138
ugauccgaaaacucu

SEQ ID NO: 535695 - RNA, 13 nt, Chlamydophila pneumoniae J138
ugauccagcucca

SEQ ID NO: 535696 - RNA, 16 nt, Chlamydophila pneumoniae J138
ugauccagcuccauaa

SEQ ID NO: 535697 - RNA, 17 nt, Chlamydophila pneumoniae J138
ugauccagcccccaggc

SEQ ID NO: 535698 - RNA, 13 nt, Chlamydophila pneumoniae J138
ugaucagaaucua

SEQ ID NO: 535699 - RNA, 22 nt, Chlamydophila pneumoniae J138
ugaucagaaaugaagccaaaag

SEQ ID NO: 535700 - RNA, 18 nt, Chlamydophila pneumoniae J138
ugaugaccucuauaccua

SEQ ID NO: 535701 - RNA, 14 nt, Chlamydophila pneumoniae J138
ugaugacauugcaa

SEQ ID NO: 535702 - RNA, 14 nt, Chlamydophila pneumoniae J138
ugauccuucuuaug

SEQ ID NO: 535703 - RNA, 16 nt, Chlamydophila pneumoniae J138
ugauccuugcaaaaca

SEQ ID NO: 535704 - RNA, 16 nt, Chlamydophila pneumoniae J138
ugaugcuucuuucaaa

SEQ ID NO: 535705 - RNA, 19 nt, Chlamydophila pneumoniae J138
ugaugcuucuuucaaagcc

SEQ ID NO: 535706 - RNA, 15 nt, Chlamydophila pneumoniae J138
ugaugccaagaaaua

SEQ ID NO: 535707 - RNA, 15 nt, Chlamydophila pneumoniae J138
ugcaaaccaaaaaag

SEQ ID NO: 535708 - RNA, 14 nt, Chlamydophila pneumoniae J138
ugcaaaaaaccagc

SEQ ID NO: 535709 - RNA, 13 nt, Chlamydophila pneumoniae J138
ugauuuuucaaau

SEQ ID NO: 535710 - RNA, 23 nt, Chlamydophila pneumoniae J138
ugauuuggccaacaguguagccu

SEQ ID NO: 535711 - RNA, 17 nt, Chlamydophila pneumoniae J138
ugauuucgugaacaaaa

SEQ ID NO: 535712 - RNA, 19 nt, Chlamydophila pneumoniae J138
ugauuucgacgcauaguau

SEQ ID NO: 535713 - RNA, 19 nt, Chlamydophila pneumoniae J138
ugauuuccugacuauaaaa

SEQ ID NO: 535714 - RNA, 14 nt, Chlamydophila pneumoniae J138
ugauuccuuaaguc

SEQ ID NO: 535715 - RNA, 21 nt, Chlamydophila pneumoniae J138
ugauuccuuggcauacucuau

SEQ ID NO: 535716 - RNA, 22 nt, Chlamydophila pneumoniae J138
ugauucucccaauauccagaaa

SEQ ID NO: 535717 - RNA, 15 nt, Chlamydophila pneumoniae J138
ugauggggauuaucc

SEQ ID NO: 535718 - RNA, 20 nt, Chlamydophila pneumoniae J138
ugauguauaaaguuuguaaa

SEQ ID NO: 535719 - RNA, 22 nt, Chlamydophila pneumoniae J138
ugcaagcagauagagcuucuuu

SEQ ID NO: 535720 - RNA, 19 nt, Chlamydophila pneumoniae J138
ugcaagcauuguuuguccu

SEQ ID NO: 535721 - RNA, 19 nt, Chlamydophila pneumoniae J138
ugcaaggccuaaucuugua

SEQ ID NO: 535722 - RNA, 13 nt, Chlamydophila pneumoniae J138
ugcaaggagcuuu

SEQ ID NO: 535723 - RNA, 12 nt, Chlamydophila pneumoniae J138
ugcaaagagaau

SEQ ID NO: 535724 - RNA, 16 nt, Chlamydophila pneumoniae J138
ugcaaguucacacgua

SEQ ID NO: 535725 - RNA, 16 nt, Chlamydophila pneumoniae J138
ugcaagugcuuucagg

SEQ ID NO: 535726 - RNA, 18 nt, Chlamydophila pneumoniae J138
ugcaagcuucaucaggag

SEQ ID NO: 535727 - RNA, 17 nt, Chlamydophila pneumoniae J138
ugcaaugguugucuuua

SEQ ID NO: 535728 - RNA, 14 nt, Chlamydophila pneumoniae J138
ugcaaucucaaaau

SEQ ID NO: 535729 - RNA, 21 nt, Chlamydophila pneumoniae J138
ugcacaaucgcaucaaaaaau

SEQ ID NO: 535730 - RNA, 14 nt, Chlamydophila pneumoniae J138
ugcacgagagccuc

SEQ ID NO: 535731 - RNA, 22 nt, Chlamydophila pneumoniae J138
ugcacgaucgcgauaagaagcu

SEQ ID NO: 535732 - RNA, 20 nt, Chlamydophila pneumoniae J138
ugcacgaucgcgauaagaag

SEQ ID NO: 535733 - RNA, 15 nt, Chlamydophila pneumoniae J138
ugcacuuugaauaau

SEQ ID NO: 535734 - RNA, 16 nt, Chlamydophila pneumoniae J138
ugcacuuugaauaaug

SEQ ID NO: 535735 - RNA, 18 nt, Chlamydophila pneumoniae J138
ugcacuuucuuuuuuaau

SEQ ID NO: 535736 - RNA, 20 nt, Chlamydophila pneumoniae J138
ugcagauagcuuacagagaa

SEQ ID NO: 535737 - RNA, 13 nt, Chlamydophila pneumoniae J138
ugcagauacuaaa

SEQ ID NO: 535738 - RNA, 21 nt, Chlamydophila pneumoniae J138
ugcagauacuaaacuccauug

SEQ ID NO: 535739 - RNA, 20 nt, Chlamydophila pneumoniae J138
ugcagaguuuuaaacugcua

SEQ ID NO: 535740 - RNA, 15 nt, Chlamydophila pneumoniae J138
ugcagaaucuaugag

SEQ ID NO: 535741 - RNA, 14 nt, Chlamydophila pneumoniae J138
ugcagcgcagcacc

SEQ ID NO: 535742 - RNA, 19 nt, Chlamydophila pneumoniae J138
ugcagcguuucuagggacg

SEQ ID NO: 535743 - RNA, 16 nt, Chlamydophila pneumoniae J138
ugcaggccaggagacu

SEQ ID NO: 535744 - RNA, 16 nt, Chlamydophila pneumoniae J138
ugcaggagaacaauau

SEQ ID NO: 535745 - RNA, 21 nt, Chlamydophila pneumoniae J138
ugcaggacugucuagcaguug

SEQ ID NO: 535746 - RNA, 19 nt, Chlamydophila pneumoniae J138
ugccaggagagcuaacagc

SEQ ID NO: 535747 - RNA, 18 nt, Chlamydophila pneumoniae J138
ugccagugacauaaucac

SEQ ID NO: 535748 - RNA, 18 nt, Chlamydophila pneumoniae J138
ugccauaaguccaugcua

SEQ ID NO: 535749 - RNA, 13 nt, Chlamydophila pneumoniae J138
ugcccaaacauca

SEQ ID NO: 535750 - RNA, 17 nt, Chlamydophila pneumoniae J138
ugcccauuuuuggaaaa

SEQ ID NO: 535751 - RNA, 19 nt, Chlamydophila pneumoniae J138
ugcccacacccuuuaaguu

SEQ ID NO: 535752 - RNA, 12 nt, Chlamydophila pneumoniae J138
ugcccacuucua

SEQ ID NO: 535753 - RNA, 22 nt, Chlamydophila pneumoniae J138
ugcccugucacuaucuucuaaa

SEQ ID NO: 535754 - RNA, 15 nt, Chlamydophila pneumoniae J138
ugccgagaauacaga

SEQ ID NO: 535755 - RNA, 16 nt, Chlamydophila pneumoniae J138
ugccugaaauccuggg

SEQ ID NO: 535756 - RNA, 18 nt, Chlamydophila pneumoniae J138
ugccucaggucugcugag

SEQ ID NO: 535757 - RNA, 13 nt, Chlamydophila pneumoniae J138
ugccuuaggcuuu

SEQ ID NO: 535758 - RNA, 14 nt, Chlamydophila pneumoniae J138
ugccuguuuuauug

SEQ ID NO: 535759 - RNA, 12 nt, Chlamydophila pneumoniae J138
ugccuuucucuu

SEQ ID NO: 535760 - RNA, 14 nt, Chlamydophila pneumoniae J138
ugccuuuagggaaa

SEQ ID NO: 535761 - RNA, 22 nt, Chlamydophila pneumoniae J138
ugccuugauccuuuccaagaag

SEQ ID NO: 535762 - RNA, 21 nt, Chlamydophila pneumoniae J138
ugccuuuuucuugauuagaga

SEQ ID NO: 535763 - RNA, 14 nt, Chlamydophila pneumoniae J138
ugccuuuuuuucua

SEQ ID NO: 535764 - RNA, 20 nt, Chlamydophila pneumoniae J138
ugcgaauccugaggaugcua

SEQ ID NO: 535765 - RNA, 19 nt, Chlamydophila pneumoniae J138
ugcgaaugucguuaaaaac

SEQ ID NO: 535766 - RNA, 19 nt, Chlamydophila pneumoniae J138
ugcgauaucuauaaaugua

SEQ ID NO: 535767 - RNA, 22 nt, Chlamydophila pneumoniae J138
ugcgcaaagaacucaacuuuuu

SEQ ID NO: 535768 - RNA, 23 nt, Chlamydophila pneumoniae J138
ugcgauuuccccuucagaggcua

SEQ ID NO: 535769 - RNA, 17 nt, Chlamydophila pneumoniae J138
ugcgcacggauucuaaa

SEQ ID NO: 535770 - RNA, 15 nt, Chlamydophila pneumoniae J138
ugcggauuugcauua

SEQ ID NO: 535771 - RNA, 21 nt, Chlamydophila pneumoniae J138
ugcggcaaguaucucaucacg

SEQ ID NO: 535772 - RNA, 21 nt, Chlamydophila pneumoniae J138
ugcguauagauccaagaauga

SEQ ID NO: 535773 - RNA, 15 nt, Chlamydophila pneumoniae J138
ugcuauuuuccucua

SEQ ID NO: 535774 - RNA, 14 nt, Chlamydophila pneumoniae J138
ugcuauuuacugaa

SEQ ID NO: 535775 - RNA, 20 nt, Chlamydophila pneumoniae J138
ugcuacuuuaaaguggcaau

SEQ ID NO: 535776 - RNA, 14 nt, Chlamydophila pneumoniae J138
ugcuaggaagauga

SEQ ID NO: 535777 - RNA, 21 nt, Chlamydophila pneumoniae J138
ugcuaucaaagacucaugaaa

SEQ ID NO: 535778 - RNA, 20 nt, Chlamydophila pneumoniae J138
ugcuaaacaaugcaaaauaa

SEQ ID NO: 535779 - RNA, 16 nt, Chlamydophila pneumoniae J138
ugcuaaaacuaaaguu

SEQ ID NO: 535780 - RNA, 17 nt, Chlamydophila pneumoniae J138
ugcuaagaucuuuagaa

SEQ ID NO: 535781 - RNA, 17 nt, Chlamydophila pneumoniae J138
ugcuaagagcucuuucc

SEQ ID NO: 535782 - RNA, 15 nt, Chlamydophila pneumoniae J138
ugcuaauaccucaaa

SEQ ID NO: 535783 - RNA, 20 nt, Chlamydophila pneumoniae J138
ugcuaagcgaaccaaaguca

SEQ ID NO: 535784 - RNA, 12 nt, Chlamydophila pneumoniae J138
ugcuaauaauuc

SEQ ID NO: 535785 - RNA, 13 nt, Chlamydophila pneumoniae J138
ugcuacagcuucu

SEQ ID NO: 535786 - RNA, 18 nt, Chlamydophila pneumoniae J138
ugcuccagaaacgcagcu

SEQ ID NO: 535787 - RNA, 18 nt, Chlamydophila pneumoniae J138
ugcucaggagauacaagu

SEQ ID NO: 535788 - RNA, 15 nt, Chlamydophila pneumoniae J138
ugcucacuucuuugc

SEQ ID NO: 535789 - RNA, 15 nt, Chlamydophila pneumoniae J138
ugcucucuucuucuc

SEQ ID NO: 535790 - RNA, 14 nt, Chlamydophila pneumoniae J138
ugcucugacaagug

SEQ ID NO: 535791 - RNA, 15 nt, Chlamydophila pneumoniae J138
ugcucugacaagugu

SEQ ID NO: 535792 - RNA, 16 nt, Chlamydophila pneumoniae J138
ugcucuguauuggaaa

SEQ ID NO: 535793 - RNA, 19 nt, Chlamydophila pneumoniae J138
ugcucuccugcaaaaaguu

SEQ ID NO: 535794 - RNA, 17 nt, Chlamydophila pneumoniae J138
ugcucuaccaacugagc

SEQ ID NO: 535795 - RNA, 16 nt, Chlamydophila pneumoniae J138
ugcucuagucuuucaa

SEQ ID NO: 535796 - RNA, 17 nt, Chlamydophila pneumoniae J138
ugcucuaaguugauacu

SEQ ID NO: 535797 - RNA, 21 nt, Chlamydophila pneumoniae J138
ugcugacagcuccauuuaaau

SEQ ID NO: 535798 - RNA, 13 nt, Chlamydophila pneumoniae J138
ugcugaauuccuc

SEQ ID NO: 535799 - RNA, 22 nt, Chlamydophila pneumoniae J138
ugcugaauauaguuuaaauguc

SEQ ID NO: 535800 - RNA, 11 nt, Chlamydophila pneumoniae J138
ugcuuaaggaa

SEQ ID NO: 535801 - RNA, 16 nt, Chlamydophila pneumoniae J138
ugcuuaaaauucugua

SEQ ID NO: 535802 - RNA, 21 nt, Chlamydophila pneumoniae J138
ugcuuccaacggacauuuuca

SEQ ID NO: 535803 - RNA, 18 nt, Chlamydophila pneumoniae J138
ugcuucuaagaaacuucc

SEQ ID NO: 535804 - RNA, 17 nt, Chlamydophila pneumoniae J138
ugcuucgggaacgugcu

SEQ ID NO: 535805 - RNA, 14 nt, Chlamydophila pneumoniae J138
ugcuucuucagagu

SEQ ID NO: 535806 - RNA, 17 nt, Chlamydophila pneumoniae J138
ugcuuggcaauagcuuu

SEQ ID NO: 535807 - RNA, 15 nt, Chlamydophila pneumoniae J138
ugcuugucuacagag

SEQ ID NO: 535808 - RNA, 12 nt, Chlamydophila pneumoniae J138
ugcuucuccaaa

SEQ ID NO: 535809 - RNA, 22 nt, Chlamydophila pneumoniae J138
ugcuuucuguacaacaaaauuu

SEQ ID NO: 535810 - RNA, 23 nt, Chlamydophila pneumoniae J138
ugcuuucuagcugcucuuuuaga

SEQ ID NO: 535811 - RNA, 19 nt, Chlamydophila pneumoniae J138
ugcuuugccgccucagcac

SEQ ID NO: 535812 - RNA, 19 nt, Chlamydophila pneumoniae J138
ugcuuuuguuguuuuugcu

SEQ ID NO: 535813 - RNA, 18 nt, Chlamydophila pneumoniae J138
uggaaauugugaaaaaaa

SEQ ID NO: 535814 - RNA, 21 nt, Chlamydophila pneumoniae J138
uggaaauccguaaagguugua

SEQ ID NO: 535815 - RNA, 20 nt, Chlamydophila pneumoniae J138
uggaaauagagaaacuuuug

SEQ ID NO: 535816 - RNA, 19 nt, Chlamydophila pneumoniae J138
uggaaagcuucuggauuca

SEQ ID NO: 535817 - RNA, 18 nt, Chlamydophila pneumoniae J138
uggaaagagucccugauu

SEQ ID NO: 535818 - RNA, 14 nt, Chlamydophila pneumoniae J138
uggaaacuuuucca

SEQ ID NO: 535819 - RNA, 17 nt, Chlamydophila pneumoniae J138
uggaagaauuucauaag

SEQ ID NO: 535820 - RNA, 15 nt, Chlamydophila pneumoniae J138
uggaagagagcaaga

SEQ ID NO: 535821 - RNA, 16 nt, Chlamydophila pneumoniae J138
uggaagauugaaggca

SEQ ID NO: 535822 - RNA, 16 nt, Chlamydophila pneumoniae J138
uggaaguaaucuggaa

SEQ ID NO: 535823 - RNA, 21 nt, Chlamydophila pneumoniae J138
uggaagcuuuuacgagcuuuu

SEQ ID NO: 535824 - RNA, 13 nt, Chlamydophila pneumoniae J138
uggaauuuuccug

SEQ ID NO: 535825 - RNA, 18 nt, Chlamydophila pneumoniae J138
uggaauucaaacuccuuu

SEQ ID NO: 535826 - RNA, 22 nt, Chlamydophila pneumoniae J138
uggaauucaaacuccuuuuaaa

SEQ ID NO: 535827 - RNA, 16 nt, Chlamydophila pneumoniae J138
uggaauucaaacuccu

SEQ ID NO: 535828 - RNA, 14 nt, Chlamydophila pneumoniae J138
uggaaugacuaaau

SEQ ID NO: 535829 - RNA, 13 nt, Chlamydophila pneumoniae J138
uggaaugccaaau

SEQ ID NO: 535830 - RNA, 18 nt, Chlamydophila pneumoniae J138
uggaaucagggacucuuu

SEQ ID NO: 535831 - RNA, 15 nt, Chlamydophila pneumoniae J138
uggacaauauagaga

SEQ ID NO: 535832 - RNA, 16 nt, Chlamydophila pneumoniae J138
uggaccagaugcuaaa

SEQ ID NO: 535833 - RNA, 22 nt, Chlamydophila pneumoniae J138
uggaccagaugcuaaagagucu

SEQ ID NO: 535834 - RNA, 12 nt, Chlamydophila pneumoniae J138
uuaggucuuaaa

SEQ ID NO: 535835 - RNA, 20 nt, Chlamydophila pneumoniae J138
uuagggaugguuuccucuau

SEQ ID NO: 535836 - RNA, 13 nt, Chlamydophila pneumoniae J138
uuaguagcuauuc

SEQ ID NO: 535837 - RNA, 18 nt, Chlamydophila pneumoniae J138
uuaguagcuauucucaaa

SEQ ID NO: 535838 - RNA, 12 nt, Chlamydophila pneumoniae J138
uuaguaaagaau

SEQ ID NO: 535839 - RNA, 23 nt, Chlamydophila pneumoniae J138
uuaguaaaugccucuuucauacu

SEQ ID NO: 535840 - RNA, 19 nt, Chlamydophila pneumoniae J138
uuaguuuuucuagcuuccu

SEQ ID NO: 535841 - RNA, 19 nt, Chlamydophila pneumoniae J138
uuaguuuaccugaaaaaac

SEQ ID NO: 535842 - RNA, 13 nt, Chlamydophila pneumoniae J138
uuagugcuucaga

SEQ ID NO: 535843 - RNA, 21 nt, Chlamydophila pneumoniae J138
uuaguggaaauugugaaaaaa

SEQ ID NO: 535844 - RNA, 20 nt, Chlamydophila pneumoniae J138
uuauaguagcgaauccagaa

SEQ ID NO: 535845 - RNA, 20 nt, Chlamydophila pneumoniae J138
uuaucaaaagguuuuauaaa

SEQ ID NO: 535846 - RNA, 16 nt, Chlamydophila pneumoniae J138
uuacuucacguugcaa

SEQ ID NO: 535847 - RNA, 19 nt, Chlamydophila pneumoniae J138
uuacgaaaacaucuguaua

SEQ ID NO: 535848 - RNA, 16 nt, Chlamydophila pneumoniae J138
uuacuucaagaaaaac

SEQ ID NO: 535849 - RNA, 21 nt, Chlamydophila pneumoniae J138
uuagacaagacaccgaaagaa

SEQ ID NO: 535850 - RNA, 22 nt, Chlamydophila pneumoniae J138
uuagacaagacaccgaaagaaa

SEQ ID NO: 535851 - RNA, 23 nt, Chlamydophila pneumoniae J138
uuagaacuucaaugaaagcugua

SEQ ID NO: 535852 - RNA, 14 nt, Chlamydophila pneumoniae J138
uuagaacuauagga

SEQ ID NO: 535853 - RNA, 18 nt, Chlamydophila pneumoniae J138
uuagacgugcucucuucu

SEQ ID NO: 535854 - RNA, 20 nt, Chlamydophila pneumoniae J138
uuagauacgcuuacaaauaa

SEQ ID NO: 535855 - RNA, 23 nt, Chlamydophila pneumoniae J138
uuagcauagagcucuaaaaaaga

SEQ ID NO: 535856 - RNA, 14 nt, Chlamydophila pneumoniae J138
uuagcauagagcuc

SEQ ID NO: 535857 - RNA, 20 nt, Chlamydophila pneumoniae J138
uuagcauagagcucuaaaaa

SEQ ID NO: 535858 - RNA, 22 nt, Chlamydophila pneumoniae J138
uuagcauaaggggagucuugga

SEQ ID NO: 535859 - RNA, 16 nt, Chlamydophila pneumoniae J138
uuagcaaacauuuuua

SEQ ID NO: 535860 - RNA, 20 nt, Chlamydophila pneumoniae J138
uuagccauggcaucuaagcc

SEQ ID NO: 535861 - RNA, 13 nt, Chlamydophila pneumoniae J138
uuagcauuucucu

SEQ ID NO: 535862 - RNA, 16 nt, Chlamydophila pneumoniae J138
uuagccaaaauuuccu

SEQ ID NO: 535863 - RNA, 16 nt, Chlamydophila pneumoniae J138
uuaggauucaguuccu

SEQ ID NO: 535864 - RNA, 19 nt, Chlamydophila pneumoniae J138
uuaggauuucgagauauug

SEQ ID NO: 535865 - RNA, 20 nt, Chlamydophila pneumoniae J138
uuaggaggaguauagcauga

SEQ ID NO: 535866 - RNA, 14 nt, Chlamydophila pneumoniae J138
uuagcuucuuuuuu

SEQ ID NO: 535867 - RNA, 14 nt, Chlamydophila pneumoniae J138
uuagcgaucucucu

SEQ ID NO: 535868 - RNA, 22 nt, Chlamydophila pneumoniae J138
uuaauuuuugcuaaacaaugca

SEQ ID NO: 535869 - RNA, 18 nt, Chlamydophila pneumoniae J138
uuaauuuuugcuaaacaa

SEQ ID NO: 535870 - RNA, 16 nt, Chlamydophila pneumoniae J138
uuaauccuuucacaaa

SEQ ID NO: 535871 - RNA, 13 nt, Chlamydophila pneumoniae J138
uuaauccuugagg

SEQ ID NO: 535872 - RNA, 10 nt, Chlamydophila pneumoniae J138
uuaauucucu

SEQ ID NO: 535873 - RNA, 12 nt, Chlamydophila pneumoniae J138
uuaauucucuga

SEQ ID NO: 535874 - RNA, 13 nt, Chlamydophila pneumoniae J138
uuaauuccuugga

SEQ ID NO: 535875 - RNA, 17 nt, Chlamydophila pneumoniae J138
uuacauaacacuuuguu

SEQ ID NO: 535876 - RNA, 18 nt, Chlamydophila pneumoniae J138
uuacaauuuaaaucugca

SEQ ID NO: 535877 - RNA, 14 nt, Chlamydophila pneumoniae J138
uuacacaacucuuu

SEQ ID NO: 535878 - RNA, 16 nt, Chlamydophila pneumoniae J138
uuaccguuuccuccuc

SEQ ID NO: 535879 - RNA, 19 nt, Chlamydophila pneumoniae J138
uuacccuaauuugaauagu

SEQ ID NO: 535880 - RNA, 16 nt, Chlamydophila pneumoniae J138
uuaagaagaagaaaaa

SEQ ID NO: 535881 - RNA, 14 nt, Chlamydophila pneumoniae J138
uuaaauaaaaccac

SEQ ID NO: 535882 - RNA, 19 nt, Chlamydophila pneumoniae J138
uuaagaccaaacuuucuuu

SEQ ID NO: 535883 - RNA, 19 nt, Chlamydophila pneumoniae J138
uuaagaagauucuuuaauc

SEQ ID NO: 535884 - RNA, 14 nt, Chlamydophila pneumoniae J138
uuaagucacacuuu

SEQ ID NO: 535885 - RNA, 20 nt, Chlamydophila pneumoniae J138
uuaagugauggggauuaucc

SEQ ID NO: 535886 - RNA, 14 nt, Chlamydophila pneumoniae J138
uuaauauaaaagaa

SEQ ID NO: 535887 - RNA, 18 nt, Chlamydophila pneumoniae J138
uuaauacaaaaaauaaaa

SEQ ID NO: 535888 - RNA, 14 nt, Chlamydophila pneumoniae J138
uuaauaauguuuua

SEQ ID NO: 535889 - RNA, 17 nt, Chlamydophila pneumoniae J138
uuaagugcuuuuagauc

SEQ ID NO: 535890 - RNA, 16 nt, Chlamydophila pneumoniae J138
uuaauauuugagaaga

SEQ ID NO: 535891 - RNA, 14 nt, Chlamydophila pneumoniae J138
uuaaucaagccuaa

SEQ ID NO: 535892 - RNA, 17 nt, Chlamydophila pneumoniae J138
uuaauccaaaaacuucu

SEQ ID NO: 535893 - RNA, 14 nt, Chlamydophila pneumoniae J138
ugucacggaagaac

SEQ ID NO: 535894 - RNA, 20 nt, Chlamydophila pneumoniae J138
ugucacuaagauaucuccag

SEQ ID NO: 535895 - RNA, 22 nt, Chlamydophila pneumoniae J138
ugugcgcacaagggauucuugu

SEQ ID NO: 535896 - RNA, 20 nt, Chlamydophila pneumoniae J138
ugugcagaagguuccacaga

SEQ ID NO: 535897 - RNA, 15 nt, Chlamydophila pneumoniae J138
ugugcaauaggaaaa

SEQ ID NO: 535898 - RNA, 21 nt, Chlamydophila pneumoniae J138
ugugcacccaaucgguaugau

SEQ ID NO: 535899 - RNA, 17 nt, Chlamydophila pneumoniae J138
ugugcggcgagcucuag

SEQ ID NO: 535900 - RNA, 17 nt, Chlamydophila pneumoniae J138
ugugcucaauacagaua

SEQ ID NO: 535901 - RNA, 22 nt, Chlamydophila pneumoniae J138
ugugguaaaaauauaggcugca

SEQ ID NO: 535902 - RNA, 18 nt, Chlamydophila pneumoniae J138
ugugugacgacaaaucac

SEQ ID NO: 535903 - RNA, 13 nt, Chlamydophila pneumoniae J138
ugugucuuaaagc

SEQ ID NO: 535904 - RNA, 21 nt, Chlamydophila pneumoniae J138
uguuaacaaguaccaagaaaa

SEQ ID NO: 535905 - RNA, 23 nt, Chlamydophila pneumoniae J138
uguuaaguucauaaccugggcaa

SEQ ID NO: 535906 - RNA, 18 nt, Chlamydophila pneumoniae J138
uguuaugaguuuuuaauu

SEQ ID NO: 535907 - RNA, 17 nt, Chlamydophila pneumoniae J138
uguucuaaagcugcuuc

SEQ ID NO: 535908 - RNA, 13 nt, Chlamydophila pneumoniae J138
uguuccacuugcu

SEQ ID NO: 535909 - RNA, 18 nt, Chlamydophila pneumoniae J138
uguucccucuucuuccaa

SEQ ID NO: 535910 - RNA, 16 nt, Chlamydophila pneumoniae J138
uguuguaauaaaagaa

SEQ ID NO: 535911 - RNA, 22 nt, Chlamydophila pneumoniae J138
uguuguaacgggagcguuuuuu

SEQ ID NO: 535912 - RNA, 13 nt, Chlamydophila pneumoniae J138
uguugggagcuuc

SEQ ID NO: 535913 - RNA, 13 nt, Chlamydophila pneumoniae J138
uguuguuuuugcu

SEQ ID NO: 535914 - RNA, 17 nt, Chlamydophila pneumoniae J138
uguuguauggcagccug

SEQ ID NO: 535915 - RNA, 13 nt, Chlamydophila pneumoniae J138
uguugauuuccaa

SEQ ID NO: 535916 - RNA, 21 nt, Chlamydophila pneumoniae J138
uguugcaauagcaauggcuuu

SEQ ID NO: 535917 - RNA, 13 nt, Chlamydophila pneumoniae J138
uguugcuuucugu

SEQ ID NO: 535918 - RNA, 22 nt, Chlamydophila pneumoniae J138
uuaaacucugacgucuccaaca

SEQ ID NO: 535919 - RNA, 13 nt, Chlamydophila pneumoniae J138
uuaaacuaagaau

SEQ ID NO: 535920 - RNA, 24 nt, Chlamydophila pneumoniae J138
uuaaagagcauccuguagccacua

SEQ ID NO: 535921 - RNA, 11 nt, Chlamydophila pneumoniae J138
uuaaagagcau

SEQ ID NO: 535922 - RNA, 17 nt, Chlamydophila pneumoniae J138
uuaaaguccaagaucaa

SEQ ID NO: 535923 - RNA, 14 nt, Chlamydophila pneumoniae J138
uuaaaaguucagca

SEQ ID NO: 535924 - RNA, 14 nt, Chlamydophila pneumoniae J138
uuaaaauagacauu

SEQ ID NO: 535925 - RNA, 22 nt, Chlamydophila pneumoniae J138
uuaaaagcauaguguauaucag

SEQ ID NO: 535926 - RNA, 19 nt, Chlamydophila pneumoniae J138
uuaaaacccauguuucuuc

SEQ ID NO: 535927 - RNA, 19 nt, Chlamydophila pneumoniae J138
uuaaaaaauuaucuccaaa

SEQ ID NO: 535928 - RNA, 18 nt, Chlamydophila pneumoniae J138
uguuuuucuuccacacaa

SEQ ID NO: 535929 - RNA, 13 nt, Chlamydophila pneumoniae J138
uguuuuucaauuu

SEQ ID NO: 535930 - RNA, 13 nt, Chlamydophila pneumoniae J138
uguuuuuaggagu

SEQ ID NO: 535931 - RNA, 14 nt, Chlamydophila pneumoniae J138
uguuuuuucuucug

SEQ ID NO: 535932 - RNA, 13 nt, Chlamydophila pneumoniae J138
uguuuuucuucca

SEQ ID NO: 535933 - RNA, 13 nt, Chlamydophila pneumoniae J138
uuaaaaaacuucc

SEQ ID NO: 535934 - RNA, 18 nt, Chlamydophila pneumoniae J138
uguuuuuugaaaacuuca

SEQ ID NO: 535935 - RNA, 16 nt, Chlamydophila pneumoniae J138
uguuuuccagaaaucu

SEQ ID NO: 535936 - RNA, 23 nt, Chlamydophila pneumoniae J138
uguuucuaugugaugucgcgaaa

SEQ ID NO: 535937 - RNA, 15 nt, Chlamydophila pneumoniae J138
uguuucuuuaucuaa

SEQ ID NO: 535938 - RNA, 18 nt, Chlamydophila pneumoniae J138
uguuucuuugacuuucau

SEQ ID NO: 535939 - RNA, 17 nt, Chlamydophila pneumoniae J138
uguuucuuguagcuccc

SEQ ID NO: 535940 - RNA, 14 nt, Chlamydophila pneumoniae J138
uguuucuucugaau

SEQ ID NO: 535941 - RNA, 19 nt, Chlamydophila pneumoniae J138
uguuugaaaauauccuaaa

SEQ ID NO: 535942 - RNA, 21 nt, Chlamydophila pneumoniae J138
uguuuggccaacagcuaauac

SEQ ID NO: 535943 - RNA, 15 nt, Chlamydophila pneumoniae J138
uguuuauuuagcauu

SEQ ID NO: 535944 - RNA, 22 nt, Chlamydophila pneumoniae J138
uguuucaacauaacaugagaaa

SEQ ID NO: 535945 - RNA, 12 nt, Chlamydophila pneumoniae J138
uguuucacuuaa

SEQ ID NO: 535946 - RNA, 14 nt, Chlamydophila pneumoniae J138
uguuuaaguccuuc

SEQ ID NO: 535947 - RNA, 21 nt, Chlamydophila pneumoniae J138
uguuuagcauagagcucuaaa

SEQ ID NO: 535948 - RNA, 14 nt, Chlamydophila pneumoniae J138
uggacuccaagaau

SEQ ID NO: 535949 - RNA, 17 nt, Chlamydophila pneumoniae J138
uggacuacugaaacacu

SEQ ID NO: 535950 - RNA, 15 nt, Chlamydophila pneumoniae J138
uggagagcgaaauag

SEQ ID NO: 535951 - RNA, 17 nt, Chlamydophila pneumoniae J138
uggagagggaaggaaua

SEQ ID NO: 535952 - RNA, 16 nt, Chlamydophila pneumoniae J138
uggagaagagguaaua

SEQ ID NO: 535953 - RNA, 16 nt, Chlamydophila pneumoniae J138
uggagugacaccaaca

SEQ ID NO: 535954 - RNA, 15 nt, Chlamydophila pneumoniae J138
uggagucuaaaaaau

SEQ ID NO: 535955 - RNA, 21 nt, Chlamydophila pneumoniae J138
uggaggccaaagaacagcacu

SEQ ID NO: 535956 - RNA, 14 nt, Chlamydophila pneumoniae J138
uggaggccaaagaa

SEQ ID NO: 535957 - RNA, 19 nt, Chlamydophila pneumoniae J138
uggaggccaaagaacagca

SEQ ID NO: 535958 - RNA, 16 nt, Chlamydophila pneumoniae J138
uggaggauaaaugagu

SEQ ID NO: 535959 - RNA, 15 nt, Chlamydophila pneumoniae J138
uggaggauaaaugag

SEQ ID NO: 535960 - RNA, 17 nt, Chlamydophila pneumoniae J138
uggagcaucauuccagc

SEQ ID NO: 535961 - RNA, 17 nt, Chlamydophila pneumoniae J138
uggauauugucaagagg

SEQ ID NO: 535962 - RNA, 14 nt, Chlamydophila pneumoniae J138
uggaucaaggagua

SEQ ID NO: 535963 - RNA, 22 nt, Chlamydophila pneumoniae J138
uggauacguuuuucccuuuaaa

SEQ ID NO: 535964 - RNA, 21 nt, Chlamydophila pneumoniae J138
uggauaacacgaguuucgaua

SEQ ID NO: 535965 - RNA, 12 nt, Chlamydophila pneumoniae J138
uggaucuugaua

SEQ ID NO: 535966 - RNA, 17 nt, Chlamydophila pneumoniae J138
uggauguagaggaucua

SEQ ID NO: 535967 - RNA, 20 nt, Chlamydophila pneumoniae J138
uggaucagaaaaaaugcguu

SEQ ID NO: 535968 - RNA, 22 nt, Chlamydophila pneumoniae J138
uggauccaucggcauuucucca

SEQ ID NO: 535969 - RNA, 23 nt, Chlamydophila pneumoniae J138
uggcagcaaauccuuuauguaua

SEQ ID NO: 535970 - RNA, 17 nt, Chlamydophila pneumoniae J138
uggcagcaggaauaauc

SEQ ID NO: 535971 - RNA, 17 nt, Chlamydophila pneumoniae J138
uggcauagcgaaaguca

SEQ ID NO: 535972 - RNA, 14 nt, Chlamydophila pneumoniae J138
uggcauagcgagaa

SEQ ID NO: 535973 - RNA, 18 nt, Chlamydophila pneumoniae J138
uggcaaauaaaacaagcu

SEQ ID NO: 535974 - RNA, 17 nt, Chlamydophila pneumoniae J138
uggcaaucuuuucuugu

SEQ ID NO: 535975 - RNA, 15 nt, Chlamydophila pneumoniae J138
uggcaaucuaaaauc

SEQ ID NO: 535976 - RNA, 13 nt, Chlamydophila pneumoniae J138
uggauuucuccag

SEQ ID NO: 535977 - RNA, 18 nt, Chlamydophila pneumoniae J138
uggauucgcacguaggca

SEQ ID NO: 535978 - RNA, 13 nt, Chlamydophila pneumoniae J138
uggauuucuucug

SEQ ID NO: 535979 - RNA, 17 nt, Chlamydophila pneumoniae J138
uggccuagcuuucuugg

SEQ ID NO: 535980 - RNA, 18 nt, Chlamydophila pneumoniae J138
uggcgaauccuagagaac

SEQ ID NO: 535981 - RNA, 20 nt, Chlamydophila pneumoniae J138
uggccaacaguguagccuuu

SEQ ID NO: 535982 - RNA, 17 nt, Chlamydophila pneumoniae J138
uggcauugggaaggauc

SEQ ID NO: 535983 - RNA, 15 nt, Chlamydophila pneumoniae J138
uggcaugaaagauaa

SEQ ID NO: 535984 - RNA, 23 nt, Chlamydophila pneumoniae J138
uggcuuuuuuugucccaacuaga

SEQ ID NO: 535985 - RNA, 14 nt, Chlamydophila pneumoniae J138
ugggaaaagaaaag

SEQ ID NO: 535986 - RNA, 20 nt, Chlamydophila pneumoniae J138
ugggaaaagaaaagaaagaa

SEQ ID NO: 535987 - RNA, 16 nt, Chlamydophila pneumoniae J138
ugggaucggucuuuuc

SEQ ID NO: 535988 - RNA, 21 nt, Chlamydophila pneumoniae J138
ugggcagcgauauaagacucc

SEQ ID NO: 535989 - RNA, 13 nt, Chlamydophila pneumoniae J138
uggguaaguccac

SEQ ID NO: 535990 - RNA, 15 nt, Chlamydophila pneumoniae J138
uggguaaguccacaa

SEQ ID NO: 535991 - RNA, 21 nt, Chlamydophila pneumoniae J138
ugggcauuuaacaacaugcgc

SEQ ID NO: 535992 - RNA, 20 nt, Chlamydophila pneumoniae J138
uggggcaguagguaagaagc

SEQ ID NO: 535993 - RNA, 19 nt, Chlamydophila pneumoniae J138
ugggcuaggguuucuacag

SEQ ID NO: 535994 - RNA, 15 nt, Chlamydophila pneumoniae J138
uggugagaucaucuc

SEQ ID NO: 535995 - RNA, 16 nt, Chlamydophila pneumoniae J138
uggucuagagauuuuu

SEQ ID NO: 535996 - RNA, 19 nt, Chlamydophila pneumoniae J138
uggucuagagauuuuucua

SEQ ID NO: 535997 - RNA, 12 nt, Chlamydophila pneumoniae J138
uggguucuccac

SEQ ID NO: 535998 - RNA, 19 nt, Chlamydophila pneumoniae J138
ugguacggcuaaauaaacc

SEQ ID NO: 535999 - RNA, 17 nt, Chlamydophila pneumoniae J138
ugguacggcuaaauaaa

SEQ ID NO: 536000 - RNA, 20 nt, Chlamydophila pneumoniae J138
ugguaguuugccuucuuauc

SEQ ID NO: 536001 - RNA, 17 nt, Chlamydophila pneumoniae J138
uguagccuuucuuuuua

SEQ ID NO: 536002 - RNA, 21 nt, Chlamydophila pneumoniae J138
uguaggaacaugccaaauauc

SEQ ID NO: 536003 - RNA, 19 nt, Chlamydophila pneumoniae J138
uguagagguacuugggaga

SEQ ID NO: 536004 - RNA, 17 nt, Chlamydophila pneumoniae J138
uguagcagcaagaacau

SEQ ID NO: 536005 - RNA, 13 nt, Chlamydophila pneumoniae J138
uguauaaacucca

SEQ ID NO: 536006 - RNA, 22 nt, Chlamydophila pneumoniae J138
uguauaaacuccacgaauucuu

SEQ ID NO: 536007 - RNA, 13 nt, Chlamydophila pneumoniae J138
uguaguucuugcc

SEQ ID NO: 536008 - RNA, 15 nt, Chlamydophila pneumoniae J138
uguaguaagauuuuc

SEQ ID NO: 536009 - RNA, 19 nt, Chlamydophila pneumoniae J138
uguagucaugauuuuucaa

SEQ ID NO: 536010 - RNA, 22 nt, Chlamydophila pneumoniae J138
uguaucgauaacgauuucuuga

SEQ ID NO: 536011 - RNA, 23 nt, Chlamydophila pneumoniae J138
uguauccguagugagguuugcaa

SEQ ID NO: 536012 - RNA, 19 nt, Chlamydophila pneumoniae J138
uguauauucugaaauuucu

SEQ ID NO: 536013 - RNA, 16 nt, Chlamydophila pneumoniae J138
uguauauucugaaauu

SEQ ID NO: 536014 - RNA, 16 nt, Chlamydophila pneumoniae J138
uguauaugcuuggcaa

SEQ ID NO: 536015 - RNA, 15 nt, Chlamydophila pneumoniae J138
uguauacauaucucc

SEQ ID NO: 536016 - RNA, 19 nt, Chlamydophila pneumoniae J138
uguauagcuuacuuagaac

SEQ ID NO: 536017 - RNA, 16 nt, Chlamydophila pneumoniae J138
uguauuaaagaaucua

SEQ ID NO: 536018 - RNA, 22 nt, Chlamydophila pneumoniae J138
uguauggugcgcgucuccuuga

SEQ ID NO: 536019 - RNA, 22 nt, Chlamydophila pneumoniae J138
uguauucgcuaagcuauaucuc

SEQ ID NO: 536020 - RNA, 15 nt, Chlamydophila pneumoniae J138
uguauuuucuucaac

SEQ ID NO: 536021 - RNA, 19 nt, Chlamydophila pneumoniae J138
uguauuugcagaagcauug

SEQ ID NO: 536022 - RNA, 13 nt, Chlamydophila pneumoniae J138
uguauuuccuucu

SEQ ID NO: 536023 - RNA, 19 nt, Chlamydophila pneumoniae J138
ugucacacugcgagagaaa

SEQ ID NO: 536024 - RNA, 21 nt, Chlamydophila pneumoniae J138
uguacgguaaauccauuuggg

SEQ ID NO: 536025 - RNA, 18 nt, Chlamydophila pneumoniae J138
uguaccugcauucauaaa

SEQ ID NO: 536026 - RNA, 15 nt, Chlamydophila pneumoniae J138
uguaccguaaagaaa

SEQ ID NO: 536027 - RNA, 16 nt, Chlamydophila pneumoniae J138
uguaauuuuuuucaaa

SEQ ID NO: 536028 - RNA, 21 nt, Chlamydophila pneumoniae J138
uguaauaaaagaaagaaugac

SEQ ID NO: 536029 - RNA, 11 nt, Chlamydophila pneumoniae J138
uguaaaaguua

SEQ ID NO: 536030 - RNA, 14 nt, Chlamydophila pneumoniae J138
uguaaaaguagcau

SEQ ID NO: 536031 - RNA, 21 nt, Chlamydophila pneumoniae J138
uguaacauugaccuaaaggaa

SEQ ID NO: 536032 - RNA, 20 nt, Chlamydophila pneumoniae J138
uguaaauaguauacaagcga

SEQ ID NO: 536033 - RNA, 16 nt, Chlamydophila pneumoniae J138
uguaaauacaaaacaa

SEQ ID NO: 536034 - RNA, 23 nt, Chlamydophila pneumoniae J138
uguaaagagcaacaguaauuauu

SEQ ID NO: 536035 - RNA, 23 nt, Chlamydophila pneumoniae J138
uguaaagugaaauugaacucuca

SEQ ID NO: 536036 - RNA, 17 nt, Chlamydophila pneumoniae J138
ucuuccaaagacugagc

SEQ ID NO: 536037 - RNA, 18 nt, Chlamydophila pneumoniae J138
ucuuccaaagacugagcu

SEQ ID NO: 536038 - RNA, 17 nt, Chlamydophila pneumoniae J138
ucuucauuuucuuuuaa

SEQ ID NO: 536039 - RNA, 16 nt, Chlamydophila pneumoniae J138
ucuucauuccaggauu

SEQ ID NO: 536040 - RNA, 23 nt, Chlamydophila pneumoniae J138
ucuuaaugcgaugcggucagaaa

SEQ ID NO: 536041 - RNA, 14 nt, Chlamydophila pneumoniae J138
ucuuaauuaaaaac

SEQ ID NO: 536042 - RNA, 13 nt, Chlamydophila pneumoniae J138
ucuuaauauaaaa

SEQ ID NO: 536043 - RNA, 23 nt, Chlamydophila pneumoniae J138
ucuuaauauaaaagaagacgcuc

SEQ ID NO: 536044 - RNA, 15 nt, Chlamydophila pneumoniae J138
ucuuaagagcaaaca

SEQ ID NO: 536045 - RNA, 15 nt, Chlamydophila pneumoniae J138
ucuuaacuggcaauc

SEQ ID NO: 536046 - RNA, 18 nt, Chlamydophila pneumoniae J138
ucuuaacuggcaaucuaa

SEQ ID NO: 536047 - RNA, 21 nt, Chlamydophila pneumoniae J138
ucuuaacuggcaaucuaaaau

SEQ ID NO: 536048 - RNA, 15 nt, Chlamydophila pneumoniae J138
ucuucaggugaagga

SEQ ID NO: 536049 - RNA, 15 nt, Chlamydophila pneumoniae J138
ucuucgcuggcaugu

SEQ ID NO: 536050 - RNA, 20 nt, Chlamydophila pneumoniae J138
ucuucgcaaauauaguuuuc

SEQ ID NO: 536051 - RNA, 22 nt, Chlamydophila pneumoniae J138
ucuucgcaaauauaguuuucau

SEQ ID NO: 536052 - RNA, 17 nt, Chlamydophila pneumoniae J138
ucuucgauuguaacuuc

SEQ ID NO: 536053 - RNA, 18 nt, Chlamydophila pneumoniae J138
ucuucgauuguaacuucg

SEQ ID NO: 536054 - RNA, 14 nt, Chlamydophila pneumoniae J138
ucuucgauuucuag

SEQ ID NO: 536055 - RNA, 22 nt, Chlamydophila pneumoniae J138
ucuucgauuucuaguuguccuu

SEQ ID NO: 536056 - RNA, 14 nt, Chlamydophila pneumoniae J138
ucuucgaauuuuug

SEQ ID NO: 536057 - RNA, 18 nt, Chlamydophila pneumoniae J138
ucuucguuucuuugaguu

SEQ ID NO: 536058 - RNA, 16 nt, Chlamydophila pneumoniae J138
ucuucguuuauaacau

SEQ ID NO: 536059 - RNA, 18 nt, Chlamydophila pneumoniae J138
ucuucguuuauaacauca

SEQ ID NO: 536060 - RNA, 21 nt, Chlamydophila pneumoniae J138
ucuucuagagcuucaaguuuc

SEQ ID NO: 536061 - RNA, 14 nt, Chlamydophila pneumoniae J138
ucuucuauuuuuuu

SEQ ID NO: 536062 - RNA, 22 nt, Chlamydophila pneumoniae J138
ucuucucgaacaggagagagaa

SEQ ID NO: 536063 - RNA, 17 nt, Chlamydophila pneumoniae J138
ucuucuucaucuucuaa

SEQ ID NO: 536064 - RNA, 14 nt, Chlamydophila pneumoniae J138
ucuucuucuggcug

SEQ ID NO: 536065 - RNA, 15 nt, Chlamydophila pneumoniae J138
ucuucuugcaaucuu

SEQ ID NO: 536066 - RNA, 22 nt, Chlamydophila pneumoniae J138
ucuucuugcaaucuuugaagcu

SEQ ID NO: 536067 - RNA, 19 nt, Chlamydophila pneumoniae J138
ucuucuggguucuccacau

SEQ ID NO: 536068 - RNA, 17 nt, Chlamydophila pneumoniae J138
ucuucuggcugagagaa

SEQ ID NO: 536069 - RNA, 18 nt, Chlamydophila pneumoniae J138
ucuucuuagaagagaaag

SEQ ID NO: 536070 - RNA, 15 nt, Chlamydophila pneumoniae J138
ucuucuguuuucucu

SEQ ID NO: 536071 - RNA, 17 nt, Chlamydophila pneumoniae J138
ucuucuguaauuuuuuu

SEQ ID NO: 536072 - RNA, 17 nt, Chlamydophila pneumoniae J138
ucuucucuaugaacgau

SEQ ID NO: 536073 - RNA, 19 nt, Chlamydophila pneumoniae J138
ucuucugauugaaguucag

SEQ ID NO: 536074 - RNA, 19 nt, Chlamydophila pneumoniae J138
ucuugagccacuuuuaauu

SEQ ID NO: 536075 - RNA, 21 nt, Chlamydophila pneumoniae J138
ucuugagcgacgacaaggaca

SEQ ID NO: 536076 - RNA, 16 nt, Chlamydophila pneumoniae J138
ucuugagcauccaaaa

SEQ ID NO: 536077 - RNA, 17 nt, Chlamydophila pneumoniae J138
ucuugagcauccaaaau

SEQ ID NO: 536078 - RNA, 16 nt, Chlamydophila pneumoniae J138
ucuugaugaccucuau

SEQ ID NO: 536079 - RNA, 18 nt, Chlamydophila pneumoniae J138
ucuugaugaccucuauac

SEQ ID NO: 536080 - RNA, 18 nt, Chlamydophila pneumoniae J138
ucuugauagcuaagagca

SEQ ID NO: 536081 - RNA, 20 nt, Chlamydophila pneumoniae J138
ucuugaagagauugauuucu

SEQ ID NO: 536082 - RNA, 18 nt, Chlamydophila pneumoniae J138
ucuugacaacgguguuca

SEQ ID NO: 536083 - RNA, 23 nt, Chlamydophila pneumoniae J138
ucuugaaaguacaggcuccauca

SEQ ID NO: 536084 - RNA, 18 nt, Chlamydophila pneumoniae J138
ucuucuuugccaaugaga

SEQ ID NO: 536085 - RNA, 14 nt, Chlamydophila pneumoniae J138
ucuucuuugccaau

SEQ ID NO: 536086 - RNA, 15 nt, Chlamydophila pneumoniae J138
ucuugaaaaaauucu

SEQ ID NO: 536087 - RNA, 14 nt, Chlamydophila pneumoniae J138
ucuugauuccuuaa

SEQ ID NO: 536088 - RNA, 14 nt, Chlamydophila pneumoniae J138
ucuugguguauagu

SEQ ID NO: 536089 - RNA, 16 nt, Chlamydophila pneumoniae J138
ucuugguguauaguau

SEQ ID NO: 536090 - RNA, 14 nt, Chlamydophila pneumoniae J138
ucuuuaaaaauaua

SEQ ID NO: 536091 - RNA, 20 nt, Chlamydophila pneumoniae J138
ucuuuaaaaacccaacuccc

SEQ ID NO: 536092 - RNA, 18 nt, Chlamydophila pneumoniae J138
ucuuuaggguaaagaaau

SEQ ID NO: 536093 - RNA, 13 nt, Chlamydophila pneumoniae J138
ucuuuaggagcau

SEQ ID NO: 536094 - RNA, 14 nt, Chlamydophila pneumoniae J138
ucuuuagcaaacau

SEQ ID NO: 536095 - RNA, 15 nt, Chlamydophila pneumoniae J138
ucuuuagaauaagag

SEQ ID NO: 536096 - RNA, 20 nt, Chlamydophila pneumoniae J138
ucugcgauugccggcuauga

SEQ ID NO: 536097 - RNA, 20 nt, Chlamydophila pneumoniae J138
ucugcgauaggaucuucuau

SEQ ID NO: 536098 - RNA, 22 nt, Chlamydophila pneumoniae J138
ucugcgcagcguauaauuggcg

SEQ ID NO: 536099 - RNA, 22 nt, Chlamydophila pneumoniae J138
ucugcuucuccaaauaaagcaa

SEQ ID NO: 536100 - RNA, 22 nt, Chlamydophila pneumoniae J138
ucugcuucuguaaagauucuau

SEQ ID NO: 536101 - RNA, 13 nt, Chlamydophila pneumoniae J138
ucuggauguagag

SEQ ID NO: 536102 - RNA, 18 nt, Chlamydophila pneumoniae J138
ucuggauacguuuuuccc

SEQ ID NO: 536103 - RNA, 23 nt, Chlamydophila pneumoniae J138
ucugggaagacucucaucagcaa

SEQ ID NO: 536104 - RNA, 15 nt, Chlamydophila pneumoniae J138
ucugugaguacccag

SEQ ID NO: 536105 - RNA, 13 nt, Chlamydophila pneumoniae J138
ucugugagaaaua

SEQ ID NO: 536106 - RNA, 14 nt, Chlamydophila pneumoniae J138
ucugugagaaauag

SEQ ID NO: 536107 - RNA, 13 nt, Chlamydophila pneumoniae J138
ucuguauaguuuu

SEQ ID NO: 536108 - RNA, 16 nt, Chlamydophila pneumoniae J138
ucugucuguauuuccg

SEQ ID NO: 536109 - RNA, 23 nt, Chlamydophila pneumoniae J138
ucuguauccuuccuuauugguaa

SEQ ID NO: 536110 - RNA, 15 nt, Chlamydophila pneumoniae J138
ucuguaguaaagcca

SEQ ID NO: 536111 - RNA, 16 nt, Chlamydophila pneumoniae J138
ucuguagguuuuucca

SEQ ID NO: 536112 - RNA, 17 nt, Chlamydophila pneumoniae J138
ucugguauagaaacacc

SEQ ID NO: 536113 - RNA, 21 nt, Chlamydophila pneumoniae J138
ucuguuggucucuauuuagac

SEQ ID NO: 536114 - RNA, 13 nt, Chlamydophila pneumoniae J138
ucuguugggagcu

SEQ ID NO: 536115 - RNA, 15 nt, Chlamydophila pneumoniae J138
ucuguuuuuugaaaa

SEQ ID NO: 536116 - RNA, 12 nt, Chlamydophila pneumoniae J138
ucuuaaaacaug

SEQ ID NO: 536117 - RNA, 13 nt, Chlamydophila pneumoniae J138
ucuguuuuuugaa

SEQ ID NO: 536118 - RNA, 22 nt, Chlamydophila pneumoniae J138
ucugacauuccuuaauuacucg

SEQ ID NO: 536119 - RNA, 15 nt, Chlamydophila pneumoniae J138
ucugacaaguguguu

SEQ ID NO: 536120 - RNA, 19 nt, Chlamydophila pneumoniae J138
ucugauaaucagaggagcc

SEQ ID NO: 536121 - RNA, 16 nt, Chlamydophila pneumoniae J138
ucugaguuagcuuuug

SEQ ID NO: 536122 - RNA, 15 nt, Chlamydophila pneumoniae J138
ucugauaaagcuaca

SEQ ID NO: 536123 - RNA, 14 nt, Chlamydophila pneumoniae J138
ucugagcuugccua

SEQ ID NO: 536124 - RNA, 17 nt, Chlamydophila pneumoniae J138
ucugauuauuucuaaaa

SEQ ID NO: 536125 - RNA, 20 nt, Chlamydophila pneumoniae J138
ucugauuauuucuaaaaaau

SEQ ID NO: 536126 - RNA, 20 nt, Chlamydophila pneumoniae J138
ucugauguaggugauauuuu

SEQ ID NO: 536127 - RNA, 13 nt, Chlamydophila pneumoniae J138
ucugaaacaaugc

SEQ ID NO: 536128 - RNA, 22 nt, Chlamydophila pneumoniae J138
ucucgaaaaauuugcgaagucc

SEQ ID NO: 536129 - RNA, 19 nt, Chlamydophila pneumoniae J138
ucuccuucuggaugcccug

SEQ ID NO: 536130 - RNA, 17 nt, Chlamydophila pneumoniae J138
ucucgaaauccuaaaaa

SEQ ID NO: 536131 - RNA, 13 nt, Chlamydophila pneumoniae J138
ucugcccaaagcu

SEQ ID NO: 536132 - RNA, 19 nt, Chlamydophila pneumoniae J138
ucugcccaaagcuaaaaug

SEQ ID NO: 536133 - RNA, 16 nt, Chlamydophila pneumoniae J138
ucugcccuuucugcaa

SEQ ID NO: 536134 - RNA, 17 nt, Chlamydophila pneumoniae J138
ucugccuaccaaaguuu

SEQ ID NO: 536135 - RNA, 17 nt, Chlamydophila pneumoniae J138
ucugccuuaugcucauu

SEQ ID NO: 536136 - RNA, 22 nt, Chlamydophila pneumoniae J138
ucugcauauaaagacucucuuc

SEQ ID NO: 536137 - RNA, 16 nt, Chlamydophila pneumoniae J138
ucugauuauuucuaaa

SEQ ID NO: 536138 - RNA, 17 nt, Chlamydophila pneumoniae J138
ucugcaggacugucuag

SEQ ID NO: 536139 - RNA, 21 nt, Chlamydophila pneumoniae J138
ucugcauauaaagacucucuu

SEQ ID NO: 536140 - RNA, 16 nt, Chlamydophila pneumoniae J138
ucugcauauugcucuu

SEQ ID NO: 536141 - RNA, 19 nt, Chlamydophila pneumoniae J138
ucugccauaggauccagga

SEQ ID NO: 536142 - RNA, 18 nt, Chlamydophila pneumoniae J138
ucgguuauuuuuccagaa

SEQ ID NO: 536143 - RNA, 21 nt, Chlamydophila pneumoniae J138
ucguagacaacaagucuuccc

SEQ ID NO: 536144 - RNA, 12 nt, Chlamydophila pneumoniae J138
ucgucaccugag

SEQ ID NO: 536145 - RNA, 17 nt, Chlamydophila pneumoniae J138
ucguagccuuacguaaa

SEQ ID NO: 536146 - RNA, 19 nt, Chlamydophila pneumoniae J138
ucguagccccauagagccu

SEQ ID NO: 536147 - RNA, 14 nt, Chlamydophila pneumoniae J138
ucguagcuaaauug

SEQ ID NO: 536148 - RNA, 13 nt, Chlamydophila pneumoniae J138
ucguauuuuccug

SEQ ID NO: 536149 - RNA, 21 nt, Chlamydophila pneumoniae J138
ucguccugacacaacucuuaa

SEQ ID NO: 536150 - RNA, 22 nt, Chlamydophila pneumoniae J138
ucguccugacacaacucuuaaa

SEQ ID NO: 536151 - RNA, 14 nt, Chlamydophila pneumoniae J138
ucgucuuggaaugc

SEQ ID NO: 536152 - RNA, 18 nt, Chlamydophila pneumoniae J138
ucgucuuagaauccucua

SEQ ID NO: 536153 - RNA, 17 nt, Chlamydophila pneumoniae J138
ucguuuucuagcauagu

SEQ ID NO: 536154 - RNA, 17 nt, Chlamydophila pneumoniae J138
ucguuucucuggcaaug

SEQ ID NO: 536155 - RNA, 23 nt, Chlamydophila pneumoniae J138
ucguuucuuugaguuaagcaaua

SEQ ID NO: 536156 - RNA, 22 nt, Chlamydophila pneumoniae J138
ucguuaaaaacuauccuauuuu

SEQ ID NO: 536157 - RNA, 13 nt, Chlamydophila pneumoniae J138
ucguguuuuccug

SEQ ID NO: 536158 - RNA, 22 nt, Chlamydophila pneumoniae J138
ucguugccaaucuuucauuccc

SEQ ID NO: 536159 - RNA, 20 nt, Chlamydophila pneumoniae J138
ucuaaaauaaccccuccaaa

SEQ ID NO: 536160 - RNA, 19 nt, Chlamydophila pneumoniae J138
ucuaaaacaucagcaacau

SEQ ID NO: 536161 - RNA, 18 nt, Chlamydophila pneumoniae J138
ucuaaaacagaaauugcu

SEQ ID NO: 536162 - RNA, 20 nt, Chlamydophila pneumoniae J138
ucuaaaagcaaguuguugau

SEQ ID NO: 536163 - RNA, 12 nt, Chlamydophila pneumoniae J138
ucuaaacauaaa

SEQ ID NO: 536164 - RNA, 19 nt, Chlamydophila pneumoniae J138
ucuaaacauaaagacccuu

SEQ ID NO: 536165 - RNA, 23 nt, Chlamydophila pneumoniae J138
ucuaaccaaccuuguugaaaggc

SEQ ID NO: 536166 - RNA, 15 nt, Chlamydophila pneumoniae J138
ucuaaagaaauguaa

SEQ ID NO: 536167 - RNA, 12 nt, Chlamydophila pneumoniae J138
ucuaaagaaaug

SEQ ID NO: 536168 - RNA, 18 nt, Chlamydophila pneumoniae J138
ucuaaagcugcuuuuucu

SEQ ID NO: 536169 - RNA, 21 nt, Chlamydophila pneumoniae J138
ucuacugaaaccuucucucuu

SEQ ID NO: 536170 - RNA, 22 nt, Chlamydophila pneumoniae J138
ucuacugaaaccuucucucuua

SEQ ID NO: 536171 - RNA, 16 nt, Chlamydophila pneumoniae J138
ucuacucuuuaaaaau

SEQ ID NO: 536172 - RNA, 17 nt, Chlamydophila pneumoniae J138
ucuacuaaaaucucauu

SEQ ID NO: 536173 - RNA, 16 nt, Chlamydophila pneumoniae J138
ucuacgauguuuucuu

SEQ ID NO: 536174 - RNA, 20 nt, Chlamydophila pneumoniae J138
ucuaccgaacagagcgucua

SEQ ID NO: 536175 - RNA, 18 nt, Chlamydophila pneumoniae J138
ucuaccaauucucucucu

SEQ ID NO: 536176 - RNA, 18 nt, Chlamydophila pneumoniae J138
ucuacaccauagaacugc

SEQ ID NO: 536177 - RNA, 20 nt, Chlamydophila pneumoniae J138
ucuacacacaugacaaauaa

SEQ ID NO: 536178 - RNA, 16 nt, Chlamydophila pneumoniae J138
ucuaaugguuucccac

SEQ ID NO: 536179 - RNA, 14 nt, Chlamydophila pneumoniae J138
ucuauguguucucg

SEQ ID NO: 536180 - RNA, 16 nt, Chlamydophila pneumoniae J138
ucuaucuugaaaguac

SEQ ID NO: 536181 - RNA, 22 nt, Chlamydophila pneumoniae J138
ucuaugauccaauagccaaaga

SEQ ID NO: 536182 - RNA, 19 nt, Chlamydophila pneumoniae J138
ucuaugccauaaauacagg

SEQ ID NO: 536183 - RNA, 19 nt, Chlamydophila pneumoniae J138
ucuaugauccgaaaacucu

SEQ ID NO: 536184 - RNA, 22 nt, Chlamydophila pneumoniae J138
ucuaugagaguaaguuuuuaau

SEQ ID NO: 536185 - RNA, 19 nt, Chlamydophila pneumoniae J138
ucuaugagaguaaguuuuu

SEQ ID NO: 536186 - RNA, 19 nt, Chlamydophila pneumoniae J138
ucuaucagggcuacgguaa

SEQ ID NO: 536187 - RNA, 13 nt, Chlamydophila pneumoniae J138
ucuauccaucauc

SEQ ID NO: 536188 - RNA, 19 nt, Chlamydophila pneumoniae J138
ucuaucgauagccauuaga

SEQ ID NO: 536189 - RNA, 18 nt, Chlamydophila pneumoniae J138
ucuauauccacaaucucu

SEQ ID NO: 536190 - RNA, 16 nt, Chlamydophila pneumoniae J138
ucuauagaguagcuca

SEQ ID NO: 536191 - RNA, 15 nt, Chlamydophila pneumoniae J138
ucuagcuuugucucu

SEQ ID NO: 536192 - RNA, 15 nt, Chlamydophila pneumoniae J138
ucuagcuaauaauga

SEQ ID NO: 536193 - RNA, 15 nt, Chlamydophila pneumoniae J138
ucuagcuuccucacg

SEQ ID NO: 536194 - RNA, 15 nt, Chlamydophila pneumoniae J138
ucuagggucaagaac

SEQ ID NO: 536195 - RNA, 12 nt, Chlamydophila pneumoniae J138
ucuaggagcuuc

SEQ ID NO: 536196 - RNA, 18 nt, Chlamydophila pneumoniae J138
ucuagguuuucucuuccu

SEQ ID NO: 536197 - RNA, 15 nt, Chlamydophila pneumoniae J138
ucuagguuuucucuu

SEQ ID NO: 536198 - RNA, 14 nt, Chlamydophila pneumoniae J138
ucuaguucuagaaa

SEQ ID NO: 536199 - RNA, 15 nt, Chlamydophila pneumoniae J138
ucuauaacuacaaaa

SEQ ID NO: 536200 - RNA, 18 nt, Chlamydophila pneumoniae J138
ucuauaauuaauccuuga

SEQ ID NO: 536201 - RNA, 18 nt, Chlamydophila pneumoniae J138
ucuaguuuuucuuuagag

SEQ ID NO: 536202 - RNA, 15 nt, Chlamydophila pneumoniae J138
ucuauaaauguaggg

SEQ ID NO: 536203 - RNA, 14 nt, Chlamydophila pneumoniae J138
ucuagaaaaucucu

SEQ ID NO: 536204 - RNA, 21 nt, Chlamydophila pneumoniae J138
ucuagaaaaauucuuuaggga

SEQ ID NO: 536205 - RNA, 23 nt, Chlamydophila pneumoniae J138
ucuagaaacaacugaaaaaccau

SEQ ID NO: 536206 - RNA, 16 nt, Chlamydophila pneumoniae J138
ucuagaaaaucucuaa

SEQ ID NO: 536207 - RNA, 18 nt, Chlamydophila pneumoniae J138
ucuagaaaagauucuaaa

SEQ ID NO: 536208 - RNA, 17 nt, Chlamydophila pneumoniae J138
ucuagaaagauuuauuu

SEQ ID NO: 536209 - RNA, 14 nt, Chlamydophila pneumoniae J138
ucuagaaguuuaaa

SEQ ID NO: 536210 - RNA, 17 nt, Chlamydophila pneumoniae J138
ucuagaaugaugcaagc

SEQ ID NO: 536211 - RNA, 12 nt, Chlamydophila pneumoniae J138
ucuagaagauga

SEQ ID NO: 536212 - RNA, 17 nt, Chlamydophila pneumoniae J138
ucuagaguugcuuuaug

SEQ ID NO: 536213 - RNA, 14 nt, Chlamydophila pneumoniae J138
ucuagaucuucaau

SEQ ID NO: 536214 - RNA, 15 nt, Chlamydophila pneumoniae J138
ucuagagauuuuucu

SEQ ID NO: 536215 - RNA, 17 nt, Chlamydophila pneumoniae J138
ucuagcaaaucuaaaac

SEQ ID NO: 536216 - RNA, 16 nt, Chlamydophila pneumoniae J138
ucuagcucaaaucuca

SEQ ID NO: 536217 - RNA, 13 nt, Chlamydophila pneumoniae J138
ucuagcugcucuu

SEQ ID NO: 536218 - RNA, 12 nt, Chlamydophila pneumoniae J138
ucuccguccccc

SEQ ID NO: 536219 - RNA, 22 nt, Chlamydophila pneumoniae J138
ucuccgucccccggcucuguug

SEQ ID NO: 536220 - RNA, 17 nt, Chlamydophila pneumoniae J138
ucuccgucauauuuaaa

SEQ ID NO: 536221 - RNA, 17 nt, Chlamydophila pneumoniae J138
ucuccuaaaccaucacu

SEQ ID NO: 536222 - RNA, 21 nt, Chlamydophila pneumoniae J138
ucuccuaggucuaauccccaa

SEQ ID NO: 536223 - RNA, 23 nt, Chlamydophila pneumoniae J138
ucuccuugacaaauaaguccugu

SEQ ID NO: 536224 - RNA, 13 nt, Chlamydophila pneumoniae J138
ucuccuugacaaa

SEQ ID NO: 536225 - RNA, 14 nt, Chlamydophila pneumoniae J138
ucuccuuaccaaua

SEQ ID NO: 536226 - RNA, 21 nt, Chlamydophila pneumoniae J138
ucucccauguaguaaauuccu

SEQ ID NO: 536227 - RNA, 21 nt, Chlamydophila pneumoniae J138
ucuccauccucagucucucua

SEQ ID NO: 536228 - RNA, 17 nt, Chlamydophila pneumoniae J138
ucuccauccucagucuc

SEQ ID NO: 536229 - RNA, 14 nt, Chlamydophila pneumoniae J138
ucucagugaacucu

SEQ ID NO: 536230 - RNA, 22 nt, Chlamydophila pneumoniae J138
ucucaggaaagguaguuuucuu

SEQ ID NO: 536231 - RNA, 15 nt, Chlamydophila pneumoniae J138
ucucaguuaaagagc

SEQ ID NO: 536232 - RNA, 17 nt, Chlamydophila pneumoniae J138
ucucaguaggagcagcg

SEQ ID NO: 536233 - RNA, 15 nt, Chlamydophila pneumoniae J138
ucuccaaaagcucua

SEQ ID NO: 536234 - RNA, 22 nt, Chlamydophila pneumoniae J138
ucucauuucguagacgcucuaa

SEQ ID NO: 536235 - RNA, 21 nt, Chlamydophila pneumoniae J138
ucucaucggcauaacuuuauc

SEQ ID NO: 536236 - RNA, 17 nt, Chlamydophila pneumoniae J138
ucuccacagcuucuucg

SEQ ID NO: 536237 - RNA, 14 nt, Chlamydophila pneumoniae J138
ucuccaaagauaca

SEQ ID NO: 536238 - RNA, 21 nt, Chlamydophila pneumoniae J138
ucuccaaagagucucuugcuu

SEQ ID NO: 536239 - RNA, 13 nt, Chlamydophila pneumoniae J138
ucucaaauuucaa

SEQ ID NO: 536240 - RNA, 16 nt, Chlamydophila pneumoniae J138
ucucaaagaucaucua

SEQ ID NO: 536241 - RNA, 16 nt, Chlamydophila pneumoniae J138
ucucaacgcaauagga

SEQ ID NO: 536242 - RNA, 13 nt, Chlamydophila pneumoniae J138
ucuauuuucagga

SEQ ID NO: 536243 - RNA, 22 nt, Chlamydophila pneumoniae J138
ucucaagaguaggcaauacaga

SEQ ID NO: 536244 - RNA, 17 nt, Chlamydophila pneumoniae J138
ucucaaguaagaagucu

SEQ ID NO: 536245 - RNA, 16 nt, Chlamydophila pneumoniae J138
ucucacaagcauccua

SEQ ID NO: 536246 - RNA, 18 nt, Chlamydophila pneumoniae J138
ucucaccagaagcaacua

SEQ ID NO: 536247 - RNA, 14 nt, Chlamydophila pneumoniae J138
ucucacucuaugag

SEQ ID NO: 536248 - RNA, 15 nt, Chlamydophila pneumoniae J138
ucucacucuuuucua

SEQ ID NO: 536249 - RNA, 11 nt, Chlamydophila pneumoniae J138
ucucacugagu

SEQ ID NO: 536250 - RNA, 19 nt, Chlamydophila pneumoniae J138
ucucagauaaaaagaagua

SEQ ID NO: 536251 - RNA, 21 nt, Chlamydophila pneumoniae J138
ucucagaaagccuuugcucac

SEQ ID NO: 536252 - RNA, 15 nt, Chlamydophila pneumoniae J138
ucgcuagaucacaag

SEQ ID NO: 536253 - RNA, 14 nt, Chlamydophila pneumoniae J138
ucgcuaagcaaagc

SEQ ID NO: 536254 - RNA, 13 nt, Chlamydophila pneumoniae J138
ucgcucuccucuc

SEQ ID NO: 536255 - RNA, 14 nt, Chlamydophila pneumoniae J138
ucgcugauaaaaua

SEQ ID NO: 536256 - RNA, 21 nt, Chlamydophila pneumoniae J138
ucggaauuugccugaaauccu

SEQ ID NO: 536257 - RNA, 14 nt, Chlamydophila pneumoniae J138
ucggcaauuguuaa

SEQ ID NO: 536258 - RNA, 15 nt, Chlamydophila pneumoniae J138
ucgcggaucuucuuc

SEQ ID NO: 536259 - RNA, 15 nt, Chlamydophila pneumoniae J138
ucgauacccaaagag

SEQ ID NO: 536260 - RNA, 16 nt, Chlamydophila pneumoniae J138
ucgauacgguuuuuau

SEQ ID NO: 536261 - RNA, 15 nt, Chlamydophila pneumoniae J138
ucgaugagggaaaug

SEQ ID NO: 536262 - RNA, 14 nt, Chlamydophila pneumoniae J138
ucgauuauuucuug

SEQ ID NO: 536263 - RNA, 22 nt, Chlamydophila pneumoniae J138
ucgccaaacgaauuucuuguuc

SEQ ID NO: 536264 - RNA, 11 nt, Chlamydophila pneumoniae J138
ucgccaaacca

SEQ ID NO: 536265 - RNA, 13 nt, Chlamydophila pneumoniae J138
ucgccaaaccaug

SEQ ID NO: 536266 - RNA, 23 nt, Chlamydophila pneumoniae J138
ucgcaaauauaguuuucauaauc

SEQ ID NO: 536267 - RNA, 19 nt, Chlamydophila pneumoniae J138
ucgaagagcccucuucacu

SEQ ID NO: 536268 - RNA, 16 nt, Chlamydophila pneumoniae J138
uccuuaacaacaucac

SEQ ID NO: 536269 - RNA, 22 nt, Chlamydophila pneumoniae J138
uccuuaacaacaucacuuauau

SEQ ID NO: 536270 - RNA, 23 nt, Chlamydophila pneumoniae J138
ucgaagaaaauaaagaucuucau

SEQ ID NO: 536271 - RNA, 19 nt, Chlamydophila pneumoniae J138
ucgaagaacuuagcaauga

SEQ ID NO: 536272 - RNA, 21 nt, Chlamydophila pneumoniae J138
uccuguuucaacauaacauga

SEQ ID NO: 536273 - RNA, 19 nt, Chlamydophila pneumoniae J138
ucgaaucuuuauuucugau

SEQ ID NO: 536274 - RNA, 20 nt, Chlamydophila pneumoniae J138
ucgaaugguuccugaagcag

SEQ ID NO: 536275 - RNA, 16 nt, Chlamydophila pneumoniae J138
ucgaagcuugcugauu

SEQ ID NO: 536276 - RNA, 20 nt, Chlamydophila pneumoniae J138
ucgacaugcaggccaacucu

SEQ ID NO: 536277 - RNA, 19 nt, Chlamydophila pneumoniae J138
ucgacaggggaguuuucaa

SEQ ID NO: 536278 - RNA, 16 nt, Chlamydophila pneumoniae J138
ucgagauauugugagg

SEQ ID NO: 536279 - RNA, 19 nt, Chlamydophila pneumoniae J138
ucgagagaagaaauucuga

SEQ ID NO: 536280 - RNA, 17 nt, Chlamydophila pneumoniae J138
ucgagaucuuuuugcca

SEQ ID NO: 536281 - RNA, 15 nt, Chlamydophila pneumoniae J138
ucgagaaccuccacc

SEQ ID NO: 536282 - RNA, 18 nt, Chlamydophila pneumoniae J138
ucgagaacguagcagagg

SEQ ID NO: 536283 - RNA, 20 nt, Chlamydophila pneumoniae J138
ucgagaacguagcagaggca

SEQ ID NO: 536284 - RNA, 21 nt, Chlamydophila pneumoniae J138
ucgacuuuuuuaagagugucu

SEQ ID NO: 536285 - RNA, 19 nt, Chlamydophila pneumoniae J138
ucgagcagaaacuccaaaa

SEQ ID NO: 536286 - RNA, 15 nt, Chlamydophila pneumoniae J138
ucgagcagaaaugau

SEQ ID NO: 536287 - RNA, 15 nt, Chlamydophila pneumoniae J138
ucgacuuccuucaau

SEQ ID NO: 536288 - RNA, 17 nt, Chlamydophila pneumoniae J138
uccgcaaguaaucauga

SEQ ID NO: 536289 - RNA, 15 nt, Chlamydophila pneumoniae J138
uccgcaguuguacaa

SEQ ID NO: 536290 - RNA, 17 nt, Chlamydophila pneumoniae J138
uccgcaggucgcaucaa

SEQ ID NO: 536291 - RNA, 14 nt, Chlamydophila pneumoniae J138
uccggaacgcagag

SEQ ID NO: 536292 - RNA, 13 nt, Chlamydophila pneumoniae J138
uccguauaaguau

SEQ ID NO: 536293 - RNA, 16 nt, Chlamydophila pneumoniae J138
uccucucgauucucgu

SEQ ID NO: 536294 - RNA, 22 nt, Chlamydophila pneumoniae J138
uccucucaugaaauuuucuaag

SEQ ID NO: 536295 - RNA, 17 nt, Chlamydophila pneumoniae J138
uccucgauacuguugau

SEQ ID NO: 536296 - RNA, 23 nt, Chlamydophila pneumoniae J138
uccucgauacuguugauccuucu

SEQ ID NO: 536297 - RNA, 16 nt, Chlamydophila pneumoniae J138
uccucggcaacuacug

SEQ ID NO: 536298 - RNA, 14 nt, Chlamydophila pneumoniae J138
uccucgauacuguu

SEQ ID NO: 536299 - RNA, 17 nt, Chlamydophila pneumoniae J138
uccucuuucuuaggaaa

SEQ ID NO: 536300 - RNA, 15 nt, Chlamydophila pneumoniae J138
uccucuucaauuucu

SEQ ID NO: 536301 - RNA, 14 nt, Chlamydophila pneumoniae J138
uccucugaaggauu

SEQ ID NO: 536302 - RNA, 14 nt, Chlamydophila pneumoniae J138
uccucucuuuauau

SEQ ID NO: 536303 - RNA, 14 nt, Chlamydophila pneumoniae J138
uccucucaugaaau

SEQ ID NO: 536304 - RNA, 19 nt, Chlamydophila pneumoniae J138
uccugaaucagcuuaucua

SEQ ID NO: 536305 - RNA, 12 nt, Chlamydophila pneumoniae J138
uccugaccagug

SEQ ID NO: 536306 - RNA, 17 nt, Chlamydophila pneumoniae J138
uccugacuauaaaaugc

SEQ ID NO: 536307 - RNA, 21 nt, Chlamydophila pneumoniae J138
uccugaauggcucugucacua

SEQ ID NO: 536308 - RNA, 19 nt, Chlamydophila pneumoniae J138
uccugaagggacaaguacg

SEQ ID NO: 536309 - RNA, 19 nt, Chlamydophila pneumoniae J138
uccugaauaugcuuuucaa

SEQ ID NO: 536310 - RNA, 18 nt, Chlamydophila pneumoniae J138
uccugaacggcucuuucu

SEQ ID NO: 536311 - RNA, 21 nt, Chlamydophila pneumoniae J138
uccugagagcguuguggaagu

SEQ ID NO: 536312 - RNA, 15 nt, Chlamydophila pneumoniae J138
uccugacucuuuuaa

SEQ ID NO: 536313 - RNA, 11 nt, Chlamydophila pneumoniae J138
uccugagagcg

SEQ ID NO: 536314 - RNA, 19 nt, Chlamydophila pneumoniae J138
uccugaggcuauagaauac

SEQ ID NO: 536315 - RNA, 19 nt, Chlamydophila pneumoniae J138
uccugagguugggcagaag

SEQ ID NO: 536316 - RNA, 21 nt, Chlamydophila pneumoniae J138
uccugagguugggcagaagcu

SEQ ID NO: 536317 - RNA, 17 nt, Chlamydophila pneumoniae J138
uccugaugccuuuuucu

SEQ ID NO: 536318 - RNA, 23 nt, Chlamydophila pneumoniae J138
uccugaucccuuagaaauucuaa

SEQ ID NO: 536319 - RNA, 22 nt, Chlamydophila pneumoniae J138
uccuggggugcguaucaguuuu

SEQ ID NO: 536320 - RNA, 17 nt, Chlamydophila pneumoniae J138
uccucaagauaaauccc

SEQ ID NO: 536321 - RNA, 13 nt, Chlamydophila pneumoniae J138
uccucaagaauau

SEQ ID NO: 536322 - RNA, 19 nt, Chlamydophila pneumoniae J138
uccuauuuuagcauaaucu

SEQ ID NO: 536323 - RNA, 14 nt, Chlamydophila pneumoniae J138
uccucaaaagauau

SEQ ID NO: 536324 - RNA, 15 nt, Chlamydophila pneumoniae J138
uccucaccgaucuca

SEQ ID NO: 536325 - RNA, 16 nt, Chlamydophila pneumoniae J138
uccucacaucuccuuu

SEQ ID NO: 536326 - RNA, 13 nt, Chlamydophila pneumoniae J138
uccucaauuuguu

SEQ ID NO: 536327 - RNA, 13 nt, Chlamydophila pneumoniae J138
uccucacuauuaa

SEQ ID NO: 536328 - RNA, 16 nt, Chlamydophila pneumoniae J138
uccucagaauccauuu

SEQ ID NO: 536329 - RNA, 15 nt, Chlamydophila pneumoniae J138
uccuaucaaagcaaa

SEQ ID NO: 536330 - RNA, 16 nt, Chlamydophila pneumoniae J138
uccuaugaucagagag

SEQ ID NO: 536331 - RNA, 17 nt, Chlamydophila pneumoniae J138
uccuauaguaauuucuc

SEQ ID NO: 536332 - RNA, 15 nt, Chlamydophila pneumoniae J138
uccuagcagagaaau

SEQ ID NO: 536333 - RNA, 17 nt, Chlamydophila pneumoniae J138
uccuaggcugagacaua

SEQ ID NO: 536334 - RNA, 18 nt, Chlamydophila pneumoniae J138
uccuagggagugaggaau

SEQ ID NO: 536335 - RNA, 18 nt, Chlamydophila pneumoniae J138
uccuccaaugagcucuau

SEQ ID NO: 536336 - RNA, 14 nt, Chlamydophila pneumoniae J138
uccuccaaaagacc

SEQ ID NO: 536337 - RNA, 12 nt, Chlamydophila pneumoniae J138
uccuccaaaauu

SEQ ID NO: 536338 - RNA, 12 nt, Chlamydophila pneumoniae J138
uccucagucucu

SEQ ID NO: 536339 - RNA, 13 nt, Chlamydophila pneumoniae J138
uccucaucagaag

SEQ ID NO: 536340 - RNA, 14 nt, Chlamydophila pneumoniae J138
uccucaucagaagc

SEQ ID NO: 536341 - RNA, 16 nt, Chlamydophila pneumoniae J138
uccuccauguacaguu

SEQ ID NO: 536342 - RNA, 22 nt, Chlamydophila pneumoniae J138
uccuccauggaaagaaacaaau

SEQ ID NO: 536343 - RNA, 20 nt, Chlamydophila pneumoniae J138
uccuccucgucuaaagaaga

SEQ ID NO: 536344 - RNA, 23 nt, Chlamydophila pneumoniae J138
uccuccuucugcaaucagugcug

SEQ ID NO: 536345 - RNA, 16 nt, Chlamydophila pneumoniae J138
uccguuucagaaguca

SEQ ID NO: 536346 - RNA, 18 nt, Chlamydophila pneumoniae J138
uccguucgagagguuccc

SEQ ID NO: 536347 - RNA, 19 nt, Chlamydophila pneumoniae J138
uccuaaaaaggguuccucu

SEQ ID NO: 536348 - RNA, 11 nt, Chlamydophila pneumoniae J138
uccuaaaaaaa

SEQ ID NO: 536349 - RNA, 17 nt, Chlamydophila pneumoniae J138
uccuaaaauuucuagga

SEQ ID NO: 536350 - RNA, 15 nt, Chlamydophila pneumoniae J138
uccuaaaauuucuag

SEQ ID NO: 536351 - RNA, 21 nt, Chlamydophila pneumoniae J138
uccuaaguuagagacacagaa

SEQ ID NO: 536352 - RNA, 19 nt, Chlamydophila pneumoniae J138
uccuaagucguuaacauca

SEQ ID NO: 536353 - RNA, 23 nt, Chlamydophila pneumoniae J138
uccuaaauuaaauaucuaauaaa

SEQ ID NO: 536354 - RNA, 15 nt, Chlamydophila pneumoniae J138
uccuaacaaaaggau

SEQ ID NO: 536355 - RNA, 19 nt, Chlamydophila pneumoniae J138
uccuaacuucugaaggaaa

SEQ ID NO: 536356 - RNA, 18 nt, Chlamydophila pneumoniae J138
uccuaagagauuuuccau

SEQ ID NO: 536357 - RNA, 14 nt, Chlamydophila pneumoniae J138
uccuaccuauauuu

SEQ ID NO: 536358 - RNA, 19 nt, Chlamydophila pneumoniae J138
uccuaccuacguagcauua

SEQ ID NO: 536359 - RNA, 13 nt, Chlamydophila pneumoniae J138
uccuacggcaaga

SEQ ID NO: 536360 - RNA, 16 nt, Chlamydophila pneumoniae J138
uccuacuccuaaagua

SEQ ID NO: 536361 - RNA, 13 nt, Chlamydophila pneumoniae J138
ucccgacaagcuu

SEQ ID NO: 536362 - RNA, 15 nt, Chlamydophila pneumoniae J138
uccccuucauucuuu

SEQ ID NO: 536363 - RNA, 23 nt, Chlamydophila pneumoniae J138
uccccucugauuauuucuaaaaa

SEQ ID NO: 536364 - RNA, 16 nt, Chlamydophila pneumoniae J138
uccccugcaucucugc

SEQ ID NO: 536365 - RNA, 19 nt, Chlamydophila pneumoniae J138
uccccucugauuauuucua

SEQ ID NO: 536366 - RNA, 21 nt, Chlamydophila pneumoniae J138
ucccgagggaugaugcccuga

SEQ ID NO: 536367 - RNA, 17 nt, Chlamydophila pneumoniae J138
ucccgacauuuaacauc

SEQ ID NO: 536368 - RNA, 21 nt, Chlamydophila pneumoniae J138
ucccuagguuuuaucuuuaga

SEQ ID NO: 536369 - RNA, 23 nt, Chlamydophila pneumoniae J138
ucccuauaaagcaaaugccugua

SEQ ID NO: 536370 - RNA, 22 nt, Chlamydophila pneumoniae J138
ucccuaaaguaacgauaagaag

SEQ ID NO: 536371 - RNA, 16 nt, Chlamydophila pneumoniae J138
ucccuagcauacaucg

SEQ ID NO: 536372 - RNA, 23 nt, Chlamydophila pneumoniae J138
ucccuaaaaugagauuccuauga

SEQ ID NO: 536373 - RNA, 13 nt, Chlamydophila pneumoniae J138
ucccguuccuuua

SEQ ID NO: 536374 - RNA, 18 nt, Chlamydophila pneumoniae J138
ucccgugagcaugcucac

SEQ ID NO: 536375 - RNA, 21 nt, Chlamydophila pneumoniae J138
ucccgguaugaucaagaggag

SEQ ID NO: 536376 - RNA, 12 nt, Chlamydophila pneumoniae J138
ucccuccuuccu

SEQ ID NO: 536377 - RNA, 23 nt, Chlamydophila pneumoniae J138
ucccuccuccucgucuaaagaag

SEQ ID NO: 536378 - RNA, 18 nt, Chlamydophila pneumoniae J138
ucccuccgcaguuguaca

SEQ ID NO: 536379 - RNA, 15 nt, Chlamydophila pneumoniae J138
ucccucuucuuccaa

SEQ ID NO: 536380 - RNA, 15 nt, Chlamydophila pneumoniae J138
ucccugguacuuaug

SEQ ID NO: 536381 - RNA, 18 nt, Chlamydophila pneumoniae J138
ucccuggauuucuucugu

SEQ ID NO: 536382 - RNA, 20 nt, Chlamydophila pneumoniae J138
ucccugauguugcccuacaa

SEQ ID NO: 536383 - RNA, 13 nt, Chlamydophila pneumoniae J138
ucccuucuucuuu

SEQ ID NO: 536384 - RNA, 17 nt, Chlamydophila pneumoniae J138
ucccuucuucuuuuaga

SEQ ID NO: 536385 - RNA, 12 nt, Chlamydophila pneumoniae J138
ucccuucuucuu

SEQ ID NO: 536386 - RNA, 13 nt, Chlamydophila pneumoniae J138
ucccuuuuuaagu

SEQ ID NO: 536387 - RNA, 18 nt, Chlamydophila pneumoniae J138
ucccuuagaaauucuaag

SEQ ID NO: 536388 - RNA, 18 nt, Chlamydophila pneumoniae J138
ucccuguaguuucuaaaa

SEQ ID NO: 536389 - RNA, 18 nt, Chlamydophila pneumoniae J138
uccgaggagggaaacacc

SEQ ID NO: 536390 - RNA, 16 nt, Chlamydophila pneumoniae J138
uccgaggagggaaaca

SEQ ID NO: 536391 - RNA, 19 nt, Chlamydophila pneumoniae J138
uccgaucauaauuagagag

SEQ ID NO: 536392 - RNA, 12 nt, Chlamydophila pneumoniae J138
uccgauauacuu

SEQ ID NO: 536393 - RNA, 15 nt, Chlamydophila pneumoniae J138
uccgauuaguaauga

SEQ ID NO: 536394 - RNA, 19 nt, Chlamydophila pneumoniae J138
uccgauuaguaaugaugua

SEQ ID NO: 536395 - RNA, 17 nt, Chlamydophila pneumoniae J138
uccgagaaacaaccauc

SEQ ID NO: 536396 - RNA, 23 nt, Chlamydophila pneumoniae J138
uccgaagacucaaagaacugcau

SEQ ID NO: 536397 - RNA, 19 nt, Chlamydophila pneumoniae J138
uccgaaaucugacagaccu

SEQ ID NO: 536398 - RNA, 21 nt, Chlamydophila pneumoniae J138
ucccaugugcugaagaccaug

SEQ ID NO: 536399 - RNA, 18 nt, Chlamydophila pneumoniae J138
ucccaugugcugaagacc

SEQ ID NO: 536400 - RNA, 16 nt, Chlamydophila pneumoniae J138
ucccauguaguaaauu

SEQ ID NO: 536401 - RNA, 15 nt, Chlamydophila pneumoniae J138
ucccaucacauaaau

SEQ ID NO: 536402 - RNA, 22 nt, Chlamydophila pneumoniae J138
ucccaucaucgagcugaucuuc

SEQ ID NO: 536403 - RNA, 21 nt, Chlamydophila pneumoniae J138
ucccauaaauguauaggcauu

SEQ ID NO: 536404 - RNA, 16 nt, Chlamydophila pneumoniae J138
ucccagauuacaagag

SEQ ID NO: 536405 - RNA, 20 nt, Chlamydophila pneumoniae J138
ucccagauuuuuuugguugc

SEQ ID NO: 536406 - RNA, 24 nt, Chlamydophila pneumoniae J138
uccccccucacaauauaaaugcua

SEQ ID NO: 536407 - RNA, 23 nt, Chlamydophila pneumoniae J138
ucccccugaaugcaacagaguca

SEQ ID NO: 536408 - RNA, 23 nt, Chlamydophila pneumoniae J138
uccaugacuuuuguugcaauucc

SEQ ID NO: 536409 - RNA, 21 nt, Chlamydophila pneumoniae J138
uccaucggggcggacuauguu

SEQ ID NO: 536410 - RNA, 22 nt, Chlamydophila pneumoniae J138
uccauggauauggaauggcuuu

SEQ ID NO: 536411 - RNA, 22 nt, Chlamydophila pneumoniae J138
uccauucagauggucagucucg

SEQ ID NO: 536412 - RNA, 15 nt, Chlamydophila pneumoniae J138
uccauuauacuuuuu

SEQ ID NO: 536413 - RNA, 18 nt, Chlamydophila pneumoniae J138
uccauucugagaaagaag

SEQ ID NO: 536414 - RNA, 20 nt, Chlamydophila pneumoniae J138
uccauucuuaauauaaaaga

SEQ ID NO: 536415 - RNA, 21 nt, Chlamydophila pneumoniae J138
uccauuagggcauucuguaau

SEQ ID NO: 536416 - RNA, 21 nt, Chlamydophila pneumoniae J138
uccauuggcauagagccuaga

SEQ ID NO: 536417 - RNA, 14 nt, Chlamydophila pneumoniae J138
uccauuuagaauga

SEQ ID NO: 536418 - RNA, 13 nt, Chlamydophila pneumoniae J138
ucccaaacuucuu

SEQ ID NO: 536419 - RNA, 15 nt, Chlamydophila pneumoniae J138
ucccaagucugcuug

SEQ ID NO: 536420 - RNA, 14 nt, Chlamydophila pneumoniae J138
ucccaagggccaga

SEQ ID NO: 536421 - RNA, 16 nt, Chlamydophila pneumoniae J138
ucccaagcugaaagaa

SEQ ID NO: 536422 - RNA, 11 nt, Chlamydophila pneumoniae J138
ucccacagaaa

SEQ ID NO: 536423 - RNA, 20 nt, Chlamydophila pneumoniae J138
ucccacggugccuaggcuaa

SEQ ID NO: 536424 - RNA, 17 nt, Chlamydophila pneumoniae J138
uccagcccccaggcugc

SEQ ID NO: 536425 - RNA, 17 nt, Chlamydophila pneumoniae J138
uccagccugugagcucu

SEQ ID NO: 536426 - RNA, 22 nt, Chlamydophila pneumoniae J138
uccagcuccauaagcuuuucuu

SEQ ID NO: 536427 - RNA, 20 nt, Chlamydophila pneumoniae J138
uccagcugagcuaucuucaa

SEQ ID NO: 536428 - RNA, 14 nt, Chlamydophila pneumoniae J138
uccagcuguggugg

SEQ ID NO: 536429 - RNA, 15 nt, Chlamydophila pneumoniae J138
uccagcuucucccau

SEQ ID NO: 536430 - RNA, 17 nt, Chlamydophila pneumoniae J138
uccaggacguaaaaaga

SEQ ID NO: 536431 - RNA, 18 nt, Chlamydophila pneumoniae J138
uccaguuuguugaucucu

SEQ ID NO: 536432 - RNA, 19 nt, Chlamydophila pneumoniae J138
uccaguagaucuucugaaa

SEQ ID NO: 536433 - RNA, 23 nt, Chlamydophila pneumoniae J138
uccaguagagccucuaagaaaau

SEQ ID NO: 536434 - RNA, 17 nt, Chlamydophila pneumoniae J138
uccaguaucuucucuua

SEQ ID NO: 536435 - RNA, 23 nt, Chlamydophila pneumoniae J138
uccagguagcagaguuuuucccu

SEQ ID NO: 536436 - RNA, 23 nt, Chlamydophila pneumoniae J138
uccaucacgaggagcuuuuaccu

SEQ ID NO: 536437 - RNA, 22 nt, Chlamydophila pneumoniae J138
uccauaugggacuucaagccaa

SEQ ID NO: 536438 - RNA, 22 nt, Chlamydophila pneumoniae J138
uccauaagcuuuucuuccaaag

SEQ ID NO: 536439 - RNA, 18 nt, Chlamydophila pneumoniae J138
uccauaacaguuuguucu

SEQ ID NO: 536440 - RNA, 20 nt, Chlamydophila pneumoniae J138
uccauaagcuuuucuuccaa

SEQ ID NO: 536441 - RNA, 18 nt, Chlamydophila pneumoniae J138
uccauacccaaauuucuu

SEQ ID NO: 536442 - RNA, 13 nt, Chlamydophila pneumoniae J138
uccauaauuucuu

SEQ ID NO: 536443 - RNA, 20 nt, Chlamydophila pneumoniae J138
uccauagcuuuagaagcccg

SEQ ID NO: 536444 - RNA, 16 nt, Chlamydophila pneumoniae J138
uccauaggaacaaagc

SEQ ID NO: 536445 - RNA, 16 nt, Chlamydophila pneumoniae J138
uccauaggaucugcau

SEQ ID NO: 536446 - RNA, 21 nt, Chlamydophila pneumoniae J138
uccauagcuaaguaacagucc

SEQ ID NO: 536447 - RNA, 18 nt, Chlamydophila pneumoniae J138
uccauagcuuuagaagcc

SEQ ID NO: 536448 - RNA, 21 nt, Chlamydophila pneumoniae J138
uccauagccaaggagcuauag

SEQ ID NO: 536449 - RNA, 22 nt, Chlamydophila pneumoniae J138
uccauagcgauagcuaaaccuu

SEQ ID NO: 536450 - RNA, 21 nt, Chlamydophila pneumoniae J138
uccauagaguaucuaaaacuu

SEQ ID NO: 536451 - RNA, 15 nt, Chlamydophila pneumoniae J138
uccacggaaauauuc

SEQ ID NO: 536452 - RNA, 22 nt, Chlamydophila pneumoniae J138
uccacgaccugcaaacucccca

SEQ ID NO: 536453 - RNA, 14 nt, Chlamydophila pneumoniae J138
uccacgaaggaauc

SEQ ID NO: 536454 - RNA, 15 nt, Chlamydophila pneumoniae J138
uccacgaaggaaucu

SEQ ID NO: 536455 - RNA, 14 nt, Chlamydophila pneumoniae J138
uccacgaauucuuu

SEQ ID NO: 536456 - RNA, 19 nt, Chlamydophila pneumoniae J138
uccacugcagcagguguca

SEQ ID NO: 536457 - RNA, 15 nt, Chlamydophila pneumoniae J138
uccacuacugucaau

SEQ ID NO: 536458 - RNA, 15 nt, Chlamydophila pneumoniae J138
uccacugcuuuaggc

SEQ ID NO: 536459 - RNA, 23 nt, Chlamydophila pneumoniae J138
uccagcaccuuuaggaagcugua

SEQ ID NO: 536460 - RNA, 16 nt, Chlamydophila pneumoniae J138
uccagauuguucaaaa

SEQ ID NO: 536461 - RNA, 20 nt, Chlamydophila pneumoniae J138
uccagcaaagcgaccugcaa

SEQ ID NO: 536462 - RNA, 16 nt, Chlamydophila pneumoniae J138
uccagcaacaaccaaa

SEQ ID NO: 536463 - RNA, 15 nt, Chlamydophila pneumoniae J138
uccagaaacgcagcu

SEQ ID NO: 536464 - RNA, 15 nt, Chlamydophila pneumoniae J138
uccagaaauuuuuac

SEQ ID NO: 536465 - RNA, 18 nt, Chlamydophila pneumoniae J138
uccagaaauuacuguggu

SEQ ID NO: 536466 - RNA, 16 nt, Chlamydophila pneumoniae J138
uccagagacaaagcca

SEQ ID NO: 536467 - RNA, 20 nt, Chlamydophila pneumoniae J138
uccagacuuuccucucuuua

SEQ ID NO: 536468 - RNA, 18 nt, Chlamydophila pneumoniae J138
uccagaucaaugccuugc

SEQ ID NO: 536469 - RNA, 21 nt, Chlamydophila pneumoniae J138
uccacaaucucuuuaaaaauu

SEQ ID NO: 536470 - RNA, 20 nt, Chlamydophila pneumoniae J138
uccacagagaccuucucuuc

SEQ ID NO: 536471 - RNA, 20 nt, Chlamydophila pneumoniae J138
uccaccaaugauaauuucau

SEQ ID NO: 536472 - RNA, 13 nt, Chlamydophila pneumoniae J138
uccaccaagacug

SEQ ID NO: 536473 - RNA, 18 nt, Chlamydophila pneumoniae J138
uccacaugcccaaacauc

SEQ ID NO: 536474 - RNA, 13 nt, Chlamydophila pneumoniae J138
uccacaugcccaa

SEQ ID NO: 536475 - RNA, 17 nt, Chlamydophila pneumoniae J138
uccacaucuugagcuuc

SEQ ID NO: 536476 - RNA, 23 nt, Chlamydophila pneumoniae J138
uccaccaggagcuccuccuugaa

SEQ ID NO: 536477 - RNA, 19 nt, Chlamydophila pneumoniae J138
uccaagugaucagaaauga

SEQ ID NO: 536478 - RNA, 15 nt, Chlamydophila pneumoniae J138
uccaauacuaaaacu

SEQ ID NO: 536479 - RNA, 23 nt, Chlamydophila pneumoniae J138
uccaagugaucagaaaugaagcc

SEQ ID NO: 536480 - RNA, 14 nt, Chlamydophila pneumoniae J138
uccaacuucuguau

SEQ ID NO: 536481 - RNA, 19 nt, Chlamydophila pneumoniae J138
uccaagacaauaaaaaaga

SEQ ID NO: 536482 - RNA, 20 nt, Chlamydophila pneumoniae J138
uccaagacaauaaaaaagag

SEQ ID NO: 536483 - RNA, 21 nt, Chlamydophila pneumoniae J138
uccaagacaauaaaaaagaga

SEQ ID NO: 536484 - RNA, 22 nt, Chlamydophila pneumoniae J138
uccaagaucuccgccuacaaua

SEQ ID NO: 536485 - RNA, 16 nt, Chlamydophila pneumoniae J138
uccaagaucaaacgaa

SEQ ID NO: 536486 - RNA, 13 nt, Chlamydophila pneumoniae J138
uccaagauugaau

SEQ ID NO: 536487 - RNA, 23 nt, Chlamydophila pneumoniae J138
uccaauaggccagaauguacaua

SEQ ID NO: 536488 - RNA, 17 nt, Chlamydophila pneumoniae J138
uccaauaggccagaaug

SEQ ID NO: 536489 - RNA, 13 nt, Chlamydophila pneumoniae J138
uccaaucugcuga

SEQ ID NO: 536490 - RNA, 16 nt, Chlamydophila pneumoniae J138
uccaaugcaugaaucu

SEQ ID NO: 536491 - RNA, 16 nt, Chlamydophila pneumoniae J138
uccaauuguaaaucau

SEQ ID NO: 536492 - RNA, 19 nt, Chlamydophila pneumoniae J138
uccaauuuuugcauagaca

SEQ ID NO: 536493 - RNA, 20 nt, Chlamydophila pneumoniae J138
uaucuucaaaaguaaucacu

SEQ ID NO: 536494 - RNA, 17 nt, Chlamydophila pneumoniae J138
uaucuucaaaaguaauc

SEQ ID NO: 536495 - RNA, 20 nt, Chlamydophila pneumoniae J138
ucagcgcaucacgaaaagga

SEQ ID NO: 536496 - RNA, 18 nt, Chlamydophila pneumoniae J138
ucaggaaaacuuaauaag

SEQ ID NO: 536497 - RNA, 20 nt, Chlamydophila pneumoniae J138
ucaggaaaacuuaauaagcg

SEQ ID NO: 536498 - RNA, 19 nt, Chlamydophila pneumoniae J138
ucagcuuugcuuaaaaagu

SEQ ID NO: 536499 - RNA, 18 nt, Chlamydophila pneumoniae J138
ucagcuucuacagcaucg

SEQ ID NO: 536500 - RNA, 15 nt, Chlamydophila pneumoniae J138
ucagcuuaucuauag

SEQ ID NO: 536501 - RNA, 17 nt, Chlamydophila pneumoniae J138
ucaggagauacaaguaa

SEQ ID NO: 536502 - RNA, 16 nt, Chlamydophila pneumoniae J138
ucaggacccuuuuccu

SEQ ID NO: 536503 - RNA, 22 nt, Chlamydophila pneumoniae J138
ucaggaccuaagggcucuccua

SEQ ID NO: 536504 - RNA, 21 nt, Chlamydophila pneumoniae J138
ucagcucccaugugcugaaga

SEQ ID NO: 536505 - RNA, 14 nt, Chlamydophila pneumoniae J138
ucagcuguccuccg

SEQ ID NO: 536506 - RNA, 23 nt, Chlamydophila pneumoniae J138
ucagcucuaauucuucuacagaa

SEQ ID NO: 536507 - RNA, 13 nt, Chlamydophila pneumoniae J138
ucaggauuuucca

SEQ ID NO: 536508 - RNA, 15 nt, Chlamydophila pneumoniae J138
ucaggauuuuccauu

SEQ ID NO: 536509 - RNA, 17 nt, Chlamydophila pneumoniae J138
ucaggauuaguaacuaa

SEQ ID NO: 536510 - RNA, 20 nt, Chlamydophila pneumoniae J138
ucaggagaccagggaucuuc

SEQ ID NO: 536511 - RNA, 18 nt, Chlamydophila pneumoniae J138
ucaggauuacggaaaaua

SEQ ID NO: 536512 - RNA, 21 nt, Chlamydophila pneumoniae J138
ucaggcuuuaaguguuucuuc

SEQ ID NO: 536513 - RNA, 21 nt, Chlamydophila pneumoniae J138
ucagggagcggaauuucucau

SEQ ID NO: 536514 - RNA, 16 nt, Chlamydophila pneumoniae J138
ucagguaaagagcuuc

SEQ ID NO: 536515 - RNA, 16 nt, Chlamydophila pneumoniae J138
ucaguauggcguuuuu

SEQ ID NO: 536516 - RNA, 16 nt, Chlamydophila pneumoniae J138
ucaguaucaauaaucg

SEQ ID NO: 536517 - RNA, 21 nt, Chlamydophila pneumoniae J138
ucaguaaacccucagaacacg

SEQ ID NO: 536518 - RNA, 20 nt, Chlamydophila pneumoniae J138
ucaguaaacccucagaacac

SEQ ID NO: 536519 - RNA, 15 nt, Chlamydophila pneumoniae J138
ucagucuuccuuuau

SEQ ID NO: 536520 - RNA, 16 nt, Chlamydophila pneumoniae J138
ucagucuuccuuuaua

SEQ ID NO: 536521 - RNA, 22 nt, Chlamydophila pneumoniae J138
ucaguuguuucuagaaaaucuc

SEQ ID NO: 536522 - RNA, 20 nt, Chlamydophila pneumoniae J138
ucaguuccucauccucauca

SEQ ID NO: 536523 - RNA, 21 nt, Chlamydophila pneumoniae J138
ucaguuccucauccucaucau

SEQ ID NO: 536524 - RNA, 19 nt, Chlamydophila pneumoniae J138
ucagugucuugaagagauu

SEQ ID NO: 536525 - RNA, 19 nt, Chlamydophila pneumoniae J138
ucaguuuuuucuucugaca

SEQ ID NO: 536526 - RNA, 15 nt, Chlamydophila pneumoniae J138
ucauaaaaauuucau

SEQ ID NO: 536527 - RNA, 15 nt, Chlamydophila pneumoniae J138
ucauaaccugggcaa

SEQ ID NO: 536528 - RNA, 16 nt, Chlamydophila pneumoniae J138
ucauaaccaaguaaau

SEQ ID NO: 536529 - RNA, 15 nt, Chlamydophila pneumoniae J138
ucauaaccaaaagaa

SEQ ID NO: 536530 - RNA, 20 nt, Chlamydophila pneumoniae J138
ucauaaauacgugcuugaau

SEQ ID NO: 536531 - RNA, 23 nt, Chlamydophila pneumoniae J138
ucauagcauguucgauuuucucu

SEQ ID NO: 536532 - RNA, 22 nt, Chlamydophila pneumoniae J138
ucauagagauaucaucaaaaga

SEQ ID NO: 536533 - RNA, 23 nt, Chlamydophila pneumoniae J138
ucauaggaaacgcccuucuuagu

SEQ ID NO: 536534 - RNA, 17 nt, Chlamydophila pneumoniae J138
ucauaagaguagacaag

SEQ ID NO: 536535 - RNA, 17 nt, Chlamydophila pneumoniae J138
ucauaagauagagcgac

SEQ ID NO: 536536 - RNA, 15 nt, Chlamydophila pneumoniae J138
ucauaaccuaaggca

SEQ ID NO: 536537 - RNA, 12 nt, Chlamydophila pneumoniae J138
ucauaagaaauu

SEQ ID NO: 536538 - RNA, 18 nt, Chlamydophila pneumoniae J138
ucauaagcucuauuucug

SEQ ID NO: 536539 - RNA, 21 nt, Chlamydophila pneumoniae J138
ucauaagcucuauuucugccu

SEQ ID NO: 536540 - RNA, 17 nt, Chlamydophila pneumoniae J138
ucauaagcucuauuucu

SEQ ID NO: 536541 - RNA, 16 nt, Chlamydophila pneumoniae J138
ucauaagaguagacaa

SEQ ID NO: 536542 - RNA, 23 nt, Chlamydophila pneumoniae J138
ucauaauuagagagaaugcccug

SEQ ID NO: 536543 - RNA, 20 nt, Chlamydophila pneumoniae J138
ucauaucugcgccagcucuc

SEQ ID NO: 536544 - RNA, 20 nt, Chlamydophila pneumoniae J138
ucauaugaaugacugcagau

SEQ ID NO: 536545 - RNA, 12 nt, Chlamydophila pneumoniae J138
ucauauuuaaaa

SEQ ID NO: 536546 - RNA, 20 nt, Chlamydophila pneumoniae J138
ucauauuuuucuugaagguu

SEQ ID NO: 536547 - RNA, 17 nt, Chlamydophila pneumoniae J138
ucauauuuuuguccugc

SEQ ID NO: 536548 - RNA, 19 nt, Chlamydophila pneumoniae J138
ucauauuuuucuugaaggu

SEQ ID NO: 536549 - RNA, 18 nt, Chlamydophila pneumoniae J138
ucaucaaaacauaaugau

SEQ ID NO: 536550 - RNA, 14 nt, Chlamydophila pneumoniae J138
ucaucaaaaagauc

SEQ ID NO: 536551 - RNA, 12 nt, Chlamydophila pneumoniae J138
ucaucaaagcaa

SEQ ID NO: 536552 - RNA, 22 nt, Chlamydophila pneumoniae J138
ucaucaccauccaaagcuauuu

SEQ ID NO: 536553 - RNA, 16 nt, Chlamydophila pneumoniae J138
ucaucacaucaguuaa

SEQ ID NO: 536554 - RNA, 17 nt, Chlamydophila pneumoniae J138
ucaucacaauuuuaaaa

SEQ ID NO: 536555 - RNA, 18 nt, Chlamydophila pneumoniae J138
ucaucagaaaucaaaggg

SEQ ID NO: 536556 - RNA, 16 nt, Chlamydophila pneumoniae J138
ucaucagaagccacca

SEQ ID NO: 536557 - RNA, 18 nt, Chlamydophila pneumoniae J138
ucaucagcaaaacucccg

SEQ ID NO: 536558 - RNA, 16 nt, Chlamydophila pneumoniae J138
ucaucagcaaccuuuc

SEQ ID NO: 536559 - RNA, 13 nt, Chlamydophila pneumoniae J138
ucaucauccucag

SEQ ID NO: 536560 - RNA, 17 nt, Chlamydophila pneumoniae J138
ucauccccucagaaagg

SEQ ID NO: 536561 - RNA, 22 nt, Chlamydophila pneumoniae J138
ucaucccuacccucaucauccu

SEQ ID NO: 536562 - RNA, 15 nt, Chlamydophila pneumoniae J138
ucauccgaagacuca

SEQ ID NO: 536563 - RNA, 20 nt, Chlamydophila pneumoniae J138
ucauccagauuagaaaagau

SEQ ID NO: 536564 - RNA, 17 nt, Chlamydophila pneumoniae J138
ucaucccacgggucagg

SEQ ID NO: 536565 - RNA, 14 nt, Chlamydophila pneumoniae J138
ucauccucaucauc

SEQ ID NO: 536566 - RNA, 18 nt, Chlamydophila pneumoniae J138
ucauccucaucaucagaa

SEQ ID NO: 536567 - RNA, 11 nt, Chlamydophila pneumoniae J138
ucaucuucuuu

SEQ ID NO: 536568 - RNA, 20 nt, Chlamydophila pneumoniae J138
ucaucuuguacgaaaaucua

SEQ ID NO: 536569 - RNA, 21 nt, Chlamydophila pneumoniae J138
ucaucuuguacgaaaaucuac

SEQ ID NO: 536570 - RNA, 18 nt, Chlamydophila pneumoniae J138
ucaucucgcaguccaaag

SEQ ID NO: 536571 - RNA, 21 nt, Chlamydophila pneumoniae J138
ucaucucacaagcauccuaga

SEQ ID NO: 536572 - RNA, 19 nt, Chlamydophila pneumoniae J138
ucaucugguauucuaggua

SEQ ID NO: 536573 - RNA, 23 nt, Chlamydophila pneumoniae J138
ucaucgucgcgacugaagucagu

SEQ ID NO: 536574 - RNA, 16 nt, Chlamydophila pneumoniae J138
ucaugagaauuuucau

SEQ ID NO: 536575 - RNA, 10 nt, Chlamydophila pneumoniae J138
ucaugaggac

SEQ ID NO: 536576 - RNA, 23 nt, Chlamydophila pneumoniae J138
ucaugagccgauguugcagaaug

SEQ ID NO: 536577 - RNA, 14 nt, Chlamydophila pneumoniae J138
ucaugauaaaaauu

SEQ ID NO: 536578 - RNA, 22 nt, Chlamydophila pneumoniae J138
ucaugauaaaaauuuucaggaa

SEQ ID NO: 536579 - RNA, 20 nt, Chlamydophila pneumoniae J138
ucaugaaagugcucuuuuaa

SEQ ID NO: 536580 - RNA, 15 nt, Chlamydophila pneumoniae J138
ucaugaagaauuacc

SEQ ID NO: 536581 - RNA, 23 nt, Chlamydophila pneumoniae J138
ucauuucgauaacacuucuuucu

SEQ ID NO: 536582 - RNA, 22 nt, Chlamydophila pneumoniae J138
ucauugcuauugaaaaaucccu

SEQ ID NO: 536583 - RNA, 20 nt, Chlamydophila pneumoniae J138
ucauugcuauugaaaaaucc

SEQ ID NO: 536584 - RNA, 18 nt, Chlamydophila pneumoniae J138
ucauugcggcaccaaaga

SEQ ID NO: 536585 - RNA, 15 nt, Chlamydophila pneumoniae J138
uccaaaagaccaaaa

SEQ ID NO: 536586 - RNA, 17 nt, Chlamydophila pneumoniae J138
uccaaaaacuucuaacu

SEQ ID NO: 536587 - RNA, 15 nt, Chlamydophila pneumoniae J138
ucauuuuuuaauaaa

SEQ ID NO: 536588 - RNA, 17 nt, Chlamydophila pneumoniae J138
uccaaaauaaaaggagc

SEQ ID NO: 536589 - RNA, 19 nt, Chlamydophila pneumoniae J138
uccaaaaugucuuuuucaa

SEQ ID NO: 536590 - RNA, 16 nt, Chlamydophila pneumoniae J138
uccaaacauuuuuaag

SEQ ID NO: 536591 - RNA, 12 nt, Chlamydophila pneumoniae J138
uccaaaaucucu

SEQ ID NO: 536592 - RNA, 20 nt, Chlamydophila pneumoniae J138
uccaaacguggucauuagcc

SEQ ID NO: 536593 - RNA, 15 nt, Chlamydophila pneumoniae J138
uccaaagauacauua

SEQ ID NO: 536594 - RNA, 17 nt, Chlamydophila pneumoniae J138
uccaaagcuauuucucu

SEQ ID NO: 536595 - RNA, 21 nt, Chlamydophila pneumoniae J138
uccaaaggaaaauaaucuuca

SEQ ID NO: 536596 - RNA, 23 nt, Chlamydophila pneumoniae J138
uccaaaggaaaauaaucuucaaa

SEQ ID NO: 536597 - RNA, 22 nt, Chlamydophila pneumoniae J138
uccaaauagagugaccauagca

SEQ ID NO: 536598 - RNA, 14 nt, Chlamydophila pneumoniae J138
uccaaauguucucu

SEQ ID NO: 536599 - RNA, 22 nt, Chlamydophila pneumoniae J138
uccaaauugcaauuuucuaaag

SEQ ID NO: 536600 - RNA, 21 nt, Chlamydophila pneumoniae J138
uccaacuaaaccuucaaugau

SEQ ID NO: 536601 - RNA, 14 nt, Chlamydophila pneumoniae J138
ucauucccuuuuuc

SEQ ID NO: 536602 - RNA, 14 nt, Chlamydophila pneumoniae J138
ucauuccagcaucu

SEQ ID NO: 536603 - RNA, 17 nt, Chlamydophila pneumoniae J138
ucauuaucacagaugua

SEQ ID NO: 536604 - RNA, 18 nt, Chlamydophila pneumoniae J138
ucauuaucaagaaauucu

SEQ ID NO: 536605 - RNA, 16 nt, Chlamydophila pneumoniae J138
ucauuagcaagagcuc

SEQ ID NO: 536606 - RNA, 22 nt, Chlamydophila pneumoniae J138
ucauuagcaucaucuccugaag

SEQ ID NO: 536607 - RNA, 20 nt, Chlamydophila pneumoniae J138
ucauuagcccuacgaaucca

SEQ ID NO: 536608 - RNA, 19 nt, Chlamydophila pneumoniae J138
ucauuaccugcuaaacuuu

SEQ ID NO: 536609 - RNA, 12 nt, Chlamydophila pneumoniae J138
ucauuaccugcu

SEQ ID NO: 536610 - RNA, 22 nt, Chlamydophila pneumoniae J138
ucauuaagauccuuuaaagauu

SEQ ID NO: 536611 - RNA, 13 nt, Chlamydophila pneumoniae J138
ucauuaagaagau

SEQ ID NO: 536612 - RNA, 16 nt, Chlamydophila pneumoniae J138
ucauuaagaacaucuu

SEQ ID NO: 536613 - RNA, 12 nt, Chlamydophila pneumoniae J138
ucauuaaaaauu

SEQ ID NO: 536614 - RNA, 15 nt, Chlamydophila pneumoniae J138
ucauuaaaaauuuaa

SEQ ID NO: 536615 - RNA, 13 nt, Chlamydophila pneumoniae J138
ucauguccuucaa

SEQ ID NO: 536616 - RNA, 16 nt, Chlamydophila pneumoniae J138
ucauguagcagagccu

SEQ ID NO: 536617 - RNA, 20 nt, Chlamydophila pneumoniae J138
ggaaucuaagaacuagaaaa

SEQ ID NO: 536618 - RNA, 14 nt, Chlamydophila pneumoniae J138
ggacaaaucuccca

SEQ ID NO: 536619 - RNA, 20 nt, Chlamydophila pneumoniae J138
ggacaacaacagcuuuaucu

SEQ ID NO: 536620 - RNA, 9 nt, Chlamydophila pneumoniae J138
ggacaacua

SEQ ID NO: 536621 - RNA, 15 nt, Chlamydophila pneumoniae J138
ggaauacauuccuag

SEQ ID NO: 536622 - RNA, 14 nt, Chlamydophila pneumoniae J138
ggaagguucucaaa

SEQ ID NO: 536623 - RNA, 19 nt, Chlamydophila pneumoniae J138
ggacagcacauagagugug

SEQ ID NO: 536624 - RNA, 22 nt, Chlamydophila pneumoniae J138
ggaccacaauuccuaaaacaag

SEQ ID NO: 536625 - RNA, 13 nt, Chlamydophila pneumoniae J138
ggacaugccuuag

SEQ ID NO: 536626 - RNA, 23 nt, Chlamydophila pneumoniae J138
ggaccagguguagguuccugcuu

SEQ ID NO: 536627 - RNA, 18 nt, Chlamydophila pneumoniae J138
ggaccuuccuuaucuuca

SEQ ID NO: 536628 - RNA, 23 nt, Chlamydophila pneumoniae J138
ggaccuuauacccacaaagauca

SEQ ID NO: 536629 - RNA, 17 nt, Chlamydophila pneumoniae J138
ggaccuuaagaugaggu

SEQ ID NO: 536630 - RNA, 13 nt, Chlamydophila pneumoniae J138
ggaccuguuuucu

SEQ ID NO: 536631 - RNA, 19 nt, Chlamydophila pneumoniae J138
ggaccuuggacucuagggu

SEQ ID NO: 536632 - RNA, 23 nt, Chlamydophila pneumoniae J138
ggaccuccucacauguuucacuu

SEQ ID NO: 536633 - RNA, 21 nt, Chlamydophila pneumoniae J138
ggacgagaaccaaagcagugu

SEQ ID NO: 536634 - RNA, 22 nt, Chlamydophila pneumoniae J138
ggacugacuucuaugauaucac

SEQ ID NO: 536635 - RNA, 22 nt, Chlamydophila pneumoniae J138
ggagauaaagauguagaauaac

SEQ ID NO: 536636 - RNA, 13 nt, Chlamydophila pneumoniae J138
ggagauuccuaaa

SEQ ID NO: 536637 - RNA, 13 nt, Chlamydophila pneumoniae J138
ggacugcugacau

SEQ ID NO: 536638 - RNA, 15 nt, Chlamydophila pneumoniae J138
ggacuucucaaagac

SEQ ID NO: 536639 - RNA, 16 nt, Chlamydophila pneumoniae J138
ggacuucucaaagaca

SEQ ID NO: 536640 - RNA, 16 nt, Chlamydophila pneumoniae J138
ggacuuguguauuugc

SEQ ID NO: 536641 - RNA, 18 nt, Chlamydophila pneumoniae J138
ggaguacuucuuacccua

SEQ ID NO: 536642 - RNA, 12 nt, Chlamydophila pneumoniae J138
ggauacuuagca

SEQ ID NO: 536643 - RNA, 20 nt, Chlamydophila pneumoniae J138
ggauacucugaacaggaaua

SEQ ID NO: 536644 - RNA, 17 nt, Chlamydophila pneumoniae J138
ggauaggcaagauuaug

SEQ ID NO: 536645 - RNA, 14 nt, Chlamydophila pneumoniae J138
ggagucgugcagga

SEQ ID NO: 536646 - RNA, 14 nt, Chlamydophila pneumoniae J138
ggagucacuggcau

SEQ ID NO: 536647 - RNA, 20 nt, Chlamydophila pneumoniae J138
ggaguccuucuugcaaagau

SEQ ID NO: 536648 - RNA, 20 nt, Chlamydophila pneumoniae J138
ggagugaggaaucauaacca

SEQ ID NO: 536649 - RNA, 13 nt, Chlamydophila pneumoniae J138
ggagucuuggaua

SEQ ID NO: 536650 - RNA, 17 nt, Chlamydophila pneumoniae J138
ggaugaggucuuuagca

SEQ ID NO: 536651 - RNA, 22 nt, Chlamydophila pneumoniae J138
ggaucucucuuuccuuagcauu

SEQ ID NO: 536652 - RNA, 20 nt, Chlamydophila pneumoniae J138
ggaucucaucauaaauaggc

SEQ ID NO: 536653 - RNA, 17 nt, Chlamydophila pneumoniae J138
ggaucacagucuuaaau

SEQ ID NO: 536654 - RNA, 22 nt, Chlamydophila pneumoniae J138
ggauuaucccaaacuucuucuc

SEQ ID NO: 536655 - RNA, 15 nt, Chlamydophila pneumoniae J138
ggauuaguaacuaaa

SEQ ID NO: 536656 - RNA, 13 nt, Chlamydophila pneumoniae J138
ggauguucaaagc

SEQ ID NO: 536657 - RNA, 16 nt, Chlamydophila pneumoniae J138
ggauuucuucuucuaa

SEQ ID NO: 536658 - RNA, 15 nt, Chlamydophila pneumoniae J138
ggcaacaagagcgca

SEQ ID NO: 536659 - RNA, 16 nt, Chlamydophila pneumoniae J138
ggcaaguguuuuucug

SEQ ID NO: 536660 - RNA, 13 nt, Chlamydophila pneumoniae J138
ggcaaugauaggg

SEQ ID NO: 536661 - RNA, 16 nt, Chlamydophila pneumoniae J138
ggcaauagcagcagcg

SEQ ID NO: 536662 - RNA, 14 nt, Chlamydophila pneumoniae J138
ggcacuggcaugga

SEQ ID NO: 536663 - RNA, 18 nt, Chlamydophila pneumoniae J138
ggcagguagucccuuucu

SEQ ID NO: 536664 - RNA, 17 nt, Chlamydophila pneumoniae J138
ggcauaaaaaaguccua

SEQ ID NO: 536665 - RNA, 20 nt, Chlamydophila pneumoniae J138
ggccaagauucucacucuau

SEQ ID NO: 536666 - RNA, 21 nt, Chlamydophila pneumoniae J138
ggccaagagcuugucuuccac

SEQ ID NO: 536667 - RNA, 16 nt, Chlamydophila pneumoniae J138
ggcauuucuccacaug

SEQ ID NO: 536668 - RNA, 12 nt, Chlamydophila pneumoniae J138
ggcaucuuuuac

SEQ ID NO: 536669 - RNA, 17 nt, Chlamydophila pneumoniae J138
ggcaucuuuuacagacu

SEQ ID NO: 536670 - RNA, 14 nt, Chlamydophila pneumoniae J138
ggcauucaggagca

SEQ ID NO: 536671 - RNA, 13 nt, Chlamydophila pneumoniae J138
ggccacauuaagc

SEQ ID NO: 536672 - RNA, 17 nt, Chlamydophila pneumoniae J138
ggccaucauuaaguacu

SEQ ID NO: 536673 - RNA, 15 nt, Chlamydophila pneumoniae J138
ggccagcgcauuaac

SEQ ID NO: 536674 - RNA, 18 nt, Chlamydophila pneumoniae J138
ggcccgauacaaauagcu

SEQ ID NO: 536675 - RNA, 14 nt, Chlamydophila pneumoniae J138
ggccucaacacgcu

SEQ ID NO: 536676 - RNA, 13 nt, Chlamydophila pneumoniae J138
ggccucuucccaa

SEQ ID NO: 536677 - RNA, 18 nt, Chlamydophila pneumoniae J138
ggccugagaccauaaaau

SEQ ID NO: 536678 - RNA, 19 nt, Chlamydophila pneumoniae J138
ggccuugccaguauugaua

SEQ ID NO: 536679 - RNA, 19 nt, Chlamydophila pneumoniae J138
ggcgccuucagcaacuaaa

SEQ ID NO: 536680 - RNA, 14 nt, Chlamydophila pneumoniae J138
ggcuaaauaaacca

SEQ ID NO: 536681 - RNA, 13 nt, Chlamydophila pneumoniae J138
ggcuaaagaaaag

SEQ ID NO: 536682 - RNA, 12 nt, Chlamydophila pneumoniae J138
ggcguuuuugca

SEQ ID NO: 536683 - RNA, 16 nt, Chlamydophila pneumoniae J138
ggcuacuuuaagaccu

SEQ ID NO: 536684 - RNA, 13 nt, Chlamydophila pneumoniae J138
ggcuauagauacu

SEQ ID NO: 536685 - RNA, 18 nt, Chlamydophila pneumoniae J138
ggcuauagaauacacagc

SEQ ID NO: 536686 - RNA, 12 nt, Chlamydophila pneumoniae J138
ggcucaaagaaa

SEQ ID NO: 536687 - RNA, 12 nt, Chlamydophila pneumoniae J138
ggcuccagcaua

SEQ ID NO: 536688 - RNA, 24 nt, Chlamydophila pneumoniae J138
ggcugauucucccaauauccagaa

SEQ ID NO: 536689 - RNA, 14 nt, Chlamydophila pneumoniae J138
ggcugagagaagca

SEQ ID NO: 536690 - RNA, 22 nt, Chlamydophila pneumoniae J138
ggcucuaggacccguagccccu

SEQ ID NO: 536691 - RNA, 21 nt, Chlamydophila pneumoniae J138
ggcucucaaggucacagcauu

SEQ ID NO: 536692 - RNA, 18 nt, Chlamydophila pneumoniae J138
ggcucuccuaaaccauca

SEQ ID NO: 536693 - RNA, 14 nt, Chlamydophila pneumoniae J138
ggcuuuuuccaaaa

SEQ ID NO: 536694 - RNA, 19 nt, Chlamydophila pneumoniae J138
ggcuuuaaguguuucuuca

SEQ ID NO: 536695 - RNA, 11 nt, Chlamydophila pneumoniae J138
gggaaaaugcg

SEQ ID NO: 536696 - RNA, 13 nt, Chlamydophila pneumoniae J138
ggcuuaagucuug

SEQ ID NO: 536697 - RNA, 10 nt, Chlamydophila pneumoniae J138
gggagcuucc

SEQ ID NO: 536698 - RNA, 18 nt, Chlamydophila pneumoniae J138
gggaaauaccccaucuaa

SEQ ID NO: 536699 - RNA, 21 nt, Chlamydophila pneumoniae J138
gggaacaacugugguuuuaaa

SEQ ID NO: 536700 - RNA, 19 nt, Chlamydophila pneumoniae J138
gggauaggcaagauuauga

SEQ ID NO: 536701 - RNA, 21 nt, Chlamydophila pneumoniae J138
gggauaaaacuauaaaagcca

SEQ ID NO: 536702 - RNA, 21 nt, Chlamydophila pneumoniae J138
ggguuguauuuccuucuuuua

SEQ ID NO: 536703 - RNA, 12 nt, Chlamydophila pneumoniae J138
ggguuucccugu

SEQ ID NO: 536704 - RNA, 19 nt, Chlamydophila pneumoniae J138
gguaaagagcuucuucuaa

SEQ ID NO: 536705 - RNA, 24 nt, Chlamydophila pneumoniae J138
gguaguuugccuucuuaucuucua

SEQ ID NO: 536706 - RNA, 19 nt, Chlamydophila pneumoniae J138
gguagauccuauaguaauu

SEQ ID NO: 536707 - RNA, 18 nt, Chlamydophila pneumoniae J138
gguagcagaguuuuuccc

SEQ ID NO: 536708 - RNA, 19 nt, Chlamydophila pneumoniae J138
gguagcagaguuuuucccu

SEQ ID NO: 536709 - RNA, 22 nt, Chlamydophila pneumoniae J138
gguauuaggaaguaguggacua

SEQ ID NO: 536710 - RNA, 20 nt, Chlamydophila pneumoniae J138
gguaucuccuugauaaaacg

SEQ ID NO: 536711 - RNA, 19 nt, Chlamydophila pneumoniae J138
gguacgcuuuuucuugaaa

SEQ ID NO: 536712 - RNA, 15 nt, Chlamydophila pneumoniae J138
gguagagcuagaaug

SEQ ID NO: 536713 - RNA, 19 nt, Chlamydophila pneumoniae J138
ggucgauaucccacagaaa

SEQ ID NO: 536714 - RNA, 22 nt, Chlamydophila pneumoniae J138
ggucgauugagauugaggauaa

SEQ ID NO: 536715 - RNA, 18 nt, Chlamydophila pneumoniae J138
ggucgagaaccuccacca

SEQ ID NO: 536716 - RNA, 16 nt, Chlamydophila pneumoniae J138
ggugaaaguacaggag

SEQ ID NO: 536717 - RNA, 17 nt, Chlamydophila pneumoniae J138
ggugccuaggcuaagag

SEQ ID NO: 536718 - RNA, 23 nt, Chlamydophila pneumoniae J138
guaauccuucuuucugcucuucu

SEQ ID NO: 536719 - RNA, 18 nt, Chlamydophila pneumoniae J138
guaauccuucuuucugcu

SEQ ID NO: 536720 - RNA, 22 nt, Chlamydophila pneumoniae J138
guaauaacuauaauauaacugc

SEQ ID NO: 536721 - RNA, 17 nt, Chlamydophila pneumoniae J138
guaagguuaucuuuuug

SEQ ID NO: 536722 - RNA, 22 nt, Chlamydophila pneumoniae J138
guaaguaaccaauacagcauaa

SEQ ID NO: 536723 - RNA, 18 nt, Chlamydophila pneumoniae J138
guaagacuaaaaaagaga

SEQ ID NO: 536724 - RNA, 16 nt, Chlamydophila pneumoniae J138
guaagacuaaaaaaga

SEQ ID NO: 536725 - RNA, 17 nt, Chlamydophila pneumoniae J138
guaagaauccuugcuaa

SEQ ID NO: 536726 - RNA, 19 nt, Chlamydophila pneumoniae J138
guaacuaauaaucauaucu

SEQ ID NO: 536727 - RNA, 17 nt, Chlamydophila pneumoniae J138
guaacgcugcuaauguu

SEQ ID NO: 536728 - RNA, 19 nt, Chlamydophila pneumoniae J138
guaaccaauacagcauaaa

SEQ ID NO: 536729 - RNA, 20 nt, Chlamydophila pneumoniae J138
guaacauugaccuaaaggaa

SEQ ID NO: 536730 - RNA, 19 nt, Chlamydophila pneumoniae J138
guaacauugaccuaaagga

SEQ ID NO: 536731 - RNA, 13 nt, Chlamydophila pneumoniae J138
guaaccagagagc

SEQ ID NO: 536732 - RNA, 12 nt, Chlamydophila pneumoniae J138
guaaagaaucac

SEQ ID NO: 536733 - RNA, 14 nt, Chlamydophila pneumoniae J138
guaaagauucuauu

SEQ ID NO: 536734 - RNA, 20 nt, Chlamydophila pneumoniae J138
guaaagaguagccccagcaa

SEQ ID NO: 536735 - RNA, 20 nt, Chlamydophila pneumoniae J138
guaaaccaauugagcucucu

SEQ ID NO: 536736 - RNA, 11 nt, Chlamydophila pneumoniae J138
guaaacaacaa

SEQ ID NO: 536737 - RNA, 23 nt, Chlamydophila pneumoniae J138
gguuaaaacccauguuucuuccu

SEQ ID NO: 536738 - RNA, 19 nt, Chlamydophila pneumoniae J138
guaaauuuuuccuucaaca

SEQ ID NO: 536739 - RNA, 20 nt, Chlamydophila pneumoniae J138
guaaaguaugcauagccucg

SEQ ID NO: 536740 - RNA, 18 nt, Chlamydophila pneumoniae J138
guaaaguaggcacaucau

SEQ ID NO: 536741 - RNA, 19 nt, Chlamydophila pneumoniae J138
guaaagguuguaaggacga

SEQ ID NO: 536742 - RNA, 17 nt, Chlamydophila pneumoniae J138
guaaauaguauacaagc

SEQ ID NO: 536743 - RNA, 12 nt, Chlamydophila pneumoniae J138
guaaauaucuua

SEQ ID NO: 536744 - RNA, 21 nt, Chlamydophila pneumoniae J138
guaaaucauuggaaccauagg

SEQ ID NO: 536745 - RNA, 17 nt, Chlamydophila pneumoniae J138
guaaauauuuuaccauu

SEQ ID NO: 536746 - RNA, 18 nt, Chlamydophila pneumoniae J138
guaaucgagagaagaaau

SEQ ID NO: 536747 - RNA, 15 nt, Chlamydophila pneumoniae J138
guaaucuaagaaucu

SEQ ID NO: 536748 - RNA, 12 nt, Chlamydophila pneumoniae J138
guaaucuaagaa

SEQ ID NO: 536749 - RNA, 19 nt, Chlamydophila pneumoniae J138
guaauccuucuuucugcuc

SEQ ID NO: 536750 - RNA, 19 nt, Chlamydophila pneumoniae J138
guaaugcuuagccauggca

SEQ ID NO: 536751 - RNA, 13 nt, Chlamydophila pneumoniae J138
guaccaagaaaau

SEQ ID NO: 536752 - RNA, 20 nt, Chlamydophila pneumoniae J138
guaccguaaagaaaagcaau

SEQ ID NO: 536753 - RNA, 23 nt, Chlamydophila pneumoniae J138
guaccguagcguacguuuucucu

SEQ ID NO: 536754 - RNA, 14 nt, Chlamydophila pneumoniae J138
guacggcuaaauaa

SEQ ID NO: 536755 - RNA, 13 nt, Chlamydophila pneumoniae J138
guacuaagauacg

SEQ ID NO: 536756 - RNA, 20 nt, Chlamydophila pneumoniae J138
guacuaucgguuuaaacaga

SEQ ID NO: 536757 - RNA, 12 nt, Chlamydophila pneumoniae J138
guagagcaagau

SEQ ID NO: 536758 - RNA, 16 nt, Chlamydophila pneumoniae J138
guagagcaagauucuu

SEQ ID NO: 536759 - RNA, 19 nt, Chlamydophila pneumoniae J138
guagagccucuaagaaaau

SEQ ID NO: 536760 - RNA, 21 nt, Chlamydophila pneumoniae J138
guacuuaagcacugaugaaaa

SEQ ID NO: 536761 - RNA, 21 nt, Chlamydophila pneumoniae J138
guacuucccucaugaagaauu

SEQ ID NO: 536762 - RNA, 20 nt, Chlamydophila pneumoniae J138
guaggcacaucauuaucaua

SEQ ID NO: 536763 - RNA, 21 nt, Chlamydophila pneumoniae J138
guagagucggccguauaacuu

SEQ ID NO: 536764 - RNA, 14 nt, Chlamydophila pneumoniae J138
guagaguccacagu

SEQ ID NO: 536765 - RNA, 17 nt, Chlamydophila pneumoniae J138
guagaggacgugcuccc

SEQ ID NO: 536766 - RNA, 20 nt, Chlamydophila pneumoniae J138
guagauagaaauucuguaga

SEQ ID NO: 536767 - RNA, 18 nt, Chlamydophila pneumoniae J138
guagcgacguuugaucuu

SEQ ID NO: 536768 - RNA, 24 nt, Chlamydophila pneumoniae J138
guagccuggaggcgguggcaugcc

SEQ ID NO: 536769 - RNA, 21 nt, Chlamydophila pneumoniae J138
guagccguaggguagccaucc

SEQ ID NO: 536770 - RNA, 17 nt, Chlamydophila pneumoniae J138
guagcuauuuuugagga

SEQ ID NO: 536771 - RNA, 22 nt, Chlamydophila pneumoniae J138
guagcuacaaaauuauuaaacu

SEQ ID NO: 536772 - RNA, 19 nt, Chlamydophila pneumoniae J138
guaguuucuaaaacagaaa

SEQ ID NO: 536773 - RNA, 14 nt, Chlamydophila pneumoniae J138
guaguuugccuucu

SEQ ID NO: 536774 - RNA, 19 nt, Chlamydophila pneumoniae J138
guauaauagugagcucccu

SEQ ID NO: 536775 - RNA, 18 nt, Chlamydophila pneumoniae J138
guagugagauacggagga

SEQ ID NO: 536776 - RNA, 15 nt, Chlamydophila pneumoniae J138
guagucaugauuuuu

SEQ ID NO: 536777 - RNA, 22 nt, Chlamydophila pneumoniae J138
guagucaugauuuuucaaucaa

SEQ ID NO: 536778 - RNA, 16 nt, Chlamydophila pneumoniae J138
guaguaggcacuuauc

SEQ ID NO: 536779 - RNA, 21 nt, Chlamydophila pneumoniae J138
guaggucucccuggucuguau

SEQ ID NO: 536780 - RNA, 14 nt, Chlamydophila pneumoniae J138
guagguuuuuccaa

SEQ ID NO: 536781 - RNA, 15 nt, Chlamydophila pneumoniae J138
guauacauaucuccu

SEQ ID NO: 536782 - RNA, 20 nt, Chlamydophila pneumoniae J138
guauaauuggcguaauaauu

SEQ ID NO: 536783 - RNA, 22 nt, Chlamydophila pneumoniae J138
guauaauuggcguaauaauucc

SEQ ID NO: 536784 - RNA, 11 nt, Chlamydophila pneumoniae J138
gucaaaauauc

SEQ ID NO: 536785 - RNA, 19 nt, Chlamydophila pneumoniae J138
gucacuguuuuccagaaau

SEQ ID NO: 536786 - RNA, 12 nt, Chlamydophila pneumoniae J138
gucacguucuua

SEQ ID NO: 536787 - RNA, 19 nt, Chlamydophila pneumoniae J138
gucacguucuuagaaagcg

SEQ ID NO: 536788 - RNA, 19 nt, Chlamydophila pneumoniae J138
gucaggaggugguggagcu

SEQ ID NO: 536789 - RNA, 15 nt, Chlamydophila pneumoniae J138
gucaggagguggugg

SEQ ID NO: 536790 - RNA, 16 nt, Chlamydophila pneumoniae J138
gucaggagguggugga

SEQ ID NO: 536791 - RNA, 17 nt, Chlamydophila pneumoniae J138
gucaugcauagaauaaa

SEQ ID NO: 536792 - RNA, 16 nt, Chlamydophila pneumoniae J138
gucauaaaaauuucau

SEQ ID NO: 536793 - RNA, 17 nt, Chlamydophila pneumoniae J138
gucauacuacucucauc

SEQ ID NO: 536794 - RNA, 18 nt, Chlamydophila pneumoniae J138
guccauaauuucuuucac

SEQ ID NO: 536795 - RNA, 21 nt, Chlamydophila pneumoniae J138
gucauucugcaaggcaaugau

SEQ ID NO: 536796 - RNA, 19 nt, Chlamydophila pneumoniae J138
guccugcaggcuucaccau

SEQ ID NO: 536797 - RNA, 14 nt, Chlamydophila pneumoniae J138
guccuaggagagcu

SEQ ID NO: 536798 - RNA, 16 nt, Chlamydophila pneumoniae J138
guccuaauuuuccucc

SEQ ID NO: 536799 - RNA, 11 nt, Chlamydophila pneumoniae J138
guccucucccu

SEQ ID NO: 536800 - RNA, 19 nt, Chlamydophila pneumoniae J138
guccuugcagcccugcaua

SEQ ID NO: 536801 - RNA, 17 nt, Chlamydophila pneumoniae J138
gucgagcuuuaagaaga

SEQ ID NO: 536802 - RNA, 23 nt, Chlamydophila pneumoniae J138
gucgagcuuuaagaagaagaaaa

SEQ ID NO: 536803 - RNA, 15 nt, Chlamydophila pneumoniae J138
guccuucuugcaaag

SEQ ID NO: 536804 - RNA, 22 nt, Chlamydophila pneumoniae J138
guccugggguucucuaauggac

SEQ ID NO: 536805 - RNA, 22 nt, Chlamydophila pneumoniae J138
guccugggggaaauaccccauc

SEQ ID NO: 536806 - RNA, 21 nt, Chlamydophila pneumoniae J138
gucgcgaaaguaaaauuucug

SEQ ID NO: 536807 - RNA, 19 nt, Chlamydophila pneumoniae J138
gugcauuaucuaagaauau

SEQ ID NO: 536808 - RNA, 17 nt, Chlamydophila pneumoniae J138
gugcaaguucacacgua

SEQ ID NO: 536809 - RNA, 14 nt, Chlamydophila pneumoniae J138
gugaucuugagaaa

SEQ ID NO: 536810 - RNA, 18 nt, Chlamydophila pneumoniae J138
gugcgaaagcccaugaga

SEQ ID NO: 536811 - RNA, 23 nt, Chlamydophila pneumoniae J138
gugccuucuucaaagcuacuaau

SEQ ID NO: 536812 - RNA, 20 nt, Chlamydophila pneumoniae J138
gugcgcgucuccuugauuug

SEQ ID NO: 536813 - RNA, 13 nt, Chlamydophila pneumoniae J138
gugcucuacccca

SEQ ID NO: 536814 - RNA, 13 nt, Chlamydophila pneumoniae J138
gugcucuguauug

SEQ ID NO: 536815 - RNA, 12 nt, Chlamydophila pneumoniae J138
gugcucucuaaa

SEQ ID NO: 536816 - RNA, 19 nt, Chlamydophila pneumoniae J138
gugcucaguaaauauuuua

SEQ ID NO: 536817 - RNA, 23 nt, Chlamydophila pneumoniae J138
gugguaaaaauauaggcugcaca

SEQ ID NO: 536818 - RNA, 22 nt, Chlamydophila pneumoniae J138
gugguuagagcagcagaaucau

SEQ ID NO: 536819 - RNA, 16 nt, Chlamydophila pneumoniae J138
guuacgugagaacuca

SEQ ID NO: 536820 - RNA, 22 nt, Chlamydophila pneumoniae J138
guuacggaacucauuaagaaga

SEQ ID NO: 536821 - RNA, 23 nt, Chlamydophila pneumoniae J138
guuacgcucguagguaugagcuc

SEQ ID NO: 536822 - RNA, 17 nt, Chlamydophila pneumoniae J138
guuacagcguugcuaag

SEQ ID NO: 536823 - RNA, 17 nt, Chlamydophila pneumoniae J138
guuacaagcaauacuaa

SEQ ID NO: 536824 - RNA, 11 nt, Chlamydophila pneumoniae J138
guuaauaagaa

SEQ ID NO: 536825 - RNA, 17 nt, Chlamydophila pneumoniae J138
guuaaacaaaguaggau

SEQ ID NO: 536826 - RNA, 20 nt, Chlamydophila pneumoniae J138
guguaccucucaucaaagca

SEQ ID NO: 536827 - RNA, 14 nt, Chlamydophila pneumoniae J138
guguaaaaguuagg

SEQ ID NO: 536828 - RNA, 18 nt, Chlamydophila pneumoniae J138
gugugguaaaaauauagg

SEQ ID NO: 536829 - RNA, 13 nt, Chlamydophila pneumoniae J138
guguugaauaaga

SEQ ID NO: 536830 - RNA, 12 nt, Chlamydophila pneumoniae J138
guguuuccuucg

SEQ ID NO: 536831 - RNA, 21 nt, Chlamydophila pneumoniae J138
guguuuccuuuucuccuucug

SEQ ID NO: 536832 - RNA, 12 nt, Chlamydophila pneumoniae J138
guguuuucuagu

SEQ ID NO: 536833 - RNA, 19 nt, Chlamydophila pneumoniae J138
guucccaucacauaaauca

SEQ ID NO: 536834 - RNA, 18 nt, Chlamydophila pneumoniae J138
guuccaagacaauaaaaa

SEQ ID NO: 536835 - RNA, 19 nt, Chlamydophila pneumoniae J138
guuccuauaugaaugauuu

SEQ ID NO: 536836 - RNA, 20 nt, Chlamydophila pneumoniae J138
guuccuacuucugcaggacu

SEQ ID NO: 536837 - RNA, 19 nt, Chlamydophila pneumoniae J138
guuccuacaggcaggccac

SEQ ID NO: 536838 - RNA, 20 nt, Chlamydophila pneumoniae J138
guuccuguaguuugcagaga

SEQ ID NO: 536839 - RNA, 20 nt, Chlamydophila pneumoniae J138
guuccugaaaagcauucugc

SEQ ID NO: 536840 - RNA, 12 nt, Chlamydophila pneumoniae J138
guuccucauccu

SEQ ID NO: 536841 - RNA, 19 nt, Chlamydophila pneumoniae J138
guucauuagcuaaaucaaa

SEQ ID NO: 536842 - RNA, 24 nt, Chlamydophila pneumoniae J138
guucauucucaugucuaagucaga

SEQ ID NO: 536843 - RNA, 22 nt, Chlamydophila pneumoniae J138
guucauacaccccauagagcug

SEQ ID NO: 536844 - RNA, 13 nt, Chlamydophila pneumoniae J138
guuagagaagagg

SEQ ID NO: 536845 - RNA, 15 nt, Chlamydophila pneumoniae J138
guuagaugaagagug

SEQ ID NO: 536846 - RNA, 15 nt, Chlamydophila pneumoniae J138
guucagcaaggaagu

SEQ ID NO: 536847 - RNA, 13 nt, Chlamydophila pneumoniae J138
guucuuucuuucu

SEQ ID NO: 536848 - RNA, 14 nt, Chlamydophila pneumoniae J138
guucuuguaauaaa

SEQ ID NO: 536849 - RNA, 20 nt, Chlamydophila pneumoniae J138
guucuuuuguuugucuucca

SEQ ID NO: 536850 - RNA, 17 nt, Chlamydophila pneumoniae J138
guucuuugaauuuccaa

SEQ ID NO: 536851 - RNA, 17 nt, Chlamydophila pneumoniae J138
guugaaaugagugagaa

SEQ ID NO: 536852 - RNA, 23 nt, Chlamydophila pneumoniae J138
guugcaucgccuuaagcucuaag

SEQ ID NO: 536853 - RNA, 20 nt, Chlamydophila pneumoniae J138
guugcacucgauuauuucuu

SEQ ID NO: 536854 - RNA, 17 nt, Chlamydophila pneumoniae J138
guugaggaauuggcagg

SEQ ID NO: 536855 - RNA, 16 nt, Chlamydophila pneumoniae J138
guugaggaaaggaggg

SEQ ID NO: 536856 - RNA, 19 nt, Chlamydophila pneumoniae J138
guugagaaccuucacaaga

SEQ ID NO: 536857 - RNA, 22 nt, Chlamydophila pneumoniae J138
guugcaugcuugaaguucucaa

SEQ ID NO: 536858 - RNA, 19 nt, Chlamydophila pneumoniae J138
guugcgcaguggacgggga

SEQ ID NO: 536859 - RNA, 16 nt, Chlamydophila pneumoniae J138
guugcuaagaucuuua

SEQ ID NO: 536860 - RNA, 20 nt, Chlamydophila pneumoniae J138
guugcuaagaucuuuagaau

SEQ ID NO: 536861 - RNA, 22 nt, Chlamydophila pneumoniae J138
guugcuaagaucuuuagaauaa

SEQ ID NO: 536862 - RNA, 16 nt, Chlamydophila pneumoniae J138
guugcucauccuuuag

SEQ ID NO: 536863 - RNA, 14 nt, Chlamydophila pneumoniae J138
guuggacugcaaga

SEQ ID NO: 536864 - RNA, 15 nt, Chlamydophila pneumoniae J138
guuggaggaacaaua

SEQ ID NO: 536865 - RNA, 19 nt, Chlamydophila pneumoniae J138
guugcuucuaagaaacuuc

SEQ ID NO: 536866 - RNA, 20 nt, Chlamydophila pneumoniae J138
guuggauccaucggcauuuc

SEQ ID NO: 536867 - RNA, 23 nt, Chlamydophila pneumoniae J138
guuggauccaucggcauuucucc

SEQ ID NO: 536868 - RNA, 14 nt, Chlamydophila pneumoniae J138
guuucccccauaaa

SEQ ID NO: 536869 - RNA, 13 nt, Chlamydophila pneumoniae J138
guuuccuccucuu

SEQ ID NO: 536870 - RNA, 23 nt, Chlamydophila pneumoniae J138
guuucuuuuuuuauaaagaagaa

SEQ ID NO: 536871 - RNA, 22 nt, Chlamydophila pneumoniae J138
guuucuuuugauugaaacuuuu

SEQ ID NO: 536872 - RNA, 24 nt, Chlamydophila pneumoniae J138
guuucuagaaaaucucuaagaauc

SEQ ID NO: 536873 - RNA, 17 nt, Chlamydophila pneumoniae J138
guuucgauaucacggcu

SEQ ID NO: 536874 - RNA, 18 nt, Chlamydophila pneumoniae J138
guuguugcaauucuucau

SEQ ID NO: 536875 - RNA, 15 nt, Chlamydophila pneumoniae J138
guuguuggagcagaa

SEQ ID NO: 536876 - RNA, 22 nt, Chlamydophila pneumoniae J138
guugucacuaagauaucuccag

SEQ ID NO: 536877 - RNA, 18 nt, Chlamydophila pneumoniae J138
guuguagugaaugagcuu

SEQ ID NO: 536878 - RNA, 21 nt, Chlamydophila pneumoniae J138
guuguagcuacaagucccccu

SEQ ID NO: 536879 - RNA, 21 nt, Chlamydophila pneumoniae J138
uaaaaugcgcacggauucuaa

SEQ ID NO: 536880 - RNA, 19 nt, Chlamydophila pneumoniae J138
uaaaauggugaagaauaau

SEQ ID NO: 536881 - RNA, 18 nt, Chlamydophila pneumoniae J138
uaaaauucaaaucccuga

SEQ ID NO: 536882 - RNA, 20 nt, Chlamydophila pneumoniae J138
uaaaauucugaagauauauu

SEQ ID NO: 536883 - RNA, 15 nt, Chlamydophila pneumoniae J138
uaaaauuuaaaaaaa

SEQ ID NO: 536884 - RNA, 16 nt, Chlamydophila pneumoniae J138
uaaaauuuaaaaaaau

SEQ ID NO: 536885 - RNA, 18 nt, Chlamydophila pneumoniae J138
uaaaauuuaaaaaaaucu

SEQ ID NO: 536886 - RNA, 15 nt, Chlamydophila pneumoniae J138
uaaaauuucuguagu

SEQ ID NO: 536887 - RNA, 14 nt, Chlamydophila pneumoniae J138
uaaaauuucuagga

SEQ ID NO: 536888 - RNA, 23 nt, Chlamydophila pneumoniae J138
uaaaauuucuaggacagcacaua

SEQ ID NO: 536889 - RNA, 13 nt, Chlamydophila pneumoniae J138
uaaacaauaagag

SEQ ID NO: 536890 - RNA, 22 nt, Chlamydophila pneumoniae J138
uaaaaacccuaguucauuagcu

SEQ ID NO: 536891 - RNA, 18 nt, Chlamydophila pneumoniae J138
uaaaaacccuaguucauu

SEQ ID NO: 536892 - RNA, 15 nt, Chlamydophila pneumoniae J138
uaaaaacuucccauc

SEQ ID NO: 536893 - RNA, 23 nt, Chlamydophila pneumoniae J138
uaaaaauggcacuugagcacauu

SEQ ID NO: 536894 - RNA, 23 nt, Chlamydophila pneumoniae J138
uaaaaccacagaaugauaagaaa

SEQ ID NO: 536895 - RNA, 14 nt, Chlamydophila pneumoniae J138
uaaaagaauaauag

SEQ ID NO: 536896 - RNA, 13 nt, Chlamydophila pneumoniae J138
uaaaagacugaaa

SEQ ID NO: 536897 - RNA, 14 nt, Chlamydophila pneumoniae J138
uaaaagauuccuua

SEQ ID NO: 536898 - RNA, 20 nt, Chlamydophila pneumoniae J138
uaaaagcuuaucccauaaau

SEQ ID NO: 536899 - RNA, 16 nt, Chlamydophila pneumoniae J138
uaaacggacgcuagag

SEQ ID NO: 536900 - RNA, 18 nt, Chlamydophila pneumoniae J138
uaaacucuccaaaagcuc

SEQ ID NO: 536901 - RNA, 14 nt, Chlamydophila pneumoniae J138
uaaacucuccaaaa

SEQ ID NO: 536902 - RNA, 12 nt, Chlamydophila pneumoniae J138
uaaacucuccaa

SEQ ID NO: 536903 - RNA, 22 nt, Chlamydophila pneumoniae J138
uaaacugggaagaccacgaaau

SEQ ID NO: 536904 - RNA, 21 nt, Chlamydophila pneumoniae J138
uaaacucucuuccuucuccug

SEQ ID NO: 536905 - RNA, 23 nt, Chlamydophila pneumoniae J138
uaaacucucuuccuucuccugua

SEQ ID NO: 536906 - RNA, 20 nt, Chlamydophila pneumoniae J138
uaaacauacaugcuaaucca

SEQ ID NO: 536907 - RNA, 17 nt, Chlamydophila pneumoniae J138
uaaacaucgcagcagga

SEQ ID NO: 536908 - RNA, 16 nt, Chlamydophila pneumoniae J138
uaaacagaucuuuauc

SEQ ID NO: 536909 - RNA, 23 nt, Chlamydophila pneumoniae J138
uaaacagcgguugccuuucucuu

SEQ ID NO: 536910 - RNA, 17 nt, Chlamydophila pneumoniae J138
uaaaccaucacuuccug

SEQ ID NO: 536911 - RNA, 16 nt, Chlamydophila pneumoniae J138
uaaacccuucaagcaa

SEQ ID NO: 536912 - RNA, 20 nt, Chlamydophila pneumoniae J138
uaaagcaaagauaaagaagu

SEQ ID NO: 536913 - RNA, 18 nt, Chlamydophila pneumoniae J138
uaaaggaccuguuuucuu

SEQ ID NO: 536914 - RNA, 21 nt, Chlamydophila pneumoniae J138
uaaaggaacugugccauaacg

SEQ ID NO: 536915 - RNA, 18 nt, Chlamydophila pneumoniae J138
uaaaggcauaacugugcu

SEQ ID NO: 536916 - RNA, 19 nt, Chlamydophila pneumoniae J138
uaaagcuauuguuuuucaa

SEQ ID NO: 536917 - RNA, 15 nt, Chlamydophila pneumoniae J138
uaaagauuuucauaa

SEQ ID NO: 536918 - RNA, 15 nt, Chlamydophila pneumoniae J138
uaaagauuggaauau

SEQ ID NO: 536919 - RNA, 19 nt, Chlamydophila pneumoniae J138
uaaagauguagaauaacgc

SEQ ID NO: 536920 - RNA, 17 nt, Chlamydophila pneumoniae J138
uaaagauacuuaucuuu

SEQ ID NO: 536921 - RNA, 22 nt, Chlamydophila pneumoniae J138
uaaagauagcgacgucaucaua

SEQ ID NO: 536922 - RNA, 19 nt, Chlamydophila pneumoniae J138
uaaagauacuuaucuuuaa

SEQ ID NO: 536923 - RNA, 20 nt, Chlamydophila pneumoniae J138
uaaagauacuuaucuuuaaa

SEQ ID NO: 536924 - RNA, 23 nt, Chlamydophila pneumoniae J138
uaaagaucgggucuacaacaguu

SEQ ID NO: 536925 - RNA, 20 nt, Chlamydophila pneumoniae J138
uaaagaucgugaucaaagaa

SEQ ID NO: 536926 - RNA, 15 nt, Chlamydophila pneumoniae J138
uaaagaucuucauaa

SEQ ID NO: 536927 - RNA, 23 nt, Chlamydophila pneumoniae J138
uaaagaucuuuuaugauguauaa

SEQ ID NO: 536928 - RNA, 14 nt, Chlamydophila pneumoniae J138
uaaagaucuucaua

SEQ ID NO: 536929 - RNA, 15 nt, Chlamydophila pneumoniae J138
uaaagauaaucugua

SEQ ID NO: 536930 - RNA, 17 nt, Chlamydophila pneumoniae J138
uaaagauaaucuguaag

SEQ ID NO: 536931 - RNA, 19 nt, Chlamydophila pneumoniae J138
uaaacuuuuuuucaaauca

SEQ ID NO: 536932 - RNA, 18 nt, Chlamydophila pneumoniae J138
uaaagaaagagucucacu

SEQ ID NO: 536933 - RNA, 20 nt, Chlamydophila pneumoniae J138
uaaauccccaccaacaaugc

SEQ ID NO: 536934 - RNA, 20 nt, Chlamydophila pneumoniae J138
uaaaucccacuaucuguaau

SEQ ID NO: 536935 - RNA, 19 nt, Chlamydophila pneumoniae J138
uaaauccaccaaugauaau

SEQ ID NO: 536936 - RNA, 21 nt, Chlamydophila pneumoniae J138
uaaaucgcugggauucguaau

SEQ ID NO: 536937 - RNA, 17 nt, Chlamydophila pneumoniae J138
uaaaguguguaaauguu

SEQ ID NO: 536938 - RNA, 19 nt, Chlamydophila pneumoniae J138
uaaagugucauacgcagca

SEQ ID NO: 536939 - RNA, 20 nt, Chlamydophila pneumoniae J138
uaaaguggcaaucuuuucuu

SEQ ID NO: 536940 - RNA, 14 nt, Chlamydophila pneumoniae J138
uaaaggcucuuuua

SEQ ID NO: 536941 - RNA, 14 nt, Chlamydophila pneumoniae J138
uaaauaggcucuac

SEQ ID NO: 536942 - RNA, 22 nt, Chlamydophila pneumoniae J138
uaaauaccuagagcucugaaau

SEQ ID NO: 536943 - RNA, 20 nt, Chlamydophila pneumoniae J138
uaacauaaagucaaacauca

SEQ ID NO: 536944 - RNA, 13 nt, Chlamydophila pneumoniae J138
uaacauagauaag

SEQ ID NO: 536945 - RNA, 14 nt, Chlamydophila pneumoniae J138
uaacaucaagaauu

SEQ ID NO: 536946 - RNA, 13 nt, Chlamydophila pneumoniae J138
uaacacuucuuuc

SEQ ID NO: 536947 - RNA, 15 nt, Chlamydophila pneumoniae J138
uaacacuucuuucuu

SEQ ID NO: 536948 - RNA, 17 nt, Chlamydophila pneumoniae J138
uaacacuuuguuuuuca

SEQ ID NO: 536949 - RNA, 12 nt, Chlamydophila pneumoniae J138
uaaccagagagc

SEQ ID NO: 536950 - RNA, 15 nt, Chlamydophila pneumoniae J138
uaaccaaguaaauca

SEQ ID NO: 536951 - RNA, 14 nt, Chlamydophila pneumoniae J138
uaacaucuaaaaau

SEQ ID NO: 536952 - RNA, 20 nt, Chlamydophila pneumoniae J138
uaaccaaaagaauuaagaag

SEQ ID NO: 536953 - RNA, 23 nt, Chlamydophila pneumoniae J138
uaaccaaaagaauuaagaagaag

SEQ ID NO: 536954 - RNA, 17 nt, Chlamydophila pneumoniae J138
uaaccaacaucaaagaa

SEQ ID NO: 536955 - RNA, 15 nt, Chlamydophila pneumoniae J138
uaaauguauugcaaa

SEQ ID NO: 536956 - RNA, 20 nt, Chlamydophila pneumoniae J138
uaaauguauaggcauuaaua

SEQ ID NO: 536957 - RNA, 20 nt, Chlamydophila pneumoniae J138
uaaauuuuguuuuuccauuu

SEQ ID NO: 536958 - RNA, 23 nt, Chlamydophila pneumoniae J138
uaacaaaaggauucuaugaggac

SEQ ID NO: 536959 - RNA, 14 nt, Chlamydophila pneumoniae J138
uaaauuuuuccuuc

SEQ ID NO: 536960 - RNA, 20 nt, Chlamydophila pneumoniae J138
uaaauuuuuccuucaacaca

SEQ ID NO: 536961 - RNA, 19 nt, Chlamydophila pneumoniae J138
uaacaacuucugacaauaa

SEQ ID NO: 536962 - RNA, 22 nt, Chlamydophila pneumoniae J138
uaacaaguaccaagaaaauagu

SEQ ID NO: 536963 - RNA, 15 nt, Chlamydophila pneumoniae J138
uaacaauauaugcua

SEQ ID NO: 536964 - RNA, 18 nt, Chlamydophila pneumoniae J138
uaacacuucuuucuugcu

SEQ ID NO: 536965 - RNA, 22 nt, Chlamydophila pneumoniae J138
uaacacuuccuacggcaagaau

SEQ ID NO: 536966 - RNA, 14 nt, Chlamydophila pneumoniae J138
uaacaccucuucaa

SEQ ID NO: 536967 - RNA, 17 nt, Chlamydophila pneumoniae J138
uaaccccuccaaaauca

SEQ ID NO: 536968 - RNA, 20 nt, Chlamydophila pneumoniae J138
uaacuaaauucuuaacaaua

SEQ ID NO: 536969 - RNA, 20 nt, Chlamydophila pneumoniae J138
uaacguuucuucgcaaauau

SEQ ID NO: 536970 - RNA, 17 nt, Chlamydophila pneumoniae J138
uaacguagucaaaaauu

SEQ ID NO: 536971 - RNA, 16 nt, Chlamydophila pneumoniae J138
uaacguagucaaaaau

SEQ ID NO: 536972 - RNA, 19 nt, Chlamydophila pneumoniae J138
uaacguuucaggucagcaa

SEQ ID NO: 536973 - RNA, 23 nt, Chlamydophila pneumoniae J138
uaacguacgcaaguaaagaaauu

SEQ ID NO: 536974 - RNA, 22 nt, Chlamydophila pneumoniae J138
uaacuaucucuguuuuuugaaa

SEQ ID NO: 536975 - RNA, 23 nt, Chlamydophila pneumoniae J138
uaacuaucucuguuuuuugaaaa

SEQ ID NO: 536976 - RNA, 19 nt, Chlamydophila pneumoniae J138
uaacuaucuacacaguagc

SEQ ID NO: 536977 - RNA, 14 nt, Chlamydophila pneumoniae J138
uaacuaagauaugu

SEQ ID NO: 536978 - RNA, 13 nt, Chlamydophila pneumoniae J138
uaacuaguaacuu

SEQ ID NO: 536979 - RNA, 14 nt, Chlamydophila pneumoniae J138
uaacuccagcgagg

SEQ ID NO: 536980 - RNA, 18 nt, Chlamydophila pneumoniae J138
uaacucagagauugccag

SEQ ID NO: 536981 - RNA, 21 nt, Chlamydophila pneumoniae J138
uaacucuagaucuucaauccc

SEQ ID NO: 536982 - RNA, 16 nt, Chlamydophila pneumoniae J138
uaacugcaaagagaau

SEQ ID NO: 536983 - RNA, 16 nt, Chlamydophila pneumoniae J138
uaacugaggcaaagau

SEQ ID NO: 536984 - RNA, 17 nt, Chlamydophila pneumoniae J138
uaacucuuaagaauaaa

SEQ ID NO: 536985 - RNA, 21 nt, Chlamydophila pneumoniae J138
uaacuuggugagcagcuuuau

SEQ ID NO: 536986 - RNA, 21 nt, Chlamydophila pneumoniae J138
uaacuugcauuuuuuggaaua

SEQ ID NO: 536987 - RNA, 22 nt, Chlamydophila pneumoniae J138
uaacuucuaaaagcaaguuguu

SEQ ID NO: 536988 - RNA, 20 nt, Chlamydophila pneumoniae J138
uaacuuaaagacuugcuucc

SEQ ID NO: 536989 - RNA, 18 nt, Chlamydophila pneumoniae J138
uaacuuaauagauucguu

SEQ ID NO: 536990 - RNA, 15 nt, Chlamydophila pneumoniae J138
uaacuuuaucauaga

SEQ ID NO: 536991 - RNA, 18 nt, Chlamydophila pneumoniae J138
uaagaaaaugaggacaca

SEQ ID NO: 536992 - RNA, 22 nt, Chlamydophila pneumoniae J138
uaagaaaggcacuccaaaacuc

SEQ ID NO: 536993 - RNA, 14 nt, Chlamydophila pneumoniae J138
uaagaaaucccagu

SEQ ID NO: 536994 - RNA, 14 nt, Chlamydophila pneumoniae J138
uaagaaacuuccaa

SEQ ID NO: 536995 - RNA, 16 nt, Chlamydophila pneumoniae J138
uaagaacaucuuccca

SEQ ID NO: 536996 - RNA, 15 nt, Chlamydophila pneumoniae J138
uaagaacguauacgu

SEQ ID NO: 536997 - RNA, 20 nt, Chlamydophila pneumoniae J138
uaagaauguagcuguuccaa

SEQ ID NO: 536998 - RNA, 15 nt, Chlamydophila pneumoniae J138
uaagaauaaaauagg

SEQ ID NO: 536999 - RNA, 12 nt, Chlamydophila pneumoniae J138
uaagaccagaaa

SEQ ID NO: 537000 - RNA, 15 nt, Chlamydophila pneumoniae J138
uaagacuaaaaaaga

SEQ ID NO: 537001 - RNA, 16 nt, Chlamydophila pneumoniae J138
uaagacuaaaaaagag

SEQ ID NO: 537002 - RNA, 17 nt, Chlamydophila pneumoniae J138
uaagagacauuucuuga

SEQ ID NO: 537003 - RNA, 15 nt, Chlamydophila pneumoniae J138
uaagagcaaacauca

SEQ ID NO: 537004 - RNA, 23 nt, Chlamydophila pneumoniae J138
uaagagauuuuccauaggaacaa

SEQ ID NO: 537005 - RNA, 18 nt, Chlamydophila pneumoniae J138
uaagagcaaacaucaaag

SEQ ID NO: 537006 - RNA, 12 nt, Chlamydophila pneumoniae J138
uaagagcuacaa

SEQ ID NO: 537007 - RNA, 17 nt, Chlamydophila pneumoniae J138
uaagaggugauacauag

SEQ ID NO: 537008 - RNA, 16 nt, Chlamydophila pneumoniae J138
uaagagguucucuuaa

SEQ ID NO: 537009 - RNA, 17 nt, Chlamydophila pneumoniae J138
uaagagguucuugcuua

SEQ ID NO: 537010 - RNA, 18 nt, Chlamydophila pneumoniae J138
uaagauaauagagaagaa

SEQ ID NO: 537011 - RNA, 16 nt, Chlamydophila pneumoniae J138
uaagauaaacauuaag

SEQ ID NO: 537012 - RNA, 21 nt, Chlamydophila pneumoniae J138
uaagauaaacauuaagugaug

SEQ ID NO: 537013 - RNA, 20 nt, Chlamydophila pneumoniae J138
uaagauaaacagcacaggca

SEQ ID NO: 537014 - RNA, 14 nt, Chlamydophila pneumoniae J138
uaagauaaacagca

SEQ ID NO: 537015 - RNA, 17 nt, Chlamydophila pneumoniae J138
uaagaguuccaagacaa

SEQ ID NO: 537016 - RNA, 21 nt, Chlamydophila pneumoniae J138
uaagaguuuuacaucaaugau

SEQ ID NO: 537017 - RNA, 15 nt, Chlamydophila pneumoniae J138
uaagauacuucucca

SEQ ID NO: 537018 - RNA, 20 nt, Chlamydophila pneumoniae J138
uaagauagacucucacugag

SEQ ID NO: 537019 - RNA, 21 nt, Chlamydophila pneumoniae J138
uaagauagacucucacugagu

SEQ ID NO: 537020 - RNA, 18 nt, Chlamydophila pneumoniae J138
uaagaucaauauagagaa

SEQ ID NO: 537021 - RNA, 14 nt, Chlamydophila pneumoniae J138
uaagauaucuccag

SEQ ID NO: 537022 - RNA, 20 nt, Chlamydophila pneumoniae J138
uaagauguggucuuccguau

SEQ ID NO: 537023 - RNA, 17 nt, Chlamydophila pneumoniae J138
uaagauccuuuaaagau

SEQ ID NO: 537024 - RNA, 19 nt, Chlamydophila pneumoniae J138
uaagauccuuuaaagauuc

SEQ ID NO: 537025 - RNA, 16 nt, Chlamydophila pneumoniae J138
uaagauccucuauaga

SEQ ID NO: 537026 - RNA, 18 nt, Chlamydophila pneumoniae J138
uaagauugccauguacau

SEQ ID NO: 537027 - RNA, 12 nt, Chlamydophila pneumoniae J138
uaagauuuugaa

SEQ ID NO: 537028 - RNA, 13 nt, Chlamydophila pneumoniae J138
uaagauuuccuua

SEQ ID NO: 537029 - RNA, 18 nt, Chlamydophila pneumoniae J138
uaagcaaagcggcucuua

SEQ ID NO: 537030 - RNA, 21 nt, Chlamydophila pneumoniae J138
uaagcaagagcuccgcuagag

SEQ ID NO: 537031 - RNA, 13 nt, Chlamydophila pneumoniae J138
uaagcaucuagaa

SEQ ID NO: 537032 - RNA, 14 nt, Chlamydophila pneumoniae J138
uaagccaaauacca

SEQ ID NO: 537033 - RNA, 15 nt, Chlamydophila pneumoniae J138
uaagccaaauaccaa

SEQ ID NO: 537034 - RNA, 15 nt, Chlamydophila pneumoniae J138
uaagccaguacuaaa

SEQ ID NO: 537035 - RNA, 19 nt, Chlamydophila pneumoniae J138
uaagcaggaaaagcaaaau

SEQ ID NO: 537036 - RNA, 21 nt, Chlamydophila pneumoniae J138
uaagcauagcccgaaauucau

SEQ ID NO: 537037 - RNA, 22 nt, Chlamydophila pneumoniae J138
uaagcaauauuucuguucugcu

SEQ ID NO: 537038 - RNA, 14 nt, Chlamydophila pneumoniae J138
uaagcucuaagucc

SEQ ID NO: 537039 - RNA, 19 nt, Chlamydophila pneumoniae J138
uaagcucuuaauuucugcu

SEQ ID NO: 537040 - RNA, 17 nt, Chlamydophila pneumoniae J138
uaagcucauaagaaauu

SEQ ID NO: 537041 - RNA, 14 nt, Chlamydophila pneumoniae J138
uaagcuauaucuca

SEQ ID NO: 537042 - RNA, 15 nt, Chlamydophila pneumoniae J138
uaagcugcaaucuca

SEQ ID NO: 537043 - RNA, 17 nt, Chlamydophila pneumoniae J138
uaagcugugcauuuucu

SEQ ID NO: 537044 - RNA, 14 nt, Chlamydophila pneumoniae J138
uaaggacaaaucuc

SEQ ID NO: 537045 - RNA, 15 nt, Chlamydophila pneumoniae J138
uaagcuuuucuucca

SEQ ID NO: 537046 - RNA, 22 nt, Chlamydophila pneumoniae J138
uaagcuuuucuuccaaagacug

SEQ ID NO: 537047 - RNA, 23 nt, Chlamydophila pneumoniae J138
uaagcuuuucuuccaaagacuga

SEQ ID NO: 537048 - RNA, 20 nt, Chlamydophila pneumoniae J138
uaagcuuuuacccucgccaa

SEQ ID NO: 537049 - RNA, 17 nt, Chlamydophila pneumoniae J138
uaagcuuuccucuccaa

SEQ ID NO: 537050 - RNA, 16 nt, Chlamydophila pneumoniae J138
uaagcuuuauguggag

SEQ ID NO: 537051 - RNA, 15 nt, Chlamydophila pneumoniae J138
uaagcgcucuucaau

SEQ ID NO: 537052 - RNA, 21 nt, Chlamydophila pneumoniae J138
uaagcgauuucgacagcagca

SEQ ID NO: 537053 - RNA, 15 nt, Chlamydophila pneumoniae J138
uaagcgauggcaguu

SEQ ID NO: 537054 - RNA, 20 nt, Chlamydophila pneumoniae J138
uaauccagcaacaaccaaaa

SEQ ID NO: 537055 - RNA, 23 nt, Chlamydophila pneumoniae J138
uaauccagauuguucaaaaauag

SEQ ID NO: 537056 - RNA, 19 nt, Chlamydophila pneumoniae J138
uaaucuauaggauuugcau

SEQ ID NO: 537057 - RNA, 12 nt, Chlamydophila pneumoniae J138
uaaucuguauau

SEQ ID NO: 537058 - RNA, 12 nt, Chlamydophila pneumoniae J138
uaaucucaccag

SEQ ID NO: 537059 - RNA, 22 nt, Chlamydophila pneumoniae J138
uaaucuccaaacauuuuuaagg

SEQ ID NO: 537060 - RNA, 22 nt, Chlamydophila pneumoniae J138
uaauagcgacaugagaaaucuu

SEQ ID NO: 537061 - RNA, 21 nt, Chlamydophila pneumoniae J138
uaauagcgacaugagaaaucu

SEQ ID NO: 537062 - RNA, 12 nt, Chlamydophila pneumoniae J138
uaauagagaaga

SEQ ID NO: 537063 - RNA, 13 nt, Chlamydophila pneumoniae J138
uaauagagaagaa

SEQ ID NO: 537064 - RNA, 16 nt, Chlamydophila pneumoniae J138
uaauauuugagaagau

SEQ ID NO: 537065 - RNA, 13 nt, Chlamydophila pneumoniae J138
uaaucaaccaaaa

SEQ ID NO: 537066 - RNA, 17 nt, Chlamydophila pneumoniae J138
uaaucaagccuaaaucu

SEQ ID NO: 537067 - RNA, 20 nt, Chlamydophila pneumoniae J138
uaauggagagcuuucgcucc

SEQ ID NO: 537068 - RNA, 23 nt, Chlamydophila pneumoniae J138
uaaugucuccaucggaauuugcc

SEQ ID NO: 537069 - RNA, 14 nt, Chlamydophila pneumoniae J138
uaaugucuccaucg

SEQ ID NO: 537070 - RNA, 20 nt, Chlamydophila pneumoniae J138
uaauuccaaaauaaaaggag

SEQ ID NO: 537071 - RNA, 14 nt, Chlamydophila pneumoniae J138
uaauuccuuggauu

SEQ ID NO: 537072 - RNA, 21 nt, Chlamydophila pneumoniae J138
uaauugcuggaggccaaagaa

SEQ ID NO: 537073 - RNA, 18 nt, Chlamydophila pneumoniae J138
uaaggcuuuucugcuccu

SEQ ID NO: 537074 - RNA, 17 nt, Chlamydophila pneumoniae J138
uaaggcuuccaaugcua

SEQ ID NO: 537075 - RNA, 20 nt, Chlamydophila pneumoniae J138
uaaggcuuccaaugcuauug

SEQ ID NO: 537076 - RNA, 16 nt, Chlamydophila pneumoniae J138
uaagggcucuagauau

SEQ ID NO: 537077 - RNA, 16 nt, Chlamydophila pneumoniae J138
uaagggcucuccuaaa

SEQ ID NO: 537078 - RNA, 22 nt, Chlamydophila pneumoniae J138
uaagggggaucuucagagagaa

SEQ ID NO: 537079 - RNA, 22 nt, Chlamydophila pneumoniae J138
uaaggagagggguucccucucc

SEQ ID NO: 537080 - RNA, 22 nt, Chlamydophila pneumoniae J138
uaaguacacauugucucuuuua

SEQ ID NO: 537081 - RNA, 17 nt, Chlamydophila pneumoniae J138
uaaguaaccaauacagc

SEQ ID NO: 537082 - RNA, 13 nt, Chlamydophila pneumoniae J138
uaaggguuuugaa

SEQ ID NO: 537083 - RNA, 18 nt, Chlamydophila pneumoniae J138
uaagguuaucuuuuugga

SEQ ID NO: 537084 - RNA, 20 nt, Chlamydophila pneumoniae J138
uaagucuccauaauucugca

SEQ ID NO: 537085 - RNA, 17 nt, Chlamydophila pneumoniae J138
uaagucgaauucauuaa

SEQ ID NO: 537086 - RNA, 19 nt, Chlamydophila pneumoniae J138
uaaguccuucuucccagcc

SEQ ID NO: 537087 - RNA, 19 nt, Chlamydophila pneumoniae J138
uaaguccaacaucagcugu

SEQ ID NO: 537088 - RNA, 18 nt, Chlamydophila pneumoniae J138
uaagugacuuuucuucuu

SEQ ID NO: 537089 - RNA, 12 nt, Chlamydophila pneumoniae J138
uaagugcuuuua

SEQ ID NO: 537090 - RNA, 21 nt, Chlamydophila pneumoniae J138
uaaguuagagacacagaagga

SEQ ID NO: 537091 - RNA, 13 nt, Chlamydophila pneumoniae J138
uaaguucuuccaa

SEQ ID NO: 537092 - RNA, 16 nt, Chlamydophila pneumoniae J138
uaaguuuguagcagca

SEQ ID NO: 537093 - RNA, 17 nt, Chlamydophila pneumoniae J138
uaaguugguccaucgag

SEQ ID NO: 537094 - RNA, 20 nt, Chlamydophila pneumoniae J138
uaaguuuguagcagcaagaa

SEQ ID NO: 537095 - RNA, 12 nt, Chlamydophila pneumoniae J138
uaauaaaucuau

SEQ ID NO: 537096 - RNA, 14 nt, Chlamydophila pneumoniae J138
uaauaaaagaacau

SEQ ID NO: 537097 - RNA, 15 nt, Chlamydophila pneumoniae J138
uaauaaaagaacauu

SEQ ID NO: 537098 - RNA, 13 nt, Chlamydophila pneumoniae J138
uaauaaaauuuaa

SEQ ID NO: 537099 - RNA, 16 nt, Chlamydophila pneumoniae J138
uaauaaaauuuaaaaa

SEQ ID NO: 537100 - RNA, 16 nt, Chlamydophila pneumoniae J138
uaauaagcaggaaaag

SEQ ID NO: 537101 - RNA, 18 nt, Chlamydophila pneumoniae J138
uaauaagcaggaaaagca

SEQ ID NO: 537102 - RNA, 15 nt, Chlamydophila pneumoniae J138
uaauaagaaccucua

SEQ ID NO: 537103 - RNA, 22 nt, Chlamydophila pneumoniae J138
uaauaaccugggggacuucaaa

SEQ ID NO: 537104 - RNA, 14 nt, Chlamydophila pneumoniae J138
uaauacaaaaaaua

SEQ ID NO: 537105 - RNA, 13 nt, Chlamydophila pneumoniae J138
uaauacuuaaucc

SEQ ID NO: 537106 - RNA, 14 nt, Chlamydophila pneumoniae J138
uaauaccuuucuaa

SEQ ID NO: 537107 - RNA, 24 nt, Chlamydophila pneumoniae J138
uacaaauuaccuugagacaaagaa

SEQ ID NO: 537108 - RNA, 24 nt, Chlamydophila pneumoniae J138
uacaaauggcaugaaagauaaugu

SEQ ID NO: 537109 - RNA, 16 nt, Chlamydophila pneumoniae J138
uacaauacuggagagg

SEQ ID NO: 537110 - RNA, 23 nt, Chlamydophila pneumoniae J138
uacaauaaccaggggcuuuccuu

SEQ ID NO: 537111 - RNA, 12 nt, Chlamydophila pneumoniae J138
uacaacccuuua

SEQ ID NO: 537112 - RNA, 18 nt, Chlamydophila pneumoniae J138
uacaaucccgaguccuaa

SEQ ID NO: 537113 - RNA, 20 nt, Chlamydophila pneumoniae J138
uacaaucccgaguccuaaaa

SEQ ID NO: 537114 - RNA, 19 nt, Chlamydophila pneumoniae J138
uacagauucaccaagaaca

SEQ ID NO: 537115 - RNA, 13 nt, Chlamydophila pneumoniae J138
uacagauguuuuc

SEQ ID NO: 537116 - RNA, 15 nt, Chlamydophila pneumoniae J138
uacagaucugcauaa

SEQ ID NO: 537117 - RNA, 23 nt, Chlamydophila pneumoniae J138
uacagaucaggauucuaaaaaga

SEQ ID NO: 537118 - RNA, 17 nt, Chlamydophila pneumoniae J138
uacagauaucaaagcau

SEQ ID NO: 537119 - RNA, 22 nt, Chlamydophila pneumoniae J138
uacagagagaaacuuaguuuug

SEQ ID NO: 537120 - RNA, 18 nt, Chlamydophila pneumoniae J138
uacagaccguccucccca

SEQ ID NO: 537121 - RNA, 20 nt, Chlamydophila pneumoniae J138
uacacacacgccaaugggaa

SEQ ID NO: 537122 - RNA, 15 nt, Chlamydophila pneumoniae J138
uacacagcacaagaa

SEQ ID NO: 537123 - RNA, 21 nt, Chlamydophila pneumoniae J138
uacagaaaggaccuccucaca

SEQ ID NO: 537124 - RNA, 23 nt, Chlamydophila pneumoniae J138
uacagaaagagcuaaagaaacuu

SEQ ID NO: 537125 - RNA, 20 nt, Chlamydophila pneumoniae J138
uacagaaaggaccuccucac

SEQ ID NO: 537126 - RNA, 21 nt, Chlamydophila pneumoniae J138
uacagaaagagcuaaagaaac

SEQ ID NO: 537127 - RNA, 14 nt, Chlamydophila pneumoniae J138
uacagaacaauggu

SEQ ID NO: 537128 - RNA, 22 nt, Chlamydophila pneumoniae J138
uacagaaaauaagaagcagcac

SEQ ID NO: 537129 - RNA, 20 nt, Chlamydophila pneumoniae J138
uaccaagacaauggaaauag

SEQ ID NO: 537130 - RNA, 20 nt, Chlamydophila pneumoniae J138
uaccaaggcagguaucuccu

SEQ ID NO: 537131 - RNA, 21 nt, Chlamydophila pneumoniae J138
uaccaaccuucgauuccaggc

SEQ ID NO: 537132 - RNA, 23 nt, Chlamydophila pneumoniae J138
uaccaaagucgauacccaaagag

SEQ ID NO: 537133 - RNA, 19 nt, Chlamydophila pneumoniae J138
uacaucuucuuggcuuucc

SEQ ID NO: 537134 - RNA, 15 nt, Chlamydophila pneumoniae J138
uacaugcucaagaag

SEQ ID NO: 537135 - RNA, 11 nt, Chlamydophila pneumoniae J138
uacauguaaac

SEQ ID NO: 537136 - RNA, 14 nt, Chlamydophila pneumoniae J138
uacaucagacugaa

SEQ ID NO: 537137 - RNA, 21 nt, Chlamydophila pneumoniae J138
uacaucguauccaaauugcaa

SEQ ID NO: 537138 - RNA, 15 nt, Chlamydophila pneumoniae J138
uacaucagacugaag

SEQ ID NO: 537139 - RNA, 16 nt, Chlamydophila pneumoniae J138
uacaucagacugaaga

SEQ ID NO: 537140 - RNA, 14 nt, Chlamydophila pneumoniae J138
uacaggcaaggaga

SEQ ID NO: 537141 - RNA, 16 nt, Chlamydophila pneumoniae J138
uaccgaccgaaucucu

SEQ ID NO: 537142 - RNA, 21 nt, Chlamydophila pneumoniae J138
uaccucaucucuggaauacau

SEQ ID NO: 537143 - RNA, 20 nt, Chlamydophila pneumoniae J138
uaccguuuacaucaauuuua

SEQ ID NO: 537144 - RNA, 14 nt, Chlamydophila pneumoniae J138
uaccguuuccuccu

SEQ ID NO: 537145 - RNA, 15 nt, Chlamydophila pneumoniae J138
uaccugcuaaacuuu

SEQ ID NO: 537146 - RNA, 23 nt, Chlamydophila pneumoniae J138
uaccucuccgucauauuuaaaag

SEQ ID NO: 537147 - RNA, 14 nt, Chlamydophila pneumoniae J138
uaccaauucucucu

SEQ ID NO: 537148 - RNA, 14 nt, Chlamydophila pneumoniae J138
uaccaccuaaaaug

SEQ ID NO: 537149 - RNA, 17 nt, Chlamydophila pneumoniae J138
uacccaucuagaaacau

SEQ ID NO: 537150 - RNA, 16 nt, Chlamydophila pneumoniae J138
uacgcuuuucuucuuu

SEQ ID NO: 537151 - RNA, 13 nt, Chlamydophila pneumoniae J138
uacguggcuucca

SEQ ID NO: 537152 - RNA, 14 nt, Chlamydophila pneumoniae J138
uacgguuucuggga

SEQ ID NO: 537153 - RNA, 18 nt, Chlamydophila pneumoniae J138
uacguaaacuauacucuc

SEQ ID NO: 537154 - RNA, 14 nt, Chlamydophila pneumoniae J138
uacguucuuucuuu

SEQ ID NO: 537155 - RNA, 16 nt, Chlamydophila pneumoniae J138
uacguucuuucuuucu

SEQ ID NO: 537156 - RNA, 19 nt, Chlamydophila pneumoniae J138
uacuaaauuaguaaaugcc

SEQ ID NO: 537157 - RNA, 15 nt, Chlamydophila pneumoniae J138
uacgcaaaguacuaa

SEQ ID NO: 537158 - RNA, 15 nt, Chlamydophila pneumoniae J138
uacgcaaguaaagaa

SEQ ID NO: 537159 - RNA, 19 nt, Chlamydophila pneumoniae J138
uacgccgugccuauagaaa

SEQ ID NO: 537160 - RNA, 19 nt, Chlamydophila pneumoniae J138
uacgaccaacuccucaaaa

SEQ ID NO: 537161 - RNA, 14 nt, Chlamydophila pneumoniae J138
uaccuuaucgccaa

SEQ ID NO: 537162 - RNA, 19 nt, Chlamydophila pneumoniae J138
uaccuuaucgccaacggca

SEQ ID NO: 537163 - RNA, 20 nt, Chlamydophila pneumoniae J138
uaccuuaguuuuuucuaagg

SEQ ID NO: 537164 - RNA, 18 nt, Chlamydophila pneumoniae J138
uacgacgaaguuagcuaa

SEQ ID NO: 537165 - RNA, 18 nt, Chlamydophila pneumoniae J138
uacgagaucagauguaaa

SEQ ID NO: 537166 - RNA, 14 nt, Chlamydophila pneumoniae J138
uacgauguuuucuu

SEQ ID NO: 537167 - RNA, 18 nt, Chlamydophila pneumoniae J138
uaguuucccacuagcccu

SEQ ID NO: 537168 - RNA, 16 nt, Chlamydophila pneumoniae J138
uaguuucacauaguuu

SEQ ID NO: 537169 - RNA, 23 nt, Chlamydophila pneumoniae J138
uaguuucacauaguuuaauaaau

SEQ ID NO: 537170 - RNA, 14 nt, Chlamydophila pneumoniae J138
uaguuuguuuuaau

SEQ ID NO: 537171 - RNA, 18 nt, Chlamydophila pneumoniae J138
uaguuuuuauuuuuaaau

SEQ ID NO: 537172 - RNA, 15 nt, Chlamydophila pneumoniae J138
uaguuuuuacaugua

SEQ ID NO: 537173 - RNA, 15 nt, Chlamydophila pneumoniae J138
uaguuuucuucuuua

SEQ ID NO: 537174 - RNA, 17 nt, Chlamydophila pneumoniae J138
uauaaauaauuacaauu

SEQ ID NO: 537175 - RNA, 19 nt, Chlamydophila pneumoniae J138
uauaaaugcuguagauugu

SEQ ID NO: 537176 - RNA, 23 nt, Chlamydophila pneumoniae J138
uagguaucagcaagaucuaacuu

SEQ ID NO: 537177 - RNA, 18 nt, Chlamydophila pneumoniae J138
uagguagguuguuguuga

SEQ ID NO: 537178 - RNA, 22 nt, Chlamydophila pneumoniae J138
uagguaucucuccacagggucu

SEQ ID NO: 537179 - RNA, 19 nt, Chlamydophila pneumoniae J138
uagguaugagcuccaaaau

SEQ ID NO: 537180 - RNA, 17 nt, Chlamydophila pneumoniae J138
uagguagauagaaauuc

SEQ ID NO: 537181 - RNA, 17 nt, Chlamydophila pneumoniae J138
uagguacgcuuuuucuu

SEQ ID NO: 537182 - RNA, 18 nt, Chlamydophila pneumoniae J138
uagucgucuuuuaaagag

SEQ ID NO: 537183 - RNA, 19 nt, Chlamydophila pneumoniae J138
uagucgucuuuuaaagagc

SEQ ID NO: 537184 - RNA, 18 nt, Chlamydophila pneumoniae J138
uagucuggcauaagucac

SEQ ID NO: 537185 - RNA, 16 nt, Chlamydophila pneumoniae J138
uagucuucuuagaaag

SEQ ID NO: 537186 - RNA, 21 nt, Chlamydophila pneumoniae J138
uagucuucuuagaaagacuag

SEQ ID NO: 537187 - RNA, 21 nt, Chlamydophila pneumoniae J138
uagugaagcugcuucuucaga

SEQ ID NO: 537188 - RNA, 17 nt, Chlamydophila pneumoniae J138
uagugaacacucucuac

SEQ ID NO: 537189 - RNA, 22 nt, Chlamydophila pneumoniae J138
uagugaacacucucuaccauca

SEQ ID NO: 537190 - RNA, 14 nt, Chlamydophila pneumoniae J138
uagucuuucuaaga

SEQ ID NO: 537191 - RNA, 21 nt, Chlamydophila pneumoniae J138
uaguguucgagcaucucaaga

SEQ ID NO: 537192 - RNA, 21 nt, Chlamydophila pneumoniae J138
uagugaaugagcuucacaucu

SEQ ID NO: 537193 - RNA, 22 nt, Chlamydophila pneumoniae J138
uaguguuucuuuaucuaaccaa

SEQ ID NO: 537194 - RNA, 14 nt, Chlamydophila pneumoniae J138
uauagaucuugaaa

SEQ ID NO: 537195 - RNA, 18 nt, Chlamydophila pneumoniae J138
uauagcauuauucccuaa

SEQ ID NO: 537196 - RNA, 14 nt, Chlamydophila pneumoniae J138
uauagcauuauucc

SEQ ID NO: 537197 - RNA, 14 nt, Chlamydophila pneumoniae J138
uauagagaagauuu

SEQ ID NO: 537198 - RNA, 18 nt, Chlamydophila pneumoniae J138
uauacuguuuuucuucca

SEQ ID NO: 537199 - RNA, 19 nt, Chlamydophila pneumoniae J138
uauacuguuuuucuuccac

SEQ ID NO: 537200 - RNA, 15 nt, Chlamydophila pneumoniae J138
uauacuuauaccacc

SEQ ID NO: 537201 - RNA, 14 nt, Chlamydophila pneumoniae J138
uauacuaagacugu

SEQ ID NO: 537202 - RNA, 23 nt, Chlamydophila pneumoniae J138
uauacuaagacugucuaugaucc

SEQ ID NO: 537203 - RNA, 16 nt, Chlamydophila pneumoniae J138
uauacgucccacaaaa

SEQ ID NO: 537204 - RNA, 18 nt, Chlamydophila pneumoniae J138
uauaauugacguagacga

SEQ ID NO: 537205 - RNA, 16 nt, Chlamydophila pneumoniae J138
uauacaagcgaaagca

SEQ ID NO: 537206 - RNA, 19 nt, Chlamydophila pneumoniae J138
uauacaaccacuuccugca

SEQ ID NO: 537207 - RNA, 21 nt, Chlamydophila pneumoniae J138
uauacaguuggcguuuucuag

SEQ ID NO: 537208 - RNA, 17 nt, Chlamydophila pneumoniae J138
uauacagaaaagaaugu

SEQ ID NO: 537209 - RNA, 21 nt, Chlamydophila pneumoniae J138
uauaaauucaagacuauagaa

SEQ ID NO: 537210 - RNA, 22 nt, Chlamydophila pneumoniae J138
uaucagggagcggaauuucuca

SEQ ID NO: 537211 - RNA, 16 nt, Chlamydophila pneumoniae J138
uauauuggcuuucuac

SEQ ID NO: 537212 - RNA, 11 nt, Chlamydophila pneumoniae J138
uaucaauaaug

SEQ ID NO: 537213 - RNA, 22 nt, Chlamydophila pneumoniae J138
uauaggaauaacaccaaaagaa

SEQ ID NO: 537214 - RNA, 17 nt, Chlamydophila pneumoniae J138
uauaggcugcacacauc

SEQ ID NO: 537215 - RNA, 20 nt, Chlamydophila pneumoniae J138
uauagguuaagccaaucccu

SEQ ID NO: 537216 - RNA, 19 nt, Chlamydophila pneumoniae J138
uauaucgcguguaaaagcu

SEQ ID NO: 537217 - RNA, 16 nt, Chlamydophila pneumoniae J138
uaucgaccuuaaaauu

SEQ ID NO: 537218 - RNA, 19 nt, Chlamydophila pneumoniae J138
uauccuugauuuuaaaaug

SEQ ID NO: 537219 - RNA, 22 nt, Chlamydophila pneumoniae J138
uauccuugaaauugcucuugcu

SEQ ID NO: 537220 - RNA, 18 nt, Chlamydophila pneumoniae J138
uauccuugaaauugcucu

SEQ ID NO: 537221 - RNA, 17 nt, Chlamydophila pneumoniae J138
uauccuguuucaacaua

SEQ ID NO: 537222 - RNA, 14 nt, Chlamydophila pneumoniae J138
uauccuuccuuauu

SEQ ID NO: 537223 - RNA, 21 nt, Chlamydophila pneumoniae J138
uauccgacucuguuuccuugu

SEQ ID NO: 537224 - RNA, 22 nt, Chlamydophila pneumoniae J138
uaucaucaaugguuaaaaccca

SEQ ID NO: 537225 - RNA, 21 nt, Chlamydophila pneumoniae J138
uaucaucaaaagauaugucuu

SEQ ID NO: 537226 - RNA, 16 nt, Chlamydophila pneumoniae J138
uaucauggacaagcaa

SEQ ID NO: 537227 - RNA, 23 nt, Chlamydophila pneumoniae J138
uauccagcucaaggcaucuagag

SEQ ID NO: 537228 - RNA, 18 nt, Chlamydophila pneumoniae J138
uauccaggguagcgcuuu

SEQ ID NO: 537229 - RNA, 15 nt, Chlamydophila pneumoniae J138
uaucuaaagaaaugu

SEQ ID NO: 537230 - RNA, 19 nt, Chlamydophila pneumoniae J138
uaucuagggacuucucaaa

SEQ ID NO: 537231 - RNA, 13 nt, Chlamydophila pneumoniae J138
uaucuacgagcau

SEQ ID NO: 537232 - RNA, 13 nt, Chlamydophila pneumoniae J138
uaucuaauaaaau

SEQ ID NO: 537233 - RNA, 17 nt, Chlamydophila pneumoniae J138
uaucuacacaguagccu

SEQ ID NO: 537234 - RNA, 23 nt, Chlamydophila pneumoniae J138
uaucuacacaguagccuucuucu

SEQ ID NO: 537235 - RNA, 14 nt, Chlamydophila pneumoniae J138
uaucucuguuuuuu

SEQ ID NO: 537236 - RNA, 20 nt, Chlamydophila pneumoniae J138
uaucuauccuuaggugaaau

SEQ ID NO: 537237 - RNA, 18 nt, Chlamydophila pneumoniae J138
uaucucuaccgaacagag

SEQ ID NO: 537238 - RNA, 18 nt, Chlamydophila pneumoniae J138
uaucucuacgaugaacua

SEQ ID NO: 537239 - RNA, 19 nt, Chlamydophila pneumoniae J138
uaucuguauccuuccuuau

SEQ ID NO: 537240 - RNA, 20 nt, Chlamydophila pneumoniae J138
uaucuguggcguaagcaaua

SEQ ID NO: 537241 - RNA, 19 nt, Chlamydophila pneumoniae J138
uaucuguuaaaaacaagau

SEQ ID NO: 537242 - RNA, 12 nt, Chlamydophila pneumoniae J138
uagccauagugu

SEQ ID NO: 537243 - RNA, 14 nt, Chlamydophila pneumoniae J138
uagcgaaagucaaa

SEQ ID NO: 537244 - RNA, 14 nt, Chlamydophila pneumoniae J138
uagccuuucuuuuu

SEQ ID NO: 537245 - RNA, 23 nt, Chlamydophila pneumoniae J138
uagccuuacggccccuggaauuu

SEQ ID NO: 537246 - RNA, 18 nt, Chlamydophila pneumoniae J138
uagcauagagcucuaaaa

SEQ ID NO: 537247 - RNA, 14 nt, Chlamydophila pneumoniae J138
uagcauacaucgua

SEQ ID NO: 537248 - RNA, 13 nt, Chlamydophila pneumoniae J138
uagccaaagacuc

SEQ ID NO: 537249 - RNA, 19 nt, Chlamydophila pneumoniae J138
uagccaauauagaagcugc

SEQ ID NO: 537250 - RNA, 23 nt, Chlamydophila pneumoniae J138
uagccaauauagaagcugcugcu

SEQ ID NO: 537251 - RNA, 21 nt, Chlamydophila pneumoniae J138
uagauccccuucauucuuucg

SEQ ID NO: 537252 - RNA, 18 nt, Chlamydophila pneumoniae J138
uagaucauaaacagcagu

SEQ ID NO: 537253 - RNA, 19 nt, Chlamydophila pneumoniae J138
uagauccuauaguaauuuc

SEQ ID NO: 537254 - RNA, 17 nt, Chlamydophila pneumoniae J138
uagcaagcgcuagugca

SEQ ID NO: 537255 - RNA, 20 nt, Chlamydophila pneumoniae J138
uagcaaugccuacaguagcu

SEQ ID NO: 537256 - RNA, 16 nt, Chlamydophila pneumoniae J138
uagcuuuuuuuaugau

SEQ ID NO: 537257 - RNA, 14 nt, Chlamydophila pneumoniae J138
uaggaacaaagcca

SEQ ID NO: 537258 - RNA, 15 nt, Chlamydophila pneumoniae J138
uagcuuuagaagccc

SEQ ID NO: 537259 - RNA, 12 nt, Chlamydophila pneumoniae J138
uagcugcucuuu

SEQ ID NO: 537260 - RNA, 19 nt, Chlamydophila pneumoniae J138
uagcucguuauauuuuucu

SEQ ID NO: 537261 - RNA, 22 nt, Chlamydophila pneumoniae J138
uagcucuugcgaacuauccuaa

SEQ ID NO: 537262 - RNA, 13 nt, Chlamydophila pneumoniae J138
uagcuaagagcau

SEQ ID NO: 537263 - RNA, 20 nt, Chlamydophila pneumoniae J138
uagcucauuaucaagaaauu

SEQ ID NO: 537264 - RNA, 19 nt, Chlamydophila pneumoniae J138
uagcucaggugguuagagc

SEQ ID NO: 537265 - RNA, 22 nt, Chlamydophila pneumoniae J138
uagcucagcucuaauucuucua

SEQ ID NO: 537266 - RNA, 18 nt, Chlamydophila pneumoniae J138
uagcucauuaucaagaaa

SEQ ID NO: 537267 - RNA, 19 nt, Chlamydophila pneumoniae J138
uagcgacgacgacgccuag

SEQ ID NO: 537268 - RNA, 17 nt, Chlamydophila pneumoniae J138
uagcgacaugagaaauc

SEQ ID NO: 537269 - RNA, 23 nt, Chlamydophila pneumoniae J138
uagcgaucucucuuccugcugcu

SEQ ID NO: 537270 - RNA, 18 nt, Chlamydophila pneumoniae J138
uaggaaugauaaugcagg

SEQ ID NO: 537271 - RNA, 16 nt, Chlamydophila pneumoniae J138
uaggaaucuuuuagag

SEQ ID NO: 537272 - RNA, 13 nt, Chlamydophila pneumoniae J138
uaggaaucuuuua

SEQ ID NO: 537273 - RNA, 16 nt, Chlamydophila pneumoniae J138
uaggaacaugccaaau

SEQ ID NO: 537274 - RNA, 17 nt, Chlamydophila pneumoniae J138
uaggaagcuuaucaaga

SEQ ID NO: 537275 - RNA, 17 nt, Chlamydophila pneumoniae J138
uaggaaggucagaguau

SEQ ID NO: 537276 - RNA, 14 nt, Chlamydophila pneumoniae J138
uaggauccaggagu

SEQ ID NO: 537277 - RNA, 13 nt, Chlamydophila pneumoniae J138
uaggaucucucuu

SEQ ID NO: 537278 - RNA, 12 nt, Chlamydophila pneumoniae J138
uaggaucccuga

SEQ ID NO: 537279 - RNA, 17 nt, Chlamydophila pneumoniae J138
uaggccgggauuuuaau

SEQ ID NO: 537280 - RNA, 15 nt, Chlamydophila pneumoniae J138
uagggaauuucggac

SEQ ID NO: 537281 - RNA, 21 nt, Chlamydophila pneumoniae J138
uagggaauuuuuucuguuccu

SEQ ID NO: 537282 - RNA, 22 nt, Chlamydophila pneumoniae J138
uagggaaagcaucuuucaucaa

SEQ ID NO: 537283 - RNA, 19 nt, Chlamydophila pneumoniae J138
uagggaacaaaaaagccaa

SEQ ID NO: 537284 - RNA, 18 nt, Chlamydophila pneumoniae J138
uagggacuucucaaagac

SEQ ID NO: 537285 - RNA, 19 nt, Chlamydophila pneumoniae J138
uaggcgaugcaaauuccag

SEQ ID NO: 537286 - RNA, 23 nt, Chlamydophila pneumoniae J138
uagggagugaggaaucauaacca

SEQ ID NO: 537287 - RNA, 16 nt, Chlamydophila pneumoniae J138
uaggguaaagaaauau

SEQ ID NO: 537288 - RNA, 16 nt, Chlamydophila pneumoniae J138
uaggguagccauccac

SEQ ID NO: 537289 - RNA, 18 nt, Chlamydophila pneumoniae J138
uaggguuugcaugccuau

SEQ ID NO: 537290 - RNA, 21 nt, Chlamydophila pneumoniae J138
uagacuuguauucuugagagu

SEQ ID NO: 537291 - RNA, 23 nt, Chlamydophila pneumoniae J138
uagagaaagagugccaagagcau

SEQ ID NO: 537292 - RNA, 12 nt, Chlamydophila pneumoniae J138
uagagaaauuuu

SEQ ID NO: 537293 - RNA, 14 nt, Chlamydophila pneumoniae J138
uagagaaacuuuug

SEQ ID NO: 537294 - RNA, 22 nt, Chlamydophila pneumoniae J138
uagagaaauuuuuaauuuuucu

SEQ ID NO: 537295 - RNA, 16 nt, Chlamydophila pneumoniae J138
uagagaagauuucuau

SEQ ID NO: 537296 - RNA, 15 nt, Chlamydophila pneumoniae J138
uagagaagaagcaaa

SEQ ID NO: 537297 - RNA, 13 nt, Chlamydophila pneumoniae J138
uagagacaucgua

SEQ ID NO: 537298 - RNA, 16 nt, Chlamydophila pneumoniae J138
uagagacagccuguuu

SEQ ID NO: 537299 - RNA, 18 nt, Chlamydophila pneumoniae J138
uagacucucacugagugu

SEQ ID NO: 537300 - RNA, 17 nt, Chlamydophila pneumoniae J138
uagacgucguccuacag

SEQ ID NO: 537301 - RNA, 22 nt, Chlamydophila pneumoniae J138
uagaccggaucccguaaaagaa

SEQ ID NO: 537302 - RNA, 22 nt, Chlamydophila pneumoniae J138
uagacacuugcuuaaggaaaca

SEQ ID NO: 537303 - RNA, 23 nt, Chlamydophila pneumoniae J138
uagacacgaccacuacuuaaagc

SEQ ID NO: 537304 - RNA, 21 nt, Chlamydophila pneumoniae J138
uagacaauaccagauaaagca

SEQ ID NO: 537305 - RNA, 17 nt, Chlamydophila pneumoniae J138
uagacaugcgaagggag

SEQ ID NO: 537306 - RNA, 19 nt, Chlamydophila pneumoniae J138
uagaguccacagucauaaa

SEQ ID NO: 537307 - RNA, 20 nt, Chlamydophila pneumoniae J138
uagaguccaagguucuggga

SEQ ID NO: 537308 - RNA, 14 nt, Chlamydophila pneumoniae J138
uagagucugcagca

SEQ ID NO: 537309 - RNA, 21 nt, Chlamydophila pneumoniae J138
uagagucuucgacaaggaagc

SEQ ID NO: 537310 - RNA, 22 nt, Chlamydophila pneumoniae J138
uagagucuucgacaaggaagcc

SEQ ID NO: 537311 - RNA, 16 nt, Chlamydophila pneumoniae J138
uagagugacucaucag

SEQ ID NO: 537312 - RNA, 16 nt, Chlamydophila pneumoniae J138
uagaguucauuuuagu

SEQ ID NO: 537313 - RNA, 19 nt, Chlamydophila pneumoniae J138
uagagauuuuucuaggaau

SEQ ID NO: 537314 - RNA, 13 nt, Chlamydophila pneumoniae J138
uagagauuuuucu

SEQ ID NO: 537315 - RNA, 23 nt, Chlamydophila pneumoniae J138
uagagcaagauucuucagaaucu

SEQ ID NO: 537316 - RNA, 19 nt, Chlamydophila pneumoniae J138
uagagcaagauucuucaga

SEQ ID NO: 537317 - RNA, 22 nt, Chlamydophila pneumoniae J138
uagagcaucauaaagugcgagg

SEQ ID NO: 537318 - RNA, 15 nt, Chlamydophila pneumoniae J138
uagagagaaacaucg

SEQ ID NO: 537319 - RNA, 17 nt, Chlamydophila pneumoniae J138
uagagagcgcagagucu

SEQ ID NO: 537320 - RNA, 15 nt, Chlamydophila pneumoniae J138
uagagagccuuuccu

SEQ ID NO: 537321 - RNA, 13 nt, Chlamydophila pneumoniae J138
uagagagaaugcc

SEQ ID NO: 537322 - RNA, 20 nt, Chlamydophila pneumoniae J138
uagagauuaccgaagagccc

SEQ ID NO: 537323 - RNA, 18 nt, Chlamydophila pneumoniae J138
uagagauucuacaaauua

SEQ ID NO: 537324 - RNA, 20 nt, Chlamydophila pneumoniae J138
uagagaucuuuuuauuaaaa

SEQ ID NO: 537325 - RNA, 19 nt, Chlamydophila pneumoniae J138
uagagcuucaaguuucuuu

SEQ ID NO: 537326 - RNA, 17 nt, Chlamydophila pneumoniae J138
uagaggguccagggucu

SEQ ID NO: 537327 - RNA, 12 nt, Chlamydophila pneumoniae J138
uagagcuagaau

SEQ ID NO: 537328 - RNA, 21 nt, Chlamydophila pneumoniae J138
uagagcgcccgaaucuuucaa

SEQ ID NO: 537329 - RNA, 17 nt, Chlamydophila pneumoniae J138
uagagcgaauguagcca

SEQ ID NO: 537330 - RNA, 17 nt, Chlamydophila pneumoniae J138
uagagccucuaagaaaa

SEQ ID NO: 537331 - RNA, 14 nt, Chlamydophila pneumoniae J138
uagagccuugcagc

SEQ ID NO: 537332 - RNA, 20 nt, Chlamydophila pneumoniae J138
uagaaacaacugaaaaacca

SEQ ID NO: 537333 - RNA, 18 nt, Chlamydophila pneumoniae J138
uagaaacaacugaaaaac

SEQ ID NO: 537334 - RNA, 22 nt, Chlamydophila pneumoniae J138
uagaaauauacucuugcuugcu

SEQ ID NO: 537335 - RNA, 15 nt, Chlamydophila pneumoniae J138
uagaaauauacucuu

SEQ ID NO: 537336 - RNA, 16 nt, Chlamydophila pneumoniae J138
uagaaauauacucuug

SEQ ID NO: 537337 - RNA, 21 nt, Chlamydophila pneumoniae J138
uagaaauauacucuugcuugc

SEQ ID NO: 537338 - RNA, 16 nt, Chlamydophila pneumoniae J138
uagaaagacaaaaaau

SEQ ID NO: 537339 - RNA, 20 nt, Chlamydophila pneumoniae J138
uagaaagacauccuucuuua

SEQ ID NO: 537340 - RNA, 13 nt, Chlamydophila pneumoniae J138
uagaaagacaaaa

SEQ ID NO: 537341 - RNA, 19 nt, Chlamydophila pneumoniae J138
uagaaaugaaacgaaagca

SEQ ID NO: 537342 - RNA, 20 nt, Chlamydophila pneumoniae J138
uagaacaggauugauaaaua

SEQ ID NO: 537343 - RNA, 18 nt, Chlamydophila pneumoniae J138
uagaauccuucucccucu

SEQ ID NO: 537344 - RNA, 16 nt, Chlamydophila pneumoniae J138
uagaauccaaagacuu

SEQ ID NO: 537345 - RNA, 23 nt, Chlamydophila pneumoniae J138
uagaaucagagggacuccuguga

SEQ ID NO: 537346 - RNA, 12 nt, Chlamydophila pneumoniae J138
uagaaucaccaa

SEQ ID NO: 537347 - RNA, 16 nt, Chlamydophila pneumoniae J138
uagaaucaccaauuuu

SEQ ID NO: 537348 - RNA, 15 nt, Chlamydophila pneumoniae J138
uagaaucacauaaaa

SEQ ID NO: 537349 - RNA, 12 nt, Chlamydophila pneumoniae J138
uagaauuuucuu

SEQ ID NO: 537350 - RNA, 14 nt, Chlamydophila pneumoniae J138
uagaauaaagauuu

SEQ ID NO: 537351 - RNA, 23 nt, Chlamydophila pneumoniae J138
uagaagcauucucaauucuguau

SEQ ID NO: 537352 - RNA, 21 nt, Chlamydophila pneumoniae J138
uagaagcaugaagcagaaacu

SEQ ID NO: 537353 - RNA, 12 nt, Chlamydophila pneumoniae J138
uagaagcugcug

SEQ ID NO: 537354 - RNA, 15 nt, Chlamydophila pneumoniae J138
uagaagcugcugcua

SEQ ID NO: 537355 - RNA, 21 nt, Chlamydophila pneumoniae J138
uagaagguguuuuggcugcuu

SEQ ID NO: 537356 - RNA, 23 nt, Chlamydophila pneumoniae J138
uagaacugcgaaggguuguugcc

SEQ ID NO: 537357 - RNA, 15 nt, Chlamydophila pneumoniae J138
uagaacacucagaga

SEQ ID NO: 537358 - RNA, 17 nt, Chlamydophila pneumoniae J138
gcauagcccgaaauuca

SEQ ID NO: 537359 - RNA, 22 nt, Chlamydophila pneumoniae J138
gcauagcccgaaauucauuaaa

SEQ ID NO: 537360 - RNA, 16 nt, Chlamydophila pneumoniae J138
gcauaggcuaagacua

SEQ ID NO: 537361 - RNA, 21 nt, Chlamydophila pneumoniae J138
gcauagcaacuacagagggcu

SEQ ID NO: 537362 - RNA, 17 nt, Chlamydophila pneumoniae J138
gcauagauacaaacauc

SEQ ID NO: 537363 - RNA, 18 nt, Chlamydophila pneumoniae J138
gcauacccuucuucuuca

SEQ ID NO: 537364 - RNA, 21 nt, Chlamydophila pneumoniae J138
gccacuaaguuuaggcaggaa

SEQ ID NO: 537365 - RNA, 12 nt, Chlamydophila pneumoniae J138
gccagcagaagg

SEQ ID NO: 537366 - RNA, 20 nt, Chlamydophila pneumoniae J138
gccagcagaaguuccuucag

SEQ ID NO: 537367 - RNA, 21 nt, Chlamydophila pneumoniae J138
gccaguucuugaaacucuauc

SEQ ID NO: 537368 - RNA, 15 nt, Chlamydophila pneumoniae J138
gccaguucuugaaac

SEQ ID NO: 537369 - RNA, 22 nt, Chlamydophila pneumoniae J138
gccaguuacugucugcaaagag

SEQ ID NO: 537370 - RNA, 21 nt, Chlamydophila pneumoniae J138
gcccucauccccucagaaagg

SEQ ID NO: 537371 - RNA, 23 nt, Chlamydophila pneumoniae J138
gcccucgguuauuuuuccagaaa

SEQ ID NO: 537372 - RNA, 12 nt, Chlamydophila pneumoniae J138
gcccucuucacu

SEQ ID NO: 537373 - RNA, 24 nt, Chlamydophila pneumoniae J138
gcccgacucaucuaacgucagcug

SEQ ID NO: 537374 - RNA, 18 nt, Chlamydophila pneumoniae J138
gccccuggaauuucucca

SEQ ID NO: 537375 - RNA, 18 nt, Chlamydophila pneumoniae J138
gcccagauucugaagaga

SEQ ID NO: 537376 - RNA, 16 nt, Chlamydophila pneumoniae J138
gcccagauucugaaga

SEQ ID NO: 537377 - RNA, 16 nt, Chlamydophila pneumoniae J138
gcccccucccccacca

SEQ ID NO: 537378 - RNA, 21 nt, Chlamydophila pneumoniae J138
gccccaugaaucacagcgcug

SEQ ID NO: 537379 - RNA, 14 nt, Chlamydophila pneumoniae J138
gccgcauuucuuca

SEQ ID NO: 537380 - RNA, 13 nt, Chlamydophila pneumoniae J138
gccuaccaaaguu

SEQ ID NO: 537381 - RNA, 23 nt, Chlamydophila pneumoniae J138
gccuaugggaggaauuccucuca

SEQ ID NO: 537382 - RNA, 18 nt, Chlamydophila pneumoniae J138
gccuauagaaauuagagu

SEQ ID NO: 537383 - RNA, 14 nt, Chlamydophila pneumoniae J138
gccuagcuuucuug

SEQ ID NO: 537384 - RNA, 21 nt, Chlamydophila pneumoniae J138
gccgugccuauagaaauuaga

SEQ ID NO: 537385 - RNA, 12 nt, Chlamydophila pneumoniae J138
gccucauugccg

SEQ ID NO: 537386 - RNA, 15 nt, Chlamydophila pneumoniae J138
gccucccgaagacaa

SEQ ID NO: 537387 - RNA, 16 nt, Chlamydophila pneumoniae J138
gccucgagcagaaacu

SEQ ID NO: 537388 - RNA, 18 nt, Chlamydophila pneumoniae J138
gccugagaccauaaaauc

SEQ ID NO: 537389 - RNA, 22 nt, Chlamydophila pneumoniae J138
gccugacgauaguacuuauccu

SEQ ID NO: 537390 - RNA, 13 nt, Chlamydophila pneumoniae J138
gccucuccuugag

SEQ ID NO: 537391 - RNA, 13 nt, Chlamydophila pneumoniae J138
gccugaaauccug

SEQ ID NO: 537392 - RNA, 23 nt, Chlamydophila pneumoniae J138
gccugaaaacaaggcaaaaaguu

SEQ ID NO: 537393 - RNA, 17 nt, Chlamydophila pneumoniae J138
gccuggaaagcuucugg

SEQ ID NO: 537394 - RNA, 20 nt, Chlamydophila pneumoniae J138
gccuguaauugauguuccuu

SEQ ID NO: 537395 - RNA, 15 nt, Chlamydophila pneumoniae J138
gccugugauaguaga

SEQ ID NO: 537396 - RNA, 15 nt, Chlamydophila pneumoniae J138
gccuggcuaaaggau

SEQ ID NO: 537397 - RNA, 23 nt, Chlamydophila pneumoniae J138
gccuggggaucuuaggaaauuug

SEQ ID NO: 537398 - RNA, 20 nt, Chlamydophila pneumoniae J138
gccuuccuuaacaacaucac

SEQ ID NO: 537399 - RNA, 17 nt, Chlamydophila pneumoniae J138
gccuuccuguuaaggga

SEQ ID NO: 537400 - RNA, 17 nt, Chlamydophila pneumoniae J138
gccuuccauaucuagaa

SEQ ID NO: 537401 - RNA, 19 nt, Chlamydophila pneumoniae J138
gccuuggguuugucuccaa

SEQ ID NO: 537402 - RNA, 13 nt, Chlamydophila pneumoniae J138
gccuugcugcaua

SEQ ID NO: 537403 - RNA, 17 nt, Chlamydophila pneumoniae J138
gccuugauugaacaguc

SEQ ID NO: 537404 - RNA, 20 nt, Chlamydophila pneumoniae J138
gccuugauccuuuccaagaa

SEQ ID NO: 537405 - RNA, 12 nt, Chlamydophila pneumoniae J138
gccuuuucagau

SEQ ID NO: 537406 - RNA, 18 nt, Chlamydophila pneumoniae J138
gccuuuagggaaaaagua

SEQ ID NO: 537407 - RNA, 13 nt, Chlamydophila pneumoniae J138
gccuuuauauaaa

SEQ ID NO: 537408 - RNA, 13 nt, Chlamydophila pneumoniae J138
gccuuuagggaaa

SEQ ID NO: 537409 - RNA, 16 nt, Chlamydophila pneumoniae J138
gcgaaagucaaagggc

SEQ ID NO: 537410 - RNA, 11 nt, Chlamydophila pneumoniae J138
gccuuuuucuu

SEQ ID NO: 537411 - RNA, 14 nt, Chlamydophila pneumoniae J138
gccuuuuucuugau

SEQ ID NO: 537412 - RNA, 22 nt, Chlamydophila pneumoniae J138
gccuuuuucuugauuagagaau

SEQ ID NO: 537413 - RNA, 13 nt, Chlamydophila pneumoniae J138
gccuuuuuuucua

SEQ ID NO: 537414 - RNA, 15 nt, Chlamydophila pneumoniae J138
gcgaccuaggagaaa

SEQ ID NO: 537415 - RNA, 16 nt, Chlamydophila pneumoniae J138
gcgaagggaggagaac

SEQ ID NO: 537416 - RNA, 15 nt, Chlamydophila pneumoniae J138
gcgaagggaggagaa

SEQ ID NO: 537417 - RNA, 18 nt, Chlamydophila pneumoniae J138
gcgagaggggaaccaagg

SEQ ID NO: 537418 - RNA, 16 nt, Chlamydophila pneumoniae J138
gcgauaguaaacagaa

SEQ ID NO: 537419 - RNA, 15 nt, Chlamydophila pneumoniae J138
gcgauaguaaacaga

SEQ ID NO: 537420 - RNA, 11 nt, Chlamydophila pneumoniae J138
gcgcagcuucu

SEQ ID NO: 537421 - RNA, 21 nt, Chlamydophila pneumoniae J138
gcgcagcuucuggagaaaaaa

SEQ ID NO: 537422 - RNA, 22 nt, Chlamydophila pneumoniae J138
gcgcaaaucuuacauaaaccuu

SEQ ID NO: 537423 - RNA, 11 nt, Chlamydophila pneumoniae J138
gcgcaaagaac

SEQ ID NO: 537424 - RNA, 17 nt, Chlamydophila pneumoniae J138
gcgccgcauuacaggga

SEQ ID NO: 537425 - RNA, 21 nt, Chlamydophila pneumoniae J138
gcgcuaccuuaguuuuuucua

SEQ ID NO: 537426 - RNA, 14 nt, Chlamydophila pneumoniae J138
gcgcuagcuccagc

SEQ ID NO: 537427 - RNA, 14 nt, Chlamydophila pneumoniae J138
gcgcuaucaucauu

SEQ ID NO: 537428 - RNA, 18 nt, Chlamydophila pneumoniae J138
gcgcucuaagagcccuug

SEQ ID NO: 537429 - RNA, 14 nt, Chlamydophila pneumoniae J138
gcgcucuacaaaug

SEQ ID NO: 537430 - RNA, 21 nt, Chlamydophila pneumoniae J138
gcggcauggacaauauagaaa

SEQ ID NO: 537431 - RNA, 15 nt, Chlamydophila pneumoniae J138
gcgcugugaggaaaa

SEQ ID NO: 537432 - RNA, 14 nt, Chlamydophila pneumoniae J138
gcguacguuuucuc

SEQ ID NO: 537433 - RNA, 23 nt, Chlamydophila pneumoniae J138
gcgguggaaaaggaggaggagca

SEQ ID NO: 537434 - RNA, 18 nt, Chlamydophila pneumoniae J138
gcguucuugaaucuucaa

SEQ ID NO: 537435 - RNA, 17 nt, Chlamydophila pneumoniae J138
gcgucugcccuuucugc

SEQ ID NO: 537436 - RNA, 14 nt, Chlamydophila pneumoniae J138
gcuaccuagggucu

SEQ ID NO: 537437 - RNA, 21 nt, Chlamydophila pneumoniae J138
gcuacgacuacaucuuguucu

SEQ ID NO: 537438 - RNA, 16 nt, Chlamydophila pneumoniae J138
gcuacaaacucuucca

SEQ ID NO: 537439 - RNA, 17 nt, Chlamydophila pneumoniae J138
gcuacaaaauuauuaaa

SEQ ID NO: 537440 - RNA, 16 nt, Chlamydophila pneumoniae J138
gcuacaaaauuauuaa

SEQ ID NO: 537441 - RNA, 19 nt, Chlamydophila pneumoniae J138
gcuacaaggucuuuuccug

SEQ ID NO: 537442 - RNA, 17 nt, Chlamydophila pneumoniae J138
gcuacaaggucuuuucc

SEQ ID NO: 537443 - RNA, 15 nt, Chlamydophila pneumoniae J138
gcuacauaguuuuua

SEQ ID NO: 537444 - RNA, 21 nt, Chlamydophila pneumoniae J138
gcuacauaguuuuuauuuuua

SEQ ID NO: 537445 - RNA, 17 nt, Chlamydophila pneumoniae J138
gcuacagauucuuguau

SEQ ID NO: 537446 - RNA, 17 nt, Chlamydophila pneumoniae J138
gcuacagcuucuuuucc

SEQ ID NO: 537447 - RNA, 22 nt, Chlamydophila pneumoniae J138
gcuaccauuaaggaaucccaag

SEQ ID NO: 537448 - RNA, 15 nt, Chlamydophila pneumoniae J138
gcuaaauuugucauc

SEQ ID NO: 537449 - RNA, 24 nt, Chlamydophila pneumoniae J138
gcuaaagugaugccuggacugcug

SEQ ID NO: 537450 - RNA, 17 nt, Chlamydophila pneumoniae J138
gcuaaaguagaauccuu

SEQ ID NO: 537451 - RNA, 19 nt, Chlamydophila pneumoniae J138
gcuaaaguagaauccuucu

SEQ ID NO: 537452 - RNA, 22 nt, Chlamydophila pneumoniae J138
gcuaaaguagaauccuucuccc

SEQ ID NO: 537453 - RNA, 18 nt, Chlamydophila pneumoniae J138
gcuaaaggaucauuaaag

SEQ ID NO: 537454 - RNA, 22 nt, Chlamydophila pneumoniae J138
gcuaaagcaggagcaucauuaa

SEQ ID NO: 537455 - RNA, 21 nt, Chlamydophila pneumoniae J138
gcuaacgcagcuuuagcuuuu

SEQ ID NO: 537456 - RNA, 15 nt, Chlamydophila pneumoniae J138
gcuaacgaagccuca

SEQ ID NO: 537457 - RNA, 15 nt, Chlamydophila pneumoniae J138
gcuaaggauucccgg

SEQ ID NO: 537458 - RNA, 16 nt, Chlamydophila pneumoniae J138
gcuaagaucuuuagaa

SEQ ID NO: 537459 - RNA, 23 nt, Chlamydophila pneumoniae J138
gcuaauacaucaccacugcucca

SEQ ID NO: 537460 - RNA, 21 nt, Chlamydophila pneumoniae J138
gcuaauaauuccugagguugg

SEQ ID NO: 537461 - RNA, 17 nt, Chlamydophila pneumoniae J138
gcuaaucaauccaagaa

SEQ ID NO: 537462 - RNA, 18 nt, Chlamydophila pneumoniae J138
gcuaaucaauccaagaau

SEQ ID NO: 537463 - RNA, 14 nt, Chlamydophila pneumoniae J138
gcuaaucauuagag

SEQ ID NO: 537464 - RNA, 19 nt, Chlamydophila pneumoniae J138
gcuaaucauagccaucaua

SEQ ID NO: 537465 - RNA, 14 nt, Chlamydophila pneumoniae J138
gcuagucuucuuag

SEQ ID NO: 537466 - RNA, 17 nt, Chlamydophila pneumoniae J138
gcuacuucuucuuuucg

SEQ ID NO: 537467 - RNA, 14 nt, Chlamydophila pneumoniae J138
gcuacuuuaagacc

SEQ ID NO: 537468 - RNA, 12 nt, Chlamydophila pneumoniae J138
gcuagguagugu

SEQ ID NO: 537469 - RNA, 15 nt, Chlamydophila pneumoniae J138
gcucacucuuuaaaa

SEQ ID NO: 537470 - RNA, 21 nt, Chlamydophila pneumoniae J138
gcuccaaaaugggauccugca

SEQ ID NO: 537471 - RNA, 19 nt, Chlamydophila pneumoniae J138
gcuccaaugggcagguuuc

SEQ ID NO: 537472 - RNA, 17 nt, Chlamydophila pneumoniae J138
gcucaguguauuguuug

SEQ ID NO: 537473 - RNA, 22 nt, Chlamydophila pneumoniae J138
gcucccuccuccucgucuaaag

SEQ ID NO: 537474 - RNA, 23 nt, Chlamydophila pneumoniae J138
gcuccgacccgaccuaccugcua

SEQ ID NO: 537475 - RNA, 13 nt, Chlamydophila pneumoniae J138
gcuccuaaagcau

SEQ ID NO: 537476 - RNA, 12 nt, Chlamydophila pneumoniae J138
gcuccugcaaaa

SEQ ID NO: 537477 - RNA, 17 nt, Chlamydophila pneumoniae J138
gcuccuacaguccuggg

SEQ ID NO: 537478 - RNA, 17 nt, Chlamydophila pneumoniae J138
gcaacauccauucuuaa

SEQ ID NO: 537479 - RNA, 15 nt, Chlamydophila pneumoniae J138
gcaacaaucuuucuu

SEQ ID NO: 537480 - RNA, 16 nt, Chlamydophila pneumoniae J138
gcaacaaucuuucuuc

SEQ ID NO: 537481 - RNA, 18 nt, Chlamydophila pneumoniae J138
gcaacaaucuuucuucua

SEQ ID NO: 537482 - RNA, 19 nt, Chlamydophila pneumoniae J138
gcaacaacgccuacaugga

SEQ ID NO: 537483 - RNA, 12 nt, Chlamydophila pneumoniae J138
gcaacaaccaaa

SEQ ID NO: 537484 - RNA, 17 nt, Chlamydophila pneumoniae J138
gcaaaagcaaggcugcc

SEQ ID NO: 537485 - RNA, 16 nt, Chlamydophila pneumoniae J138
gcaacgcgauuuucaa

SEQ ID NO: 537486 - RNA, 19 nt, Chlamydophila pneumoniae J138
gcaaccucugcauguugca

SEQ ID NO: 537487 - RNA, 21 nt, Chlamydophila pneumoniae J138
gcaaccuguaaagaccaaaua

SEQ ID NO: 537488 - RNA, 21 nt, Chlamydophila pneumoniae J138
gcaacucuuuaggucuugucu

SEQ ID NO: 537489 - RNA, 13 nt, Chlamydophila pneumoniae J138
gcaacucuucagc

SEQ ID NO: 537490 - RNA, 18 nt, Chlamydophila pneumoniae J138
gcaacucuuuaggucuug

SEQ ID NO: 537491 - RNA, 14 nt, Chlamydophila pneumoniae J138
gcaaggcaaugaua

SEQ ID NO: 537492 - RNA, 14 nt, Chlamydophila pneumoniae J138
gcaaggagcucccu

SEQ ID NO: 537493 - RNA, 19 nt, Chlamydophila pneumoniae J138
gcaagcuguggcgauuuua

SEQ ID NO: 537494 - RNA, 18 nt, Chlamydophila pneumoniae J138
gcaagcucgcguauuuuc

SEQ ID NO: 537495 - RNA, 20 nt, Chlamydophila pneumoniae J138
gcaagagcucuugagaaagc

SEQ ID NO: 537496 - RNA, 12 nt, Chlamydophila pneumoniae J138
gcaagagcuccg

SEQ ID NO: 537497 - RNA, 15 nt, Chlamydophila pneumoniae J138
gcaauacuaagaagc

SEQ ID NO: 537498 - RNA, 18 nt, Chlamydophila pneumoniae J138
gcaauccaggaauagaaa

SEQ ID NO: 537499 - RNA, 23 nt, Chlamydophila pneumoniae J138
gcaauccauaguccuagcagaga

SEQ ID NO: 537500 - RNA, 21 nt, Chlamydophila pneumoniae J138
gcaaugauagauaaaucccca

SEQ ID NO: 537501 - RNA, 23 nt, Chlamydophila pneumoniae J138
gcacccaaacugaugccaagaaa

SEQ ID NO: 537502 - RNA, 13 nt, Chlamydophila pneumoniae J138
gcaccauaauaua

SEQ ID NO: 537503 - RNA, 16 nt, Chlamydophila pneumoniae J138
gcaccuaauaaagaag

SEQ ID NO: 537504 - RNA, 13 nt, Chlamydophila pneumoniae J138
gcaccgccugacc

SEQ ID NO: 537505 - RNA, 14 nt, Chlamydophila pneumoniae J138
gcacuuguuuuuuc

SEQ ID NO: 537506 - RNA, 13 nt, Chlamydophila pneumoniae J138
gcacuuucuuuuu

SEQ ID NO: 537507 - RNA, 23 nt, Chlamydophila pneumoniae J138
gcacuuucuuuuuuaaucuagaa

SEQ ID NO: 537508 - RNA, 14 nt, Chlamydophila pneumoniae J138
gcacuuuuauuaug

SEQ ID NO: 537509 - RNA, 17 nt, Chlamydophila pneumoniae J138
gcagaaguuccuucagg

SEQ ID NO: 537510 - RNA, 21 nt, Chlamydophila pneumoniae J138
gcagaaguccuaucaaagcaa

SEQ ID NO: 537511 - RNA, 17 nt, Chlamydophila pneumoniae J138
gcagaaguccuaucaaa

SEQ ID NO: 537512 - RNA, 12 nt, Chlamydophila pneumoniae J138
gcagaaguuccu

SEQ ID NO: 537513 - RNA, 15 nt, Chlamydophila pneumoniae J138
gcagaaguuccuuca

SEQ ID NO: 537514 - RNA, 14 nt, Chlamydophila pneumoniae J138
gcagaaacacugaa

SEQ ID NO: 537515 - RNA, 17 nt, Chlamydophila pneumoniae J138
gcagaaacuuuaaaagc

SEQ ID NO: 537516 - RNA, 22 nt, Chlamydophila pneumoniae J138
gcagaguuuuucccucgcuaaa

SEQ ID NO: 537517 - RNA, 19 nt, Chlamydophila pneumoniae J138
gcagaguccuucuuuuccg

SEQ ID NO: 537518 - RNA, 21 nt, Chlamydophila pneumoniae J138
gcagacggggaucuaaagcau

SEQ ID NO: 537519 - RNA, 17 nt, Chlamydophila pneumoniae J138
gcagauagacaaccuag

SEQ ID NO: 537520 - RNA, 13 nt, Chlamydophila pneumoniae J138
gcagaucuuuuau

SEQ ID NO: 537521 - RNA, 15 nt, Chlamydophila pneumoniae J138
gcagccucuucucua

SEQ ID NO: 537522 - RNA, 22 nt, Chlamydophila pneumoniae J138
gcaggaagucaccuuacaucca

SEQ ID NO: 537523 - RNA, 21 nt, Chlamydophila pneumoniae J138
gcaggaauaaucaaccaaaau

SEQ ID NO: 537524 - RNA, 19 nt, Chlamydophila pneumoniae J138
gcaggaauaaucaaccaaa

SEQ ID NO: 537525 - RNA, 18 nt, Chlamydophila pneumoniae J138
gcagcuucuggagaaaaa

SEQ ID NO: 537526 - RNA, 17 nt, Chlamydophila pneumoniae J138
gcagcucggauggacua

SEQ ID NO: 537527 - RNA, 18 nt, Chlamydophila pneumoniae J138
gcagcuagaggcaaacag

SEQ ID NO: 537528 - RNA, 15 nt, Chlamydophila pneumoniae J138
gcaggaguuuucaag

SEQ ID NO: 537529 - RNA, 17 nt, Chlamydophila pneumoniae J138
gcagggggccugccaug

SEQ ID NO: 537530 - RNA, 22 nt, Chlamydophila pneumoniae J138
gcagucguauucagguucugaa

SEQ ID NO: 537531 - RNA, 14 nt, Chlamydophila pneumoniae J138
gcagucucaggaaa

SEQ ID NO: 537532 - RNA, 16 nt, Chlamydophila pneumoniae J138
gcaguaaugccaauau

SEQ ID NO: 537533 - RNA, 19 nt, Chlamydophila pneumoniae J138
gcaguaauuccaaaauaaa

SEQ ID NO: 537534 - RNA, 21 nt, Chlamydophila pneumoniae J138
gcaguggcuuauagagagaau

SEQ ID NO: 537535 - RNA, 21 nt, Chlamydophila pneumoniae J138
gcagugaaauuuugcaacaaa

SEQ ID NO: 537536 - RNA, 14 nt, Chlamydophila pneumoniae J138
gcagugugcugauu

SEQ ID NO: 537537 - RNA, 21 nt, Chlamydophila pneumoniae J138
gcauaacugugcuccauagca

SEQ ID NO: 537538 - RNA, 17 nt, Chlamydophila pneumoniae J138
gcauaacuuuaucauag

SEQ ID NO: 537539 - RNA, 21 nt, Chlamydophila pneumoniae J138
gcaguugcuguggcauacucu

SEQ ID NO: 537540 - RNA, 14 nt, Chlamydophila pneumoniae J138
gcaguuguacaauu

SEQ ID NO: 537541 - RNA, 16 nt, Chlamydophila pneumoniae J138
gcaguuccgauaaaga

SEQ ID NO: 537542 - RNA, 20 nt, Chlamydophila pneumoniae J138
gaugugccgugacuccagaa

SEQ ID NO: 537543 - RNA, 21 nt, Chlamydophila pneumoniae J138
gaugugcggcgagcucuagga

SEQ ID NO: 537544 - RNA, 22 nt, Chlamydophila pneumoniae J138
gauguuauaagugacuuuucuu

SEQ ID NO: 537545 - RNA, 22 nt, Chlamydophila pneumoniae J138
gauuacagcaucuauagaauuu

SEQ ID NO: 537546 - RNA, 15 nt, Chlamydophila pneumoniae J138
gauguuuaauacaaa

SEQ ID NO: 537547 - RNA, 21 nt, Chlamydophila pneumoniae J138
gauucacaucuuaaaaacuac

SEQ ID NO: 537548 - RNA, 17 nt, Chlamydophila pneumoniae J138
gauucaaugcagcuaac

SEQ ID NO: 537549 - RNA, 19 nt, Chlamydophila pneumoniae J138
gauucaguuccucauccuc

SEQ ID NO: 537550 - RNA, 13 nt, Chlamydophila pneumoniae J138
gauuaguaaugau

SEQ ID NO: 537551 - RNA, 19 nt, Chlamydophila pneumoniae J138
gauuaggaacaagucggca

SEQ ID NO: 537552 - RNA, 14 nt, Chlamydophila pneumoniae J138
gauuccuagaaucu

SEQ ID NO: 537553 - RNA, 19 nt, Chlamydophila pneumoniae J138
gauuccugucauuccuaag

SEQ ID NO: 537554 - RNA, 16 nt, Chlamydophila pneumoniae J138
gauuuagggaagaguu

SEQ ID NO: 537555 - RNA, 20 nt, Chlamydophila pneumoniae J138
gauuuagaaucuuuucuaga

SEQ ID NO: 537556 - RNA, 15 nt, Chlamydophila pneumoniae J138
gauuguaaaaguagc

SEQ ID NO: 537557 - RNA, 17 nt, Chlamydophila pneumoniae J138
gauugguaaggagaguc

SEQ ID NO: 537558 - RNA, 21 nt, Chlamydophila pneumoniae J138
gauugcaguugcuguggcaua

SEQ ID NO: 537559 - RNA, 23 nt, Chlamydophila pneumoniae J138
gauucucauaaaggcucuuuuag

SEQ ID NO: 537560 - RNA, 21 nt, Chlamydophila pneumoniae J138
gauucuccagcuucuuucuag

SEQ ID NO: 537561 - RNA, 14 nt, Chlamydophila pneumoniae J138
gauucuaaaucaac

SEQ ID NO: 537562 - RNA, 13 nt, Chlamydophila pneumoniae J138
gauucuacaaauu

SEQ ID NO: 537563 - RNA, 13 nt, Chlamydophila pneumoniae J138
gauucuaaaagag

SEQ ID NO: 537564 - RNA, 21 nt, Chlamydophila pneumoniae J138
gauuuuuuaaccucuuuucuu

SEQ ID NO: 537565 - RNA, 15 nt, Chlamydophila pneumoniae J138
gcaaaaauucuaggu

SEQ ID NO: 537566 - RNA, 11 nt, Chlamydophila pneumoniae J138
gauuuucucua

SEQ ID NO: 537567 - RNA, 12 nt, Chlamydophila pneumoniae J138
gauuuuccauua

SEQ ID NO: 537568 - RNA, 13 nt, Chlamydophila pneumoniae J138
gauuuuaaagccu

SEQ ID NO: 537569 - RNA, 21 nt, Chlamydophila pneumoniae J138
gauuuugcagugauaaaccaa

SEQ ID NO: 537570 - RNA, 23 nt, Chlamydophila pneumoniae J138
gauuuccaauccauucugagaaa

SEQ ID NO: 537571 - RNA, 20 nt, Chlamydophila pneumoniae J138
gauuuccccuucagaggcua

SEQ ID NO: 537572 - RNA, 18 nt, Chlamydophila pneumoniae J138
gauuuccuuaagcuucug

SEQ ID NO: 537573 - RNA, 23 nt, Chlamydophila pneumoniae J138
gauuucguauagcuggcaaugau

SEQ ID NO: 537574 - RNA, 22 nt, Chlamydophila pneumoniae J138
gaucucaguaggagcagcggca

SEQ ID NO: 537575 - RNA, 14 nt, Chlamydophila pneumoniae J138
gaucucaucauaaa

SEQ ID NO: 537576 - RNA, 14 nt, Chlamydophila pneumoniae J138
gaucucccgugagc

SEQ ID NO: 537577 - RNA, 23 nt, Chlamydophila pneumoniae J138
gaucuccgauagagauucuuucu

SEQ ID NO: 537578 - RNA, 17 nt, Chlamydophila pneumoniae J138
gaucuacaaacagauuu

SEQ ID NO: 537579 - RNA, 21 nt, Chlamydophila pneumoniae J138
gaucuaacuucaccauauaau

SEQ ID NO: 537580 - RNA, 20 nt, Chlamydophila pneumoniae J138
gaucuaaaagcacuuaaaaa

SEQ ID NO: 537581 - RNA, 15 nt, Chlamydophila pneumoniae J138
gauccccuucauucu

SEQ ID NO: 537582 - RNA, 15 nt, Chlamydophila pneumoniae J138
gaucguuagagaccc

SEQ ID NO: 537583 - RNA, 22 nt, Chlamydophila pneumoniae J138
gaucugcaaacgcaaugauuuc

SEQ ID NO: 537584 - RNA, 19 nt, Chlamydophila pneumoniae J138
gaucugcagcguuucuagg

SEQ ID NO: 537585 - RNA, 21 nt, Chlamydophila pneumoniae J138
gaucugcagcguuucuaggga

SEQ ID NO: 537586 - RNA, 19 nt, Chlamydophila pneumoniae J138
gaucucucuuccugcugcu

SEQ ID NO: 537587 - RNA, 14 nt, Chlamydophila pneumoniae J138
gaucucucuuuccu

SEQ ID NO: 537588 - RNA, 19 nt, Chlamydophila pneumoniae J138
gaucucucuuuccuuagca

SEQ ID NO: 537589 - RNA, 12 nt, Chlamydophila pneumoniae J138
gaugaacauaau

SEQ ID NO: 537590 - RNA, 23 nt, Chlamydophila pneumoniae J138
gaucuuuucuacuucaggaaaua

SEQ ID NO: 537591 - RNA, 17 nt, Chlamydophila pneumoniae J138
gaugaaacuuuaggauu

SEQ ID NO: 537592 - RNA, 18 nt, Chlamydophila pneumoniae J138
gaucuugagaaaagaaca

SEQ ID NO: 537593 - RNA, 23 nt, Chlamydophila pneumoniae J138
gaucuugcucaggagauacaagu

SEQ ID NO: 537594 - RNA, 14 nt, Chlamydophila pneumoniae J138
gaucuuuucuuucu

SEQ ID NO: 537595 - RNA, 20 nt, Chlamydophila pneumoniae J138
gaucuuuucuuucuaagaua

SEQ ID NO: 537596 - RNA, 20 nt, Chlamydophila pneumoniae J138
gaucuuuuugccaguucuug

SEQ ID NO: 537597 - RNA, 21 nt, Chlamydophila pneumoniae J138
gaucuuuuugccaguucuuga

SEQ ID NO: 537598 - RNA, 23 nt, Chlamydophila pneumoniae J138
gaucuuuugauaacuuugcauga

SEQ ID NO: 537599 - RNA, 19 nt, Chlamydophila pneumoniae J138
gaucuggagagggaaggaa

SEQ ID NO: 537600 - RNA, 21 nt, Chlamydophila pneumoniae J138
gaucuucauaaccaaguaaau

SEQ ID NO: 537601 - RNA, 12 nt, Chlamydophila pneumoniae J138
gaucuucauccc

SEQ ID NO: 537602 - RNA, 20 nt, Chlamydophila pneumoniae J138
gaucuugaacagagacuucc

SEQ ID NO: 537603 - RNA, 16 nt, Chlamydophila pneumoniae J138
gaucuucuagaugugu

SEQ ID NO: 537604 - RNA, 17 nt, Chlamydophila pneumoniae J138
gaucuucuaaaacaccu

SEQ ID NO: 537605 - RNA, 16 nt, Chlamydophila pneumoniae J138
gaucuucuaaaacacc

SEQ ID NO: 537606 - RNA, 15 nt, Chlamydophila pneumoniae J138
gaucuucuaaaacac

SEQ ID NO: 537607 - RNA, 23 nt, Chlamydophila pneumoniae J138
gaugaacguauagggaaccuuga

SEQ ID NO: 537608 - RNA, 19 nt, Chlamydophila pneumoniae J138
gaugaggucuuuagcaaaa

SEQ ID NO: 537609 - RNA, 22 nt, Chlamydophila pneumoniae J138
gaugcagcauuuguaagaauca

SEQ ID NO: 537610 - RNA, 15 nt, Chlamydophila pneumoniae J138
gaugccagccauagc

SEQ ID NO: 537611 - RNA, 22 nt, Chlamydophila pneumoniae J138
gaugcaaauccuguagaaacau

SEQ ID NO: 537612 - RNA, 19 nt, Chlamydophila pneumoniae J138
gaugcaaauccuguagaaa

SEQ ID NO: 537613 - RNA, 16 nt, Chlamydophila pneumoniae J138
gaugcaccauaauaua

SEQ ID NO: 537614 - RNA, 23 nt, Chlamydophila pneumoniae J138
gaugcucuagaaaacgcucuccu

SEQ ID NO: 537615 - RNA, 17 nt, Chlamydophila pneumoniae J138
gaugcugaggacgcaga

SEQ ID NO: 537616 - RNA, 13 nt, Chlamydophila pneumoniae J138
gaugcuaauaaaa

SEQ ID NO: 537617 - RNA, 16 nt, Chlamydophila pneumoniae J138
gaucacauagaaaaca

SEQ ID NO: 537618 - RNA, 17 nt, Chlamydophila pneumoniae J138
gaucaaagaacaauaaa

SEQ ID NO: 537619 - RNA, 17 nt, Chlamydophila pneumoniae J138
gaucaaagauuccuaag

SEQ ID NO: 537620 - RNA, 11 nt, Chlamydophila pneumoniae J138
gauauauagag

SEQ ID NO: 537621 - RNA, 16 nt, Chlamydophila pneumoniae J138
gauauauagagcagac

SEQ ID NO: 537622 - RNA, 15 nt, Chlamydophila pneumoniae J138
gauauagagagaguc

SEQ ID NO: 537623 - RNA, 20 nt, Chlamydophila pneumoniae J138
gauauugauaaaucccgaac

SEQ ID NO: 537624 - RNA, 19 nt, Chlamydophila pneumoniae J138
gauauuuuuauuuaaaauu

SEQ ID NO: 537625 - RNA, 11 nt, Chlamydophila pneumoniae J138
gaucacugaga

SEQ ID NO: 537626 - RNA, 17 nt, Chlamydophila pneumoniae J138
gaucagaaaaaaugcgu

SEQ ID NO: 537627 - RNA, 21 nt, Chlamydophila pneumoniae J138
gaucauaugcaccgauuggcu

SEQ ID NO: 537628 - RNA, 19 nt, Chlamydophila pneumoniae J138
gaucauaucuuaugccuuu

SEQ ID NO: 537629 - RNA, 23 nt, Chlamydophila pneumoniae J138
gaucauaucggcagcagcauaag

SEQ ID NO: 537630 - RNA, 19 nt, Chlamydophila pneumoniae J138
gauccaucggcauuucucc

SEQ ID NO: 537631 - RNA, 14 nt, Chlamydophila pneumoniae J138
gauccauaaccuuu

SEQ ID NO: 537632 - RNA, 23 nt, Chlamydophila pneumoniae J138
gaucauggauucacaucuuaaaa

SEQ ID NO: 537633 - RNA, 16 nt, Chlamydophila pneumoniae J138
gaucaucuucacuaaa

SEQ ID NO: 537634 - RNA, 22 nt, Chlamydophila pneumoniae J138
gauaccgcuguuuuauagcauc

SEQ ID NO: 537635 - RNA, 15 nt, Chlamydophila pneumoniae J138
gauaaguucuuccaa

SEQ ID NO: 537636 - RNA, 19 nt, Chlamydophila pneumoniae J138
gauagccaucauaaaacgu

SEQ ID NO: 537637 - RNA, 19 nt, Chlamydophila pneumoniae J138
gauauaagacuccaaguca

SEQ ID NO: 537638 - RNA, 21 nt, Chlamydophila pneumoniae J138
gauaguucacaagugcauuau

SEQ ID NO: 537639 - RNA, 22 nt, Chlamydophila pneumoniae J138
gauaguguucgagcaucucaag

SEQ ID NO: 537640 - RNA, 19 nt, Chlamydophila pneumoniae J138
gauaguuuuugcuguuucu

SEQ ID NO: 537641 - RNA, 19 nt, Chlamydophila pneumoniae J138
gauagcuaaaccuucagau

SEQ ID NO: 537642 - RNA, 13 nt, Chlamydophila pneumoniae J138
gauagccauuaga

SEQ ID NO: 537643 - RNA, 17 nt, Chlamydophila pneumoniae J138
gauaggcuggaacuguu

SEQ ID NO: 537644 - RNA, 17 nt, Chlamydophila pneumoniae J138
gauaggguaagauugca

SEQ ID NO: 537645 - RNA, 16 nt, Chlamydophila pneumoniae J138
gauaguaucguaagcc

SEQ ID NO: 537646 - RNA, 13 nt, Chlamydophila pneumoniae J138
gauagggaauuuc

SEQ ID NO: 537647 - RNA, 21 nt, Chlamydophila pneumoniae J138
gaggcuagaaaaucauacgcc

SEQ ID NO: 537648 - RNA, 11 nt, Chlamydophila pneumoniae J138
gagggauuugu

SEQ ID NO: 537649 - RNA, 19 nt, Chlamydophila pneumoniae J138
gagggaucuucucuaugaa

SEQ ID NO: 537650 - RNA, 21 nt, Chlamydophila pneumoniae J138
gagggaucauguagcagagcc

SEQ ID NO: 537651 - RNA, 19 nt, Chlamydophila pneumoniae J138
gaggcuucugagcuugccu

SEQ ID NO: 537652 - RNA, 23 nt, Chlamydophila pneumoniae J138
gagggguaaaccaauugagcucu

SEQ ID NO: 537653 - RNA, 18 nt, Chlamydophila pneumoniae J138
gaggggacggaaaaucac

SEQ ID NO: 537654 - RNA, 13 nt, Chlamydophila pneumoniae J138
gagggucucagca

SEQ ID NO: 537655 - RNA, 23 nt, Chlamydophila pneumoniae J138
gagguccuuggcauucaggagca

SEQ ID NO: 537656 - RNA, 18 nt, Chlamydophila pneumoniae J138
gaggucuuugaguagcca

SEQ ID NO: 537657 - RNA, 22 nt, Chlamydophila pneumoniae J138
gagguucgcagaacuucuccaa

SEQ ID NO: 537658 - RNA, 15 nt, Chlamydophila pneumoniae J138
gagguugagcaagaa

SEQ ID NO: 537659 - RNA, 15 nt, Chlamydophila pneumoniae J138
gagguuagaagggag

SEQ ID NO: 537660 - RNA, 13 nt, Chlamydophila pneumoniae J138
gagguuauguacu

SEQ ID NO: 537661 - RNA, 21 nt, Chlamydophila pneumoniae J138
gagguuucccgguaugaucaa

SEQ ID NO: 537662 - RNA, 13 nt, Chlamydophila pneumoniae J138
gaguuuucaaacu

SEQ ID NO: 537663 - RNA, 12 nt, Chlamydophila pneumoniae J138
gaguuuuccuaa

SEQ ID NO: 537664 - RNA, 13 nt, Chlamydophila pneumoniae J138
gaguuuuuuucuu

SEQ ID NO: 537665 - RNA, 23 nt, Chlamydophila pneumoniae J138
gaguuuuuguguuugacugaaac

SEQ ID NO: 537666 - RNA, 21 nt, Chlamydophila pneumoniae J138
gaguuuuaaacugcuacuuua

SEQ ID NO: 537667 - RNA, 13 nt, Chlamydophila pneumoniae J138
gaguuuuacauca

SEQ ID NO: 537668 - RNA, 17 nt, Chlamydophila pneumoniae J138
gauaaacauuaagugau

SEQ ID NO: 537669 - RNA, 12 nt, Chlamydophila pneumoniae J138
gauaaacagcac

SEQ ID NO: 537670 - RNA, 11 nt, Chlamydophila pneumoniae J138
gauaaacauac

SEQ ID NO: 537671 - RNA, 23 nt, Chlamydophila pneumoniae J138
gauaaauacccucggagacucag

SEQ ID NO: 537672 - RNA, 15 nt, Chlamydophila pneumoniae J138
gauaagaucucuccg

SEQ ID NO: 537673 - RNA, 15 nt, Chlamydophila pneumoniae J138
gauaagauaaagaau

SEQ ID NO: 537674 - RNA, 18 nt, Chlamydophila pneumoniae J138
gauaagaacuuuagggaa

SEQ ID NO: 537675 - RNA, 14 nt, Chlamydophila pneumoniae J138
gauaacacuucuuu

SEQ ID NO: 537676 - RNA, 15 nt, Chlamydophila pneumoniae J138
gaguugccaggaaac

SEQ ID NO: 537677 - RNA, 20 nt, Chlamydophila pneumoniae J138
gaguguuguuggagcagaaa

SEQ ID NO: 537678 - RNA, 15 nt, Chlamydophila pneumoniae J138
gaguguauuguaaag

SEQ ID NO: 537679 - RNA, 19 nt, Chlamydophila pneumoniae J138
gaguagccagacuggucua

SEQ ID NO: 537680 - RNA, 21 nt, Chlamydophila pneumoniae J138
gaguagacaagagagagcugg

SEQ ID NO: 537681 - RNA, 13 nt, Chlamydophila pneumoniae J138
gaguagccccagc

SEQ ID NO: 537682 - RNA, 16 nt, Chlamydophila pneumoniae J138
gaguagcucaucuaga

SEQ ID NO: 537683 - RNA, 19 nt, Chlamydophila pneumoniae J138
gaguaggguguauucugaa

SEQ ID NO: 537684 - RNA, 19 nt, Chlamydophila pneumoniae J138
gaguccuaaaauuucuagg

SEQ ID NO: 537685 - RNA, 22 nt, Chlamydophila pneumoniae J138
gagucgaaacacucaugaaagu

SEQ ID NO: 537686 - RNA, 14 nt, Chlamydophila pneumoniae J138
gaguccuucuuuuc

SEQ ID NO: 537687 - RNA, 14 nt, Chlamydophila pneumoniae J138
gagugacaccaaca

SEQ ID NO: 537688 - RNA, 13 nt, Chlamydophila pneumoniae J138
gagugacucauca

SEQ ID NO: 537689 - RNA, 19 nt, Chlamydophila pneumoniae J138
gagucugcgucguuuuuga

SEQ ID NO: 537690 - RNA, 15 nt, Chlamydophila pneumoniae J138
gagucgauuucccag

SEQ ID NO: 537691 - RNA, 21 nt, Chlamydophila pneumoniae J138
gagucugcagcagaugaaacu

SEQ ID NO: 537692 - RNA, 21 nt, Chlamydophila pneumoniae J138
gagaguccugggguucucuaa

SEQ ID NO: 537693 - RNA, 18 nt, Chlamydophila pneumoniae J138
gagaguagugaacacucu

SEQ ID NO: 537694 - RNA, 18 nt, Chlamydophila pneumoniae J138
gagauauugugaggggau

SEQ ID NO: 537695 - RNA, 20 nt, Chlamydophila pneumoniae J138
gagauauugugaggggauga

SEQ ID NO: 537696 - RNA, 23 nt, Chlamydophila pneumoniae J138
gagaucauuagcaucaucuccug

SEQ ID NO: 537697 - RNA, 17 nt, Chlamydophila pneumoniae J138
gagauccuccuggaaga

SEQ ID NO: 537698 - RNA, 15 nt, Chlamydophila pneumoniae J138
gagauucgaaagaac

SEQ ID NO: 537699 - RNA, 22 nt, Chlamydophila pneumoniae J138
gagauuccuaaaccuaaaaugg

SEQ ID NO: 537700 - RNA, 17 nt, Chlamydophila pneumoniae J138
gagauuaccgaagagcc

SEQ ID NO: 537701 - RNA, 21 nt, Chlamydophila pneumoniae J138
gagaugaaaggcucguagaua

SEQ ID NO: 537702 - RNA, 13 nt, Chlamydophila pneumoniae J138
gagaucuuugaga

SEQ ID NO: 537703 - RNA, 17 nt, Chlamydophila pneumoniae J138
gagcaauuaagaaacua

SEQ ID NO: 537704 - RNA, 15 nt, Chlamydophila pneumoniae J138
gagcacaaggagaga

SEQ ID NO: 537705 - RNA, 20 nt, Chlamydophila pneumoniae J138
gagcaagauaaucauuaaga

SEQ ID NO: 537706 - RNA, 12 nt, Chlamydophila pneumoniae J138
gagauuuuucua

SEQ ID NO: 537707 - RNA, 12 nt, Chlamydophila pneumoniae J138
gagauuuuccau

SEQ ID NO: 537708 - RNA, 11 nt, Chlamydophila pneumoniae J138
gagcaaacauc

SEQ ID NO: 537709 - RNA, 23 nt, Chlamydophila pneumoniae J138
gagcagcuuuaucaggaucuuga

SEQ ID NO: 537710 - RNA, 14 nt, Chlamydophila pneumoniae J138
gagcaucuuuucaa

SEQ ID NO: 537711 - RNA, 20 nt, Chlamydophila pneumoniae J138
gagcaucuuuucaaaagaaa

SEQ ID NO: 537712 - RNA, 22 nt, Chlamydophila pneumoniae J138
gagcaucuuuucaaaagaaaag

SEQ ID NO: 537713 - RNA, 21 nt, Chlamydophila pneumoniae J138
gagcauccuguagccacuaag

SEQ ID NO: 537714 - RNA, 16 nt, Chlamydophila pneumoniae J138
gagcaucauuaauucc

SEQ ID NO: 537715 - RNA, 14 nt, Chlamydophila pneumoniae J138
gagcauccaaaaug

SEQ ID NO: 537716 - RNA, 16 nt, Chlamydophila pneumoniae J138
gagcauagacucuucc

SEQ ID NO: 537717 - RNA, 19 nt, Chlamydophila pneumoniae J138
gagcauugacuugggauuc

SEQ ID NO: 537718 - RNA, 20 nt, Chlamydophila pneumoniae J138
gagccacuuuuaauuucuua

SEQ ID NO: 537719 - RNA, 19 nt, Chlamydophila pneumoniae J138
gagcgcguuucaaauagga

SEQ ID NO: 537720 - RNA, 17 nt, Chlamydophila pneumoniae J138
gagccgucuacuuuugu

SEQ ID NO: 537721 - RNA, 14 nt, Chlamydophila pneumoniae J138
gagccuccauaaug

SEQ ID NO: 537722 - RNA, 15 nt, Chlamydophila pneumoniae J138
gagcgggagaaucaa

SEQ ID NO: 537723 - RNA, 12 nt, Chlamydophila pneumoniae J138
gagcggaauuuc

SEQ ID NO: 537724 - RNA, 23 nt, Chlamydophila pneumoniae J138
gagcuaugaugagaacguccuca

SEQ ID NO: 537725 - RNA, 16 nt, Chlamydophila pneumoniae J138
gagcuagaaugucuug

SEQ ID NO: 537726 - RNA, 20 nt, Chlamydophila pneumoniae J138
gagcucccucuagagcuuug

SEQ ID NO: 537727 - RNA, 12 nt, Chlamydophila pneumoniae J138
gagcuccuccuu

SEQ ID NO: 537728 - RNA, 20 nt, Chlamydophila pneumoniae J138
gagcucguaauccuucuuuc

SEQ ID NO: 537729 - RNA, 23 nt, Chlamydophila pneumoniae J138
gagcucuaaaaaagauaaagcua

SEQ ID NO: 537730 - RNA, 18 nt, Chlamydophila pneumoniae J138
gagcugauccagcuccau

SEQ ID NO: 537731 - RNA, 16 nt, Chlamydophila pneumoniae J138
gagcuucuaagaucuu

SEQ ID NO: 537732 - RNA, 13 nt, Chlamydophila pneumoniae J138
gagcuucuaucuu

SEQ ID NO: 537733 - RNA, 22 nt, Chlamydophila pneumoniae J138
gagcuuguucuguaacacuucc

SEQ ID NO: 537734 - RNA, 14 nt, Chlamydophila pneumoniae J138
gagcuugucuucca

SEQ ID NO: 537735 - RNA, 13 nt, Chlamydophila pneumoniae J138
gagcuugucuucc

SEQ ID NO: 537736 - RNA, 18 nt, Chlamydophila pneumoniae J138
gagcuugucuaggagcuu

SEQ ID NO: 537737 - RNA, 15 nt, Chlamydophila pneumoniae J138
gagcuuuuaguaggu

SEQ ID NO: 537738 - RNA, 15 nt, Chlamydophila pneumoniae J138
gagcuuuuacaaacc

SEQ ID NO: 537739 - RNA, 14 nt, Chlamydophila pneumoniae J138
gagcugcugguccu

SEQ ID NO: 537740 - RNA, 17 nt, Chlamydophila pneumoniae J138
gagcuggacuucugguu

SEQ ID NO: 537741 - RNA, 18 nt, Chlamydophila pneumoniae J138
gagcuucacaucuuucuc

SEQ ID NO: 537742 - RNA, 11 nt, Chlamydophila pneumoniae J138
gaggaggagca

SEQ ID NO: 537743 - RNA, 21 nt, Chlamydophila pneumoniae J138
gaggagcuuggggguggucua

SEQ ID NO: 537744 - RNA, 18 nt, Chlamydophila pneumoniae J138
gaggagcucccucuagag

SEQ ID NO: 537745 - RNA, 23 nt, Chlamydophila pneumoniae J138
gaggagcuauuaaauuaucagag

SEQ ID NO: 537746 - RNA, 14 nt, Chlamydophila pneumoniae J138
gaggaauucuggaa

SEQ ID NO: 537747 - RNA, 23 nt, Chlamydophila pneumoniae J138
gaggagacuugaucuacaaaaac

SEQ ID NO: 537748 - RNA, 19 nt, Chlamydophila pneumoniae J138
gaggagcgauagcucagcu

SEQ ID NO: 537749 - RNA, 16 nt, Chlamydophila pneumoniae J138
gaggaauucuggaaca

SEQ ID NO: 537750 - RNA, 14 nt, Chlamydophila pneumoniae J138
gaggacgaaucaau

SEQ ID NO: 537751 - RNA, 13 nt, Chlamydophila pneumoniae J138
gaggaaucuaaga

SEQ ID NO: 537752 - RNA, 13 nt, Chlamydophila pneumoniae J138
gaggaacaauacu

SEQ ID NO: 537753 - RNA, 15 nt, Chlamydophila pneumoniae J138
gaggagggaaacacc

SEQ ID NO: 537754 - RNA, 19 nt, Chlamydophila pneumoniae J138
gaggaguccuucuagguau

SEQ ID NO: 537755 - RNA, 19 nt, Chlamydophila pneumoniae J138
gaggauaaaugaguggguu

SEQ ID NO: 537756 - RNA, 14 nt, Chlamydophila pneumoniae J138
gaggaguuuuccaa

SEQ ID NO: 537757 - RNA, 16 nt, Chlamydophila pneumoniae J138
gaggcacauguaggau

SEQ ID NO: 537758 - RNA, 15 nt, Chlamydophila pneumoniae J138
gaggcaagucucaaa

SEQ ID NO: 537759 - RNA, 16 nt, Chlamydophila pneumoniae J138
gaggauucuuuuugau

SEQ ID NO: 537760 - RNA, 21 nt, Chlamydophila pneumoniae J138
gacgucuucuuagaagagaaa

SEQ ID NO: 537761 - RNA, 16 nt, Chlamydophila pneumoniae J138
gacgucuccaacaguc

SEQ ID NO: 537762 - RNA, 17 nt, Chlamydophila pneumoniae J138
gacgugggagacauucc

SEQ ID NO: 537763 - RNA, 22 nt, Chlamydophila pneumoniae J138
gacguuaauaaagaggcuccca

SEQ ID NO: 537764 - RNA, 23 nt, Chlamydophila pneumoniae J138
gacguucgacaacaacauaaaga

SEQ ID NO: 537765 - RNA, 16 nt, Chlamydophila pneumoniae J138
gacuaaaagaauaaua

SEQ ID NO: 537766 - RNA, 16 nt, Chlamydophila pneumoniae J138
gacguuugaucuucuc

SEQ ID NO: 537767 - RNA, 23 nt, Chlamydophila pneumoniae J138
gacuaaacaagaaaaagcaucua

SEQ ID NO: 537768 - RNA, 17 nt, Chlamydophila pneumoniae J138
gacuaaaugcgaggccc

SEQ ID NO: 537769 - RNA, 15 nt, Chlamydophila pneumoniae J138
gacuagcuuuucaug

SEQ ID NO: 537770 - RNA, 16 nt, Chlamydophila pneumoniae J138
gacuaauaccuuucua

SEQ ID NO: 537771 - RNA, 13 nt, Chlamydophila pneumoniae J138
gacuacaagauag

SEQ ID NO: 537772 - RNA, 14 nt, Chlamydophila pneumoniae J138
gacuauagaugcca

SEQ ID NO: 537773 - RNA, 21 nt, Chlamydophila pneumoniae J138
gacuauagaugccauaagucc

SEQ ID NO: 537774 - RNA, 18 nt, Chlamydophila pneumoniae J138
gacuaucgcaaauuucca

SEQ ID NO: 537775 - RNA, 16 nt, Chlamydophila pneumoniae J138
gacucaaucaaauuca

SEQ ID NO: 537776 - RNA, 21 nt, Chlamydophila pneumoniae J138
gacuauuuuggaaagcucuuu

SEQ ID NO: 537777 - RNA, 22 nt, Chlamydophila pneumoniae J138
gacucgccgaaaguaucuucag

SEQ ID NO: 537778 - RNA, 16 nt, Chlamydophila pneumoniae J138
gacucgcgucaugcau

SEQ ID NO: 537779 - RNA, 15 nt, Chlamydophila pneumoniae J138
gacuccaagaauagc

SEQ ID NO: 537780 - RNA, 14 nt, Chlamydophila pneumoniae J138
gacugcaaaggaag

SEQ ID NO: 537781 - RNA, 15 nt, Chlamydophila pneumoniae J138
gacugcucuuucauu

SEQ ID NO: 537782 - RNA, 11 nt, Chlamydophila pneumoniae J138
gacugaaacuc

SEQ ID NO: 537783 - RNA, 23 nt, Chlamydophila pneumoniae J138
gacugaaaagaucguuaucaaaa

SEQ ID NO: 537784 - RNA, 23 nt, Chlamydophila pneumoniae J138
gacucucaucagcaaaacucccg

SEQ ID NO: 537785 - RNA, 16 nt, Chlamydophila pneumoniae J138
gacuuccuccaaaauu

SEQ ID NO: 537786 - RNA, 22 nt, Chlamydophila pneumoniae J138
gacuuccucuucaauuucuuca

SEQ ID NO: 537787 - RNA, 21 nt, Chlamydophila pneumoniae J138
gacuucaccuugaaguuuuuu

SEQ ID NO: 537788 - RNA, 23 nt, Chlamydophila pneumoniae J138
gacuucaccuugaaguuuuuucu

SEQ ID NO: 537789 - RNA, 20 nt, Chlamydophila pneumoniae J138
gacuugccaaucuuccuuaa

SEQ ID NO: 537790 - RNA, 20 nt, Chlamydophila pneumoniae J138
gacuucuuguccuguuaaga

SEQ ID NO: 537791 - RNA, 18 nt, Chlamydophila pneumoniae J138
gacuucuggaagcuguug

SEQ ID NO: 537792 - RNA, 18 nt, Chlamydophila pneumoniae J138
gacuggcgacuugccaau

SEQ ID NO: 537793 - RNA, 15 nt, Chlamydophila pneumoniae J138
gacuguacaaaugca

SEQ ID NO: 537794 - RNA, 19 nt, Chlamydophila pneumoniae J138
gacugugauugcguauaga

SEQ ID NO: 537795 - RNA, 12 nt, Chlamydophila pneumoniae J138
gacuuuccucaa

SEQ ID NO: 537796 - RNA, 17 nt, Chlamydophila pneumoniae J138
gacuuucauaugaauga

SEQ ID NO: 537797 - RNA, 17 nt, Chlamydophila pneumoniae J138
gacuuuggucuucugua

SEQ ID NO: 537798 - RNA, 15 nt, Chlamydophila pneumoniae J138
gacuuuuuuaagagu

SEQ ID NO: 537799 - RNA, 18 nt, Chlamydophila pneumoniae J138
gagaaccuccaccaggag

SEQ ID NO: 537800 - RNA, 19 nt, Chlamydophila pneumoniae J138
gagaaagucgauuuccuuu

SEQ ID NO: 537801 - RNA, 13 nt, Chlamydophila pneumoniae J138
gagaaaucacacu

SEQ ID NO: 537802 - RNA, 18 nt, Chlamydophila pneumoniae J138
gagaaaugcucuucugca

SEQ ID NO: 537803 - RNA, 17 nt, Chlamydophila pneumoniae J138
gagaaagcuucuaugaa

SEQ ID NO: 537804 - RNA, 23 nt, Chlamydophila pneumoniae J138
gagaaacuuaguuuugaaaagau

SEQ ID NO: 537805 - RNA, 13 nt, Chlamydophila pneumoniae J138
gagaaaaucaacu

SEQ ID NO: 537806 - RNA, 16 nt, Chlamydophila pneumoniae J138
gagaaaaucugcagca

SEQ ID NO: 537807 - RNA, 22 nt, Chlamydophila pneumoniae J138
gagaaccuucacaagaaaacaa

SEQ ID NO: 537808 - RNA, 17 nt, Chlamydophila pneumoniae J138
gagaacuucaacaaagg

SEQ ID NO: 537809 - RNA, 12 nt, Chlamydophila pneumoniae J138
gagaacuucaac

SEQ ID NO: 537810 - RNA, 17 nt, Chlamydophila pneumoniae J138
gagaagagguaauaaua

SEQ ID NO: 537811 - RNA, 18 nt, Chlamydophila pneumoniae J138
gagaauacagagucugug

SEQ ID NO: 537812 - RNA, 21 nt, Chlamydophila pneumoniae J138
gagaauacgaucugcuuugca

SEQ ID NO: 537813 - RNA, 14 nt, Chlamydophila pneumoniae J138
gagaaguuugauaa

SEQ ID NO: 537814 - RNA, 19 nt, Chlamydophila pneumoniae J138
gagaagcucaucagcaacc

SEQ ID NO: 537815 - RNA, 23 nt, Chlamydophila pneumoniae J138
gagaagcaucuucgauuucuagu

SEQ ID NO: 537816 - RNA, 19 nt, Chlamydophila pneumoniae J138
gagaaugacuuuagaaauu

SEQ ID NO: 537817 - RNA, 12 nt, Chlamydophila pneumoniae J138
gagaaugcugua

SEQ ID NO: 537818 - RNA, 22 nt, Chlamydophila pneumoniae J138
gagacagacagucugugagaaa

SEQ ID NO: 537819 - RNA, 14 nt, Chlamydophila pneumoniae J138
gagacaagaaaaua

SEQ ID NO: 537820 - RNA, 17 nt, Chlamydophila pneumoniae J138
gagacaaagccacagcc

SEQ ID NO: 537821 - RNA, 16 nt, Chlamydophila pneumoniae J138
gagacaaagccacagc

SEQ ID NO: 537822 - RNA, 14 nt, Chlamydophila pneumoniae J138
gagaauuucuccag

SEQ ID NO: 537823 - RNA, 15 nt, Chlamydophila pneumoniae J138
gagacauuucuugau

SEQ ID NO: 537824 - RNA, 13 nt, Chlamydophila pneumoniae J138
gagaccuucucuu

SEQ ID NO: 537825 - RNA, 21 nt, Chlamydophila pneumoniae J138
gagaccuacuuauuguucuug

SEQ ID NO: 537826 - RNA, 13 nt, Chlamydophila pneumoniae J138
gagagaagaaauu

SEQ ID NO: 537827 - RNA, 22 nt, Chlamydophila pneumoniae J138
gagagaaacaucggagaacuuc

SEQ ID NO: 537828 - RNA, 13 nt, Chlamydophila pneumoniae J138
gagacuuccucuu

SEQ ID NO: 537829 - RNA, 16 nt, Chlamydophila pneumoniae J138
gagacucuaguuuuuc

SEQ ID NO: 537830 - RNA, 19 nt, Chlamydophila pneumoniae J138
gagacucuaguuuuucuuu

SEQ ID NO: 537831 - RNA, 17 nt, Chlamydophila pneumoniae J138
gagacucagagaaaauc

SEQ ID NO: 537832 - RNA, 14 nt, Chlamydophila pneumoniae J138
gagagguucccuca

SEQ ID NO: 537833 - RNA, 19 nt, Chlamydophila pneumoniae J138
gagagcuugguuuucuccu

SEQ ID NO: 537834 - RNA, 21 nt, Chlamydophila pneumoniae J138
gagaggaaaucccgagauaug

SEQ ID NO: 537835 - RNA, 17 nt, Chlamydophila pneumoniae J138
gagaggagagaauccuu

SEQ ID NO: 537836 - RNA, 14 nt, Chlamydophila pneumoniae J138
gagagccuuuccua

SEQ ID NO: 537837 - RNA, 13 nt, Chlamydophila pneumoniae J138
gagagagcucuuc

SEQ ID NO: 537838 - RNA, 18 nt, Chlamydophila pneumoniae J138
gagagaaggaauuaaaau

SEQ ID NO: 537839 - RNA, 21 nt, Chlamydophila pneumoniae J138
gagagaagcagaaucugugag

SEQ ID NO: 537840 - RNA, 17 nt, Chlamydophila pneumoniae J138
gagagacuguguuuuua

SEQ ID NO: 537841 - RNA, 14 nt, Chlamydophila pneumoniae J138
gaccauaaaaucaa

SEQ ID NO: 537842 - RNA, 21 nt, Chlamydophila pneumoniae J138
gaccgcaaggagucacuggca

SEQ ID NO: 537843 - RNA, 19 nt, Chlamydophila pneumoniae J138
gaccgagaagcuucaauga

SEQ ID NO: 537844 - RNA, 22 nt, Chlamydophila pneumoniae J138
gacccuagguagcucgagauuu

SEQ ID NO: 537845 - RNA, 19 nt, Chlamydophila pneumoniae J138
gaccugcaaacuccccagu

SEQ ID NO: 537846 - RNA, 18 nt, Chlamydophila pneumoniae J138
gaccugcuuuuuuucuag

SEQ ID NO: 537847 - RNA, 23 nt, Chlamydophila pneumoniae J138
gaccuguaguaaaauaagaaauc

SEQ ID NO: 537848 - RNA, 15 nt, Chlamydophila pneumoniae J138
gaccucaucagaagu

SEQ ID NO: 537849 - RNA, 19 nt, Chlamydophila pneumoniae J138
gaccuaagggcucuccuaa

SEQ ID NO: 537850 - RNA, 15 nt, Chlamydophila pneumoniae J138
gaccuacguuuucuc

SEQ ID NO: 537851 - RNA, 12 nt, Chlamydophila pneumoniae J138
gaccuacaccau

SEQ ID NO: 537852 - RNA, 13 nt, Chlamydophila pneumoniae J138
gaccuguuuucuu

SEQ ID NO: 537853 - RNA, 19 nt, Chlamydophila pneumoniae J138
gaccuucucaagaucuuca

SEQ ID NO: 537854 - RNA, 17 nt, Chlamydophila pneumoniae J138
gaccuuccuuaucuuca

SEQ ID NO: 537855 - RNA, 17 nt, Chlamydophila pneumoniae J138
gaccuuggacucuaggg

SEQ ID NO: 537856 - RNA, 23 nt, Chlamydophila pneumoniae J138
gacgaaagcacauaagaugaagu

SEQ ID NO: 537857 - RNA, 16 nt, Chlamydophila pneumoniae J138
gacgaacgaagaaaac

SEQ ID NO: 537858 - RNA, 22 nt, Chlamydophila pneumoniae J138
gacgaccuacacguuacgaaug

SEQ ID NO: 537859 - RNA, 21 nt, Chlamydophila pneumoniae J138
gacgagcaugcuaagcaucag

SEQ ID NO: 537860 - RNA, 15 nt, Chlamydophila pneumoniae J138
gacgcacauuuagaa

SEQ ID NO: 537861 - RNA, 18 nt, Chlamydophila pneumoniae J138
gacgcaagagacaagaaa

SEQ ID NO: 537862 - RNA, 14 nt, Chlamydophila pneumoniae J138
gacggaaaaucaca

SEQ ID NO: 537863 - RNA, 20 nt, Chlamydophila pneumoniae J138
gacgcucuaaacucucuucc

SEQ ID NO: 537864 - RNA, 12 nt, Chlamydophila pneumoniae J138
gacggauaaaug

SEQ ID NO: 537865 - RNA, 17 nt, Chlamydophila pneumoniae J138
gacggauaaauggagga

SEQ ID NO: 537866 - RNA, 13 nt, Chlamydophila pneumoniae J138
gacggauaggauc

SEQ ID NO: 537867 - RNA, 14 nt, Chlamydophila pneumoniae J138
gacggauccuagaa

SEQ ID NO: 537868 - RNA, 18 nt, Chlamydophila pneumoniae J138
gacauacaucaaaaugcu

SEQ ID NO: 537869 - RNA, 22 nt, Chlamydophila pneumoniae J138
gacauacucgucaaauucauua

SEQ ID NO: 537870 - RNA, 19 nt, Chlamydophila pneumoniae J138
gacauacucgucaaauuca

SEQ ID NO: 537871 - RNA, 23 nt, Chlamydophila pneumoniae J138
gacaugccuugguacuuaagcac

SEQ ID NO: 537872 - RNA, 21 nt, Chlamydophila pneumoniae J138
gacaugccuaaauagcucagu

SEQ ID NO: 537873 - RNA, 18 nt, Chlamydophila pneumoniae J138
gacauuauagaggucuuu

SEQ ID NO: 537874 - RNA, 19 nt, Chlamydophila pneumoniae J138
gacauuuccccaugaaaau

SEQ ID NO: 537875 - RNA, 16 nt, Chlamydophila pneumoniae J138
gacauuuucaagcuuu

SEQ ID NO: 537876 - RNA, 20 nt, Chlamydophila pneumoniae J138
gacauugaauccagcaccuu

SEQ ID NO: 537877 - RNA, 14 nt, Chlamydophila pneumoniae J138
gacauuccuuaauu

SEQ ID NO: 537878 - RNA, 15 nt, Chlamydophila pneumoniae J138
gacaucuccaagaua

SEQ ID NO: 537879 - RNA, 17 nt, Chlamydophila pneumoniae J138
gacaucuccaagauaau

SEQ ID NO: 537880 - RNA, 14 nt, Chlamydophila pneumoniae J138
gacaucuaauuuua

SEQ ID NO: 537881 - RNA, 16 nt, Chlamydophila pneumoniae J138
gaccaaauaauuaaau

SEQ ID NO: 537882 - RNA, 23 nt, Chlamydophila pneumoniae J138
gaccaaacuucgauuggaagcaa

SEQ ID NO: 537883 - RNA, 19 nt, Chlamydophila pneumoniae J138
gaccaaaaauaaacauauu

SEQ ID NO: 537884 - RNA, 19 nt, Chlamydophila pneumoniae J138
gacacgaacuuugaccaga

SEQ ID NO: 537885 - RNA, 20 nt, Chlamydophila pneumoniae J138
gacacgaccacuacuuaaag

SEQ ID NO: 537886 - RNA, 23 nt, Chlamydophila pneumoniae J138
gacacgccuccuucaaagauaua

SEQ ID NO: 537887 - RNA, 15 nt, Chlamydophila pneumoniae J138
gacacgccuccuuca

SEQ ID NO: 537888 - RNA, 19 nt, Chlamydophila pneumoniae J138
gacacuauguguuuccuuu

SEQ ID NO: 537889 - RNA, 17 nt, Chlamydophila pneumoniae J138
gacacucagcucccaug

SEQ ID NO: 537890 - RNA, 19 nt, Chlamydophila pneumoniae J138
gacacagcuaaucaaucca

SEQ ID NO: 537891 - RNA, 12 nt, Chlamydophila pneumoniae J138
gacacagagaac

SEQ ID NO: 537892 - RNA, 21 nt, Chlamydophila pneumoniae J138
gacacagagaacaauaaacga

SEQ ID NO: 537893 - RNA, 12 nt, Chlamydophila pneumoniae J138
gacacaacucuu

SEQ ID NO: 537894 - RNA, 23 nt, Chlamydophila pneumoniae J138
gacacaaaaagcuuuuuucucuu

SEQ ID NO: 537895 - RNA, 18 nt, Chlamydophila pneumoniae J138
gacaccaacaacaauaau

SEQ ID NO: 537896 - RNA, 17 nt, Chlamydophila pneumoniae J138
gacagcguauaggaaac

SEQ ID NO: 537897 - RNA, 20 nt, Chlamydophila pneumoniae J138
gacagccggagcuucuaaga

SEQ ID NO: 537898 - RNA, 23 nt, Chlamydophila pneumoniae J138
gacacuugcuuaaggaaacagug

SEQ ID NO: 537899 - RNA, 19 nt, Chlamydophila pneumoniae J138
gacacuugcuuaaggaaac

SEQ ID NO: 537900 - RNA, 15 nt, Chlamydophila pneumoniae J138
gacagcagcauuuuc

SEQ ID NO: 537901 - RNA, 17 nt, Chlamydophila pneumoniae J138
gacaauggaaauagaga

SEQ ID NO: 537902 - RNA, 19 nt, Chlamydophila pneumoniae J138
gacaaucgcuguaaauuca

SEQ ID NO: 537903 - RNA, 16 nt, Chlamydophila pneumoniae J138
gacaauaaaauagccc

SEQ ID NO: 537904 - RNA, 20 nt, Chlamydophila pneumoniae J138
gacaagguggguagccagga

SEQ ID NO: 537905 - RNA, 18 nt, Chlamydophila pneumoniae J138
gacaauaagaaaauccua

SEQ ID NO: 537906 - RNA, 14 nt, Chlamydophila pneumoniae J138
gacaauauagagau

SEQ ID NO: 537907 - RNA, 16 nt, Chlamydophila pneumoniae J138
gacaauauaagcacca

SEQ ID NO: 537908 - RNA, 20 nt, Chlamydophila pneumoniae J138
gacaagauggugagauuucu

SEQ ID NO: 537909 - RNA, 21 nt, Chlamydophila pneumoniae J138
gacaaggagucgugcaggaga

SEQ ID NO: 537910 - RNA, 22 nt, Chlamydophila pneumoniae J138
gacaaggagucgugcaggagaa

SEQ ID NO: 537911 - RNA, 19 nt, Chlamydophila pneumoniae J138
gacaaggagucgugcagga

SEQ ID NO: 537912 - RNA, 16 nt, Chlamydophila pneumoniae J138
gacaacaccucccacc

SEQ ID NO: 537913 - RNA, 18 nt, Chlamydophila pneumoniae J138
gacaacaacauaaagaag

SEQ ID NO: 537914 - RNA, 15 nt, Chlamydophila pneumoniae J138
gacaaauagaaagga

SEQ ID NO: 537915 - RNA, 14 nt, Chlamydophila pneumoniae J138
gaauuuuaucagaa

SEQ ID NO: 537916 - RNA, 12 nt, Chlamydophila pneumoniae J138
gaauuuuccuga

SEQ ID NO: 537917 - RNA, 20 nt, Chlamydophila pneumoniae J138
gaauuuuucuaguucguuca

SEQ ID NO: 537918 - RNA, 22 nt, Chlamydophila pneumoniae J138
gaauuuuuguuuuaacucuaga

SEQ ID NO: 537919 - RNA, 13 nt, Chlamydophila pneumoniae J138
gaauuuuuguuuu

SEQ ID NO: 537920 - RNA, 21 nt, Chlamydophila pneumoniae J138
gacaaaaaagggaucuccuuc

SEQ ID NO: 537921 - RNA, 13 nt, Chlamydophila pneumoniae J138
gacaaaaaugccu

SEQ ID NO: 537922 - RNA, 15 nt, Chlamydophila pneumoniae J138
cguuauccucgucuu

SEQ ID NO: 537923 - RNA, 21 nt, Chlamydophila pneumoniae J138
cguucguggagcaucauucca

SEQ ID NO: 537924 - RNA, 11 nt, Chlamydophila pneumoniae J138
cguugccuguu

SEQ ID NO: 537925 - RNA, 21 nt, Chlamydophila pneumoniae J138
cuaaacucucuuccuucuccu

SEQ ID NO: 537926 - RNA, 20 nt, Chlamydophila pneumoniae J138
cuaaacucuccaaaagcucu

SEQ ID NO: 537927 - RNA, 14 nt, Chlamydophila pneumoniae J138
cuaaacucucuucc

SEQ ID NO: 537928 - RNA, 17 nt, Chlamydophila pneumoniae J138
cuaaacucucuuccuuc

SEQ ID NO: 537929 - RNA, 20 nt, Chlamydophila pneumoniae J138
cuaaacucucuuccuucucc

SEQ ID NO: 537930 - RNA, 16 nt, Chlamydophila pneumoniae J138
cuaaagcugcuuuuuc

SEQ ID NO: 537931 - RNA, 22 nt, Chlamydophila pneumoniae J138
cuaaagcugccagugacauaau

SEQ ID NO: 537932 - RNA, 18 nt, Chlamydophila pneumoniae J138
cuaaagcugcuuuuucua

SEQ ID NO: 537933 - RNA, 17 nt, Chlamydophila pneumoniae J138
cuaaaggaaucucggga

SEQ ID NO: 537934 - RNA, 15 nt, Chlamydophila pneumoniae J138
cuaaagguuuuaaau

SEQ ID NO: 537935 - RNA, 18 nt, Chlamydophila pneumoniae J138
cuaaaguaacgauaagaa

SEQ ID NO: 537936 - RNA, 13 nt, Chlamydophila pneumoniae J138
cuaaauaaaccac

SEQ ID NO: 537937 - RNA, 23 nt, Chlamydophila pneumoniae J138
cuaaauacuuaggaauuuuucua

SEQ ID NO: 537938 - RNA, 18 nt, Chlamydophila pneumoniae J138
cuaaaguaggaauuuuca

SEQ ID NO: 537939 - RNA, 20 nt, Chlamydophila pneumoniae J138
cuaaaaugcuuguauaaaug

SEQ ID NO: 537940 - RNA, 21 nt, Chlamydophila pneumoniae J138
cuaaaaucuuucaauguaauu

SEQ ID NO: 537941 - RNA, 20 nt, Chlamydophila pneumoniae J138
cuaaacaacucccguuuugu

SEQ ID NO: 537942 - RNA, 13 nt, Chlamydophila pneumoniae J138
cuaaacaauuuca

SEQ ID NO: 537943 - RNA, 23 nt, Chlamydophila pneumoniae J138
cuaaacgcgagcuauuuuacuua

SEQ ID NO: 537944 - RNA, 16 nt, Chlamydophila pneumoniae J138
cguuuucuagaaaaga

SEQ ID NO: 537945 - RNA, 14 nt, Chlamydophila pneumoniae J138
cguuucagaaguca

SEQ ID NO: 537946 - RNA, 18 nt, Chlamydophila pneumoniae J138
cguuucagaagucacaaa

SEQ ID NO: 537947 - RNA, 19 nt, Chlamydophila pneumoniae J138
cuaccauuaaggaauccca

SEQ ID NO: 537948 - RNA, 14 nt, Chlamydophila pneumoniae J138
cuaccaucaugaau

SEQ ID NO: 537949 - RNA, 14 nt, Chlamydophila pneumoniae J138
cuaccauaucuuga

SEQ ID NO: 537950 - RNA, 13 nt, Chlamydophila pneumoniae J138
cuaccagaugccu

SEQ ID NO: 537951 - RNA, 21 nt, Chlamydophila pneumoniae J138
cuaccaaagucgauacccaaa

SEQ ID NO: 537952 - RNA, 16 nt, Chlamydophila pneumoniae J138
cuacauguaaagcaag

SEQ ID NO: 537953 - RNA, 14 nt, Chlamydophila pneumoniae J138
cuacaucugugauu

SEQ ID NO: 537954 - RNA, 14 nt, Chlamydophila pneumoniae J138
cuacaugcucaaga

SEQ ID NO: 537955 - RNA, 18 nt, Chlamydophila pneumoniae J138
cuacagagggaauuucau

SEQ ID NO: 537956 - RNA, 22 nt, Chlamydophila pneumoniae J138
cuacacugguagcuaaauuuag

SEQ ID NO: 537957 - RNA, 21 nt, Chlamydophila pneumoniae J138
cuacacuguuguaauaaaauc

SEQ ID NO: 537958 - RNA, 21 nt, Chlamydophila pneumoniae J138
cuacagaaagagcuaaagaaa

SEQ ID NO: 537959 - RNA, 17 nt, Chlamydophila pneumoniae J138
cuacagaauaggaacaa

SEQ ID NO: 537960 - RNA, 15 nt, Chlamydophila pneumoniae J138
cuacaucagacugaa

SEQ ID NO: 537961 - RNA, 21 nt, Chlamydophila pneumoniae J138
cuacauaguuuuuauuuuuaa

SEQ ID NO: 537962 - RNA, 22 nt, Chlamydophila pneumoniae J138
cuacauaguuguucggacaaaa

SEQ ID NO: 537963 - RNA, 21 nt, Chlamydophila pneumoniae J138
cuacauauacguggcuuccau

SEQ ID NO: 537964 - RNA, 19 nt, Chlamydophila pneumoniae J138
cuacauaguuguucggaca

SEQ ID NO: 537965 - RNA, 16 nt, Chlamydophila pneumoniae J138
cuacauagauccccuu

SEQ ID NO: 537966 - RNA, 16 nt, Chlamydophila pneumoniae J138
cuacaggaauucucau

SEQ ID NO: 537967 - RNA, 16 nt, Chlamydophila pneumoniae J138
cuacagcuucuuuucc

SEQ ID NO: 537968 - RNA, 19 nt, Chlamydophila pneumoniae J138
cuacagcuucuuuuccagc

SEQ ID NO: 537969 - RNA, 21 nt, Chlamydophila pneumoniae J138
cuacaccaucuuuaaaaggcc

SEQ ID NO: 537970 - RNA, 22 nt, Chlamydophila pneumoniae J138
cuacaauuuccuugguauccca

SEQ ID NO: 537971 - RNA, 23 nt, Chlamydophila pneumoniae J138
cuacaaucgccuuacaauuuaaa

SEQ ID NO: 537972 - RNA, 13 nt, Chlamydophila pneumoniae J138
cuacaauacucug

SEQ ID NO: 537973 - RNA, 18 nt, Chlamydophila pneumoniae J138
cuacaaggucuuuuccug

SEQ ID NO: 537974 - RNA, 16 nt, Chlamydophila pneumoniae J138
cuacaaauuaccuuga

SEQ ID NO: 537975 - RNA, 17 nt, Chlamydophila pneumoniae J138
cuaauuuccuucaggau

SEQ ID NO: 537976 - RNA, 12 nt, Chlamydophila pneumoniae J138
cuaauuuccuuc

SEQ ID NO: 537977 - RNA, 22 nt, Chlamydophila pneumoniae J138
cuaauuuuaaauuuuguuuuuc

SEQ ID NO: 537978 - RNA, 15 nt, Chlamydophila pneumoniae J138
cuaauuuaaaugccu

SEQ ID NO: 537979 - RNA, 20 nt, Chlamydophila pneumoniae J138
cuacaaaauuauuaaacucg

SEQ ID NO: 537980 - RNA, 14 nt, Chlamydophila pneumoniae J138
cuaauuuuagaacu

SEQ ID NO: 537981 - RNA, 14 nt, Chlamydophila pneumoniae J138
cuaaauagaaaaca

SEQ ID NO: 537982 - RNA, 21 nt, Chlamydophila pneumoniae J138
cuaaauagaaaacauagagau

SEQ ID NO: 537983 - RNA, 21 nt, Chlamydophila pneumoniae J138
cuaaauauaucgcguguaaaa

SEQ ID NO: 537984 - RNA, 20 nt, Chlamydophila pneumoniae J138
cuaacuaucucuguuuuuug

SEQ ID NO: 537985 - RNA, 17 nt, Chlamydophila pneumoniae J138
cuaagauccugagacca

SEQ ID NO: 537986 - RNA, 17 nt, Chlamydophila pneumoniae J138
cuaagauaucuuguaca

SEQ ID NO: 537987 - RNA, 13 nt, Chlamydophila pneumoniae J138
cuaagacugucua

SEQ ID NO: 537988 - RNA, 23 nt, Chlamydophila pneumoniae J138
cuaagacuagaucgucaagcucu

SEQ ID NO: 537989 - RNA, 18 nt, Chlamydophila pneumoniae J138
cuaagguagcuagcguuu

SEQ ID NO: 537990 - RNA, 15 nt, Chlamydophila pneumoniae J138
cuaagaucuuuugua

SEQ ID NO: 537991 - RNA, 21 nt, Chlamydophila pneumoniae J138
cuaagaucuuuuguaaucguu

SEQ ID NO: 537992 - RNA, 15 nt, Chlamydophila pneumoniae J138
cuaagcaauauuucu

SEQ ID NO: 537993 - RNA, 13 nt, Chlamydophila pneumoniae J138
cuaagcaauauuu

SEQ ID NO: 537994 - RNA, 17 nt, Chlamydophila pneumoniae J138
cuaagcaaagcggcucu

SEQ ID NO: 537995 - RNA, 16 nt, Chlamydophila pneumoniae J138
cuaagcacaagaaucc

SEQ ID NO: 537996 - RNA, 19 nt, Chlamydophila pneumoniae J138
cuaagcagccucuucucua

SEQ ID NO: 537997 - RNA, 19 nt, Chlamydophila pneumoniae J138
cuaaggaaauuacaaucuc

SEQ ID NO: 537998 - RNA, 17 nt, Chlamydophila pneumoniae J138
cuaaguaaaacugcgcu

SEQ ID NO: 537999 - RNA, 13 nt, Chlamydophila pneumoniae J138
cuaaguaacaguc

SEQ ID NO: 538000 - RNA, 22 nt, Chlamydophila pneumoniae J138
cuaauaaaauuggcuuuugaga

SEQ ID NO: 538001 - RNA, 17 nt, Chlamydophila pneumoniae J138
cuaauaagauccaaaaa

SEQ ID NO: 538002 - RNA, 16 nt, Chlamydophila pneumoniae J138
cuaauaagauccaaaa

SEQ ID NO: 538003 - RNA, 19 nt, Chlamydophila pneumoniae J138
cuaaucacagcgucaggga

SEQ ID NO: 538004 - RNA, 14 nt, Chlamydophila pneumoniae J138
cuaauccagcaaca

SEQ ID NO: 538005 - RNA, 15 nt, Chlamydophila pneumoniae J138
cuaaucauuagaguu

SEQ ID NO: 538006 - RNA, 19 nt, Chlamydophila pneumoniae J138
cuaaucuaugaaguccuga

SEQ ID NO: 538007 - RNA, 21 nt, Chlamydophila pneumoniae J138
cuaccccacgcuaaacuaaaa

SEQ ID NO: 538008 - RNA, 18 nt, Chlamydophila pneumoniae J138
cuaccccacgcuaaacua

SEQ ID NO: 538009 - RNA, 18 nt, Chlamydophila pneumoniae J138
cuacccucaucauccuca

SEQ ID NO: 538010 - RNA, 13 nt, Chlamydophila pneumoniae J138
cuacuuacaagaa

SEQ ID NO: 538011 - RNA, 19 nt, Chlamydophila pneumoniae J138
cuacuuaaauccuaagcau

SEQ ID NO: 538012 - RNA, 19 nt, Chlamydophila pneumoniae J138
cuagaaucacauaaaauaa

SEQ ID NO: 538013 - RNA, 20 nt, Chlamydophila pneumoniae J138
cuagaaucaccaauuuuuuc

SEQ ID NO: 538014 - RNA, 23 nt, Chlamydophila pneumoniae J138
cuagaaucaccaauuuuuucccc

SEQ ID NO: 538015 - RNA, 20 nt, Chlamydophila pneumoniae J138
cuagaauaccguuuuaggaa

SEQ ID NO: 538016 - RNA, 17 nt, Chlamydophila pneumoniae J138
cuagaaucacauaaaau

SEQ ID NO: 538017 - RNA, 16 nt, Chlamydophila pneumoniae J138
cuagaauggcguaaua

SEQ ID NO: 538018 - RNA, 14 nt, Chlamydophila pneumoniae J138
cuagacagccuuga

SEQ ID NO: 538019 - RNA, 14 nt, Chlamydophila pneumoniae J138
cuagaccaauaaau

SEQ ID NO: 538020 - RNA, 17 nt, Chlamydophila pneumoniae J138
cuagaccugccaagaua

SEQ ID NO: 538021 - RNA, 13 nt, Chlamydophila pneumoniae J138
cuacuuauuguuc

SEQ ID NO: 538022 - RNA, 19 nt, Chlamydophila pneumoniae J138
cuacuucaggaaauaauuu

SEQ ID NO: 538023 - RNA, 18 nt, Chlamydophila pneumoniae J138
cuacuucugcaggacugu

SEQ ID NO: 538024 - RNA, 15 nt, Chlamydophila pneumoniae J138
cuacuucuucuuuuc

SEQ ID NO: 538025 - RNA, 19 nt, Chlamydophila pneumoniae J138
cuacuugucugauuaguuc

SEQ ID NO: 538026 - RNA, 12 nt, Chlamydophila pneumoniae J138
cuacuuuaaagu

SEQ ID NO: 538027 - RNA, 17 nt, Chlamydophila pneumoniae J138
cuaguauuaagauagac

SEQ ID NO: 538028 - RNA, 23 nt, Chlamydophila pneumoniae J138
cuaguauuaagauagacucucac

SEQ ID NO: 538029 - RNA, 12 nt, Chlamydophila pneumoniae J138
cuagucuucuua

SEQ ID NO: 538030 - RNA, 20 nt, Chlamydophila pneumoniae J138
cuaggguuucuacaggauau

SEQ ID NO: 538031 - RNA, 15 nt, Chlamydophila pneumoniae J138
cuagguauuuguuuc

SEQ ID NO: 538032 - RNA, 22 nt, Chlamydophila pneumoniae J138
cuagagaguucuuguaauaaaa

SEQ ID NO: 538033 - RNA, 13 nt, Chlamydophila pneumoniae J138
cuagaucacaaga

SEQ ID NO: 538034 - RNA, 19 nt, Chlamydophila pneumoniae J138
cuagcuuucuuggagaaga

SEQ ID NO: 538035 - RNA, 23 nt, Chlamydophila pneumoniae J138
cuagcuuugucucuauagugcau

SEQ ID NO: 538036 - RNA, 14 nt, Chlamydophila pneumoniae J138
cuagcuuuuuuuau

SEQ ID NO: 538037 - RNA, 19 nt, Chlamydophila pneumoniae J138
cuagggaucccaaaaaaug

SEQ ID NO: 538038 - RNA, 23 nt, Chlamydophila pneumoniae J138
cuaggcugagacauauugaagau

SEQ ID NO: 538039 - RNA, 20 nt, Chlamydophila pneumoniae J138
cuaucagcuggguaagucca

SEQ ID NO: 538040 - RNA, 20 nt, Chlamydophila pneumoniae J138
cuaucaucaaugguuaaaac

SEQ ID NO: 538041 - RNA, 17 nt, Chlamydophila pneumoniae J138
cuaucccacuaacaaga

SEQ ID NO: 538042 - RNA, 19 nt, Chlamydophila pneumoniae J138
cuauagaucuugaaaagau

SEQ ID NO: 538043 - RNA, 23 nt, Chlamydophila pneumoniae J138
cuauagauacuuugcaauacacc

SEQ ID NO: 538044 - RNA, 15 nt, Chlamydophila pneumoniae J138
cuauagagacacgaa

SEQ ID NO: 538045 - RNA, 19 nt, Chlamydophila pneumoniae J138
cuaguuuuucuuuagagau

SEQ ID NO: 538046 - RNA, 12 nt, Chlamydophila pneumoniae J138
cuaguuuuucuu

SEQ ID NO: 538047 - RNA, 14 nt, Chlamydophila pneumoniae J138
cuaguucuucuuua

SEQ ID NO: 538048 - RNA, 22 nt, Chlamydophila pneumoniae J138
cuauaguauaauagugagcucc

SEQ ID NO: 538049 - RNA, 13 nt, Chlamydophila pneumoniae J138
cuauagggaucuc

SEQ ID NO: 538050 - RNA, 18 nt, Chlamydophila pneumoniae J138
cuauaggaagcucuucua

SEQ ID NO: 538051 - RNA, 20 nt, Chlamydophila pneumoniae J138
cuauagggaucuccuugaga

SEQ ID NO: 538052 - RNA, 17 nt, Chlamydophila pneumoniae J138
cuauagcuggaucuucu

SEQ ID NO: 538053 - RNA, 15 nt, Chlamydophila pneumoniae J138
cuauagccucuucua

SEQ ID NO: 538054 - RNA, 17 nt, Chlamydophila pneumoniae J138
cuauagccucuucuaca

SEQ ID NO: 538055 - RNA, 17 nt, Chlamydophila pneumoniae J138
cuauagauugguaagga

SEQ ID NO: 538056 - RNA, 19 nt, Chlamydophila pneumoniae J138
cuaugcgcucuaagagccc

SEQ ID NO: 538057 - RNA, 15 nt, Chlamydophila pneumoniae J138
cuaugcacaaaauaa

SEQ ID NO: 538058 - RNA, 16 nt, Chlamydophila pneumoniae J138
cuaugcacaaaauaaa

SEQ ID NO: 538059 - RNA, 12 nt, Chlamydophila pneumoniae J138
cuaucuccagaa

SEQ ID NO: 538060 - RNA, 22 nt, Chlamydophila pneumoniae J138
cuauuagcgcggucacuucaau

SEQ ID NO: 538061 - RNA, 14 nt, Chlamydophila pneumoniae J138
cuauguuuaaagca

SEQ ID NO: 538062 - RNA, 15 nt, Chlamydophila pneumoniae J138
cuauguguuuccuuu

SEQ ID NO: 538063 - RNA, 22 nt, Chlamydophila pneumoniae J138
cuauucuauacgcuuaacauga

SEQ ID NO: 538064 - RNA, 20 nt, Chlamydophila pneumoniae J138
cuauucucaaauuucaauaa

SEQ ID NO: 538065 - RNA, 13 nt, Chlamydophila pneumoniae J138
cucaaaucuuuca

SEQ ID NO: 538066 - RNA, 17 nt, Chlamydophila pneumoniae J138
cucaaaucuuucaagga

SEQ ID NO: 538067 - RNA, 20 nt, Chlamydophila pneumoniae J138
cucaagagcaugcuugagga

SEQ ID NO: 538068 - RNA, 21 nt, Chlamydophila pneumoniae J138
cucaagagcaugcuugaggaa

SEQ ID NO: 538069 - RNA, 17 nt, Chlamydophila pneumoniae J138
cucaagagcaugcuuga

SEQ ID NO: 538070 - RNA, 15 nt, Chlamydophila pneumoniae J138
cucaagaauaugaac

SEQ ID NO: 538071 - RNA, 22 nt, Chlamydophila pneumoniae J138
cucaagcgauuucgaaaaagcc

SEQ ID NO: 538072 - RNA, 23 nt, Chlamydophila pneumoniae J138
cucaacuuaaguugaccuuuuuc

SEQ ID NO: 538073 - RNA, 14 nt, Chlamydophila pneumoniae J138
cucacaaacaacag

SEQ ID NO: 538074 - RNA, 18 nt, Chlamydophila pneumoniae J138
cucacacgaauaauuaaa

SEQ ID NO: 538075 - RNA, 20 nt, Chlamydophila pneumoniae J138
cucacaaacaacagaaaugu

SEQ ID NO: 538076 - RNA, 15 nt, Chlamydophila pneumoniae J138
cucaaucaaauucaa

SEQ ID NO: 538077 - RNA, 19 nt, Chlamydophila pneumoniae J138
cucaauaguguaacauuga

SEQ ID NO: 538078 - RNA, 14 nt, Chlamydophila pneumoniae J138
cucaauacuucagg

SEQ ID NO: 538079 - RNA, 15 nt, Chlamydophila pneumoniae J138
cucaauacuucagga

SEQ ID NO: 538080 - RNA, 14 nt, Chlamydophila pneumoniae J138
cucacuagagauuc

SEQ ID NO: 538081 - RNA, 19 nt, Chlamydophila pneumoniae J138
cucaugcggacuuuauucu

SEQ ID NO: 538082 - RNA, 20 nt, Chlamydophila pneumoniae J138
cucaucuuugaacaacuccu

SEQ ID NO: 538083 - RNA, 16 nt, Chlamydophila pneumoniae J138
cucauccccucagaaa

SEQ ID NO: 538084 - RNA, 21 nt, Chlamydophila pneumoniae J138
cucaugaaauuucauucucac

SEQ ID NO: 538085 - RNA, 17 nt, Chlamydophila pneumoniae J138
cucaugaaauuuucuaa

SEQ ID NO: 538086 - RNA, 13 nt, Chlamydophila pneumoniae J138
cucaugaagaauu

SEQ ID NO: 538087 - RNA, 21 nt, Chlamydophila pneumoniae J138
cucaugaagaauuaccgcgag

SEQ ID NO: 538088 - RNA, 14 nt, Chlamydophila pneumoniae J138
cucaucaucagaaa

SEQ ID NO: 538089 - RNA, 21 nt, Chlamydophila pneumoniae J138
cucaucaguaaaagacugaaa

SEQ ID NO: 538090 - RNA, 17 nt, Chlamydophila pneumoniae J138
cuccaaaauaaucucgc

SEQ ID NO: 538091 - RNA, 23 nt, Chlamydophila pneumoniae J138
cuccaaaauaaucucgcaguccu

SEQ ID NO: 538092 - RNA, 15 nt, Chlamydophila pneumoniae J138
cuccaaaauauucuu

SEQ ID NO: 538093 - RNA, 21 nt, Chlamydophila pneumoniae J138
cuccaaacauuuuuaaggaaa

SEQ ID NO: 538094 - RNA, 22 nt, Chlamydophila pneumoniae J138
cucauugcggcaccaaagaugc

SEQ ID NO: 538095 - RNA, 15 nt, Chlamydophila pneumoniae J138
cucauugcggcacca

SEQ ID NO: 538096 - RNA, 18 nt, Chlamydophila pneumoniae J138
cucauuccagcaucuucu

SEQ ID NO: 538097 - RNA, 19 nt, Chlamydophila pneumoniae J138
cucauuccagcaucuucuc

SEQ ID NO: 538098 - RNA, 20 nt, Chlamydophila pneumoniae J138
cuccaacuuccauaugaggu

SEQ ID NO: 538099 - RNA, 13 nt, Chlamydophila pneumoniae J138
cuccaacagucug

SEQ ID NO: 538100 - RNA, 17 nt, Chlamydophila pneumoniae J138
cuccaaauguucucucc

SEQ ID NO: 538101 - RNA, 11 nt, Chlamydophila pneumoniae J138
cuccaaauaaa

SEQ ID NO: 538102 - RNA, 14 nt, Chlamydophila pneumoniae J138
cuccaaacauuuuu

SEQ ID NO: 538103 - RNA, 20 nt, Chlamydophila pneumoniae J138
cuccaaacauuuuuaaggaa

SEQ ID NO: 538104 - RNA, 19 nt, Chlamydophila pneumoniae J138
cuccaagaauagcaggaag

SEQ ID NO: 538105 - RNA, 13 nt, Chlamydophila pneumoniae J138
cuccaaugggcag

SEQ ID NO: 538106 - RNA, 15 nt, Chlamydophila pneumoniae J138
cucauaacccaaagg

SEQ ID NO: 538107 - RNA, 12 nt, Chlamydophila pneumoniae J138
cucaguugagaa

SEQ ID NO: 538108 - RNA, 15 nt, Chlamydophila pneumoniae J138
cucaguguauuguuu

SEQ ID NO: 538109 - RNA, 23 nt, Chlamydophila pneumoniae J138
cucagugaacucuucaagagcuu

SEQ ID NO: 538110 - RNA, 16 nt, Chlamydophila pneumoniae J138
cucauagcuuccugua

SEQ ID NO: 538111 - RNA, 18 nt, Chlamydophila pneumoniae J138
cucacugagugucccaug

SEQ ID NO: 538112 - RNA, 15 nt, Chlamydophila pneumoniae J138
cucacucuuuucuag

SEQ ID NO: 538113 - RNA, 18 nt, Chlamydophila pneumoniae J138
cucagcguucgcucucuu

SEQ ID NO: 538114 - RNA, 15 nt, Chlamydophila pneumoniae J138
cucaggcuuuaagug

SEQ ID NO: 538115 - RNA, 21 nt, Chlamydophila pneumoniae J138
cuccaccaggagcuccuccuu

SEQ ID NO: 538116 - RNA, 19 nt, Chlamydophila pneumoniae J138
cuccaccaggagcuccucc

SEQ ID NO: 538117 - RNA, 12 nt, Chlamydophila pneumoniae J138
cuccaccagaag

SEQ ID NO: 538118 - RNA, 22 nt, Chlamydophila pneumoniae J138
cuccacaugcccaaacaucauu

SEQ ID NO: 538119 - RNA, 18 nt, Chlamydophila pneumoniae J138
cuccacaugcccaaacau

SEQ ID NO: 538120 - RNA, 19 nt, Chlamydophila pneumoniae J138
cuccacaggaaugaaaccu

SEQ ID NO: 538121 - RNA, 22 nt, Chlamydophila pneumoniae J138
cuccacagggucuaguucaauu

SEQ ID NO: 538122 - RNA, 15 nt, Chlamydophila pneumoniae J138
cuccacagcuucuuc

SEQ ID NO: 538123 - RNA, 13 nt, Chlamydophila pneumoniae J138
cuccgagaaacaa

SEQ ID NO: 538124 - RNA, 16 nt, Chlamydophila pneumoniae J138
cuccgauaugggcuuu

SEQ ID NO: 538125 - RNA, 20 nt, Chlamydophila pneumoniae J138
cucccguuccuuuagccugg

SEQ ID NO: 538126 - RNA, 23 nt, Chlamydophila pneumoniae J138
cucccgugagcaugcucacggga

SEQ ID NO: 538127 - RNA, 17 nt, Chlamydophila pneumoniae J138
cuccgaauggagaagga

SEQ ID NO: 538128 - RNA, 17 nt, Chlamydophila pneumoniae J138
cucccuaugccaguucc

SEQ ID NO: 538129 - RNA, 20 nt, Chlamydophila pneumoniae J138
cuccgucauauuuaaaaggc

SEQ ID NO: 538130 - RNA, 19 nt, Chlamydophila pneumoniae J138
cuccucagaauccauuuug

SEQ ID NO: 538131 - RNA, 19 nt, Chlamydophila pneumoniae J138
cuccguggcggauaaucaa

SEQ ID NO: 538132 - RNA, 23 nt, Chlamydophila pneumoniae J138
cuccgcuuuuacgaaugagauca

SEQ ID NO: 538133 - RNA, 19 nt, Chlamydophila pneumoniae J138
cuccgcuagaggaucuuca

SEQ ID NO: 538134 - RNA, 21 nt, Chlamydophila pneumoniae J138
cuccgcucuaagcugugcauu

SEQ ID NO: 538135 - RNA, 18 nt, Chlamydophila pneumoniae J138
cuccuccaaugagcucua

SEQ ID NO: 538136 - RNA, 17 nt, Chlamydophila pneumoniae J138
cuccucuaacuucauua

SEQ ID NO: 538137 - RNA, 12 nt, Chlamydophila pneumoniae J138
cuccucugcuaa

SEQ ID NO: 538138 - RNA, 15 nt, Chlamydophila pneumoniae J138
cuccucugcuaagca

SEQ ID NO: 538139 - RNA, 12 nt, Chlamydophila pneumoniae J138
cuccugaagcug

SEQ ID NO: 538140 - RNA, 20 nt, Chlamydophila pneumoniae J138
cuccugaagggacaaguacg

SEQ ID NO: 538141 - RNA, 21 nt, Chlamydophila pneumoniae J138
cuccugaagggacaaguacga

SEQ ID NO: 538142 - RNA, 23 nt, Chlamydophila pneumoniae J138
cuccugaagccaugacaaagggu

SEQ ID NO: 538143 - RNA, 18 nt, Chlamydophila pneumoniae J138
cuccugaagccaugacaa

SEQ ID NO: 538144 - RNA, 13 nt, Chlamydophila pneumoniae J138
cuccuggaagaau

SEQ ID NO: 538145 - RNA, 18 nt, Chlamydophila pneumoniae J138
cuccuuuguauucagugu

SEQ ID NO: 538146 - RNA, 17 nt, Chlamydophila pneumoniae J138
cuccuuugagucuuuuu

SEQ ID NO: 538147 - RNA, 13 nt, Chlamydophila pneumoniae J138
cucgaaacucuuu

SEQ ID NO: 538148 - RNA, 13 nt, Chlamydophila pneumoniae J138
cuccuucucccug

SEQ ID NO: 538149 - RNA, 16 nt, Chlamydophila pneumoniae J138
cuccuugauaaaacgc

SEQ ID NO: 538150 - RNA, 15 nt, Chlamydophila pneumoniae J138
cuccuucaaagauau

SEQ ID NO: 538151 - RNA, 13 nt, Chlamydophila pneumoniae J138
cuccuucagaguu

SEQ ID NO: 538152 - RNA, 19 nt, Chlamydophila pneumoniae J138
cuccuucauucacagcagu

SEQ ID NO: 538153 - RNA, 12 nt, Chlamydophila pneumoniae J138
cucgaaauccua

SEQ ID NO: 538154 - RNA, 18 nt, Chlamydophila pneumoniae J138
cucgaaccacuguccaug

SEQ ID NO: 538155 - RNA, 16 nt, Chlamydophila pneumoniae J138
cucgaagaaaauaaag

SEQ ID NO: 538156 - RNA, 12 nt, Chlamydophila pneumoniae J138
cucgaagaaaau

SEQ ID NO: 538157 - RNA, 19 nt, Chlamydophila pneumoniae J138
cucgaacucugaaguacac

SEQ ID NO: 538158 - RNA, 23 nt, Chlamydophila pneumoniae J138
cucgaauuguguguuuucauaaa

SEQ ID NO: 538159 - RNA, 17 nt, Chlamydophila pneumoniae J138
cucguuauauuuuucug

SEQ ID NO: 538160 - RNA, 21 nt, Chlamydophila pneumoniae J138
cucguguagaauucacucccu

SEQ ID NO: 538161 - RNA, 16 nt, Chlamydophila pneumoniae J138
cucuaagcgaaacauu

SEQ ID NO: 538162 - RNA, 12 nt, Chlamydophila pneumoniae J138
cucuaagacugu

SEQ ID NO: 538163 - RNA, 14 nt, Chlamydophila pneumoniae J138
cucuaagaggguuu

SEQ ID NO: 538164 - RNA, 14 nt, Chlamydophila pneumoniae J138
cucuaacuucauua

SEQ ID NO: 538165 - RNA, 21 nt, Chlamydophila pneumoniae J138
cucuaggaacucuuuaaaagg

SEQ ID NO: 538166 - RNA, 23 nt, Chlamydophila pneumoniae J138
cucuagccaauauagaagcugcu

SEQ ID NO: 538167 - RNA, 18 nt, Chlamydophila pneumoniae J138
cucuaauucuucuacaga

SEQ ID NO: 538168 - RNA, 20 nt, Chlamydophila pneumoniae J138
cucuagcaccuaauaaagaa

SEQ ID NO: 538169 - RNA, 16 nt, Chlamydophila pneumoniae J138
cucucaagucuauuug

SEQ ID NO: 538170 - RNA, 13 nt, Chlamydophila pneumoniae J138
cucucacugagug

SEQ ID NO: 538171 - RNA, 14 nt, Chlamydophila pneumoniae J138
cucucacugagugu

SEQ ID NO: 538172 - RNA, 17 nt, Chlamydophila pneumoniae J138
cucuauauauccugagu

SEQ ID NO: 538173 - RNA, 13 nt, Chlamydophila pneumoniae J138
cucuauagcauua

SEQ ID NO: 538174 - RNA, 15 nt, Chlamydophila pneumoniae J138
cucuagggguuuccc

SEQ ID NO: 538175 - RNA, 13 nt, Chlamydophila pneumoniae J138
cucuaguaagaaa

SEQ ID NO: 538176 - RNA, 19 nt, Chlamydophila pneumoniae J138
cucuagucuuucaaccucc

SEQ ID NO: 538177 - RNA, 13 nt, Chlamydophila pneumoniae J138
cucuaguuuuucu

SEQ ID NO: 538178 - RNA, 19 nt, Chlamydophila pneumoniae J138
cucucaguuaaagagcauc

SEQ ID NO: 538179 - RNA, 18 nt, Chlamydophila pneumoniae J138
cucuccagaagucgcagu

SEQ ID NO: 538180 - RNA, 13 nt, Chlamydophila pneumoniae J138
cucucaugaaauu

SEQ ID NO: 538181 - RNA, 19 nt, Chlamydophila pneumoniae J138
cucuccgauaugggcuuug

SEQ ID NO: 538182 - RNA, 12 nt, Chlamydophila pneumoniae J138
cucuccauggcu

SEQ ID NO: 538183 - RNA, 21 nt, Chlamydophila pneumoniae J138
cucuccacagggucuaguuca

SEQ ID NO: 538184 - RNA, 23 nt, Chlamydophila pneumoniae J138
cucuccacagggucuaguucaau

SEQ ID NO: 538185 - RNA, 20 nt, Chlamydophila pneumoniae J138
cucuccagcuguggugguga

SEQ ID NO: 538186 - RNA, 16 nt, Chlamydophila pneumoniae J138
cucuccagcuugauca

SEQ ID NO: 538187 - RNA, 15 nt, Chlamydophila pneumoniae J138
cucucccauguagua

SEQ ID NO: 538188 - RNA, 23 nt, Chlamydophila pneumoniae J138
cucuccuaaugccgagaauacag

SEQ ID NO: 538189 - RNA, 24 nt, Chlamydophila pneumoniae J138
cucuccuugacaaauaaguccugu

SEQ ID NO: 538190 - RNA, 13 nt, Chlamydophila pneumoniae J138
cucucuuccuucu

SEQ ID NO: 538191 - RNA, 14 nt, Chlamydophila pneumoniae J138
cucucuuccuucuc

SEQ ID NO: 538192 - RNA, 13 nt, Chlamydophila pneumoniae J138
cucucuuccugcu

SEQ ID NO: 538193 - RNA, 19 nt, Chlamydophila pneumoniae J138
cucucuuccugcugcuuug

SEQ ID NO: 538194 - RNA, 14 nt, Chlamydophila pneumoniae J138
cucucuucccccag

SEQ ID NO: 538195 - RNA, 13 nt, Chlamydophila pneumoniae J138
cucucuuccaaaa

SEQ ID NO: 538196 - RNA, 14 nt, Chlamydophila pneumoniae J138
cucucuuccaaaag

SEQ ID NO: 538197 - RNA, 14 nt, Chlamydophila pneumoniae J138
cucucuuaaauuua

SEQ ID NO: 538198 - RNA, 19 nt, Chlamydophila pneumoniae J138
cucucuguagcacuucuca

SEQ ID NO: 538199 - RNA, 16 nt, Chlamydophila pneumoniae J138
cucucuccaugagcuc

SEQ ID NO: 538200 - RNA, 12 nt, Chlamydophila pneumoniae J138
cucucucugcag

SEQ ID NO: 538201 - RNA, 15 nt, Chlamydophila pneumoniae J138
cucucugccuaccaa

SEQ ID NO: 538202 - RNA, 23 nt, Chlamydophila pneumoniae J138
cucucucaagucuauuugaaaag

SEQ ID NO: 538203 - RNA, 20 nt, Chlamydophila pneumoniae J138
cucucuaucuacacacauga

SEQ ID NO: 538204 - RNA, 15 nt, Chlamydophila pneumoniae J138
cucucuuuaaaaaua

SEQ ID NO: 538205 - RNA, 11 nt, Chlamydophila pneumoniae J138
cucucuucuuc

SEQ ID NO: 538206 - RNA, 20 nt, Chlamydophila pneumoniae J138
cucugaagaccccucuugcu

SEQ ID NO: 538207 - RNA, 23 nt, Chlamydophila pneumoniae J138
cucugaagaccccucuugcuuuu

SEQ ID NO: 538208 - RNA, 21 nt, Chlamydophila pneumoniae J138
cucugacuugcaagcuucuug

SEQ ID NO: 538209 - RNA, 15 nt, Chlamydophila pneumoniae J138
cucugagcagcuucg

SEQ ID NO: 538210 - RNA, 14 nt, Chlamydophila pneumoniae J138
cucugaccaucaau

SEQ ID NO: 538211 - RNA, 22 nt, Chlamydophila pneumoniae J138
cucugaccaucaaugagaucug

SEQ ID NO: 538212 - RNA, 19 nt, Chlamydophila pneumoniae J138
cucugccaugucuaaagga

SEQ ID NO: 538213 - RNA, 20 nt, Chlamydophila pneumoniae J138
cucugccaugucuaaaggag

SEQ ID NO: 538214 - RNA, 21 nt, Chlamydophila pneumoniae J138
cucugccaugucuaaaggagu

SEQ ID NO: 538215 - RNA, 13 nt, Chlamydophila pneumoniae J138
cucugcauauaaa

SEQ ID NO: 538216 - RNA, 12 nt, Chlamydophila pneumoniae J138
cucugcagggaa

SEQ ID NO: 538217 - RNA, 14 nt, Chlamydophila pneumoniae J138
cucugcagggaauc

SEQ ID NO: 538218 - RNA, 15 nt, Chlamydophila pneumoniae J138
cucugccuaccaaag

SEQ ID NO: 538219 - RNA, 19 nt, Chlamydophila pneumoniae J138
cucugguauagaaacaccg

SEQ ID NO: 538220 - RNA, 15 nt, Chlamydophila pneumoniae J138
cucuggaauacauuc

SEQ ID NO: 538221 - RNA, 15 nt, Chlamydophila pneumoniae J138
cucuuccuucuauug

SEQ ID NO: 538222 - RNA, 15 nt, Chlamydophila pneumoniae J138
cucuuccugcugcuu

SEQ ID NO: 538223 - RNA, 18 nt, Chlamydophila pneumoniae J138
cucuuccuucuacagauu

SEQ ID NO: 538224 - RNA, 15 nt, Chlamydophila pneumoniae J138
cucuucccuuguuau

SEQ ID NO: 538225 - RNA, 13 nt, Chlamydophila pneumoniae J138
cucuuccaaaagu

SEQ ID NO: 538226 - RNA, 19 nt, Chlamydophila pneumoniae J138
cucuucacuuauaagcugc

SEQ ID NO: 538227 - RNA, 23 nt, Chlamydophila pneumoniae J138
cucuuaucgugacucuuaucugg

SEQ ID NO: 538228 - RNA, 15 nt, Chlamydophila pneumoniae J138
cucuuauguuaaaaa

SEQ ID NO: 538229 - RNA, 16 nt, Chlamydophila pneumoniae J138
cucuuauugcagaauc

SEQ ID NO: 538230 - RNA, 12 nt, Chlamydophila pneumoniae J138
cucuuaacuggc

SEQ ID NO: 538231 - RNA, 20 nt, Chlamydophila pneumoniae J138
cucuuaaaugugaaaucgua

SEQ ID NO: 538232 - RNA, 14 nt, Chlamydophila pneumoniae J138
cucuuaauuaaaaa

SEQ ID NO: 538233 - RNA, 20 nt, Chlamydophila pneumoniae J138
cucuguaagaacguggggaa

SEQ ID NO: 538234 - RNA, 18 nt, Chlamydophila pneumoniae J138
cucuguaguaaagccaca

SEQ ID NO: 538235 - RNA, 18 nt, Chlamydophila pneumoniae J138
cucuguauuggaaaguau

SEQ ID NO: 538236 - RNA, 23 nt, Chlamydophila pneumoniae J138
cucuguagguuuuuccaacuuca

SEQ ID NO: 538237 - RNA, 23 nt, Chlamydophila pneumoniae J138
cucugugguuccuggauuuagga

SEQ ID NO: 538238 - RNA, 20 nt, Chlamydophila pneumoniae J138
cucugugccaucuguagacc

SEQ ID NO: 538239 - RNA, 20 nt, Chlamydophila pneumoniae J138
cucuguugggagcuuccucc

SEQ ID NO: 538240 - RNA, 22 nt, Chlamydophila pneumoniae J138
cucuguugggagcuuccuccaa

SEQ ID NO: 538241 - RNA, 15 nt, Chlamydophila pneumoniae J138
cucuuggaugaccuu

SEQ ID NO: 538242 - RNA, 20 nt, Chlamydophila pneumoniae J138
cucuugcgucacauuuguug

SEQ ID NO: 538243 - RNA, 19 nt, Chlamydophila pneumoniae J138
cucuuuaagcaagagcucc

SEQ ID NO: 538244 - RNA, 21 nt, Chlamydophila pneumoniae J138
cucuuuaacuucuaaaagcaa

SEQ ID NO: 538245 - RNA, 13 nt, Chlamydophila pneumoniae J138
cucuuuaaaaggg

SEQ ID NO: 538246 - RNA, 20 nt, Chlamydophila pneumoniae J138
cucuuuaaaaauagaaauaa

SEQ ID NO: 538247 - RNA, 22 nt, Chlamydophila pneumoniae J138
cucuuuaaaagggcgcuucccu

SEQ ID NO: 538248 - RNA, 16 nt, Chlamydophila pneumoniae J138
cucuuucagcucaagu

SEQ ID NO: 538249 - RNA, 14 nt, Chlamydophila pneumoniae J138
cucuuucagcucaa

SEQ ID NO: 538250 - RNA, 16 nt, Chlamydophila pneumoniae J138
cucuuuauauuuuuug

SEQ ID NO: 538251 - RNA, 23 nt, Chlamydophila pneumoniae J138
cucuuuauauuuuuugagaaaua

SEQ ID NO: 538252 - RNA, 20 nt, Chlamydophila pneumoniae J138
cucuuuauauuuuuugagaa

SEQ ID NO: 538253 - RNA, 15 nt, Chlamydophila pneumoniae J138
cucuucuuuggaugc

SEQ ID NO: 538254 - RNA, 16 nt, Chlamydophila pneumoniae J138
cucuugaauauuuaaa

SEQ ID NO: 538255 - RNA, 20 nt, Chlamydophila pneumoniae J138
cucuugauugcuaucaaaga

SEQ ID NO: 538256 - RNA, 14 nt, Chlamydophila pneumoniae J138
cucuugaggaccuu

SEQ ID NO: 538257 - RNA, 21 nt, Chlamydophila pneumoniae J138
cucuucgcuggcauguuuaau

SEQ ID NO: 538258 - RNA, 23 nt, Chlamydophila pneumoniae J138
cucuucuacuuuaagaagcacuu

SEQ ID NO: 538259 - RNA, 16 nt, Chlamydophila pneumoniae J138
cucuuucuaaaacauc

SEQ ID NO: 538260 - RNA, 21 nt, Chlamydophila pneumoniae J138
cucuuucuauagcuccuuggc

SEQ ID NO: 538261 - RNA, 16 nt, Chlamydophila pneumoniae J138
cucuuuccuuagcauu

SEQ ID NO: 538262 - RNA, 13 nt, Chlamydophila pneumoniae J138
cucuuuuaagaca

SEQ ID NO: 538263 - RNA, 12 nt, Chlamydophila pneumoniae J138
cucuuugaggau

SEQ ID NO: 538264 - RNA, 18 nt, Chlamydophila pneumoniae J138
cucuuuuagagccuuuuc

SEQ ID NO: 538265 - RNA, 17 nt, Chlamydophila pneumoniae J138
cugaaagaacacuccug

SEQ ID NO: 538266 - RNA, 20 nt, Chlamydophila pneumoniae J138
cugaaaccuucucucuuaaa

SEQ ID NO: 538267 - RNA, 22 nt, Chlamydophila pneumoniae J138
cugaaaaugauucauaacauug

SEQ ID NO: 538268 - RNA, 18 nt, Chlamydophila pneumoniae J138
cugaaauugucuucagug

SEQ ID NO: 538269 - RNA, 15 nt, Chlamydophila pneumoniae J138
cugaaauccugggca

SEQ ID NO: 538270 - RNA, 16 nt, Chlamydophila pneumoniae J138
cugaaauuaagucaca

SEQ ID NO: 538271 - RNA, 14 nt, Chlamydophila pneumoniae J138
cugaacgagguaac

SEQ ID NO: 538272 - RNA, 23 nt, Chlamydophila pneumoniae J138
cugaaccgcaaaaagcuucuuuc

SEQ ID NO: 538273 - RNA, 22 nt, Chlamydophila pneumoniae J138
cugaacuguucauaauccaaga

SEQ ID NO: 538274 - RNA, 17 nt, Chlamydophila pneumoniae J138
cugaacgccaucuccac

SEQ ID NO: 538275 - RNA, 20 nt, Chlamydophila pneumoniae J138
cugaagccaugacaaagggu

SEQ ID NO: 538276 - RNA, 16 nt, Chlamydophila pneumoniae J138
cugaagccaugacaaa

SEQ ID NO: 538277 - RNA, 21 nt, Chlamydophila pneumoniae J138
cugaagauauauuuuuaaaga

SEQ ID NO: 538278 - RNA, 21 nt, Chlamydophila pneumoniae J138
cugaagagcaauuaagaaacu

SEQ ID NO: 538279 - RNA, 19 nt, Chlamydophila pneumoniae J138
cugaagagcaauuaagaaa

SEQ ID NO: 538280 - RNA, 14 nt, Chlamydophila pneumoniae J138
cugaagaugagaaa

SEQ ID NO: 538281 - RNA, 19 nt, Chlamydophila pneumoniae J138
cugaagauggcaaggaaaa

SEQ ID NO: 538282 - RNA, 12 nt, Chlamydophila pneumoniae J138
cugaagcugcaa

SEQ ID NO: 538283 - RNA, 16 nt, Chlamydophila pneumoniae J138
cugaagggacagucuc

SEQ ID NO: 538284 - RNA, 20 nt, Chlamydophila pneumoniae J138
cugaagucagugcuucuugg

SEQ ID NO: 538285 - RNA, 22 nt, Chlamydophila pneumoniae J138
cugaauagcucuuuucaugaua

SEQ ID NO: 538286 - RNA, 16 nt, Chlamydophila pneumoniae J138
cugaauagcucuuuuc

SEQ ID NO: 538287 - RNA, 20 nt, Chlamydophila pneumoniae J138
cugaauauaguuuaaauguc

SEQ ID NO: 538288 - RNA, 18 nt, Chlamydophila pneumoniae J138
cugaauaugcuuuucaaa

SEQ ID NO: 538289 - RNA, 14 nt, Chlamydophila pneumoniae J138
cugaaucuuuuguu

SEQ ID NO: 538290 - RNA, 22 nt, Chlamydophila pneumoniae J138
cugacccuguagcgaagagagu

SEQ ID NO: 538291 - RNA, 18 nt, Chlamydophila pneumoniae J138
cugaccaucaaugagauc

SEQ ID NO: 538292 - RNA, 18 nt, Chlamydophila pneumoniae J138
cugacacucagcucccau

SEQ ID NO: 538293 - RNA, 17 nt, Chlamydophila pneumoniae J138
cugacacuccucagaau

SEQ ID NO: 538294 - RNA, 22 nt, Chlamydophila pneumoniae J138
cugacuauagggagacucuuga

SEQ ID NO: 538295 - RNA, 20 nt, Chlamydophila pneumoniae J138
cugacucuuauugcagaauc

SEQ ID NO: 538296 - RNA, 23 nt, Chlamydophila pneumoniae J138
cugacgugcauugaauccuucua

SEQ ID NO: 538297 - RNA, 21 nt, Chlamydophila pneumoniae J138
cugagaauacaacccuuuaua

SEQ ID NO: 538298 - RNA, 23 nt, Chlamydophila pneumoniae J138
cugagaauacaacccuuuauacu

SEQ ID NO: 538299 - RNA, 13 nt, Chlamydophila pneumoniae J138
cugagaauacaac

SEQ ID NO: 538300 - RNA, 15 nt, Chlamydophila pneumoniae J138
cugagaaagaagucc

SEQ ID NO: 538301 - RNA, 19 nt, Chlamydophila pneumoniae J138
cugagaccauaaaaucaac

SEQ ID NO: 538302 - RNA, 18 nt, Chlamydophila pneumoniae J138
cugagagaagcagaaucu

SEQ ID NO: 538303 - RNA, 17 nt, Chlamydophila pneumoniae J138
cugagagauuuuuucau

SEQ ID NO: 538304 - RNA, 19 nt, Chlamydophila pneumoniae J138
cugacuugcaagcuucuug

SEQ ID NO: 538305 - RNA, 15 nt, Chlamydophila pneumoniae J138
cugagaaguuaagac

SEQ ID NO: 538306 - RNA, 14 nt, Chlamydophila pneumoniae J138
cugaugccaagaaa

SEQ ID NO: 538307 - RNA, 16 nt, Chlamydophila pneumoniae J138
cugaugaccucaucuc

SEQ ID NO: 538308 - RNA, 17 nt, Chlamydophila pneumoniae J138
cugaugaccucaucucg

SEQ ID NO: 538309 - RNA, 20 nt, Chlamydophila pneumoniae J138
cugauuuuucaagaccuaag

SEQ ID NO: 538310 - RNA, 19 nt, Chlamydophila pneumoniae J138
cugcaaaaaguuucaaucu

SEQ ID NO: 538311 - RNA, 18 nt, Chlamydophila pneumoniae J138
cugauucuguauaaacaa

SEQ ID NO: 538312 - RNA, 22 nt, Chlamydophila pneumoniae J138
cugauucucccaauauccagaa

SEQ ID NO: 538313 - RNA, 19 nt, Chlamydophila pneumoniae J138
cugauucucccaauaucca

SEQ ID NO: 538314 - RNA, 12 nt, Chlamydophila pneumoniae J138
cugauucuccca

SEQ ID NO: 538315 - RNA, 13 nt, Chlamydophila pneumoniae J138
cugauucucccaa

SEQ ID NO: 538316 - RNA, 20 nt, Chlamydophila pneumoniae J138
cugauuauuucuaaaaaaua

SEQ ID NO: 538317 - RNA, 23 nt, Chlamydophila pneumoniae J138
cugauguaggugauauuuucuug

SEQ ID NO: 538318 - RNA, 23 nt, Chlamydophila pneumoniae J138
cugcacgaucgcgauaagaagcu

SEQ ID NO: 538319 - RNA, 20 nt, Chlamydophila pneumoniae J138
cugcacgaucgcgauaagaa

SEQ ID NO: 538320 - RNA, 16 nt, Chlamydophila pneumoniae J138
cugcagcagaugaaac

SEQ ID NO: 538321 - RNA, 14 nt, Chlamydophila pneumoniae J138
cugcacaguucaca

SEQ ID NO: 538322 - RNA, 20 nt, Chlamydophila pneumoniae J138
cugcauaaucucaccagaag

SEQ ID NO: 538323 - RNA, 15 nt, Chlamydophila pneumoniae J138
cugcauaauuuuucu

SEQ ID NO: 538324 - RNA, 14 nt, Chlamydophila pneumoniae J138
cugcauauaaagac

SEQ ID NO: 538325 - RNA, 16 nt, Chlamydophila pneumoniae J138
cugcagcguuucuagg

SEQ ID NO: 538326 - RNA, 13 nt, Chlamydophila pneumoniae J138
cugcaugaauaua

SEQ ID NO: 538327 - RNA, 14 nt, Chlamydophila pneumoniae J138
cugcccuucggacu

SEQ ID NO: 538328 - RNA, 16 nt, Chlamydophila pneumoniae J138
cugcccccuguuugaa

SEQ ID NO: 538329 - RNA, 22 nt, Chlamydophila pneumoniae J138
cugcgacacgaauuucuaacuu

SEQ ID NO: 538330 - RNA, 19 nt, Chlamydophila pneumoniae J138
cugcgacuacaagauagug

SEQ ID NO: 538331 - RNA, 15 nt, Chlamydophila pneumoniae J138
cugccuuaugcucau

SEQ ID NO: 538332 - RNA, 16 nt, Chlamydophila pneumoniae J138
cugcgcuaucaucauu

SEQ ID NO: 538333 - RNA, 18 nt, Chlamydophila pneumoniae J138
cugcgcuaucaucauuuc

SEQ ID NO: 538334 - RNA, 19 nt, Chlamydophila pneumoniae J138
cugcgucaauaagcuugcc

SEQ ID NO: 538335 - RNA, 20 nt, Chlamydophila pneumoniae J138
cugcgucaauaagcuugcca

SEQ ID NO: 538336 - RNA, 17 nt, Chlamydophila pneumoniae J138
cugcgucaauaagcuug

SEQ ID NO: 538337 - RNA, 16 nt, Chlamydophila pneumoniae J138
cugcugacaucuccaa

SEQ ID NO: 538338 - RNA, 11 nt, Chlamydophila pneumoniae J138
cugcuccugaa

SEQ ID NO: 538339 - RNA, 21 nt, Chlamydophila pneumoniae J138
cugcuguguuauggaaaucac

SEQ ID NO: 538340 - RNA, 12 nt, Chlamydophila pneumoniae J138
cugcugcuacga

SEQ ID NO: 538341 - RNA, 17 nt, Chlamydophila pneumoniae J138
cugcugccaugcagccu

SEQ ID NO: 538342 - RNA, 13 nt, Chlamydophila pneumoniae J138
cugcugaggagag

SEQ ID NO: 538343 - RNA, 15 nt, Chlamydophila pneumoniae J138
cugcugagcagcaaa

SEQ ID NO: 538344 - RNA, 23 nt, Chlamydophila pneumoniae J138
cugcugaggagaguaaggucauu

SEQ ID NO: 538345 - RNA, 15 nt, Chlamydophila pneumoniae J138
cugcugauccaaaag

SEQ ID NO: 538346 - RNA, 13 nt, Chlamydophila pneumoniae J138
cuggccaucauca

SEQ ID NO: 538347 - RNA, 17 nt, Chlamydophila pneumoniae J138
cugcuucuauagagaca

SEQ ID NO: 538348 - RNA, 18 nt, Chlamydophila pneumoniae J138
cuggauugauccacagau

SEQ ID NO: 538349 - RNA, 19 nt, Chlamydophila pneumoniae J138
cuggauuucuucuguuuuc

SEQ ID NO: 538350 - RNA, 16 nt, Chlamydophila pneumoniae J138
cuggauuuuaaagcaa

SEQ ID NO: 538351 - RNA, 14 nt, Chlamydophila pneumoniae J138
cuggcugagagaag

SEQ ID NO: 538352 - RNA, 20 nt, Chlamydophila pneumoniae J138
cuggcuaaaggaucauuaaa

SEQ ID NO: 538353 - RNA, 19 nt, Chlamydophila pneumoniae J138
cugggaaggggagauuccc

SEQ ID NO: 538354 - RNA, 15 nt, Chlamydophila pneumoniae J138
cugggaagacucuca

SEQ ID NO: 538355 - RNA, 23 nt, Chlamydophila pneumoniae J138
cugggaagaccacgaaauguuaa

SEQ ID NO: 538356 - RNA, 14 nt, Chlamydophila pneumoniae J138
cugggauucguaau

SEQ ID NO: 538357 - RNA, 16 nt, Chlamydophila pneumoniae J138
cugggcgucuucuucg

SEQ ID NO: 538358 - RNA, 22 nt, Chlamydophila pneumoniae J138
cugggggacuucaaaugaaauu

SEQ ID NO: 538359 - RNA, 16 nt, Chlamydophila pneumoniae J138
cuggggcuuccagaaa

SEQ ID NO: 538360 - RNA, 19 nt, Chlamydophila pneumoniae J138
cugguaaaggauauugaua

SEQ ID NO: 538361 - RNA, 21 nt, Chlamydophila pneumoniae J138
cuggguucuccacaugcccaa

SEQ ID NO: 538362 - RNA, 22 nt, Chlamydophila pneumoniae J138
cuguagaaacauuuaagucauu

SEQ ID NO: 538363 - RNA, 21 nt, Chlamydophila pneumoniae J138
cuguagagcgcccgaaucuuu

SEQ ID NO: 538364 - RNA, 20 nt, Chlamydophila pneumoniae J138
cuguagauuuucccuaagag

SEQ ID NO: 538365 - RNA, 13 nt, Chlamydophila pneumoniae J138
cuguagauuuucc

SEQ ID NO: 538366 - RNA, 12 nt, Chlamydophila pneumoniae J138
cuguaagaaaau

SEQ ID NO: 538367 - RNA, 16 nt, Chlamydophila pneumoniae J138
cuguacgguaaaucca

SEQ ID NO: 538368 - RNA, 21 nt, Chlamydophila pneumoniae J138
cuguaucgauaguuuuugcug

SEQ ID NO: 538369 - RNA, 21 nt, Chlamydophila pneumoniae J138
cugucauuaaaaauuuaaaag

SEQ ID NO: 538370 - RNA, 20 nt, Chlamydophila pneumoniae J138
cugucauguauccgaaaucu

SEQ ID NO: 538371 - RNA, 15 nt, Chlamydophila pneumoniae J138
cuguccauccaaaua

SEQ ID NO: 538372 - RNA, 16 nt, Chlamydophila pneumoniae J138
cuguaucgacuguaca

SEQ ID NO: 538373 - RNA, 17 nt, Chlamydophila pneumoniae J138
cuguauagaaacuguua

SEQ ID NO: 538374 - RNA, 21 nt, Chlamydophila pneumoniae J138
cugugauagguagcagcccgc

SEQ ID NO: 538375 - RNA, 16 nt, Chlamydophila pneumoniae J138
cugugaggaaaauucc

SEQ ID NO: 538376 - RNA, 16 nt, Chlamydophila pneumoniae J138
cugugaaaauuuucuu

SEQ ID NO: 538377 - RNA, 20 nt, Chlamydophila pneumoniae J138
cugugcauuuucuucuugca

SEQ ID NO: 538378 - RNA, 22 nt, Chlamydophila pneumoniae J138
cugugauuuccugacuauaaaa

SEQ ID NO: 538379 - RNA, 17 nt, Chlamydophila pneumoniae J138
cuguucauaauccaaga

SEQ ID NO: 538380 - RNA, 13 nt, Chlamydophila pneumoniae J138
cuguguuuuuagg

SEQ ID NO: 538381 - RNA, 16 nt, Chlamydophila pneumoniae J138
cuguguuuuauccacc

SEQ ID NO: 538382 - RNA, 23 nt, Chlamydophila pneumoniae J138
cuguguuuuauccaccaagacug

SEQ ID NO: 538383 - RNA, 22 nt, Chlamydophila pneumoniae J138
cuguggcauacucuuugcagug

SEQ ID NO: 538384 - RNA, 14 nt, Chlamydophila pneumoniae J138
cugugguauacauc

SEQ ID NO: 538385 - RNA, 14 nt, Chlamydophila pneumoniae J138
cugugguuccugga

SEQ ID NO: 538386 - RNA, 16 nt, Chlamydophila pneumoniae J138
cugugguuccuggauu

SEQ ID NO: 538387 - RNA, 21 nt, Chlamydophila pneumoniae J138
cuguguaaaaguuagguagau

SEQ ID NO: 538388 - RNA, 13 nt, Chlamydophila pneumoniae J138
cuguguaugaauc

SEQ ID NO: 538389 - RNA, 11 nt, Chlamydophila pneumoniae J138
cuucucagaaa

SEQ ID NO: 538390 - RNA, 11 nt, Chlamydophila pneumoniae J138
cuucucaaaga

SEQ ID NO: 538391 - RNA, 19 nt, Chlamydophila pneumoniae J138
cuucucaagaucuucauca

SEQ ID NO: 538392 - RNA, 18 nt, Chlamydophila pneumoniae J138
cuucucaagaucuucauc

SEQ ID NO: 538393 - RNA, 18 nt, Chlamydophila pneumoniae J138
cuucuuucugcucuucua

SEQ ID NO: 538394 - RNA, 20 nt, Chlamydophila pneumoniae J138
cuucuuuccauagaucccua

SEQ ID NO: 538395 - RNA, 14 nt, Chlamydophila pneumoniae J138
cuucuuucuugcuc

SEQ ID NO: 538396 - RNA, 20 nt, Chlamydophila pneumoniae J138
cuugacacaggagguucauu

SEQ ID NO: 538397 - RNA, 22 nt, Chlamydophila pneumoniae J138
cuugacacaggagguucauucu

SEQ ID NO: 538398 - RNA, 15 nt, Chlamydophila pneumoniae J138
cuugaaguucuucaa

SEQ ID NO: 538399 - RNA, 22 nt, Chlamydophila pneumoniae J138
cuugaucaggauggucauacca

SEQ ID NO: 538400 - RNA, 17 nt, Chlamydophila pneumoniae J138
cuugauauuguucuucc

SEQ ID NO: 538401 - RNA, 18 nt, Chlamydophila pneumoniae J138
cuugauauuguucuucca

SEQ ID NO: 538402 - RNA, 17 nt, Chlamydophila pneumoniae J138
cuugagaaaagaacagg

SEQ ID NO: 538403 - RNA, 21 nt, Chlamydophila pneumoniae J138
cuugagagauauagcguacag

SEQ ID NO: 538404 - RNA, 22 nt, Chlamydophila pneumoniae J138
cuugacucuaauucagaaagac

SEQ ID NO: 538405 - RNA, 16 nt, Chlamydophila pneumoniae J138
cuugacucuaauucag

SEQ ID NO: 538406 - RNA, 18 nt, Chlamydophila pneumoniae J138
cuugagaaaagaacaggg

SEQ ID NO: 538407 - RNA, 17 nt, Chlamydophila pneumoniae J138
cuugauccuuuccaaga

SEQ ID NO: 538408 - RNA, 21 nt, Chlamydophila pneumoniae J138
cuugaucuacaaaaacuagaa

SEQ ID NO: 538409 - RNA, 19 nt, Chlamydophila pneumoniae J138
cuugauuuuaaaaugaccg

SEQ ID NO: 538410 - RNA, 24 nt, Chlamydophila pneumoniae J138
cuugcaaaacagcaucaggauucu

SEQ ID NO: 538411 - RNA, 14 nt, Chlamydophila pneumoniae J138
cuugauuugggaug

SEQ ID NO: 538412 - RNA, 17 nt, Chlamydophila pneumoniae J138
cuugcaaggagcuuuuc

SEQ ID NO: 538413 - RNA, 16 nt, Chlamydophila pneumoniae J138
cuugccagcagaaguu

SEQ ID NO: 538414 - RNA, 15 nt, Chlamydophila pneumoniae J138
cuugccaaucuuccu

SEQ ID NO: 538415 - RNA, 18 nt, Chlamydophila pneumoniae J138
cuugccaguauugauaau

SEQ ID NO: 538416 - RNA, 20 nt, Chlamydophila pneumoniae J138
cuugcugauuucuuuuucag

SEQ ID NO: 538417 - RNA, 20 nt, Chlamydophila pneumoniae J138
cuugcugauuuuugcuaaga

SEQ ID NO: 538418 - RNA, 13 nt, Chlamydophila pneumoniae J138
cuugcgcagcuuc

SEQ ID NO: 538419 - RNA, 18 nt, Chlamydophila pneumoniae J138
cuugcugauuucuuuuuc

SEQ ID NO: 538420 - RNA, 23 nt, Chlamydophila pneumoniae J138
cuugcgauacaauaaacaacgau

SEQ ID NO: 538421 - RNA, 18 nt, Chlamydophila pneumoniae J138
cuuggauuucuucuucua

SEQ ID NO: 538422 - RNA, 13 nt, Chlamydophila pneumoniae J138
cuuggauuucuuc

SEQ ID NO: 538423 - RNA, 16 nt, Chlamydophila pneumoniae J138
cuuggauuucuucuuc

SEQ ID NO: 538424 - RNA, 16 nt, Chlamydophila pneumoniae J138
cuuggcucuagaaaua

SEQ ID NO: 538425 - RNA, 13 nt, Chlamydophila pneumoniae J138
cuuguagcaauua

SEQ ID NO: 538426 - RNA, 18 nt, Chlamydophila pneumoniae J138
cuuguauuguacuuuuug

SEQ ID NO: 538427 - RNA, 14 nt, Chlamydophila pneumoniae J138
cuuguauuguacuu

SEQ ID NO: 538428 - RNA, 16 nt, Chlamydophila pneumoniae J138
cuuguauaagagcaag

SEQ ID NO: 538429 - RNA, 13 nt, Chlamydophila pneumoniae J138
cuuggucgcaagg

SEQ ID NO: 538430 - RNA, 18 nt, Chlamydophila pneumoniae J138
cuugguguauaguauuuu

SEQ ID NO: 538431 - RNA, 23 nt, Chlamydophila pneumoniae J138
cuugguguauaguauuuuuaaau

SEQ ID NO: 538432 - RNA, 18 nt, Chlamydophila pneumoniae J138
cuuuaagguugcuuuucu

SEQ ID NO: 538433 - RNA, 15 nt, Chlamydophila pneumoniae J138
cuugucuaggagcuu

SEQ ID NO: 538434 - RNA, 19 nt, Chlamydophila pneumoniae J138
cuuuaaguguuucuucaua

SEQ ID NO: 538435 - RNA, 21 nt, Chlamydophila pneumoniae J138
cuugucuuccacgaaggaauc

SEQ ID NO: 538436 - RNA, 17 nt, Chlamydophila pneumoniae J138
cuuuagaaaagugcccu

SEQ ID NO: 538437 - RNA, 21 nt, Chlamydophila pneumoniae J138
cuuuacuucggaugagaucca

SEQ ID NO: 538438 - RNA, 23 nt, Chlamydophila pneumoniae J138
cuuuagaaauuccaauuuuugca

SEQ ID NO: 538439 - RNA, 16 nt, Chlamydophila pneumoniae J138
cuuuagcaaucucuuu

SEQ ID NO: 538440 - RNA, 22 nt, Chlamydophila pneumoniae J138
cuuuagagacgcuuuuaucugu

SEQ ID NO: 538441 - RNA, 14 nt, Chlamydophila pneumoniae J138
cuuuagcugcugaa

SEQ ID NO: 538442 - RNA, 13 nt, Chlamydophila pneumoniae J138
cuuucagaaagaa

SEQ ID NO: 538443 - RNA, 11 nt, Chlamydophila pneumoniae J138
cuuucaaggaa

SEQ ID NO: 538444 - RNA, 10 nt, Chlamydophila pneumoniae J138
cuuucaaagg

SEQ ID NO: 538445 - RNA, 22 nt, Chlamydophila pneumoniae J138
cuuucaaaagaaaucaaacauu

SEQ ID NO: 538446 - RNA, 19 nt, Chlamydophila pneumoniae J138
cuuuaugaucucccgugag

SEQ ID NO: 538447 - RNA, 17 nt, Chlamydophila pneumoniae J138
cuuuagggaauccccaa

SEQ ID NO: 538448 - RNA, 17 nt, Chlamydophila pneumoniae J138
cuuuauacuguuuuucu

SEQ ID NO: 538449 - RNA, 20 nt, Chlamydophila pneumoniae J138
cuuuauacuguuuuucuucc

SEQ ID NO: 538450 - RNA, 19 nt, Chlamydophila pneumoniae J138
cuuucuaagaauucuuugc

SEQ ID NO: 538451 - RNA, 19 nt, Chlamydophila pneumoniae J138
cuuucugauuuaaaagguu

SEQ ID NO: 538452 - RNA, 23 nt, Chlamydophila pneumoniae J138
cuuugaagcucgaccucuagcuc

SEQ ID NO: 538453 - RNA, 19 nt, Chlamydophila pneumoniae J138
cuuugaagcucgaccucua

SEQ ID NO: 538454 - RNA, 16 nt, Chlamydophila pneumoniae J138
cuuugaauaaugcauc

SEQ ID NO: 538455 - RNA, 17 nt, Chlamydophila pneumoniae J138
cuuucuuauuacagaaa

SEQ ID NO: 538456 - RNA, 14 nt, Chlamydophila pneumoniae J138
cuuugaguagccag

SEQ ID NO: 538457 - RNA, 19 nt, Chlamydophila pneumoniae J138
cuuugaguaggguguauuc

SEQ ID NO: 538458 - RNA, 14 nt, Chlamydophila pneumoniae J138
cuuugagucuuuuu

SEQ ID NO: 538459 - RNA, 19 nt, Chlamydophila pneumoniae J138
cuuugaggcaagucucaaa

SEQ ID NO: 538460 - RNA, 20 nt, Chlamydophila pneumoniae J138
cuuugaggauacgaauaagu

SEQ ID NO: 538461 - RNA, 21 nt, Chlamydophila pneumoniae J138
cuuugaccagaugauuuuuug

SEQ ID NO: 538462 - RNA, 16 nt, Chlamydophila pneumoniae J138
cuuugacaucuaauuu

SEQ ID NO: 538463 - RNA, 19 nt, Chlamydophila pneumoniae J138
cuuugaauuuccaaaggaa

SEQ ID NO: 538464 - RNA, 17 nt, Chlamydophila pneumoniae J138
cuuugaucgcuugugca

SEQ ID NO: 538465 - RNA, 14 nt, Chlamydophila pneumoniae J138
cuuugcaugaggag

SEQ ID NO: 538466 - RNA, 21 nt, Chlamydophila pneumoniae J138
cuuugcaugaggagaccuuua

SEQ ID NO: 538467 - RNA, 16 nt, Chlamydophila pneumoniae J138
cuuugccaacagcugg

SEQ ID NO: 538468 - RNA, 20 nt, Chlamydophila pneumoniae J138
cuuugccaacagcugggauc

SEQ ID NO: 538469 - RNA, 15 nt, Chlamydophila pneumoniae J138
cuuugccaaggaccu

SEQ ID NO: 538470 - RNA, 15 nt, Chlamydophila pneumoniae J138
cuuugcuuaaaaagu

SEQ ID NO: 538471 - RNA, 19 nt, Chlamydophila pneumoniae J138
cuuugcuggagacaacuau

SEQ ID NO: 538472 - RNA, 14 nt, Chlamydophila pneumoniae J138
cuuugcuuauuucc

SEQ ID NO: 538473 - RNA, 19 nt, Chlamydophila pneumoniae J138
cuuaacaaccgccuuuaua

SEQ ID NO: 538474 - RNA, 20 nt, Chlamydophila pneumoniae J138
cuuaacaacaucacuuauau

SEQ ID NO: 538475 - RNA, 17 nt, Chlamydophila pneumoniae J138
cuguucccacuaagaau

SEQ ID NO: 538476 - RNA, 12 nt, Chlamydophila pneumoniae J138
cuuaaauccuaa

SEQ ID NO: 538477 - RNA, 22 nt, Chlamydophila pneumoniae J138
cuuaacuggcaaucuaaaauca

SEQ ID NO: 538478 - RNA, 16 nt, Chlamydophila pneumoniae J138
cuuaacgcuuagagaa

SEQ ID NO: 538479 - RNA, 15 nt, Chlamydophila pneumoniae J138
cuuaagauacuucuc

SEQ ID NO: 538480 - RNA, 22 nt, Chlamydophila pneumoniae J138
cuuaacuuuaggcccugacuua

SEQ ID NO: 538481 - RNA, 15 nt, Chlamydophila pneumoniae J138
cuuaaggaaauguag

SEQ ID NO: 538482 - RNA, 17 nt, Chlamydophila pneumoniae J138
cuuaagcucuaagucca

SEQ ID NO: 538483 - RNA, 20 nt, Chlamydophila pneumoniae J138
cuuaaugagaguuucuaaug

SEQ ID NO: 538484 - RNA, 15 nt, Chlamydophila pneumoniae J138
cuuacauaaaccuuu

SEQ ID NO: 538485 - RNA, 22 nt, Chlamydophila pneumoniae J138
cuuagaagggaaaguaccuuua

SEQ ID NO: 538486 - RNA, 22 nt, Chlamydophila pneumoniae J138
cuuagaaucuaagauccugaga

SEQ ID NO: 538487 - RNA, 14 nt, Chlamydophila pneumoniae J138
cuuagaauccaaag

SEQ ID NO: 538488 - RNA, 18 nt, Chlamydophila pneumoniae J138
cuuagaauccaaagacuu

SEQ ID NO: 538489 - RNA, 16 nt, Chlamydophila pneumoniae J138
cuuagccccuccaaca

SEQ ID NO: 538490 - RNA, 13 nt, Chlamydophila pneumoniae J138
cuuagccccucca

SEQ ID NO: 538491 - RNA, 15 nt, Chlamydophila pneumoniae J138
cuuaggaaagagucu

SEQ ID NO: 538492 - RNA, 15 nt, Chlamydophila pneumoniae J138
cuuaggaauuuuucu

SEQ ID NO: 538493 - RNA, 15 nt, Chlamydophila pneumoniae J138
cuuaggauucuuauc

SEQ ID NO: 538494 - RNA, 15 nt, Chlamydophila pneumoniae J138
cuuaggguucucaaa

SEQ ID NO: 538495 - RNA, 23 nt, Chlamydophila pneumoniae J138
cuuaguccgguuucuucuaccaa

SEQ ID NO: 538496 - RNA, 16 nt, Chlamydophila pneumoniae J138
cuuaguaucgagcucu

SEQ ID NO: 538497 - RNA, 22 nt, Chlamydophila pneumoniae J138
cuuaucuugcugcccaaauuga

SEQ ID NO: 538498 - RNA, 14 nt, Chlamydophila pneumoniae J138
cuuaucuuuaaauu

SEQ ID NO: 538499 - RNA, 14 nt, Chlamydophila pneumoniae J138
cuuauaagcugcuu

SEQ ID NO: 538500 - RNA, 12 nt, Chlamydophila pneumoniae J138
cuucaaaaagcu

SEQ ID NO: 538501 - RNA, 14 nt, Chlamydophila pneumoniae J138
cuucaaaaaacaac

SEQ ID NO: 538502 - RNA, 21 nt, Chlamydophila pneumoniae J138
cuucaaaaguuccccaauuuc

SEQ ID NO: 538503 - RNA, 18 nt, Chlamydophila pneumoniae J138
cuucaaaauguuuaucga

SEQ ID NO: 538504 - RNA, 20 nt, Chlamydophila pneumoniae J138
cuucaaagauauagauucau

SEQ ID NO: 538505 - RNA, 20 nt, Chlamydophila pneumoniae J138
cuucaaaggcaaccucugca

SEQ ID NO: 538506 - RNA, 18 nt, Chlamydophila pneumoniae J138
cuucaaagucaaauacuu

SEQ ID NO: 538507 - RNA, 18 nt, Chlamydophila pneumoniae J138
cuucaagucgagaaacaa

SEQ ID NO: 538508 - RNA, 21 nt, Chlamydophila pneumoniae J138
cuucaagucgagaaacaaaau

SEQ ID NO: 538509 - RNA, 12 nt, Chlamydophila pneumoniae J138
cuucaacucuau

SEQ ID NO: 538510 - RNA, 16 nt, Chlamydophila pneumoniae J138
cuucacucuuucugua

SEQ ID NO: 538511 - RNA, 22 nt, Chlamydophila pneumoniae J138
cuucacucuuuuauuuuaggaa

SEQ ID NO: 538512 - RNA, 18 nt, Chlamydophila pneumoniae J138
cuucacgacauacaucaa

SEQ ID NO: 538513 - RNA, 21 nt, Chlamydophila pneumoniae J138
cuucacuauuaggcuuuuuuc

SEQ ID NO: 538514 - RNA, 19 nt, Chlamydophila pneumoniae J138
cuucaaguuucuuuugcaa

SEQ ID NO: 538515 - RNA, 22 nt, Chlamydophila pneumoniae J138
cuucaauacgcuagcucuuaaa

SEQ ID NO: 538516 - RNA, 18 nt, Chlamydophila pneumoniae J138
cuucgaccuauuugcaac

SEQ ID NO: 538517 - RNA, 16 nt, Chlamydophila pneumoniae J138
cuucgaauuuuuguuu

SEQ ID NO: 538518 - RNA, 15 nt, Chlamydophila pneumoniae J138
cuucgacaaggaagc

SEQ ID NO: 538519 - RNA, 20 nt, Chlamydophila pneumoniae J138
cuuccuuuuucugcuucucc

SEQ ID NO: 538520 - RNA, 11 nt, Chlamydophila pneumoniae J138
cuuccuuguug

SEQ ID NO: 538521 - RNA, 15 nt, Chlamydophila pneumoniae J138
cuucggaucuguaau

SEQ ID NO: 538522 - RNA, 17 nt, Chlamydophila pneumoniae J138
cuucggaauacugcgca

SEQ ID NO: 538523 - RNA, 14 nt, Chlamydophila pneumoniae J138
cuucggaucuguaa

SEQ ID NO: 538524 - RNA, 19 nt, Chlamydophila pneumoniae J138
cuucuaaaaacucuucauc

SEQ ID NO: 538525 - RNA, 16 nt, Chlamydophila pneumoniae J138
cuucguuagaaaccau

SEQ ID NO: 538526 - RNA, 17 nt, Chlamydophila pneumoniae J138
cuucguggaacuuucug

SEQ ID NO: 538527 - RNA, 21 nt, Chlamydophila pneumoniae J138
cuucuacagaauaggaacaaa

SEQ ID NO: 538528 - RNA, 12 nt, Chlamydophila pneumoniae J138
cuucuacaccau

SEQ ID NO: 538529 - RNA, 13 nt, Chlamydophila pneumoniae J138
cuucuacagcauc

SEQ ID NO: 538530 - RNA, 16 nt, Chlamydophila pneumoniae J138
cuucuaaggaaauuac

SEQ ID NO: 538531 - RNA, 12 nt, Chlamydophila pneumoniae J138
cuucuaaaacca

SEQ ID NO: 538532 - RNA, 16 nt, Chlamydophila pneumoniae J138
cuucuaugguaaucac

SEQ ID NO: 538533 - RNA, 22 nt, Chlamydophila pneumoniae J138
cuucccgaaggggaagaggaau

SEQ ID NO: 538534 - RNA, 15 nt, Chlamydophila pneumoniae J138
cuucccccagaccua

SEQ ID NO: 538535 - RNA, 15 nt, Chlamydophila pneumoniae J138
cuucccaucuuguuc

SEQ ID NO: 538536 - RNA, 16 nt, Chlamydophila pneumoniae J138
cuucccaucuuguucu

SEQ ID NO: 538537 - RNA, 13 nt, Chlamydophila pneumoniae J138
cuuccagcuucuc

SEQ ID NO: 538538 - RNA, 14 nt, Chlamydophila pneumoniae J138
cuuccuccaaaauu

SEQ ID NO: 538539 - RNA, 14 nt, Chlamydophila pneumoniae J138
cuucccucuccuug

SEQ ID NO: 538540 - RNA, 20 nt, Chlamydophila pneumoniae J138
cuuccgugcgauuuccccuu

SEQ ID NO: 538541 - RNA, 13 nt, Chlamydophila pneumoniae J138
cuuccugcugcuu

SEQ ID NO: 538542 - RNA, 17 nt, Chlamydophila pneumoniae J138
cuuccuucuccuguaaa

SEQ ID NO: 538543 - RNA, 17 nt, Chlamydophila pneumoniae J138
cuuccuuaaccuccuca

SEQ ID NO: 538544 - RNA, 22 nt, Chlamydophila pneumoniae J138
cuuccaaagacugagcuucuau

SEQ ID NO: 538545 - RNA, 18 nt, Chlamydophila pneumoniae J138
cuuccaacggacauuuuc

SEQ ID NO: 538546 - RNA, 18 nt, Chlamydophila pneumoniae J138
cuuccaacuucuguaucg

SEQ ID NO: 538547 - RNA, 16 nt, Chlamydophila pneumoniae J138
cuucagaauucucaag

SEQ ID NO: 538548 - RNA, 20 nt, Chlamydophila pneumoniae J138
cuuccacuguucuucuucag

SEQ ID NO: 538549 - RNA, 16 nt, Chlamydophila pneumoniae J138
cuuccaauuguaaauc

SEQ ID NO: 538550 - RNA, 13 nt, Chlamydophila pneumoniae J138
ccuucauucuuuc

SEQ ID NO: 538551 - RNA, 13 nt, Chlamydophila pneumoniae J138
cgauaaaaacucc

SEQ ID NO: 538552 - RNA, 20 nt, Chlamydophila pneumoniae J138
cgauacgaaggaucauauuu

SEQ ID NO: 538553 - RNA, 16 nt, Chlamydophila pneumoniae J138
cgauaacgauuucuug

SEQ ID NO: 538554 - RNA, 15 nt, Chlamydophila pneumoniae J138
cgauaacacuucuuu

SEQ ID NO: 538555 - RNA, 19 nt, Chlamydophila pneumoniae J138
cgauaacacuucuuucuug

SEQ ID NO: 538556 - RNA, 14 nt, Chlamydophila pneumoniae J138
cgaucgucaguaaa

SEQ ID NO: 538557 - RNA, 17 nt, Chlamydophila pneumoniae J138
cgaucgcgauaagaagc

SEQ ID NO: 538558 - RNA, 17 nt, Chlamydophila pneumoniae J138
cgaugacagggaaagaa

SEQ ID NO: 538559 - RNA, 21 nt, Chlamydophila pneumoniae J138
cgauggcaguuuuaaugagag

SEQ ID NO: 538560 - RNA, 22 nt, Chlamydophila pneumoniae J138
cgauggcaguuuuaaugagagc

SEQ ID NO: 538561 - RNA, 16 nt, Chlamydophila pneumoniae J138
cgcaaaggaaaagaua

SEQ ID NO: 538562 - RNA, 23 nt, Chlamydophila pneumoniae J138
cgcaaaccgagacuauuuuggaa

SEQ ID NO: 538563 - RNA, 20 nt, Chlamydophila pneumoniae J138
cgcaaguaaagaaauucugg

SEQ ID NO: 538564 - RNA, 12 nt, Chlamydophila pneumoniae J138
cgcaguaaugcc

SEQ ID NO: 538565 - RNA, 20 nt, Chlamydophila pneumoniae J138
cgcagaaacacugaacgcca

SEQ ID NO: 538566 - RNA, 15 nt, Chlamydophila pneumoniae J138
cgcccgagcuuccau

SEQ ID NO: 538567 - RNA, 13 nt, Chlamydophila pneumoniae J138
cgcauaagagaca

SEQ ID NO: 538568 - RNA, 12 nt, Chlamydophila pneumoniae J138
cgccuacaaguu

SEQ ID NO: 538569 - RNA, 20 nt, Chlamydophila pneumoniae J138
cgccuucaagucgagaaaca

SEQ ID NO: 538570 - RNA, 17 nt, Chlamydophila pneumoniae J138
cgccuuucuacccuucc

SEQ ID NO: 538571 - RNA, 19 nt, Chlamydophila pneumoniae J138
cgccuuggguuugucucca

SEQ ID NO: 538572 - RNA, 12 nt, Chlamydophila pneumoniae J138
cgcgaccuguga

SEQ ID NO: 538573 - RNA, 20 nt, Chlamydophila pneumoniae J138
cgcccuucaggacaugccuu

SEQ ID NO: 538574 - RNA, 21 nt, Chlamydophila pneumoniae J138
cggucgucuuagaauccucua

SEQ ID NO: 538575 - RNA, 16 nt, Chlamydophila pneumoniae J138
cgguuucuuuuuuuug

SEQ ID NO: 538576 - RNA, 12 nt, Chlamydophila pneumoniae J138
cguaaagaaaag

SEQ ID NO: 538577 - RNA, 15 nt, Chlamydophila pneumoniae J138
cguaaagaaaagcaa

SEQ ID NO: 538578 - RNA, 21 nt, Chlamydophila pneumoniae J138
cguagcuugcgagcuucuuga

SEQ ID NO: 538579 - RNA, 20 nt, Chlamydophila pneumoniae J138
cguaggguagccauccacga

SEQ ID NO: 538580 - RNA, 23 nt, Chlamydophila pneumoniae J138
cguagcuacaaaauuauuaaacu

SEQ ID NO: 538581 - RNA, 17 nt, Chlamydophila pneumoniae J138
cguagacgcucuaaacu

SEQ ID NO: 538582 - RNA, 23 nt, Chlamydophila pneumoniae J138
cguacuuuacacuauaagacauu

SEQ ID NO: 538583 - RNA, 14 nt, Chlamydophila pneumoniae J138
cguagcagaggcag

SEQ ID NO: 538584 - RNA, 18 nt, Chlamydophila pneumoniae J138
cguagcaggcaucacuaa

SEQ ID NO: 538585 - RNA, 15 nt, Chlamydophila pneumoniae J138
cguauagauuuuccg

SEQ ID NO: 538586 - RNA, 16 nt, Chlamydophila pneumoniae J138
cguauaaggauguugu

SEQ ID NO: 538587 - RNA, 18 nt, Chlamydophila pneumoniae J138
cguaggugccugaagaug

SEQ ID NO: 538588 - RNA, 15 nt, Chlamydophila pneumoniae J138
cguagguguuaaguu

SEQ ID NO: 538589 - RNA, 16 nt, Chlamydophila pneumoniae J138
cguagguuugcugcuc

SEQ ID NO: 538590 - RNA, 21 nt, Chlamydophila pneumoniae J138
cguauccuugauuuuaaaaug

SEQ ID NO: 538591 - RNA, 16 nt, Chlamydophila pneumoniae J138
cguaugcaucaaugaa

SEQ ID NO: 538592 - RNA, 19 nt, Chlamydophila pneumoniae J138
cguauggauuucuccagca

SEQ ID NO: 538593 - RNA, 13 nt, Chlamydophila pneumoniae J138
cguauucccaggu

SEQ ID NO: 538594 - RNA, 19 nt, Chlamydophila pneumoniae J138
cgucacuguuuuccagaaa

SEQ ID NO: 538595 - RNA, 18 nt, Chlamydophila pneumoniae J138
cgucaaauucauuaagaa

SEQ ID NO: 538596 - RNA, 18 nt, Chlamydophila pneumoniae J138
cgucaauaagcuugccag

SEQ ID NO: 538597 - RNA, 20 nt, Chlamydophila pneumoniae J138
cgucaugagccgauguugca

SEQ ID NO: 538598 - RNA, 23 nt, Chlamydophila pneumoniae J138
cgucaucgucgcgacugaaguca

SEQ ID NO: 538599 - RNA, 19 nt, Chlamydophila pneumoniae J138
cggggucggagauuguuuc

SEQ ID NO: 538600 - RNA, 19 nt, Chlamydophila pneumoniae J138
cggcggagaauaucaucuu

SEQ ID NO: 538601 - RNA, 12 nt, Chlamydophila pneumoniae J138
cgcggaucuucu

SEQ ID NO: 538602 - RNA, 17 nt, Chlamydophila pneumoniae J138
cgcuacgguacuuuaca

SEQ ID NO: 538603 - RNA, 14 nt, Chlamydophila pneumoniae J138
cgcuaaacaaucuu

SEQ ID NO: 538604 - RNA, 16 nt, Chlamydophila pneumoniae J138
cgcucuaagcugugca

SEQ ID NO: 538605 - RNA, 16 nt, Chlamydophila pneumoniae J138
cgcucguagguaugag

SEQ ID NO: 538606 - RNA, 21 nt, Chlamydophila pneumoniae J138
cgcuuaaaaucagcacacugc

SEQ ID NO: 538607 - RNA, 13 nt, Chlamydophila pneumoniae J138
cgcuugcaucuua

SEQ ID NO: 538608 - RNA, 13 nt, Chlamydophila pneumoniae J138
cgcuuacaaauaa

SEQ ID NO: 538609 - RNA, 14 nt, Chlamydophila pneumoniae J138
cgcuuuuuuaaagu

SEQ ID NO: 538610 - RNA, 12 nt, Chlamydophila pneumoniae J138
cgcuuuuuuaaa

SEQ ID NO: 538611 - RNA, 13 nt, Chlamydophila pneumoniae J138
cgcuuuuuacuga

SEQ ID NO: 538612 - RNA, 17 nt, Chlamydophila pneumoniae J138
cggaaaaucacacuuuc

SEQ ID NO: 538613 - RNA, 19 nt, Chlamydophila pneumoniae J138
cggaaaauacagccagcag

SEQ ID NO: 538614 - RNA, 20 nt, Chlamydophila pneumoniae J138
cggcacuuacuucaagaaaa

SEQ ID NO: 538615 - RNA, 14 nt, Chlamydophila pneumoniae J138
cggaacguauccuu

SEQ ID NO: 538616 - RNA, 19 nt, Chlamydophila pneumoniae J138
cggaucuucaauuggagga

SEQ ID NO: 538617 - RNA, 19 nt, Chlamydophila pneumoniae J138
cggaucuuuucuuucuaag

SEQ ID NO: 538618 - RNA, 17 nt, Chlamydophila pneumoniae J138
cggauuuucucuacaca

SEQ ID NO: 538619 - RNA, 14 nt, Chlamydophila pneumoniae J138
cggauuucaugauu

SEQ ID NO: 538620 - RNA, 16 nt, Chlamydophila pneumoniae J138
ccacgaauucuuuaaa

SEQ ID NO: 538621 - RNA, 15 nt, Chlamydophila pneumoniae J138
ccacgaccuacacca

SEQ ID NO: 538622 - RNA, 21 nt, Chlamydophila pneumoniae J138
ccaaaaaagagcccaaaaaca

SEQ ID NO: 538623 - RNA, 13 nt, Chlamydophila pneumoniae J138
ccacuacugagcu

SEQ ID NO: 538624 - RNA, 22 nt, Chlamydophila pneumoniae J138
ccacuccagaaaguauuccucu

SEQ ID NO: 538625 - RNA, 23 nt, Chlamydophila pneumoniae J138
ccacuccagaaaguauuccucuu

SEQ ID NO: 538626 - RNA, 18 nt, Chlamydophila pneumoniae J138
ccacucaaaagaagaguu

SEQ ID NO: 538627 - RNA, 12 nt, Chlamydophila pneumoniae J138
ccacugcuuuag

SEQ ID NO: 538628 - RNA, 14 nt, Chlamydophila pneumoniae J138
ccagaaauuuuuac

SEQ ID NO: 538629 - RNA, 16 nt, Chlamydophila pneumoniae J138
ccagaaauuuuuacaa

SEQ ID NO: 538630 - RNA, 21 nt, Chlamydophila pneumoniae J138
ccagaacaccaucacauccug

SEQ ID NO: 538631 - RNA, 12 nt, Chlamydophila pneumoniae J138
ccagaaaguauu

SEQ ID NO: 538632 - RNA, 22 nt, Chlamydophila pneumoniae J138
ccagagucgugccugguccaug

SEQ ID NO: 538633 - RNA, 22 nt, Chlamydophila pneumoniae J138
ccagaagucgcaguaaugccaa

SEQ ID NO: 538634 - RNA, 20 nt, Chlamydophila pneumoniae J138
ccagaagguguggguacagg

SEQ ID NO: 538635 - RNA, 22 nt, Chlamydophila pneumoniae J138
ccagauuuuuuugguugcuucu

SEQ ID NO: 538636 - RNA, 19 nt, Chlamydophila pneumoniae J138
ccagauuguucaaaaauag

SEQ ID NO: 538637 - RNA, 22 nt, Chlamydophila pneumoniae J138
ccagauuguucaaaaauagaua

SEQ ID NO: 538638 - RNA, 16 nt, Chlamydophila pneumoniae J138
ccagcgaugucuuuga

SEQ ID NO: 538639 - RNA, 18 nt, Chlamydophila pneumoniae J138
ccagcugauauccuugcu

SEQ ID NO: 538640 - RNA, 18 nt, Chlamydophila pneumoniae J138
ccagcugagcuaucuuca

SEQ ID NO: 538641 - RNA, 22 nt, Chlamydophila pneumoniae J138
ccaggaaguccgauagcaauga

SEQ ID NO: 538642 - RNA, 21 nt, Chlamydophila pneumoniae J138
ccauaaauacaggccugaugu

SEQ ID NO: 538643 - RNA, 16 nt, Chlamydophila pneumoniae J138
ccauauccauggaaug

SEQ ID NO: 538644 - RNA, 20 nt, Chlamydophila pneumoniae J138
ccauaauuucuuucacaucu

SEQ ID NO: 538645 - RNA, 22 nt, Chlamydophila pneumoniae J138
ccauaauuagaacagcauggac

SEQ ID NO: 538646 - RNA, 22 nt, Chlamydophila pneumoniae J138
ccauaagaaugguuauuucuug

SEQ ID NO: 538647 - RNA, 17 nt, Chlamydophila pneumoniae J138
ccauaauuagaacagca

SEQ ID NO: 538648 - RNA, 20 nt, Chlamydophila pneumoniae J138
ccauacccaaauuucuucug

SEQ ID NO: 538649 - RNA, 20 nt, Chlamydophila pneumoniae J138
ccaucggcauuucuccacau

SEQ ID NO: 538650 - RNA, 22 nt, Chlamydophila pneumoniae J138
ccaucggaauuugccugaaauc

SEQ ID NO: 538651 - RNA, 17 nt, Chlamydophila pneumoniae J138
ccaucaucgaagaacuu

SEQ ID NO: 538652 - RNA, 23 nt, Chlamydophila pneumoniae J138
ccaucauaaaacgugauugcugc

SEQ ID NO: 538653 - RNA, 15 nt, Chlamydophila pneumoniae J138
ccaucauaauuugac

SEQ ID NO: 538654 - RNA, 18 nt, Chlamydophila pneumoniae J138
cccacggcaaguuguggc

SEQ ID NO: 538655 - RNA, 20 nt, Chlamydophila pneumoniae J138
cccacggcaaguuguggcau

SEQ ID NO: 538656 - RNA, 21 nt, Chlamydophila pneumoniae J138
cccacgggucaggagguggug

SEQ ID NO: 538657 - RNA, 14 nt, Chlamydophila pneumoniae J138
cccacuagcccuug

SEQ ID NO: 538658 - RNA, 11 nt, Chlamydophila pneumoniae J138
cccagccuuga

SEQ ID NO: 538659 - RNA, 15 nt, Chlamydophila pneumoniae J138
ccauuguuguugcau

SEQ ID NO: 538660 - RNA, 13 nt, Chlamydophila pneumoniae J138
ccauuucauguaa

SEQ ID NO: 538661 - RNA, 18 nt, Chlamydophila pneumoniae J138
ccauugaucagaaucuaa

SEQ ID NO: 538662 - RNA, 12 nt, Chlamydophila pneumoniae J138
ccauuuucuaag

SEQ ID NO: 538663 - RNA, 13 nt, Chlamydophila pneumoniae J138
ccauuuuuccucc

SEQ ID NO: 538664 - RNA, 17 nt, Chlamydophila pneumoniae J138
ccauuuucuaagagauc

SEQ ID NO: 538665 - RNA, 19 nt, Chlamydophila pneumoniae J138
cccaaacugaugccaagaa

SEQ ID NO: 538666 - RNA, 22 nt, Chlamydophila pneumoniae J138
ccccaaucaguucaucuagaug

SEQ ID NO: 538667 - RNA, 19 nt, Chlamydophila pneumoniae J138
ccccacgcuaaacuaaaau

SEQ ID NO: 538668 - RNA, 22 nt, Chlamydophila pneumoniae J138
ccccaccaaagugacuuccucc

SEQ ID NO: 538669 - RNA, 11 nt, Chlamydophila pneumoniae J138
cccauuacagc

SEQ ID NO: 538670 - RNA, 14 nt, Chlamydophila pneumoniae J138
cccaugucuucaua

SEQ ID NO: 538671 - RNA, 14 nt, Chlamydophila pneumoniae J138
cccccagcauucac

SEQ ID NO: 538672 - RNA, 11 nt, Chlamydophila pneumoniae J138
ccccgcagcuu

SEQ ID NO: 538673 - RNA, 10 nt, Chlamydophila pneumoniae J138
ccccucucuc

SEQ ID NO: 538674 - RNA, 16 nt, Chlamydophila pneumoniae J138
cccggaggcaaagauc

SEQ ID NO: 538675 - RNA, 12 nt, Chlamydophila pneumoniae J138
cccgcagcuucu

SEQ ID NO: 538676 - RNA, 13 nt, Chlamydophila pneumoniae J138
cccgugagcaugc

SEQ ID NO: 538677 - RNA, 13 nt, Chlamydophila pneumoniae J138
cccgugacugcgu

SEQ ID NO: 538678 - RNA, 19 nt, Chlamydophila pneumoniae J138
cccucaagcgauuucgaaa

SEQ ID NO: 538679 - RNA, 22 nt, Chlamydophila pneumoniae J138
cccuauagaacaugaggcacau

SEQ ID NO: 538680 - RNA, 17 nt, Chlamydophila pneumoniae J138
cccuagagguauuuccu

SEQ ID NO: 538681 - RNA, 12 nt, Chlamydophila pneumoniae J138
cccuacccucau

SEQ ID NO: 538682 - RNA, 20 nt, Chlamydophila pneumoniae J138
cccuaagguagaguccacag

SEQ ID NO: 538683 - RNA, 19 nt, Chlamydophila pneumoniae J138
cccuaaaaugagauuccua

SEQ ID NO: 538684 - RNA, 22 nt, Chlamydophila pneumoniae J138
cccucccccaccaaagugacuu

SEQ ID NO: 538685 - RNA, 20 nt, Chlamydophila pneumoniae J138
cccucauaagauuuccccaa

SEQ ID NO: 538686 - RNA, 13 nt, Chlamydophila pneumoniae J138
cccuccaccagaa

SEQ ID NO: 538687 - RNA, 16 nt, Chlamydophila pneumoniae J138
cccuugggauuccuua

SEQ ID NO: 538688 - RNA, 13 nt, Chlamydophila pneumoniae J138
cccucgccaaacc

SEQ ID NO: 538689 - RNA, 14 nt, Chlamydophila pneumoniae J138
cccucgccaaacca

SEQ ID NO: 538690 - RNA, 16 nt, Chlamydophila pneumoniae J138
ccgaaacuucucagau

SEQ ID NO: 538691 - RNA, 15 nt, Chlamydophila pneumoniae J138
ccgaaaguaucuuca

SEQ ID NO: 538692 - RNA, 18 nt, Chlamydophila pneumoniae J138
ccgaaucuuucaaaagaa

SEQ ID NO: 538693 - RNA, 17 nt, Chlamydophila pneumoniae J138
ccgacauucacccucau

SEQ ID NO: 538694 - RNA, 19 nt, Chlamydophila pneumoniae J138
ccgaggagggaaacaccgu

SEQ ID NO: 538695 - RNA, 14 nt, Chlamydophila pneumoniae J138
ccgcauuuccuagu

SEQ ID NO: 538696 - RNA, 13 nt, Chlamydophila pneumoniae J138
ccgcauauugauc

SEQ ID NO: 538697 - RNA, 18 nt, Chlamydophila pneumoniae J138
ccggauucuuuaucccca

SEQ ID NO: 538698 - RNA, 15 nt, Chlamydophila pneumoniae J138
ccguccaguucuuca

SEQ ID NO: 538699 - RNA, 18 nt, Chlamydophila pneumoniae J138
ccgucauauuuaaaaggc

SEQ ID NO: 538700 - RNA, 11 nt, Chlamydophila pneumoniae J138
ccuaaagcauc

SEQ ID NO: 538701 - RNA, 17 nt, Chlamydophila pneumoniae J138
ccuaaauucauaacacc

SEQ ID NO: 538702 - RNA, 23 nt, Chlamydophila pneumoniae J138
ccuaagagauuuuccauaggaac

SEQ ID NO: 538703 - RNA, 17 nt, Chlamydophila pneumoniae J138
ccuaagugauaaggaag

SEQ ID NO: 538704 - RNA, 16 nt, Chlamydophila pneumoniae J138
ccuaagugauaaggaa

SEQ ID NO: 538705 - RNA, 23 nt, Chlamydophila pneumoniae J138
ccuaagguuuccaugagaauaug

SEQ ID NO: 538706 - RNA, 15 nt, Chlamydophila pneumoniae J138
ccuaagggcucuccu

SEQ ID NO: 538707 - RNA, 16 nt, Chlamydophila pneumoniae J138
ccuaagggcucuccua

SEQ ID NO: 538708 - RNA, 15 nt, Chlamydophila pneumoniae J138
ccuaagagauuuucc

SEQ ID NO: 538709 - RNA, 20 nt, Chlamydophila pneumoniae J138
ccuaagguuuccaugagaau

SEQ ID NO: 538710 - RNA, 21 nt, Chlamydophila pneumoniae J138
ccuaaaccaucacuuccuguu

SEQ ID NO: 538711 - RNA, 18 nt, Chlamydophila pneumoniae J138
ccucaagauaaaucccac

SEQ ID NO: 538712 - RNA, 22 nt, Chlamydophila pneumoniae J138
ccucaaagccgaggauucgcua

SEQ ID NO: 538713 - RNA, 10 nt, Chlamydophila pneumoniae J138
ccuauuuaag

SEQ ID NO: 538714 - RNA, 23 nt, Chlamydophila pneumoniae J138
ccuauggcagcaggaauaaucaa

SEQ ID NO: 538715 - RNA, 20 nt, Chlamydophila pneumoniae J138
ccucacagaauuguuuuguu

SEQ ID NO: 538716 - RNA, 21 nt, Chlamydophila pneumoniae J138
ccucagaauccauuuugccca

SEQ ID NO: 538717 - RNA, 18 nt, Chlamydophila pneumoniae J138
ccuaucaaagcaaaaguc

SEQ ID NO: 538718 - RNA, 16 nt, Chlamydophila pneumoniae J138
ccuaucaaagcaaaag

SEQ ID NO: 538719 - RNA, 13 nt, Chlamydophila pneumoniae J138
ccuauauuuuuua

SEQ ID NO: 538720 - RNA, 13 nt, Chlamydophila pneumoniae J138
ccuaucaaagcaa

SEQ ID NO: 538721 - RNA, 22 nt, Chlamydophila pneumoniae J138
ccuauaucgccguuaaagacuu

SEQ ID NO: 538722 - RNA, 16 nt, Chlamydophila pneumoniae J138
ccuauaguauaauagu

SEQ ID NO: 538723 - RNA, 12 nt, Chlamydophila pneumoniae J138
ccuaugauaaag

SEQ ID NO: 538724 - RNA, 16 nt, Chlamydophila pneumoniae J138
ccuaugauaaagccug

SEQ ID NO: 538725 - RNA, 18 nt, Chlamydophila pneumoniae J138
ccuaugaucagagagagg

SEQ ID NO: 538726 - RNA, 20 nt, Chlamydophila pneumoniae J138
ccuaguguuagaugaagagu

SEQ ID NO: 538727 - RNA, 21 nt, Chlamydophila pneumoniae J138
ccuaguucauuagcuaaauca

SEQ ID NO: 538728 - RNA, 23 nt, Chlamydophila pneumoniae J138
ccuaguucauuagcuaaaucaaa

SEQ ID NO: 538729 - RNA, 14 nt, Chlamydophila pneumoniae J138
ccuagggucuucuc

SEQ ID NO: 538730 - RNA, 13 nt, Chlamydophila pneumoniae J138
ccuagguucuuuu

SEQ ID NO: 538731 - RNA, 14 nt, Chlamydophila pneumoniae J138
ccuagguucuuuuc

SEQ ID NO: 538732 - RNA, 11 nt, Chlamydophila pneumoniae J138
ccuaggaggau

SEQ ID NO: 538733 - RNA, 19 nt, Chlamydophila pneumoniae J138
ccuagaauaggaauugcag

SEQ ID NO: 538734 - RNA, 20 nt, Chlamydophila pneumoniae J138
ccuagaaaagcaaccuuaaa

SEQ ID NO: 538735 - RNA, 19 nt, Chlamydophila pneumoniae J138
ccuagagaguucuuguaau

SEQ ID NO: 538736 - RNA, 23 nt, Chlamydophila pneumoniae J138
ccuagaaggaggaguccuucuag

SEQ ID NO: 538737 - RNA, 14 nt, Chlamydophila pneumoniae J138
ccuacuaaacccug

SEQ ID NO: 538738 - RNA, 16 nt, Chlamydophila pneumoniae J138
ccuacugggaaaucua

SEQ ID NO: 538739 - RNA, 19 nt, Chlamydophila pneumoniae J138
ccuacaaucgccuuacaau

SEQ ID NO: 538740 - RNA, 21 nt, Chlamydophila pneumoniae J138
ccuacaccaucuuuaaaaggc

SEQ ID NO: 538741 - RNA, 15 nt, Chlamydophila pneumoniae J138
ccuacguuuucucua

SEQ ID NO: 538742 - RNA, 22 nt, Chlamydophila pneumoniae J138
ccucgcaauccaggaauagaaa

SEQ ID NO: 538743 - RNA, 15 nt, Chlamydophila pneumoniae J138
ccucgccgcugcccu

SEQ ID NO: 538744 - RNA, 16 nt, Chlamydophila pneumoniae J138
ccucgccgcugcccua

SEQ ID NO: 538745 - RNA, 21 nt, Chlamydophila pneumoniae J138
ccucgagcagaaacuccaaaa

SEQ ID NO: 538746 - RNA, 21 nt, Chlamydophila pneumoniae J138
ccucgaguauggcaaauaaaa

SEQ ID NO: 538747 - RNA, 17 nt, Chlamydophila pneumoniae J138
ccucgauacuguugauc

SEQ ID NO: 538748 - RNA, 13 nt, Chlamydophila pneumoniae J138
ccucagucucucu

SEQ ID NO: 538749 - RNA, 16 nt, Chlamydophila pneumoniae J138
ccucugggaagacucu

SEQ ID NO: 538750 - RNA, 14 nt, Chlamydophila pneumoniae J138
ccucuucaauuucu

SEQ ID NO: 538751 - RNA, 19 nt, Chlamydophila pneumoniae J138
ccucuucaauuucuucauc

SEQ ID NO: 538752 - RNA, 18 nt, Chlamydophila pneumoniae J138
ccucuguagguuuuucca

SEQ ID NO: 538753 - RNA, 20 nt, Chlamydophila pneumoniae J138
ccucugcauguugcaaagca

SEQ ID NO: 538754 - RNA, 17 nt, Chlamydophila pneumoniae J138
ccucuagaagacacagg

SEQ ID NO: 538755 - RNA, 15 nt, Chlamydophila pneumoniae J138
ccucuagaagacaca

SEQ ID NO: 538756 - RNA, 19 nt, Chlamydophila pneumoniae J138
ccucuaaugacagcugaga

SEQ ID NO: 538757 - RNA, 22 nt, Chlamydophila pneumoniae J138
ccucuaaggacaaaucucccaa

SEQ ID NO: 538758 - RNA, 16 nt, Chlamydophila pneumoniae J138
ccucgucaccugagcu

SEQ ID NO: 538759 - RNA, 23 nt, Chlamydophila pneumoniae J138
ccugagaccauaaaaucaacaag

SEQ ID NO: 538760 - RNA, 21 nt, Chlamydophila pneumoniae J138
ccugaggcuauagaauacaca

SEQ ID NO: 538761 - RNA, 22 nt, Chlamydophila pneumoniae J138
ccugaguauccgaaucuaucca

SEQ ID NO: 538762 - RNA, 23 nt, Chlamydophila pneumoniae J138
ccugacgcauagcacuaugaauu

SEQ ID NO: 538763 - RNA, 15 nt, Chlamydophila pneumoniae J138
ccugauguugcccua

SEQ ID NO: 538764 - RNA, 23 nt, Chlamydophila pneumoniae J138
ccugcaaaaaaccagccaauaac

SEQ ID NO: 538765 - RNA, 17 nt, Chlamydophila pneumoniae J138
ccugcugccaugcagcc

SEQ ID NO: 538766 - RNA, 17 nt, Chlamydophila pneumoniae J138
ccugcuuuuuuucuaga

SEQ ID NO: 538767 - RNA, 17 nt, Chlamydophila pneumoniae J138
ccugugauuuccugacu

SEQ ID NO: 538768 - RNA, 18 nt, Chlamydophila pneumoniae J138
ccuguucuagcaaaucua

SEQ ID NO: 538769 - RNA, 18 nt, Chlamydophila pneumoniae J138
ccuuaaagagaaucuccu

SEQ ID NO: 538770 - RNA, 15 nt, Chlamydophila pneumoniae J138
ccuuaacaacaucac

SEQ ID NO: 538771 - RNA, 22 nt, Chlamydophila pneumoniae J138
ccuguuucaacauaacaugaga

SEQ ID NO: 538772 - RNA, 21 nt, Chlamydophila pneumoniae J138
ccuguugucacuaagauaucu

SEQ ID NO: 538773 - RNA, 19 nt, Chlamydophila pneumoniae J138
ccuucacaagaaaacaaag

SEQ ID NO: 538774 - RNA, 20 nt, Chlamydophila pneumoniae J138
ccuucaacacaccauuuuug

SEQ ID NO: 538775 - RNA, 18 nt, Chlamydophila pneumoniae J138
ccuucagaauucucaagu

SEQ ID NO: 538776 - RNA, 16 nt, Chlamydophila pneumoniae J138
ccuucaggauuuucca

SEQ ID NO: 538777 - RNA, 14 nt, Chlamydophila pneumoniae J138
ccuuauaguccaua

SEQ ID NO: 538778 - RNA, 17 nt, Chlamydophila pneumoniae J138
ccuuauugguaacacga

SEQ ID NO: 538779 - RNA, 17 nt, Chlamydophila pneumoniae J138
ccuuaucuugcugccca

SEQ ID NO: 538780 - RNA, 23 nt, Chlamydophila pneumoniae J138
ccuuaugcucauuaauaauaucu

SEQ ID NO: 538781 - RNA, 17 nt, Chlamydophila pneumoniae J138
ccuuaucuucagaaugc

SEQ ID NO: 538782 - RNA, 20 nt, Chlamydophila pneumoniae J138
ccuuacggccccuggaauuu

SEQ ID NO: 538783 - RNA, 22 nt, Chlamydophila pneumoniae J138
ccuuacucccaugggauaggaa

SEQ ID NO: 538784 - RNA, 22 nt, Chlamydophila pneumoniae J138
ccuuagcagcacccauaaggga

SEQ ID NO: 538785 - RNA, 20 nt, Chlamydophila pneumoniae J138
cagcuucuugauguacagua

SEQ ID NO: 538786 - RNA, 15 nt, Chlamydophila pneumoniae J138
cagcuucuuuuccag

SEQ ID NO: 538787 - RNA, 14 nt, Chlamydophila pneumoniae J138
cagcuucaucagaa

SEQ ID NO: 538788 - RNA, 13 nt, Chlamydophila pneumoniae J138
cagcugugguggu

SEQ ID NO: 538789 - RNA, 19 nt, Chlamydophila pneumoniae J138
cagcugucaauccaacaaa

SEQ ID NO: 538790 - RNA, 19 nt, Chlamydophila pneumoniae J138
cagcuagagcacauagaaa

SEQ ID NO: 538791 - RNA, 19 nt, Chlamydophila pneumoniae J138
cagcuccauaagcuuuucu

SEQ ID NO: 538792 - RNA, 16 nt, Chlamydophila pneumoniae J138
caggaacuaaaaguuu

SEQ ID NO: 538793 - RNA, 17 nt, Chlamydophila pneumoniae J138
caggaaguccauguaca

SEQ ID NO: 538794 - RNA, 23 nt, Chlamydophila pneumoniae J138
caggaaguccauguacagaaaau

SEQ ID NO: 538795 - RNA, 17 nt, Chlamydophila pneumoniae J138
caggaaggaauagagaa

SEQ ID NO: 538796 - RNA, 14 nt, Chlamydophila pneumoniae J138
caggaagaaaggau

SEQ ID NO: 538797 - RNA, 16 nt, Chlamydophila pneumoniae J138
caggaauaaucaacca

SEQ ID NO: 538798 - RNA, 21 nt, Chlamydophila pneumoniae J138
caggaaguaagguuccaaaaa

SEQ ID NO: 538799 - RNA, 23 nt, Chlamydophila pneumoniae J138
caggaaucacuguaucagcaagc

SEQ ID NO: 538800 - RNA, 20 nt, Chlamydophila pneumoniae J138
caggaccuaagggcucuccu

SEQ ID NO: 538801 - RNA, 17 nt, Chlamydophila pneumoniae J138
caggaccugugaguaaa

SEQ ID NO: 538802 - RNA, 14 nt, Chlamydophila pneumoniae J138
caggagcuccuccu

SEQ ID NO: 538803 - RNA, 16 nt, Chlamydophila pneumoniae J138
caggagcuagaagagc

SEQ ID NO: 538804 - RNA, 17 nt, Chlamydophila pneumoniae J138
caggacguaaaaagaaa

SEQ ID NO: 538805 - RNA, 14 nt, Chlamydophila pneumoniae J138
caggacuucgcaaa

SEQ ID NO: 538806 - RNA, 16 nt, Chlamydophila pneumoniae J138
caggagagagaaggcu

SEQ ID NO: 538807 - RNA, 20 nt, Chlamydophila pneumoniae J138
caggagaacaauaucagcag

SEQ ID NO: 538808 - RNA, 15 nt, Chlamydophila pneumoniae J138
caggauugauaaaua

SEQ ID NO: 538809 - RNA, 21 nt, Chlamydophila pneumoniae J138
cagggaauccuguaacacccu

SEQ ID NO: 538810 - RNA, 19 nt, Chlamydophila pneumoniae J138
cagggacucuuuccauagc

SEQ ID NO: 538811 - RNA, 14 nt, Chlamydophila pneumoniae J138
cagggacagaaguc

SEQ ID NO: 538812 - RNA, 22 nt, Chlamydophila pneumoniae J138
cagggccugagaccauaaaauc

SEQ ID NO: 538813 - RNA, 13 nt, Chlamydophila pneumoniae J138
caggggugagauc

SEQ ID NO: 538814 - RNA, 14 nt, Chlamydophila pneumoniae J138
caggggauaaaacu

SEQ ID NO: 538815 - RNA, 19 nt, Chlamydophila pneumoniae J138
caggugcggaacucaucac

SEQ ID NO: 538816 - RNA, 20 nt, Chlamydophila pneumoniae J138
caguaaaacacaaauagcaa

SEQ ID NO: 538817 - RNA, 19 nt, Chlamydophila pneumoniae J138
caguaucaauaaucggccg

SEQ ID NO: 538818 - RNA, 17 nt, Chlamydophila pneumoniae J138
cagucacaauauagccc

SEQ ID NO: 538819 - RNA, 21 nt, Chlamydophila pneumoniae J138
caguagagccucuaagaaaau

SEQ ID NO: 538820 - RNA, 20 nt, Chlamydophila pneumoniae J138
caguagagccucuaagaaaa

SEQ ID NO: 538821 - RNA, 19 nt, Chlamydophila pneumoniae J138
cagucgugagaagcaucuu

SEQ ID NO: 538822 - RNA, 15 nt, Chlamydophila pneumoniae J138
cagucguauucaggu

SEQ ID NO: 538823 - RNA, 18 nt, Chlamydophila pneumoniae J138
cagucuauagccucuucu

SEQ ID NO: 538824 - RNA, 16 nt, Chlamydophila pneumoniae J138
cagugcugccaugaca

SEQ ID NO: 538825 - RNA, 23 nt, Chlamydophila pneumoniae J138
caguguccacugcagcagguguc

SEQ ID NO: 538826 - RNA, 16 nt, Chlamydophila pneumoniae J138
caguguauaacguaga

SEQ ID NO: 538827 - RNA, 23 nt, Chlamydophila pneumoniae J138
cagucuugcgccagcaaagauua

SEQ ID NO: 538828 - RNA, 18 nt, Chlamydophila pneumoniae J138
cagugaaauuuugcaaca

SEQ ID NO: 538829 - RNA, 23 nt, Chlamydophila pneumoniae J138
cauaaagaccgagaagcuucaau

SEQ ID NO: 538830 - RNA, 22 nt, Chlamydophila pneumoniae J138
cauaaagaucgugaucaaagaa

SEQ ID NO: 538831 - RNA, 15 nt, Chlamydophila pneumoniae J138
cauaaaaauucucau

SEQ ID NO: 538832 - RNA, 16 nt, Chlamydophila pneumoniae J138
cauaaaaauucucaua

SEQ ID NO: 538833 - RNA, 14 nt, Chlamydophila pneumoniae J138
cauaaaaauuucau

SEQ ID NO: 538834 - RNA, 15 nt, Chlamydophila pneumoniae J138
cauaacauugcuugc

SEQ ID NO: 538835 - RNA, 17 nt, Chlamydophila pneumoniae J138
cauaaccaaguaaauca

SEQ ID NO: 538836 - RNA, 19 nt, Chlamydophila pneumoniae J138
cauaacaagggaagagaaa

SEQ ID NO: 538837 - RNA, 20 nt, Chlamydophila pneumoniae J138
caguugcgcgcccucuucua

SEQ ID NO: 538838 - RNA, 16 nt, Chlamydophila pneumoniae J138
caguugaugagaaaaa

SEQ ID NO: 538839 - RNA, 20 nt, Chlamydophila pneumoniae J138
caguugaugagaaaaagaau

SEQ ID NO: 538840 - RNA, 17 nt, Chlamydophila pneumoniae J138
caguuggcguuuucuag

SEQ ID NO: 538841 - RNA, 18 nt, Chlamydophila pneumoniae J138
caguuggcguuuucuaga

SEQ ID NO: 538842 - RNA, 21 nt, Chlamydophila pneumoniae J138
caguugguagagcaacacauu

SEQ ID NO: 538843 - RNA, 17 nt, Chlamydophila pneumoniae J138
caguuguacaauuugcu

SEQ ID NO: 538844 - RNA, 13 nt, Chlamydophila pneumoniae J138
caguuaaagagca

SEQ ID NO: 538845 - RNA, 21 nt, Chlamydophila pneumoniae J138
caguucuugaaacucuaucag

SEQ ID NO: 538846 - RNA, 13 nt, Chlamydophila pneumoniae J138
cauaaccugggca

SEQ ID NO: 538847 - RNA, 19 nt, Chlamydophila pneumoniae J138
cauaaccugggcaauauuu

SEQ ID NO: 538848 - RNA, 18 nt, Chlamydophila pneumoniae J138
cauaaccucggucucgcu

SEQ ID NO: 538849 - RNA, 17 nt, Chlamydophila pneumoniae J138
cauaaugagacagacag

SEQ ID NO: 538850 - RNA, 15 nt, Chlamydophila pneumoniae J138
cauaaucucaccaga

SEQ ID NO: 538851 - RNA, 19 nt, Chlamydophila pneumoniae J138
cauacaccccaguuucuug

SEQ ID NO: 538852 - RNA, 16 nt, Chlamydophila pneumoniae J138
cauaaucucaccagaa

SEQ ID NO: 538853 - RNA, 15 nt, Chlamydophila pneumoniae J138
cauacauucuauucu

SEQ ID NO: 538854 - RNA, 16 nt, Chlamydophila pneumoniae J138
cauacaguagaaacau

SEQ ID NO: 538855 - RNA, 18 nt, Chlamydophila pneumoniae J138
cauacccuucuucuucag

SEQ ID NO: 538856 - RNA, 13 nt, Chlamydophila pneumoniae J138
cauacccaaauuu

SEQ ID NO: 538857 - RNA, 14 nt, Chlamydophila pneumoniae J138
cauacucgucaaau

SEQ ID NO: 538858 - RNA, 15 nt, Chlamydophila pneumoniae J138
cauacucuauuaagg

SEQ ID NO: 538859 - RNA, 13 nt, Chlamydophila pneumoniae J138
cauacugauauac

SEQ ID NO: 538860 - RNA, 20 nt, Chlamydophila pneumoniae J138
cauacugauauacaguuggc

SEQ ID NO: 538861 - RNA, 14 nt, Chlamydophila pneumoniae J138
cauacucuucaucc

SEQ ID NO: 538862 - RNA, 16 nt, Chlamydophila pneumoniae J138
cauacgguaaggagga

SEQ ID NO: 538863 - RNA, 13 nt, Chlamydophila pneumoniae J138
cauacgacaguaa

SEQ ID NO: 538864 - RNA, 21 nt, Chlamydophila pneumoniae J138
cauacgccgugccuauagaaa

SEQ ID NO: 538865 - RNA, 22 nt, Chlamydophila pneumoniae J138
cauauaaagacucucuuccaaa

SEQ ID NO: 538866 - RNA, 20 nt, Chlamydophila pneumoniae J138
cauauaaagacucucuucca

SEQ ID NO: 538867 - RNA, 19 nt, Chlamydophila pneumoniae J138
cauaucuccuuuaaauaaa

SEQ ID NO: 538868 - RNA, 14 nt, Chlamydophila pneumoniae J138
cauaugcuccagaa

SEQ ID NO: 538869 - RNA, 17 nt, Chlamydophila pneumoniae J138
cauaugggacuucaagc

SEQ ID NO: 538870 - RNA, 21 nt, Chlamydophila pneumoniae J138
caucaaccgaagauccuagag

SEQ ID NO: 538871 - RNA, 22 nt, Chlamydophila pneumoniae J138
caucaccauccaaagcuauuuc

SEQ ID NO: 538872 - RNA, 13 nt, Chlamydophila pneumoniae J138
caucaaaaaauac

SEQ ID NO: 538873 - RNA, 16 nt, Chlamydophila pneumoniae J138
cauauuuuucuugaag

SEQ ID NO: 538874 - RNA, 20 nt, Chlamydophila pneumoniae J138
cauauuuuucuugaagguuc

SEQ ID NO: 538875 - RNA, 15 nt, Chlamydophila pneumoniae J138
cauauuuugucuuca

SEQ ID NO: 538876 - RNA, 17 nt, Chlamydophila pneumoniae J138
cauauuuugucuucauc

SEQ ID NO: 538877 - RNA, 21 nt, Chlamydophila pneumoniae J138
caucaaaagauaugucuugcu

SEQ ID NO: 538878 - RNA, 13 nt, Chlamydophila pneumoniae J138
caucaguaaaaga

SEQ ID NO: 538879 - RNA, 19 nt, Chlamydophila pneumoniae J138
caucaguggauucgugcuu

SEQ ID NO: 538880 - RNA, 13 nt, Chlamydophila pneumoniae J138
caucaguuccauu

SEQ ID NO: 538881 - RNA, 21 nt, Chlamydophila pneumoniae J138
caucaggcggaugaccuucuc

SEQ ID NO: 538882 - RNA, 14 nt, Chlamydophila pneumoniae J138
caucaucagaagcu

SEQ ID NO: 538883 - RNA, 17 nt, Chlamydophila pneumoniae J138
caucaucagaagcuccu

SEQ ID NO: 538884 - RNA, 18 nt, Chlamydophila pneumoniae J138
cauccaaaaugucuuuuu

SEQ ID NO: 538885 - RNA, 22 nt, Chlamydophila pneumoniae J138
cauccacgaccucgaauuccuc

SEQ ID NO: 538886 - RNA, 12 nt, Chlamydophila pneumoniae J138
cauccagaagua

SEQ ID NO: 538887 - RNA, 21 nt, Chlamydophila pneumoniae J138
cauccuuuagcuguuucucug

SEQ ID NO: 538888 - RNA, 22 nt, Chlamydophila pneumoniae J138
cauccuuguagaacuucucaag

SEQ ID NO: 538889 - RNA, 18 nt, Chlamydophila pneumoniae J138
cauccuucuuuaccuaug

SEQ ID NO: 538890 - RNA, 12 nt, Chlamydophila pneumoniae J138
caucgaagaacu

SEQ ID NO: 538891 - RNA, 15 nt, Chlamydophila pneumoniae J138
caucgaaaccacagc

SEQ ID NO: 538892 - RNA, 19 nt, Chlamydophila pneumoniae J138
caucgaagcgccgcauuac

SEQ ID NO: 538893 - RNA, 14 nt, Chlamydophila pneumoniae J138
cauccugaucuucu

SEQ ID NO: 538894 - RNA, 21 nt, Chlamydophila pneumoniae J138
cauccugaacggcucuuucua

SEQ ID NO: 538895 - RNA, 14 nt, Chlamydophila pneumoniae J138
cauccucagucucu

SEQ ID NO: 538896 - RNA, 21 nt, Chlamydophila pneumoniae J138
cauccucaucaucagaaauca

SEQ ID NO: 538897 - RNA, 17 nt, Chlamydophila pneumoniae J138
caucuagaaagauuuau

SEQ ID NO: 538898 - RNA, 20 nt, Chlamydophila pneumoniae J138
caucuagaagcauucucaau

SEQ ID NO: 538899 - RNA, 17 nt, Chlamydophila pneumoniae J138
caucgguuuccaagaca

SEQ ID NO: 538900 - RNA, 19 nt, Chlamydophila pneumoniae J138
caucuacgauguuuucuua

SEQ ID NO: 538901 - RNA, 21 nt, Chlamydophila pneumoniae J138
caucuacgauguuuucuuauc

SEQ ID NO: 538902 - RNA, 18 nt, Chlamydophila pneumoniae J138
caucugcguuuaaggguu

SEQ ID NO: 538903 - RNA, 18 nt, Chlamydophila pneumoniae J138
caucugauacuguuuuuu

SEQ ID NO: 538904 - RNA, 14 nt, Chlamydophila pneumoniae J138
caucuccugaagcc

SEQ ID NO: 538905 - RNA, 18 nt, Chlamydophila pneumoniae J138
caucucgcaguccaaaga

SEQ ID NO: 538906 - RNA, 15 nt, Chlamydophila pneumoniae J138
caucuuuggcacaau

SEQ ID NO: 538907 - RNA, 12 nt, Chlamydophila pneumoniae J138
caucuuccucuu

SEQ ID NO: 538908 - RNA, 20 nt, Chlamydophila pneumoniae J138
caugccuuuggcaaucaucu

SEQ ID NO: 538909 - RNA, 17 nt, Chlamydophila pneumoniae J138
caugcgaagggaggaga

SEQ ID NO: 538910 - RNA, 18 nt, Chlamydophila pneumoniae J138
caugcgcagaauaaaaug

SEQ ID NO: 538911 - RNA, 19 nt, Chlamydophila pneumoniae J138
caugccuaaauagcucagu

SEQ ID NO: 538912 - RNA, 18 nt, Chlamydophila pneumoniae J138
caugcacgagagccucgg

SEQ ID NO: 538913 - RNA, 19 nt, Chlamydophila pneumoniae J138
caucuuuucaaaagaaaag

SEQ ID NO: 538914 - RNA, 13 nt, Chlamydophila pneumoniae J138
caucuuuuacaga

SEQ ID NO: 538915 - RNA, 17 nt, Chlamydophila pneumoniae J138
caucuuuuacagacuga

SEQ ID NO: 538916 - RNA, 23 nt, Chlamydophila pneumoniae J138
caugaaagauaaugucuccaucg

SEQ ID NO: 538917 - RNA, 13 nt, Chlamydophila pneumoniae J138
caugauuuuucaa

SEQ ID NO: 538918 - RNA, 16 nt, Chlamydophila pneumoniae J138
caugcuaauaauuccu

SEQ ID NO: 538919 - RNA, 13 nt, Chlamydophila pneumoniae J138
caugcuugaggaa

SEQ ID NO: 538920 - RNA, 14 nt, Chlamydophila pneumoniae J138
cauggagguucuca

SEQ ID NO: 538921 - RNA, 16 nt, Chlamydophila pneumoniae J138
cauggacaauauagag

SEQ ID NO: 538922 - RNA, 15 nt, Chlamydophila pneumoniae J138
caugcuuuccuucca

SEQ ID NO: 538923 - RNA, 20 nt, Chlamydophila pneumoniae J138
cauguuuaauaucagcuucu

SEQ ID NO: 538924 - RNA, 14 nt, Chlamydophila pneumoniae J138
cauguuucuuccug

SEQ ID NO: 538925 - RNA, 17 nt, Chlamydophila pneumoniae J138
caugucuucauaugcuc

SEQ ID NO: 538926 - RNA, 13 nt, Chlamydophila pneumoniae J138
caugugcugaaga

SEQ ID NO: 538927 - RNA, 15 nt, Chlamydophila pneumoniae J138
caugugcugaagacc

SEQ ID NO: 538928 - RNA, 12 nt, Chlamydophila pneumoniae J138
cauuaaggugug

SEQ ID NO: 538929 - RNA, 16 nt, Chlamydophila pneumoniae J138
cauuaauaauaucuaa

SEQ ID NO: 538930 - RNA, 15 nt, Chlamydophila pneumoniae J138
cauuaauaucccagu

SEQ ID NO: 538931 - RNA, 13 nt, Chlamydophila pneumoniae J138
cauuaaggaaucc

SEQ ID NO: 538932 - RNA, 17 nt, Chlamydophila pneumoniae J138
cauuaagauaaacauua

SEQ ID NO: 538933 - RNA, 22 nt, Chlamydophila pneumoniae J138
cauuagcccuacgaauccaaaa

SEQ ID NO: 538934 - RNA, 16 nt, Chlamydophila pneumoniae J138
cauuagcuaaaucaaa

SEQ ID NO: 538935 - RNA, 19 nt, Chlamydophila pneumoniae J138
cauuagcaaucgaauagcu

SEQ ID NO: 538936 - RNA, 23 nt, Chlamydophila pneumoniae J138
cauuagaguuugguuuguuugau

SEQ ID NO: 538937 - RNA, 21 nt, Chlamydophila pneumoniae J138
cauuacacaacucuuucccua

SEQ ID NO: 538938 - RNA, 17 nt, Chlamydophila pneumoniae J138
cauuuuuggaaaaccau

SEQ ID NO: 538939 - RNA, 15 nt, Chlamydophila pneumoniae J138
cauuuuucaauaacc

SEQ ID NO: 538940 - RNA, 13 nt, Chlamydophila pneumoniae J138
cauuuuuccuccu

SEQ ID NO: 538941 - RNA, 12 nt, Chlamydophila pneumoniae J138
cauuuuuaggau

SEQ ID NO: 538942 - RNA, 21 nt, Chlamydophila pneumoniae J138
cauuuucuucuugcaaucuuu

SEQ ID NO: 538943 - RNA, 14 nt, Chlamydophila pneumoniae J138
cauuuucuaaagua

SEQ ID NO: 538944 - RNA, 20 nt, Chlamydophila pneumoniae J138
cauuuucaggcugaaccaaa

SEQ ID NO: 538945 - RNA, 15 nt, Chlamydophila pneumoniae J138
cauuuaaauggaugc

SEQ ID NO: 538946 - RNA, 17 nt, Chlamydophila pneumoniae J138
cauuugauucauaaaga

SEQ ID NO: 538947 - RNA, 15 nt, Chlamydophila pneumoniae J138
cauuuguuuggaaau

SEQ ID NO: 538948 - RNA, 13 nt, Chlamydophila pneumoniae J138
cauuguuuaaguc

SEQ ID NO: 538949 - RNA, 20 nt, Chlamydophila pneumoniae J138
cauuguggaacgcauaagag

SEQ ID NO: 538950 - RNA, 14 nt, Chlamydophila pneumoniae J138
cauugccuugcugc

SEQ ID NO: 538951 - RNA, 16 nt, Chlamydophila pneumoniae J138
cauugcaaaaaugaaa

SEQ ID NO: 538952 - RNA, 15 nt, Chlamydophila pneumoniae J138
cauugaauccuucua

SEQ ID NO: 538953 - RNA, 16 nt, Chlamydophila pneumoniae J138
cauucuuaauauaaaa

SEQ ID NO: 538954 - RNA, 15 nt, Chlamydophila pneumoniae J138
cauugagauccauag

SEQ ID NO: 538955 - RNA, 17 nt, Chlamydophila pneumoniae J138
cauugaccugcuuuuuu

SEQ ID NO: 538956 - RNA, 13 nt, Chlamydophila pneumoniae J138
cauucuauucuau

SEQ ID NO: 538957 - RNA, 15 nt, Chlamydophila pneumoniae J138
cauucucaugucuaa

SEQ ID NO: 538958 - RNA, 19 nt, Chlamydophila pneumoniae J138
cauucucaugucuaaguca

SEQ ID NO: 538959 - RNA, 23 nt, Chlamydophila pneumoniae J138
cauucuccgccagaguuuaaagc

SEQ ID NO: 538960 - RNA, 18 nt, Chlamydophila pneumoniae J138
cauucguuaggugaccca

SEQ ID NO: 538961 - RNA, 22 nt, Chlamydophila pneumoniae J138
cauucuaacgcuuuuucaaacu

SEQ ID NO: 538962 - RNA, 21 nt, Chlamydophila pneumoniae J138
cauuaucuucguaauaacuau

SEQ ID NO: 538963 - RNA, 16 nt, Chlamydophila pneumoniae J138
cauuaucacagaugua

SEQ ID NO: 538964 - RNA, 18 nt, Chlamydophila pneumoniae J138
cagcacgaauaaagcccu

SEQ ID NO: 538965 - RNA, 15 nt, Chlamydophila pneumoniae J138
cagcacucuuuuucu

SEQ ID NO: 538966 - RNA, 18 nt, Chlamydophila pneumoniae J138
cagcacuuuuauuaugua

SEQ ID NO: 538967 - RNA, 14 nt, Chlamydophila pneumoniae J138
cagcagaugaaacu

SEQ ID NO: 538968 - RNA, 16 nt, Chlamydophila pneumoniae J138
cagcagguucuugaau

SEQ ID NO: 538969 - RNA, 22 nt, Chlamydophila pneumoniae J138
cagcagcuucccaagcagaaga

SEQ ID NO: 538970 - RNA, 22 nt, Chlamydophila pneumoniae J138
cagcauaaggauucugagaagu

SEQ ID NO: 538971 - RNA, 18 nt, Chlamydophila pneumoniae J138
cagcauaaguuagccugg

SEQ ID NO: 538972 - RNA, 15 nt, Chlamydophila pneumoniae J138
cagcauaaaaauucu

SEQ ID NO: 538973 - RNA, 20 nt, Chlamydophila pneumoniae J138
cagcaucaggauucucucug

SEQ ID NO: 538974 - RNA, 22 nt, Chlamydophila pneumoniae J138
cagcaucacguauaauacguac

SEQ ID NO: 538975 - RNA, 18 nt, Chlamydophila pneumoniae J138
cagcauggacuccaagaa

SEQ ID NO: 538976 - RNA, 16 nt, Chlamydophila pneumoniae J138
cagcauuuucuaaagu

SEQ ID NO: 538977 - RNA, 14 nt, Chlamydophila pneumoniae J138
cagcauuuucucug

SEQ ID NO: 538978 - RNA, 12 nt, Chlamydophila pneumoniae J138
cagcccacuguu

SEQ ID NO: 538979 - RNA, 13 nt, Chlamydophila pneumoniae J138
cagcccccaggcu

SEQ ID NO: 538980 - RNA, 13 nt, Chlamydophila pneumoniae J138
cagccagcagaag

SEQ ID NO: 538981 - RNA, 16 nt, Chlamydophila pneumoniae J138
cagcgcugugaggaaa

SEQ ID NO: 538982 - RNA, 12 nt, Chlamydophila pneumoniae J138
cagcggcacccu

SEQ ID NO: 538983 - RNA, 18 nt, Chlamydophila pneumoniae J138
cagcgauauaagacucca

SEQ ID NO: 538984 - RNA, 13 nt, Chlamydophila pneumoniae J138
cagccggagcuuc

SEQ ID NO: 538985 - RNA, 20 nt, Chlamydophila pneumoniae J138
cagccggagcuucuaagauc

SEQ ID NO: 538986 - RNA, 16 nt, Chlamydophila pneumoniae J138
cagccgcaucaugguc

SEQ ID NO: 538987 - RNA, 19 nt, Chlamydophila pneumoniae J138
cagccugucuauaaaauaa

SEQ ID NO: 538988 - RNA, 17 nt, Chlamydophila pneumoniae J138
cagccuggaaagcuucu

SEQ ID NO: 538989 - RNA, 21 nt, Chlamydophila pneumoniae J138
cagccuuggcucuagaaauau

SEQ ID NO: 538990 - RNA, 15 nt, Chlamydophila pneumoniae J138
cagccucuucucuac

SEQ ID NO: 538991 - RNA, 13 nt, Chlamydophila pneumoniae J138
cagcgaggagaag

SEQ ID NO: 538992 - RNA, 17 nt, Chlamydophila pneumoniae J138
cagcgaggaguuuucca

SEQ ID NO: 538993 - RNA, 18 nt, Chlamydophila pneumoniae J138
caauuaaaaaauuaucuc

SEQ ID NO: 538994 - RNA, 12 nt, Chlamydophila pneumoniae J138
caauuaaaaaau

SEQ ID NO: 538995 - RNA, 16 nt, Chlamydophila pneumoniae J138
caauuaaaaaauuauc

SEQ ID NO: 538996 - RNA, 17 nt, Chlamydophila pneumoniae J138
caaugucgucucagaaa

SEQ ID NO: 538997 - RNA, 24 nt, Chlamydophila pneumoniae J138
cacuggaaugacauaagcacucuu

SEQ ID NO: 538998 - RNA, 18 nt, Chlamydophila pneumoniae J138
cacugguagcuaaauuua

SEQ ID NO: 538999 - RNA, 14 nt, Chlamydophila pneumoniae J138
cacuuaaagguaaa

SEQ ID NO: 539000 - RNA, 23 nt, Chlamydophila pneumoniae J138
cacuuaauaauguuuuaauagcu

SEQ ID NO: 539001 - RNA, 17 nt, Chlamydophila pneumoniae J138
cacuguaucagcaagcc

SEQ ID NO: 539002 - RNA, 18 nt, Chlamydophila pneumoniae J138
cacuucucagcaucucga

SEQ ID NO: 539003 - RNA, 18 nt, Chlamydophila pneumoniae J138
cacuucucuguaucgaua

SEQ ID NO: 539004 - RNA, 23 nt, Chlamydophila pneumoniae J138
cacuucuucaagaaaugcccugu

SEQ ID NO: 539005 - RNA, 16 nt, Chlamydophila pneumoniae J138
cacuuacuucaagaaa

SEQ ID NO: 539006 - RNA, 21 nt, Chlamydophila pneumoniae J138
cacuuaguccgguuucuucua

SEQ ID NO: 539007 - RNA, 13 nt, Chlamydophila pneumoniae J138
cacuuauguucua

SEQ ID NO: 539008 - RNA, 21 nt, Chlamydophila pneumoniae J138
cacuugguagcgucucuucuu

SEQ ID NO: 539009 - RNA, 16 nt, Chlamydophila pneumoniae J138
cacuugcuuaaggaaa

SEQ ID NO: 539010 - RNA, 18 nt, Chlamydophila pneumoniae J138
cacuugcucuuuaggaua

SEQ ID NO: 539011 - RNA, 19 nt, Chlamydophila pneumoniae J138
cacuuguuuuuucuucugu

SEQ ID NO: 539012 - RNA, 15 nt, Chlamydophila pneumoniae J138
cacuuucugauguga

SEQ ID NO: 539013 - RNA, 18 nt, Chlamydophila pneumoniae J138
cagaaauugcuucuucca

SEQ ID NO: 539014 - RNA, 17 nt, Chlamydophila pneumoniae J138
cagaaaugaagccaaaa

SEQ ID NO: 539015 - RNA, 15 nt, Chlamydophila pneumoniae J138
cagaaaugggcaaca

SEQ ID NO: 539016 - RNA, 15 nt, Chlamydophila pneumoniae J138
cagaaaugucgugug

SEQ ID NO: 539017 - RNA, 21 nt, Chlamydophila pneumoniae J138
cagaaauacguccagccugca

SEQ ID NO: 539018 - RNA, 17 nt, Chlamydophila pneumoniae J138
cagaaacuuuaaaagca

SEQ ID NO: 539019 - RNA, 17 nt, Chlamydophila pneumoniae J138
cagaaagagcuaaagaa

SEQ ID NO: 539020 - RNA, 18 nt, Chlamydophila pneumoniae J138
cagaaagauaucccaaag

SEQ ID NO: 539021 - RNA, 22 nt, Chlamydophila pneumoniae J138
cagaaagauugugcucacgaau

SEQ ID NO: 539022 - RNA, 18 nt, Chlamydophila pneumoniae J138
cagaaaggagauccacag

SEQ ID NO: 539023 - RNA, 14 nt, Chlamydophila pneumoniae J138
cagaaacaugaagu

SEQ ID NO: 539024 - RNA, 18 nt, Chlamydophila pneumoniae J138
cagaaacgcaugaaccua

SEQ ID NO: 539025 - RNA, 16 nt, Chlamydophila pneumoniae J138
cagaaacuccaaaaua

SEQ ID NO: 539026 - RNA, 16 nt, Chlamydophila pneumoniae J138
cagaagcauugaggac

SEQ ID NO: 539027 - RNA, 15 nt, Chlamydophila pneumoniae J138
cagaagcuccugagu

SEQ ID NO: 539028 - RNA, 17 nt, Chlamydophila pneumoniae J138
cagaagccaccaaaaau

SEQ ID NO: 539029 - RNA, 20 nt, Chlamydophila pneumoniae J138
cagaaggacccuccuuugua

SEQ ID NO: 539030 - RNA, 16 nt, Chlamydophila pneumoniae J138
cagaaggcuuguuucu

SEQ ID NO: 539031 - RNA, 15 nt, Chlamydophila pneumoniae J138
cagaaggcuuguuuc

SEQ ID NO: 539032 - RNA, 14 nt, Chlamydophila pneumoniae J138
cagaagguaaauuu

SEQ ID NO: 539033 - RNA, 15 nt, Chlamydophila pneumoniae J138
cagaagguaaauuuu

SEQ ID NO: 539034 - RNA, 20 nt, Chlamydophila pneumoniae J138
cagaagguuccacagagacc

SEQ ID NO: 539035 - RNA, 23 nt, Chlamydophila pneumoniae J138
cagaagugaucuugagaaaagaa

SEQ ID NO: 539036 - RNA, 18 nt, Chlamydophila pneumoniae J138
cagaaguuccuacuucug

SEQ ID NO: 539037 - RNA, 13 nt, Chlamydophila pneumoniae J138
cagaaguuccuuc

SEQ ID NO: 539038 - RNA, 17 nt, Chlamydophila pneumoniae J138
cagaaguccuaucaaag

SEQ ID NO: 539039 - RNA, 14 nt, Chlamydophila pneumoniae J138
cagaauuguuuugu

SEQ ID NO: 539040 - RNA, 16 nt, Chlamydophila pneumoniae J138
cagaauguacauagag

SEQ ID NO: 539041 - RNA, 15 nt, Chlamydophila pneumoniae J138
cagacacaaaaagcu

SEQ ID NO: 539042 - RNA, 18 nt, Chlamydophila pneumoniae J138
cagaauuuuaucagaaac

SEQ ID NO: 539043 - RNA, 12 nt, Chlamydophila pneumoniae J138
cagaauuuucug

SEQ ID NO: 539044 - RNA, 19 nt, Chlamydophila pneumoniae J138
cagaauuuuaucagaaacu

SEQ ID NO: 539045 - RNA, 20 nt, Chlamydophila pneumoniae J138
cagaauaggaacaaagcucu

SEQ ID NO: 539046 - RNA, 13 nt, Chlamydophila pneumoniae J138
cagaauccugagu

SEQ ID NO: 539047 - RNA, 17 nt, Chlamydophila pneumoniae J138
cagaaucuaaguaaaac

SEQ ID NO: 539048 - RNA, 18 nt, Chlamydophila pneumoniae J138
cagaaucuaaguaaaacu

SEQ ID NO: 539049 - RNA, 16 nt, Chlamydophila pneumoniae J138
cagaaugauaagaaag

SEQ ID NO: 539050 - RNA, 22 nt, Chlamydophila pneumoniae J138
cagaccuaaaaaggucagcccu

SEQ ID NO: 539051 - RNA, 23 nt, Chlamydophila pneumoniae J138
cagaccuaaaaaggucagcccug

SEQ ID NO: 539052 - RNA, 17 nt, Chlamydophila pneumoniae J138
cagacagucugugagaa

SEQ ID NO: 539053 - RNA, 14 nt, Chlamydophila pneumoniae J138
cagagauuuuaaag

SEQ ID NO: 539054 - RNA, 17 nt, Chlamydophila pneumoniae J138
cagagaugcuaacaacu

SEQ ID NO: 539055 - RNA, 16 nt, Chlamydophila pneumoniae J138
cagagcauaggguuuc

SEQ ID NO: 539056 - RNA, 22 nt, Chlamydophila pneumoniae J138
cagagacuuccucuucaauuuc

SEQ ID NO: 539057 - RNA, 21 nt, Chlamydophila pneumoniae J138
cagagacuuccucuucaauuu

SEQ ID NO: 539058 - RNA, 17 nt, Chlamydophila pneumoniae J138
cagagauugccaggaga

SEQ ID NO: 539059 - RNA, 13 nt, Chlamydophila pneumoniae J138
cagagauucuuca

SEQ ID NO: 539060 - RNA, 15 nt, Chlamydophila pneumoniae J138
cagagauguggcaga

SEQ ID NO: 539061 - RNA, 12 nt, Chlamydophila pneumoniae J138
cagagauggucu

SEQ ID NO: 539062 - RNA, 22 nt, Chlamydophila pneumoniae J138
cagagaauugcauucuuaauag

SEQ ID NO: 539063 - RNA, 14 nt, Chlamydophila pneumoniae J138
cagagaccuucucu

SEQ ID NO: 539064 - RNA, 13 nt, Chlamydophila pneumoniae J138
cagagaaaaucaa

SEQ ID NO: 539065 - RNA, 15 nt, Chlamydophila pneumoniae J138
cagagaaaaucaacu

SEQ ID NO: 539066 - RNA, 23 nt, Chlamydophila pneumoniae J138
cagagaaauuaacagagcgccuc

SEQ ID NO: 539067 - RNA, 15 nt, Chlamydophila pneumoniae J138
cagagaaauucaugc

SEQ ID NO: 539068 - RNA, 12 nt, Chlamydophila pneumoniae J138
cagagaaaauca

SEQ ID NO: 539069 - RNA, 14 nt, Chlamydophila pneumoniae J138
cagacuuuccucuc

SEQ ID NO: 539070 - RNA, 18 nt, Chlamydophila pneumoniae J138
cagacuucguaucuucga

SEQ ID NO: 539071 - RNA, 22 nt, Chlamydophila pneumoniae J138
cagacugaagucguuuagauuu

SEQ ID NO: 539072 - RNA, 20 nt, Chlamydophila pneumoniae J138
cagaccucucccuugggauu

SEQ ID NO: 539073 - RNA, 22 nt, Chlamydophila pneumoniae J138
cagacucgccgaaaguaucuuc

SEQ ID NO: 539074 - RNA, 16 nt, Chlamydophila pneumoniae J138
cagagcgccuccaccu

SEQ ID NO: 539075 - RNA, 16 nt, Chlamydophila pneumoniae J138
cagagccgucuacuuu

SEQ ID NO: 539076 - RNA, 16 nt, Chlamydophila pneumoniae J138
cagagccucacuaacg

SEQ ID NO: 539077 - RNA, 17 nt, Chlamydophila pneumoniae J138
cagagcuucuaaaaacu

SEQ ID NO: 539078 - RNA, 18 nt, Chlamydophila pneumoniae J138
cagaggagccuccauaau

SEQ ID NO: 539079 - RNA, 12 nt, Chlamydophila pneumoniae J138
cagaggagccuc

SEQ ID NO: 539080 - RNA, 14 nt, Chlamydophila pneumoniae J138
cagaggagccucca

SEQ ID NO: 539081 - RNA, 23 nt, Chlamydophila pneumoniae J138
cagaggaucuagaaaaugaagag

SEQ ID NO: 539082 - RNA, 11 nt, Chlamydophila pneumoniae J138
cagaggagccu

SEQ ID NO: 539083 - RNA, 16 nt, Chlamydophila pneumoniae J138
cagaguuuuucccucg

SEQ ID NO: 539084 - RNA, 21 nt, Chlamydophila pneumoniae J138
cagauaaaaagaaguaaucgu

SEQ ID NO: 539085 - RNA, 22 nt, Chlamydophila pneumoniae J138
cagagucugggauguucaaagc

SEQ ID NO: 539086 - RNA, 18 nt, Chlamydophila pneumoniae J138
cagaguccuucuuuuccg

SEQ ID NO: 539087 - RNA, 17 nt, Chlamydophila pneumoniae J138
cagaggcuagaaaauca

SEQ ID NO: 539088 - RNA, 20 nt, Chlamydophila pneumoniae J138
cagagggcuucauuccuaca

SEQ ID NO: 539089 - RNA, 18 nt, Chlamydophila pneumoniae J138
cagauaccaaaauaccau

SEQ ID NO: 539090 - RNA, 15 nt, Chlamydophila pneumoniae J138
cagauacuaaacucc

SEQ ID NO: 539091 - RNA, 20 nt, Chlamydophila pneumoniae J138
cagauacuaaacuccauugu

SEQ ID NO: 539092 - RNA, 16 nt, Chlamydophila pneumoniae J138
cagauacuucuuccac

SEQ ID NO: 539093 - RNA, 15 nt, Chlamydophila pneumoniae J138
cagauagcuuacaga

SEQ ID NO: 539094 - RNA, 14 nt, Chlamydophila pneumoniae J138
cagaucaaugccuu

SEQ ID NO: 539095 - RNA, 15 nt, Chlamydophila pneumoniae J138
cagauaucaaagcau

SEQ ID NO: 539096 - RNA, 19 nt, Chlamydophila pneumoniae J138
cagauaucaaagcauugca

SEQ ID NO: 539097 - RNA, 15 nt, Chlamydophila pneumoniae J138
cagcaacaaccaaaa

SEQ ID NO: 539098 - RNA, 19 nt, Chlamydophila pneumoniae J138
cagcaacaucguuaauaua

SEQ ID NO: 539099 - RNA, 17 nt, Chlamydophila pneumoniae J138
cagcaaccuuuccuaaa

SEQ ID NO: 539100 - RNA, 17 nt, Chlamydophila pneumoniae J138
cagcaaggaaguuauaa

SEQ ID NO: 539101 - RNA, 19 nt, Chlamydophila pneumoniae J138
cagcaacuaaagcauacuu

SEQ ID NO: 539102 - RNA, 23 nt, Chlamydophila pneumoniae J138
cagcaagaacauaaccucggucu

SEQ ID NO: 539103 - RNA, 19 nt, Chlamydophila pneumoniae J138
cagcaaucacaucaguucc

SEQ ID NO: 539104 - RNA, 20 nt, Chlamydophila pneumoniae J138
cagcaaucacaucaguucca

SEQ ID NO: 539105 - RNA, 17 nt, Chlamydophila pneumoniae J138
cagcacaggcauggucu

SEQ ID NO: 539106 - RNA, 17 nt, Chlamydophila pneumoniae J138
cagauguaaucuugauc

SEQ ID NO: 539107 - RNA, 15 nt, Chlamydophila pneumoniae J138
cagauguaaaugcuc

SEQ ID NO: 539108 - RNA, 14 nt, Chlamydophila pneumoniae J138
cagauggucagucu

SEQ ID NO: 539109 - RNA, 23 nt, Chlamydophila pneumoniae J138
cagauuagaaaagauaaaacauu

SEQ ID NO: 539110 - RNA, 13 nt, Chlamydophila pneumoniae J138
cagauuagaguua

SEQ ID NO: 539111 - RNA, 22 nt, Chlamydophila pneumoniae J138
cagauugaugcugacagcucca

SEQ ID NO: 539112 - RNA, 16 nt, Chlamydophila pneumoniae J138
cagauucugaagagag

SEQ ID NO: 539113 - RNA, 20 nt, Chlamydophila pneumoniae J138
cagauuuuuuaaccucuuuu

SEQ ID NO: 539114 - RNA, 14 nt, Chlamydophila pneumoniae J138
cagaucugcauaau

SEQ ID NO: 539115 - RNA, 13 nt, Chlamydophila pneumoniae J138
cagaucucuuuag

SEQ ID NO: 539116 - RNA, 16 nt, Chlamydophila pneumoniae J138
cagauccugcuucuau

SEQ ID NO: 539117 - RNA, 12 nt, Chlamydophila pneumoniae J138
cagaugauuuua

SEQ ID NO: 539118 - RNA, 21 nt, Chlamydophila pneumoniae J138
caaaagccauuccauauccau

SEQ ID NO: 539119 - RNA, 18 nt, Chlamydophila pneumoniae J138
caaaaggcccaacucuug

SEQ ID NO: 539120 - RNA, 17 nt, Chlamydophila pneumoniae J138
caaaaggcccaacucuu

SEQ ID NO: 539121 - RNA, 17 nt, Chlamydophila pneumoniae J138
caaaaggcacagcaaug

SEQ ID NO: 539122 - RNA, 13 nt, Chlamydophila pneumoniae J138
caaagaaagugaa

SEQ ID NO: 539123 - RNA, 21 nt, Chlamydophila pneumoniae J138
caaagaaaauucucagauugc

SEQ ID NO: 539124 - RNA, 23 nt, Chlamydophila pneumoniae J138
caaagaagucgcuagaucacaag

SEQ ID NO: 539125 - RNA, 16 nt, Chlamydophila pneumoniae J138
caaagaauucagagaa

SEQ ID NO: 539126 - RNA, 19 nt, Chlamydophila pneumoniae J138
caaagaacacccccgcagc

SEQ ID NO: 539127 - RNA, 15 nt, Chlamydophila pneumoniae J138
caaagaacagcacuc

SEQ ID NO: 539128 - RNA, 20 nt, Chlamydophila pneumoniae J138
caaagaacagcacucucugc

SEQ ID NO: 539129 - RNA, 19 nt, Chlamydophila pneumoniae J138
caaagaacucaacuuuuuu

SEQ ID NO: 539130 - RNA, 18 nt, Chlamydophila pneumoniae J138
caaagaauucagagaaag

SEQ ID NO: 539131 - RNA, 12 nt, Chlamydophila pneumoniae J138
caaagauugcua

SEQ ID NO: 539132 - RNA, 14 nt, Chlamydophila pneumoniae J138
caaagauuuccaau

SEQ ID NO: 539133 - RNA, 21 nt, Chlamydophila pneumoniae J138
caaagauuucugcuguguuau

SEQ ID NO: 539134 - RNA, 20 nt, Chlamydophila pneumoniae J138
caaaguacuaauuacagaau

SEQ ID NO: 539135 - RNA, 23 nt, Chlamydophila pneumoniae J138
caaagguuauggaugcuaaauuu

SEQ ID NO: 539136 - RNA, 14 nt, Chlamydophila pneumoniae J138
caaagccugaaaaa

SEQ ID NO: 539137 - RNA, 21 nt, Chlamydophila pneumoniae J138
caaagcgaccugcaaaugaag

SEQ ID NO: 539138 - RNA, 17 nt, Chlamydophila pneumoniae J138
caaagucaaauacuucu

SEQ ID NO: 539139 - RNA, 20 nt, Chlamydophila pneumoniae J138
caaagucaaauacuucuccu

SEQ ID NO: 539140 - RNA, 22 nt, Chlamydophila pneumoniae J138
caaauaaguccuguuugaaaau

SEQ ID NO: 539141 - RNA, 20 nt, Chlamydophila pneumoniae J138
caaauaauuaaauauauaaa

SEQ ID NO: 539142 - RNA, 12 nt, Chlamydophila pneumoniae J138
caaauaaaacaa

SEQ ID NO: 539143 - RNA, 22 nt, Chlamydophila pneumoniae J138
caaauuaccuugagacaaagaa

SEQ ID NO: 539144 - RNA, 13 nt, Chlamydophila pneumoniae J138
caaaucaucaaaa

SEQ ID NO: 539145 - RNA, 15 nt, Chlamydophila pneumoniae J138
caaaucuaaaaccug

SEQ ID NO: 539146 - RNA, 21 nt, Chlamydophila pneumoniae J138
caaaucuaucugcacuuucuu

SEQ ID NO: 539147 - RNA, 17 nt, Chlamydophila pneumoniae J138
caaauaguucaucauau

SEQ ID NO: 539148 - RNA, 20 nt, Chlamydophila pneumoniae J138
caaauauaguuuucauaauc

SEQ ID NO: 539149 - RNA, 23 nt, Chlamydophila pneumoniae J138
caacagcuaauacaucaccacug

SEQ ID NO: 539150 - RNA, 16 nt, Chlamydophila pneumoniae J138
caacagcuaauacauc

SEQ ID NO: 539151 - RNA, 24 nt, Chlamydophila pneumoniae J138
caacacgucacuggggcauaagaa

SEQ ID NO: 539152 - RNA, 18 nt, Chlamydophila pneumoniae J138
caaauuuccauaggaucu

SEQ ID NO: 539153 - RNA, 19 nt, Chlamydophila pneumoniae J138
caaauuucauuuagacaau

SEQ ID NO: 539154 - RNA, 23 nt, Chlamydophila pneumoniae J138
caaauugcaauuuucuaaagauu

SEQ ID NO: 539155 - RNA, 17 nt, Chlamydophila pneumoniae J138
caaauugagaaauauaa

SEQ ID NO: 539156 - RNA, 17 nt, Chlamydophila pneumoniae J138
caaauugcaauuuucua

SEQ ID NO: 539157 - RNA, 17 nt, Chlamydophila pneumoniae J138
caacaaucuuucuucua

SEQ ID NO: 539158 - RNA, 12 nt, Chlamydophila pneumoniae J138
caacauucguua

SEQ ID NO: 539159 - RNA, 23 nt, Chlamydophila pneumoniae J138
caaccaaaaugcauuugccccua

SEQ ID NO: 539160 - RNA, 16 nt, Chlamydophila pneumoniae J138
caacauuuugccuuua

SEQ ID NO: 539161 - RNA, 16 nt, Chlamydophila pneumoniae J138
caaccaguugagucaa

SEQ ID NO: 539162 - RNA, 15 nt, Chlamydophila pneumoniae J138
caaccgccuuuauau

SEQ ID NO: 539163 - RNA, 16 nt, Chlamydophila pneumoniae J138
caacuagaccaauaaa

SEQ ID NO: 539164 - RNA, 21 nt, Chlamydophila pneumoniae J138
caacugaaaaaccauaagaau

SEQ ID NO: 539165 - RNA, 15 nt, Chlamydophila pneumoniae J138
caacucuugacaacg

SEQ ID NO: 539166 - RNA, 20 nt, Chlamydophila pneumoniae J138
caacucuuuaggucuugucu

SEQ ID NO: 539167 - RNA, 14 nt, Chlamydophila pneumoniae J138
caacggauaagacg

SEQ ID NO: 539168 - RNA, 13 nt, Chlamydophila pneumoniae J138
caaccucugcaug

SEQ ID NO: 539169 - RNA, 17 nt, Chlamydophila pneumoniae J138
caauccggcauaaaaaa

SEQ ID NO: 539170 - RNA, 20 nt, Chlamydophila pneumoniae J138
caaucccgaguccuaaaauu

SEQ ID NO: 539171 - RNA, 17 nt, Chlamydophila pneumoniae J138
caaucccccagcauuca

SEQ ID NO: 539172 - RNA, 16 nt, Chlamydophila pneumoniae J138
caauccacgcuccucu

SEQ ID NO: 539173 - RNA, 16 nt, Chlamydophila pneumoniae J138
caauccaacaaagaug

SEQ ID NO: 539174 - RNA, 14 nt, Chlamydophila pneumoniae J138
caaucucuuuaaaa

SEQ ID NO: 539175 - RNA, 13 nt, Chlamydophila pneumoniae J138
caaucugcugaag

SEQ ID NO: 539176 - RNA, 14 nt, Chlamydophila pneumoniae J138
caaucuaaaaucac

SEQ ID NO: 539177 - RNA, 19 nt, Chlamydophila pneumoniae J138
caaucuaaagguuuuaaau

SEQ ID NO: 539178 - RNA, 22 nt, Chlamydophila pneumoniae J138
caaucucaaaaucaaauagauu

SEQ ID NO: 539179 - RNA, 22 nt, Chlamydophila pneumoniae J138
caaucguagccccauagagccu

SEQ ID NO: 539180 - RNA, 15 nt, Chlamydophila pneumoniae J138
caaucgcaucaaaaa

SEQ ID NO: 539181 - RNA, 22 nt, Chlamydophila pneumoniae J138
caaugauuucuuuagcuuuauu

SEQ ID NO: 539182 - RNA, 19 nt, Chlamydophila pneumoniae J138
caaugcaaccuguaaagac

SEQ ID NO: 539183 - RNA, 15 nt, Chlamydophila pneumoniae J138
caaugcaugaaucuc

SEQ ID NO: 539184 - RNA, 16 nt, Chlamydophila pneumoniae J138
caaugcagcuaacgaa

SEQ ID NO: 539185 - RNA, 11 nt, Chlamydophila pneumoniae J138
caaugcauuug

SEQ ID NO: 539186 - RNA, 15 nt, Chlamydophila pneumoniae J138
caaugauguuuuuua

SEQ ID NO: 539187 - RNA, 14 nt, Chlamydophila pneumoniae J138
caaugauuucucua

SEQ ID NO: 539188 - RNA, 20 nt, Chlamydophila pneumoniae J138
caaugauauaaaagcugaau

SEQ ID NO: 539189 - RNA, 16 nt, Chlamydophila pneumoniae J138
caaugauauaaaagcu

SEQ ID NO: 539190 - RNA, 15 nt, Chlamydophila pneumoniae J138
caaugauaauuucau

SEQ ID NO: 539191 - RNA, 23 nt, Chlamydophila pneumoniae J138
caaucuuugaucgcuugugcaug

SEQ ID NO: 539192 - RNA, 20 nt, Chlamydophila pneumoniae J138
caaucuuccuuaaccuccuc

SEQ ID NO: 539193 - RNA, 19 nt, Chlamydophila pneumoniae J138
caaucuugagcauccaaaa

SEQ ID NO: 539194 - RNA, 18 nt, Chlamydophila pneumoniae J138
caaucugguuaagcacca

SEQ ID NO: 539195 - RNA, 21 nt, Chlamydophila pneumoniae J138
caaugacuguaggaccugugu

SEQ ID NO: 539196 - RNA, 21 nt, Chlamydophila pneumoniae J138
caaugacaauccgcauauuga

SEQ ID NO: 539197 - RNA, 15 nt, Chlamydophila pneumoniae J138
caaugcuucuucagc

SEQ ID NO: 539198 - RNA, 20 nt, Chlamydophila pneumoniae J138
caaugcuugucgcgacaaga

SEQ ID NO: 539199 - RNA, 16 nt, Chlamydophila pneumoniae J138
caaugcuaucuccaga

SEQ ID NO: 539200 - RNA, 15 nt, Chlamydophila pneumoniae J138
caauggaaauagaga

SEQ ID NO: 539201 - RNA, 20 nt, Chlamydophila pneumoniae J138
caauggcuuuuuuuguccca

SEQ ID NO: 539202 - RNA, 21 nt, Chlamydophila pneumoniae J138
caauaggccagaauguacaua

SEQ ID NO: 539203 - RNA, 12 nt, Chlamydophila pneumoniae J138
caauagcuucca

SEQ ID NO: 539204 - RNA, 15 nt, Chlamydophila pneumoniae J138
caauaguaaagcauu

SEQ ID NO: 539205 - RNA, 19 nt, Chlamydophila pneumoniae J138
caauaguguaacauugacc

SEQ ID NO: 539206 - RNA, 21 nt, Chlamydophila pneumoniae J138
caauauaaaugcuauuuuccu

SEQ ID NO: 539207 - RNA, 20 nt, Chlamydophila pneumoniae J138
caauauaaaugcuauuuucc

SEQ ID NO: 539208 - RNA, 17 nt, Chlamydophila pneumoniae J138
caauauaaaugcuauuu

SEQ ID NO: 539209 - RNA, 16 nt, Chlamydophila pneumoniae J138
caauagccaaagacuc

SEQ ID NO: 539210 - RNA, 23 nt, Chlamydophila pneumoniae J138
caauacuggagagguaaccagag

SEQ ID NO: 539211 - RNA, 19 nt, Chlamydophila pneumoniae J138
caauacucuguuuguaguc

SEQ ID NO: 539212 - RNA, 18 nt, Chlamydophila pneumoniae J138
caauacgcuagcucuuaa

SEQ ID NO: 539213 - RNA, 17 nt, Chlamydophila pneumoniae J138
caauacuaagaagcuca

SEQ ID NO: 539214 - RNA, 14 nt, Chlamydophila pneumoniae J138
caauacgaucuuuu

SEQ ID NO: 539215 - RNA, 17 nt, Chlamydophila pneumoniae J138
caauacagauaucaaag

SEQ ID NO: 539216 - RNA, 15 nt, Chlamydophila pneumoniae J138
caauacagauguaaa

SEQ ID NO: 539217 - RNA, 16 nt, Chlamydophila pneumoniae J138
caauaauuucaaagau

SEQ ID NO: 539218 - RNA, 15 nt, Chlamydophila pneumoniae J138
caauaauuucaaaga

SEQ ID NO: 539219 - RNA, 15 nt, Chlamydophila pneumoniae J138
caaguagcucucucc

SEQ ID NO: 539220 - RNA, 20 nt, Chlamydophila pneumoniae J138
caagguguugauuucgugaa

SEQ ID NO: 539221 - RNA, 14 nt, Chlamydophila pneumoniae J138
caagucauaaagau

SEQ ID NO: 539222 - RNA, 19 nt, Chlamydophila pneumoniae J138
caagucagccaagacaaaa

SEQ ID NO: 539223 - RNA, 22 nt, Chlamydophila pneumoniae J138
caauaaaaggguagcgaaugaa

SEQ ID NO: 539224 - RNA, 24 nt, Chlamydophila pneumoniae J138
caauaauaucgguuccuauaugaa

SEQ ID NO: 539225 - RNA, 19 nt, Chlamydophila pneumoniae J138
caaggacaggaccugugag

SEQ ID NO: 539226 - RNA, 15 nt, Chlamydophila pneumoniae J138
caaggaacauuugag

SEQ ID NO: 539227 - RNA, 16 nt, Chlamydophila pneumoniae J138
caaggaacauuugagc

SEQ ID NO: 539228 - RNA, 18 nt, Chlamydophila pneumoniae J138
caaggagcuuuucguaua

SEQ ID NO: 539229 - RNA, 16 nt, Chlamydophila pneumoniae J138
caaggagagaaaauau

SEQ ID NO: 539230 - RNA, 17 nt, Chlamydophila pneumoniae J138
caaggccuaaucuugua

SEQ ID NO: 539231 - RNA, 23 nt, Chlamydophila pneumoniae J138
caaggcgaguguagauuauugau

SEQ ID NO: 539232 - RNA, 17 nt, Chlamydophila pneumoniae J138
caaggcgccuaacaacu

SEQ ID NO: 539233 - RNA, 20 nt, Chlamydophila pneumoniae J138
caaggggcguucuugaaaaa

SEQ ID NO: 539234 - RNA, 21 nt, Chlamydophila pneumoniae J138
caagguaacauccauagagaa

SEQ ID NO: 539235 - RNA, 16 nt, Chlamydophila pneumoniae J138
caagguaacauccaua

SEQ ID NO: 539236 - RNA, 13 nt, Chlamydophila pneumoniae J138
caacuuccauaug

SEQ ID NO: 539237 - RNA, 16 nt, Chlamydophila pneumoniae J138
caagcacuuucgcaaa

SEQ ID NO: 539238 - RNA, 23 nt, Chlamydophila pneumoniae J138
caagcaggugugugguaaaaaua

SEQ ID NO: 539239 - RNA, 18 nt, Chlamydophila pneumoniae J138
caagcauuguuuguccua

SEQ ID NO: 539240 - RNA, 23 nt, Chlamydophila pneumoniae J138
caagcauaguacgauccaucuca

SEQ ID NO: 539241 - RNA, 14 nt, Chlamydophila pneumoniae J138
caagcauaaacucc

SEQ ID NO: 539242 - RNA, 14 nt, Chlamydophila pneumoniae J138
caagcauccuagaa

SEQ ID NO: 539243 - RNA, 23 nt, Chlamydophila pneumoniae J138
auuuuuuaaccgagcuuuuugcu

SEQ ID NO: 539244 - RNA, 17 nt, Chlamydophila pneumoniae J138
auuuuuuaauaaaauuu

SEQ ID NO: 539245 - RNA, 19 nt, Chlamydophila pneumoniae J138
auuuuuuacguucuuucuu

SEQ ID NO: 539246 - RNA, 13 nt, Chlamydophila pneumoniae J138
auuuuugcagagu

SEQ ID NO: 539247 - RNA, 15 nt, Chlamydophila pneumoniae J138
auuuuugcuaaacaa

SEQ ID NO: 539248 - RNA, 20 nt, Chlamydophila pneumoniae J138
auuuuucuuuuagagaaauc

SEQ ID NO: 539249 - RNA, 12 nt, Chlamydophila pneumoniae J138
auuuuuaaauac

SEQ ID NO: 539250 - RNA, 17 nt, Chlamydophila pneumoniae J138
auuuuuccuucaacaca

SEQ ID NO: 539251 - RNA, 12 nt, Chlamydophila pneumoniae J138
caaaaaagagcc

SEQ ID NO: 539252 - RNA, 13 nt, Chlamydophila pneumoniae J138
caaaaaacgauga

SEQ ID NO: 539253 - RNA, 16 nt, Chlamydophila pneumoniae J138
auuuuuucuguuccug

SEQ ID NO: 539254 - RNA, 11 nt, Chlamydophila pneumoniae J138
auuuuuucuug

SEQ ID NO: 539255 - RNA, 14 nt, Chlamydophila pneumoniae J138
auuuuuucauuguu

SEQ ID NO: 539256 - RNA, 21 nt, Chlamydophila pneumoniae J138
auuuuuugagaaauauaaaca

SEQ ID NO: 539257 - RNA, 15 nt, Chlamydophila pneumoniae J138
caaaaaaguaacuau

SEQ ID NO: 539258 - RNA, 13 nt, Chlamydophila pneumoniae J138
caaaaaaugcucc

SEQ ID NO: 539259 - RNA, 19 nt, Chlamydophila pneumoniae J138
caaaaacacugcgcaaaga

SEQ ID NO: 539260 - RNA, 23 nt, Chlamydophila pneumoniae J138
caaaaaauuuuauaggaauaaca

SEQ ID NO: 539261 - RNA, 20 nt, Chlamydophila pneumoniae J138
caaaaagcuucuuucuuacu

SEQ ID NO: 539262 - RNA, 18 nt, Chlamydophila pneumoniae J138
caaaaagcuucuuucuua

SEQ ID NO: 539263 - RNA, 20 nt, Chlamydophila pneumoniae J138
caaaaaguugaggaaaggag

SEQ ID NO: 539264 - RNA, 15 nt, Chlamydophila pneumoniae J138
caaaaaguugaggaa

SEQ ID NO: 539265 - RNA, 21 nt, Chlamydophila pneumoniae J138
caaaaauaaacauauucuccu

SEQ ID NO: 539266 - RNA, 23 nt, Chlamydophila pneumoniae J138
caaaaauaaacauauucuccuua

SEQ ID NO: 539267 - RNA, 10 nt, Chlamydophila pneumoniae J138
caaaaauucc

SEQ ID NO: 539268 - RNA, 22 nt, Chlamydophila pneumoniae J138
caaaaaugauaccaccuaaaau

SEQ ID NO: 539269 - RNA, 21 nt, Chlamydophila pneumoniae J138
caaaaaucgugcuuagagccu

SEQ ID NO: 539270 - RNA, 14 nt, Chlamydophila pneumoniae J138
caaaacaaaagcca

SEQ ID NO: 539271 - RNA, 12 nt, Chlamydophila pneumoniae J138
caaaacaggaau

SEQ ID NO: 539272 - RNA, 23 nt, Chlamydophila pneumoniae J138
caaaagaauuccuaaaacgagca

SEQ ID NO: 539273 - RNA, 13 nt, Chlamydophila pneumoniae J138
caaaagaccaaaa

SEQ ID NO: 539274 - RNA, 14 nt, Chlamydophila pneumoniae J138
caaaagaccaaaaa

SEQ ID NO: 539275 - RNA, 16 nt, Chlamydophila pneumoniae J138
caaaagaauuccuaaa

SEQ ID NO: 539276 - RNA, 18 nt, Chlamydophila pneumoniae J138
caaaagaaaucaaacauu

SEQ ID NO: 539277 - RNA, 19 nt, Chlamydophila pneumoniae J138
caaaagaaaucaaacauua

SEQ ID NO: 539278 - RNA, 21 nt, Chlamydophila pneumoniae J138
caaaagaauuaagaagaagcu

SEQ ID NO: 539279 - RNA, 17 nt, Chlamydophila pneumoniae J138
caaaagccauuccauau

SEQ ID NO: 539280 - RNA, 11 nt, Chlamydophila pneumoniae J138
caaaagaaaag

SEQ ID NO: 539281 - RNA, 19 nt, Chlamydophila pneumoniae J138
auuucuccgucaagaacaa

SEQ ID NO: 539282 - RNA, 23 nt, Chlamydophila pneumoniae J138
auuucuaaauagaaaacauagag

SEQ ID NO: 539283 - RNA, 17 nt, Chlamydophila pneumoniae J138
auuucauguaagaaugu

SEQ ID NO: 539284 - RNA, 21 nt, Chlamydophila pneumoniae J138
auuugaauaaaggacauagac

SEQ ID NO: 539285 - RNA, 13 nt, Chlamydophila pneumoniae J138
auuugaacaugag

SEQ ID NO: 539286 - RNA, 19 nt, Chlamydophila pneumoniae J138
auuucuugagucugaacau

SEQ ID NO: 539287 - RNA, 14 nt, Chlamydophila pneumoniae J138
auuucuucuuucca

SEQ ID NO: 539288 - RNA, 13 nt, Chlamydophila pneumoniae J138
auuucuucuucua

SEQ ID NO: 539289 - RNA, 14 nt, Chlamydophila pneumoniae J138
auuucuucuagcuc

SEQ ID NO: 539290 - RNA, 19 nt, Chlamydophila pneumoniae J138
auuucuucaauaggaauua

SEQ ID NO: 539291 - RNA, 22 nt, Chlamydophila pneumoniae J138
auuugugggacucuuccuucua

SEQ ID NO: 539292 - RNA, 17 nt, Chlamydophila pneumoniae J138
auuugugcgucaucaac

SEQ ID NO: 539293 - RNA, 19 nt, Chlamydophila pneumoniae J138
auuuguccuuugcuaagaa

SEQ ID NO: 539294 - RNA, 23 nt, Chlamydophila pneumoniae J138
auuugucuagugaagcugcuucu

SEQ ID NO: 539295 - RNA, 16 nt, Chlamydophila pneumoniae J138
auuugucaucacauca

SEQ ID NO: 539296 - RNA, 17 nt, Chlamydophila pneumoniae J138
auuugucaucacaucag

SEQ ID NO: 539297 - RNA, 18 nt, Chlamydophila pneumoniae J138
auuuuaaaaucuccucuc

SEQ ID NO: 539298 - RNA, 14 nt, Chlamydophila pneumoniae J138
auuugauucccgga

SEQ ID NO: 539299 - RNA, 22 nt, Chlamydophila pneumoniae J138
auuugcgaaguccuggauuuua

SEQ ID NO: 539300 - RNA, 17 nt, Chlamydophila pneumoniae J138
auuugcgacaccuacaa

SEQ ID NO: 539301 - RNA, 23 nt, Chlamydophila pneumoniae J138
auuugguaguuuuucagucucga

SEQ ID NO: 539302 - RNA, 14 nt, Chlamydophila pneumoniae J138
auuuugaugcuucu

SEQ ID NO: 539303 - RNA, 18 nt, Chlamydophila pneumoniae J138
auuuugagacgaaagaga

SEQ ID NO: 539304 - RNA, 20 nt, Chlamydophila pneumoniae J138
auuuugagacgaaagagauu

SEQ ID NO: 539305 - RNA, 21 nt, Chlamydophila pneumoniae J138
auuuuguaggaacaugccaaa

SEQ ID NO: 539306 - RNA, 21 nt, Chlamydophila pneumoniae J138
auuuucuuaugaccaagaaca

SEQ ID NO: 539307 - RNA, 16 nt, Chlamydophila pneumoniae J138
auuuucucuacacaga

SEQ ID NO: 539308 - RNA, 23 nt, Chlamydophila pneumoniae J138
auuuucaugggcagcgauauaag

SEQ ID NO: 539309 - RNA, 14 nt, Chlamydophila pneumoniae J138
auuuuaaagccucc

SEQ ID NO: 539310 - RNA, 17 nt, Chlamydophila pneumoniae J138
auuuuaaagccuccuca

SEQ ID NO: 539311 - RNA, 16 nt, Chlamydophila pneumoniae J138
auuuuaaagcaaaaau

SEQ ID NO: 539312 - RNA, 18 nt, Chlamydophila pneumoniae J138
auuuuaaagucacuuuca

SEQ ID NO: 539313 - RNA, 13 nt, Chlamydophila pneumoniae J138
auuuuaaauuuug

SEQ ID NO: 539314 - RNA, 21 nt, Chlamydophila pneumoniae J138
auuuuacuugcgauacaauaa

SEQ ID NO: 539315 - RNA, 17 nt, Chlamydophila pneumoniae J138
auuuucaggagaccagg

SEQ ID NO: 539316 - RNA, 20 nt, Chlamydophila pneumoniae J138
auuuucaggagaccagggau

SEQ ID NO: 539317 - RNA, 18 nt, Chlamydophila pneumoniae J138
auuuuauuaguuuugaaa

SEQ ID NO: 539318 - RNA, 22 nt, Chlamydophila pneumoniae J138
auucuccgccguggaauagcuu

SEQ ID NO: 539319 - RNA, 15 nt, Chlamydophila pneumoniae J138
auucuccgccagagu

SEQ ID NO: 539320 - RNA, 20 nt, Chlamydophila pneumoniae J138
auucuccgccagaguuuaaa

SEQ ID NO: 539321 - RNA, 13 nt, Chlamydophila pneumoniae J138
auucucgaaaaau

SEQ ID NO: 539322 - RNA, 17 nt, Chlamydophila pneumoniae J138
auucucgagcagcugca

SEQ ID NO: 539323 - RNA, 15 nt, Chlamydophila pneumoniae J138
auucuuaaaaagcua

SEQ ID NO: 539324 - RNA, 20 nt, Chlamydophila pneumoniae J138
auucuuaaaaagcuaaacaa

SEQ ID NO: 539325 - RNA, 13 nt, Chlamydophila pneumoniae J138
auucuuaaaaagc

SEQ ID NO: 539326 - RNA, 11 nt, Chlamydophila pneumoniae J138
auucugucuau

SEQ ID NO: 539327 - RNA, 14 nt, Chlamydophila pneumoniae J138
auucuguaauuuug

SEQ ID NO: 539328 - RNA, 20 nt, Chlamydophila pneumoniae J138
auucagggggaaagccaaga

SEQ ID NO: 539329 - RNA, 20 nt, Chlamydophila pneumoniae J138
auucuaggggagguaaaaua

SEQ ID NO: 539330 - RNA, 22 nt, Chlamydophila pneumoniae J138
auucuaggggagguaaaauaaa

SEQ ID NO: 539331 - RNA, 19 nt, Chlamydophila pneumoniae J138
auugacguagacgauuuuc

SEQ ID NO: 539332 - RNA, 21 nt, Chlamydophila pneumoniae J138
auugaccugcuuuuuuucuag

SEQ ID NO: 539333 - RNA, 13 nt, Chlamydophila pneumoniae J138
auugaaucagauu

SEQ ID NO: 539334 - RNA, 16 nt, Chlamydophila pneumoniae J138
auugaaucccaucaaa

SEQ ID NO: 539335 - RNA, 18 nt, Chlamydophila pneumoniae J138
auugaaucccaucaaagg

SEQ ID NO: 539336 - RNA, 21 nt, Chlamydophila pneumoniae J138
auugaaucccaucaaaggcaa

SEQ ID NO: 539337 - RNA, 22 nt, Chlamydophila pneumoniae J138
auugaauaagcuuuccucucca

SEQ ID NO: 539338 - RNA, 20 nt, Chlamydophila pneumoniae J138
auugaauaucgaguucuuuu

SEQ ID NO: 539339 - RNA, 23 nt, Chlamydophila pneumoniae J138
auugaaacuuuuuuucuucucua

SEQ ID NO: 539340 - RNA, 15 nt, Chlamydophila pneumoniae J138
auugaaacuuuuuuu

SEQ ID NO: 539341 - RNA, 18 nt, Chlamydophila pneumoniae J138
auucuucagaaucuuugu

SEQ ID NO: 539342 - RNA, 19 nt, Chlamydophila pneumoniae J138
auugcaaaaaugaaagaaa

SEQ ID NO: 539343 - RNA, 12 nt, Chlamydophila pneumoniae J138
auugcaauacau

SEQ ID NO: 539344 - RNA, 23 nt, Chlamydophila pneumoniae J138
auugcaauacaucuuaagagcaa

SEQ ID NO: 539345 - RNA, 17 nt, Chlamydophila pneumoniae J138
auugcaauuuucuaaag

SEQ ID NO: 539346 - RNA, 19 nt, Chlamydophila pneumoniae J138
auugcaauuuucuaaagau

SEQ ID NO: 539347 - RNA, 17 nt, Chlamydophila pneumoniae J138
auugcaaaaaugaaaga

SEQ ID NO: 539348 - RNA, 17 nt, Chlamydophila pneumoniae J138
auugcacucaucuugag

SEQ ID NO: 539349 - RNA, 18 nt, Chlamydophila pneumoniae J138
auugcacucaucuugagu

SEQ ID NO: 539350 - RNA, 22 nt, Chlamydophila pneumoniae J138
auugcucguauuagaguuucuu

SEQ ID NO: 539351 - RNA, 20 nt, Chlamydophila pneumoniae J138
auugcucguauuagaguuuc

SEQ ID NO: 539352 - RNA, 21 nt, Chlamydophila pneumoniae J138
auugcuaucaaagacucauga

SEQ ID NO: 539353 - RNA, 13 nt, Chlamydophila pneumoniae J138
auugccuucuucu

SEQ ID NO: 539354 - RNA, 22 nt, Chlamydophila pneumoniae J138
auugggagguucgcagaacuuc

SEQ ID NO: 539355 - RNA, 15 nt, Chlamydophila pneumoniae J138
auuggaugauagcua

SEQ ID NO: 539356 - RNA, 18 nt, Chlamydophila pneumoniae J138
auuggaggauaaaugagu

SEQ ID NO: 539357 - RNA, 20 nt, Chlamydophila pneumoniae J138
auuggaucuugauaaaagau

SEQ ID NO: 539358 - RNA, 15 nt, Chlamydophila pneumoniae J138
auugcuucuuccaag

SEQ ID NO: 539359 - RNA, 17 nt, Chlamydophila pneumoniae J138
auugcuugcgcagcuuc

SEQ ID NO: 539360 - RNA, 21 nt, Chlamydophila pneumoniae J138
auugcuugcgcaucagcagcu

SEQ ID NO: 539361 - RNA, 17 nt, Chlamydophila pneumoniae J138
auuuauuuugucuuuuu

SEQ ID NO: 539362 - RNA, 20 nt, Chlamydophila pneumoniae J138
auuuauuuugucuuuuuaag

SEQ ID NO: 539363 - RNA, 14 nt, Chlamydophila pneumoniae J138
auuucaaagaugca

SEQ ID NO: 539364 - RNA, 20 nt, Chlamydophila pneumoniae J138
auuucagcguagguuugcug

SEQ ID NO: 539365 - RNA, 18 nt, Chlamydophila pneumoniae J138
auuuagauuaaagagacu

SEQ ID NO: 539366 - RNA, 15 nt, Chlamydophila pneumoniae J138
auuuagagagaaaca

SEQ ID NO: 539367 - RNA, 21 nt, Chlamydophila pneumoniae J138
auuuaaaugccuuaaauguau

SEQ ID NO: 539368 - RNA, 17 nt, Chlamydophila pneumoniae J138
auuuaaagcugaaauuc

SEQ ID NO: 539369 - RNA, 15 nt, Chlamydophila pneumoniae J138
auuguucuugaaguu

SEQ ID NO: 539370 - RNA, 21 nt, Chlamydophila pneumoniae J138
auuguuuaaguccuucuuccc

SEQ ID NO: 539371 - RNA, 23 nt, Chlamydophila pneumoniae J138
auugugcauuaccuccuauuuuc

SEQ ID NO: 539372 - RNA, 22 nt, Chlamydophila pneumoniae J138
auuguaauuucuaaauagaaaa

SEQ ID NO: 539373 - RNA, 13 nt, Chlamydophila pneumoniae J138
auuguagagauua

SEQ ID NO: 539374 - RNA, 19 nt, Chlamydophila pneumoniae J138
auuaccuccuauuuucuua

SEQ ID NO: 539375 - RNA, 21 nt, Chlamydophila pneumoniae J138
auuaccguucccuaaaguaac

SEQ ID NO: 539376 - RNA, 17 nt, Chlamydophila pneumoniae J138
auuaccguuuccuccuc

SEQ ID NO: 539377 - RNA, 15 nt, Chlamydophila pneumoniae J138
auuaccuugagacaa

SEQ ID NO: 539378 - RNA, 14 nt, Chlamydophila pneumoniae J138
auuaccugcuaaac

SEQ ID NO: 539379 - RNA, 22 nt, Chlamydophila pneumoniae J138
auuaccugcuaaacuuuuuuuc

SEQ ID NO: 539380 - RNA, 19 nt, Chlamydophila pneumoniae J138
auuacacaacucuuucccu

SEQ ID NO: 539381 - RNA, 21 nt, Chlamydophila pneumoniae J138
auuacagaaaggcuuuucuuu

SEQ ID NO: 539382 - RNA, 23 nt, Chlamydophila pneumoniae J138
auuacagaucugcauaauuuuuc

SEQ ID NO: 539383 - RNA, 22 nt, Chlamydophila pneumoniae J138
auuacagauuucuucuucagag

SEQ ID NO: 539384 - RNA, 15 nt, Chlamydophila pneumoniae J138
auuagcuaaaucaaa

SEQ ID NO: 539385 - RNA, 19 nt, Chlamydophila pneumoniae J138
auuagcuaaaucaaaauuu

SEQ ID NO: 539386 - RNA, 15 nt, Chlamydophila pneumoniae J138
auuagcgaguacuuu

SEQ ID NO: 539387 - RNA, 20 nt, Chlamydophila pneumoniae J138
auuagcccuacgaauccaaa

SEQ ID NO: 539388 - RNA, 17 nt, Chlamydophila pneumoniae J138
auuagagccccaacccu

SEQ ID NO: 539389 - RNA, 13 nt, Chlamydophila pneumoniae J138
auuagagaauccg

SEQ ID NO: 539390 - RNA, 14 nt, Chlamydophila pneumoniae J138
auuagaaguaucuu

SEQ ID NO: 539391 - RNA, 21 nt, Chlamydophila pneumoniae J138
auuagaaguaucuugauguuu

SEQ ID NO: 539392 - RNA, 17 nt, Chlamydophila pneumoniae J138
auuagaaaagauaaaac

SEQ ID NO: 539393 - RNA, 20 nt, Chlamydophila pneumoniae J138
auuagaaaagauaaaacauu

SEQ ID NO: 539394 - RNA, 20 nt, Chlamydophila pneumoniae J138
auuaguagcuauucucaaau

SEQ ID NO: 539395 - RNA, 20 nt, Chlamydophila pneumoniae J138
auuaguaacuaaauucuuaa

SEQ ID NO: 539396 - RNA, 12 nt, Chlamydophila pneumoniae J138
auuaguuuguuu

SEQ ID NO: 539397 - RNA, 16 nt, Chlamydophila pneumoniae J138
auuaguuucacauagu

SEQ ID NO: 539398 - RNA, 23 nt, Chlamydophila pneumoniae J138
auuaguuucacauaguuuaauaa

SEQ ID NO: 539399 - RNA, 19 nt, Chlamydophila pneumoniae J138
auucagauggucagucucg

SEQ ID NO: 539400 - RNA, 14 nt, Chlamydophila pneumoniae J138
auucacuggaauga

SEQ ID NO: 539401 - RNA, 12 nt, Chlamydophila pneumoniae J138
auucacuggaau

SEQ ID NO: 539402 - RNA, 18 nt, Chlamydophila pneumoniae J138
auucacaaaucuuccccu

SEQ ID NO: 539403 - RNA, 15 nt, Chlamydophila pneumoniae J138
auucacaaaucuucc

SEQ ID NO: 539404 - RNA, 15 nt, Chlamydophila pneumoniae J138
auucaaugcagcuaa

SEQ ID NO: 539405 - RNA, 18 nt, Chlamydophila pneumoniae J138
auucaaugagcaucugag

SEQ ID NO: 539406 - RNA, 15 nt, Chlamydophila pneumoniae J138
auucacaucuuaaaa

SEQ ID NO: 539407 - RNA, 18 nt, Chlamydophila pneumoniae J138
auucaaaauagaagccac

SEQ ID NO: 539408 - RNA, 21 nt, Chlamydophila pneumoniae J138
auucaaacuccuuuuaaaauu

SEQ ID NO: 539409 - RNA, 20 nt, Chlamydophila pneumoniae J138
auucaaacuccuuuuaaaau

SEQ ID NO: 539410 - RNA, 21 nt, Chlamydophila pneumoniae J138
auuauuuguuucuuccauaca

SEQ ID NO: 539411 - RNA, 12 nt, Chlamydophila pneumoniae J138
auuauuuuaaag

SEQ ID NO: 539412 - RNA, 13 nt, Chlamydophila pneumoniae J138
auuauuuuaaagu

SEQ ID NO: 539413 - RNA, 17 nt, Chlamydophila pneumoniae J138
auuauuucuaaaaaaua

SEQ ID NO: 539414 - RNA, 18 nt, Chlamydophila pneumoniae J138
auuauuuguuucuuccau

SEQ ID NO: 539415 - RNA, 13 nt, Chlamydophila pneumoniae J138
auucaaccaaacg

SEQ ID NO: 539416 - RNA, 16 nt, Chlamydophila pneumoniae J138
auucaauaauuucaaa

SEQ ID NO: 539417 - RNA, 21 nt, Chlamydophila pneumoniae J138
auucaauaauuucaaagaugc

SEQ ID NO: 539418 - RNA, 12 nt, Chlamydophila pneumoniae J138
auuaucuccaaa

SEQ ID NO: 539419 - RNA, 11 nt, Chlamydophila pneumoniae J138
auuaucuacag

SEQ ID NO: 539420 - RNA, 17 nt, Chlamydophila pneumoniae J138
auuaucccaaacuucuu

SEQ ID NO: 539421 - RNA, 15 nt, Chlamydophila pneumoniae J138
auuaucauaaauacg

SEQ ID NO: 539422 - RNA, 17 nt, Chlamydophila pneumoniae J138
auuauguauaaacucca

SEQ ID NO: 539423 - RNA, 15 nt, Chlamydophila pneumoniae J138
auuauguagaucaua

SEQ ID NO: 539424 - RNA, 17 nt, Chlamydophila pneumoniae J138
auuauguagaucuacaa

SEQ ID NO: 539425 - RNA, 13 nt, Chlamydophila pneumoniae J138
auuauugaauaag

SEQ ID NO: 539426 - RNA, 23 nt, Chlamydophila pneumoniae J138
auuauucccuaagguagagucca

SEQ ID NO: 539427 - RNA, 21 nt, Chlamydophila pneumoniae J138
auguuuguaguguugaauaag

SEQ ID NO: 539428 - RNA, 20 nt, Chlamydophila pneumoniae J138
auguuucuaagcugaaagaa

SEQ ID NO: 539429 - RNA, 15 nt, Chlamydophila pneumoniae J138
auguuucuuccugaa

SEQ ID NO: 539430 - RNA, 20 nt, Chlamydophila pneumoniae J138
auguuucuuccugaaucagc

SEQ ID NO: 539431 - RNA, 15 nt, Chlamydophila pneumoniae J138
auguugucucauggg

SEQ ID NO: 539432 - RNA, 20 nt, Chlamydophila pneumoniae J138
auguugcuaagcgaaccaaa

SEQ ID NO: 539433 - RNA, 15 nt, Chlamydophila pneumoniae J138
auuaaaaauuuaaaa

SEQ ID NO: 539434 - RNA, 16 nt, Chlamydophila pneumoniae J138
auuaaacgaauacugu

SEQ ID NO: 539435 - RNA, 24 nt, Chlamydophila pneumoniae J138
auuaaauucuuuucuacaugcuca

SEQ ID NO: 539436 - RNA, 19 nt, Chlamydophila pneumoniae J138
auuaaaucguauugacuuu

SEQ ID NO: 539437 - RNA, 22 nt, Chlamydophila pneumoniae J138
auuaaaucguacuucacuucug

SEQ ID NO: 539438 - RNA, 20 nt, Chlamydophila pneumoniae J138
auuaacagagcgccuccacc

SEQ ID NO: 539439 - RNA, 22 nt, Chlamydophila pneumoniae J138
auuaacuccucggcaacuacug

SEQ ID NO: 539440 - RNA, 12 nt, Chlamydophila pneumoniae J138
auuaacuuuaua

SEQ ID NO: 539441 - RNA, 20 nt, Chlamydophila pneumoniae J138
auuaagaagaaccucauuuu

SEQ ID NO: 539442 - RNA, 11 nt, Chlamydophila pneumoniae J138
auuaagaagau

SEQ ID NO: 539443 - RNA, 18 nt, Chlamydophila pneumoniae J138
auuaacuuuauacagcug

SEQ ID NO: 539444 - RNA, 16 nt, Chlamydophila pneumoniae J138
auuaagauaaacagca

SEQ ID NO: 539445 - RNA, 18 nt, Chlamydophila pneumoniae J138
auuaagauaaacauuaag

SEQ ID NO: 539446 - RNA, 17 nt, Chlamydophila pneumoniae J138
auuaagacucaauacuu

SEQ ID NO: 539447 - RNA, 15 nt, Chlamydophila pneumoniae J138
auuaagaauggaugu

SEQ ID NO: 539448 - RNA, 16 nt, Chlamydophila pneumoniae J138
auuaaggauuccuuga

SEQ ID NO: 539449 - RNA, 22 nt, Chlamydophila pneumoniae J138
auuaaggcuccagcauaaggau

SEQ ID NO: 539450 - RNA, 16 nt, Chlamydophila pneumoniae J138
auuaauaaauuuaucu

SEQ ID NO: 539451 - RNA, 14 nt, Chlamydophila pneumoniae J138
auuaauacuuugcc

SEQ ID NO: 539452 - RNA, 13 nt, Chlamydophila pneumoniae J138
auuaauaaauuua

SEQ ID NO: 539453 - RNA, 18 nt, Chlamydophila pneumoniae J138
augcgcagcucggaugga

SEQ ID NO: 539454 - RNA, 19 nt, Chlamydophila pneumoniae J138
auggcagccuggaaagcuu

SEQ ID NO: 539455 - RNA, 16 nt, Chlamydophila pneumoniae J138
auggcaucuaagccag

SEQ ID NO: 539456 - RNA, 20 nt, Chlamydophila pneumoniae J138
auggcauugggaaggaucug

SEQ ID NO: 539457 - RNA, 22 nt, Chlamydophila pneumoniae J138
auggcucugucacuagagaaaa

SEQ ID NO: 539458 - RNA, 16 nt, Chlamydophila pneumoniae J138
auggcucaacuuaagu

SEQ ID NO: 539459 - RNA, 16 nt, Chlamydophila pneumoniae J138
augggagaagcuaagg

SEQ ID NO: 539460 - RNA, 15 nt, Chlamydophila pneumoniae J138
augggaauuugauuu

SEQ ID NO: 539461 - RNA, 15 nt, Chlamydophila pneumoniae J138
augggaucggucuuu

SEQ ID NO: 539462 - RNA, 18 nt, Chlamydophila pneumoniae J138
augggauccugcaaagcc

SEQ ID NO: 539463 - RNA, 22 nt, Chlamydophila pneumoniae J138
auggggauuaucccaaacuucu

SEQ ID NO: 539464 - RNA, 17 nt, Chlamydophila pneumoniae J138
auggugaagaauaauag

SEQ ID NO: 539465 - RNA, 20 nt, Chlamydophila pneumoniae J138
auggucucccucacaagaag

SEQ ID NO: 539466 - RNA, 14 nt, Chlamydophila pneumoniae J138
augguacaauacug

SEQ ID NO: 539467 - RNA, 14 nt, Chlamydophila pneumoniae J138
auguaagaauguag

SEQ ID NO: 539468 - RNA, 16 nt, Chlamydophila pneumoniae J138
auguaggaugugaagg

SEQ ID NO: 539469 - RNA, 17 nt, Chlamydophila pneumoniae J138
auguaaucccagauuuu

SEQ ID NO: 539470 - RNA, 18 nt, Chlamydophila pneumoniae J138
auguaaucccagauuuuu

SEQ ID NO: 539471 - RNA, 19 nt, Chlamydophila pneumoniae J138
auguaaucccagauuuuuu

SEQ ID NO: 539472 - RNA, 17 nt, Chlamydophila pneumoniae J138
auguaaucauaaaaaaa

SEQ ID NO: 539473 - RNA, 15 nt, Chlamydophila pneumoniae J138
auguauaaacuccac

SEQ ID NO: 539474 - RNA, 13 nt, Chlamydophila pneumoniae J138
auguauaaaguuu

SEQ ID NO: 539475 - RNA, 22 nt, Chlamydophila pneumoniae J138
auguaucggggauugcaaaauu

SEQ ID NO: 539476 - RNA, 22 nt, Chlamydophila pneumoniae J138
auguauggugcgcgucuccuug

SEQ ID NO: 539477 - RNA, 21 nt, Chlamydophila pneumoniae J138
auguccgugagcaacaagcug

SEQ ID NO: 539478 - RNA, 18 nt, Chlamydophila pneumoniae J138
augugcuuuugguucuug

SEQ ID NO: 539479 - RNA, 15 nt, Chlamydophila pneumoniae J138
auguuaaucuaauuu

SEQ ID NO: 539480 - RNA, 21 nt, Chlamydophila pneumoniae J138
auguuaagcguauagaauaga

SEQ ID NO: 539481 - RNA, 16 nt, Chlamydophila pneumoniae J138
auguguuuccuuuucu

SEQ ID NO: 539482 - RNA, 21 nt, Chlamydophila pneumoniae J138
auguguuuccuuuucuccuuc

SEQ ID NO: 539483 - RNA, 16 nt, Chlamydophila pneumoniae J138
augucuuugaauauau

SEQ ID NO: 539484 - RNA, 16 nt, Chlamydophila pneumoniae J138
augugaagccauuuuc

SEQ ID NO: 539485 - RNA, 16 nt, Chlamydophila pneumoniae J138
auguccuucaaaaugu

SEQ ID NO: 539486 - RNA, 20 nt, Chlamydophila pneumoniae J138
auguccuccauggaaagaaa

SEQ ID NO: 539487 - RNA, 23 nt, Chlamydophila pneumoniae J138
aucuucuuucuaucgauagccau

SEQ ID NO: 539488 - RNA, 18 nt, Chlamydophila pneumoniae J138
aucuucuuggcuuucccc

SEQ ID NO: 539489 - RNA, 23 nt, Chlamydophila pneumoniae J138
aucuucuucuggcugagagaagc

SEQ ID NO: 539490 - RNA, 15 nt, Chlamydophila pneumoniae J138
aucuucuuagccaaa

SEQ ID NO: 539491 - RNA, 15 nt, Chlamydophila pneumoniae J138
aucuucugaaaucaa

SEQ ID NO: 539492 - RNA, 18 nt, Chlamydophila pneumoniae J138
aucuggggcuuccagaaa

SEQ ID NO: 539493 - RNA, 15 nt, Chlamydophila pneumoniae J138
aucugcguuuaaggg

SEQ ID NO: 539494 - RNA, 13 nt, Chlamydophila pneumoniae J138
aucuugaaaguac

SEQ ID NO: 539495 - RNA, 16 nt, Chlamydophila pneumoniae J138
aucuugauaaaagaua

SEQ ID NO: 539496 - RNA, 14 nt, Chlamydophila pneumoniae J138
aucuugagaaaaga

SEQ ID NO: 539497 - RNA, 23 nt, Chlamydophila pneumoniae J138
aucuuuaaauucgccaaacgaau

SEQ ID NO: 539498 - RNA, 14 nt, Chlamydophila pneumoniae J138
aucuugauuaggaa

SEQ ID NO: 539499 - RNA, 11 nt, Chlamydophila pneumoniae J138
aucuuguugua

SEQ ID NO: 539500 - RNA, 22 nt, Chlamydophila pneumoniae J138
aucuugaugaccucuauaccua

SEQ ID NO: 539501 - RNA, 22 nt, Chlamydophila pneumoniae J138
aucuuucaucaaugcgauuacu

SEQ ID NO: 539502 - RNA, 21 nt, Chlamydophila pneumoniae J138
aucuuucauucccuuuuucca

SEQ ID NO: 539503 - RNA, 19 nt, Chlamydophila pneumoniae J138
aucuuucaauguaauugcg

SEQ ID NO: 539504 - RNA, 16 nt, Chlamydophila pneumoniae J138
aucuuuaagauuuuua

SEQ ID NO: 539505 - RNA, 21 nt, Chlamydophila pneumoniae J138
aucuuuccucucaugaaauuu

SEQ ID NO: 539506 - RNA, 17 nt, Chlamydophila pneumoniae J138
aucuuuccucucaugaa

SEQ ID NO: 539507 - RNA, 15 nt, Chlamydophila pneumoniae J138
aucuuuucaaaagaa

SEQ ID NO: 539508 - RNA, 18 nt, Chlamydophila pneumoniae J138
aucuuuucuuucuaagau

SEQ ID NO: 539509 - RNA, 23 nt, Chlamydophila pneumoniae J138
aucuuuugauuaggcuucagaga

SEQ ID NO: 539510 - RNA, 13 nt, Chlamydophila pneumoniae J138
aucuuuucuagaa

SEQ ID NO: 539511 - RNA, 15 nt, Chlamydophila pneumoniae J138
aucuuuucuagaaaa

SEQ ID NO: 539512 - RNA, 23 nt, Chlamydophila pneumoniae J138
aucuuuugguugugucaacccuu

SEQ ID NO: 539513 - RNA, 17 nt, Chlamydophila pneumoniae J138
augaaaggcucguagau

SEQ ID NO: 539514 - RNA, 15 nt, Chlamydophila pneumoniae J138
augaaaccuucagau

SEQ ID NO: 539515 - RNA, 16 nt, Chlamydophila pneumoniae J138
augaaacgaaagcagu

SEQ ID NO: 539516 - RNA, 19 nt, Chlamydophila pneumoniae J138
augaagagugguuccugaa

SEQ ID NO: 539517 - RNA, 14 nt, Chlamydophila pneumoniae J138
augagaaaaagaau

SEQ ID NO: 539518 - RNA, 12 nt, Chlamydophila pneumoniae J138
augagaaaaaga

SEQ ID NO: 539519 - RNA, 20 nt, Chlamydophila pneumoniae J138
augagaaauacgcuuuucuu

SEQ ID NO: 539520 - RNA, 23 nt, Chlamydophila pneumoniae J138
augagauuccuaugaucagagag

SEQ ID NO: 539521 - RNA, 19 nt, Chlamydophila pneumoniae J138
augagggucggauuuagau

SEQ ID NO: 539522 - RNA, 17 nt, Chlamydophila pneumoniae J138
augagaauuuucaugau

SEQ ID NO: 539523 - RNA, 13 nt, Chlamydophila pneumoniae J138
augagagagcucu

SEQ ID NO: 539524 - RNA, 18 nt, Chlamydophila pneumoniae J138
augagagagcucuucagc

SEQ ID NO: 539525 - RNA, 23 nt, Chlamydophila pneumoniae J138
augagauccaaagccugaaaaau

SEQ ID NO: 539526 - RNA, 15 nt, Chlamydophila pneumoniae J138
augagauccaaagcc

SEQ ID NO: 539527 - RNA, 16 nt, Chlamydophila pneumoniae J138
augagaucagcuccca

SEQ ID NO: 539528 - RNA, 16 nt, Chlamydophila pneumoniae J138
augaccaagaacauag

SEQ ID NO: 539529 - RNA, 16 nt, Chlamydophila pneumoniae J138
augaaucugguuccuu

SEQ ID NO: 539530 - RNA, 21 nt, Chlamydophila pneumoniae J138
augaaucgaagaacagaggau

SEQ ID NO: 539531 - RNA, 17 nt, Chlamydophila pneumoniae J138
augaugacauugcaaua

SEQ ID NO: 539532 - RNA, 18 nt, Chlamydophila pneumoniae J138
augaugagaacguccuca

SEQ ID NO: 539533 - RNA, 14 nt, Chlamydophila pneumoniae J138
augauaaagccugc

SEQ ID NO: 539534 - RNA, 15 nt, Chlamydophila pneumoniae J138
augcaagcaacucuu

SEQ ID NO: 539535 - RNA, 21 nt, Chlamydophila pneumoniae J138
augcaacagagucagaagcua

SEQ ID NO: 539536 - RNA, 21 nt, Chlamydophila pneumoniae J138
augcaaauuccagaaaaagaa

SEQ ID NO: 539537 - RNA, 18 nt, Chlamydophila pneumoniae J138
augcaaauccuguagaaa

SEQ ID NO: 539538 - RNA, 22 nt, Chlamydophila pneumoniae J138
augauuucuuuagcuuuauuga

SEQ ID NO: 539539 - RNA, 14 nt, Chlamydophila pneumoniae J138
augauguguugauu

SEQ ID NO: 539540 - RNA, 14 nt, Chlamydophila pneumoniae J138
augcaagugcuuuc

SEQ ID NO: 539541 - RNA, 14 nt, Chlamydophila pneumoniae J138
augcacaaaauaaa

SEQ ID NO: 539542 - RNA, 22 nt, Chlamydophila pneumoniae J138
augcagccugcgacuacaagau

SEQ ID NO: 539543 - RNA, 17 nt, Chlamydophila pneumoniae J138
augccauugaucagaau

SEQ ID NO: 539544 - RNA, 19 nt, Chlamydophila pneumoniae J138
augccaguuccuaaagcuu

SEQ ID NO: 539545 - RNA, 13 nt, Chlamydophila pneumoniae J138
augccaguuccua

SEQ ID NO: 539546 - RNA, 15 nt, Chlamydophila pneumoniae J138
augccauuguagaga

SEQ ID NO: 539547 - RNA, 15 nt, Chlamydophila pneumoniae J138
augccgcaucuagaa

SEQ ID NO: 539548 - RNA, 19 nt, Chlamydophila pneumoniae J138
augccugaaaacaaggcaa

SEQ ID NO: 539549 - RNA, 13 nt, Chlamydophila pneumoniae J138
augccucuuucau

SEQ ID NO: 539550 - RNA, 19 nt, Chlamydophila pneumoniae J138
augccucaggucugcugag

SEQ ID NO: 539551 - RNA, 19 nt, Chlamydophila pneumoniae J138
augccucuuucauacuaaa

SEQ ID NO: 539552 - RNA, 22 nt, Chlamydophila pneumoniae J138
augccuaaauagcucaguuggu

SEQ ID NO: 539553 - RNA, 21 nt, Chlamydophila pneumoniae J138
augccuauuaagucaccuuaa

SEQ ID NO: 539554 - RNA, 23 nt, Chlamydophila pneumoniae J138
augccuggccaucaucaccagaa

SEQ ID NO: 539555 - RNA, 17 nt, Chlamydophila pneumoniae J138
augccuuuggcaaucau

SEQ ID NO: 539556 - RNA, 18 nt, Chlamydophila pneumoniae J138
aucuauacccaguuguau

SEQ ID NO: 539557 - RNA, 22 nt, Chlamydophila pneumoniae J138
aucuaggucgauaucccacaga

SEQ ID NO: 539558 - RNA, 21 nt, Chlamydophila pneumoniae J138
aucuagaagcauucucaauuc

SEQ ID NO: 539559 - RNA, 13 nt, Chlamydophila pneumoniae J138
aucuagaugauaa

SEQ ID NO: 539560 - RNA, 15 nt, Chlamydophila pneumoniae J138
aucuaccgugaagau

SEQ ID NO: 539561 - RNA, 15 nt, Chlamydophila pneumoniae J138
aucuacgagcauuca

SEQ ID NO: 539562 - RNA, 15 nt, Chlamydophila pneumoniae J138
aucuacucuuuaaaa

SEQ ID NO: 539563 - RNA, 14 nt, Chlamydophila pneumoniae J138
aucuagaacauaca

SEQ ID NO: 539564 - RNA, 16 nt, Chlamydophila pneumoniae J138
aucuagaaagauuuau

SEQ ID NO: 539565 - RNA, 14 nt, Chlamydophila pneumoniae J138
aucuagaaaaugaa

SEQ ID NO: 539566 - RNA, 14 nt, Chlamydophila pneumoniae J138
aucuagaaagauuu

SEQ ID NO: 539567 - RNA, 23 nt, Chlamydophila pneumoniae J138
aucuauagcauuguuuggcaguu

SEQ ID NO: 539568 - RNA, 22 nt, Chlamydophila pneumoniae J138
aucuauccuuaggugaaauauu

SEQ ID NO: 539569 - RNA, 15 nt, Chlamydophila pneumoniae J138
aucuaugagaguaag

SEQ ID NO: 539570 - RNA, 17 nt, Chlamydophila pneumoniae J138
aucuaugaaguccugau

SEQ ID NO: 539571 - RNA, 22 nt, Chlamydophila pneumoniae J138
aucuaucugcaauuccgaagaa

SEQ ID NO: 539572 - RNA, 17 nt, Chlamydophila pneumoniae J138
aucucacaaaagucucu

SEQ ID NO: 539573 - RNA, 12 nt, Chlamydophila pneumoniae J138
aucucagugaac

SEQ ID NO: 539574 - RNA, 22 nt, Chlamydophila pneumoniae J138
aucucaguaggagcagcggcac

SEQ ID NO: 539575 - RNA, 15 nt, Chlamydophila pneumoniae J138
aucuccaaagaucau

SEQ ID NO: 539576 - RNA, 20 nt, Chlamydophila pneumoniae J138
aucucaugcggacuuuauuc

SEQ ID NO: 539577 - RNA, 22 nt, Chlamydophila pneumoniae J138
aucucauuucguagacgcucua

SEQ ID NO: 539578 - RNA, 23 nt, Chlamydophila pneumoniae J138
aucuccagguagcagaguuuuuc

SEQ ID NO: 539579 - RNA, 17 nt, Chlamydophila pneumoniae J138
aucucccaagacgagaa

SEQ ID NO: 539580 - RNA, 20 nt, Chlamydophila pneumoniae J138
aucuccccauucacaaaucu

SEQ ID NO: 539581 - RNA, 16 nt, Chlamydophila pneumoniae J138
aucuccugcagguuug

SEQ ID NO: 539582 - RNA, 17 nt, Chlamydophila pneumoniae J138
aucuccuuucaagagca

SEQ ID NO: 539583 - RNA, 18 nt, Chlamydophila pneumoniae J138
aucucuaguucuagaaag

SEQ ID NO: 539584 - RNA, 21 nt, Chlamydophila pneumoniae J138
aucucuagggauaauuaaacu

SEQ ID NO: 539585 - RNA, 13 nt, Chlamydophila pneumoniae J138
aucucuccucccc

SEQ ID NO: 539586 - RNA, 15 nt, Chlamydophila pneumoniae J138
aucucuccacagggu

SEQ ID NO: 539587 - RNA, 22 nt, Chlamydophila pneumoniae J138
aucucgcuauuccauaaaaaug

SEQ ID NO: 539588 - RNA, 15 nt, Chlamydophila pneumoniae J138
aucucgggagaacau

SEQ ID NO: 539589 - RNA, 19 nt, Chlamydophila pneumoniae J138
aucucuccuugacaaauaa

SEQ ID NO: 539590 - RNA, 17 nt, Chlamydophila pneumoniae J138
aucucugaccaucaaug

SEQ ID NO: 539591 - RNA, 19 nt, Chlamydophila pneumoniae J138
aucucugaccaucaaugag

SEQ ID NO: 539592 - RNA, 19 nt, Chlamydophila pneumoniae J138
aucucuggaauacauuccu

SEQ ID NO: 539593 - RNA, 23 nt, Chlamydophila pneumoniae J138
aucucuguuuuuugaaaacuuca

SEQ ID NO: 539594 - RNA, 13 nt, Chlamydophila pneumoniae J138
aucucugugccau

SEQ ID NO: 539595 - RNA, 16 nt, Chlamydophila pneumoniae J138
aucucugugguuccug

SEQ ID NO: 539596 - RNA, 15 nt, Chlamydophila pneumoniae J138
aucucuucuguagga

SEQ ID NO: 539597 - RNA, 17 nt, Chlamydophila pneumoniae J138
aucucuuaaaacaugag

SEQ ID NO: 539598 - RNA, 16 nt, Chlamydophila pneumoniae J138
aucucuugaagcacuu

SEQ ID NO: 539599 - RNA, 13 nt, Chlamydophila pneumoniae J138
aucucuuuaacuu

SEQ ID NO: 539600 - RNA, 11 nt, Chlamydophila pneumoniae J138
aucucuuucac

SEQ ID NO: 539601 - RNA, 19 nt, Chlamydophila pneumoniae J138
aucucuuuuggaagaccuu

SEQ ID NO: 539602 - RNA, 23 nt, Chlamydophila pneumoniae J138
aucucuuuuggaagaccuuugga

SEQ ID NO: 539603 - RNA, 23 nt, Chlamydophila pneumoniae J138
aucugagucauaagcucuauuuc

SEQ ID NO: 539604 - RNA, 20 nt, Chlamydophila pneumoniae J138
aucugacagaccuugcauua

SEQ ID NO: 539605 - RNA, 22 nt, Chlamydophila pneumoniae J138
aucugaucuucagggacaucau

SEQ ID NO: 539606 - RNA, 14 nt, Chlamydophila pneumoniae J138
aucugauagaacag

SEQ ID NO: 539607 - RNA, 18 nt, Chlamydophila pneumoniae J138
aucugaugcaccauaaua

SEQ ID NO: 539608 - RNA, 22 nt, Chlamydophila pneumoniae J138
aucugcgacaaaaaugccugaa

SEQ ID NO: 539609 - RNA, 19 nt, Chlamydophila pneumoniae J138
aucugcgacaaaaaugccu

SEQ ID NO: 539610 - RNA, 21 nt, Chlamydophila pneumoniae J138
aucugcagcguuucuagggac

SEQ ID NO: 539611 - RNA, 12 nt, Chlamydophila pneumoniae J138
aucugcauucca

SEQ ID NO: 539612 - RNA, 19 nt, Chlamydophila pneumoniae J138
aucagcuggguaaguccac

SEQ ID NO: 539613 - RNA, 15 nt, Chlamydophila pneumoniae J138
aucgaaaaauaccuc

SEQ ID NO: 539614 - RNA, 19 nt, Chlamydophila pneumoniae J138
aucgaaaccacagcaaaga

SEQ ID NO: 539615 - RNA, 23 nt, Chlamydophila pneumoniae J138
aucgauaacgauuucuugaagau

SEQ ID NO: 539616 - RNA, 16 nt, Chlamydophila pneumoniae J138
aucgucccuaaagcuu

SEQ ID NO: 539617 - RNA, 15 nt, Chlamydophila pneumoniae J138
aucguccucaccgau

SEQ ID NO: 539618 - RNA, 19 nt, Chlamydophila pneumoniae J138
aucgugauugcugucagaa

SEQ ID NO: 539619 - RNA, 23 nt, Chlamydophila pneumoniae J138
aucgugauugcugucagaacaag

SEQ ID NO: 539620 - RNA, 15 nt, Chlamydophila pneumoniae J138
aucgucggaagacuu

SEQ ID NO: 539621 - RNA, 14 nt, Chlamydophila pneumoniae J138
aucuaaaaucacac

SEQ ID NO: 539622 - RNA, 14 nt, Chlamydophila pneumoniae J138
aucuaaagaaaugu

SEQ ID NO: 539623 - RNA, 15 nt, Chlamydophila pneumoniae J138
aucuaaagaaaugua

SEQ ID NO: 539624 - RNA, 18 nt, Chlamydophila pneumoniae J138
aucuacacacacgccaau

SEQ ID NO: 539625 - RNA, 20 nt, Chlamydophila pneumoniae J138
aucuacaagacuacgacaga

SEQ ID NO: 539626 - RNA, 18 nt, Chlamydophila pneumoniae J138
aucgggguuucagaagga

SEQ ID NO: 539627 - RNA, 15 nt, Chlamydophila pneumoniae J138
aucgcguguaaaagc

SEQ ID NO: 539628 - RNA, 22 nt, Chlamydophila pneumoniae J138
aucggaucuuuucuuucuaaga

SEQ ID NO: 539629 - RNA, 15 nt, Chlamydophila pneumoniae J138
aucggaucuuuucuu

SEQ ID NO: 539630 - RNA, 18 nt, Chlamydophila pneumoniae J138
aucggaguuaucaaaagg

SEQ ID NO: 539631 - RNA, 15 nt, Chlamydophila pneumoniae J138
auaaugcucacuucu

SEQ ID NO: 539632 - RNA, 17 nt, Chlamydophila pneumoniae J138
auaauguuuuaauagcu

SEQ ID NO: 539633 - RNA, 13 nt, Chlamydophila pneumoniae J138
auaauuaaauaua

SEQ ID NO: 539634 - RNA, 18 nt, Chlamydophila pneumoniae J138
auaaugaagcagggaaaa

SEQ ID NO: 539635 - RNA, 20 nt, Chlamydophila pneumoniae J138
auaaucagaggagccuccau

SEQ ID NO: 539636 - RNA, 14 nt, Chlamydophila pneumoniae J138
auaaucagaggagc

SEQ ID NO: 539637 - RNA, 18 nt, Chlamydophila pneumoniae J138
auaaucacuuaauaaugu

SEQ ID NO: 539638 - RNA, 14 nt, Chlamydophila pneumoniae J138
auaauagagccucc

SEQ ID NO: 539639 - RNA, 14 nt, Chlamydophila pneumoniae J138
auaauagagaagaa

SEQ ID NO: 539640 - RNA, 13 nt, Chlamydophila pneumoniae J138
auaauagagccuc

SEQ ID NO: 539641 - RNA, 21 nt, Chlamydophila pneumoniae J138
auaauagauauacgcccaugu

SEQ ID NO: 539642 - RNA, 20 nt, Chlamydophila pneumoniae J138
auaauaggauaagaaauuaa

SEQ ID NO: 539643 - RNA, 18 nt, Chlamydophila pneumoniae J138
auaauaggauaagaaauu

SEQ ID NO: 539644 - RNA, 22 nt, Chlamydophila pneumoniae J138
auaauagugagcucccugaugu

SEQ ID NO: 539645 - RNA, 17 nt, Chlamydophila pneumoniae J138
auaauauaacugcauac

SEQ ID NO: 539646 - RNA, 20 nt, Chlamydophila pneumoniae J138
auaagcuaacaccucuucaa

SEQ ID NO: 539647 - RNA, 19 nt, Chlamydophila pneumoniae J138
auaagcuugccagcagaag

SEQ ID NO: 539648 - RNA, 21 nt, Chlamydophila pneumoniae J138
auaagcuugccagcagaaguu

SEQ ID NO: 539649 - RNA, 17 nt, Chlamydophila pneumoniae J138
auaagcuugccagcaga

SEQ ID NO: 539650 - RNA, 15 nt, Chlamydophila pneumoniae J138
auaagcuugccagca

SEQ ID NO: 539651 - RNA, 16 nt, Chlamydophila pneumoniae J138
auaagcaggaaaagca

SEQ ID NO: 539652 - RNA, 18 nt, Chlamydophila pneumoniae J138
auaagcaggaaaagcaaa

SEQ ID NO: 539653 - RNA, 22 nt, Chlamydophila pneumoniae J138
auaagaagcucuaucuuuggua

SEQ ID NO: 539654 - RNA, 13 nt, Chlamydophila pneumoniae J138
auaagagacauuu

SEQ ID NO: 539655 - RNA, 15 nt, Chlamydophila pneumoniae J138
auaagaccagaaagg

SEQ ID NO: 539656 - RNA, 18 nt, Chlamydophila pneumoniae J138
auaagauccaaaaauucu

SEQ ID NO: 539657 - RNA, 15 nt, Chlamydophila pneumoniae J138
auaagauaauagaga

SEQ ID NO: 539658 - RNA, 20 nt, Chlamydophila pneumoniae J138
auaaggcuuuucugcuccug

SEQ ID NO: 539659 - RNA, 23 nt, Chlamydophila pneumoniae J138
auaagggggaucuucagagagaa

SEQ ID NO: 539660 - RNA, 19 nt, Chlamydophila pneumoniae J138
auaaguagauuaaaggcau

SEQ ID NO: 539661 - RNA, 18 nt, Chlamydophila pneumoniae J138
auaagggggaucuucaga

SEQ ID NO: 539662 - RNA, 13 nt, Chlamydophila pneumoniae J138
auaaguucuucca

SEQ ID NO: 539663 - RNA, 15 nt, Chlamydophila pneumoniae J138
auaauaaaagcaccc

SEQ ID NO: 539664 - RNA, 13 nt, Chlamydophila pneumoniae J138
auaauaaaagcac

SEQ ID NO: 539665 - RNA, 11 nt, Chlamydophila pneumoniae J138
auaaaguauau

SEQ ID NO: 539666 - RNA, 23 nt, Chlamydophila pneumoniae J138
auaaagguuacaagcaauacuaa

SEQ ID NO: 539667 - RNA, 14 nt, Chlamydophila pneumoniae J138
auaaaggcauaacu

SEQ ID NO: 539668 - RNA, 24 nt, Chlamydophila pneumoniae J138
auaaaggcauaacugugcuccaua

SEQ ID NO: 539669 - RNA, 14 nt, Chlamydophila pneumoniae J138
auaaaggacauaga

SEQ ID NO: 539670 - RNA, 20 nt, Chlamydophila pneumoniae J138
auaaaggaccuguuuucuuu

SEQ ID NO: 539671 - RNA, 22 nt, Chlamydophila pneumoniae J138
auaaagcaaagauaaagaaguu

SEQ ID NO: 539672 - RNA, 23 nt, Chlamydophila pneumoniae J138
auaaauaauuacaauuuuagaua

SEQ ID NO: 539673 - RNA, 17 nt, Chlamydophila pneumoniae J138
auaaaucccgaacaauc

SEQ ID NO: 539674 - RNA, 15 nt, Chlamydophila pneumoniae J138
auaaaccuuugguuu

SEQ ID NO: 539675 - RNA, 20 nt, Chlamydophila pneumoniae J138
auaaacucuuguugucuaug

SEQ ID NO: 539676 - RNA, 15 nt, Chlamydophila pneumoniae J138
auaaagcaaaugccu

SEQ ID NO: 539677 - RNA, 14 nt, Chlamydophila pneumoniae J138
auaaagaucuucau

SEQ ID NO: 539678 - RNA, 15 nt, Chlamydophila pneumoniae J138
auaaagaucuuuuau

SEQ ID NO: 539679 - RNA, 22 nt, Chlamydophila pneumoniae J138
auaaagaucuuuauuuuuaaaa

SEQ ID NO: 539680 - RNA, 21 nt, Chlamydophila pneumoniae J138
auaaagauaaucuguaagaaa

SEQ ID NO: 539681 - RNA, 16 nt, Chlamydophila pneumoniae J138
auaaaaaguuuuuguu

SEQ ID NO: 539682 - RNA, 22 nt, Chlamydophila pneumoniae J138
auaaccgaaacuucucagauaa

SEQ ID NO: 539683 - RNA, 18 nt, Chlamydophila pneumoniae J138
auaaccaaguaaaucaga

SEQ ID NO: 539684 - RNA, 20 nt, Chlamydophila pneumoniae J138
auaaccaaguaaaucagacu

SEQ ID NO: 539685 - RNA, 22 nt, Chlamydophila pneumoniae J138
auaacacuucuuucuugcucug

SEQ ID NO: 539686 - RNA, 14 nt, Chlamydophila pneumoniae J138
auaacaccaaaaga

SEQ ID NO: 539687 - RNA, 20 nt, Chlamydophila pneumoniae J138
auaacaccaaaagaauacuc

SEQ ID NO: 539688 - RNA, 12 nt, Chlamydophila pneumoniae J138
auaaauuugcuu

SEQ ID NO: 539689 - RNA, 15 nt, Chlamydophila pneumoniae J138
auaaccuaaggcaug

SEQ ID NO: 539690 - RNA, 20 nt, Chlamydophila pneumoniae J138
auaaccuaaggcauggcaca

SEQ ID NO: 539691 - RNA, 21 nt, Chlamydophila pneumoniae J138
auaacugcauacaaggcacau

SEQ ID NO: 539692 - RNA, 13 nt, Chlamydophila pneumoniae J138
auaacuuuaucau

SEQ ID NO: 539693 - RNA, 16 nt, Chlamydophila pneumoniae J138
auaacuuuaucauaga

SEQ ID NO: 539694 - RNA, 19 nt, Chlamydophila pneumoniae J138
auaacuuugcaugaggaga

SEQ ID NO: 539695 - RNA, 17 nt, Chlamydophila pneumoniae J138
auaagaaccucuaauuu

SEQ ID NO: 539696 - RNA, 18 nt, Chlamydophila pneumoniae J138
auaagaaaauccuaacaa

SEQ ID NO: 539697 - RNA, 18 nt, Chlamydophila pneumoniae J138
agucuugcgccagcaaag

SEQ ID NO: 539698 - RNA, 20 nt, Chlamydophila pneumoniae J138
agucuugaguucuuuuguuu

SEQ ID NO: 539699 - RNA, 20 nt, Chlamydophila pneumoniae J138
agucuugcgccagcaaagau

SEQ ID NO: 539700 - RNA, 16 nt, Chlamydophila pneumoniae J138
agucuuggacguuccu

SEQ ID NO: 539701 - RNA, 14 nt, Chlamydophila pneumoniae J138
agucugcagcagau

SEQ ID NO: 539702 - RNA, 17 nt, Chlamydophila pneumoniae J138
agucugaacauucuuaa

SEQ ID NO: 539703 - RNA, 18 nt, Chlamydophila pneumoniae J138
agucuguuuuggaaagaa

SEQ ID NO: 539704 - RNA, 15 nt, Chlamydophila pneumoniae J138
agucuguuuuggaaa

SEQ ID NO: 539705 - RNA, 18 nt, Chlamydophila pneumoniae J138
agucugguuuuucuccug

SEQ ID NO: 539706 - RNA, 15 nt, Chlamydophila pneumoniae J138
agucuggcauaaguc

SEQ ID NO: 539707 - RNA, 23 nt, Chlamydophila pneumoniae J138
agucuucccucuccuugaagcaa

SEQ ID NO: 539708 - RNA, 17 nt, Chlamydophila pneumoniae J138
agucuucccucuccuug

SEQ ID NO: 539709 - RNA, 20 nt, Chlamydophila pneumoniae J138
aguccuucuagguauuuguu

SEQ ID NO: 539710 - RNA, 13 nt, Chlamydophila pneumoniae J138
aguccuucuuccc

SEQ ID NO: 539711 - RNA, 19 nt, Chlamydophila pneumoniae J138
aguccuucuugcaaagaua

SEQ ID NO: 539712 - RNA, 17 nt, Chlamydophila pneumoniae J138
aguccuugaauuaguuu

SEQ ID NO: 539713 - RNA, 16 nt, Chlamydophila pneumoniae J138
agucgaaucuaaaaac

SEQ ID NO: 539714 - RNA, 13 nt, Chlamydophila pneumoniae J138
aguccuaaaauuu

SEQ ID NO: 539715 - RNA, 23 nt, Chlamydophila pneumoniae J138
agucuauagccucuucuacacca

SEQ ID NO: 539716 - RNA, 14 nt, Chlamydophila pneumoniae J138
agucucucuaucua

SEQ ID NO: 539717 - RNA, 23 nt, Chlamydophila pneumoniae J138
agucucuuucagcucaaguuggc

SEQ ID NO: 539718 - RNA, 21 nt, Chlamydophila pneumoniae J138
agucguuuucucgaauagaaa

SEQ ID NO: 539719 - RNA, 15 nt, Chlamydophila pneumoniae J138
agucguuaacaucaa

SEQ ID NO: 539720 - RNA, 11 nt, Chlamydophila pneumoniae J138
agugagauacg

SEQ ID NO: 539721 - RNA, 14 nt, Chlamydophila pneumoniae J138
agugagaucaaaaa

SEQ ID NO: 539722 - RNA, 16 nt, Chlamydophila pneumoniae J138
agugacuuuucuucuu

SEQ ID NO: 539723 - RNA, 15 nt, Chlamydophila pneumoniae J138
agugcucaguaaaua

SEQ ID NO: 539724 - RNA, 16 nt, Chlamydophila pneumoniae J138
agugcguacucuucuu

SEQ ID NO: 539725 - RNA, 17 nt, Chlamydophila pneumoniae J138
aguggacggggagagcc

SEQ ID NO: 539726 - RNA, 18 nt, Chlamydophila pneumoniae J138
aguggaguaaaagcccua

SEQ ID NO: 539727 - RNA, 19 nt, Chlamydophila pneumoniae J138
agugucaucggcuucucca

SEQ ID NO: 539728 - RNA, 21 nt, Chlamydophila pneumoniae J138
agugucaucggcuucuccaac

SEQ ID NO: 539729 - RNA, 16 nt, Chlamydophila pneumoniae J138
agugucauacgcagca

SEQ ID NO: 539730 - RNA, 17 nt, Chlamydophila pneumoniae J138
agugucauacgcagcac

SEQ ID NO: 539731 - RNA, 22 nt, Chlamydophila pneumoniae J138
agugucuaagauauagagagag

SEQ ID NO: 539732 - RNA, 14 nt, Chlamydophila pneumoniae J138
agugugacugcaga

SEQ ID NO: 539733 - RNA, 21 nt, Chlamydophila pneumoniae J138
aguguauaacguagaugucuu

SEQ ID NO: 539734 - RNA, 19 nt, Chlamydophila pneumoniae J138
aguguauaacguagauguc

SEQ ID NO: 539735 - RNA, 15 nt, Chlamydophila pneumoniae J138
aguguauaacguaga

SEQ ID NO: 539736 - RNA, 22 nt, Chlamydophila pneumoniae J138
aguguauuguuugcuauacaga

SEQ ID NO: 539737 - RNA, 19 nt, Chlamydophila pneumoniae J138
agugguuccugaaaagcau

SEQ ID NO: 539738 - RNA, 16 nt, Chlamydophila pneumoniae J138
aguggucggcagaaac

SEQ ID NO: 539739 - RNA, 20 nt, Chlamydophila pneumoniae J138
agugguaugcuuuuccuucu

SEQ ID NO: 539740 - RNA, 15 nt, Chlamydophila pneumoniae J138
agugugaggagacuu

SEQ ID NO: 539741 - RNA, 17 nt, Chlamydophila pneumoniae J138
agugugacugcagagaa

SEQ ID NO: 539742 - RNA, 14 nt, Chlamydophila pneumoniae J138
agugugcucuguau

SEQ ID NO: 539743 - RNA, 15 nt, Chlamydophila pneumoniae J138
aguguguaaauguuu

SEQ ID NO: 539744 - RNA, 16 nt, Chlamydophila pneumoniae J138
aguguguaaauguuuu

SEQ ID NO: 539745 - RNA, 11 nt, Chlamydophila pneumoniae J138
aguguguuuca

SEQ ID NO: 539746 - RNA, 18 nt, Chlamydophila pneumoniae J138
aguguugccagcccaugu

SEQ ID NO: 539747 - RNA, 19 nt, Chlamydophila pneumoniae J138
aguuacgcgaccucuguag

SEQ ID NO: 539748 - RNA, 16 nt, Chlamydophila pneumoniae J138
aguuacggaacucauu

SEQ ID NO: 539749 - RNA, 20 nt, Chlamydophila pneumoniae J138
aguuagaagagucauuauca

SEQ ID NO: 539750 - RNA, 16 nt, Chlamydophila pneumoniae J138
aguuagaagagucauu

SEQ ID NO: 539751 - RNA, 18 nt, Chlamydophila pneumoniae J138
aguuacugucugcaaaga

SEQ ID NO: 539752 - RNA, 20 nt, Chlamydophila pneumoniae J138
aguuagauguaaucauaaaa

SEQ ID NO: 539753 - RNA, 23 nt, Chlamydophila pneumoniae J138
aguuaggaucccugauuccuugg

SEQ ID NO: 539754 - RNA, 15 nt, Chlamydophila pneumoniae J138
aguuaggaucccuga

SEQ ID NO: 539755 - RNA, 23 nt, Chlamydophila pneumoniae J138
aguuccaagacaauaaaaaagag

SEQ ID NO: 539756 - RNA, 20 nt, Chlamydophila pneumoniae J138
aguuccaagacaauaaaaaa

SEQ ID NO: 539757 - RNA, 22 nt, Chlamydophila pneumoniae J138
aguuccucauccucaucaucag

SEQ ID NO: 539758 - RNA, 21 nt, Chlamydophila pneumoniae J138
aguuccucauccucaucauca

SEQ ID NO: 539759 - RNA, 20 nt, Chlamydophila pneumoniae J138
aguuccucauccucaucauc

SEQ ID NO: 539760 - RNA, 15 nt, Chlamydophila pneumoniae J138
aguuccucauccuca

SEQ ID NO: 539761 - RNA, 16 nt, Chlamydophila pneumoniae J138
aguucccacuggacuu

SEQ ID NO: 539762 - RNA, 14 nt, Chlamydophila pneumoniae J138
aguucaauuucuau

SEQ ID NO: 539763 - RNA, 13 nt, Chlamydophila pneumoniae J138
aguucacaagcag

SEQ ID NO: 539764 - RNA, 20 nt, Chlamydophila pneumoniae J138
aguucgggcuaaucauuaga

SEQ ID NO: 539765 - RNA, 17 nt, Chlamydophila pneumoniae J138
aguucguuggcccagag

SEQ ID NO: 539766 - RNA, 21 nt, Chlamydophila pneumoniae J138
aguugaaguuuugcucucuag

SEQ ID NO: 539767 - RNA, 22 nt, Chlamydophila pneumoniae J138
aguucuuuuugcagaucuuuua

SEQ ID NO: 539768 - RNA, 10 nt, Chlamydophila pneumoniae J138
aguucuuccu

SEQ ID NO: 539769 - RNA, 15 nt, Chlamydophila pneumoniae J138
aguucuuccaaagcu

SEQ ID NO: 539770 - RNA, 19 nt, Chlamydophila pneumoniae J138
aguugauuguagagacaua

SEQ ID NO: 539771 - RNA, 17 nt, Chlamydophila pneumoniae J138
aguugauuguagagaca

SEQ ID NO: 539772 - RNA, 19 nt, Chlamydophila pneumoniae J138
aguugauuuagaaucuuuu

SEQ ID NO: 539773 - RNA, 22 nt, Chlamydophila pneumoniae J138
aguugauuuagaaucuuuucua

SEQ ID NO: 539774 - RNA, 22 nt, Chlamydophila pneumoniae J138
aguuguuuuuugagauacagcu

SEQ ID NO: 539775 - RNA, 16 nt, Chlamydophila pneumoniae J138
aguuguuucuagaaaa

SEQ ID NO: 539776 - RNA, 17 nt, Chlamydophila pneumoniae J138
aguuuaauguuuggcca

SEQ ID NO: 539777 - RNA, 18 nt, Chlamydophila pneumoniae J138
aguuuaaacgucuuauga

SEQ ID NO: 539778 - RNA, 17 nt, Chlamydophila pneumoniae J138
aguuggaacauaucgau

SEQ ID NO: 539779 - RNA, 20 nt, Chlamydophila pneumoniae J138
aguuuacaaauaaaaugauu

SEQ ID NO: 539780 - RNA, 15 nt, Chlamydophila pneumoniae J138
aguuuacaaauaaaa

SEQ ID NO: 539781 - RNA, 15 nt, Chlamydophila pneumoniae J138
aguuucuuuugcaaa

SEQ ID NO: 539782 - RNA, 20 nt, Chlamydophila pneumoniae J138
aguuuucuuaacuccagcga

SEQ ID NO: 539783 - RNA, 17 nt, Chlamydophila pneumoniae J138
aguuuguucacauuuuc

SEQ ID NO: 539784 - RNA, 16 nt, Chlamydophila pneumoniae J138
aguuuguucacuuggu

SEQ ID NO: 539785 - RNA, 17 nt, Chlamydophila pneumoniae J138
aguuuuaaugagagcau

SEQ ID NO: 539786 - RNA, 12 nt, Chlamydophila pneumoniae J138
aguuuuuuucuu

SEQ ID NO: 539787 - RNA, 14 nt, Chlamydophila pneumoniae J138
auaaaaaaacccuc

SEQ ID NO: 539788 - RNA, 18 nt, Chlamydophila pneumoniae J138
aguuuuuaauuuucuguu

SEQ ID NO: 539789 - RNA, 15 nt, Chlamydophila pneumoniae J138
auaccggcaaauaaa

SEQ ID NO: 539790 - RNA, 15 nt, Chlamydophila pneumoniae J138
auaccgcuguuuuau

SEQ ID NO: 539791 - RNA, 19 nt, Chlamydophila pneumoniae J138
auaccgcuguuuuauagca

SEQ ID NO: 539792 - RNA, 20 nt, Chlamydophila pneumoniae J138
auaccuguacgguaaaucca

SEQ ID NO: 539793 - RNA, 20 nt, Chlamydophila pneumoniae J138
auacguaauccagauuguuc

SEQ ID NO: 539794 - RNA, 13 nt, Chlamydophila pneumoniae J138
auacgcagcacgc

SEQ ID NO: 539795 - RNA, 15 nt, Chlamydophila pneumoniae J138
auacgucguuacagc

SEQ ID NO: 539796 - RNA, 16 nt, Chlamydophila pneumoniae J138
auacucgucaaauuca

SEQ ID NO: 539797 - RNA, 18 nt, Chlamydophila pneumoniae J138
auacucuagguuuucucu

SEQ ID NO: 539798 - RNA, 23 nt, Chlamydophila pneumoniae J138
auacucuucauccugaucuucuu

SEQ ID NO: 539799 - RNA, 15 nt, Chlamydophila pneumoniae J138
auacuccacuuuuuu

SEQ ID NO: 539800 - RNA, 18 nt, Chlamydophila pneumoniae J138
auacuccacuuuuuuccc

SEQ ID NO: 539801 - RNA, 15 nt, Chlamydophila pneumoniae J138
auacucauauuuugu

SEQ ID NO: 539802 - RNA, 14 nt, Chlamydophila pneumoniae J138
auacuucuccugaa

SEQ ID NO: 539803 - RNA, 15 nt, Chlamydophila pneumoniae J138
auacuucuccugaac

SEQ ID NO: 539804 - RNA, 12 nt, Chlamydophila pneumoniae J138
auacuucuccug

SEQ ID NO: 539805 - RNA, 20 nt, Chlamydophila pneumoniae J138
auacuucguuaugaagcuuc

SEQ ID NO: 539806 - RNA, 16 nt, Chlamydophila pneumoniae J138
auacuguuaacaagua

SEQ ID NO: 539807 - RNA, 15 nt, Chlamydophila pneumoniae J138
auacucuuugcagug

SEQ ID NO: 539808 - RNA, 17 nt, Chlamydophila pneumoniae J138
auagagauucuacaaau

SEQ ID NO: 539809 - RNA, 17 nt, Chlamydophila pneumoniae J138
auagagccuagagaguu

SEQ ID NO: 539810 - RNA, 20 nt, Chlamydophila pneumoniae J138
auagagccuagagaguucuu

SEQ ID NO: 539811 - RNA, 14 nt, Chlamydophila pneumoniae J138
auagagauucuaca

SEQ ID NO: 539812 - RNA, 11 nt, Chlamydophila pneumoniae J138
auagagaagau

SEQ ID NO: 539813 - RNA, 23 nt, Chlamydophila pneumoniae J138
auagacuuguauucuugagaguc

SEQ ID NO: 539814 - RNA, 13 nt, Chlamydophila pneumoniae J138
auacuucuccuga

SEQ ID NO: 539815 - RNA, 21 nt, Chlamydophila pneumoniae J138
auacuuguaccguaaagaaaa

SEQ ID NO: 539816 - RNA, 21 nt, Chlamydophila pneumoniae J138
auagaguagcucaucuagaaa

SEQ ID NO: 539817 - RNA, 20 nt, Chlamydophila pneumoniae J138
auagaguagcucaucuagaa

SEQ ID NO: 539818 - RNA, 15 nt, Chlamydophila pneumoniae J138
auagaggaaugaucc

SEQ ID NO: 539819 - RNA, 14 nt, Chlamydophila pneumoniae J138
auagaggucuuuga

SEQ ID NO: 539820 - RNA, 20 nt, Chlamydophila pneumoniae J138
auagaggagauccuaagaga

SEQ ID NO: 539821 - RNA, 14 nt, Chlamydophila pneumoniae J138
auagagcgguucuu

SEQ ID NO: 539822 - RNA, 21 nt, Chlamydophila pneumoniae J138
auagagcgguucuuucuagaa

SEQ ID NO: 539823 - RNA, 22 nt, Chlamydophila pneumoniae J138
auagagcgguucuuucuagaau

SEQ ID NO: 539824 - RNA, 17 nt, Chlamydophila pneumoniae J138
auagaguaucuaaaacu

SEQ ID NO: 539825 - RNA, 20 nt, Chlamydophila pneumoniae J138
auagaguaucuaaaacuucu

SEQ ID NO: 539826 - RNA, 21 nt, Chlamydophila pneumoniae J138
auagaguaucuaaaacuucuu

SEQ ID NO: 539827 - RNA, 13 nt, Chlamydophila pneumoniae J138
auagaucucuuga

SEQ ID NO: 539828 - RNA, 12 nt, Chlamydophila pneumoniae J138
auagaucucuug

SEQ ID NO: 539829 - RNA, 13 nt, Chlamydophila pneumoniae J138
auagauccugaaa

SEQ ID NO: 539830 - RNA, 15 nt, Chlamydophila pneumoniae J138
auagcaaugauguuu

SEQ ID NO: 539831 - RNA, 20 nt, Chlamydophila pneumoniae J138
auagcaauggcuuuuuuugu

SEQ ID NO: 539832 - RNA, 16 nt, Chlamydophila pneumoniae J138
auagcucagcucuaau

SEQ ID NO: 539833 - RNA, 20 nt, Chlamydophila pneumoniae J138
auagcucagcucuaauucuu

SEQ ID NO: 539834 - RNA, 21 nt, Chlamydophila pneumoniae J138
auagcuggcaaugauauccuc

SEQ ID NO: 539835 - RNA, 18 nt, Chlamydophila pneumoniae J138
auagcuggaucuucugau

SEQ ID NO: 539836 - RNA, 19 nt, Chlamydophila pneumoniae J138
auagcugaggcaucuauug

SEQ ID NO: 539837 - RNA, 12 nt, Chlamydophila pneumoniae J138
auagcuccuugg

SEQ ID NO: 539838 - RNA, 20 nt, Chlamydophila pneumoniae J138
auagcucguuauauuuuucu

SEQ ID NO: 539839 - RNA, 14 nt, Chlamydophila pneumoniae J138
auagcucuuuucau

SEQ ID NO: 539840 - RNA, 23 nt, Chlamydophila pneumoniae J138
auagcuggcaaugauauccucaa

SEQ ID NO: 539841 - RNA, 21 nt, Chlamydophila pneumoniae J138
auagcuucugacucuguugca

SEQ ID NO: 539842 - RNA, 17 nt, Chlamydophila pneumoniae J138
auagcuuuggaacgugc

SEQ ID NO: 539843 - RNA, 16 nt, Chlamydophila pneumoniae J138
auagcuuugaagagca

SEQ ID NO: 539844 - RNA, 13 nt, Chlamydophila pneumoniae J138
auaggaagcucuu

SEQ ID NO: 539845 - RNA, 23 nt, Chlamydophila pneumoniae J138
auaggaacaaagccaaauucucg

SEQ ID NO: 539846 - RNA, 23 nt, Chlamydophila pneumoniae J138
auaggaacucacaaacaacagaa

SEQ ID NO: 539847 - RNA, 19 nt, Chlamydophila pneumoniae J138
auagccauaauuagaacag

SEQ ID NO: 539848 - RNA, 22 nt, Chlamydophila pneumoniae J138
auagccauuagaaucucugccc

SEQ ID NO: 539849 - RNA, 13 nt, Chlamydophila pneumoniae J138
auagcgucuguua

SEQ ID NO: 539850 - RNA, 19 nt, Chlamydophila pneumoniae J138
auaggcauuacacaacucu

SEQ ID NO: 539851 - RNA, 13 nt, Chlamydophila pneumoniae J138
auaggcauuacac

SEQ ID NO: 539852 - RNA, 23 nt, Chlamydophila pneumoniae J138
auaggaauugcagcaaggagagu

SEQ ID NO: 539853 - RNA, 14 nt, Chlamydophila pneumoniae J138
auaggaucugcaug

SEQ ID NO: 539854 - RNA, 15 nt, Chlamydophila pneumoniae J138
auaggauccaggagu

SEQ ID NO: 539855 - RNA, 12 nt, Chlamydophila pneumoniae J138
auagggaauuuc

SEQ ID NO: 539856 - RNA, 22 nt, Chlamydophila pneumoniae J138
auagggcaggcggaaaggaagg

SEQ ID NO: 539857 - RNA, 23 nt, Chlamydophila pneumoniae J138
auaggcugcacacauccuggagc

SEQ ID NO: 539858 - RNA, 20 nt, Chlamydophila pneumoniae J138
auaggcucuuuagcaaacau

SEQ ID NO: 539859 - RNA, 15 nt, Chlamydophila pneumoniae J138
auaguaaacagaagu

SEQ ID NO: 539860 - RNA, 13 nt, Chlamydophila pneumoniae J138
auaguagaacugc

SEQ ID NO: 539861 - RNA, 22 nt, Chlamydophila pneumoniae J138
auaguauaauagugagcucccu

SEQ ID NO: 539862 - RNA, 21 nt, Chlamydophila pneumoniae J138
auaguagacauauccaaugag

SEQ ID NO: 539863 - RNA, 23 nt, Chlamydophila pneumoniae J138
auaguguauaucagcaaaaaacu

SEQ ID NO: 539864 - RNA, 19 nt, Chlamydophila pneumoniae J138
auaguuuuuauuuuuaaau

SEQ ID NO: 539865 - RNA, 20 nt, Chlamydophila pneumoniae J138
auaguuuuuauuuuuaaaua

SEQ ID NO: 539866 - RNA, 16 nt, Chlamydophila pneumoniae J138
auauaauuccaauugc

SEQ ID NO: 539867 - RNA, 20 nt, Chlamydophila pneumoniae J138
auauaagauaauagagaaga

SEQ ID NO: 539868 - RNA, 16 nt, Chlamydophila pneumoniae J138
auaucaccuacaucag

SEQ ID NO: 539869 - RNA, 17 nt, Chlamydophila pneumoniae J138
auaucauuaagaagauu

SEQ ID NO: 539870 - RNA, 14 nt, Chlamydophila pneumoniae J138
auaucagcaaaaaa

SEQ ID NO: 539871 - RNA, 16 nt, Chlamydophila pneumoniae J138
auaucagcaaaaaacu

SEQ ID NO: 539872 - RNA, 16 nt, Chlamydophila pneumoniae J138
auaucagcagcuucua

SEQ ID NO: 539873 - RNA, 16 nt, Chlamydophila pneumoniae J138
auaucaaagcauugca

SEQ ID NO: 539874 - RNA, 16 nt, Chlamydophila pneumoniae J138
auaucaaagaucugaa

SEQ ID NO: 539875 - RNA, 17 nt, Chlamydophila pneumoniae J138
auauagaagcugcugcu

SEQ ID NO: 539876 - RNA, 13 nt, Chlamydophila pneumoniae J138
auauacaauccag

SEQ ID NO: 539877 - RNA, 14 nt, Chlamydophila pneumoniae J138
auauacuuauacca

SEQ ID NO: 539878 - RNA, 17 nt, Chlamydophila pneumoniae J138
auauacuuauaccaccc

SEQ ID NO: 539879 - RNA, 18 nt, Chlamydophila pneumoniae J138
auauacuuauaccacccc

SEQ ID NO: 539880 - RNA, 13 nt, Chlamydophila pneumoniae J138
auaucgauaggau

SEQ ID NO: 539881 - RNA, 15 nt, Chlamydophila pneumoniae J138
auauccaccuuacca

SEQ ID NO: 539882 - RNA, 12 nt, Chlamydophila pneumoniae J138
auauccagaaau

SEQ ID NO: 539883 - RNA, 17 nt, Chlamydophila pneumoniae J138
auaucgaccuuaaaauu

SEQ ID NO: 539884 - RNA, 15 nt, Chlamydophila pneumoniae J138
auaucuauaaaugua

SEQ ID NO: 539885 - RNA, 17 nt, Chlamydophila pneumoniae J138
auaucuauagaaggcau

SEQ ID NO: 539886 - RNA, 20 nt, Chlamydophila pneumoniae J138
auaucuucuggguucuccac

SEQ ID NO: 539887 - RNA, 11 nt, Chlamydophila pneumoniae J138
auauuuaaaag

SEQ ID NO: 539888 - RNA, 12 nt, Chlamydophila pneumoniae J138
auauuuaaaagg

SEQ ID NO: 539889 - RNA, 13 nt, Chlamydophila pneumoniae J138
auauuuuaccauu

SEQ ID NO: 539890 - RNA, 15 nt, Chlamydophila pneumoniae J138
auauuguucuuccaa

SEQ ID NO: 539891 - RNA, 18 nt, Chlamydophila pneumoniae J138
auauugucaagaggcugu

SEQ ID NO: 539892 - RNA, 17 nt, Chlamydophila pneumoniae J138
auauugucaagaggcug

SEQ ID NO: 539893 - RNA, 22 nt, Chlamydophila pneumoniae J138
auauugccuucuucuuguucuu

SEQ ID NO: 539894 - RNA, 16 nt, Chlamydophila pneumoniae J138
auauuuuuguccugca

SEQ ID NO: 539895 - RNA, 13 nt, Chlamydophila pneumoniae J138
auauuuuuaaaga

SEQ ID NO: 539896 - RNA, 20 nt, Chlamydophila pneumoniae J138
auauuuucuugucucuugcg

SEQ ID NO: 539897 - RNA, 21 nt, Chlamydophila pneumoniae J138
auauuuuuugagaaauauaaa

SEQ ID NO: 539898 - RNA, 22 nt, Chlamydophila pneumoniae J138
aucaaaaauagcaggauagcaa

SEQ ID NO: 539899 - RNA, 12 nt, Chlamydophila pneumoniae J138
aucaaaaaugau

SEQ ID NO: 539900 - RNA, 15 nt, Chlamydophila pneumoniae J138
auauucuccuuacca

SEQ ID NO: 539901 - RNA, 15 nt, Chlamydophila pneumoniae J138
auauucucgaaaaau

SEQ ID NO: 539902 - RNA, 14 nt, Chlamydophila pneumoniae J138
auauucugauucuc

SEQ ID NO: 539903 - RNA, 23 nt, Chlamydophila pneumoniae J138
auauucugaaauuucugaaacaa

SEQ ID NO: 539904 - RNA, 22 nt, Chlamydophila pneumoniae J138
aucaacauucuucugucuguau

SEQ ID NO: 539905 - RNA, 16 nt, Chlamydophila pneumoniae J138
aucaaaacauaaugau

SEQ ID NO: 539906 - RNA, 13 nt, Chlamydophila pneumoniae J138
aucaagccuaaau

SEQ ID NO: 539907 - RNA, 15 nt, Chlamydophila pneumoniae J138
aucaaggaguacucu

SEQ ID NO: 539908 - RNA, 14 nt, Chlamydophila pneumoniae J138
aucaaugguuaaaa

SEQ ID NO: 539909 - RNA, 15 nt, Chlamydophila pneumoniae J138
aucacaagaaagaau

SEQ ID NO: 539910 - RNA, 19 nt, Chlamydophila pneumoniae J138
aucacaaauugucugagga

SEQ ID NO: 539911 - RNA, 21 nt, Chlamydophila pneumoniae J138
aucacaauuuuaaaaucuccu

SEQ ID NO: 539912 - RNA, 19 nt, Chlamydophila pneumoniae J138
aucaccguacuucccucau

SEQ ID NO: 539913 - RNA, 15 nt, Chlamydophila pneumoniae J138
aucaccuacaucaga

SEQ ID NO: 539914 - RNA, 16 nt, Chlamydophila pneumoniae J138
aucaccagcauuaaga

SEQ ID NO: 539915 - RNA, 15 nt, Chlamydophila pneumoniae J138
aucacauuccaagaa

SEQ ID NO: 539916 - RNA, 15 nt, Chlamydophila pneumoniae J138
aucacauagaaaaca

SEQ ID NO: 539917 - RNA, 17 nt, Chlamydophila pneumoniae J138
aucacauagaaaacaua

SEQ ID NO: 539918 - RNA, 13 nt, Chlamydophila pneumoniae J138
aucacaguuaaga

SEQ ID NO: 539919 - RNA, 15 nt, Chlamydophila pneumoniae J138
aucacaucaguuaac

SEQ ID NO: 539920 - RNA, 16 nt, Chlamydophila pneumoniae J138
aucacacuuucaucca

SEQ ID NO: 539921 - RNA, 23 nt, Chlamydophila pneumoniae J138
aucacagccaucgguucggucuc

SEQ ID NO: 539922 - RNA, 18 nt, Chlamydophila pneumoniae J138
aucacaggcuucaucaca

SEQ ID NO: 539923 - RNA, 14 nt, Chlamydophila pneumoniae J138
aucacgaaaaggag

SEQ ID NO: 539924 - RNA, 20 nt, Chlamydophila pneumoniae J138
aucacguaaggugucugcca

SEQ ID NO: 539925 - RNA, 15 nt, Chlamydophila pneumoniae J138
aucacuaucauggac

SEQ ID NO: 539926 - RNA, 16 nt, Chlamydophila pneumoniae J138
aucagagacaaguuca

SEQ ID NO: 539927 - RNA, 12 nt, Chlamydophila pneumoniae J138
aucagaggagcc

SEQ ID NO: 539928 - RNA, 23 nt, Chlamydophila pneumoniae J138
aucagaaucguucccaucacaua

SEQ ID NO: 539929 - RNA, 17 nt, Chlamydophila pneumoniae J138
aucagaaucguucccau

SEQ ID NO: 539930 - RNA, 18 nt, Chlamydophila pneumoniae J138
aucacuuauauuuucuau

SEQ ID NO: 539931 - RNA, 20 nt, Chlamydophila pneumoniae J138
aucagaaaugaagccaaaag

SEQ ID NO: 539932 - RNA, 19 nt, Chlamydophila pneumoniae J138
aucagaauccugaguaaaa

SEQ ID NO: 539933 - RNA, 18 nt, Chlamydophila pneumoniae J138
aucagaagccaccaaaaa

SEQ ID NO: 539934 - RNA, 19 nt, Chlamydophila pneumoniae J138
aucagaacaacgcugcuuc

SEQ ID NO: 539935 - RNA, 23 nt, Chlamydophila pneumoniae J138
aucagcaacaucguuaauauaau

SEQ ID NO: 539936 - RNA, 15 nt, Chlamydophila pneumoniae J138
aucagcaaaacuccc

SEQ ID NO: 539937 - RNA, 15 nt, Chlamydophila pneumoniae J138
aucagcacacugcuu

SEQ ID NO: 539938 - RNA, 17 nt, Chlamydophila pneumoniae J138
aucagcaagaucuaacu

SEQ ID NO: 539939 - RNA, 21 nt, Chlamydophila pneumoniae J138
aggguauccugcuccaaaaug

SEQ ID NO: 539940 - RNA, 17 nt, Chlamydophila pneumoniae J138
agguaaaacuacaggaa

SEQ ID NO: 539941 - RNA, 16 nt, Chlamydophila pneumoniae J138
agguaaaauaaagagc

SEQ ID NO: 539942 - RNA, 12 nt, Chlamydophila pneumoniae J138
aggguuugcaug

SEQ ID NO: 539943 - RNA, 19 nt, Chlamydophila pneumoniae J138
aggguuuugaaauaauuuu

SEQ ID NO: 539944 - RNA, 12 nt, Chlamydophila pneumoniae J138
aggguucaucug

SEQ ID NO: 539945 - RNA, 19 nt, Chlamydophila pneumoniae J138
agguaacauccauagagaa

SEQ ID NO: 539946 - RNA, 15 nt, Chlamydophila pneumoniae J138
agguaagaagcuguc

SEQ ID NO: 539947 - RNA, 22 nt, Chlamydophila pneumoniae J138
agguaucaauaaugacucuaga

SEQ ID NO: 539948 - RNA, 14 nt, Chlamydophila pneumoniae J138
agguaucagcaaga

SEQ ID NO: 539949 - RNA, 16 nt, Chlamydophila pneumoniae J138
agguaucccacgauau

SEQ ID NO: 539950 - RNA, 22 nt, Chlamydophila pneumoniae J138
agguaucucuccacagggucua

SEQ ID NO: 539951 - RNA, 20 nt, Chlamydophila pneumoniae J138
aggucacagcauuuucucug

SEQ ID NO: 539952 - RNA, 16 nt, Chlamydophila pneumoniae J138
aggucacagcauuuuc

SEQ ID NO: 539953 - RNA, 13 nt, Chlamydophila pneumoniae J138
agguacuuuauag

SEQ ID NO: 539954 - RNA, 15 nt, Chlamydophila pneumoniae J138
agguagauagaaauu

SEQ ID NO: 539955 - RNA, 14 nt, Chlamydophila pneumoniae J138
agguagaguccaca

SEQ ID NO: 539956 - RNA, 16 nt, Chlamydophila pneumoniae J138
agguaaugucguaccc

SEQ ID NO: 539957 - RNA, 19 nt, Chlamydophila pneumoniae J138
aggucgaagauucaaagaa

SEQ ID NO: 539958 - RNA, 20 nt, Chlamydophila pneumoniae J138
aggucgaagauucaaagaag

SEQ ID NO: 539959 - RNA, 16 nt, Chlamydophila pneumoniae J138
aggucuuuuccuguag

SEQ ID NO: 539960 - RNA, 21 nt, Chlamydophila pneumoniae J138
aggucuguuggucucuauuua

SEQ ID NO: 539961 - RNA, 21 nt, Chlamydophila pneumoniae J138
aggucugcucuauauauccug

SEQ ID NO: 539962 - RNA, 17 nt, Chlamydophila pneumoniae J138
aggucuuccaucucuuu

SEQ ID NO: 539963 - RNA, 13 nt, Chlamydophila pneumoniae J138
aggucguaaacgg

SEQ ID NO: 539964 - RNA, 15 nt, Chlamydophila pneumoniae J138
aggugauauuuucuu

SEQ ID NO: 539965 - RNA, 16 nt, Chlamydophila pneumoniae J138
aggugcaucauuuuca

SEQ ID NO: 539966 - RNA, 16 nt, Chlamydophila pneumoniae J138
agguggguagccagga

SEQ ID NO: 539967 - RNA, 17 nt, Chlamydophila pneumoniae J138
aggugcggaacucauca

SEQ ID NO: 539968 - RNA, 22 nt, Chlamydophila pneumoniae J138
agguguuuuggcugcuuuuguu

SEQ ID NO: 539969 - RNA, 17 nt, Chlamydophila pneumoniae J138
agguguagguuccugcu

SEQ ID NO: 539970 - RNA, 15 nt, Chlamydophila pneumoniae J138
agguuaucuuuuugg

SEQ ID NO: 539971 - RNA, 16 nt, Chlamydophila pneumoniae J138
agguuauguacuagau

SEQ ID NO: 539972 - RNA, 22 nt, Chlamydophila pneumoniae J138
agguugggcagaagcuucugaa

SEQ ID NO: 539973 - RNA, 14 nt, Chlamydophila pneumoniae J138
agguugcuuuucua

SEQ ID NO: 539974 - RNA, 22 nt, Chlamydophila pneumoniae J138
agguucuuuucggaucagaaug

SEQ ID NO: 539975 - RNA, 21 nt, Chlamydophila pneumoniae J138
agguuccacagagaccuucuc

SEQ ID NO: 539976 - RNA, 12 nt, Chlamydophila pneumoniae J138
agguucacuuca

SEQ ID NO: 539977 - RNA, 13 nt, Chlamydophila pneumoniae J138
agguucaccagaa

SEQ ID NO: 539978 - RNA, 21 nt, Chlamydophila pneumoniae J138
agguucuugcuuauugucuua

SEQ ID NO: 539979 - RNA, 21 nt, Chlamydophila pneumoniae J138
agguuuuuccaacuucaacuu

SEQ ID NO: 539980 - RNA, 14 nt, Chlamydophila pneumoniae J138
agguuuuuccaacu

SEQ ID NO: 539981 - RNA, 22 nt, Chlamydophila pneumoniae J138
agguuuuaaaaugugucuugcu

SEQ ID NO: 539982 - RNA, 23 nt, Chlamydophila pneumoniae J138
agguuugcaauuuucucaauagu

SEQ ID NO: 539983 - RNA, 20 nt, Chlamydophila pneumoniae J138
aguaaaaucauaggcuauaa

SEQ ID NO: 539984 - RNA, 22 nt, Chlamydophila pneumoniae J138
aguaaaaucauaggcuauaauu

SEQ ID NO: 539985 - RNA, 18 nt, Chlamydophila pneumoniae J138
aguaaacccucagaacac

SEQ ID NO: 539986 - RNA, 20 nt, Chlamydophila pneumoniae J138
aguaaagccacauucuucug

SEQ ID NO: 539987 - RNA, 12 nt, Chlamydophila pneumoniae J138
aguaaagccaca

SEQ ID NO: 539988 - RNA, 14 nt, Chlamydophila pneumoniae J138
aguaaagccacauu

SEQ ID NO: 539989 - RNA, 19 nt, Chlamydophila pneumoniae J138
aguaaagaaucacucucua

SEQ ID NO: 539990 - RNA, 13 nt, Chlamydophila pneumoniae J138
aguaaaguaugca

SEQ ID NO: 539991 - RNA, 19 nt, Chlamydophila pneumoniae J138
aguaaauauuuuaccauug

SEQ ID NO: 539992 - RNA, 15 nt, Chlamydophila pneumoniae J138
aguaacuuaaucaau

SEQ ID NO: 539993 - RNA, 19 nt, Chlamydophila pneumoniae J138
aguaacuuaaucaauccua

SEQ ID NO: 539994 - RNA, 16 nt, Chlamydophila pneumoniae J138
aguaacugcaaagaga

SEQ ID NO: 539995 - RNA, 15 nt, Chlamydophila pneumoniae J138
aguaacuaucuacac

SEQ ID NO: 539996 - RNA, 21 nt, Chlamydophila pneumoniae J138
aguaagcgauuucgacagcag

SEQ ID NO: 539997 - RNA, 13 nt, Chlamydophila pneumoniae J138
aguaagucuucga

SEQ ID NO: 539998 - RNA, 21 nt, Chlamydophila pneumoniae J138
aguacauuaucacagcaaucu

SEQ ID NO: 539999 - RNA, 14 nt, Chlamydophila pneumoniae J138
aguaccaagaaaau

SEQ ID NO: 540000 - RNA, 18 nt, Chlamydophila pneumoniae J138
aguaccaagaaaauagua

SEQ ID NO: 540001 - RNA, 21 nt, Chlamydophila pneumoniae J138
aguacagauuucagauaaucu

SEQ ID NO: 540002 - RNA, 16 nt, Chlamydophila pneumoniae J138
aguaauccuaauuccu

SEQ ID NO: 540003 - RNA, 23 nt, Chlamydophila pneumoniae J138
aguaaucuggaagcaaucuguau

SEQ ID NO: 540004 - RNA, 19 nt, Chlamydophila pneumoniae J138
aguaauuccccuuuaaagc

SEQ ID NO: 540005 - RNA, 13 nt, Chlamydophila pneumoniae J138
aguaauuucuccg

SEQ ID NO: 540006 - RNA, 14 nt, Chlamydophila pneumoniae J138
aguaauuacagcuu

SEQ ID NO: 540007 - RNA, 23 nt, Chlamydophila pneumoniae J138
aguaauuauuuucuacacuguug

SEQ ID NO: 540008 - RNA, 23 nt, Chlamydophila pneumoniae J138
aggccgggauuuuaauucaaaaa

SEQ ID NO: 540009 - RNA, 16 nt, Chlamydophila pneumoniae J138
aggccuccuucauuca

SEQ ID NO: 540010 - RNA, 17 nt, Chlamydophila pneumoniae J138
aggcgauaguaaacaga

SEQ ID NO: 540011 - RNA, 18 nt, Chlamydophila pneumoniae J138
aggcgcauaugcuccaga

SEQ ID NO: 540012 - RNA, 20 nt, Chlamydophila pneumoniae J138
aggcgcauaugcuccagaaa

SEQ ID NO: 540013 - RNA, 17 nt, Chlamydophila pneumoniae J138
aggcggaugaccuucuc

SEQ ID NO: 540014 - RNA, 15 nt, Chlamydophila pneumoniae J138
aggcuacugaagagg

SEQ ID NO: 540015 - RNA, 21 nt, Chlamydophila pneumoniae J138
aggcuauaauuaacguuucuu

SEQ ID NO: 540016 - RNA, 21 nt, Chlamydophila pneumoniae J138
aggcuaaaaccuagacucugc

SEQ ID NO: 540017 - RNA, 20 nt, Chlamydophila pneumoniae J138
aggcuccucugcuaagcaca

SEQ ID NO: 540018 - RNA, 13 nt, Chlamydophila pneumoniae J138
aggcuccagcaua

SEQ ID NO: 540019 - RNA, 13 nt, Chlamydophila pneumoniae J138
aggcucucgacac

SEQ ID NO: 540020 - RNA, 22 nt, Chlamydophila pneumoniae J138
aggcucucgacacuauguguuu

SEQ ID NO: 540021 - RNA, 14 nt, Chlamydophila pneumoniae J138
agggcggaauacuu

SEQ ID NO: 540022 - RNA, 17 nt, Chlamydophila pneumoniae J138
agggcauguaguuagag

SEQ ID NO: 540023 - RNA, 20 nt, Chlamydophila pneumoniae J138
agggcaucuuuuacagacug

SEQ ID NO: 540024 - RNA, 14 nt, Chlamydophila pneumoniae J138
agggcuucaacauu

SEQ ID NO: 540025 - RNA, 15 nt, Chlamydophila pneumoniae J138
aggggaagaggaaug

SEQ ID NO: 540026 - RNA, 18 nt, Chlamydophila pneumoniae J138
agggcuucguggaacuuu

SEQ ID NO: 540027 - RNA, 16 nt, Chlamydophila pneumoniae J138
agggcugcgucaugag

SEQ ID NO: 540028 - RNA, 19 nt, Chlamydophila pneumoniae J138
agggcuauccacaacuaaa

SEQ ID NO: 540029 - RNA, 13 nt, Chlamydophila pneumoniae J138
aggggcucgacac

SEQ ID NO: 540030 - RNA, 14 nt, Chlamydophila pneumoniae J138
aggggcuccuaaag

SEQ ID NO: 540031 - RNA, 14 nt, Chlamydophila pneumoniae J138
aggggcaguuccua

SEQ ID NO: 540032 - RNA, 16 nt, Chlamydophila pneumoniae J138
agggggccugccauga

SEQ ID NO: 540033 - RNA, 14 nt, Chlamydophila pneumoniae J138
agggggccugccau

SEQ ID NO: 540034 - RNA, 17 nt, Chlamydophila pneumoniae J138
agggggaucuucagaga

SEQ ID NO: 540035 - RNA, 18 nt, Chlamydophila pneumoniae J138
agggguuucuaaauacuu

SEQ ID NO: 540036 - RNA, 18 nt, Chlamydophila pneumoniae J138
aggguaagauugcaggua

SEQ ID NO: 540037 - RNA, 23 nt, Chlamydophila pneumoniae J138
aggguagccauccacgaccugca

SEQ ID NO: 540038 - RNA, 13 nt, Chlamydophila pneumoniae J138
aggcugcuaucaa

SEQ ID NO: 540039 - RNA, 15 nt, Chlamydophila pneumoniae J138
aggcuguguaaaagu

SEQ ID NO: 540040 - RNA, 17 nt, Chlamydophila pneumoniae J138
aggcuguguaaaaguua

SEQ ID NO: 540041 - RNA, 15 nt, Chlamydophila pneumoniae J138
aggcuuguuucuguu

SEQ ID NO: 540042 - RNA, 18 nt, Chlamydophila pneumoniae J138
agggaaaguucaguaaaa

SEQ ID NO: 540043 - RNA, 23 nt, Chlamydophila pneumoniae J138
agggaaaaugcgaucuucacgac

SEQ ID NO: 540044 - RNA, 10 nt, Chlamydophila pneumoniae J138
agggaaaaag

SEQ ID NO: 540045 - RNA, 22 nt, Chlamydophila pneumoniae J138
agggaauuucauguccuccaug

SEQ ID NO: 540046 - RNA, 14 nt, Chlamydophila pneumoniae J138
agggacaaguacga

SEQ ID NO: 540047 - RNA, 13 nt, Chlamydophila pneumoniae J138
agggaagagaaaa

SEQ ID NO: 540048 - RNA, 17 nt, Chlamydophila pneumoniae J138
agggacguuguaucccu

SEQ ID NO: 540049 - RNA, 18 nt, Chlamydophila pneumoniae J138
agggacuucucaaagaca

SEQ ID NO: 540050 - RNA, 19 nt, Chlamydophila pneumoniae J138
agggaucauguagcagagc

SEQ ID NO: 540051 - RNA, 20 nt, Chlamydophila pneumoniae J138
agggaucuccuucaugcagu

SEQ ID NO: 540052 - RNA, 16 nt, Chlamydophila pneumoniae J138
agggaucuucaucccu

SEQ ID NO: 540053 - RNA, 18 nt, Chlamydophila pneumoniae J138
agggauguuuaauacaaa

SEQ ID NO: 540054 - RNA, 18 nt, Chlamydophila pneumoniae J138
agggaugaggucguacaa

SEQ ID NO: 540055 - RNA, 17 nt, Chlamydophila pneumoniae J138
agauugguaaggagagu

SEQ ID NO: 540056 - RNA, 19 nt, Chlamydophila pneumoniae J138
agcggaacaacuuugaggc

SEQ ID NO: 540057 - RNA, 16 nt, Chlamydophila pneumoniae J138
agcgcuuuuuuaaagu

SEQ ID NO: 540058 - RNA, 17 nt, Chlamydophila pneumoniae J138
agcggacuuuagcgcua

SEQ ID NO: 540059 - RNA, 17 nt, Chlamydophila pneumoniae J138
agcgggauaggcaagau

SEQ ID NO: 540060 - RNA, 16 nt, Chlamydophila pneumoniae J138
agcguauuccccacug

SEQ ID NO: 540061 - RNA, 22 nt, Chlamydophila pneumoniae J138
agcgucuaucgacucuucgccc

SEQ ID NO: 540062 - RNA, 16 nt, Chlamydophila pneumoniae J138
agcguacaggaagucc

SEQ ID NO: 540063 - RNA, 21 nt, Chlamydophila pneumoniae J138
agcguacuuuacacuauaaga

SEQ ID NO: 540064 - RNA, 15 nt, Chlamydophila pneumoniae J138
agcguguauccaucu

SEQ ID NO: 540065 - RNA, 22 nt, Chlamydophila pneumoniae J138
agcuaaauuguuaucaggaacu

SEQ ID NO: 540066 - RNA, 18 nt, Chlamydophila pneumoniae J138
agcuaagucuccauaauu

SEQ ID NO: 540067 - RNA, 19 nt, Chlamydophila pneumoniae J138
agcuaaguaacaguccucu

SEQ ID NO: 540068 - RNA, 21 nt, Chlamydophila pneumoniae J138
agcuaaguaacaguccucucc

SEQ ID NO: 540069 - RNA, 19 nt, Chlamydophila pneumoniae J138
agcuaauaagauccaaaaa

SEQ ID NO: 540070 - RNA, 17 nt, Chlamydophila pneumoniae J138
agcuaauacaucaccac

SEQ ID NO: 540071 - RNA, 21 nt, Chlamydophila pneumoniae J138
agcuaauuuaaaugccuuaaa

SEQ ID NO: 540072 - RNA, 15 nt, Chlamydophila pneumoniae J138
agcuaugaugagaac

SEQ ID NO: 540073 - RNA, 12 nt, Chlamydophila pneumoniae J138
agcucaaggcau

SEQ ID NO: 540074 - RNA, 23 nt, Chlamydophila pneumoniae J138
agcuauuuuugaggaacgcacgc

SEQ ID NO: 540075 - RNA, 20 nt, Chlamydophila pneumoniae J138
agcuauuucucuaucaucaa

SEQ ID NO: 540076 - RNA, 22 nt, Chlamydophila pneumoniae J138
agcugccagugacauaaucaca

SEQ ID NO: 540077 - RNA, 18 nt, Chlamydophila pneumoniae J138
agcugccagugacauaau

SEQ ID NO: 540078 - RNA, 20 nt, Chlamydophila pneumoniae J138
agcucuuugggauaaaaagu

SEQ ID NO: 540079 - RNA, 16 nt, Chlamydophila pneumoniae J138
agcucuuucuuggauu

SEQ ID NO: 540080 - RNA, 20 nt, Chlamydophila pneumoniae J138
agcucacgcaccauuccuua

SEQ ID NO: 540081 - RNA, 21 nt, Chlamydophila pneumoniae J138
agcucaggaaaacuuaauaag

SEQ ID NO: 540082 - RNA, 12 nt, Chlamydophila pneumoniae J138
agcucauaagaa

SEQ ID NO: 540083 - RNA, 20 nt, Chlamydophila pneumoniae J138
agcucuaggauaucauauuu

SEQ ID NO: 540084 - RNA, 16 nt, Chlamydophila pneumoniae J138
agcucuauuucugccu

SEQ ID NO: 540085 - RNA, 19 nt, Chlamydophila pneumoniae J138
agcucuaaguccaacauca

SEQ ID NO: 540086 - RNA, 17 nt, Chlamydophila pneumoniae J138
agcucaucagcaaccuu

SEQ ID NO: 540087 - RNA, 19 nt, Chlamydophila pneumoniae J138
agcucaucuagaaagauuu

SEQ ID NO: 540088 - RNA, 22 nt, Chlamydophila pneumoniae J138
agcucuaaaaaagauaaagcua

SEQ ID NO: 540089 - RNA, 18 nt, Chlamydophila pneumoniae J138
agcucaucggaucuuuuc

SEQ ID NO: 540090 - RNA, 16 nt, Chlamydophila pneumoniae J138
agcugcuuuuucuacu

SEQ ID NO: 540091 - RNA, 15 nt, Chlamydophila pneumoniae J138
agcugcuuuuucuac

SEQ ID NO: 540092 - RNA, 20 nt, Chlamydophila pneumoniae J138
agcugcugguccuaaaaaaa

SEQ ID NO: 540093 - RNA, 15 nt, Chlamydophila pneumoniae J138
agcuggaucuucuga

SEQ ID NO: 540094 - RNA, 16 nt, Chlamydophila pneumoniae J138
agcuguauugggaaug

SEQ ID NO: 540095 - RNA, 20 nt, Chlamydophila pneumoniae J138
agcuguccagucuauagccu

SEQ ID NO: 540096 - RNA, 14 nt, Chlamydophila pneumoniae J138
agcuguccuccgag

SEQ ID NO: 540097 - RNA, 15 nt, Chlamydophila pneumoniae J138
agcuguacagaacaa

SEQ ID NO: 540098 - RNA, 12 nt, Chlamydophila pneumoniae J138
agcugugcauuu

SEQ ID NO: 540099 - RNA, 14 nt, Chlamydophila pneumoniae J138
agcugucaauccaa

SEQ ID NO: 540100 - RNA, 16 nt, Chlamydophila pneumoniae J138
agcuguuucucuguau

SEQ ID NO: 540101 - RNA, 22 nt, Chlamydophila pneumoniae J138
agcuucaaaggcaaccucugca

SEQ ID NO: 540102 - RNA, 22 nt, Chlamydophila pneumoniae J138
agcuucaaguuucuuuugcaaa

SEQ ID NO: 540103 - RNA, 14 nt, Chlamydophila pneumoniae J138
agcuuacuuagaac

SEQ ID NO: 540104 - RNA, 21 nt, Chlamydophila pneumoniae J138
agcuuacuuagaacuauagga

SEQ ID NO: 540105 - RNA, 18 nt, Chlamydophila pneumoniae J138
agcuuacguguugcauga

SEQ ID NO: 540106 - RNA, 18 nt, Chlamydophila pneumoniae J138
agcuuacuuucuuuuagc

SEQ ID NO: 540107 - RNA, 20 nt, Chlamydophila pneumoniae J138
agcuuccucacguucugcaa

SEQ ID NO: 540108 - RNA, 23 nt, Chlamydophila pneumoniae J138
agcuuccucacguucugcaacaa

SEQ ID NO: 540109 - RNA, 23 nt, Chlamydophila pneumoniae J138
agcuuccugcuccucuucuuccc

SEQ ID NO: 540110 - RNA, 15 nt, Chlamydophila pneumoniae J138
agcuuccugcuccuc

SEQ ID NO: 540111 - RNA, 20 nt, Chlamydophila pneumoniae J138
agcuucggggaagcguagca

SEQ ID NO: 540112 - RNA, 16 nt, Chlamydophila pneumoniae J138
agcuucugaacuguuc

SEQ ID NO: 540113 - RNA, 15 nt, Chlamydophila pneumoniae J138
agcuucuacagcauc

SEQ ID NO: 540114 - RNA, 19 nt, Chlamydophila pneumoniae J138
agcuucuuucuuacuaaag

SEQ ID NO: 540115 - RNA, 15 nt, Chlamydophila pneumoniae J138
agcuucuuucuuacu

SEQ ID NO: 540116 - RNA, 19 nt, Chlamydophila pneumoniae J138
agcuucuuuaucuagcucu

SEQ ID NO: 540117 - RNA, 17 nt, Chlamydophila pneumoniae J138
agcuucuuuuccagcaa

SEQ ID NO: 540118 - RNA, 13 nt, Chlamydophila pneumoniae J138
agcuucuugaugu

SEQ ID NO: 540119 - RNA, 22 nt, Chlamydophila pneumoniae J138
agcuuuggcgucugcccuuucu

SEQ ID NO: 540120 - RNA, 23 nt, Chlamydophila pneumoniae J138
agcuuugcuuaaaaagucugaau

SEQ ID NO: 540121 - RNA, 17 nt, Chlamydophila pneumoniae J138
agcuuuuaguuucccac

SEQ ID NO: 540122 - RNA, 20 nt, Chlamydophila pneumoniae J138
agcuuuugcuacagcuucuu

SEQ ID NO: 540123 - RNA, 23 nt, Chlamydophila pneumoniae J138
agcuuuuccguaaguaaccaaua

SEQ ID NO: 540124 - RNA, 16 nt, Chlamydophila pneumoniae J138
agcuuuucguauagag

SEQ ID NO: 540125 - RNA, 12 nt, Chlamydophila pneumoniae J138
agcuuuaaucag

SEQ ID NO: 540126 - RNA, 14 nt, Chlamydophila pneumoniae J138
agcuuuaagaagaa

SEQ ID NO: 540127 - RNA, 15 nt, Chlamydophila pneumoniae J138
agcuuuaagaagaag

SEQ ID NO: 540128 - RNA, 13 nt, Chlamydophila pneumoniae J138
agcuuguuuuugc

SEQ ID NO: 540129 - RNA, 17 nt, Chlamydophila pneumoniae J138
agcuuuaacaugccaaa

SEQ ID NO: 540130 - RNA, 16 nt, Chlamydophila pneumoniae J138
agcuuucagaaaagaa

SEQ ID NO: 540131 - RNA, 23 nt, Chlamydophila pneumoniae J138
agcuuucguuuucuagcauagug

SEQ ID NO: 540132 - RNA, 22 nt, Chlamydophila pneumoniae J138
agcuugcccuucguaacgcuuu

SEQ ID NO: 540133 - RNA, 13 nt, Chlamydophila pneumoniae J138
agcuugucacacu

SEQ ID NO: 540134 - RNA, 20 nt, Chlamydophila pneumoniae J138
agcuugguuuucuccuucuc

SEQ ID NO: 540135 - RNA, 19 nt, Chlamydophila pneumoniae J138
agcuuguucuguaacacuu

SEQ ID NO: 540136 - RNA, 21 nt, Chlamydophila pneumoniae J138
agcuuggggguggucuagaga

SEQ ID NO: 540137 - RNA, 20 nt, Chlamydophila pneumoniae J138
aggaucuuuggguucuucca

SEQ ID NO: 540138 - RNA, 15 nt, Chlamydophila pneumoniae J138
aggaucugcauggau

SEQ ID NO: 540139 - RNA, 17 nt, Chlamydophila pneumoniae J138
aggaugucgcuuuugcu

SEQ ID NO: 540140 - RNA, 16 nt, Chlamydophila pneumoniae J138
aggaugcuuagcaaag

SEQ ID NO: 540141 - RNA, 16 nt, Chlamydophila pneumoniae J138
aggaugcuugugagau

SEQ ID NO: 540142 - RNA, 23 nt, Chlamydophila pneumoniae J138
aggauucugagaaguuaagacaa

SEQ ID NO: 540143 - RNA, 17 nt, Chlamydophila pneumoniae J138
aggauugcacucaucuu

SEQ ID NO: 540144 - RNA, 14 nt, Chlamydophila pneumoniae J138
aggauugauaaaua

SEQ ID NO: 540145 - RNA, 18 nt, Chlamydophila pneumoniae J138
aggauucuauaacuacaa

SEQ ID NO: 540146 - RNA, 17 nt, Chlamydophila pneumoniae J138
aggauucuuuugcaaug

SEQ ID NO: 540147 - RNA, 12 nt, Chlamydophila pneumoniae J138
aggauuccuuga

SEQ ID NO: 540148 - RNA, 14 nt, Chlamydophila pneumoniae J138
aggauguuccuugu

SEQ ID NO: 540149 - RNA, 14 nt, Chlamydophila pneumoniae J138
aggauuaguaacua

SEQ ID NO: 540150 - RNA, 16 nt, Chlamydophila pneumoniae J138
aggcaaagaucaguuu

SEQ ID NO: 540151 - RNA, 19 nt, Chlamydophila pneumoniae J138
aggcaacgcgauuuucaac

SEQ ID NO: 540152 - RNA, 16 nt, Chlamydophila pneumoniae J138
aggcaagauuaugaug

SEQ ID NO: 540153 - RNA, 17 nt, Chlamydophila pneumoniae J138
aggcaaggagagcuucu

SEQ ID NO: 540154 - RNA, 18 nt, Chlamydophila pneumoniae J138
aggcaauuuuuauaauau

SEQ ID NO: 540155 - RNA, 19 nt, Chlamydophila pneumoniae J138
aggcaauuuuuauaauauu

SEQ ID NO: 540156 - RNA, 18 nt, Chlamydophila pneumoniae J138
aggcacuccaaaacucaa

SEQ ID NO: 540157 - RNA, 23 nt, Chlamydophila pneumoniae J138
aggcacccaaacugaugccaaga

SEQ ID NO: 540158 - RNA, 23 nt, Chlamydophila pneumoniae J138
aggcaucuagagucucuuucagc

SEQ ID NO: 540159 - RNA, 15 nt, Chlamydophila pneumoniae J138
aggcauaaucuccaa

SEQ ID NO: 540160 - RNA, 19 nt, Chlamydophila pneumoniae J138
aggcauacaguagaaacau

SEQ ID NO: 540161 - RNA, 16 nt, Chlamydophila pneumoniae J138
aggcauaacugugcuc

SEQ ID NO: 540162 - RNA, 14 nt, Chlamydophila pneumoniae J138
aggcauaagaucau

SEQ ID NO: 540163 - RNA, 13 nt, Chlamydophila pneumoniae J138
aggccaaagaaca

SEQ ID NO: 540164 - RNA, 17 nt, Chlamydophila pneumoniae J138
aggcauggcacaguccu

SEQ ID NO: 540165 - RNA, 15 nt, Chlamydophila pneumoniae J138
aggcaucuagagucu

SEQ ID NO: 540166 - RNA, 17 nt, Chlamydophila pneumoniae J138
aggcauuacacaacucu

SEQ ID NO: 540167 - RNA, 16 nt, Chlamydophila pneumoniae J138
aggcaugccuacaggc

SEQ ID NO: 540168 - RNA, 22 nt, Chlamydophila pneumoniae J138
aggcccaccagggguuucuaaa

SEQ ID NO: 540169 - RNA, 14 nt, Chlamydophila pneumoniae J138
aggccaggagacua

SEQ ID NO: 540170 - RNA, 16 nt, Chlamydophila pneumoniae J138
aggaccuguaguaaaa

SEQ ID NO: 540171 - RNA, 18 nt, Chlamydophila pneumoniae J138
aggaccuguuuucuuuuc

SEQ ID NO: 540172 - RNA, 21 nt, Chlamydophila pneumoniae J138
aggaccgugguaucccugagc

SEQ ID NO: 540173 - RNA, 16 nt, Chlamydophila pneumoniae J138
aggaccuaagggcucu

SEQ ID NO: 540174 - RNA, 16 nt, Chlamydophila pneumoniae J138
aggacaguauucccuc

SEQ ID NO: 540175 - RNA, 20 nt, Chlamydophila pneumoniae J138
aggagagcuucuucuguaaa

SEQ ID NO: 540176 - RNA, 20 nt, Chlamydophila pneumoniae J138
aggagagcacuuuuaauauu

SEQ ID NO: 540177 - RNA, 16 nt, Chlamydophila pneumoniae J138
aggagacuaaaagaau

SEQ ID NO: 540178 - RNA, 17 nt, Chlamydophila pneumoniae J138
aggagacuaaaagaaua

SEQ ID NO: 540179 - RNA, 20 nt, Chlamydophila pneumoniae J138
aggagacuaaaagaauaaua

SEQ ID NO: 540180 - RNA, 20 nt, Chlamydophila pneumoniae J138
aggagaccuuuauagauaug

SEQ ID NO: 540181 - RNA, 16 nt, Chlamydophila pneumoniae J138
aggagagaauccuuuu

SEQ ID NO: 540182 - RNA, 12 nt, Chlamydophila pneumoniae J138
aggagagagaag

SEQ ID NO: 540183 - RNA, 12 nt, Chlamydophila pneumoniae J138
aggagagcacuu

SEQ ID NO: 540184 - RNA, 14 nt, Chlamydophila pneumoniae J138
aggacucuuucuau

SEQ ID NO: 540185 - RNA, 13 nt, Chlamydophila pneumoniae J138
aggagcuccuccu

SEQ ID NO: 540186 - RNA, 10 nt, Chlamydophila pneumoniae J138
aggaggagca

SEQ ID NO: 540187 - RNA, 13 nt, Chlamydophila pneumoniae J138
aggaggaggagca

SEQ ID NO: 540188 - RNA, 21 nt, Chlamydophila pneumoniae J138
aggaggauuuccuagguucuu

SEQ ID NO: 540189 - RNA, 19 nt, Chlamydophila pneumoniae J138
aggagguccuuggcauuca

SEQ ID NO: 540190 - RNA, 20 nt, Chlamydophila pneumoniae J138
aggagucgugcaggagaaca

SEQ ID NO: 540191 - RNA, 23 nt, Chlamydophila pneumoniae J138
aggagucgugcaggagaacaaua

SEQ ID NO: 540192 - RNA, 23 nt, Chlamydophila pneumoniae J138
aggaguccccuggcguucaggau

SEQ ID NO: 540193 - RNA, 13 nt, Chlamydophila pneumoniae J138
aggaguuuuccaa

SEQ ID NO: 540194 - RNA, 18 nt, Chlamydophila pneumoniae J138
aggaguuuucaagucugu

SEQ ID NO: 540195 - RNA, 22 nt, Chlamydophila pneumoniae J138
aggaucauaccgacaagcauca

SEQ ID NO: 540196 - RNA, 15 nt, Chlamydophila pneumoniae J138
aggauaucauauuuu

SEQ ID NO: 540197 - RNA, 22 nt, Chlamydophila pneumoniae J138
aggauagaccccccauuccaaa

SEQ ID NO: 540198 - RNA, 20 nt, Chlamydophila pneumoniae J138
aggauagaccccccauucca

SEQ ID NO: 540199 - RNA, 16 nt, Chlamydophila pneumoniae J138
aggauacgaauaaguu

SEQ ID NO: 540200 - RNA, 17 nt, Chlamydophila pneumoniae J138
aggauacgaauaaguuu

SEQ ID NO: 540201 - RNA, 16 nt, Chlamydophila pneumoniae J138
aggauauauagagcag

SEQ ID NO: 540202 - RNA, 19 nt, Chlamydophila pneumoniae J138
aggauagugacuccugguu

SEQ ID NO: 540203 - RNA, 22 nt, Chlamydophila pneumoniae J138
aggauagguccguuuuuucaga

SEQ ID NO: 540204 - RNA, 21 nt, Chlamydophila pneumoniae J138
aggauagcaauucgguagagc

SEQ ID NO: 540205 - RNA, 13 nt, Chlamydophila pneumoniae J138
agcuuuugugaua

SEQ ID NO: 540206 - RNA, 14 nt, Chlamydophila pneumoniae J138
agcuuuuuucucuu

SEQ ID NO: 540207 - RNA, 21 nt, Chlamydophila pneumoniae J138
aggaaacgauuucuucuucua

SEQ ID NO: 540208 - RNA, 21 nt, Chlamydophila pneumoniae J138
aggaaacagugguaugcuuuu

SEQ ID NO: 540209 - RNA, 16 nt, Chlamydophila pneumoniae J138
aggaaaauucuuaaaa

SEQ ID NO: 540210 - RNA, 19 nt, Chlamydophila pneumoniae J138
aggaaaucacagagucugg

SEQ ID NO: 540211 - RNA, 21 nt, Chlamydophila pneumoniae J138
aggaaauaccacagcuguaca

SEQ ID NO: 540212 - RNA, 11 nt, Chlamydophila pneumoniae J138
aggaaauuccg

SEQ ID NO: 540213 - RNA, 18 nt, Chlamydophila pneumoniae J138
aggaaaucgcauuacaaa

SEQ ID NO: 540214 - RNA, 14 nt, Chlamydophila pneumoniae J138
aggaacaauguaaa

SEQ ID NO: 540215 - RNA, 14 nt, Chlamydophila pneumoniae J138
aggaacaugccaaa

SEQ ID NO: 540216 - RNA, 15 nt, Chlamydophila pneumoniae J138
aggaacuugaauacc

SEQ ID NO: 540217 - RNA, 17 nt, Chlamydophila pneumoniae J138
aggaacuugaauaccaa

SEQ ID NO: 540218 - RNA, 19 nt, Chlamydophila pneumoniae J138
aggaacucuuuaaaagggc

SEQ ID NO: 540219 - RNA, 15 nt, Chlamydophila pneumoniae J138
aggaaggaauagaga

SEQ ID NO: 540220 - RNA, 16 nt, Chlamydophila pneumoniae J138
aggaaggaaaucacag

SEQ ID NO: 540221 - RNA, 14 nt, Chlamydophila pneumoniae J138
aggaagcucuucua

SEQ ID NO: 540222 - RNA, 19 nt, Chlamydophila pneumoniae J138
aggaagaucuugaacagag

SEQ ID NO: 540223 - RNA, 17 nt, Chlamydophila pneumoniae J138
aggaauaaucaaccaaa

SEQ ID NO: 540224 - RNA, 19 nt, Chlamydophila pneumoniae J138
aggaauaaucaaccaaaau

SEQ ID NO: 540225 - RNA, 19 nt, Chlamydophila pneumoniae J138
aggaauaacaccaaaagaa

SEQ ID NO: 540226 - RNA, 21 nt, Chlamydophila pneumoniae J138
aggaaguccgauagcaaugau

SEQ ID NO: 540227 - RNA, 19 nt, Chlamydophila pneumoniae J138
aggaagguucucaaagcua

SEQ ID NO: 540228 - RNA, 14 nt, Chlamydophila pneumoniae J138
aggaauagaaagac

SEQ ID NO: 540229 - RNA, 14 nt, Chlamydophila pneumoniae J138
aggaaucauaacca

SEQ ID NO: 540230 - RNA, 21 nt, Chlamydophila pneumoniae J138
aggaaucauaaccaaaagaau

SEQ ID NO: 540231 - RNA, 19 nt, Chlamydophila pneumoniae J138
aggaaucccugcacucuuu

SEQ ID NO: 540232 - RNA, 13 nt, Chlamydophila pneumoniae J138
aggaaucuaagaa

SEQ ID NO: 540233 - RNA, 14 nt, Chlamydophila pneumoniae J138
aggaaugagcggca

SEQ ID NO: 540234 - RNA, 14 nt, Chlamydophila pneumoniae J138
aggaaugaagagag

SEQ ID NO: 540235 - RNA, 13 nt, Chlamydophila pneumoniae J138
aggacaaaucucc

SEQ ID NO: 540236 - RNA, 17 nt, Chlamydophila pneumoniae J138
aggaauucuuuaugaga

SEQ ID NO: 540237 - RNA, 14 nt, Chlamydophila pneumoniae J138
aggaauuaaaauau

SEQ ID NO: 540238 - RNA, 20 nt, Chlamydophila pneumoniae J138
acggauauucuuuagggcua

SEQ ID NO: 540239 - RNA, 21 nt, Chlamydophila pneumoniae J138
acggaacucauuaagaagaac

SEQ ID NO: 540240 - RNA, 18 nt, Chlamydophila pneumoniae J138
acggaacaagucuucaau

SEQ ID NO: 540241 - RNA, 15 nt, Chlamydophila pneumoniae J138
acggaaagcacauac

SEQ ID NO: 540242 - RNA, 17 nt, Chlamydophila pneumoniae J138
acgcuuuuucuugaaaa

SEQ ID NO: 540243 - RNA, 13 nt, Chlamydophila pneumoniae J138
acgcuuuuucuug

SEQ ID NO: 540244 - RNA, 13 nt, Chlamydophila pneumoniae J138
acggaaaaucaca

SEQ ID NO: 540245 - RNA, 15 nt, Chlamydophila pneumoniae J138
acggaaaaucacacu

SEQ ID NO: 540246 - RNA, 16 nt, Chlamydophila pneumoniae J138
acgcuguugaaaugca

SEQ ID NO: 540247 - RNA, 14 nt, Chlamydophila pneumoniae J138
acggauucuaaaag

SEQ ID NO: 540248 - RNA, 20 nt, Chlamydophila pneumoniae J138
acggauccuagaauaggaau

SEQ ID NO: 540249 - RNA, 20 nt, Chlamydophila pneumoniae J138
acgggucaggagguggugga

SEQ ID NO: 540250 - RNA, 19 nt, Chlamydophila pneumoniae J138
acgguagucaaaggaucca

SEQ ID NO: 540251 - RNA, 19 nt, Chlamydophila pneumoniae J138
acguacgcaaguaaagaaa

SEQ ID NO: 540252 - RNA, 17 nt, Chlamydophila pneumoniae J138
acguccugaugccuuuu

SEQ ID NO: 540253 - RNA, 20 nt, Chlamydophila pneumoniae J138
acguuuaauuccuuggauuc

SEQ ID NO: 540254 - RNA, 17 nt, Chlamydophila pneumoniae J138
acguuugacaaauuuau

SEQ ID NO: 540255 - RNA, 20 nt, Chlamydophila pneumoniae J138
acguuaucuaagacuucugg

SEQ ID NO: 540256 - RNA, 15 nt, Chlamydophila pneumoniae J138
acguuggacugcaag

SEQ ID NO: 540257 - RNA, 18 nt, Chlamydophila pneumoniae J138
acguuuuucccuuuaaaa

SEQ ID NO: 540258 - RNA, 19 nt, Chlamydophila pneumoniae J138
acguuuucucuucccuugu

SEQ ID NO: 540259 - RNA, 21 nt, Chlamydophila pneumoniae J138
acuaaaagaauaauagcaagc

SEQ ID NO: 540260 - RNA, 14 nt, Chlamydophila pneumoniae J138
acuaaaaaagagac

SEQ ID NO: 540261 - RNA, 15 nt, Chlamydophila pneumoniae J138
acuauuuucauucca

SEQ ID NO: 540262 - RNA, 21 nt, Chlamydophila pneumoniae J138
acuauugggagguucgcagaa

SEQ ID NO: 540263 - RNA, 12 nt, Chlamydophila pneumoniae J138
acucaaacccuc

SEQ ID NO: 540264 - RNA, 12 nt, Chlamydophila pneumoniae J138
acucaaagaacu

SEQ ID NO: 540265 - RNA, 15 nt, Chlamydophila pneumoniae J138
acucaaauucaaaau

SEQ ID NO: 540266 - RNA, 13 nt, Chlamydophila pneumoniae J138
acucaaaagaaga

SEQ ID NO: 540267 - RNA, 20 nt, Chlamydophila pneumoniae J138
acuauaaaagccagggcagc

SEQ ID NO: 540268 - RNA, 23 nt, Chlamydophila pneumoniae J138
acuauaagagguucucuuaacug

SEQ ID NO: 540269 - RNA, 23 nt, Chlamydophila pneumoniae J138
acuaucauggacaagcaaaagca

SEQ ID NO: 540270 - RNA, 18 nt, Chlamydophila pneumoniae J138
acuaucauggacaagcaa

SEQ ID NO: 540271 - RNA, 15 nt, Chlamydophila pneumoniae J138
acuauuaauacuuug

SEQ ID NO: 540272 - RNA, 18 nt, Chlamydophila pneumoniae J138
acuauuaauacuuugcca

SEQ ID NO: 540273 - RNA, 16 nt, Chlamydophila pneumoniae J138
acuauuaggcuuuuuu

SEQ ID NO: 540274 - RNA, 20 nt, Chlamydophila pneumoniae J138
acuauuaauacuuugccaac

SEQ ID NO: 540275 - RNA, 15 nt, Chlamydophila pneumoniae J138
acuauguguuuccuu

SEQ ID NO: 540276 - RNA, 23 nt, Chlamydophila pneumoniae J138
acuauccgcacucauaggguagu

SEQ ID NO: 540277 - RNA, 17 nt, Chlamydophila pneumoniae J138
acuacuuacaagaacaa

SEQ ID NO: 540278 - RNA, 15 nt, Chlamydophila pneumoniae J138
acuacuuaaauccua

SEQ ID NO: 540279 - RNA, 14 nt, Chlamydophila pneumoniae J138
acuacuuaaagcuu

SEQ ID NO: 540280 - RNA, 14 nt, Chlamydophila pneumoniae J138
acuacuuacaagaa

SEQ ID NO: 540281 - RNA, 15 nt, Chlamydophila pneumoniae J138
acuaguucuucuuua

SEQ ID NO: 540282 - RNA, 20 nt, Chlamydophila pneumoniae J138
acuagaaucaccaauuuuuu

SEQ ID NO: 540283 - RNA, 18 nt, Chlamydophila pneumoniae J138
acuaccgaauuuucaauu

SEQ ID NO: 540284 - RNA, 23 nt, Chlamydophila pneumoniae J138
acuaaaucaacuacaucuccaag

SEQ ID NO: 540285 - RNA, 12 nt, Chlamydophila pneumoniae J138
acuaaaggugaa

SEQ ID NO: 540286 - RNA, 13 nt, Chlamydophila pneumoniae J138
acuaaagauacuu

SEQ ID NO: 540287 - RNA, 19 nt, Chlamydophila pneumoniae J138
acuacagcugcuagagcag

SEQ ID NO: 540288 - RNA, 17 nt, Chlamydophila pneumoniae J138
acuacauucgcaagaau

SEQ ID NO: 540289 - RNA, 13 nt, Chlamydophila pneumoniae J138
acuacauucagga

SEQ ID NO: 540290 - RNA, 18 nt, Chlamydophila pneumoniae J138
acucgaauuguguguuuu

SEQ ID NO: 540291 - RNA, 13 nt, Chlamydophila pneumoniae J138
acuccuuaacaac

SEQ ID NO: 540292 - RNA, 13 nt, Chlamydophila pneumoniae J138
acucaacuuuuuu

SEQ ID NO: 540293 - RNA, 16 nt, Chlamydophila pneumoniae J138
acucaacuuuuuuacu

SEQ ID NO: 540294 - RNA, 16 nt, Chlamydophila pneumoniae J138
acucaaggaguuuuaa

SEQ ID NO: 540295 - RNA, 20 nt, Chlamydophila pneumoniae J138
acucaaggaguuuuaacuaa

SEQ ID NO: 540296 - RNA, 17 nt, Chlamydophila pneumoniae J138
acucaaucucuuugaca

SEQ ID NO: 540297 - RNA, 23 nt, Chlamydophila pneumoniae J138
acucuguuuccuugugucuuaaa

SEQ ID NO: 540298 - RNA, 23 nt, Chlamydophila pneumoniae J138
acucuuuucuagaaacugcuccu

SEQ ID NO: 540299 - RNA, 19 nt, Chlamydophila pneumoniae J138
acucuuuuaagacaauaua

SEQ ID NO: 540300 - RNA, 16 nt, Chlamydophila pneumoniae J138
acucuuuuaagacaau

SEQ ID NO: 540301 - RNA, 15 nt, Chlamydophila pneumoniae J138
acucuuuuaagacaa

SEQ ID NO: 540302 - RNA, 15 nt, Chlamydophila pneumoniae J138
acucucuuccuucuc

SEQ ID NO: 540303 - RNA, 18 nt, Chlamydophila pneumoniae J138
acucucuuccuucuccug

SEQ ID NO: 540304 - RNA, 21 nt, Chlamydophila pneumoniae J138
acucucugcagggaauccugu

SEQ ID NO: 540305 - RNA, 16 nt, Chlamydophila pneumoniae J138
acucucuuccaaaagu

SEQ ID NO: 540306 - RNA, 13 nt, Chlamydophila pneumoniae J138
acucucuuccuuc

SEQ ID NO: 540307 - RNA, 17 nt, Chlamydophila pneumoniae J138
acucuaucgaagagccc

SEQ ID NO: 540308 - RNA, 21 nt, Chlamydophila pneumoniae J138
acucuaguuuuucuuuagaga

SEQ ID NO: 540309 - RNA, 12 nt, Chlamydophila pneumoniae J138
acucuacaagug

SEQ ID NO: 540310 - RNA, 14 nt, Chlamydophila pneumoniae J138
acucuacaaguguc

SEQ ID NO: 540311 - RNA, 19 nt, Chlamydophila pneumoniae J138
acucuacccccagcuucuu

SEQ ID NO: 540312 - RNA, 19 nt, Chlamydophila pneumoniae J138
acucuacaguaguaaauaa

SEQ ID NO: 540313 - RNA, 22 nt, Chlamydophila pneumoniae J138
acucuacaguaguaaauaauaa

SEQ ID NO: 540314 - RNA, 16 nt, Chlamydophila pneumoniae J138
acucgauuauuucuug

SEQ ID NO: 540315 - RNA, 16 nt, Chlamydophila pneumoniae J138
acucggaaaaaauaga

SEQ ID NO: 540316 - RNA, 16 nt, Chlamydophila pneumoniae J138
acugaugccaagaaau

SEQ ID NO: 540317 - RNA, 13 nt, Chlamydophila pneumoniae J138
acugaugaaaaag

SEQ ID NO: 540318 - RNA, 22 nt, Chlamydophila pneumoniae J138
acugaugaaaaagcugacacuc

SEQ ID NO: 540319 - RNA, 17 nt, Chlamydophila pneumoniae J138
acugaucugaaauagca

SEQ ID NO: 540320 - RNA, 17 nt, Chlamydophila pneumoniae J138
acugaaaccuucucucu

SEQ ID NO: 540321 - RNA, 15 nt, Chlamydophila pneumoniae J138
acucuuuucuagaaa

SEQ ID NO: 540322 - RNA, 17 nt, Chlamydophila pneumoniae J138
acugacuuuaugaucuc

SEQ ID NO: 540323 - RNA, 15 nt, Chlamydophila pneumoniae J138
acugcagagaaauuc

SEQ ID NO: 540324 - RNA, 22 nt, Chlamydophila pneumoniae J138
acugccagcgaucacauagaaa

SEQ ID NO: 540325 - RNA, 20 nt, Chlamydophila pneumoniae J138
acugcgaaggguuguugcca

SEQ ID NO: 540326 - RNA, 13 nt, Chlamydophila pneumoniae J138
acugcuagagucc

SEQ ID NO: 540327 - RNA, 17 nt, Chlamydophila pneumoniae J138
acugcuuuaggcccaag

SEQ ID NO: 540328 - RNA, 19 nt, Chlamydophila pneumoniae J138
acugcuuggucacaccaaa

SEQ ID NO: 540329 - RNA, 13 nt, Chlamydophila pneumoniae J138
acuggaaugacau

SEQ ID NO: 540330 - RNA, 15 nt, Chlamydophila pneumoniae J138
acuggagagguaacc

SEQ ID NO: 540331 - RNA, 22 nt, Chlamydophila pneumoniae J138
acuggagagguaaccagagagc

SEQ ID NO: 540332 - RNA, 20 nt, Chlamydophila pneumoniae J138
acugggaaaucuaaacagua

SEQ ID NO: 540333 - RNA, 16 nt, Chlamydophila pneumoniae J138
acuuaaagacuugcuu

SEQ ID NO: 540334 - RNA, 13 nt, Chlamydophila pneumoniae J138
acuuaaaaaacuu

SEQ ID NO: 540335 - RNA, 13 nt, Chlamydophila pneumoniae J138
acuguuuuucuuc

SEQ ID NO: 540336 - RNA, 19 nt, Chlamydophila pneumoniae J138
acuguugauccuucuuaug

SEQ ID NO: 540337 - RNA, 15 nt, Chlamydophila pneumoniae J138
acuguugauccuucu

SEQ ID NO: 540338 - RNA, 17 nt, Chlamydophila pneumoniae J138
acuguugauccuucuua

SEQ ID NO: 540339 - RNA, 22 nt, Chlamydophila pneumoniae J138
acuuaggguucucaaagaucau

SEQ ID NO: 540340 - RNA, 17 nt, Chlamydophila pneumoniae J138
acuuagguaauguaguc

SEQ ID NO: 540341 - RNA, 15 nt, Chlamydophila pneumoniae J138
acuuaggaauuuuuc

SEQ ID NO: 540342 - RNA, 16 nt, Chlamydophila pneumoniae J138
acuuaggaauuuuucu

SEQ ID NO: 540343 - RNA, 13 nt, Chlamydophila pneumoniae J138
acuuagcaaugaa

SEQ ID NO: 540344 - RNA, 18 nt, Chlamydophila pneumoniae J138
acuuaauccuguagggaa

SEQ ID NO: 540345 - RNA, 21 nt, Chlamydophila pneumoniae J138
acuuaagauacuucuccacag

SEQ ID NO: 540346 - RNA, 22 nt, Chlamydophila pneumoniae J138
acuuaagauacuucuccacagc

SEQ ID NO: 540347 - RNA, 18 nt, Chlamydophila pneumoniae J138
acuuaauaauguuuuaau

SEQ ID NO: 540348 - RNA, 20 nt, Chlamydophila pneumoniae J138
acugucuagcaguugcaaua

SEQ ID NO: 540349 - RNA, 18 nt, Chlamydophila pneumoniae J138
acuguucgauaagaacuu

SEQ ID NO: 540350 - RNA, 15 nt, Chlamydophila pneumoniae J138
acuuauauuggcuuu

SEQ ID NO: 540351 - RNA, 20 nt, Chlamydophila pneumoniae J138
acuuauaccaccccaaagca

SEQ ID NO: 540352 - RNA, 14 nt, Chlamydophila pneumoniae J138
acuucacaaagaac

SEQ ID NO: 540353 - RNA, 13 nt, Chlamydophila pneumoniae J138
acuucacaaagaa

SEQ ID NO: 540354 - RNA, 16 nt, Chlamydophila pneumoniae J138
acuuaucuuuaaauuc

SEQ ID NO: 540355 - RNA, 18 nt, Chlamydophila pneumoniae J138
acuucaagccaaaaccaa

SEQ ID NO: 540356 - RNA, 20 nt, Chlamydophila pneumoniae J138
acuuccuacggcaagaaucg

SEQ ID NO: 540357 - RNA, 17 nt, Chlamydophila pneumoniae J138
acuucccaucuuguucu

SEQ ID NO: 540358 - RNA, 16 nt, Chlamydophila pneumoniae J138
acuucaccuugaaguu

SEQ ID NO: 540359 - RNA, 15 nt, Chlamydophila pneumoniae J138
acuucagcaagaaaa

SEQ ID NO: 540360 - RNA, 23 nt, Chlamydophila pneumoniae J138
acuucaggaaauaauuuguuuag

SEQ ID NO: 540361 - RNA, 18 nt, Chlamydophila pneumoniae J138
agagauuguaauuuccuu

SEQ ID NO: 540362 - RNA, 21 nt, Chlamydophila pneumoniae J138
agagauugccaggagagcuaa

SEQ ID NO: 540363 - RNA, 19 nt, Chlamydophila pneumoniae J138
agagauuuuucuaggaauc

SEQ ID NO: 540364 - RNA, 16 nt, Chlamydophila pneumoniae J138
agagauuuuuucauac

SEQ ID NO: 540365 - RNA, 14 nt, Chlamydophila pneumoniae J138
agagauuuuucuag

SEQ ID NO: 540366 - RNA, 12 nt, Chlamydophila pneumoniae J138
agagauuuuucu

SEQ ID NO: 540367 - RNA, 17 nt, Chlamydophila pneumoniae J138
agagcaaacaucaaaga

SEQ ID NO: 540368 - RNA, 13 nt, Chlamydophila pneumoniae J138
agagaucacugua

SEQ ID NO: 540369 - RNA, 14 nt, Chlamydophila pneumoniae J138
agagaucacaggga

SEQ ID NO: 540370 - RNA, 19 nt, Chlamydophila pneumoniae J138
agagaucuuuuuauuaaaa

SEQ ID NO: 540371 - RNA, 22 nt, Chlamydophila pneumoniae J138
agagaugcaaauccuguagaaa

SEQ ID NO: 540372 - RNA, 15 nt, Chlamydophila pneumoniae J138
agagaugcuaacaac

SEQ ID NO: 540373 - RNA, 21 nt, Chlamydophila pneumoniae J138
agacuaaaugacgaguugaag

SEQ ID NO: 540374 - RNA, 14 nt, Chlamydophila pneumoniae J138
agacuaaaaaagag

SEQ ID NO: 540375 - RNA, 17 nt, Chlamydophila pneumoniae J138
agacuagcuuuuuuuau

SEQ ID NO: 540376 - RNA, 16 nt, Chlamydophila pneumoniae J138
agacuauagaaaagga

SEQ ID NO: 540377 - RNA, 14 nt, Chlamydophila pneumoniae J138
agagagcaagauaa

SEQ ID NO: 540378 - RNA, 13 nt, Chlamydophila pneumoniae J138
agagagaacagga

SEQ ID NO: 540379 - RNA, 23 nt, Chlamydophila pneumoniae J138
agagaguucuuguaauaaaagaa

SEQ ID NO: 540380 - RNA, 20 nt, Chlamydophila pneumoniae J138
agagagugcguacucuucuu

SEQ ID NO: 540381 - RNA, 15 nt, Chlamydophila pneumoniae J138
agagaggguaagcug

SEQ ID NO: 540382 - RNA, 22 nt, Chlamydophila pneumoniae J138
agagagcuugucacacugcgag

SEQ ID NO: 540383 - RNA, 17 nt, Chlamydophila pneumoniae J138
agaggucuuugaguagc

SEQ ID NO: 540384 - RNA, 12 nt, Chlamydophila pneumoniae J138
agaguagcccca

SEQ ID NO: 540385 - RNA, 16 nt, Chlamydophila pneumoniae J138
agaguauuagcgagua

SEQ ID NO: 540386 - RNA, 19 nt, Chlamydophila pneumoniae J138
agaguauuagcgaguacuu

SEQ ID NO: 540387 - RNA, 13 nt, Chlamydophila pneumoniae J138
agaguauuuacaa

SEQ ID NO: 540388 - RNA, 17 nt, Chlamydophila pneumoniae J138
agagucaaacuuauaca

SEQ ID NO: 540389 - RNA, 14 nt, Chlamydophila pneumoniae J138
agagucacuagcag

SEQ ID NO: 540390 - RNA, 16 nt, Chlamydophila pneumoniae J138
agaguccgaagccuuc

SEQ ID NO: 540391 - RNA, 16 nt, Chlamydophila pneumoniae J138
agaguccuucuuuucc

SEQ ID NO: 540392 - RNA, 15 nt, Chlamydophila pneumoniae J138
agaguccuuuuuguu

SEQ ID NO: 540393 - RNA, 20 nt, Chlamydophila pneumoniae J138
agagucucacucuuuucuag

SEQ ID NO: 540394 - RNA, 14 nt, Chlamydophila pneumoniae J138
agagucugcagcag

SEQ ID NO: 540395 - RNA, 17 nt, Chlamydophila pneumoniae J138
agagucugcagcagaug

SEQ ID NO: 540396 - RNA, 22 nt, Chlamydophila pneumoniae J138
agagccuuuucagauuuuuuaa

SEQ ID NO: 540397 - RNA, 23 nt, Chlamydophila pneumoniae J138
agagcgcguuucaaauaggaucu

SEQ ID NO: 540398 - RNA, 17 nt, Chlamydophila pneumoniae J138
agagcaauuaagaaacu

SEQ ID NO: 540399 - RNA, 14 nt, Chlamydophila pneumoniae J138
agagcacauagaaa

SEQ ID NO: 540400 - RNA, 15 nt, Chlamydophila pneumoniae J138
agagccucuaagaaa

SEQ ID NO: 540401 - RNA, 14 nt, Chlamydophila pneumoniae J138
agagcuuucagaaa

SEQ ID NO: 540402 - RNA, 15 nt, Chlamydophila pneumoniae J138
agagcuuucagaaaa

SEQ ID NO: 540403 - RNA, 17 nt, Chlamydophila pneumoniae J138
agagcuuucagaaaaga

SEQ ID NO: 540404 - RNA, 15 nt, Chlamydophila pneumoniae J138
agagcuucuuuaucu

SEQ ID NO: 540405 - RNA, 20 nt, Chlamydophila pneumoniae J138
agagcuugucacacugcgag

SEQ ID NO: 540406 - RNA, 20 nt, Chlamydophila pneumoniae J138
agaggggaaccaaggacgua

SEQ ID NO: 540407 - RNA, 18 nt, Chlamydophila pneumoniae J138
agagcugauccagcucca

SEQ ID NO: 540408 - RNA, 18 nt, Chlamydophila pneumoniae J138
agagcuucuaaaaacucu

SEQ ID NO: 540409 - RNA, 20 nt, Chlamydophila pneumoniae J138
agagcuuccauuggaauccu

SEQ ID NO: 540410 - RNA, 12 nt, Chlamydophila pneumoniae J138
agaguugauugu

SEQ ID NO: 540411 - RNA, 16 nt, Chlamydophila pneumoniae J138
agagugacucaucagu

SEQ ID NO: 540412 - RNA, 15 nt, Chlamydophila pneumoniae J138
agaguugcuuuaugg

SEQ ID NO: 540413 - RNA, 14 nt, Chlamydophila pneumoniae J138
agaguuucuuuuga

SEQ ID NO: 540414 - RNA, 19 nt, Chlamydophila pneumoniae J138
agaguuuuacaucaaugau

SEQ ID NO: 540415 - RNA, 21 nt, Chlamydophila pneumoniae J138
agaguuucuuuugauugaaac

SEQ ID NO: 540416 - RNA, 14 nt, Chlamydophila pneumoniae J138
agaguuuuucccuc

SEQ ID NO: 540417 - RNA, 20 nt, Chlamydophila pneumoniae J138
agaguuuuuguguuugacug

SEQ ID NO: 540418 - RNA, 16 nt, Chlamydophila pneumoniae J138
agauagcaaaucaaua

SEQ ID NO: 540419 - RNA, 14 nt, Chlamydophila pneumoniae J138
agauagcucuugcg

SEQ ID NO: 540420 - RNA, 18 nt, Chlamydophila pneumoniae J138
agauagcgacgucaucau

SEQ ID NO: 540421 - RNA, 20 nt, Chlamydophila pneumoniae J138
agauagcuuacagagaaauu

SEQ ID NO: 540422 - RNA, 23 nt, Chlamydophila pneumoniae J138
agauaggaacucacaaacaacag

SEQ ID NO: 540423 - RNA, 17 nt, Chlamydophila pneumoniae J138
agauacggguucguuuc

SEQ ID NO: 540424 - RNA, 19 nt, Chlamydophila pneumoniae J138
agauacgcuuacaaauaac

SEQ ID NO: 540425 - RNA, 22 nt, Chlamydophila pneumoniae J138
agauacuaucugccauaggauc

SEQ ID NO: 540426 - RNA, 21 nt, Chlamydophila pneumoniae J138
agauacuaucugccauaggau

SEQ ID NO: 540427 - RNA, 18 nt, Chlamydophila pneumoniae J138
agauacuuugcaauacac

SEQ ID NO: 540428 - RNA, 22 nt, Chlamydophila pneumoniae J138
agauaucgaccuuaaaauugaa

SEQ ID NO: 540429 - RNA, 15 nt, Chlamydophila pneumoniae J138
agauaugaagagacg

SEQ ID NO: 540430 - RNA, 21 nt, Chlamydophila pneumoniae J138
agauaguucacaagugcauua

SEQ ID NO: 540431 - RNA, 19 nt, Chlamydophila pneumoniae J138
agauauagcguacaggaag

SEQ ID NO: 540432 - RNA, 14 nt, Chlamydophila pneumoniae J138
agaucauaaacagc

SEQ ID NO: 540433 - RNA, 12 nt, Chlamydophila pneumoniae J138
agaucagcuccc

SEQ ID NO: 540434 - RNA, 17 nt, Chlamydophila pneumoniae J138
agaucaggauucuaaaa

SEQ ID NO: 540435 - RNA, 19 nt, Chlamydophila pneumoniae J138
agaucagaggaaucuaaga

SEQ ID NO: 540436 - RNA, 14 nt, Chlamydophila pneumoniae J138
agaucacaucaaga

SEQ ID NO: 540437 - RNA, 19 nt, Chlamydophila pneumoniae J138
agaucauuagcaucaucuc

SEQ ID NO: 540438 - RNA, 16 nt, Chlamydophila pneumoniae J138
agaucauuagcaucau

SEQ ID NO: 540439 - RNA, 18 nt, Chlamydophila pneumoniae J138
agaucauuagcaucaucu

SEQ ID NO: 540440 - RNA, 14 nt, Chlamydophila pneumoniae J138
agauccaaagccug

SEQ ID NO: 540441 - RNA, 22 nt, Chlamydophila pneumoniae J138
agaucaucuacgauguuuucuu

SEQ ID NO: 540442 - RNA, 20 nt, Chlamydophila pneumoniae J138
agaucaucucccaaauagcu

SEQ ID NO: 540443 - RNA, 17 nt, Chlamydophila pneumoniae J138
agauccaugaacagcau

SEQ ID NO: 540444 - RNA, 15 nt, Chlamydophila pneumoniae J138
agauccugaaaguac

SEQ ID NO: 540445 - RNA, 22 nt, Chlamydophila pneumoniae J138
agauccugagaccauacacaaa

SEQ ID NO: 540446 - RNA, 16 nt, Chlamydophila pneumoniae J138
agauccuagagaaugu

SEQ ID NO: 540447 - RNA, 18 nt, Chlamydophila pneumoniae J138
agaucuccgaagacuacc

SEQ ID NO: 540448 - RNA, 14 nt, Chlamydophila pneumoniae J138
agaucuacaagacu

SEQ ID NO: 540449 - RNA, 20 nt, Chlamydophila pneumoniae J138
agaucgggucuacaacaguu

SEQ ID NO: 540450 - RNA, 15 nt, Chlamydophila pneumoniae J138
agaucgaucucugug

SEQ ID NO: 540451 - RNA, 18 nt, Chlamydophila pneumoniae J138
agaucgagaucauuagca

SEQ ID NO: 540452 - RNA, 21 nt, Chlamydophila pneumoniae J138
agauccuuuaaagauucccca

SEQ ID NO: 540453 - RNA, 23 nt, Chlamydophila pneumoniae J138
agauccuuuaaagauuccccaua

SEQ ID NO: 540454 - RNA, 13 nt, Chlamydophila pneumoniae J138
agaucuucauaac

SEQ ID NO: 540455 - RNA, 13 nt, Chlamydophila pneumoniae J138
agaucuucaucac

SEQ ID NO: 540456 - RNA, 18 nt, Chlamydophila pneumoniae J138
agaucuucugaaaucaaa

SEQ ID NO: 540457 - RNA, 21 nt, Chlamydophila pneumoniae J138
agaucuucaucacaaaauuca

SEQ ID NO: 540458 - RNA, 23 nt, Chlamydophila pneumoniae J138
agaucuggagagggaaggaauaa

SEQ ID NO: 540459 - RNA, 17 nt, Chlamydophila pneumoniae J138
agaucugcauaauuuuu

SEQ ID NO: 540460 - RNA, 19 nt, Chlamydophila pneumoniae J138
agaucucuugaagcacuuu

SEQ ID NO: 540461 - RNA, 17 nt, Chlamydophila pneumoniae J138
agaucucuuuagcaauc

SEQ ID NO: 540462 - RNA, 20 nt, Chlamydophila pneumoniae J138
agaucugcaaacgcaaugau

SEQ ID NO: 540463 - RNA, 21 nt, Chlamydophila pneumoniae J138
agaucuuuauuuuuaaaaaua

SEQ ID NO: 540464 - RNA, 23 nt, Chlamydophila pneumoniae J138
agaucuuuucuacuucaggaaau

SEQ ID NO: 540465 - RNA, 13 nt, Chlamydophila pneumoniae J138
agaucuuuuguaa

SEQ ID NO: 540466 - RNA, 14 nt, Chlamydophila pneumoniae J138
agaucuuuuugcca

SEQ ID NO: 540467 - RNA, 15 nt, Chlamydophila pneumoniae J138
agaucuuuuugccag

SEQ ID NO: 540468 - RNA, 15 nt, Chlamydophila pneumoniae J138
agaugaaguucccac

SEQ ID NO: 540469 - RNA, 13 nt, Chlamydophila pneumoniae J138
agaugaagagugg

SEQ ID NO: 540470 - RNA, 18 nt, Chlamydophila pneumoniae J138
agaugaauaccagaagca

SEQ ID NO: 540471 - RNA, 16 nt, Chlamydophila pneumoniae J138
agaugagguaucccac

SEQ ID NO: 540472 - RNA, 13 nt, Chlamydophila pneumoniae J138
agauucaaagaag

SEQ ID NO: 540473 - RNA, 15 nt, Chlamydophila pneumoniae J138
agauucauaaaacug

SEQ ID NO: 540474 - RNA, 16 nt, Chlamydophila pneumoniae J138
agauuccuaacuucug

SEQ ID NO: 540475 - RNA, 22 nt, Chlamydophila pneumoniae J138
agauucccugcggacagaaacu

SEQ ID NO: 540476 - RNA, 20 nt, Chlamydophila pneumoniae J138
agauuauuuguuucuuccau

SEQ ID NO: 540477 - RNA, 23 nt, Chlamydophila pneumoniae J138
agauugcacuugcgguuuuggau

SEQ ID NO: 540478 - RNA, 21 nt, Chlamydophila pneumoniae J138
agauugaaggcaccaacacuu

SEQ ID NO: 540479 - RNA, 20 nt, Chlamydophila pneumoniae J138
agauucugcuuuaucucuau

SEQ ID NO: 540480 - RNA, 16 nt, Chlamydophila pneumoniae J138
agauucugaagagaga

SEQ ID NO: 540481 - RNA, 12 nt, Chlamydophila pneumoniae J138
agauucugaaga

SEQ ID NO: 540482 - RNA, 21 nt, Chlamydophila pneumoniae J138
agauucugcccaaagcuaaaa

SEQ ID NO: 540483 - RNA, 15 nt, Chlamydophila pneumoniae J138
agauucuaaaucaac

SEQ ID NO: 540484 - RNA, 22 nt, Chlamydophila pneumoniae J138
agaugcuauuuacugaaacauu

SEQ ID NO: 540485 - RNA, 21 nt, Chlamydophila pneumoniae J138
agauggcaaggaaaauucagu

SEQ ID NO: 540486 - RNA, 24 nt, Chlamydophila pneumoniae J138
agauguuuucguaaauaugaauua

SEQ ID NO: 540487 - RNA, 13 nt, Chlamydophila pneumoniae J138
agaugucuugguu

SEQ ID NO: 540488 - RNA, 20 nt, Chlamydophila pneumoniae J138
agauguagguaucagcaaga

SEQ ID NO: 540489 - RNA, 18 nt, Chlamydophila pneumoniae J138
agauguuaugaguuuuua

SEQ ID NO: 540490 - RNA, 22 nt, Chlamydophila pneumoniae J138
agauguggcagaguccuucuuu

SEQ ID NO: 540491 - RNA, 15 nt, Chlamydophila pneumoniae J138
agauguaaagagcaa

SEQ ID NO: 540492 - RNA, 17 nt, Chlamydophila pneumoniae J138
agauguaaagagcaaca

SEQ ID NO: 540493 - RNA, 22 nt, Chlamydophila pneumoniae J138
agauggucuuggguuuuaaaug

SEQ ID NO: 540494 - RNA, 20 nt, Chlamydophila pneumoniae J138
agaacuuucgucuuugcuuu

SEQ ID NO: 540495 - RNA, 16 nt, Chlamydophila pneumoniae J138
agaacuuuagggaaga

SEQ ID NO: 540496 - RNA, 15 nt, Chlamydophila pneumoniae J138
agaacuuuacaauua

SEQ ID NO: 540497 - RNA, 21 nt, Chlamydophila pneumoniae J138
agaacuuuaacgaagaaggga

SEQ ID NO: 540498 - RNA, 14 nt, Chlamydophila pneumoniae J138
agaacuuagcaaug

SEQ ID NO: 540499 - RNA, 16 nt, Chlamydophila pneumoniae J138
agaacuuccugauucu

SEQ ID NO: 540500 - RNA, 16 nt, Chlamydophila pneumoniae J138
agaagaaggacaacua

SEQ ID NO: 540501 - RNA, 21 nt, Chlamydophila pneumoniae J138
agaagcacuucuuuaggagca

SEQ ID NO: 540502 - RNA, 22 nt, Chlamydophila pneumoniae J138
agaagcacuucuuuaggagcau

SEQ ID NO: 540503 - RNA, 17 nt, Chlamydophila pneumoniae J138
agaagcaacuaaacucu

SEQ ID NO: 540504 - RNA, 13 nt, Chlamydophila pneumoniae J138
agaagcaugaagc

SEQ ID NO: 540505 - RNA, 21 nt, Chlamydophila pneumoniae J138
agaagcaugaagcagaaacuu

SEQ ID NO: 540506 - RNA, 13 nt, Chlamydophila pneumoniae J138
agaagccaccaaa

SEQ ID NO: 540507 - RNA, 15 nt, Chlamydophila pneumoniae J138
agaagccaccaaaaa

SEQ ID NO: 540508 - RNA, 17 nt, Chlamydophila pneumoniae J138
agaagaaauuagaggga

SEQ ID NO: 540509 - RNA, 13 nt, Chlamydophila pneumoniae J138
agaagcaaaggua

SEQ ID NO: 540510 - RNA, 15 nt, Chlamydophila pneumoniae J138
agaagcaacuaaacu

SEQ ID NO: 540511 - RNA, 14 nt, Chlamydophila pneumoniae J138
agaagucgcaguaa

SEQ ID NO: 540512 - RNA, 23 nt, Chlamydophila pneumoniae J138
agaagucgcuagaucacaagaaa

SEQ ID NO: 540513 - RNA, 15 nt, Chlamydophila pneumoniae J138
agaauacaaacaaga

SEQ ID NO: 540514 - RNA, 23 nt, Chlamydophila pneumoniae J138
agaauaccguuuuaggaagguca

SEQ ID NO: 540515 - RNA, 20 nt, Chlamydophila pneumoniae J138
agaauacaacccuuuauacu

SEQ ID NO: 540516 - RNA, 23 nt, Chlamydophila pneumoniae J138
agaagguguuuuggcugcuuuug

SEQ ID NO: 540517 - RNA, 18 nt, Chlamydophila pneumoniae J138
agaaguagggucccuuga

SEQ ID NO: 540518 - RNA, 20 nt, Chlamydophila pneumoniae J138
agaaguauucgauuccugag

SEQ ID NO: 540519 - RNA, 22 nt, Chlamydophila pneumoniae J138
agaaguauucgauuccugaggc

SEQ ID NO: 540520 - RNA, 19 nt, Chlamydophila pneumoniae J138
agaaguaauccuaauuccu

SEQ ID NO: 540521 - RNA, 16 nt, Chlamydophila pneumoniae J138
agaagguuuauuagaa

SEQ ID NO: 540522 - RNA, 20 nt, Chlamydophila pneumoniae J138
agaagguuuauuagaaguau

SEQ ID NO: 540523 - RNA, 20 nt, Chlamydophila pneumoniae J138
agaagcucacucuuuaaaaa

SEQ ID NO: 540524 - RNA, 19 nt, Chlamydophila pneumoniae J138
agaagcucacucuuuaaaa

SEQ ID NO: 540525 - RNA, 22 nt, Chlamydophila pneumoniae J138
agaagguccaugucuaaagauu

SEQ ID NO: 540526 - RNA, 15 nt, Chlamydophila pneumoniae J138
agaagcuucaaugau

SEQ ID NO: 540527 - RNA, 15 nt, Chlamydophila pneumoniae J138
agaauucagagaaag

SEQ ID NO: 540528 - RNA, 16 nt, Chlamydophila pneumoniae J138
agaauuccuaaaacga

SEQ ID NO: 540529 - RNA, 20 nt, Chlamydophila pneumoniae J138
agaauguacauagaggagau

SEQ ID NO: 540530 - RNA, 16 nt, Chlamydophila pneumoniae J138
agaaugacacagagaa

SEQ ID NO: 540531 - RNA, 17 nt, Chlamydophila pneumoniae J138
agaaugaacaauagaaa

SEQ ID NO: 540532 - RNA, 17 nt, Chlamydophila pneumoniae J138
agaaucuuuucuagaaa

SEQ ID NO: 540533 - RNA, 12 nt, Chlamydophila pneumoniae J138
agaaucuuuucu

SEQ ID NO: 540534 - RNA, 14 nt, Chlamydophila pneumoniae J138
agaaucuuuucuag

SEQ ID NO: 540535 - RNA, 18 nt, Chlamydophila pneumoniae J138
agaaucucugaccaucaa

SEQ ID NO: 540536 - RNA, 14 nt, Chlamydophila pneumoniae J138
agaaucuccucauc

SEQ ID NO: 540537 - RNA, 16 nt, Chlamydophila pneumoniae J138
agaaucuccucaucag

SEQ ID NO: 540538 - RNA, 12 nt, Chlamydophila pneumoniae J138
agaaucucugcc

SEQ ID NO: 540539 - RNA, 12 nt, Chlamydophila pneumoniae J138
agaaucuuugug

SEQ ID NO: 540540 - RNA, 18 nt, Chlamydophila pneumoniae J138
agaauagccauaauuaga

SEQ ID NO: 540541 - RNA, 24 nt, Chlamydophila pneumoniae J138
agaauagccauaauuagaacagca

SEQ ID NO: 540542 - RNA, 16 nt, Chlamydophila pneumoniae J138
agaauagcaggaagga

SEQ ID NO: 540543 - RNA, 13 nt, Chlamydophila pneumoniae J138
agaauagcaagca

SEQ ID NO: 540544 - RNA, 22 nt, Chlamydophila pneumoniae J138
agaauacucuagguuuucucuu

SEQ ID NO: 540545 - RNA, 21 nt, Chlamydophila pneumoniae J138
agaauacucauauuuugucuu

SEQ ID NO: 540546 - RNA, 13 nt, Chlamydophila pneumoniae J138
agaaucaauaaaa

SEQ ID NO: 540547 - RNA, 21 nt, Chlamydophila pneumoniae J138
agaauccucuauccaucaucg

SEQ ID NO: 540548 - RNA, 19 nt, Chlamydophila pneumoniae J138
agaauccucuauccaucau

SEQ ID NO: 540549 - RNA, 18 nt, Chlamydophila pneumoniae J138
agaaucggaucuucaauu

SEQ ID NO: 540550 - RNA, 21 nt, Chlamydophila pneumoniae J138
agaaucguucccaucacauaa

SEQ ID NO: 540551 - RNA, 15 nt, Chlamydophila pneumoniae J138
agaaucuaaguaaaa

SEQ ID NO: 540552 - RNA, 16 nt, Chlamydophila pneumoniae J138
agaauugcaaaguacu

SEQ ID NO: 540553 - RNA, 13 nt, Chlamydophila pneumoniae J138
agaauuucuucuu

SEQ ID NO: 540554 - RNA, 13 nt, Chlamydophila pneumoniae J138
agacaagagaaga

SEQ ID NO: 540555 - RNA, 15 nt, Chlamydophila pneumoniae J138
agacaagagagagcu

SEQ ID NO: 540556 - RNA, 16 nt, Chlamydophila pneumoniae J138
agacaagagagagcug

SEQ ID NO: 540557 - RNA, 19 nt, Chlamydophila pneumoniae J138
agacaaccuagaaucacau

SEQ ID NO: 540558 - RNA, 17 nt, Chlamydophila pneumoniae J138
agacaauaaaauagccc

SEQ ID NO: 540559 - RNA, 16 nt, Chlamydophila pneumoniae J138
agacacgccuccuuca

SEQ ID NO: 540560 - RNA, 22 nt, Chlamydophila pneumoniae J138
agacacgccuccuucaaagaua

SEQ ID NO: 540561 - RNA, 23 nt, Chlamydophila pneumoniae J138
agacacgccuccuucaaagauau

SEQ ID NO: 540562 - RNA, 22 nt, Chlamydophila pneumoniae J138
agaccguugccagcuugcccuu

SEQ ID NO: 540563 - RNA, 20 nt, Chlamydophila pneumoniae J138
agaccaugaccuuuagcugc

SEQ ID NO: 540564 - RNA, 19 nt, Chlamydophila pneumoniae J138
agaccauaaaaucaacaag

SEQ ID NO: 540565 - RNA, 16 nt, Chlamydophila pneumoniae J138
agacgaggagaagucg

SEQ ID NO: 540566 - RNA, 16 nt, Chlamydophila pneumoniae J138
agacgaccuuuaagau

SEQ ID NO: 540567 - RNA, 18 nt, Chlamydophila pneumoniae J138
agaccuaacgcaacaucc

SEQ ID NO: 540568 - RNA, 13 nt, Chlamydophila pneumoniae J138
agacguaaccaca

SEQ ID NO: 540569 - RNA, 23 nt, Chlamydophila pneumoniae J138
agacgugcucucuacuucuguag

SEQ ID NO: 540570 - RNA, 22 nt, Chlamydophila pneumoniae J138
agacgugcucucuucuucucag

SEQ ID NO: 540571 - RNA, 22 nt, Chlamydophila pneumoniae J138
agacguuaucuaagacuucugg

SEQ ID NO: 540572 - RNA, 22 nt, Chlamydophila pneumoniae J138
agaacaaguuuuuucaauccuu

SEQ ID NO: 540573 - RNA, 18 nt, Chlamydophila pneumoniae J138
agaacaauaucagcagcu

SEQ ID NO: 540574 - RNA, 11 nt, Chlamydophila pneumoniae J138
agaacaagaag

SEQ ID NO: 540575 - RNA, 21 nt, Chlamydophila pneumoniae J138
agaaauuuuuaauuuuucuaa

SEQ ID NO: 540576 - RNA, 19 nt, Chlamydophila pneumoniae J138
agaaauucuguagauacua

SEQ ID NO: 540577 - RNA, 13 nt, Chlamydophila pneumoniae J138
agaaauucuuccc

SEQ ID NO: 540578 - RNA, 15 nt, Chlamydophila pneumoniae J138
agaaaguagagacau

SEQ ID NO: 540579 - RNA, 18 nt, Chlamydophila pneumoniae J138
agaaaguauuccucuuag

SEQ ID NO: 540580 - RNA, 15 nt, Chlamydophila pneumoniae J138
agaacaugcccccac

SEQ ID NO: 540581 - RNA, 16 nt, Chlamydophila pneumoniae J138
agaacacucagagaug

SEQ ID NO: 540582 - RNA, 17 nt, Chlamydophila pneumoniae J138
agaacacgccugcgaaa

SEQ ID NO: 540583 - RNA, 22 nt, Chlamydophila pneumoniae J138
agaacagaggaucuagaaaaug

SEQ ID NO: 540584 - RNA, 22 nt, Chlamydophila pneumoniae J138
agaacagcacucucugcaggga

SEQ ID NO: 540585 - RNA, 22 nt, Chlamydophila pneumoniae J138
agaaccuaggaaauccuccuag

SEQ ID NO: 540586 - RNA, 19 nt, Chlamydophila pneumoniae J138
agaaccuucacaagaaaac

SEQ ID NO: 540587 - RNA, 17 nt, Chlamydophila pneumoniae J138
agaaccuguuuuucuaa

SEQ ID NO: 540588 - RNA, 20 nt, Chlamydophila pneumoniae J138
agaaccuucacaagaaaaca

SEQ ID NO: 540589 - RNA, 21 nt, Chlamydophila pneumoniae J138
agaaccuucacaagaaaacaa

SEQ ID NO: 540590 - RNA, 24 nt, Chlamydophila pneumoniae J138
agaaccuucacaagaaaacaaagu

SEQ ID NO: 540591 - RNA, 19 nt, Chlamydophila pneumoniae J138
agaacgaacaguucauguu

SEQ ID NO: 540592 - RNA, 21 nt, Chlamydophila pneumoniae J138
agaacguccucaccuugugag

SEQ ID NO: 540593 - RNA, 18 nt, Chlamydophila pneumoniae J138
agaacgucaccauuaaau

SEQ ID NO: 540594 - RNA, 18 nt, Chlamydophila pneumoniae J138
agaacgucuaaagacgaa

SEQ ID NO: 540595 - RNA, 18 nt, Chlamydophila pneumoniae J138
agaacguggggaaauuaa

SEQ ID NO: 540596 - RNA, 19 nt, Chlamydophila pneumoniae J138
agaacguagcagaggcagg

SEQ ID NO: 540597 - RNA, 17 nt, Chlamydophila pneumoniae J138
agaacucaacuuuuuua

SEQ ID NO: 540598 - RNA, 15 nt, Chlamydophila pneumoniae J138
agaacuacucucauu

SEQ ID NO: 540599 - RNA, 13 nt, Chlamydophila pneumoniae J138
agaacucuccucg

SEQ ID NO: 540600 - RNA, 15 nt, Chlamydophila pneumoniae J138
agaacuccuuugagu

SEQ ID NO: 540601 - RNA, 22 nt, Chlamydophila pneumoniae J138
agaacucuuaaagguaaagcuu

SEQ ID NO: 540602 - RNA, 17 nt, Chlamydophila pneumoniae J138
acuucgcaaauuuuucg

SEQ ID NO: 540603 - RNA, 22 nt, Chlamydophila pneumoniae J138
acuucgauuggaagcaaagaaa

SEQ ID NO: 540604 - RNA, 16 nt, Chlamydophila pneumoniae J138
acuucgcaaauuuuuc

SEQ ID NO: 540605 - RNA, 16 nt, Chlamydophila pneumoniae J138
acuucgaugucuuucc

SEQ ID NO: 540606 - RNA, 20 nt, Chlamydophila pneumoniae J138
acuucgacacgaacuuugac

SEQ ID NO: 540607 - RNA, 16 nt, Chlamydophila pneumoniae J138
acuucgacacgaacuu

SEQ ID NO: 540608 - RNA, 13 nt, Chlamydophila pneumoniae J138
acuuccuuuuucu

SEQ ID NO: 540609 - RNA, 18 nt, Chlamydophila pneumoniae J138
acuuuuguacacagagau

SEQ ID NO: 540610 - RNA, 21 nt, Chlamydophila pneumoniae J138
acuuuugaagauccugaguau

SEQ ID NO: 540611 - RNA, 20 nt, Chlamydophila pneumoniae J138
acuuuucucuuuaauccagu

SEQ ID NO: 540612 - RNA, 14 nt, Chlamydophila pneumoniae J138
acuuuuuuucaaau

SEQ ID NO: 540613 - RNA, 21 nt, Chlamydophila pneumoniae J138
agaaaaauucuucgagagcau

SEQ ID NO: 540614 - RNA, 22 nt, Chlamydophila pneumoniae J138
agaaaaauucuucgagagcaug

SEQ ID NO: 540615 - RNA, 14 nt, Chlamydophila pneumoniae J138
agaaaauaucacau

SEQ ID NO: 540616 - RNA, 20 nt, Chlamydophila pneumoniae J138
agaaaauucucagauugcuu

SEQ ID NO: 540617 - RNA, 16 nt, Chlamydophila pneumoniae J138
agaaacuccaaaauau

SEQ ID NO: 540618 - RNA, 15 nt, Chlamydophila pneumoniae J138
agaaacuccaaaaua

SEQ ID NO: 540619 - RNA, 19 nt, Chlamydophila pneumoniae J138
agaaacugcuccugaagcu

SEQ ID NO: 540620 - RNA, 18 nt, Chlamydophila pneumoniae J138
agaaacuuaguuuugaaa

SEQ ID NO: 540621 - RNA, 22 nt, Chlamydophila pneumoniae J138
agaaacuuaguuuugaaaagau

SEQ ID NO: 540622 - RNA, 23 nt, Chlamydophila pneumoniae J138
agaaacuuaguuuugaaaagauu

SEQ ID NO: 540623 - RNA, 23 nt, Chlamydophila pneumoniae J138
agaaagccuuugcucacuguuuu

SEQ ID NO: 540624 - RNA, 14 nt, Chlamydophila pneumoniae J138
accguaaagaaaag

SEQ ID NO: 540625 - RNA, 13 nt, Chlamydophila pneumoniae J138
accccuagaacuu

SEQ ID NO: 540626 - RNA, 20 nt, Chlamydophila pneumoniae J138
accgucccaugcguccaaua

SEQ ID NO: 540627 - RNA, 21 nt, Chlamydophila pneumoniae J138
accgucacuguuuuccagaaa

SEQ ID NO: 540628 - RNA, 18 nt, Chlamydophila pneumoniae J138
accguuucaggaaacuca

SEQ ID NO: 540629 - RNA, 14 nt, Chlamydophila pneumoniae J138
accguuaauuuuug

SEQ ID NO: 540630 - RNA, 14 nt, Chlamydophila pneumoniae J138
accuaauaaagaag

SEQ ID NO: 540631 - RNA, 18 nt, Chlamydophila pneumoniae J138
accuacugggaaaucuaa

SEQ ID NO: 540632 - RNA, 17 nt, Chlamydophila pneumoniae J138
accuacugggaaaucua

SEQ ID NO: 540633 - RNA, 16 nt, Chlamydophila pneumoniae J138
accuacuaaacccugu

SEQ ID NO: 540634 - RNA, 17 nt, Chlamydophila pneumoniae J138
accuaccugcuaccugu

SEQ ID NO: 540635 - RNA, 12 nt, Chlamydophila pneumoniae J138
accuaggaggau

SEQ ID NO: 540636 - RNA, 15 nt, Chlamydophila pneumoniae J138
accuagaaucacaua

SEQ ID NO: 540637 - RNA, 13 nt, Chlamydophila pneumoniae J138
accuauaggcaag

SEQ ID NO: 540638 - RNA, 22 nt, Chlamydophila pneumoniae J138
accuauagguucaccagaagca

SEQ ID NO: 540639 - RNA, 22 nt, Chlamydophila pneumoniae J138
accuccaccaggagcuccuccu

SEQ ID NO: 540640 - RNA, 21 nt, Chlamydophila pneumoniae J138
accucgaauuccucccagccc

SEQ ID NO: 540641 - RNA, 20 nt, Chlamydophila pneumoniae J138
accuccuauuuucuuaugac

SEQ ID NO: 540642 - RNA, 17 nt, Chlamydophila pneumoniae J138
accucaucucuggaaua

SEQ ID NO: 540643 - RNA, 18 nt, Chlamydophila pneumoniae J138
accucaucucgcagucca

SEQ ID NO: 540644 - RNA, 19 nt, Chlamydophila pneumoniae J138
accucauggagguucucaa

SEQ ID NO: 540645 - RNA, 12 nt, Chlamydophila pneumoniae J138
accucaucagaa

SEQ ID NO: 540646 - RNA, 13 nt, Chlamydophila pneumoniae J138
accuauuugcaac

SEQ ID NO: 540647 - RNA, 19 nt, Chlamydophila pneumoniae J138
accuauuugcaacaaucuu

SEQ ID NO: 540648 - RNA, 20 nt, Chlamydophila pneumoniae J138
accuaugacggauccuagaa

SEQ ID NO: 540649 - RNA, 22 nt, Chlamydophila pneumoniae J138
accuaugacggauccuagaaua

SEQ ID NO: 540650 - RNA, 19 nt, Chlamydophila pneumoniae J138
accucugcauguugcaaag

SEQ ID NO: 540651 - RNA, 14 nt, Chlamydophila pneumoniae J138
accucugcauguug

SEQ ID NO: 540652 - RNA, 22 nt, Chlamydophila pneumoniae J138
accucuccgucauauuuaaaag

SEQ ID NO: 540653 - RNA, 12 nt, Chlamydophila pneumoniae J138
accucuuuucuu

SEQ ID NO: 540654 - RNA, 13 nt, Chlamydophila pneumoniae J138
accucuuuucuua

SEQ ID NO: 540655 - RNA, 10 nt, Chlamydophila pneumoniae J138
accugggcaa

SEQ ID NO: 540656 - RNA, 19 nt, Chlamydophila pneumoniae J138
accuggauugauccacaga

SEQ ID NO: 540657 - RNA, 21 nt, Chlamydophila pneumoniae J138
accuguaaagaccaaauagag

SEQ ID NO: 540658 - RNA, 14 nt, Chlamydophila pneumoniae J138
accuguaaagacca

SEQ ID NO: 540659 - RNA, 23 nt, Chlamydophila pneumoniae J138
accuguagcuacagauucuugua

SEQ ID NO: 540660 - RNA, 17 nt, Chlamydophila pneumoniae J138
accugugaaaauuuucu

SEQ ID NO: 540661 - RNA, 21 nt, Chlamydophila pneumoniae J138
accuucaaugauuucuuuagc

SEQ ID NO: 540662 - RNA, 20 nt, Chlamydophila pneumoniae J138
accuugauacugaaucccgu

SEQ ID NO: 540663 - RNA, 16 nt, Chlamydophila pneumoniae J138
accuugagacaaagaa

SEQ ID NO: 540664 - RNA, 17 nt, Chlamydophila pneumoniae J138
accuuguauaagagcaa

SEQ ID NO: 540665 - RNA, 18 nt, Chlamydophila pneumoniae J138
accuuuuucauugaugcu

SEQ ID NO: 540666 - RNA, 23 nt, Chlamydophila pneumoniae J138
accuuuaacccgcuugcaucuua

SEQ ID NO: 540667 - RNA, 15 nt, Chlamydophila pneumoniae J138
accuuuccuaaaaua

SEQ ID NO: 540668 - RNA, 18 nt, Chlamydophila pneumoniae J138
acgaaaaggagaauacaa

SEQ ID NO: 540669 - RNA, 12 nt, Chlamydophila pneumoniae J138
acgaaaaggaga

SEQ ID NO: 540670 - RNA, 14 nt, Chlamydophila pneumoniae J138
acgaaaaucuacac

SEQ ID NO: 540671 - RNA, 14 nt, Chlamydophila pneumoniae J138
acgaaauguuaaag

SEQ ID NO: 540672 - RNA, 13 nt, Chlamydophila pneumoniae J138
acgaaagcacaua

SEQ ID NO: 540673 - RNA, 17 nt, Chlamydophila pneumoniae J138
acgaaagcacauaagau

SEQ ID NO: 540674 - RNA, 20 nt, Chlamydophila pneumoniae J138
acgaacaugccugaaaacaa

SEQ ID NO: 540675 - RNA, 17 nt, Chlamydophila pneumoniae J138
acgaacaagacgaaagc

SEQ ID NO: 540676 - RNA, 15 nt, Chlamydophila pneumoniae J138
acgaaggaaucugau

SEQ ID NO: 540677 - RNA, 20 nt, Chlamydophila pneumoniae J138
acgaauuucacacagcggua

SEQ ID NO: 540678 - RNA, 19 nt, Chlamydophila pneumoniae J138
acgaauuucaacagcuuca

SEQ ID NO: 540679 - RNA, 21 nt, Chlamydophila pneumoniae J138
acgaauacuguucgauaagaa

SEQ ID NO: 540680 - RNA, 21 nt, Chlamydophila pneumoniae J138
acgacaugccuaaauagcuca

SEQ ID NO: 540681 - RNA, 18 nt, Chlamydophila pneumoniae J138
acgacauacaucaaaaug

SEQ ID NO: 540682 - RNA, 17 nt, Chlamydophila pneumoniae J138
acgaccaacuccucaaa

SEQ ID NO: 540683 - RNA, 11 nt, Chlamydophila pneumoniae J138
acgacgaggac

SEQ ID NO: 540684 - RNA, 16 nt, Chlamydophila pneumoniae J138
acgacguuuugcugug

SEQ ID NO: 540685 - RNA, 23 nt, Chlamydophila pneumoniae J138
acgacgucuucuuagaagagaaa

SEQ ID NO: 540686 - RNA, 14 nt, Chlamydophila pneumoniae J138
acgacucugccaug

SEQ ID NO: 540687 - RNA, 20 nt, Chlamydophila pneumoniae J138
acgagaaccaaagcagugua

SEQ ID NO: 540688 - RNA, 18 nt, Chlamydophila pneumoniae J138
acgagacugcaaaggaag

SEQ ID NO: 540689 - RNA, 11 nt, Chlamydophila pneumoniae J138
acgagacugca

SEQ ID NO: 540690 - RNA, 17 nt, Chlamydophila pneumoniae J138
acgagacugcaaaggaa

SEQ ID NO: 540691 - RNA, 17 nt, Chlamydophila pneumoniae J138
acgagcccuagauagca

SEQ ID NO: 540692 - RNA, 14 nt, Chlamydophila pneumoniae J138
acgagcgcuuucuu

SEQ ID NO: 540693 - RNA, 13 nt, Chlamydophila pneumoniae J138
acgaggagcuuuu

SEQ ID NO: 540694 - RNA, 15 nt, Chlamydophila pneumoniae J138
acgagucccuucuuu

SEQ ID NO: 540695 - RNA, 23 nt, Chlamydophila pneumoniae J138
acgaguucucccgugaacaaaaa

SEQ ID NO: 540696 - RNA, 21 nt, Chlamydophila pneumoniae J138
acgaguucgcggaucuucuuc

SEQ ID NO: 540697 - RNA, 20 nt, Chlamydophila pneumoniae J138
acgaucacauuccaagaaaa

SEQ ID NO: 540698 - RNA, 19 nt, Chlamydophila pneumoniae J138
acgaucaaauuccuucuca

SEQ ID NO: 540699 - RNA, 18 nt, Chlamydophila pneumoniae J138
acgauauuuagagagaaa

SEQ ID NO: 540700 - RNA, 18 nt, Chlamydophila pneumoniae J138
acgauccaucucaucgaa

SEQ ID NO: 540701 - RNA, 14 nt, Chlamydophila pneumoniae J138
acgauccaucucau

SEQ ID NO: 540702 - RNA, 20 nt, Chlamydophila pneumoniae J138
acgaucgucaguaaaacaca

SEQ ID NO: 540703 - RNA, 16 nt, Chlamydophila pneumoniae J138
acgaucgcgauaagaa

SEQ ID NO: 540704 - RNA, 13 nt, Chlamydophila pneumoniae J138
acgauuucuuuua

SEQ ID NO: 540705 - RNA, 17 nt, Chlamydophila pneumoniae J138
accaacacuuuuaaaga

SEQ ID NO: 540706 - RNA, 19 nt, Chlamydophila pneumoniae J138
accaaauagagaguaguga

SEQ ID NO: 540707 - RNA, 18 nt, Chlamydophila pneumoniae J138
accaaauaauuaaauaua

SEQ ID NO: 540708 - RNA, 13 nt, Chlamydophila pneumoniae J138
acauguaaacaaa

SEQ ID NO: 540709 - RNA, 14 nt, Chlamydophila pneumoniae J138
acauggccaaaaau

SEQ ID NO: 540710 - RNA, 19 nt, Chlamydophila pneumoniae J138
acauggccaaaaaucuuau

SEQ ID NO: 540711 - RNA, 15 nt, Chlamydophila pneumoniae J138
acauuuagauaaaga

SEQ ID NO: 540712 - RNA, 16 nt, Chlamydophila pneumoniae J138
accaauugcagucacu

SEQ ID NO: 540713 - RNA, 18 nt, Chlamydophila pneumoniae J138
accaauugagcucucuag

SEQ ID NO: 540714 - RNA, 18 nt, Chlamydophila pneumoniae J138
accaauucucucucugca

SEQ ID NO: 540715 - RNA, 13 nt, Chlamydophila pneumoniae J138
accaacuccucaa

SEQ ID NO: 540716 - RNA, 18 nt, Chlamydophila pneumoniae J138
accaacuccucaaaagau

SEQ ID NO: 540717 - RNA, 22 nt, Chlamydophila pneumoniae J138
accaaguacaguaucgacuuuu

SEQ ID NO: 540718 - RNA, 23 nt, Chlamydophila pneumoniae J138
accaaggggcguucuugaaaaaa

SEQ ID NO: 540719 - RNA, 16 nt, Chlamydophila pneumoniae J138
accaaguaaaucagac

SEQ ID NO: 540720 - RNA, 20 nt, Chlamydophila pneumoniae J138
accaaguaaaucagacuuaa

SEQ ID NO: 540721 - RNA, 17 nt, Chlamydophila pneumoniae J138
accacggauuuucucua

SEQ ID NO: 540722 - RNA, 16 nt, Chlamydophila pneumoniae J138
accacgaaauguuaaa

SEQ ID NO: 540723 - RNA, 22 nt, Chlamydophila pneumoniae J138
accacuguccaugcacgagauu

SEQ ID NO: 540724 - RNA, 21 nt, Chlamydophila pneumoniae J138
accagaaggaagguucucaaa

SEQ ID NO: 540725 - RNA, 17 nt, Chlamydophila pneumoniae J138
accagaagcaugaauga

SEQ ID NO: 540726 - RNA, 13 nt, Chlamydophila pneumoniae J138
accagaaggaagg

SEQ ID NO: 540727 - RNA, 14 nt, Chlamydophila pneumoniae J138
accagaagacuccc

SEQ ID NO: 540728 - RNA, 13 nt, Chlamydophila pneumoniae J138
accagaagcaacu

SEQ ID NO: 540729 - RNA, 18 nt, Chlamydophila pneumoniae J138
accagaugauuuuuugaa

SEQ ID NO: 540730 - RNA, 15 nt, Chlamydophila pneumoniae J138
accagaugauuuuuu

SEQ ID NO: 540731 - RNA, 16 nt, Chlamydophila pneumoniae J138
accagauaaagcaaag

SEQ ID NO: 540732 - RNA, 15 nt, Chlamydophila pneumoniae J138
accagauaaagcaaa

SEQ ID NO: 540733 - RNA, 21 nt, Chlamydophila pneumoniae J138
accagcauuaagauaaacagc

SEQ ID NO: 540734 - RNA, 23 nt, Chlamydophila pneumoniae J138
accagcauuaagauaaacagcac

SEQ ID NO: 540735 - RNA, 14 nt, Chlamydophila pneumoniae J138
accagggagaccua

SEQ ID NO: 540736 - RNA, 19 nt, Chlamydophila pneumoniae J138
accauacacaaaucauuua

SEQ ID NO: 540737 - RNA, 14 nt, Chlamydophila pneumoniae J138
accauaaagaauuc

SEQ ID NO: 540738 - RNA, 14 nt, Chlamydophila pneumoniae J138
accauucuugaaga

SEQ ID NO: 540739 - RNA, 16 nt, Chlamydophila pneumoniae J138
accauugcucuaaguu

SEQ ID NO: 540740 - RNA, 23 nt, Chlamydophila pneumoniae J138
accaucaugaaucuuaugggaga

SEQ ID NO: 540741 - RNA, 14 nt, Chlamydophila pneumoniae J138
acccaccagaagga

SEQ ID NO: 540742 - RNA, 14 nt, Chlamydophila pneumoniae J138
acccaagagaccca

SEQ ID NO: 540743 - RNA, 13 nt, Chlamydophila pneumoniae J138
acccaagagaccc

SEQ ID NO: 540744 - RNA, 18 nt, Chlamydophila pneumoniae J138
acccaauucuuaaaaagc

SEQ ID NO: 540745 - RNA, 14 nt, Chlamydophila pneumoniae J138
acccaacaguucuu

SEQ ID NO: 540746 - RNA, 12 nt, Chlamydophila pneumoniae J138
acccccgcagcu

SEQ ID NO: 540747 - RNA, 13 nt, Chlamydophila pneumoniae J138
accccaaagcaga

SEQ ID NO: 540748 - RNA, 20 nt, Chlamydophila pneumoniae J138
accccaaagcagauccugcu

SEQ ID NO: 540749 - RNA, 15 nt, Chlamydophila pneumoniae J138
acagaccaaaucauc

SEQ ID NO: 540750 - RNA, 15 nt, Chlamydophila pneumoniae J138
acagaaugauaagaa

SEQ ID NO: 540751 - RNA, 20 nt, Chlamydophila pneumoniae J138
acacugguagcuaaauuuag

SEQ ID NO: 540752 - RNA, 18 nt, Chlamydophila pneumoniae J138
acacugcgagagaaaguc

SEQ ID NO: 540753 - RNA, 11 nt, Chlamydophila pneumoniae J138
acacucucuac

SEQ ID NO: 540754 - RNA, 12 nt, Chlamydophila pneumoniae J138
acacucuaucau

SEQ ID NO: 540755 - RNA, 14 nt, Chlamydophila pneumoniae J138
acacuccucagaau

SEQ ID NO: 540756 - RNA, 15 nt, Chlamydophila pneumoniae J138
acagauguaaaugcu

SEQ ID NO: 540757 - RNA, 18 nt, Chlamydophila pneumoniae J138
acagauuucuucuucaga

SEQ ID NO: 540758 - RNA, 17 nt, Chlamydophila pneumoniae J138
acagauuucuucuucag

SEQ ID NO: 540759 - RNA, 13 nt, Chlamydophila pneumoniae J138
acagcacaggcau

SEQ ID NO: 540760 - RNA, 23 nt, Chlamydophila pneumoniae J138
acagaucugcauaauuuuucuua

SEQ ID NO: 540761 - RNA, 21 nt, Chlamydophila pneumoniae J138
acagagucagaagcuauucca

SEQ ID NO: 540762 - RNA, 19 nt, Chlamydophila pneumoniae J138
acagagaauugcauucuua

SEQ ID NO: 540763 - RNA, 17 nt, Chlamydophila pneumoniae J138
acagagaccuucucuuc

SEQ ID NO: 540764 - RNA, 21 nt, Chlamydophila pneumoniae J138
acagagcgucuauuagauuuc

SEQ ID NO: 540765 - RNA, 13 nt, Chlamydophila pneumoniae J138
acagccagcagaa

SEQ ID NO: 540766 - RNA, 17 nt, Chlamydophila pneumoniae J138
acagcguguauccaucu

SEQ ID NO: 540767 - RNA, 16 nt, Chlamydophila pneumoniae J138
acagccuguuuucuuc

SEQ ID NO: 540768 - RNA, 13 nt, Chlamydophila pneumoniae J138
acagccggagcuu

SEQ ID NO: 540769 - RNA, 20 nt, Chlamydophila pneumoniae J138
acagccggagcuucuaagau

SEQ ID NO: 540770 - RNA, 19 nt, Chlamydophila pneumoniae J138
acaggcaggccacuuccua

SEQ ID NO: 540771 - RNA, 12 nt, Chlamydophila pneumoniae J138
acaggaaagaau

SEQ ID NO: 540772 - RNA, 14 nt, Chlamydophila pneumoniae J138
acaggaauaggcuc

SEQ ID NO: 540773 - RNA, 18 nt, Chlamydophila pneumoniae J138
acaggaauaggcucuuua

SEQ ID NO: 540774 - RNA, 17 nt, Chlamydophila pneumoniae J138
acaggagagagaaggcu

SEQ ID NO: 540775 - RNA, 12 nt, Chlamydophila pneumoniae J138
acaggagaagcg

SEQ ID NO: 540776 - RNA, 14 nt, Chlamydophila pneumoniae J138
acagcuucuuuucc

SEQ ID NO: 540777 - RNA, 16 nt, Chlamydophila pneumoniae J138
acagcuucuuuuccag

SEQ ID NO: 540778 - RNA, 14 nt, Chlamydophila pneumoniae J138
acagcuuuaucuuc

SEQ ID NO: 540779 - RNA, 16 nt, Chlamydophila pneumoniae J138
acagcuuuaaucagag

SEQ ID NO: 540780 - RNA, 18 nt, Chlamydophila pneumoniae J138
acagcugggaucuggcuc

SEQ ID NO: 540781 - RNA, 22 nt, Chlamydophila pneumoniae J138
acagcuucuucguaagcugcaa

SEQ ID NO: 540782 - RNA, 12 nt, Chlamydophila pneumoniae J138
acagcuccauuu

SEQ ID NO: 540783 - RNA, 16 nt, Chlamydophila pneumoniae J138
acagcuccauuuaaau

SEQ ID NO: 540784 - RNA, 18 nt, Chlamydophila pneumoniae J138
acagcuaucgagauaucg

SEQ ID NO: 540785 - RNA, 20 nt, Chlamydophila pneumoniae J138
acagcugcuagagcagcugu

SEQ ID NO: 540786 - RNA, 14 nt, Chlamydophila pneumoniae J138
acauauucuccuua

SEQ ID NO: 540787 - RNA, 15 nt, Chlamydophila pneumoniae J138
acauacauucuauuc

SEQ ID NO: 540788 - RNA, 14 nt, Chlamydophila pneumoniae J138
acauacaucaaaau

SEQ ID NO: 540789 - RNA, 13 nt, Chlamydophila pneumoniae J138
acaucaaagaauu

SEQ ID NO: 540790 - RNA, 14 nt, Chlamydophila pneumoniae J138
acaucaaagcaauu

SEQ ID NO: 540791 - RNA, 19 nt, Chlamydophila pneumoniae J138
acaucaaagcaauuucucc

SEQ ID NO: 540792 - RNA, 15 nt, Chlamydophila pneumoniae J138
acaucaaaaugcugc

SEQ ID NO: 540793 - RNA, 15 nt, Chlamydophila pneumoniae J138
acauauugaagauau

SEQ ID NO: 540794 - RNA, 20 nt, Chlamydophila pneumoniae J138
acaucauuaucauaaauacg

SEQ ID NO: 540795 - RNA, 15 nt, Chlamydophila pneumoniae J138
acaucauguagugcu

SEQ ID NO: 540796 - RNA, 18 nt, Chlamydophila pneumoniae J138
acaucagcaacauaaagu

SEQ ID NO: 540797 - RNA, 13 nt, Chlamydophila pneumoniae J138
acaucagcaacau

SEQ ID NO: 540798 - RNA, 22 nt, Chlamydophila pneumoniae J138
acaucacuuauauuuucuauuc

SEQ ID NO: 540799 - RNA, 19 nt, Chlamydophila pneumoniae J138
acaucagacugaagagcaa

SEQ ID NO: 540800 - RNA, 19 nt, Chlamydophila pneumoniae J138
acaucacuuauauuuucua

SEQ ID NO: 540801 - RNA, 16 nt, Chlamydophila pneumoniae J138
acaucuccugcagguu

SEQ ID NO: 540802 - RNA, 22 nt, Chlamydophila pneumoniae J138
acaucuccaagccaugcaauga

SEQ ID NO: 540803 - RNA, 22 nt, Chlamydophila pneumoniae J138
acaucuccaagauaauuaugua

SEQ ID NO: 540804 - RNA, 13 nt, Chlamydophila pneumoniae J138
acaucuuaaaaac

SEQ ID NO: 540805 - RNA, 14 nt, Chlamydophila pneumoniae J138
acaucuuaaaaacu

SEQ ID NO: 540806 - RNA, 15 nt, Chlamydophila pneumoniae J138
acaucuuaaaaacua

SEQ ID NO: 540807 - RNA, 19 nt, Chlamydophila pneumoniae J138
acaucuguaguaggcacuu

SEQ ID NO: 540808 - RNA, 12 nt, Chlamydophila pneumoniae J138
acaugagauacg

SEQ ID NO: 540809 - RNA, 16 nt, Chlamydophila pneumoniae J138
acaugaggauacacuu

SEQ ID NO: 540810 - RNA, 20 nt, Chlamydophila pneumoniae J138
acaugaggauucuuuuugau

SEQ ID NO: 540811 - RNA, 14 nt, Chlamydophila pneumoniae J138
acaugacaaauaaa

SEQ ID NO: 540812 - RNA, 22 nt, Chlamydophila pneumoniae J138
acaguccucucccuuaaggaaa

SEQ ID NO: 540813 - RNA, 17 nt, Chlamydophila pneumoniae J138
acagucugugagaaaua

SEQ ID NO: 540814 - RNA, 21 nt, Chlamydophila pneumoniae J138
acaguugcgcgcccucuucua

SEQ ID NO: 540815 - RNA, 13 nt, Chlamydophila pneumoniae J138
acauaaaguuaua

SEQ ID NO: 540816 - RNA, 13 nt, Chlamydophila pneumoniae J138
acauaaagaucuu

SEQ ID NO: 540817 - RNA, 21 nt, Chlamydophila pneumoniae J138
acauaaagaucuuuauuuuua

SEQ ID NO: 540818 - RNA, 13 nt, Chlamydophila pneumoniae J138
acauaaagucaaa

SEQ ID NO: 540819 - RNA, 18 nt, Chlamydophila pneumoniae J138
acaggcuacauaguuuuu

SEQ ID NO: 540820 - RNA, 19 nt, Chlamydophila pneumoniae J138
acaggcucaugaaauuuca

SEQ ID NO: 540821 - RNA, 19 nt, Chlamydophila pneumoniae J138
acaggcuucaucacauuaa

SEQ ID NO: 540822 - RNA, 17 nt, Chlamydophila pneumoniae J138
acaggcuccucugcuaa

SEQ ID NO: 540823 - RNA, 21 nt, Chlamydophila pneumoniae J138
acaggggaugugauguucugc

SEQ ID NO: 540824 - RNA, 18 nt, Chlamydophila pneumoniae J138
acaguauuccaucacagu

SEQ ID NO: 540825 - RNA, 13 nt, Chlamydophila pneumoniae J138
acagguucacuuc

SEQ ID NO: 540826 - RNA, 16 nt, Chlamydophila pneumoniae J138
aacaagacgaaagcac

SEQ ID NO: 540827 - RNA, 14 nt, Chlamydophila pneumoniae J138
aacaagacgaaagc

SEQ ID NO: 540828 - RNA, 22 nt, Chlamydophila pneumoniae J138
aacaagagcgcauuuuacagcg

SEQ ID NO: 540829 - RNA, 22 nt, Chlamydophila pneumoniae J138
aacaagcugcugagcagcaaaa

SEQ ID NO: 540830 - RNA, 17 nt, Chlamydophila pneumoniae J138
aacaaguuuuuucaauc

SEQ ID NO: 540831 - RNA, 14 nt, Chlamydophila pneumoniae J138
aacaaguaccaaga

SEQ ID NO: 540832 - RNA, 23 nt, Chlamydophila pneumoniae J138
aacaagcuuuuaauguguucuua

SEQ ID NO: 540833 - RNA, 14 nt, Chlamydophila pneumoniae J138
aacaacugaaaaac

SEQ ID NO: 540834 - RNA, 19 nt, Chlamydophila pneumoniae J138
aacaaccaaaagaauuccu

SEQ ID NO: 540835 - RNA, 22 nt, Chlamydophila pneumoniae J138
aacaacaucacuuauauuuucu

SEQ ID NO: 540836 - RNA, 11 nt, Chlamydophila pneumoniae J138
aacaacaucac

SEQ ID NO: 540837 - RNA, 17 nt, Chlamydophila pneumoniae J138
aacaacauaaagaaggu

SEQ ID NO: 540838 - RNA, 15 nt, Chlamydophila pneumoniae J138
aacaacauaaagaag

SEQ ID NO: 540839 - RNA, 19 nt, Chlamydophila pneumoniae J138
aacaaccaucccauaugga

SEQ ID NO: 540840 - RNA, 17 nt, Chlamydophila pneumoniae J138
aaauuuuuuaggaucuu

SEQ ID NO: 540841 - RNA, 14 nt, Chlamydophila pneumoniae J138
aacaaaaaaucaau

SEQ ID NO: 540842 - RNA, 20 nt, Chlamydophila pneumoniae J138
aacaaaaaggacucuuucua

SEQ ID NO: 540843 - RNA, 18 nt, Chlamydophila pneumoniae J138
aacaaaaaggacucuuuc

SEQ ID NO: 540844 - RNA, 22 nt, Chlamydophila pneumoniae J138
aacaaaguuuaugacacagcua

SEQ ID NO: 540845 - RNA, 15 nt, Chlamydophila pneumoniae J138
aacaacagaaauguu

SEQ ID NO: 540846 - RNA, 20 nt, Chlamydophila pneumoniae J138
aaauuguuggaauugcauua

SEQ ID NO: 540847 - RNA, 20 nt, Chlamydophila pneumoniae J138
aaauuguuaucaggaacuaa

SEQ ID NO: 540848 - RNA, 20 nt, Chlamydophila pneumoniae J138
aaauuguuuguaucaaagaa

SEQ ID NO: 540849 - RNA, 16 nt, Chlamydophila pneumoniae J138
aaauugugaaaaaaaa

SEQ ID NO: 540850 - RNA, 12 nt, Chlamydophila pneumoniae J138
aaauugcucuug

SEQ ID NO: 540851 - RNA, 22 nt, Chlamydophila pneumoniae J138
aaauuuaucggcuaaagaaaag

SEQ ID NO: 540852 - RNA, 21 nt, Chlamydophila pneumoniae J138
aaauuuaucggcuaaagaaaa

SEQ ID NO: 540853 - RNA, 15 nt, Chlamydophila pneumoniae J138
aaauuucauuuagac

SEQ ID NO: 540854 - RNA, 12 nt, Chlamydophila pneumoniae J138
aaauuuuuaaaa

SEQ ID NO: 540855 - RNA, 19 nt, Chlamydophila pneumoniae J138
aaauuuucuugcgacauaa

SEQ ID NO: 540856 - RNA, 21 nt, Chlamydophila pneumoniae J138
aaauuuucucgggauaaugcu

SEQ ID NO: 540857 - RNA, 17 nt, Chlamydophila pneumoniae J138
aaauuuucccauuacag

SEQ ID NO: 540858 - RNA, 20 nt, Chlamydophila pneumoniae J138
aacacaaauagcaagagcua

SEQ ID NO: 540859 - RNA, 15 nt, Chlamydophila pneumoniae J138
aacacaaauagcaag

SEQ ID NO: 540860 - RNA, 14 nt, Chlamydophila pneumoniae J138
aacacaaauagcaa

SEQ ID NO: 540861 - RNA, 13 nt, Chlamydophila pneumoniae J138
aacaaucuuucuu

SEQ ID NO: 540862 - RNA, 14 nt, Chlamydophila pneumoniae J138
aacaaucuuucuuc

SEQ ID NO: 540863 - RNA, 16 nt, Chlamydophila pneumoniae J138
aacaauaguaaagcau

SEQ ID NO: 540864 - RNA, 15 nt, Chlamydophila pneumoniae J138
aacaccauaaaacaa

SEQ ID NO: 540865 - RNA, 17 nt, Chlamydophila pneumoniae J138
aacaccguuaauuuuug

SEQ ID NO: 540866 - RNA, 14 nt, Chlamydophila pneumoniae J138
aacaccucaauacg

SEQ ID NO: 540867 - RNA, 15 nt, Chlamydophila pneumoniae J138
aacacccggcuuuuc

SEQ ID NO: 540868 - RNA, 20 nt, Chlamydophila pneumoniae J138
aacacccucccucauaagau

SEQ ID NO: 540869 - RNA, 19 nt, Chlamydophila pneumoniae J138
aacaccgaaggcacuggca

SEQ ID NO: 540870 - RNA, 20 nt, Chlamydophila pneumoniae J138
aacacgcccacggaaagcac

SEQ ID NO: 540871 - RNA, 16 nt, Chlamydophila pneumoniae J138
aacacgcacaaacuaa

SEQ ID NO: 540872 - RNA, 18 nt, Chlamydophila pneumoniae J138
aacacgagugccuucuuc

SEQ ID NO: 540873 - RNA, 17 nt, Chlamydophila pneumoniae J138
aacacgucgaacaugac

SEQ ID NO: 540874 - RNA, 22 nt, Chlamydophila pneumoniae J138
aacacuuaguccgguuucuucu

SEQ ID NO: 540875 - RNA, 19 nt, Chlamydophila pneumoniae J138
aacacucucuaccaucaug

SEQ ID NO: 540876 - RNA, 17 nt, Chlamydophila pneumoniae J138
aacacuuuguuuuucaa

SEQ ID NO: 540877 - RNA, 14 nt, Chlamydophila pneumoniae J138
aacagaaauugcuu

SEQ ID NO: 540878 - RNA, 16 nt, Chlamydophila pneumoniae J138
aacagagcgccuccac

SEQ ID NO: 540879 - RNA, 20 nt, Chlamydophila pneumoniae J138
aacagauaagacaauaaaau

SEQ ID NO: 540880 - RNA, 22 nt, Chlamydophila pneumoniae J138
aacagaucuuuaucauugcuau

SEQ ID NO: 540881 - RNA, 17 nt, Chlamydophila pneumoniae J138
aacagaucuuuaucauu

SEQ ID NO: 540882 - RNA, 19 nt, Chlamydophila pneumoniae J138
aacagcauggacuccaaga

SEQ ID NO: 540883 - RNA, 21 nt, Chlamydophila pneumoniae J138
aacagcauggacuccaagaau

SEQ ID NO: 540884 - RNA, 23 nt, Chlamydophila pneumoniae J138
aacagauuuuucaagaacuccuu

SEQ ID NO: 540885 - RNA, 20 nt, Chlamydophila pneumoniae J138
aacagcacucacgcucucgc

SEQ ID NO: 540886 - RNA, 21 nt, Chlamydophila pneumoniae J138
aacauaaugauguaacuagua

SEQ ID NO: 540887 - RNA, 16 nt, Chlamydophila pneumoniae J138
aacauagauaagguaa

SEQ ID NO: 540888 - RNA, 22 nt, Chlamydophila pneumoniae J138
aacauacaccccaguuucuuga

SEQ ID NO: 540889 - RNA, 18 nt, Chlamydophila pneumoniae J138
aacauacaccccaguuuc

SEQ ID NO: 540890 - RNA, 15 nt, Chlamydophila pneumoniae J138
aacauccauagagaa

SEQ ID NO: 540891 - RNA, 13 nt, Chlamydophila pneumoniae J138
aacaucaaagaau

SEQ ID NO: 540892 - RNA, 15 nt, Chlamydophila pneumoniae J138
aacaucaaagaauua

SEQ ID NO: 540893 - RNA, 15 nt, Chlamydophila pneumoniae J138
aacaucaagaauuuc

SEQ ID NO: 540894 - RNA, 17 nt, Chlamydophila pneumoniae J138
aacaucacucaggauau

SEQ ID NO: 540895 - RNA, 14 nt, Chlamydophila pneumoniae J138
aacaggauugauaa

SEQ ID NO: 540896 - RNA, 15 nt, Chlamydophila pneumoniae J138
aacagugguaugcuu

SEQ ID NO: 540897 - RNA, 15 nt, Chlamydophila pneumoniae J138
aacaguucuuucugc

SEQ ID NO: 540898 - RNA, 16 nt, Chlamydophila pneumoniae J138
aacauaaagaagguuu

SEQ ID NO: 540899 - RNA, 19 nt, Chlamydophila pneumoniae J138
aacauaaagacccuucuuu

SEQ ID NO: 540900 - RNA, 15 nt, Chlamydophila pneumoniae J138
aacauaaagaagguu

SEQ ID NO: 540901 - RNA, 22 nt, Chlamydophila pneumoniae J138
aacaucggagaacuuccugauu

SEQ ID NO: 540902 - RNA, 15 nt, Chlamydophila pneumoniae J138
aacaucgaaaccaca

SEQ ID NO: 540903 - RNA, 20 nt, Chlamydophila pneumoniae J138
aacaugaccuuuaggaacuu

SEQ ID NO: 540904 - RNA, 12 nt, Chlamydophila pneumoniae J138
aacaucuuugug

SEQ ID NO: 540905 - RNA, 23 nt, Chlamydophila pneumoniae J138
aacauggcgguguuuccuucgaa

SEQ ID NO: 540906 - RNA, 15 nt, Chlamydophila pneumoniae J138
aacaugccugaaaac

SEQ ID NO: 540907 - RNA, 14 nt, Chlamydophila pneumoniae J138
aacaugcgcagaau

SEQ ID NO: 540908 - RNA, 17 nt, Chlamydophila pneumoniae J138
aacaugccugaaaacaa

SEQ ID NO: 540909 - RNA, 11 nt, Chlamydophila pneumoniae J138
aacaugaggau

SEQ ID NO: 540910 - RNA, 23 nt, Chlamydophila pneumoniae J138
aaccaaucuugagcauccaaaau

SEQ ID NO: 540911 - RNA, 16 nt, Chlamydophila pneumoniae J138
aaccaauaaacuuugu

SEQ ID NO: 540912 - RNA, 21 nt, Chlamydophila pneumoniae J138
aaccaauaaacuuuguuggga

SEQ ID NO: 540913 - RNA, 20 nt, Chlamydophila pneumoniae J138
aaccaauugagcucucuagc

SEQ ID NO: 540914 - RNA, 13 nt, Chlamydophila pneumoniae J138
aaccaacaucaaa

SEQ ID NO: 540915 - RNA, 20 nt, Chlamydophila pneumoniae J138
aaccaaaagaauuaagaaga

SEQ ID NO: 540916 - RNA, 13 nt, Chlamydophila pneumoniae J138
aaccaaaaugagu

SEQ ID NO: 540917 - RNA, 23 nt, Chlamydophila pneumoniae J138
aacauuggagucuaaaaaauacc

SEQ ID NO: 540918 - RNA, 19 nt, Chlamydophila pneumoniae J138
aacauuggagucuaaaaaa

SEQ ID NO: 540919 - RNA, 20 nt, Chlamydophila pneumoniae J138
aacauuuuuaaggaaaguuc

SEQ ID NO: 540920 - RNA, 23 nt, Chlamydophila pneumoniae J138
aaccagguagagugucuuccuug

SEQ ID NO: 540921 - RNA, 15 nt, Chlamydophila pneumoniae J138
aaccaggaacaaagg

SEQ ID NO: 540922 - RNA, 19 nt, Chlamydophila pneumoniae J138
aaccagaagacucccaagg

SEQ ID NO: 540923 - RNA, 14 nt, Chlamydophila pneumoniae J138
aaccaugaugcaau

SEQ ID NO: 540924 - RNA, 13 nt, Chlamydophila pneumoniae J138
aaccaugaggcug

SEQ ID NO: 540925 - RNA, 20 nt, Chlamydophila pneumoniae J138
aaccaucaaucacucuauga

SEQ ID NO: 540926 - RNA, 13 nt, Chlamydophila pneumoniae J138
aaccauagauuua

SEQ ID NO: 540927 - RNA, 15 nt, Chlamydophila pneumoniae J138
aaccauagagagccu

SEQ ID NO: 540928 - RNA, 22 nt, Chlamydophila pneumoniae J138
aaccgaaacuucucagauaaaa

SEQ ID NO: 540929 - RNA, 17 nt, Chlamydophila pneumoniae J138
aaccgagacuauuuugg

SEQ ID NO: 540930 - RNA, 22 nt, Chlamydophila pneumoniae J138
aacccuuuauacuguuuuucuu

SEQ ID NO: 540931 - RNA, 13 nt, Chlamydophila pneumoniae J138
aacccuauuuaag

SEQ ID NO: 540932 - RNA, 22 nt, Chlamydophila pneumoniae J138
aaccucggucucgcuguuucaa

SEQ ID NO: 540933 - RNA, 13 nt, Chlamydophila pneumoniae J138
aaccucuaaaaac

SEQ ID NO: 540934 - RNA, 11 nt, Chlamydophila pneumoniae J138
aaccuccacca

SEQ ID NO: 540935 - RNA, 12 nt, Chlamydophila pneumoniae J138
aaccucuuuucu

SEQ ID NO: 540936 - RNA, 22 nt, Chlamydophila pneumoniae J138
aaccgucacuguuuuccagaaa

SEQ ID NO: 540937 - RNA, 24 nt, Chlamydophila pneumoniae J138
aaccuagaaggaggaguccuucua

SEQ ID NO: 540938 - RNA, 15 nt, Chlamydophila pneumoniae J138
aacgacauugaagag

SEQ ID NO: 540939 - RNA, 17 nt, Chlamydophila pneumoniae J138
aacgaacaguucauguu

SEQ ID NO: 540940 - RNA, 14 nt, Chlamydophila pneumoniae J138
aaccuuuccuaaaa

SEQ ID NO: 540941 - RNA, 16 nt, Chlamydophila pneumoniae J138
aaccuuuccuaaaaua

SEQ ID NO: 540942 - RNA, 19 nt, Chlamydophila pneumoniae J138
aaccuucgauuccaggcuc

SEQ ID NO: 540943 - RNA, 17 nt, Chlamydophila pneumoniae J138
aacgacguuuaauuccu

SEQ ID NO: 540944 - RNA, 22 nt, Chlamydophila pneumoniae J138
aacgacguuuaauuccuuggau

SEQ ID NO: 540945 - RNA, 21 nt, Chlamydophila pneumoniae J138
aacgcauaagagacauuucuu

SEQ ID NO: 540946 - RNA, 15 nt, Chlamydophila pneumoniae J138
aacgcacgccaagag

SEQ ID NO: 540947 - RNA, 14 nt, Chlamydophila pneumoniae J138
aacgcacgccaaga

SEQ ID NO: 540948 - RNA, 23 nt, Chlamydophila pneumoniae J138
aacgauuguaauuucuagcuaau

SEQ ID NO: 540949 - RNA, 16 nt, Chlamydophila pneumoniae J138
aacgcaacauccauuc

SEQ ID NO: 540950 - RNA, 17 nt, Chlamydophila pneumoniae J138
aacgauuucuugaagau

SEQ ID NO: 540951 - RNA, 20 nt, Chlamydophila pneumoniae J138
aacgcccuucuuaguaaaga

SEQ ID NO: 540952 - RNA, 22 nt, Chlamydophila pneumoniae J138
aacgcaugaaccuauaggcaag

SEQ ID NO: 540953 - RNA, 18 nt, Chlamydophila pneumoniae J138
aacgccaacacgcacaaa

SEQ ID NO: 540954 - RNA, 14 nt, Chlamydophila pneumoniae J138
aacgccgcucuuga

SEQ ID NO: 540955 - RNA, 19 nt, Chlamydophila pneumoniae J138
aacgcucucuagcaccuaa

SEQ ID NO: 540956 - RNA, 20 nt, Chlamydophila pneumoniae J138
aacggauuuuguuugcaugc

SEQ ID NO: 540957 - RNA, 20 nt, Chlamydophila pneumoniae J138
aacggauaagacggauaaau

SEQ ID NO: 540958 - RNA, 21 nt, Chlamydophila pneumoniae J138
aacggacauuuucaagcuuuc

SEQ ID NO: 540959 - RNA, 23 nt, Chlamydophila pneumoniae J138
aacgggagcguuuuuugaaaauu

SEQ ID NO: 540960 - RNA, 20 nt, Chlamydophila pneumoniae J138
aacggcucuuucuaaaacau

SEQ ID NO: 540961 - RNA, 14 nt, Chlamydophila pneumoniae J138
aacgguaaauaucu

SEQ ID NO: 540962 - RNA, 15 nt, Chlamydophila pneumoniae J138
aacguacuuagguaa

SEQ ID NO: 540963 - RNA, 18 nt, Chlamydophila pneumoniae J138
aacguagaugucuugguu

SEQ ID NO: 540964 - RNA, 23 nt, Chlamydophila pneumoniae J138
aacguacucuucuuuuuaucaug

SEQ ID NO: 540965 - RNA, 20 nt, Chlamydophila pneumoniae J138
aacguaagcuuuuuaccaau

SEQ ID NO: 540966 - RNA, 14 nt, Chlamydophila pneumoniae J138
aacuaccagaugcc

SEQ ID NO: 540967 - RNA, 13 nt, Chlamydophila pneumoniae J138
aacuagaaaaaau

SEQ ID NO: 540968 - RNA, 15 nt, Chlamydophila pneumoniae J138
aacuagaaucaccaa

SEQ ID NO: 540969 - RNA, 17 nt, Chlamydophila pneumoniae J138
aacuagagaucuuuuua

SEQ ID NO: 540970 - RNA, 13 nt, Chlamydophila pneumoniae J138
aacuagaccaaua

SEQ ID NO: 540971 - RNA, 20 nt, Chlamydophila pneumoniae J138
aacuauacucucuguagcac

SEQ ID NO: 540972 - RNA, 17 nt, Chlamydophila pneumoniae J138
aacuaggaaaagcauag

SEQ ID NO: 540973 - RNA, 22 nt, Chlamydophila pneumoniae J138
aacuagguuauuaucaaaguga

SEQ ID NO: 540974 - RNA, 20 nt, Chlamydophila pneumoniae J138
aacuaaaacagccuagcaaa

SEQ ID NO: 540975 - RNA, 14 nt, Chlamydophila pneumoniae J138
aacuaaaacagccu

SEQ ID NO: 540976 - RNA, 14 nt, Chlamydophila pneumoniae J138
aacuaaacucucca

SEQ ID NO: 540977 - RNA, 18 nt, Chlamydophila pneumoniae J138
aacuaaacucuccaaaag

SEQ ID NO: 540978 - RNA, 20 nt, Chlamydophila pneumoniae J138
aacuaacuguaauuucaauu

SEQ ID NO: 540979 - RNA, 20 nt, Chlamydophila pneumoniae J138
aacuaacauagauaagguaa

SEQ ID NO: 540980 - RNA, 16 nt, Chlamydophila pneumoniae J138
aacguauccuugauuu

SEQ ID NO: 540981 - RNA, 18 nt, Chlamydophila pneumoniae J138
aacguagcuacaaaauua

SEQ ID NO: 540982 - RNA, 12 nt, Chlamydophila pneumoniae J138
aacguugauugg

SEQ ID NO: 540983 - RNA, 18 nt, Chlamydophila pneumoniae J138
aacucuuuaggucuuguc

SEQ ID NO: 540984 - RNA, 13 nt, Chlamydophila pneumoniae J138
aacucuuugagga

SEQ ID NO: 540985 - RNA, 19 nt, Chlamydophila pneumoniae J138
aacucuuuaauugugcucu

SEQ ID NO: 540986 - RNA, 22 nt, Chlamydophila pneumoniae J138
aacucuuuaauugugcucucua

SEQ ID NO: 540987 - RNA, 14 nt, Chlamydophila pneumoniae J138
aacucuucaagagc

SEQ ID NO: 540988 - RNA, 20 nt, Chlamydophila pneumoniae J138
aacucuuaaagguaaagcuu

SEQ ID NO: 540989 - RNA, 16 nt, Chlamydophila pneumoniae J138
aacucuuaagaauaaa

SEQ ID NO: 540990 - RNA, 20 nt, Chlamydophila pneumoniae J138
aacucucccauguaguaaau

SEQ ID NO: 540991 - RNA, 12 nt, Chlamydophila pneumoniae J138
aacucucuuccu

SEQ ID NO: 540992 - RNA, 13 nt, Chlamydophila pneumoniae J138
aacucucuuuaaa

SEQ ID NO: 540993 - RNA, 17 nt, Chlamydophila pneumoniae J138
aacucucuucccccaga

SEQ ID NO: 540994 - RNA, 15 nt, Chlamydophila pneumoniae J138
aacucuagaucuuca

SEQ ID NO: 540995 - RNA, 18 nt, Chlamydophila pneumoniae J138
aacucuaaucugauucaa

SEQ ID NO: 540996 - RNA, 14 nt, Chlamydophila pneumoniae J138
aacucuaaucugau

SEQ ID NO: 540997 - RNA, 18 nt, Chlamydophila pneumoniae J138
aacuccccaguuuuccau

SEQ ID NO: 540998 - RNA, 22 nt, Chlamydophila pneumoniae J138
aacuccaggggauaaaacuaua

SEQ ID NO: 540999 - RNA, 14 nt, Chlamydophila pneumoniae J138
aacuccacgccaaa

SEQ ID NO: 541000 - RNA, 18 nt, Chlamydophila pneumoniae J138
aacuccacgaauucuuua

SEQ ID NO: 541001 - RNA, 16 nt, Chlamydophila pneumoniae J138
aacuccaaaauauucu

SEQ ID NO: 541002 - RNA, 21 nt, Chlamydophila pneumoniae J138
aacuccuaagucguuaacauc

SEQ ID NO: 541003 - RNA, 22 nt, Chlamydophila pneumoniae J138
aacuccuaagucguuaacauca

SEQ ID NO: 541004 - RNA, 20 nt, Chlamydophila pneumoniae J138
aacuccgcccgucuuagaau

SEQ ID NO: 541005 - RNA, 20 nt, Chlamydophila pneumoniae J138
aacuauaggaagcucuucua

SEQ ID NO: 541006 - RNA, 19 nt, Chlamydophila pneumoniae J138
aacuauaauauaacugcau

SEQ ID NO: 541007 - RNA, 17 nt, Chlamydophila pneumoniae J138
aacucaaucucuuugac

SEQ ID NO: 541008 - RNA, 19 nt, Chlamydophila pneumoniae J138
aacucauccuaaauuaaau

SEQ ID NO: 541009 - RNA, 22 nt, Chlamydophila pneumoniae J138
aacucaucacaauuuuaaaauc

SEQ ID NO: 541010 - RNA, 15 nt, Chlamydophila pneumoniae J138
aacuccaaaauauuc

SEQ ID NO: 541011 - RNA, 12 nt, Chlamydophila pneumoniae J138
aacuccaaaaua

SEQ ID NO: 541012 - RNA, 17 nt, Chlamydophila pneumoniae J138
aacucagcgcaucacga

SEQ ID NO: 541013 - RNA, 22 nt, Chlamydophila pneumoniae J138
aacugauuaguuuguuuuaauu

SEQ ID NO: 541014 - RNA, 15 nt, Chlamydophila pneumoniae J138
aacugaugccaagaa

SEQ ID NO: 541015 - RNA, 18 nt, Chlamydophila pneumoniae J138
aacugcgauacucucagc

SEQ ID NO: 541016 - RNA, 21 nt, Chlamydophila pneumoniae J138
aacugcgauacucucagcaaa

SEQ ID NO: 541017 - RNA, 18 nt, Chlamydophila pneumoniae J138
aacugcgcuaucaucauu

SEQ ID NO: 541018 - RNA, 18 nt, Chlamydophila pneumoniae J138
aacugccugagaaaaguu

SEQ ID NO: 541019 - RNA, 17 nt, Chlamydophila pneumoniae J138
aacugcuccugaagcug

SEQ ID NO: 541020 - RNA, 22 nt, Chlamydophila pneumoniae J138
aacugcuccugaagcugagaau

SEQ ID NO: 541021 - RNA, 14 nt, Chlamydophila pneumoniae J138
aacugcauaaucuc

SEQ ID NO: 541022 - RNA, 17 nt, Chlamydophila pneumoniae J138
aacuggcuauggaagau

SEQ ID NO: 541023 - RNA, 20 nt, Chlamydophila pneumoniae J138
aacugcuuggucacaccaaa

SEQ ID NO: 541024 - RNA, 19 nt, Chlamydophila pneumoniae J138
aacugcuuggucacaccaa

SEQ ID NO: 541025 - RNA, 19 nt, Chlamydophila pneumoniae J138
aacuuaaagacuugcuucc

SEQ ID NO: 541026 - RNA, 17 nt, Chlamydophila pneumoniae J138
aacuuaaagacuugcuu

SEQ ID NO: 541027 - RNA, 19 nt, Chlamydophila pneumoniae J138
aacuguguucaauagcaaa

SEQ ID NO: 541028 - RNA, 16 nt, Chlamydophila pneumoniae J138
aacugugccauaacgc

SEQ ID NO: 541029 - RNA, 15 nt, Chlamydophila pneumoniae J138
aacuuuuccaaauuc

SEQ ID NO: 541030 - RNA, 19 nt, Chlamydophila pneumoniae J138
aacuuuugaagauccugag

SEQ ID NO: 541031 - RNA, 19 nt, Chlamydophila pneumoniae J138
aacuuugaccagaugauuu

SEQ ID NO: 541032 - RNA, 24 nt, Chlamydophila pneumoniae J138
aacuuuaggauucaguuccucauc

SEQ ID NO: 541033 - RNA, 21 nt, Chlamydophila pneumoniae J138
aacuuguuuucguaagagaau

SEQ ID NO: 541034 - RNA, 14 nt, Chlamydophila pneumoniae J138
aacuugagccaaca

SEQ ID NO: 541035 - RNA, 17 nt, Chlamydophila pneumoniae J138
aacuugauuuguuuagc

SEQ ID NO: 541036 - RNA, 18 nt, Chlamydophila pneumoniae J138
aacuucagcaagaaaaua

SEQ ID NO: 541037 - RNA, 21 nt, Chlamydophila pneumoniae J138
aacuucguuucgcuuugauaa

SEQ ID NO: 541038 - RNA, 20 nt, Chlamydophila pneumoniae J138
aacuucuaucuuacugaaga

SEQ ID NO: 541039 - RNA, 21 nt, Chlamydophila pneumoniae J138
aacuucgauuggaagcaaaga

SEQ ID NO: 541040 - RNA, 17 nt, Chlamydophila pneumoniae J138
aacuucaaugaagaaaa

SEQ ID NO: 541041 - RNA, 13 nt, Chlamydophila pneumoniae J138
aacuucaaaaguu

SEQ ID NO: 541042 - RNA, 14 nt, Chlamydophila pneumoniae J138
aacuucaacaaagg

SEQ ID NO: 541043 - RNA, 19 nt, Chlamydophila pneumoniae J138
aacuucaacuucuccaacu

SEQ ID NO: 541044 - RNA, 21 nt, Chlamydophila pneumoniae J138
aacuuaguuuugaaaagauuu

SEQ ID NO: 541045 - RNA, 18 nt, Chlamydophila pneumoniae J138
aagaacuacuuaaauccu

SEQ ID NO: 541046 - RNA, 16 nt, Chlamydophila pneumoniae J138
aagaacuccuuugagu

SEQ ID NO: 541047 - RNA, 22 nt, Chlamydophila pneumoniae J138
aagaacuccuuugagucuuuuu

SEQ ID NO: 541048 - RNA, 13 nt, Chlamydophila pneumoniae J138
aagaacucaacuu

SEQ ID NO: 541049 - RNA, 13 nt, Chlamydophila pneumoniae J138
aagaaccauagau

SEQ ID NO: 541050 - RNA, 17 nt, Chlamydophila pneumoniae J138
aagaacccauugaauuu

SEQ ID NO: 541051 - RNA, 15 nt, Chlamydophila pneumoniae J138
aagaaccuguuuuuc

SEQ ID NO: 541052 - RNA, 13 nt, Chlamydophila pneumoniae J138
aagaacauaaccu

SEQ ID NO: 541053 - RNA, 14 nt, Chlamydophila pneumoniae J138
aagaacaucuuccc

SEQ ID NO: 541054 - RNA, 14 nt, Chlamydophila pneumoniae J138
aagaacagaggauc

SEQ ID NO: 541055 - RNA, 12 nt, Chlamydophila pneumoniae J138
aagaaauucuga

SEQ ID NO: 541056 - RNA, 19 nt, Chlamydophila pneumoniae J138
aagaagacuagcuuuucau

SEQ ID NO: 541057 - RNA, 15 nt, Chlamydophila pneumoniae J138
aagaagaaggacaac

SEQ ID NO: 541058 - RNA, 13 nt, Chlamydophila pneumoniae J138
aagaagaagaaaa

SEQ ID NO: 541059 - RNA, 20 nt, Chlamydophila pneumoniae J138
aagaacugcauaaucucacc

SEQ ID NO: 541060 - RNA, 19 nt, Chlamydophila pneumoniae J138
aagaacuuaaaauucaaau

SEQ ID NO: 541061 - RNA, 17 nt, Chlamydophila pneumoniae J138
aagaacuuagcaaugaa

SEQ ID NO: 541062 - RNA, 22 nt, Chlamydophila pneumoniae J138
aagaagcucacucuuuaaaaac

SEQ ID NO: 541063 - RNA, 20 nt, Chlamydophila pneumoniae J138
aagaagcucacucuuuaaaa

SEQ ID NO: 541064 - RNA, 14 nt, Chlamydophila pneumoniae J138
aagaaggcagagaa

SEQ ID NO: 541065 - RNA, 17 nt, Chlamydophila pneumoniae J138
aagaagccuuccuuguu

SEQ ID NO: 541066 - RNA, 20 nt, Chlamydophila pneumoniae J138
aagaaaaaucuacauguaaa

SEQ ID NO: 541067 - RNA, 21 nt, Chlamydophila pneumoniae J138
aagaaaaaucgacuaucugcu

SEQ ID NO: 541068 - RNA, 15 nt, Chlamydophila pneumoniae J138
aagaaaaagcaucua

SEQ ID NO: 541069 - RNA, 20 nt, Chlamydophila pneumoniae J138
aagaaaaaccccuagaacuu

SEQ ID NO: 541070 - RNA, 15 nt, Chlamydophila pneumoniae J138
aacuuuuuuucuucu

SEQ ID NO: 541071 - RNA, 17 nt, Chlamydophila pneumoniae J138
aacuuuuuuucuucucu

SEQ ID NO: 541072 - RNA, 23 nt, Chlamydophila pneumoniae J138
aacuuuuuuucuucucuaagaaa

SEQ ID NO: 541073 - RNA, 12 nt, Chlamydophila pneumoniae J138
aagaaaagcaau

SEQ ID NO: 541074 - RNA, 13 nt, Chlamydophila pneumoniae J138
aagaaaagcaauc

SEQ ID NO: 541075 - RNA, 21 nt, Chlamydophila pneumoniae J138
aagaaaacaaagucacggcga

SEQ ID NO: 541076 - RNA, 23 nt, Chlamydophila pneumoniae J138
aagaaaaugaggacacaacucuu

SEQ ID NO: 541077 - RNA, 19 nt, Chlamydophila pneumoniae J138
aagaaaauccuaacaaaag

SEQ ID NO: 541078 - RNA, 22 nt, Chlamydophila pneumoniae J138
aagaaaauaucaccuacaucag

SEQ ID NO: 541079 - RNA, 18 nt, Chlamydophila pneumoniae J138
aagaaacccgcaacucuu

SEQ ID NO: 541080 - RNA, 18 nt, Chlamydophila pneumoniae J138
aagaaacuuccaaaacga

SEQ ID NO: 541081 - RNA, 19 nt, Chlamydophila pneumoniae J138
aagaaacuuccaaaacgau

SEQ ID NO: 541082 - RNA, 19 nt, Chlamydophila pneumoniae J138
aagaaagagucucacucuu

SEQ ID NO: 541083 - RNA, 11 nt, Chlamydophila pneumoniae J138
aagaaacuucc

SEQ ID NO: 541084 - RNA, 17 nt, Chlamydophila pneumoniae J138
aagaaagugaaaccauu

SEQ ID NO: 541085 - RNA, 13 nt, Chlamydophila pneumoniae J138
aagaaaucaaaca

SEQ ID NO: 541086 - RNA, 15 nt, Chlamydophila pneumoniae J138
aagaaaucaaacauu

SEQ ID NO: 541087 - RNA, 20 nt, Chlamydophila pneumoniae J138
aagaaaucuacucuuuaaaa

SEQ ID NO: 541088 - RNA, 22 nt, Chlamydophila pneumoniae J138
aagaaauauuaacccaccagaa

SEQ ID NO: 541089 - RNA, 21 nt, Chlamydophila pneumoniae J138
aagaaaugcaaaccaaaaaag

SEQ ID NO: 541090 - RNA, 15 nt, Chlamydophila pneumoniae J138
aagaaaucucaguga

SEQ ID NO: 541091 - RNA, 13 nt, Chlamydophila pneumoniae J138
aagaaauuaacaa

SEQ ID NO: 541092 - RNA, 19 nt, Chlamydophila pneumoniae J138
aauccaaaaacuucuaacu

SEQ ID NO: 541093 - RNA, 23 nt, Chlamydophila pneumoniae J138
aaucauuggaaccauaggauagg

SEQ ID NO: 541094 - RNA, 17 nt, Chlamydophila pneumoniae J138
aauccaacaaagaugac

SEQ ID NO: 541095 - RNA, 16 nt, Chlamydophila pneumoniae J138
aauccaacaaagauga

SEQ ID NO: 541096 - RNA, 14 nt, Chlamydophila pneumoniae J138
aauccacgcuccuc

SEQ ID NO: 541097 - RNA, 18 nt, Chlamydophila pneumoniae J138
aauccagcaacaaccaaa

SEQ ID NO: 541098 - RNA, 23 nt, Chlamydophila pneumoniae J138
aauccagauuguucaaaaauaga

SEQ ID NO: 541099 - RNA, 20 nt, Chlamydophila pneumoniae J138
aauccauaguccuagcagag

SEQ ID NO: 541100 - RNA, 22 nt, Chlamydophila pneumoniae J138
aauccauucugagaaagaaguc

SEQ ID NO: 541101 - RNA, 21 nt, Chlamydophila pneumoniae J138
aauccauucugagaaagaagu

SEQ ID NO: 541102 - RNA, 21 nt, Chlamydophila pneumoniae J138
aaucauagagauaucaucaaa

SEQ ID NO: 541103 - RNA, 23 nt, Chlamydophila pneumoniae J138
aaucaugauaaaaauuuucagga

SEQ ID NO: 541104 - RNA, 12 nt, Chlamydophila pneumoniae J138
aaucauaucugc

SEQ ID NO: 541105 - RNA, 13 nt, Chlamydophila pneumoniae J138
aaucauaucugcg

SEQ ID NO: 541106 - RNA, 19 nt, Chlamydophila pneumoniae J138
aaucauuagaguuugguuu

SEQ ID NO: 541107 - RNA, 15 nt, Chlamydophila pneumoniae J138
aauccccaauguuuu

SEQ ID NO: 541108 - RNA, 22 nt, Chlamydophila pneumoniae J138
aaucccacuaucuguaauuccc

SEQ ID NO: 541109 - RNA, 18 nt, Chlamydophila pneumoniae J138
aaucccgugcuaggaaga

SEQ ID NO: 541110 - RNA, 22 nt, Chlamydophila pneumoniae J138
aaucccuguucuagcaaaucua

SEQ ID NO: 541111 - RNA, 22 nt, Chlamydophila pneumoniae J138
aaucccugaugcaguaauucca

SEQ ID NO: 541112 - RNA, 17 nt, Chlamydophila pneumoniae J138
aauccugaguaaaauca

SEQ ID NO: 541113 - RNA, 18 nt, Chlamydophila pneumoniae J138
aauccugaguaaaaucau

SEQ ID NO: 541114 - RNA, 21 nt, Chlamydophila pneumoniae J138
aauccuguagggaaagacuca

SEQ ID NO: 541115 - RNA, 20 nt, Chlamydophila pneumoniae J138
aauccuguagggaaagacuc

SEQ ID NO: 541116 - RNA, 23 nt, Chlamydophila pneumoniae J138
aauccugcucguaaaucuggaau

SEQ ID NO: 541117 - RNA, 12 nt, Chlamydophila pneumoniae J138
aauccuaaaaag

SEQ ID NO: 541118 - RNA, 16 nt, Chlamydophila pneumoniae J138
aauccggcauaaaaaa

SEQ ID NO: 541119 - RNA, 13 nt, Chlamydophila pneumoniae J138
aauccuuccuuac

SEQ ID NO: 541120 - RNA, 19 nt, Chlamydophila pneumoniae J138
aauccuucuuucugcucuu

SEQ ID NO: 541121 - RNA, 21 nt, Chlamydophila pneumoniae J138
aaucgcuguuuuagcauagca

SEQ ID NO: 541122 - RNA, 14 nt, Chlamydophila pneumoniae J138
aaugauuucucuaa

SEQ ID NO: 541123 - RNA, 13 nt, Chlamydophila pneumoniae J138
aaugauuucucua

SEQ ID NO: 541124 - RNA, 15 nt, Chlamydophila pneumoniae J138
aaugagcucuauuuc

SEQ ID NO: 541125 - RNA, 13 nt, Chlamydophila pneumoniae J138
aaugagacagaca

SEQ ID NO: 541126 - RNA, 13 nt, Chlamydophila pneumoniae J138
aaugaaucgaaga

SEQ ID NO: 541127 - RNA, 21 nt, Chlamydophila pneumoniae J138
aaugaccgcaaggagucacug

SEQ ID NO: 541128 - RNA, 16 nt, Chlamydophila pneumoniae J138
aaugaaacgaaagcag

SEQ ID NO: 541129 - RNA, 23 nt, Chlamydophila pneumoniae J138
aaucuuacauaaaccuuugguuu

SEQ ID NO: 541130 - RNA, 14 nt, Chlamydophila pneumoniae J138
aaucuuuucuugua

SEQ ID NO: 541131 - RNA, 18 nt, Chlamydophila pneumoniae J138
aaucuuuuagaguacaca

SEQ ID NO: 541132 - RNA, 16 nt, Chlamydophila pneumoniae J138
aaucuauaggauuugc

SEQ ID NO: 541133 - RNA, 14 nt, Chlamydophila pneumoniae J138
aaucuauaaauuca

SEQ ID NO: 541134 - RNA, 13 nt, Chlamydophila pneumoniae J138
aaucuaugaauac

SEQ ID NO: 541135 - RNA, 14 nt, Chlamydophila pneumoniae J138
aaucuggggcuucc

SEQ ID NO: 541136 - RNA, 18 nt, Chlamydophila pneumoniae J138
aaucuggggcuuccagaa

SEQ ID NO: 541137 - RNA, 21 nt, Chlamydophila pneumoniae J138
aaucuguauccgacucuguuu

SEQ ID NO: 541138 - RNA, 19 nt, Chlamydophila pneumoniae J138
aaucugugaguacccaguc

SEQ ID NO: 541139 - RNA, 23 nt, Chlamydophila pneumoniae J138
aaucugugaguacccagucaucg

SEQ ID NO: 541140 - RNA, 21 nt, Chlamydophila pneumoniae J138
aaugccuguacuaucuuuuuu

SEQ ID NO: 541141 - RNA, 22 nt, Chlamydophila pneumoniae J138
aaugcgaugcggucagaaacau

SEQ ID NO: 541142 - RNA, 17 nt, Chlamydophila pneumoniae J138
aaugccuuaaauguauu

SEQ ID NO: 541143 - RNA, 16 nt, Chlamydophila pneumoniae J138
aaugccaauaugguag

SEQ ID NO: 541144 - RNA, 14 nt, Chlamydophila pneumoniae J138
aaugccaagggcuu

SEQ ID NO: 541145 - RNA, 20 nt, Chlamydophila pneumoniae J138
aaugcaguucuuguuaaagu

SEQ ID NO: 541146 - RNA, 23 nt, Chlamydophila pneumoniae J138
aaugcggaccuuaagaugaggua

SEQ ID NO: 541147 - RNA, 20 nt, Chlamydophila pneumoniae J138
aauggaaacauagaaucauu

SEQ ID NO: 541148 - RNA, 15 nt, Chlamydophila pneumoniae J138
aauggcgauaaaugc

SEQ ID NO: 541149 - RNA, 13 nt, Chlamydophila pneumoniae J138
aauugguggagcu

SEQ ID NO: 541150 - RNA, 19 nt, Chlamydophila pneumoniae J138
aauugguggagcucauuua

SEQ ID NO: 541151 - RNA, 17 nt, Chlamydophila pneumoniae J138
aauuguguguuuucaua

SEQ ID NO: 541152 - RNA, 15 nt, Chlamydophila pneumoniae J138
aauugucuucagugc

SEQ ID NO: 541153 - RNA, 16 nt, Chlamydophila pneumoniae J138
aauuguuggaauugca

SEQ ID NO: 541154 - RNA, 16 nt, Chlamydophila pneumoniae J138
aauuguucuugaaguu

SEQ ID NO: 541155 - RNA, 13 nt, Chlamydophila pneumoniae J138
aauuuaaaugccu

SEQ ID NO: 541156 - RNA, 14 nt, Chlamydophila pneumoniae J138
aauuuaaaucugca

SEQ ID NO: 541157 - RNA, 18 nt, Chlamydophila pneumoniae J138
aauuuagaggagacucua

SEQ ID NO: 541158 - RNA, 20 nt, Chlamydophila pneumoniae J138
aauuuaucggcuaaagaaaa

SEQ ID NO: 541159 - RNA, 22 nt, Chlamydophila pneumoniae J138
aauugcuugcgcaucagcagcu

SEQ ID NO: 541160 - RNA, 18 nt, Chlamydophila pneumoniae J138
aauugcauuaagauaaac

SEQ ID NO: 541161 - RNA, 22 nt, Chlamydophila pneumoniae J138
aauugcauuaagauaaacauua

SEQ ID NO: 541162 - RNA, 13 nt, Chlamydophila pneumoniae J138
aauugcauucuua

SEQ ID NO: 541163 - RNA, 22 nt, Chlamydophila pneumoniae J138
aauucuuuaugagagagcucuu

SEQ ID NO: 541164 - RNA, 21 nt, Chlamydophila pneumoniae J138
aauucuucuacagaauaggaa

SEQ ID NO: 541165 - RNA, 22 nt, Chlamydophila pneumoniae J138
aauucuucuacagaauaggaac

SEQ ID NO: 541166 - RNA, 23 nt, Chlamydophila pneumoniae J138
aauugaacguagcuacaaaauua

SEQ ID NO: 541167 - RNA, 14 nt, Chlamydophila pneumoniae J138
aauugacuggaggc

SEQ ID NO: 541168 - RNA, 22 nt, Chlamydophila pneumoniae J138
aauugagaaauauaacucucua

SEQ ID NO: 541169 - RNA, 14 nt, Chlamydophila pneumoniae J138
aauucaaaaagaga

SEQ ID NO: 541170 - RNA, 16 nt, Chlamydophila pneumoniae J138
aauucaaacuccuuuu

SEQ ID NO: 541171 - RNA, 21 nt, Chlamydophila pneumoniae J138
aauuacgcucuccauggcuuc

SEQ ID NO: 541172 - RNA, 16 nt, Chlamydophila pneumoniae J138
aauguagucaugauuu

SEQ ID NO: 541173 - RNA, 22 nt, Chlamydophila pneumoniae J138
aauguagcuguuccaagagucu

SEQ ID NO: 541174 - RNA, 16 nt, Chlamydophila pneumoniae J138
aauguaagaaggcaga

SEQ ID NO: 541175 - RNA, 15 nt, Chlamydophila pneumoniae J138
aauuaacagagcgcc

SEQ ID NO: 541176 - RNA, 15 nt, Chlamydophila pneumoniae J138
aauuccgaagaagaa

SEQ ID NO: 541177 - RNA, 15 nt, Chlamydophila pneumoniae J138
aauuccaucuggaau

SEQ ID NO: 541178 - RNA, 23 nt, Chlamydophila pneumoniae J138
aauucaugcaaaacaacaucacu

SEQ ID NO: 541179 - RNA, 18 nt, Chlamydophila pneumoniae J138
aauuccaaaauaaaagga

SEQ ID NO: 541180 - RNA, 15 nt, Chlamydophila pneumoniae J138
aauucauauuuacga

SEQ ID NO: 541181 - RNA, 12 nt, Chlamydophila pneumoniae J138
aauucauauuua

SEQ ID NO: 541182 - RNA, 19 nt, Chlamydophila pneumoniae J138
aauucucugacacuccuca

SEQ ID NO: 541183 - RNA, 15 nt, Chlamydophila pneumoniae J138
aauucucucucugca

SEQ ID NO: 541184 - RNA, 16 nt, Chlamydophila pneumoniae J138
aauucucagaaagccu

SEQ ID NO: 541185 - RNA, 16 nt, Chlamydophila pneumoniae J138
aauucucagauugcuu

SEQ ID NO: 541186 - RNA, 17 nt, Chlamydophila pneumoniae J138
aauucuagaccugccaa

SEQ ID NO: 541187 - RNA, 19 nt, Chlamydophila pneumoniae J138
aauucggcagaaggcuugu

SEQ ID NO: 541188 - RNA, 15 nt, Chlamydophila pneumoniae J138
aauucggcagaaggc

SEQ ID NO: 541189 - RNA, 20 nt, Chlamydophila pneumoniae J138
aauuccuaaaacaagaagau

SEQ ID NO: 541190 - RNA, 16 nt, Chlamydophila pneumoniae J138
aauuccuucucagaaa

SEQ ID NO: 541191 - RNA, 17 nt, Chlamydophila pneumoniae J138
aauuccuucucagaaag

SEQ ID NO: 541192 - RNA, 16 nt, Chlamydophila pneumoniae J138
aauucgaauucucaga

SEQ ID NO: 541193 - RNA, 14 nt, Chlamydophila pneumoniae J138
aauaauuacuugga

SEQ ID NO: 541194 - RNA, 14 nt, Chlamydophila pneumoniae J138
aauaauuaaaucgu

SEQ ID NO: 541195 - RNA, 14 nt, Chlamydophila pneumoniae J138
aauaauguuuuaau

SEQ ID NO: 541196 - RNA, 20 nt, Chlamydophila pneumoniae J138
aauaauguuuuaauagcuaa

SEQ ID NO: 541197 - RNA, 20 nt, Chlamydophila pneumoniae J138
aauaaggcugcuaucaacau

SEQ ID NO: 541198 - RNA, 18 nt, Chlamydophila pneumoniae J138
aauaagcuugccagcaga

SEQ ID NO: 541199 - RNA, 19 nt, Chlamydophila pneumoniae J138
aauaagcuugccagcagaa

SEQ ID NO: 541200 - RNA, 20 nt, Chlamydophila pneumoniae J138
aauaagcuugccagcagaag

SEQ ID NO: 541201 - RNA, 18 nt, Chlamydophila pneumoniae J138
aauaagccaguacuaaau

SEQ ID NO: 541202 - RNA, 19 nt, Chlamydophila pneumoniae J138
aauaagauuuuaagaccuu

SEQ ID NO: 541203 - RNA, 15 nt, Chlamydophila pneumoniae J138
aauaauaggauaaga

SEQ ID NO: 541204 - RNA, 19 nt, Chlamydophila pneumoniae J138
aauaauaggauaagaaauu

SEQ ID NO: 541205 - RNA, 16 nt, Chlamydophila pneumoniae J138
aauaauacuuaauccu

SEQ ID NO: 541206 - RNA, 15 nt, Chlamydophila pneumoniae J138
aauaaucaaccaaaa

SEQ ID NO: 541207 - RNA, 20 nt, Chlamydophila pneumoniae J138
aaguugaguugcguacgaua

SEQ ID NO: 541208 - RNA, 13 nt, Chlamydophila pneumoniae J138
aaguugagagaga

SEQ ID NO: 541209 - RNA, 15 nt, Chlamydophila pneumoniae J138
aaguugaccuuuuuc

SEQ ID NO: 541210 - RNA, 13 nt, Chlamydophila pneumoniae J138
aaguucaguaaaa

SEQ ID NO: 541211 - RNA, 14 nt, Chlamydophila pneumoniae J138
aaguucauaaccug

SEQ ID NO: 541212 - RNA, 17 nt, Chlamydophila pneumoniae J138
aaguucagcaaggaagu

SEQ ID NO: 541213 - RNA, 18 nt, Chlamydophila pneumoniae J138
aaguuccauagaguaucu

SEQ ID NO: 541214 - RNA, 16 nt, Chlamydophila pneumoniae J138
aaguugccuaaagaga

SEQ ID NO: 541215 - RNA, 18 nt, Chlamydophila pneumoniae J138
aauaacaccaaaagaaua

SEQ ID NO: 541216 - RNA, 13 nt, Chlamydophila pneumoniae J138
aauaaauuuaucu

SEQ ID NO: 541217 - RNA, 22 nt, Chlamydophila pneumoniae J138
aauaaccgaaacuucucagaua

SEQ ID NO: 541218 - RNA, 13 nt, Chlamydophila pneumoniae J138
aauaaccagaaga

SEQ ID NO: 541219 - RNA, 15 nt, Chlamydophila pneumoniae J138
aauaagauuuugaaa

SEQ ID NO: 541220 - RNA, 14 nt, Chlamydophila pneumoniae J138
aauaagauuuugaa

SEQ ID NO: 541221 - RNA, 15 nt, Chlamydophila pneumoniae J138
aauaagauccaaaaa

SEQ ID NO: 541222 - RNA, 21 nt, Chlamydophila pneumoniae J138
aauaacuauaauauaacugca

SEQ ID NO: 541223 - RNA, 20 nt, Chlamydophila pneumoniae J138
aauacaaaaaauaaaaucaa

SEQ ID NO: 541224 - RNA, 14 nt, Chlamydophila pneumoniae J138
aauacaaaaaauaa

SEQ ID NO: 541225 - RNA, 18 nt, Chlamydophila pneumoniae J138
aauacaaaaaauaaaauc

SEQ ID NO: 541226 - RNA, 17 nt, Chlamydophila pneumoniae J138
aauaccguuuuaggaag

SEQ ID NO: 541227 - RNA, 21 nt, Chlamydophila pneumoniae J138
aauaccucaaagccaucuucu

SEQ ID NO: 541228 - RNA, 18 nt, Chlamydophila pneumoniae J138
aauaccucagaaauuccu

SEQ ID NO: 541229 - RNA, 19 nt, Chlamydophila pneumoniae J138
aauacgcuuuucuucuuua

SEQ ID NO: 541230 - RNA, 16 nt, Chlamydophila pneumoniae J138
aauacggacauaccua

SEQ ID NO: 541231 - RNA, 21 nt, Chlamydophila pneumoniae J138
aauagauuuuuacuugcccaa

SEQ ID NO: 541232 - RNA, 17 nt, Chlamydophila pneumoniae J138
aauagcaaagauuucug

SEQ ID NO: 541233 - RNA, 15 nt, Chlamydophila pneumoniae J138
aauagcaaguagcuc

SEQ ID NO: 541234 - RNA, 20 nt, Chlamydophila pneumoniae J138
aauagcaagcgcuagugcaa

SEQ ID NO: 541235 - RNA, 13 nt, Chlamydophila pneumoniae J138
aauagauucguua

SEQ ID NO: 541236 - RNA, 21 nt, Chlamydophila pneumoniae J138
aauagauccugaaaguacaga

SEQ ID NO: 541237 - RNA, 14 nt, Chlamydophila pneumoniae J138
aauagcaauggcuu

SEQ ID NO: 541238 - RNA, 20 nt, Chlamydophila pneumoniae J138
aauagccauaauuagaacag

SEQ ID NO: 541239 - RNA, 21 nt, Chlamydophila pneumoniae J138
aauagccaaagacucuugaau

SEQ ID NO: 541240 - RNA, 18 nt, Chlamydophila pneumoniae J138
aauacuguucgauaagaa

SEQ ID NO: 541241 - RNA, 15 nt, Chlamydophila pneumoniae J138
aauacugcgcaggga

SEQ ID NO: 541242 - RNA, 21 nt, Chlamydophila pneumoniae J138
aauacucuagguuuucucuuc

SEQ ID NO: 541243 - RNA, 15 nt, Chlamydophila pneumoniae J138
aauagagucucuuga

SEQ ID NO: 541244 - RNA, 22 nt, Chlamydophila pneumoniae J138
aauaugguaguuugccuucuua

SEQ ID NO: 541245 - RNA, 23 nt, Chlamydophila pneumoniae J138
aauauggacagcguauaggaaac

SEQ ID NO: 541246 - RNA, 15 nt, Chlamydophila pneumoniae J138
aauaugcucugccau

SEQ ID NO: 541247 - RNA, 14 nt, Chlamydophila pneumoniae J138
aauaugcucuccuu

SEQ ID NO: 541248 - RNA, 14 nt, Chlamydophila pneumoniae J138
aauaucucuggcau

SEQ ID NO: 541249 - RNA, 21 nt, Chlamydophila pneumoniae J138
aauaucucuggcauaauccug

SEQ ID NO: 541250 - RNA, 22 nt, Chlamydophila pneumoniae J138
aauaucuccguuaccaaaaacu

SEQ ID NO: 541251 - RNA, 20 nt, Chlamydophila pneumoniae J138
aauaucaggacaaugaagaa

SEQ ID NO: 541252 - RNA, 19 nt, Chlamydophila pneumoniae J138
aauauagguuaagccaauc

SEQ ID NO: 541253 - RNA, 12 nt, Chlamydophila pneumoniae J138
aauaucaucacu

SEQ ID NO: 541254 - RNA, 17 nt, Chlamydophila pneumoniae J138
aauauagagaucuagau

SEQ ID NO: 541255 - RNA, 16 nt, Chlamydophila pneumoniae J138
aauauacucuugcuug

SEQ ID NO: 541256 - RNA, 17 nt, Chlamydophila pneumoniae J138
aauauacagauguuuuc

SEQ ID NO: 541257 - RNA, 23 nt, Chlamydophila pneumoniae J138
aauauacagauguuuucguaaau

SEQ ID NO: 541258 - RNA, 20 nt, Chlamydophila pneumoniae J138
aauagucucuguaagaacgu

SEQ ID NO: 541259 - RNA, 14 nt, Chlamydophila pneumoniae J138
aauaggucucuugc

SEQ ID NO: 541260 - RNA, 22 nt, Chlamydophila pneumoniae J138
aauaggcauuacacaacucuuu

SEQ ID NO: 541261 - RNA, 20 nt, Chlamydophila pneumoniae J138
aauagcgacaugagaaaucu

SEQ ID NO: 541262 - RNA, 19 nt, Chlamydophila pneumoniae J138
aauagcgacaugagaaauc

SEQ ID NO: 541263 - RNA, 22 nt, Chlamydophila pneumoniae J138
aaguuauacggccgacucuaca

SEQ ID NO: 541264 - RNA, 20 nt, Chlamydophila pneumoniae J138
aaguuagcuaacucggaaaa

SEQ ID NO: 541265 - RNA, 18 nt, Chlamydophila pneumoniae J138
aaguguguaaauguuuug

SEQ ID NO: 541266 - RNA, 20 nt, Chlamydophila pneumoniae J138
aagugacuuccuccaaaauu

SEQ ID NO: 541267 - RNA, 17 nt, Chlamydophila pneumoniae J138
aagugaucuugagaaaa

SEQ ID NO: 541268 - RNA, 16 nt, Chlamydophila pneumoniae J138
aagugacuuccuccaa

SEQ ID NO: 541269 - RNA, 19 nt, Chlamydophila pneumoniae J138
aagugaggagaauagcaag

SEQ ID NO: 541270 - RNA, 18 nt, Chlamydophila pneumoniae J138
aagugauaaggaagaauu

SEQ ID NO: 541271 - RNA, 17 nt, Chlamydophila pneumoniae J138
aagucgaaucuaaaaac

SEQ ID NO: 541272 - RNA, 19 nt, Chlamydophila pneumoniae J138
aagucgauacccaaagagg

SEQ ID NO: 541273 - RNA, 14 nt, Chlamydophila pneumoniae J138
aaguagcucucucc

SEQ ID NO: 541274 - RNA, 18 nt, Chlamydophila pneumoniae J138
aaguaggauugauaaauu

SEQ ID NO: 541275 - RNA, 12 nt, Chlamydophila pneumoniae J138
aaggaucugaua

SEQ ID NO: 541276 - RNA, 18 nt, Chlamydophila pneumoniae J138
aaggaucugauagaacag

SEQ ID NO: 541277 - RNA, 23 nt, Chlamydophila pneumoniae J138
aaggaucccaucaucgagcugau

SEQ ID NO: 541278 - RNA, 14 nt, Chlamydophila pneumoniae J138
aaggagagcuucuu

SEQ ID NO: 541279 - RNA, 15 nt, Chlamydophila pneumoniae J138
aaggaucauuaaagu

SEQ ID NO: 541280 - RNA, 14 nt, Chlamydophila pneumoniae J138
aagggaagagaaaa

SEQ ID NO: 541281 - RNA, 20 nt, Chlamydophila pneumoniae J138
aagggggaucuucagagaga

SEQ ID NO: 541282 - RNA, 23 nt, Chlamydophila pneumoniae J138
aagggaugggaucggucuuuucu

SEQ ID NO: 541283 - RNA, 17 nt, Chlamydophila pneumoniae J138
aagggaugcucuagaaa

SEQ ID NO: 541284 - RNA, 20 nt, Chlamydophila pneumoniae J138
aagggaugcucuagaaaacg

SEQ ID NO: 541285 - RNA, 22 nt, Chlamydophila pneumoniae J138
aagggauguuuaauacaaaaaa

SEQ ID NO: 541286 - RNA, 13 nt, Chlamydophila pneumoniae J138
aagggaggagaac

SEQ ID NO: 541287 - RNA, 18 nt, Chlamydophila pneumoniae J138
aagggacuuguuguuuca

SEQ ID NO: 541288 - RNA, 19 nt, Chlamydophila pneumoniae J138
aagguauuucucuccacag

SEQ ID NO: 541289 - RNA, 15 nt, Chlamydophila pneumoniae J138
aaguaaagaaauucu

SEQ ID NO: 541290 - RNA, 18 nt, Chlamydophila pneumoniae J138
aaguaaucaugauaaaaa

SEQ ID NO: 541291 - RNA, 13 nt, Chlamydophila pneumoniae J138
aaguacuacaaua

SEQ ID NO: 541292 - RNA, 18 nt, Chlamydophila pneumoniae J138
aaguacuaauuacagaau

SEQ ID NO: 541293 - RNA, 20 nt, Chlamydophila pneumoniae J138
aaguaccuucucgucauucu

SEQ ID NO: 541294 - RNA, 22 nt, Chlamydophila pneumoniae J138
aaguacgaccaacuccucaaaa

SEQ ID NO: 541295 - RNA, 22 nt, Chlamydophila pneumoniae J138
aaguacgcaguaucguaacuuc

SEQ ID NO: 541296 - RNA, 16 nt, Chlamydophila pneumoniae J138
aaguagaauccuucuc

SEQ ID NO: 541297 - RNA, 14 nt, Chlamydophila pneumoniae J138
aaguacacauuguc

SEQ ID NO: 541298 - RNA, 15 nt, Chlamydophila pneumoniae J138
aaguacacauugucu

SEQ ID NO: 541299 - RNA, 22 nt, Chlamydophila pneumoniae J138
aaguacagaaaggaccuccuca

SEQ ID NO: 541300 - RNA, 23 nt, Chlamydophila pneumoniae J138
aaguaaugugcgcacaagggauu

SEQ ID NO: 541301 - RNA, 21 nt, Chlamydophila pneumoniae J138
aaguacaagugaagacaagua

SEQ ID NO: 541302 - RNA, 23 nt, Chlamydophila pneumoniae J138
aagccauuuucuaagagaucuac

SEQ ID NO: 541303 - RNA, 20 nt, Chlamydophila pneumoniae J138
aagccaugcaaugaaggcgu

SEQ ID NO: 541304 - RNA, 17 nt, Chlamydophila pneumoniae J138
aagccauuuucuaagag

SEQ ID NO: 541305 - RNA, 14 nt, Chlamydophila pneumoniae J138
aagccauuuucuaa

SEQ ID NO: 541306 - RNA, 18 nt, Chlamydophila pneumoniae J138
aagccagucuucauaaga

SEQ ID NO: 541307 - RNA, 15 nt, Chlamydophila pneumoniae J138
aagccaguacuaaau

SEQ ID NO: 541308 - RNA, 14 nt, Chlamydophila pneumoniae J138
aagaaguaggaaau

SEQ ID NO: 541309 - RNA, 20 nt, Chlamydophila pneumoniae J138
aagccgauacccaucuagaa

SEQ ID NO: 541310 - RNA, 16 nt, Chlamydophila pneumoniae J138
aagccgauacccaucu

SEQ ID NO: 541311 - RNA, 19 nt, Chlamydophila pneumoniae J138
aagcccuaauucauauuua

SEQ ID NO: 541312 - RNA, 15 nt, Chlamydophila pneumoniae J138
aagcccccuccccca

SEQ ID NO: 541313 - RNA, 18 nt, Chlamydophila pneumoniae J138
aagccggcccacucaaaa

SEQ ID NO: 541314 - RNA, 22 nt, Chlamydophila pneumoniae J138
aagccuaaaucuauacccaguu

SEQ ID NO: 541315 - RNA, 22 nt, Chlamydophila pneumoniae J138
aagccguguaccucucaucaaa

SEQ ID NO: 541316 - RNA, 23 nt, Chlamydophila pneumoniae J138
aagccuccucaagauaaauccca

SEQ ID NO: 541317 - RNA, 17 nt, Chlamydophila pneumoniae J138
aagccugcggcaaguau

SEQ ID NO: 541318 - RNA, 14 nt, Chlamydophila pneumoniae J138
aagccuuucuuauu

SEQ ID NO: 541319 - RNA, 19 nt, Chlamydophila pneumoniae J138
aagccuuugcucacuguuu

SEQ ID NO: 541320 - RNA, 18 nt, Chlamydophila pneumoniae J138
aagccuuccuuguuguau

SEQ ID NO: 541321 - RNA, 13 nt, Chlamydophila pneumoniae J138
aagccuuccuugu

SEQ ID NO: 541322 - RNA, 13 nt, Chlamydophila pneumoniae J138
aagccuucauucc

SEQ ID NO: 541323 - RNA, 23 nt, Chlamydophila pneumoniae J138
aagccugucuuaucuaaagaaau

SEQ ID NO: 541324 - RNA, 15 nt, Chlamydophila pneumoniae J138
aagcgcgcuaaaaaa

SEQ ID NO: 541325 - RNA, 17 nt, Chlamydophila pneumoniae J138
aagcguagcaaaguuaa

SEQ ID NO: 541326 - RNA, 19 nt, Chlamydophila pneumoniae J138
aagcguuucgacgagaagg

SEQ ID NO: 541327 - RNA, 16 nt, Chlamydophila pneumoniae J138
aagcucuuucauaaga

SEQ ID NO: 541328 - RNA, 12 nt, Chlamydophila pneumoniae J138
aagcucaucagc

SEQ ID NO: 541329 - RNA, 16 nt, Chlamydophila pneumoniae J138
aaggacaaucaacauu

SEQ ID NO: 541330 - RNA, 18 nt, Chlamydophila pneumoniae J138
aaggaagaagaagaagga

SEQ ID NO: 541331 - RNA, 14 nt, Chlamydophila pneumoniae J138
aaggaacugugcca

SEQ ID NO: 541332 - RNA, 13 nt, Chlamydophila pneumoniae J138
aaggacauagacu

SEQ ID NO: 541333 - RNA, 13 nt, Chlamydophila pneumoniae J138
aaggacucuuucu

SEQ ID NO: 541334 - RNA, 23 nt, Chlamydophila pneumoniae J138
aaggaccuguuuucuuuucugaa

SEQ ID NO: 541335 - RNA, 15 nt, Chlamydophila pneumoniae J138
aagcuugagaaaagg

SEQ ID NO: 541336 - RNA, 14 nt, Chlamydophila pneumoniae J138
aagcuucuucugcg

SEQ ID NO: 541337 - RNA, 13 nt, Chlamydophila pneumoniae J138
aagcuucuuucuc

SEQ ID NO: 541338 - RNA, 21 nt, Chlamydophila pneumoniae J138
aagcuucguccugacacaacu

SEQ ID NO: 541339 - RNA, 14 nt, Chlamydophila pneumoniae J138
aaggaaaucacaga

SEQ ID NO: 541340 - RNA, 19 nt, Chlamydophila pneumoniae J138
aagcuggauucugucuaua

SEQ ID NO: 541341 - RNA, 18 nt, Chlamydophila pneumoniae J138
aagcuucaucaaaacaua

SEQ ID NO: 541342 - RNA, 17 nt, Chlamydophila pneumoniae J138
aagcuuccaucguuaga

SEQ ID NO: 541343 - RNA, 19 nt, Chlamydophila pneumoniae J138
aagcuuaucccauaaaugu

SEQ ID NO: 541344 - RNA, 18 nt, Chlamydophila pneumoniae J138
aagcuggauucugucuau

SEQ ID NO: 541345 - RNA, 16 nt, Chlamydophila pneumoniae J138
aagcugcuuuuucuac

SEQ ID NO: 541346 - RNA, 18 nt, Chlamydophila pneumoniae J138
aagcugcuucuucagagu

SEQ ID NO: 541347 - RNA, 22 nt, Chlamydophila pneumoniae J138
aagcugagaauacaacccuuua

SEQ ID NO: 541348 - RNA, 20 nt, Chlamydophila pneumoniae J138
aagcugacaaauagaaagga

SEQ ID NO: 541349 - RNA, 19 nt, Chlamydophila pneumoniae J138
uugagccaacagguucacu

SEQ ID NO: 541350 - RNA, 17 nt, Chlamydophila pneumoniae J138
uucuuguugcaauagca

SEQ ID NO: 541351 - RNA, 21 nt, Chlamydophila pneumoniae J138
uucuucuuuccauagaucccu

SEQ ID NO: 541352 - RNA, 22 nt, Chlamydophila pneumoniae J138
uucuuggagaagagguaauaau

SEQ ID NO: 541353 - RNA, 14 nt, Chlamydophila pneumoniae J138
uugauaauagucuu

SEQ ID NO: 541354 - RNA, 18 nt, Chlamydophila pneumoniae J138
uugaggaacgcacgccaa

SEQ ID NO: 541355 - RNA, 11 nt, Chlamydophila pneumoniae J138
uugaggaaagg

SEQ ID NO: 541356 - RNA, 20 nt, Chlamydophila pneumoniae J138
uugaggauuucuugcaagga

SEQ ID NO: 541357 - RNA, 22 nt, Chlamydophila pneumoniae J138
uugaggauacgaauaaguuuug

SEQ ID NO: 541358 - RNA, 17 nt, Chlamydophila pneumoniae J138
uugaucuacaaaaacua

SEQ ID NO: 541359 - RNA, 21 nt, Chlamydophila pneumoniae J138
uugaucuacaaaaacuagaau

SEQ ID NO: 541360 - RNA, 15 nt, Chlamydophila pneumoniae J138
uugaucgcuugugca

SEQ ID NO: 541361 - RNA, 23 nt, Chlamydophila pneumoniae J138
uugaugugcggcgagcucuagga

SEQ ID NO: 541362 - RNA, 13 nt, Chlamydophila pneumoniae J138
uugauguuccuug

SEQ ID NO: 541363 - RNA, 12 nt, Chlamydophila pneumoniae J138
uugauuuuaaaa

SEQ ID NO: 541364 - RNA, 16 nt, Chlamydophila pneumoniae J138
uugauuuagaaucuuu

SEQ ID NO: 541365 - RNA, 19 nt, Chlamydophila pneumoniae J138
uugauuuccaacaccagga

SEQ ID NO: 541366 - RNA, 22 nt, Chlamydophila pneumoniae J138
uugcaugcuugaaguucucaaa

SEQ ID NO: 541367 - RNA, 13 nt, Chlamydophila pneumoniae J138
uugcaugaggaga

SEQ ID NO: 541368 - RNA, 13 nt, Chlamydophila pneumoniae J138
uugcaguggcuua

SEQ ID NO: 541369 - RNA, 18 nt, Chlamydophila pneumoniae J138
uugcauagcggcaacaag

SEQ ID NO: 541370 - RNA, 18 nt, Chlamydophila pneumoniae J138
uugcaucuuauggaagag

SEQ ID NO: 541371 - RNA, 16 nt, Chlamydophila pneumoniae J138
uugcagcucggaaugc

SEQ ID NO: 541372 - RNA, 15 nt, Chlamydophila pneumoniae J138
uugauuuuaaaauga

SEQ ID NO: 541373 - RNA, 19 nt, Chlamydophila pneumoniae J138
uugcacucgauuauuucuu

SEQ ID NO: 541374 - RNA, 22 nt, Chlamydophila pneumoniae J138
uugcagaguuggaucauucuuu

SEQ ID NO: 541375 - RNA, 18 nt, Chlamydophila pneumoniae J138
uugcagauugaaucccau

SEQ ID NO: 541376 - RNA, 17 nt, Chlamydophila pneumoniae J138
uugccguauagauuuuc

SEQ ID NO: 541377 - RNA, 14 nt, Chlamydophila pneumoniae J138
uugccuuuagagac

SEQ ID NO: 541378 - RNA, 22 nt, Chlamydophila pneumoniae J138
uugccuuuagggaaaaaguagu

SEQ ID NO: 541379 - RNA, 22 nt, Chlamydophila pneumoniae J138
uugccaggaaacguucuuucaa

SEQ ID NO: 541380 - RNA, 21 nt, Chlamydophila pneumoniae J138
uugcgcggcgcauuuuuuccu

SEQ ID NO: 541381 - RNA, 16 nt, Chlamydophila pneumoniae J138
uugcuugaaguuuguc

SEQ ID NO: 541382 - RNA, 20 nt, Chlamydophila pneumoniae J138
uugcuucuaagaaacuucca

SEQ ID NO: 541383 - RNA, 23 nt, Chlamydophila pneumoniae J138
uugcuuugugaguucuuccuucu

SEQ ID NO: 541384 - RNA, 19 nt, Chlamydophila pneumoniae J138
uugcuguggaauuuuccug

SEQ ID NO: 541385 - RNA, 23 nt, Chlamydophila pneumoniae J138
uugcuguggcauacucuuugcag

SEQ ID NO: 541386 - RNA, 20 nt, Chlamydophila pneumoniae J138
uugcuuauugucuuaaaauu

SEQ ID NO: 541387 - RNA, 12 nt, Chlamydophila pneumoniae J138
uugcuuccaacg

SEQ ID NO: 541388 - RNA, 23 nt, Chlamydophila pneumoniae J138
uugcuuccaacggacauuuucaa

SEQ ID NO: 541389 - RNA, 20 nt, Chlamydophila pneumoniae J138
uugcuaagcgaaccaaaguc

SEQ ID NO: 541390 - RNA, 15 nt, Chlamydophila pneumoniae J138
uugcuaagcauuuua

SEQ ID NO: 541391 - RNA, 22 nt, Chlamydophila pneumoniae J138
uugcuacagcuucuuuuccagc

SEQ ID NO: 541392 - RNA, 16 nt, Chlamydophila pneumoniae J138
uugcuauacagaaaag

SEQ ID NO: 541393 - RNA, 20 nt, Chlamydophila pneumoniae J138
uugcuauugaaaaaucccug

SEQ ID NO: 541394 - RNA, 14 nt, Chlamydophila pneumoniae J138
uugcuauacagaaa

SEQ ID NO: 541395 - RNA, 16 nt, Chlamydophila pneumoniae J138
uugcugcucuccaaag

SEQ ID NO: 541396 - RNA, 18 nt, Chlamydophila pneumoniae J138
uuggauuucuucuucuaa

SEQ ID NO: 541397 - RNA, 15 nt, Chlamydophila pneumoniae J138
uuggauaggauagga

SEQ ID NO: 541398 - RNA, 16 nt, Chlamydophila pneumoniae J138
uuggcaguucacugag

SEQ ID NO: 541399 - RNA, 18 nt, Chlamydophila pneumoniae J138
uuggacaacgcuucuuuu

SEQ ID NO: 541400 - RNA, 22 nt, Chlamydophila pneumoniae J138
uuggaggaacaauacucucugc

SEQ ID NO: 541401 - RNA, 23 nt, Chlamydophila pneumoniae J138
uuggacucuagggucaagaacag

SEQ ID NO: 541402 - RNA, 14 nt, Chlamydophila pneumoniae J138
uuggaaaaccauga

SEQ ID NO: 541403 - RNA, 17 nt, Chlamydophila pneumoniae J138
uuggaagauugaaggca

SEQ ID NO: 541404 - RNA, 14 nt, Chlamydophila pneumoniae J138
uuggaaaucagaau

SEQ ID NO: 541405 - RNA, 19 nt, Chlamydophila pneumoniae J138
uugggcaaauaggagagca

SEQ ID NO: 541406 - RNA, 17 nt, Chlamydophila pneumoniae J138
uugggauaggugcauca

SEQ ID NO: 541407 - RNA, 19 nt, Chlamydophila pneumoniae J138
uuggcuauggaaagagucc

SEQ ID NO: 541408 - RNA, 16 nt, Chlamydophila pneumoniae J138
uuggcucuagaaauau

SEQ ID NO: 541409 - RNA, 13 nt, Chlamydophila pneumoniae J138
uugguucaaaucc

SEQ ID NO: 541410 - RNA, 21 nt, Chlamydophila pneumoniae J138
uuuaaucgauacgguuuuuau

SEQ ID NO: 541411 - RNA, 20 nt, Chlamydophila pneumoniae J138
uuuaaucaagccuaaaucua

SEQ ID NO: 541412 - RNA, 14 nt, Chlamydophila pneumoniae J138
uuuaauacaaaaaa

SEQ ID NO: 541413 - RNA, 17 nt, Chlamydophila pneumoniae J138
uuuaagucacuaaagau

SEQ ID NO: 541414 - RNA, 20 nt, Chlamydophila pneumoniae J138
uuuaagguucucugaacuug

SEQ ID NO: 541415 - RNA, 11 nt, Chlamydophila pneumoniae J138
uuuaagaagaa

SEQ ID NO: 541416 - RNA, 14 nt, Chlamydophila pneumoniae J138
uuuaagauuuccuu

SEQ ID NO: 541417 - RNA, 20 nt, Chlamydophila pneumoniae J138
uuuacacugcuucaaaacau

SEQ ID NO: 541418 - RNA, 16 nt, Chlamydophila pneumoniae J138
uuuagaauuuguccuu

SEQ ID NO: 541419 - RNA, 14 nt, Chlamydophila pneumoniae J138
uuuagaauaagagc

SEQ ID NO: 541420 - RNA, 13 nt, Chlamydophila pneumoniae J138
uuuagaauaagag

SEQ ID NO: 541421 - RNA, 19 nt, Chlamydophila pneumoniae J138
uuuagaaauuccaauuuuu

SEQ ID NO: 541422 - RNA, 22 nt, Chlamydophila pneumoniae J138
uuuacuuuuaauccuuucacaa

SEQ ID NO: 541423 - RNA, 14 nt, Chlamydophila pneumoniae J138
uuuagaaaaagauc

SEQ ID NO: 541424 - RNA, 16 nt, Chlamydophila pneumoniae J138
uuuagaaaaagaucua

SEQ ID NO: 541425 - RNA, 18 nt, Chlamydophila pneumoniae J138
uuuauaacaucaagaauu

SEQ ID NO: 541426 - RNA, 15 nt, Chlamydophila pneumoniae J138
uuuagagagaaacau

SEQ ID NO: 541427 - RNA, 23 nt, Chlamydophila pneumoniae J138
uuuauauuuuuugagaaauauaa

SEQ ID NO: 541428 - RNA, 16 nt, Chlamydophila pneumoniae J138
uuuaucgacucuucca

SEQ ID NO: 541429 - RNA, 16 nt, Chlamydophila pneumoniae J138
uuuaucccagauaaag

SEQ ID NO: 541430 - RNA, 13 nt, Chlamydophila pneumoniae J138
uuuauccaccaag

SEQ ID NO: 541431 - RNA, 16 nt, Chlamydophila pneumoniae J138
uuuauuuaaaauuucu

SEQ ID NO: 541432 - RNA, 18 nt, Chlamydophila pneumoniae J138
uuuauuuaaauaaaacca

SEQ ID NO: 541433 - RNA, 12 nt, Chlamydophila pneumoniae J138
uuuauuaaaauc

SEQ ID NO: 541434 - RNA, 14 nt, Chlamydophila pneumoniae J138
uuuauguuuucucg

SEQ ID NO: 541435 - RNA, 14 nt, Chlamydophila pneumoniae J138
uuuaugauguauaa

SEQ ID NO: 541436 - RNA, 16 nt, Chlamydophila pneumoniae J138
uuuaucugcguuucuu

SEQ ID NO: 541437 - RNA, 19 nt, Chlamydophila pneumoniae J138
uuuaucugcgacaaaaaug

SEQ ID NO: 541438 - RNA, 22 nt, Chlamydophila pneumoniae J138
uugucugaggacaguauucccu

SEQ ID NO: 541439 - RNA, 20 nt, Chlamydophila pneumoniae J138
uugucugauuaguucucuaa

SEQ ID NO: 541440 - RNA, 22 nt, Chlamydophila pneumoniae J138
uugugaagauaagaccagaaag

SEQ ID NO: 541441 - RNA, 15 nt, Chlamydophila pneumoniae J138
uugucuuugauuuuc

SEQ ID NO: 541442 - RNA, 22 nt, Chlamydophila pneumoniae J138
uugugcaucuauaauuaauccu

SEQ ID NO: 541443 - RNA, 15 nt, Chlamydophila pneumoniae J138
uugugcgucaucaac

SEQ ID NO: 541444 - RNA, 23 nt, Chlamydophila pneumoniae J138
uuguggacaacgauuguaaaagu

SEQ ID NO: 541445 - RNA, 16 nt, Chlamydophila pneumoniae J138
uuuaaaaauagaaaua

SEQ ID NO: 541446 - RNA, 21 nt, Chlamydophila pneumoniae J138
uuuaaaaauaggagaagcccc

SEQ ID NO: 541447 - RNA, 12 nt, Chlamydophila pneumoniae J138
uuuaaaaauaua

SEQ ID NO: 541448 - RNA, 21 nt, Chlamydophila pneumoniae J138
uuguugaggaauuggcaggua

SEQ ID NO: 541449 - RNA, 22 nt, Chlamydophila pneumoniae J138
uuguguaagacugaaauugaau

SEQ ID NO: 541450 - RNA, 17 nt, Chlamydophila pneumoniae J138
uuguguucccucuucuu

SEQ ID NO: 541451 - RNA, 18 nt, Chlamydophila pneumoniae J138
uuguguucccucuucuuc

SEQ ID NO: 541452 - RNA, 16 nt, Chlamydophila pneumoniae J138
uuguucagcuagagca

SEQ ID NO: 541453 - RNA, 20 nt, Chlamydophila pneumoniae J138
uuguucagcuagagcacaua

SEQ ID NO: 541454 - RNA, 15 nt, Chlamydophila pneumoniae J138
uuguucagcuagagc

SEQ ID NO: 541455 - RNA, 22 nt, Chlamydophila pneumoniae J138
uuguguuuuuggcauaaagacc

SEQ ID NO: 541456 - RNA, 12 nt, Chlamydophila pneumoniae J138
uugucccuuuca

SEQ ID NO: 541457 - RNA, 20 nt, Chlamydophila pneumoniae J138
uuguauuccuuggauuucuu

SEQ ID NO: 541458 - RNA, 11 nt, Chlamydophila pneumoniae J138
uuguauuaaag

SEQ ID NO: 541459 - RNA, 16 nt, Chlamydophila pneumoniae J138
uuguacuuuuugccac

SEQ ID NO: 541460 - RNA, 21 nt, Chlamydophila pneumoniae J138
uuguagagacauagccuauau

SEQ ID NO: 541461 - RNA, 22 nt, Chlamydophila pneumoniae J138
uuguagagagaaucgagaacag

SEQ ID NO: 541462 - RNA, 13 nt, Chlamydophila pneumoniae J138
uuguaguucuuug

SEQ ID NO: 541463 - RNA, 15 nt, Chlamydophila pneumoniae J138
uuguauaagagcaag

SEQ ID NO: 541464 - RNA, 23 nt, Chlamydophila pneumoniae J138
uuguaguaaggagagacuguguu

SEQ ID NO: 541465 - RNA, 17 nt, Chlamydophila pneumoniae J138
uuguaguccacaucuug

SEQ ID NO: 541466 - RNA, 18 nt, Chlamydophila pneumoniae J138
uuguagcagcaagaacau

SEQ ID NO: 541467 - RNA, 22 nt, Chlamydophila pneumoniae J138
uuguaagcgugcaaguucacac

SEQ ID NO: 541468 - RNA, 19 nt, Chlamydophila pneumoniae J138
uuguaacgcugcuaauguu

SEQ ID NO: 541469 - RNA, 23 nt, Chlamydophila pneumoniae J138
uuguaacgcugcuaauguugucu

SEQ ID NO: 541470 - RNA, 17 nt, Chlamydophila pneumoniae J138
uuguaagaaucauaaca

SEQ ID NO: 541471 - RNA, 19 nt, Chlamydophila pneumoniae J138
uuguaagacuaaaaaagag

SEQ ID NO: 541472 - RNA, 20 nt, Chlamydophila pneumoniae J138
uuguaauuucuaaauagaaa

SEQ ID NO: 541473 - RNA, 14 nt, Chlamydophila pneumoniae J138
uuguaauaaaauca

SEQ ID NO: 541474 - RNA, 16 nt, Chlamydophila pneumoniae J138
uugguuuucuccuucu

SEQ ID NO: 541475 - RNA, 18 nt, Chlamydophila pneumoniae J138
uugguugcagucguauuc

SEQ ID NO: 541476 - RNA, 14 nt, Chlamydophila pneumoniae J138
uuccaauaauuuuc

SEQ ID NO: 541477 - RNA, 23 nt, Chlamydophila pneumoniae J138
uuccaauccauucugagaaagaa

SEQ ID NO: 541478 - RNA, 18 nt, Chlamydophila pneumoniae J138
uucccccgcguaauagca

SEQ ID NO: 541479 - RNA, 15 nt, Chlamydophila pneumoniae J138
uucccuaacaggaaa

SEQ ID NO: 541480 - RNA, 18 nt, Chlamydophila pneumoniae J138
uucccucaugaagaauua

SEQ ID NO: 541481 - RNA, 21 nt, Chlamydophila pneumoniae J138
uuccccuucagaggcuagaaa

SEQ ID NO: 541482 - RNA, 19 nt, Chlamydophila pneumoniae J138
uuccggggagaacuucaac

SEQ ID NO: 541483 - RNA, 15 nt, Chlamydophila pneumoniae J138
uucccugacacagag

SEQ ID NO: 541484 - RNA, 17 nt, Chlamydophila pneumoniae J138
uucccuggaugaacucc

SEQ ID NO: 541485 - RNA, 16 nt, Chlamydophila pneumoniae J138
uucccuccuuccuuaa

SEQ ID NO: 541486 - RNA, 17 nt, Chlamydophila pneumoniae J138
uucccugacacagagcu

SEQ ID NO: 541487 - RNA, 13 nt, Chlamydophila pneumoniae J138
uuccugaaucagc

SEQ ID NO: 541488 - RNA, 19 nt, Chlamydophila pneumoniae J138
uuccucuucaauuucuuca

SEQ ID NO: 541489 - RNA, 24 nt, Chlamydophila pneumoniae J138
uuccucuucaauuucuucaucaau

SEQ ID NO: 541490 - RNA, 22 nt, Chlamydophila pneumoniae J138
uuccuuacaagcuuccuugguc

SEQ ID NO: 541491 - RNA, 19 nt, Chlamydophila pneumoniae J138
uuccuuauccgucagccuu

SEQ ID NO: 541492 - RNA, 15 nt, Chlamydophila pneumoniae J138
uuccuaacuaucucu

SEQ ID NO: 541493 - RNA, 17 nt, Chlamydophila pneumoniae J138
uuccuaaccauugcucu

SEQ ID NO: 541494 - RNA, 16 nt, Chlamydophila pneumoniae J138
uuccuaaaacaagaag

SEQ ID NO: 541495 - RNA, 16 nt, Chlamydophila pneumoniae J138
uuccuucgaagcggag

SEQ ID NO: 541496 - RNA, 18 nt, Chlamydophila pneumoniae J138
uuccuucaaagcuuguuc

SEQ ID NO: 541497 - RNA, 23 nt, Chlamydophila pneumoniae J138
uuccuugacuaugguaagcauuu

SEQ ID NO: 541498 - RNA, 12 nt, Chlamydophila pneumoniae J138
uuccuucucaga

SEQ ID NO: 541499 - RNA, 20 nt, Chlamydophila pneumoniae J138
uucgaaucguuuuuggaaaa

SEQ ID NO: 541500 - RNA, 18 nt, Chlamydophila pneumoniae J138
uucgaagcgcucuacaaa

SEQ ID NO: 541501 - RNA, 15 nt, Chlamydophila pneumoniae J138
uucgaccuauuugca

SEQ ID NO: 541502 - RNA, 21 nt, Chlamydophila pneumoniae J138
uucgacgagaaggaagaagaa

SEQ ID NO: 541503 - RNA, 21 nt, Chlamydophila pneumoniae J138
uucgauguuaaggcuuccaau

SEQ ID NO: 541504 - RNA, 18 nt, Chlamydophila pneumoniae J138
uucgaugucuuuccaggc

SEQ ID NO: 541505 - RNA, 22 nt, Chlamydophila pneumoniae J138
uucgauaucucuaccgaacaga

SEQ ID NO: 541506 - RNA, 13 nt, Chlamydophila pneumoniae J138
uucgauuccugag

SEQ ID NO: 541507 - RNA, 13 nt, Chlamydophila pneumoniae J138
uucgucuucauaa

SEQ ID NO: 541508 - RNA, 15 nt, Chlamydophila pneumoniae J138
uucgucgucauccca

SEQ ID NO: 541509 - RNA, 15 nt, Chlamydophila pneumoniae J138
uucgugagagcguug

SEQ ID NO: 541510 - RNA, 22 nt, Chlamydophila pneumoniae J138
uucgugaacaaaaucgaacaga

SEQ ID NO: 541511 - RNA, 22 nt, Chlamydophila pneumoniae J138
uucguuuccgaucauuuuugcu

SEQ ID NO: 541512 - RNA, 17 nt, Chlamydophila pneumoniae J138
uucgcggaucuucuucu

SEQ ID NO: 541513 - RNA, 16 nt, Chlamydophila pneumoniae J138
uucucccauagcaaug

SEQ ID NO: 541514 - RNA, 17 nt, Chlamydophila pneumoniae J138
uucuccagcuucuuucu

SEQ ID NO: 541515 - RNA, 21 nt, Chlamydophila pneumoniae J138
uucuccucgcaauccaggaau

SEQ ID NO: 541516 - RNA, 20 nt, Chlamydophila pneumoniae J138
uucuccucgcaauccaggaa

SEQ ID NO: 541517 - RNA, 15 nt, Chlamydophila pneumoniae J138
uucuccucuuucuua

SEQ ID NO: 541518 - RNA, 23 nt, Chlamydophila pneumoniae J138
uucuccugaaccgcaaaaagcuu

SEQ ID NO: 541519 - RNA, 14 nt, Chlamydophila pneumoniae J138
uucugaaacaaugc

SEQ ID NO: 541520 - RNA, 20 nt, Chlamydophila pneumoniae J138
uucugaaauugucuucagug

SEQ ID NO: 541521 - RNA, 15 nt, Chlamydophila pneumoniae J138
uucugaaauugucuu

SEQ ID NO: 541522 - RNA, 20 nt, Chlamydophila pneumoniae J138
uucugaaauuucugaaacaa

SEQ ID NO: 541523 - RNA, 14 nt, Chlamydophila pneumoniae J138
uucugaagauuuuu

SEQ ID NO: 541524 - RNA, 15 nt, Chlamydophila pneumoniae J138
uucugauacaucauc

SEQ ID NO: 541525 - RNA, 22 nt, Chlamydophila pneumoniae J138
uucuggauacguuuuucccuuu

SEQ ID NO: 541526 - RNA, 19 nt, Chlamydophila pneumoniae J138
uucuggagaaaaaauaucu

SEQ ID NO: 541527 - RNA, 14 nt, Chlamydophila pneumoniae J138
uucuggagaaaaaa

SEQ ID NO: 541528 - RNA, 14 nt, Chlamydophila pneumoniae J138
uucugcuucuguaa

SEQ ID NO: 541529 - RNA, 16 nt, Chlamydophila pneumoniae J138
uucuaaaacuucaguu

SEQ ID NO: 541530 - RNA, 12 nt, Chlamydophila pneumoniae J138
uucuaaacaauu

SEQ ID NO: 541531 - RNA, 20 nt, Chlamydophila pneumoniae J138
uucuaaaaagaaaagaccuc

SEQ ID NO: 541532 - RNA, 21 nt, Chlamydophila pneumoniae J138
uucuagagcuucaaguuucuu

SEQ ID NO: 541533 - RNA, 21 nt, Chlamydophila pneumoniae J138
uucuagaaacugcuccugaag

SEQ ID NO: 541534 - RNA, 18 nt, Chlamydophila pneumoniae J138
uucuagaaaagauucuaa

SEQ ID NO: 541535 - RNA, 14 nt, Chlamydophila pneumoniae J138
uucuauagcaagac

SEQ ID NO: 541536 - RNA, 20 nt, Chlamydophila pneumoniae J138
uucuagcauaguguuccaaa

SEQ ID NO: 541537 - RNA, 22 nt, Chlamydophila pneumoniae J138
uucuaugauaucaccagguccu

SEQ ID NO: 541538 - RNA, 17 nt, Chlamydophila pneumoniae J138
uucuaucuuacugaaga

SEQ ID NO: 541539 - RNA, 17 nt, Chlamydophila pneumoniae J138
uucuauuuucaggaggc

SEQ ID NO: 541540 - RNA, 19 nt, Chlamydophila pneumoniae J138
uucuauaucauuaagaaga

SEQ ID NO: 541541 - RNA, 14 nt, Chlamydophila pneumoniae J138
uucucaagaucuuc

SEQ ID NO: 541542 - RNA, 18 nt, Chlamydophila pneumoniae J138
uucucaagaucuucauca

SEQ ID NO: 541543 - RNA, 20 nt, Chlamydophila pneumoniae J138
uucuccaaccucgagauccu

SEQ ID NO: 541544 - RNA, 17 nt, Chlamydophila pneumoniae J138
uucuguaguucuugcca

SEQ ID NO: 541545 - RNA, 13 nt, Chlamydophila pneumoniae J138
uucuguaguucuu

SEQ ID NO: 541546 - RNA, 13 nt, Chlamydophila pneumoniae J138
uucuguaacacuu

SEQ ID NO: 541547 - RNA, 22 nt, Chlamydophila pneumoniae J138
uucuuacuaaagaaagagucuc

SEQ ID NO: 541548 - RNA, 13 nt, Chlamydophila pneumoniae J138
uucuuaauuuccu

SEQ ID NO: 541549 - RNA, 16 nt, Chlamydophila pneumoniae J138
uucuuaauuuccuucu

SEQ ID NO: 541550 - RNA, 18 nt, Chlamydophila pneumoniae J138
uucuuaauauaaaagaag

SEQ ID NO: 541551 - RNA, 14 nt, Chlamydophila pneumoniae J138
uucuuaacaauaua

SEQ ID NO: 541552 - RNA, 22 nt, Chlamydophila pneumoniae J138
uucuuagaagagaaaguagaga

SEQ ID NO: 541553 - RNA, 14 nt, Chlamydophila pneumoniae J138
uucuuagaagagaa

SEQ ID NO: 541554 - RNA, 16 nt, Chlamydophila pneumoniae J138
uucuuagaagagaaag

SEQ ID NO: 541555 - RNA, 15 nt, Chlamydophila pneumoniae J138
uucuuaucuucuaaa

SEQ ID NO: 541556 - RNA, 22 nt, Chlamydophila pneumoniae J138
uucuuauccuugaaauugcucu

SEQ ID NO: 541557 - RNA, 20 nt, Chlamydophila pneumoniae J138
uucuuaucaaaauaaaaaaa

SEQ ID NO: 541558 - RNA, 14 nt, Chlamydophila pneumoniae J138
uucuucaucaauac

SEQ ID NO: 541559 - RNA, 23 nt, Chlamydophila pneumoniae J138
uucuucauuauuaaacgaauacu

SEQ ID NO: 541560 - RNA, 14 nt, Chlamydophila pneumoniae J138
uucuuccaauaauu

SEQ ID NO: 541561 - RNA, 23 nt, Chlamydophila pneumoniae J138
uucuucaaagucaaauacuucuc

SEQ ID NO: 541562 - RNA, 14 nt, Chlamydophila pneumoniae J138
uucuucaagaaaug

SEQ ID NO: 541563 - RNA, 14 nt, Chlamydophila pneumoniae J138
uucuucaacgagga

SEQ ID NO: 541564 - RNA, 13 nt, Chlamydophila pneumoniae J138
uucuucacaaucu

SEQ ID NO: 541565 - RNA, 20 nt, Chlamydophila pneumoniae J138
uucuucacaaucuaaauaag

SEQ ID NO: 541566 - RNA, 14 nt, Chlamydophila pneumoniae J138
uucuucccagguaa

SEQ ID NO: 541567 - RNA, 17 nt, Chlamydophila pneumoniae J138
uucuucgguguagaucu

SEQ ID NO: 541568 - RNA, 19 nt, Chlamydophila pneumoniae J138
uucuucguuuauaacauca

SEQ ID NO: 541569 - RNA, 20 nt, Chlamydophila pneumoniae J138
uucuucugaauagcucuuuu

SEQ ID NO: 541570 - RNA, 15 nt, Chlamydophila pneumoniae J138
uucuucucuaagaaa

SEQ ID NO: 541571 - RNA, 14 nt, Chlamydophila pneumoniae J138
uucuucucuaggaa

SEQ ID NO: 541572 - RNA, 17 nt, Chlamydophila pneumoniae J138
uucauaaccaaguaaau

SEQ ID NO: 541573 - RNA, 21 nt, Chlamydophila pneumoniae J138
uucauaacacccugacaggua

SEQ ID NO: 541574 - RNA, 13 nt, Chlamydophila pneumoniae J138
uucauaaauucag

SEQ ID NO: 541575 - RNA, 20 nt, Chlamydophila pneumoniae J138
uucauaaccaaguaaaucag

SEQ ID NO: 541576 - RNA, 13 nt, Chlamydophila pneumoniae J138
uucauaaaacugu

SEQ ID NO: 541577 - RNA, 13 nt, Chlamydophila pneumoniae J138
uucagguucugaa

SEQ ID NO: 541578 - RNA, 21 nt, Chlamydophila pneumoniae J138
uucaguauugcaagccgcaaa

SEQ ID NO: 541579 - RNA, 21 nt, Chlamydophila pneumoniae J138
uucaucacaaaauucaugcaa

SEQ ID NO: 541580 - RNA, 20 nt, Chlamydophila pneumoniae J138
uucaucgauaggaugacacu

SEQ ID NO: 541581 - RNA, 20 nt, Chlamydophila pneumoniae J138
uucauaugaaugacugcaga

SEQ ID NO: 541582 - RNA, 14 nt, Chlamydophila pneumoniae J138
uucaucaaaacaua

SEQ ID NO: 541583 - RNA, 20 nt, Chlamydophila pneumoniae J138
uucauacuaaaaucuuucaa

SEQ ID NO: 541584 - RNA, 17 nt, Chlamydophila pneumoniae J138
uuccaaaauaaaaggag

SEQ ID NO: 541585 - RNA, 18 nt, Chlamydophila pneumoniae J138
uuccaaaauaaaaggagc

SEQ ID NO: 541586 - RNA, 23 nt, Chlamydophila pneumoniae J138
uuccaaagcuaggcgauaguaaa

SEQ ID NO: 541587 - RNA, 13 nt, Chlamydophila pneumoniae J138
uuccaacuucaac

SEQ ID NO: 541588 - RNA, 18 nt, Chlamydophila pneumoniae J138
uuccaagacaauaaaaaa

SEQ ID NO: 541589 - RNA, 13 nt, Chlamydophila pneumoniae J138
uucauugcaaaaa

SEQ ID NO: 541590 - RNA, 22 nt, Chlamydophila pneumoniae J138
uucauuucgauaacacuucuuu

SEQ ID NO: 541591 - RNA, 21 nt, Chlamydophila pneumoniae J138
uucauuguagaggucacuaua

SEQ ID NO: 541592 - RNA, 14 nt, Chlamydophila pneumoniae J138
uucauguccuccau

SEQ ID NO: 541593 - RNA, 22 nt, Chlamydophila pneumoniae J138
uucaugauuccgcaaguaauca

SEQ ID NO: 541594 - RNA, 19 nt, Chlamydophila pneumoniae J138
uucaugauuccgcaaguaa

SEQ ID NO: 541595 - RNA, 12 nt, Chlamydophila pneumoniae J138
uucaugcaaaac

SEQ ID NO: 541596 - RNA, 20 nt, Chlamydophila pneumoniae J138
uucaucugucauuaaaaauu

SEQ ID NO: 541597 - RNA, 20 nt, Chlamydophila pneumoniae J138
uucaucuaggggagcuauua

SEQ ID NO: 541598 - RNA, 16 nt, Chlamydophila pneumoniae J138
uucaucuucuuucuau

SEQ ID NO: 541599 - RNA, 21 nt, Chlamydophila pneumoniae J138
uucaaauuugcucuccugcaa

SEQ ID NO: 541600 - RNA, 18 nt, Chlamydophila pneumoniae J138
uuauuuuaaagucacuuu

SEQ ID NO: 541601 - RNA, 19 nt, Chlamydophila pneumoniae J138
uucaaaucaucaaaaagau

SEQ ID NO: 541602 - RNA, 21 nt, Chlamydophila pneumoniae J138
uucaaauauugcgaacuuuug

SEQ ID NO: 541603 - RNA, 14 nt, Chlamydophila pneumoniae J138
uucaaagucaaaua

SEQ ID NO: 541604 - RNA, 12 nt, Chlamydophila pneumoniae J138
uucaaagccauu

SEQ ID NO: 541605 - RNA, 12 nt, Chlamydophila pneumoniae J138
uucaaagauaua

SEQ ID NO: 541606 - RNA, 22 nt, Chlamydophila pneumoniae J138
uucaaagauauagauucaugaa

SEQ ID NO: 541607 - RNA, 12 nt, Chlamydophila pneumoniae J138
uucaaagauugc

SEQ ID NO: 541608 - RNA, 21 nt, Chlamydophila pneumoniae J138
uuauuucuaaaaaauagauaa

SEQ ID NO: 541609 - RNA, 23 nt, Chlamydophila pneumoniae J138
uuauuguagagaguauuuacaag

SEQ ID NO: 541610 - RNA, 22 nt, Chlamydophila pneumoniae J138
uuaggaucccugauuccuuggc

SEQ ID NO: 541611 - RNA, 14 nt, Chlamydophila pneumoniae J138
uuaggcuuaauaaa

SEQ ID NO: 541612 - RNA, 19 nt, Chlamydophila pneumoniae J138
uuagggaagacgauaccgc

SEQ ID NO: 541613 - RNA, 14 nt, Chlamydophila pneumoniae J138
uuauuauugaauaa

SEQ ID NO: 541614 - RNA, 21 nt, Chlamydophila pneumoniae J138
uuauucccuaagguagagucc

SEQ ID NO: 541615 - RNA, 14 nt, Chlamydophila pneumoniae J138
uucaauuguaagca

SEQ ID NO: 541616 - RNA, 18 nt, Chlamydophila pneumoniae J138
uucaauugagacaaaaaa

SEQ ID NO: 541617 - RNA, 17 nt, Chlamydophila pneumoniae J138
uucaauugagacaaaaa

SEQ ID NO: 541618 - RNA, 22 nt, Chlamydophila pneumoniae J138
uucaauuacaggagcuagaaga

SEQ ID NO: 541619 - RNA, 17 nt, Chlamydophila pneumoniae J138
uucaauuuggauuuaug

SEQ ID NO: 541620 - RNA, 12 nt, Chlamydophila pneumoniae J138
uucaauuucuau

SEQ ID NO: 541621 - RNA, 19 nt, Chlamydophila pneumoniae J138
uucacaaagaauucagaga

SEQ ID NO: 541622 - RNA, 16 nt, Chlamydophila pneumoniae J138
uucacaagugcauuau

SEQ ID NO: 541623 - RNA, 19 nt, Chlamydophila pneumoniae J138
uucaaucucuccuugacaa

SEQ ID NO: 541624 - RNA, 14 nt, Chlamydophila pneumoniae J138
uucaauguaauugc

SEQ ID NO: 541625 - RNA, 19 nt, Chlamydophila pneumoniae J138
uucaagguacuuuauagaa

SEQ ID NO: 541626 - RNA, 20 nt, Chlamydophila pneumoniae J138
uucaagguacuuuauagaaa

SEQ ID NO: 541627 - RNA, 21 nt, Chlamydophila pneumoniae J138
uucaagguacugcucaaugac

SEQ ID NO: 541628 - RNA, 13 nt, Chlamydophila pneumoniae J138
uucaagucuguaa

SEQ ID NO: 541629 - RNA, 17 nt, Chlamydophila pneumoniae J138
uucaagucgagaaacaa

SEQ ID NO: 541630 - RNA, 14 nt, Chlamydophila pneumoniae J138
uucaagucuguaag

SEQ ID NO: 541631 - RNA, 22 nt, Chlamydophila pneumoniae J138
uucaccacaaaccucuaaaaac

SEQ ID NO: 541632 - RNA, 16 nt, Chlamydophila pneumoniae J138
uucaccauuaagauau

SEQ ID NO: 541633 - RNA, 13 nt, Chlamydophila pneumoniae J138
uucacuccugaag

SEQ ID NO: 541634 - RNA, 21 nt, Chlamydophila pneumoniae J138
uucagaguugauugucucaac

SEQ ID NO: 541635 - RNA, 18 nt, Chlamydophila pneumoniae J138
uucagcaaacggagagca

SEQ ID NO: 541636 - RNA, 14 nt, Chlamydophila pneumoniae J138
uucagccugucuau

SEQ ID NO: 541637 - RNA, 20 nt, Chlamydophila pneumoniae J138
uucagaugauuuuaucugcg

SEQ ID NO: 541638 - RNA, 17 nt, Chlamydophila pneumoniae J138
uucagauggucagucuc

SEQ ID NO: 541639 - RNA, 17 nt, Chlamydophila pneumoniae J138
uggauugucgaugaggg

SEQ ID NO: 541640 - RNA, 22 nt, Chlamydophila pneumoniae J138
uggauuucuccagcagcuuccc

SEQ ID NO: 541641 - RNA, 13 nt, Chlamydophila pneumoniae J138
uggcacaauccuc

SEQ ID NO: 541642 - RNA, 18 nt, Chlamydophila pneumoniae J138
uggccaucaucaccagaa

SEQ ID NO: 541643 - RNA, 11 nt, Chlamydophila pneumoniae J138
uggccaaaaau

SEQ ID NO: 541644 - RNA, 20 nt, Chlamydophila pneumoniae J138
uggcagcuuggaugggaauc

SEQ ID NO: 541645 - RNA, 12 nt, Chlamydophila pneumoniae J138
uggcgauaaaug

SEQ ID NO: 541646 - RNA, 12 nt, Chlamydophila pneumoniae J138
uggccucaacac

SEQ ID NO: 541647 - RNA, 20 nt, Chlamydophila pneumoniae J138
uggcgucugcccuuucugca

SEQ ID NO: 541648 - RNA, 15 nt, Chlamydophila pneumoniae J138
ugggaugaucucuga

SEQ ID NO: 541649 - RNA, 22 nt, Chlamydophila pneumoniae J138
ugggcaaugaucaaaaaugaua

SEQ ID NO: 541650 - RNA, 16 nt, Chlamydophila pneumoniae J138
ugggagcuuccuccaa

SEQ ID NO: 541651 - RNA, 20 nt, Chlamydophila pneumoniae J138
ugggauauuggagacuaggg

SEQ ID NO: 541652 - RNA, 14 nt, Chlamydophila pneumoniae J138
ugggcucacucuaa

SEQ ID NO: 541653 - RNA, 19 nt, Chlamydophila pneumoniae J138
uggggcauaagaacucuau

SEQ ID NO: 541654 - RNA, 18 nt, Chlamydophila pneumoniae J138
uggggcaguagguaagaa

SEQ ID NO: 541655 - RNA, 17 nt, Chlamydophila pneumoniae J138
uggggcauaagaacucu

SEQ ID NO: 541656 - RNA, 18 nt, Chlamydophila pneumoniae J138
uggggaucuuaggaaauu

SEQ ID NO: 541657 - RNA, 20 nt, Chlamydophila pneumoniae J138
uggggauuaucccaaacuuc

SEQ ID NO: 541658 - RNA, 13 nt, Chlamydophila pneumoniae J138
uggguuugucucc

SEQ ID NO: 541659 - RNA, 13 nt, Chlamydophila pneumoniae J138
ugguaaaaauaua

SEQ ID NO: 541660 - RNA, 13 nt, Chlamydophila pneumoniae J138
uggguucacuccu

SEQ ID NO: 541661 - RNA, 15 nt, Chlamydophila pneumoniae J138
uggguucacuccuga

SEQ ID NO: 541662 - RNA, 17 nt, Chlamydophila pneumoniae J138
uggguucacuccugaag

SEQ ID NO: 541663 - RNA, 22 nt, Chlamydophila pneumoniae J138
ugguacaauacuggagagguaa

SEQ ID NO: 541664 - RNA, 15 nt, Chlamydophila pneumoniae J138
ugguaucccaaucga

SEQ ID NO: 541665 - RNA, 12 nt, Chlamydophila pneumoniae J138
ugguaucccuga

SEQ ID NO: 541666 - RNA, 19 nt, Chlamydophila pneumoniae J138
ugguagcgucucuucuucc

SEQ ID NO: 541667 - RNA, 12 nt, Chlamydophila pneumoniae J138
uggucagucucg

SEQ ID NO: 541668 - RNA, 19 nt, Chlamydophila pneumoniae J138
ugguccauaauuucuuuca

SEQ ID NO: 541669 - RNA, 20 nt, Chlamydophila pneumoniae J138
ugguccaucgagaaaugcuc

SEQ ID NO: 541670 - RNA, 23 nt, Chlamydophila pneumoniae J138
uggucauugccuugcugcauacu

SEQ ID NO: 541671 - RNA, 19 nt, Chlamydophila pneumoniae J138
uggucuguauuuucuucaa

SEQ ID NO: 541672 - RNA, 21 nt, Chlamydophila pneumoniae J138
ugguuuuugcaaccacacagg

SEQ ID NO: 541673 - RNA, 21 nt, Chlamydophila pneumoniae J138
ugguuuuucgauuuggaagau

SEQ ID NO: 541674 - RNA, 18 nt, Chlamydophila pneumoniae J138
ugguuuaccuuguuuucc

SEQ ID NO: 541675 - RNA, 21 nt, Chlamydophila pneumoniae J138
uguaaccaacaucaaagaauu

SEQ ID NO: 541676 - RNA, 16 nt, Chlamydophila pneumoniae J138
uguacaauuugcuccu

SEQ ID NO: 541677 - RNA, 19 nt, Chlamydophila pneumoniae J138
uguacaauuugcuccucca

SEQ ID NO: 541678 - RNA, 22 nt, Chlamydophila pneumoniae J138
uguacaagcuucaucaaaacau

SEQ ID NO: 541679 - RNA, 19 nt, Chlamydophila pneumoniae J138
uguacagaaaauaagaagc

SEQ ID NO: 541680 - RNA, 14 nt, Chlamydophila pneumoniae J138
uguacacuuucaag

SEQ ID NO: 541681 - RNA, 18 nt, Chlamydophila pneumoniae J138
uguacuugauauuguucu

SEQ ID NO: 541682 - RNA, 22 nt, Chlamydophila pneumoniae J138
uguacuuccccaaacauggaca

SEQ ID NO: 541683 - RNA, 16 nt, Chlamydophila pneumoniae J138
uguacuuuuugccaca

SEQ ID NO: 541684 - RNA, 21 nt, Chlamydophila pneumoniae J138
uguagacaauaccagauaaag

SEQ ID NO: 541685 - RNA, 24 nt, Chlamydophila pneumoniae J138
uguagaggucacuauagaucucuu

SEQ ID NO: 541686 - RNA, 20 nt, Chlamydophila pneumoniae J138
uguaaucauaaaaaaagcua

SEQ ID NO: 541687 - RNA, 22 nt, Chlamydophila pneumoniae J138
uguaaucccagauuuuuuuggu

SEQ ID NO: 541688 - RNA, 15 nt, Chlamydophila pneumoniae J138
uguacaaaugcaucu

SEQ ID NO: 541689 - RNA, 14 nt, Chlamydophila pneumoniae J138
uguaauuuuuucau

SEQ ID NO: 541690 - RNA, 20 nt, Chlamydophila pneumoniae J138
uguaacgggagcguuuuuug

SEQ ID NO: 541691 - RNA, 21 nt, Chlamydophila pneumoniae J138
uguaagaaaaugaggacacaa

SEQ ID NO: 541692 - RNA, 16 nt, Chlamydophila pneumoniae J138
uguagcuacagauucu

SEQ ID NO: 541693 - RNA, 14 nt, Chlamydophila pneumoniae J138
uguaguaaauuccu

SEQ ID NO: 541694 - RNA, 16 nt, Chlamydophila pneumoniae J138
uguaguaaauuccucu

SEQ ID NO: 541695 - RNA, 15 nt, Chlamydophila pneumoniae J138
uguagggaugaucac

SEQ ID NO: 541696 - RNA, 23 nt, Chlamydophila pneumoniae J138
uguauacauaucuccuuuaaaua

SEQ ID NO: 541697 - RNA, 13 nt, Chlamydophila pneumoniae J138
uguauauucugaa

SEQ ID NO: 541698 - RNA, 14 nt, Chlamydophila pneumoniae J138
uguauauucugaaa

SEQ ID NO: 541699 - RNA, 23 nt, Chlamydophila pneumoniae J138
uguauauccacgaucuagaagau

SEQ ID NO: 541700 - RNA, 20 nt, Chlamydophila pneumoniae J138
uguaguuugggaugacuggc

SEQ ID NO: 541701 - RNA, 16 nt, Chlamydophila pneumoniae J138
uguaguuuguucacuu

SEQ ID NO: 541702 - RNA, 23 nt, Chlamydophila pneumoniae J138
uguaguucuuugaauuuccaaag

SEQ ID NO: 541703 - RNA, 20 nt, Chlamydophila pneumoniae J138
uguaguuucuaaaacagaaa

SEQ ID NO: 541704 - RNA, 12 nt, Chlamydophila pneumoniae J138
uguaguucuuug

SEQ ID NO: 541705 - RNA, 21 nt, Chlamydophila pneumoniae J138
uguaguucuuugaauuuccaa

SEQ ID NO: 541706 - RNA, 23 nt, Chlamydophila pneumoniae J138
uguauaaacuccacgaauucuuu

SEQ ID NO: 541707 - RNA, 12 nt, Chlamydophila pneumoniae J138
uguauaaaguuu

SEQ ID NO: 541708 - RNA, 18 nt, Chlamydophila pneumoniae J138
uguauaaaguuuguaaaa

SEQ ID NO: 541709 - RNA, 23 nt, Chlamydophila pneumoniae J138
uguauaacaucuaaaaaugcacu

SEQ ID NO: 541710 - RNA, 13 nt, Chlamydophila pneumoniae J138
uguaugugaaaga

SEQ ID NO: 541711 - RNA, 15 nt, Chlamydophila pneumoniae J138
uguauggcagccugg

SEQ ID NO: 541712 - RNA, 17 nt, Chlamydophila pneumoniae J138
ugucacuaucuucuaaa

SEQ ID NO: 541713 - RNA, 19 nt, Chlamydophila pneumoniae J138
ugucacuaucuucuaaaac

SEQ ID NO: 541714 - RNA, 14 nt, Chlamydophila pneumoniae J138
ugucacuagagaaa

SEQ ID NO: 541715 - RNA, 21 nt, Chlamydophila pneumoniae J138
ugucaagaggcuguccuugca

SEQ ID NO: 541716 - RNA, 12 nt, Chlamydophila pneumoniae J138
ugucagaacaag

SEQ ID NO: 541717 - RNA, 13 nt, Chlamydophila pneumoniae J138
ugucauuaaaaau

SEQ ID NO: 541718 - RNA, 17 nt, Chlamydophila pneumoniae J138
uguccauccaaauagag

SEQ ID NO: 541719 - RNA, 22 nt, Chlamydophila pneumoniae J138
uguccagucuauagccucuucu

SEQ ID NO: 541720 - RNA, 20 nt, Chlamydophila pneumoniae J138
ugucuagugaagcugcuucu

SEQ ID NO: 541721 - RNA, 23 nt, Chlamydophila pneumoniae J138
ugucuauuucuuaauuuccuucu

SEQ ID NO: 541722 - RNA, 15 nt, Chlamydophila pneumoniae J138
ugucguaauaacccc

SEQ ID NO: 541723 - RNA, 23 nt, Chlamydophila pneumoniae J138
ugugcauuuucuucuugcaaucu

SEQ ID NO: 541724 - RNA, 14 nt, Chlamydophila pneumoniae J138
ugugaguucuuccu

SEQ ID NO: 541725 - RNA, 15 nt, Chlamydophila pneumoniae J138
ugugcaugcaucuua

SEQ ID NO: 541726 - RNA, 13 nt, Chlamydophila pneumoniae J138
ugugcaugcaucu

SEQ ID NO: 541727 - RNA, 12 nt, Chlamydophila pneumoniae J138
ugugcaucaguc

SEQ ID NO: 541728 - RNA, 15 nt, Chlamydophila pneumoniae J138
ugugcauuuucuucu

SEQ ID NO: 541729 - RNA, 20 nt, Chlamydophila pneumoniae J138
ugugcaucuauaauuaaucc

SEQ ID NO: 541730 - RNA, 15 nt, Chlamydophila pneumoniae J138
ugugacgacaaauca

SEQ ID NO: 541731 - RNA, 21 nt, Chlamydophila pneumoniae J138
ugugugacgacaaaucacgac

SEQ ID NO: 541732 - RNA, 23 nt, Chlamydophila pneumoniae J138
uguguuuuauccaccaagacuga

SEQ ID NO: 541733 - RNA, 19 nt, Chlamydophila pneumoniae J138
uguuaacaagauucucagc

SEQ ID NO: 541734 - RNA, 20 nt, Chlamydophila pneumoniae J138
uguuaauagaagaucauuaa

SEQ ID NO: 541735 - RNA, 20 nt, Chlamydophila pneumoniae J138
uguuaaggcuuccaaugcua

SEQ ID NO: 541736 - RNA, 17 nt, Chlamydophila pneumoniae J138
ugugggauggucaggaa

SEQ ID NO: 541737 - RNA, 14 nt, Chlamydophila pneumoniae J138
uguggucuuccgua

SEQ ID NO: 541738 - RNA, 21 nt, Chlamydophila pneumoniae J138
uguggguaaugccaauauggu

SEQ ID NO: 541739 - RNA, 13 nt, Chlamydophila pneumoniae J138
uguguaaaaguua

SEQ ID NO: 541740 - RNA, 15 nt, Chlamydophila pneumoniae J138
ugugguuagaggaag

SEQ ID NO: 541741 - RNA, 13 nt, Chlamydophila pneumoniae J138
uguguaaugagcu

SEQ ID NO: 541742 - RNA, 14 nt, Chlamydophila pneumoniae J138
uguguauuugcaga

SEQ ID NO: 541743 - RNA, 20 nt, Chlamydophila pneumoniae J138
uguguauuuaagaaaugcaa

SEQ ID NO: 541744 - RNA, 18 nt, Chlamydophila pneumoniae J138
uguguaugaaucacaucu

SEQ ID NO: 541745 - RNA, 13 nt, Chlamydophila pneumoniae J138
uuacaucaaugau

SEQ ID NO: 541746 - RNA, 20 nt, Chlamydophila pneumoniae J138
uuaccaucguuuucauaggg

SEQ ID NO: 541747 - RNA, 23 nt, Chlamydophila pneumoniae J138
uuaccucauggagguucucaaug

SEQ ID NO: 541748 - RNA, 15 nt, Chlamydophila pneumoniae J138
uuacgaaaacaucug

SEQ ID NO: 541749 - RNA, 21 nt, Chlamydophila pneumoniae J138
uuacgaacaagacgaaagcac

SEQ ID NO: 541750 - RNA, 22 nt, Chlamydophila pneumoniae J138
uuacaaauggcaugaaagauaa

SEQ ID NO: 541751 - RNA, 17 nt, Chlamydophila pneumoniae J138
uuacaaauaaaaugauu

SEQ ID NO: 541752 - RNA, 13 nt, Chlamydophila pneumoniae J138
uuacagaaaggcu

SEQ ID NO: 541753 - RNA, 15 nt, Chlamydophila pneumoniae J138
uuacacaacucuuuc

SEQ ID NO: 541754 - RNA, 15 nt, Chlamydophila pneumoniae J138
uuacaagcuuccuug

SEQ ID NO: 541755 - RNA, 16 nt, Chlamydophila pneumoniae J138
uuaauuguagagagaa

SEQ ID NO: 541756 - RNA, 14 nt, Chlamydophila pneumoniae J138
uuagcaagagcucu

SEQ ID NO: 541757 - RNA, 13 nt, Chlamydophila pneumoniae J138
uuagcaaugaagg

SEQ ID NO: 541758 - RNA, 18 nt, Chlamydophila pneumoniae J138
uuagccuggcuaaaggau

SEQ ID NO: 541759 - RNA, 12 nt, Chlamydophila pneumoniae J138
uuagauuuccuc

SEQ ID NO: 541760 - RNA, 18 nt, Chlamydophila pneumoniae J138
uuagaaaccaugaugcaa

SEQ ID NO: 541761 - RNA, 12 nt, Chlamydophila pneumoniae J138
uuagaaagcgca

SEQ ID NO: 541762 - RNA, 15 nt, Chlamydophila pneumoniae J138
uuagaaaagauaaaa

SEQ ID NO: 541763 - RNA, 20 nt, Chlamydophila pneumoniae J138
uuagaaaagauaaaacauuc

SEQ ID NO: 541764 - RNA, 12 nt, Chlamydophila pneumoniae J138
uuagaauccucu

SEQ ID NO: 541765 - RNA, 19 nt, Chlamydophila pneumoniae J138
uuagaauccugaucuguag

SEQ ID NO: 541766 - RNA, 14 nt, Chlamydophila pneumoniae J138
uuagaaucuuuucu

SEQ ID NO: 541767 - RNA, 16 nt, Chlamydophila pneumoniae J138
uuagaaucuaagaucc

SEQ ID NO: 541768 - RNA, 18 nt, Chlamydophila pneumoniae J138
uuagacgaggagaagucg

SEQ ID NO: 541769 - RNA, 15 nt, Chlamydophila pneumoniae J138
uuacgguuucuggga

SEQ ID NO: 541770 - RNA, 17 nt, Chlamydophila pneumoniae J138
uuacugucugcaaagag

SEQ ID NO: 541771 - RNA, 21 nt, Chlamydophila pneumoniae J138
uuacugugguauacaucccau

SEQ ID NO: 541772 - RNA, 16 nt, Chlamydophila pneumoniae J138
uuacuaggaaggaaau

SEQ ID NO: 541773 - RNA, 20 nt, Chlamydophila pneumoniae J138
uuacuaggaaggaaaucaca

SEQ ID NO: 541774 - RNA, 21 nt, Chlamydophila pneumoniae J138
uuaaaguuaaacaaaguagga

SEQ ID NO: 541775 - RNA, 17 nt, Chlamydophila pneumoniae J138
uuaaaguggcaaucuuu

SEQ ID NO: 541776 - RNA, 19 nt, Chlamydophila pneumoniae J138
uuaaaguaaaaaauacagg

SEQ ID NO: 541777 - RNA, 16 nt, Chlamydophila pneumoniae J138
uuaaagcuugagaaaa

SEQ ID NO: 541778 - RNA, 12 nt, Chlamydophila pneumoniae J138
uuaaauacagau

SEQ ID NO: 541779 - RNA, 17 nt, Chlamydophila pneumoniae J138
uuaaauuaucagagaca

SEQ ID NO: 541780 - RNA, 16 nt, Chlamydophila pneumoniae J138
uuaaauguauugcaaa

SEQ ID NO: 541781 - RNA, 13 nt, Chlamydophila pneumoniae J138
uuaacaaacuugu

SEQ ID NO: 541782 - RNA, 17 nt, Chlamydophila pneumoniae J138
uuaacaaguaccaagaa

SEQ ID NO: 541783 - RNA, 18 nt, Chlamydophila pneumoniae J138
uuaacaaguaccaagaaa

SEQ ID NO: 541784 - RNA, 13 nt, Chlamydophila pneumoniae J138
uuaacaacaugcg

SEQ ID NO: 541785 - RNA, 13 nt, Chlamydophila pneumoniae J138
uuaacaacaucac

SEQ ID NO: 541786 - RNA, 11 nt, Chlamydophila pneumoniae J138
uuaagaagaag

SEQ ID NO: 541787 - RNA, 19 nt, Chlamydophila pneumoniae J138
uuaagauaucgaccuuaaa

SEQ ID NO: 541788 - RNA, 13 nt, Chlamydophila pneumoniae J138
uuaagaacaucuu

SEQ ID NO: 541789 - RNA, 16 nt, Chlamydophila pneumoniae J138
uuaacuucuaaaagca

SEQ ID NO: 541790 - RNA, 21 nt, Chlamydophila pneumoniae J138
uuaacuguguaugaaucacau

SEQ ID NO: 541791 - RNA, 13 nt, Chlamydophila pneumoniae J138
uuaagguugcuuu

SEQ ID NO: 541792 - RNA, 22 nt, Chlamydophila pneumoniae J138
uuaauacaaaaaauaaaaucaa

SEQ ID NO: 541793 - RNA, 16 nt, Chlamydophila pneumoniae J138
uguuuuugcugaagau

SEQ ID NO: 541794 - RNA, 17 nt, Chlamydophila pneumoniae J138
uguuuuucuaaaaugcu

SEQ ID NO: 541795 - RNA, 12 nt, Chlamydophila pneumoniae J138
uguuuuccagaa

SEQ ID NO: 541796 - RNA, 12 nt, Chlamydophila pneumoniae J138
uguuuuccugag

SEQ ID NO: 541797 - RNA, 16 nt, Chlamydophila pneumoniae J138
uguuuucguaaauaug

SEQ ID NO: 541798 - RNA, 13 nt, Chlamydophila pneumoniae J138
uguuuucuaucag

SEQ ID NO: 541799 - RNA, 12 nt, Chlamydophila pneumoniae J138
uguuuucuucua

SEQ ID NO: 541800 - RNA, 15 nt, Chlamydophila pneumoniae J138
uguuuucuucuaccu

SEQ ID NO: 541801 - RNA, 21 nt, Chlamydophila pneumoniae J138
uguuuugcuucuauuuuagaa

SEQ ID NO: 541802 - RNA, 13 nt, Chlamydophila pneumoniae J138
uguuuguccuagg

SEQ ID NO: 541803 - RNA, 22 nt, Chlamydophila pneumoniae J138
uguuuucacauggccaaaaauc

SEQ ID NO: 541804 - RNA, 17 nt, Chlamydophila pneumoniae J138
uguuuuauccaccaaga

SEQ ID NO: 541805 - RNA, 21 nt, Chlamydophila pneumoniae J138
uguuuuagauggaucuauaag

SEQ ID NO: 541806 - RNA, 12 nt, Chlamydophila pneumoniae J138
uguuuuauagau

SEQ ID NO: 541807 - RNA, 22 nt, Chlamydophila pneumoniae J138
uguuucuuugacuuucauauga

SEQ ID NO: 541808 - RNA, 19 nt, Chlamydophila pneumoniae J138
uguuucuucugaauagcuc

SEQ ID NO: 541809 - RNA, 12 nt, Chlamydophila pneumoniae J138
uguuucuuguag

SEQ ID NO: 541810 - RNA, 20 nt, Chlamydophila pneumoniae J138
uguuucuagaaaaucucuaa

SEQ ID NO: 541811 - RNA, 24 nt, Chlamydophila pneumoniae J138
uguuucuagaaaaucucuaagaau

SEQ ID NO: 541812 - RNA, 15 nt, Chlamydophila pneumoniae J138
uguuugcuauacaga

SEQ ID NO: 541813 - RNA, 16 nt, Chlamydophila pneumoniae J138
uguuugcaugcggcuc

SEQ ID NO: 541814 - RNA, 18 nt, Chlamydophila pneumoniae J138
uguuugcaugcggcuccu

SEQ ID NO: 541815 - RNA, 16 nt, Chlamydophila pneumoniae J138
uguuucaacaccucaa

SEQ ID NO: 541816 - RNA, 12 nt, Chlamydophila pneumoniae J138
uguuuauuuagc

SEQ ID NO: 541817 - RNA, 17 nt, Chlamydophila pneumoniae J138
uguuuaucgacucuucc

SEQ ID NO: 541818 - RNA, 15 nt, Chlamydophila pneumoniae J138
uguuucgaaaguugg

SEQ ID NO: 541819 - RNA, 20 nt, Chlamydophila pneumoniae J138
uguuuccuucgaagcggagc

SEQ ID NO: 541820 - RNA, 17 nt, Chlamydophila pneumoniae J138
uuaaagauuuucauaac

SEQ ID NO: 541821 - RNA, 23 nt, Chlamydophila pneumoniae J138
uuaaacuuucuucucuaggaaga

SEQ ID NO: 541822 - RNA, 15 nt, Chlamydophila pneumoniae J138
uuaaacuaagaauac

SEQ ID NO: 541823 - RNA, 21 nt, Chlamydophila pneumoniae J138
uuaaacucugacgucuccaac

SEQ ID NO: 541824 - RNA, 17 nt, Chlamydophila pneumoniae J138
uuaaacagaucuuuauc

SEQ ID NO: 541825 - RNA, 14 nt, Chlamydophila pneumoniae J138
uuaaacagaucuuu

SEQ ID NO: 541826 - RNA, 18 nt, Chlamydophila pneumoniae J138
uuaaaauuucugggcuaa

SEQ ID NO: 541827 - RNA, 13 nt, Chlamydophila pneumoniae J138
uguuuuuugagau

SEQ ID NO: 541828 - RNA, 22 nt, Chlamydophila pneumoniae J138
uuaaaaaacuuccuaacuaucu

SEQ ID NO: 541829 - RNA, 16 nt, Chlamydophila pneumoniae J138
uuaaaaagucugaauc

SEQ ID NO: 541830 - RNA, 19 nt, Chlamydophila pneumoniae J138
uuaaaaauauaucuucaga

SEQ ID NO: 541831 - RNA, 15 nt, Chlamydophila pneumoniae J138
uuaaaacccauguuu

SEQ ID NO: 541832 - RNA, 14 nt, Chlamydophila pneumoniae J138
uuaaaacccauguu

SEQ ID NO: 541833 - RNA, 13 nt, Chlamydophila pneumoniae J138
uguuccaauagag

SEQ ID NO: 541834 - RNA, 13 nt, Chlamydophila pneumoniae J138
uguucauaaucag

SEQ ID NO: 541835 - RNA, 16 nt, Chlamydophila pneumoniae J138
uguuccauaauuuuag

SEQ ID NO: 541836 - RNA, 23 nt, Chlamydophila pneumoniae J138
uguuccauaauuuuagcuucuuu

SEQ ID NO: 541837 - RNA, 18 nt, Chlamydophila pneumoniae J138
uguucgcuccuaauggaa

SEQ ID NO: 541838 - RNA, 13 nt, Chlamydophila pneumoniae J138
uguucgauuuucu

SEQ ID NO: 541839 - RNA, 15 nt, Chlamydophila pneumoniae J138
uguucgaguucuuua

SEQ ID NO: 541840 - RNA, 15 nt, Chlamydophila pneumoniae J138
uguucucgcaaugcu

SEQ ID NO: 541841 - RNA, 21 nt, Chlamydophila pneumoniae J138
uguucugcacguggcuuuugu

SEQ ID NO: 541842 - RNA, 13 nt, Chlamydophila pneumoniae J138
uguucagcuagag

SEQ ID NO: 541843 - RNA, 12 nt, Chlamydophila pneumoniae J138
uguucaaagauu

SEQ ID NO: 541844 - RNA, 14 nt, Chlamydophila pneumoniae J138
uguucaaaaauaga

SEQ ID NO: 541845 - RNA, 14 nt, Chlamydophila pneumoniae J138
uguuauuguuucua

SEQ ID NO: 541846 - RNA, 17 nt, Chlamydophila pneumoniae J138
uguuaugaguuuuuaau

SEQ ID NO: 541847 - RNA, 15 nt, Chlamydophila pneumoniae J138
uguuaugaguuuuua

SEQ ID NO: 541848 - RNA, 18 nt, Chlamydophila pneumoniae J138
uguuagaccagggagacc

SEQ ID NO: 541849 - RNA, 22 nt, Chlamydophila pneumoniae J138
uguuagcaucgcuuaacaaacu

SEQ ID NO: 541850 - RNA, 20 nt, Chlamydophila pneumoniae J138
uguuauaagugacuuuucuu

SEQ ID NO: 541851 - RNA, 16 nt, Chlamydophila pneumoniae J138
uguugauaauuacaga

SEQ ID NO: 541852 - RNA, 20 nt, Chlamydophila pneumoniae J138
uguugcccuacaauuuccuu

SEQ ID NO: 541853 - RNA, 19 nt, Chlamydophila pneumoniae J138
uguuuaaguccuucuuccc

SEQ ID NO: 541854 - RNA, 13 nt, Chlamydophila pneumoniae J138
uguuuacagaugc

SEQ ID NO: 541855 - RNA, 22 nt, Chlamydophila pneumoniae J138
uguuuagaauuuguccuuugcu

SEQ ID NO: 541856 - RNA, 18 nt, Chlamydophila pneumoniae J138
uguuuagaaaaagaucua

SEQ ID NO: 541857 - RNA, 12 nt, Chlamydophila pneumoniae J138
uguuggguugug

SEQ ID NO: 541858 - RNA, 20 nt, Chlamydophila pneumoniae J138
uguuggaauugcauuaagau

SEQ ID NO: 541859 - RNA, 16 nt, Chlamydophila pneumoniae J138
uguugucagcuuugcu

SEQ ID NO: 541860 - RNA, 13 nt, Chlamydophila pneumoniae J138
uguugucacuaag

SEQ ID NO: 541861 - RNA, 15 nt, Chlamydophila pneumoniae J138
uguuguggaucagaa

SEQ ID NO: 541862 - RNA, 13 nt, Chlamydophila pneumoniae J138
uguuguaauaaaa

SEQ ID NO: 541863 - RNA, 16 nt, Chlamydophila pneumoniae J138
uguuguaauaaaauca

SEQ ID NO: 541864 - RNA, 24 nt, Chlamydophila pneumoniae J138
ugcacccaaucgguaugauagaac

SEQ ID NO: 541865 - RNA, 13 nt, Chlamydophila pneumoniae J138
ugauuugggauga

SEQ ID NO: 541866 - RNA, 15 nt, Chlamydophila pneumoniae J138
ugauuucuuuauucc

SEQ ID NO: 541867 - RNA, 15 nt, Chlamydophila pneumoniae J138
ugcaggccaggagac

SEQ ID NO: 541868 - RNA, 19 nt, Chlamydophila pneumoniae J138
ugcagcgaucaaaggcugc

SEQ ID NO: 541869 - RNA, 18 nt, Chlamydophila pneumoniae J138
ugcagacggggaucuaaa

SEQ ID NO: 541870 - RNA, 16 nt, Chlamydophila pneumoniae J138
ugcagcagccuuggcu

SEQ ID NO: 541871 - RNA, 22 nt, Chlamydophila pneumoniae J138
ugcagcagccuuggcucuagaa

SEQ ID NO: 541872 - RNA, 21 nt, Chlamydophila pneumoniae J138
ugcaugccuggccaucaucac

SEQ ID NO: 541873 - RNA, 22 nt, Chlamydophila pneumoniae J138
ugcaugccuggccaucaucacc

SEQ ID NO: 541874 - RNA, 13 nt, Chlamydophila pneumoniae J138
ugcaugaggagac

SEQ ID NO: 541875 - RNA, 17 nt, Chlamydophila pneumoniae J138
ugcaugauccuauuuuu

SEQ ID NO: 541876 - RNA, 16 nt, Chlamydophila pneumoniae J138
ugcauggauccuucau

SEQ ID NO: 541877 - RNA, 20 nt, Chlamydophila pneumoniae J138
ugcaucccuggauuucuucu

SEQ ID NO: 541878 - RNA, 16 nt, Chlamydophila pneumoniae J138
ugcaugaaucucuucu

SEQ ID NO: 541879 - RNA, 23 nt, Chlamydophila pneumoniae J138
ugcauauugcucuuguauuccuu

SEQ ID NO: 541880 - RNA, 15 nt, Chlamydophila pneumoniae J138
ugccagcagaaguuc

SEQ ID NO: 541881 - RNA, 13 nt, Chlamydophila pneumoniae J138
ugccaaauccucc

SEQ ID NO: 541882 - RNA, 14 nt, Chlamydophila pneumoniae J138
ugccaaauaucucu

SEQ ID NO: 541883 - RNA, 21 nt, Chlamydophila pneumoniae J138
ugccaaaaguuuugaggauuu

SEQ ID NO: 541884 - RNA, 15 nt, Chlamydophila pneumoniae J138
ugcauuuucuucuug

SEQ ID NO: 541885 - RNA, 16 nt, Chlamydophila pneumoniae J138
ugcauuuucuucuugc

SEQ ID NO: 541886 - RNA, 18 nt, Chlamydophila pneumoniae J138
ugcauuuucuucuugcaa

SEQ ID NO: 541887 - RNA, 20 nt, Chlamydophila pneumoniae J138
ugcauuaagauaaacauuaa

SEQ ID NO: 541888 - RNA, 13 nt, Chlamydophila pneumoniae J138
ugccaagagcauc

SEQ ID NO: 541889 - RNA, 16 nt, Chlamydophila pneumoniae J138
ugccacaacucauccu

SEQ ID NO: 541890 - RNA, 14 nt, Chlamydophila pneumoniae J138
ugccauaaauacag

SEQ ID NO: 541891 - RNA, 15 nt, Chlamydophila pneumoniae J138
ugccagcagcgagga

SEQ ID NO: 541892 - RNA, 11 nt, Chlamydophila pneumoniae J138
ugccagcagaa

SEQ ID NO: 541893 - RNA, 13 nt, Chlamydophila pneumoniae J138
ugccagcagaagu

SEQ ID NO: 541894 - RNA, 13 nt, Chlamydophila pneumoniae J138
ugccagcccaugu

SEQ ID NO: 541895 - RNA, 16 nt, Chlamydophila pneumoniae J138
ugccaggcuuaaauau

SEQ ID NO: 541896 - RNA, 13 nt, Chlamydophila pneumoniae J138
ugccagcuugccc

SEQ ID NO: 541897 - RNA, 22 nt, Chlamydophila pneumoniae J138
ugccauugaucagaaucuaagu

SEQ ID NO: 541898 - RNA, 19 nt, Chlamydophila pneumoniae J138
ugccauucuuaucugcugg

SEQ ID NO: 541899 - RNA, 16 nt, Chlamydophila pneumoniae J138
ugcccacuucuaccaa

SEQ ID NO: 541900 - RNA, 21 nt, Chlamydophila pneumoniae J138
ugcccauugaccugcuuuuuu

SEQ ID NO: 541901 - RNA, 18 nt, Chlamydophila pneumoniae J138
ugcccuacaauuuccuug

SEQ ID NO: 541902 - RNA, 22 nt, Chlamydophila pneumoniae J138
ugcccuucguaacgcuuuucua

SEQ ID NO: 541903 - RNA, 21 nt, Chlamydophila pneumoniae J138
ugcccuucguaacgcuuuucu

SEQ ID NO: 541904 - RNA, 15 nt, Chlamydophila pneumoniae J138
ugcccuguucuaugc

SEQ ID NO: 541905 - RNA, 23 nt, Chlamydophila pneumoniae J138
ugccgugcucuuauguuaaaaau

SEQ ID NO: 541906 - RNA, 17 nt, Chlamydophila pneumoniae J138
ugccuaaagagauguag

SEQ ID NO: 541907 - RNA, 22 nt, Chlamydophila pneumoniae J138
ugcgauugccggcuaugaggaa

SEQ ID NO: 541908 - RNA, 17 nt, Chlamydophila pneumoniae J138
ugcgacugcucuuucau

SEQ ID NO: 541909 - RNA, 23 nt, Chlamydophila pneumoniae J138
ugcgcagcuucuggagaaaaaau

SEQ ID NO: 541910 - RNA, 22 nt, Chlamydophila pneumoniae J138
ugcgcagcuucuggagaaaaaa

SEQ ID NO: 541911 - RNA, 18 nt, Chlamydophila pneumoniae J138
ugcgcagcucggauggac

SEQ ID NO: 541912 - RNA, 18 nt, Chlamydophila pneumoniae J138
ugcgcagcuucuggagaa

SEQ ID NO: 541913 - RNA, 18 nt, Chlamydophila pneumoniae J138
ugcgcaguggacggggag

SEQ ID NO: 541914 - RNA, 22 nt, Chlamydophila pneumoniae J138
aaauggugaagaauaauagcaa

SEQ ID NO: 541915 - RNA, 17 nt, Chlamydophila pneumoniae J138
ugcggaccuuaagauga

SEQ ID NO: 541916 - RNA, 14 nt, Chlamydophila pneumoniae J138
ugcgcuaucaucau

SEQ ID NO: 541917 - RNA, 13 nt, Chlamydophila pneumoniae J138
ugcgcuagcucca

SEQ ID NO: 541918 - RNA, 16 nt, Chlamydophila pneumoniae J138
ugcgcucggauuucau

SEQ ID NO: 541919 - RNA, 23 nt, Chlamydophila pneumoniae J138
ugaccuuauaguccauaugggac

SEQ ID NO: 541920 - RNA, 13 nt, Chlamydophila pneumoniae J138
ugaccuucucaag

SEQ ID NO: 541921 - RNA, 20 nt, Chlamydophila pneumoniae J138
ugaccuucucaagaucuuca

SEQ ID NO: 541922 - RNA, 13 nt, Chlamydophila pneumoniae J138
ugaccuuuuucau

SEQ ID NO: 541923 - RNA, 14 nt, Chlamydophila pneumoniae J138
ugaccuuuuucauu

SEQ ID NO: 541924 - RNA, 23 nt, Chlamydophila pneumoniae J138
ugacuggcgacuugccaaucuuc

SEQ ID NO: 541925 - RNA, 14 nt, Chlamydophila pneumoniae J138
ugagaauuuucaug

SEQ ID NO: 541926 - RNA, 22 nt, Chlamydophila pneumoniae J138
ugagacagacagucugugagaa

SEQ ID NO: 541927 - RNA, 20 nt, Chlamydophila pneumoniae J138
ugagaauauggccuagcuuu

SEQ ID NO: 541928 - RNA, 15 nt, Chlamydophila pneumoniae J138
ugagaaagaaguccu

SEQ ID NO: 541929 - RNA, 20 nt, Chlamydophila pneumoniae J138
ugagaaaaucugcagcagau

SEQ ID NO: 541930 - RNA, 15 nt, Chlamydophila pneumoniae J138
ugagaaaaucugcag

SEQ ID NO: 541931 - RNA, 17 nt, Chlamydophila pneumoniae J138
ugagaaaaucugcagca

SEQ ID NO: 541932 - RNA, 15 nt, Chlamydophila pneumoniae J138
ugagaaaaguugccu

SEQ ID NO: 541933 - RNA, 13 nt, Chlamydophila pneumoniae J138
ugagaaaaagaau

SEQ ID NO: 541934 - RNA, 19 nt, Chlamydophila pneumoniae J138
ugagaaaaagaaucucuga

SEQ ID NO: 541935 - RNA, 12 nt, Chlamydophila pneumoniae J138
ugacuuuucuuc

SEQ ID NO: 541936 - RNA, 15 nt, Chlamydophila pneumoniae J138
ugacuuuucuucuuc

SEQ ID NO: 541937 - RNA, 18 nt, Chlamydophila pneumoniae J138
ugacuuuagaaauuccaa

SEQ ID NO: 541938 - RNA, 15 nt, Chlamydophila pneumoniae J138
ugagcagcaaaaauu

SEQ ID NO: 541939 - RNA, 14 nt, Chlamydophila pneumoniae J138
ugagauugaggaua

SEQ ID NO: 541940 - RNA, 15 nt, Chlamydophila pneumoniae J138
ugagauggucgagaa

SEQ ID NO: 541941 - RNA, 13 nt, Chlamydophila pneumoniae J138
ugagaucugcaaa

SEQ ID NO: 541942 - RNA, 17 nt, Chlamydophila pneumoniae J138
ugagccccuugcaaaag

SEQ ID NO: 541943 - RNA, 14 nt, Chlamydophila pneumoniae J138
ugagcauccaaaau

SEQ ID NO: 541944 - RNA, 23 nt, Chlamydophila pneumoniae J138
ugaggcaaagauuuccaauccau

SEQ ID NO: 541945 - RNA, 17 nt, Chlamydophila pneumoniae J138
ugagguuugugcugcuu

SEQ ID NO: 541946 - RNA, 21 nt, Chlamydophila pneumoniae J138
ugaggcaaagauuuccaaucc

SEQ ID NO: 541947 - RNA, 14 nt, Chlamydophila pneumoniae J138
ugaggaaaauuccc

SEQ ID NO: 541948 - RNA, 16 nt, Chlamydophila pneumoniae J138
ugagcuugccuaccca

SEQ ID NO: 541949 - RNA, 21 nt, Chlamydophila pneumoniae J138
ugaguucuuccuucuucuuca

SEQ ID NO: 541950 - RNA, 23 nt, Chlamydophila pneumoniae J138
ugaguucuuccuucuucuucaaa

SEQ ID NO: 541951 - RNA, 12 nt, Chlamydophila pneumoniae J138
ugauaaagccug

SEQ ID NO: 541952 - RNA, 21 nt, Chlamydophila pneumoniae J138
ugagucgcgaccgaaaguccc

SEQ ID NO: 541953 - RNA, 16 nt, Chlamydophila pneumoniae J138
ugauaauuucauuaua

SEQ ID NO: 541954 - RNA, 13 nt, Chlamydophila pneumoniae J138
ugaucuacaaaaa

SEQ ID NO: 541955 - RNA, 17 nt, Chlamydophila pneumoniae J138
ugauccaucugcucuuu

SEQ ID NO: 541956 - RNA, 21 nt, Chlamydophila pneumoniae J138
ugauccagcccccaggcugca

SEQ ID NO: 541957 - RNA, 22 nt, Chlamydophila pneumoniae J138
ugauccaauagccaaagacucu

SEQ ID NO: 541958 - RNA, 20 nt, Chlamydophila pneumoniae J138
ugaucacguggacagcggcc

SEQ ID NO: 541959 - RNA, 15 nt, Chlamydophila pneumoniae J138
ugaucagaaaugaag

SEQ ID NO: 541960 - RNA, 12 nt, Chlamydophila pneumoniae J138
ugaucagaaucu

SEQ ID NO: 541961 - RNA, 21 nt, Chlamydophila pneumoniae J138
ugaucagagagaggggagucu

SEQ ID NO: 541962 - RNA, 17 nt, Chlamydophila pneumoniae J138
ugauauuugucuaguga

SEQ ID NO: 541963 - RNA, 19 nt, Chlamydophila pneumoniae J138
ugauauuuuuauuuaaaau

SEQ ID NO: 541964 - RNA, 21 nt, Chlamydophila pneumoniae J138
ugaucaaaaaugauaccaccu

SEQ ID NO: 541965 - RNA, 12 nt, Chlamydophila pneumoniae J138
ugauauuuucuu

SEQ ID NO: 541966 - RNA, 19 nt, Chlamydophila pneumoniae J138
ugaucaaaauuauccagaa

SEQ ID NO: 541967 - RNA, 12 nt, Chlamydophila pneumoniae J138
ugaucaaagaac

SEQ ID NO: 541968 - RNA, 20 nt, Chlamydophila pneumoniae J138
ugaucaagaggagugaaagc

SEQ ID NO: 541969 - RNA, 22 nt, Chlamydophila pneumoniae J138
ugaucuuuccucucaugaaauu

SEQ ID NO: 541970 - RNA, 18 nt, Chlamydophila pneumoniae J138
ugaucuugcucaggagau

SEQ ID NO: 541971 - RNA, 21 nt, Chlamydophila pneumoniae J138
ugaugcaaugguugucuuuac

SEQ ID NO: 541972 - RNA, 15 nt, Chlamydophila pneumoniae J138
ugaugccuuuuucuu

SEQ ID NO: 541973 - RNA, 15 nt, Chlamydophila pneumoniae J138
ugaugcuucuuucaa

SEQ ID NO: 541974 - RNA, 15 nt, Chlamydophila pneumoniae J138
ugauugcugucagaa

SEQ ID NO: 541975 - RNA, 20 nt, Chlamydophila pneumoniae J138
ugauuggaugauagcuauga

SEQ ID NO: 541976 - RNA, 15 nt, Chlamydophila pneumoniae J138
ugauugaaaccguaa

SEQ ID NO: 541977 - RNA, 15 nt, Chlamydophila pneumoniae J138
ugauucuccgucccc

SEQ ID NO: 541978 - RNA, 21 nt, Chlamydophila pneumoniae J138
ugauucauaaagaggaaugaa

SEQ ID NO: 541979 - RNA, 16 nt, Chlamydophila pneumoniae J138
ugauuauuuaagacca

SEQ ID NO: 541980 - RNA, 17 nt, Chlamydophila pneumoniae J138
ugauucauaaagaggaa

SEQ ID NO: 541981 - RNA, 18 nt, Chlamydophila pneumoniae J138
ugauuagagccccaaccc

SEQ ID NO: 541982 - RNA, 13 nt, Chlamydophila pneumoniae J138
ugauuaggaacaa

SEQ ID NO: 541983 - RNA, 18 nt, Chlamydophila pneumoniae J138
ugauuaguuuguuuuaau

SEQ ID NO: 541984 - RNA, 19 nt, Chlamydophila pneumoniae J138
ugauuaggcuucagagauu

SEQ ID NO: 541985 - RNA, 17 nt, Chlamydophila pneumoniae J138
ugauuaguucucuaaga

SEQ ID NO: 541986 - RNA, 15 nt, Chlamydophila pneumoniae J138
ugauguguugauuuc

SEQ ID NO: 541987 - RNA, 20 nt, Chlamydophila pneumoniae J138
ugauguuugacuuuauguua

SEQ ID NO: 541988 - RNA, 20 nt, Chlamydophila pneumoniae J138
ugauuacagcaucuauagaa

SEQ ID NO: 541989 - RNA, 18 nt, Chlamydophila pneumoniae J138
ugaauuuccaaaggaaaa

SEQ ID NO: 541990 - RNA, 15 nt, Chlamydophila pneumoniae J138
ugaauuaauaaaaga

SEQ ID NO: 541991 - RNA, 16 nt, Chlamydophila pneumoniae J138
ugaauuaauaaaagag

SEQ ID NO: 541992 - RNA, 19 nt, Chlamydophila pneumoniae J138
ugaauuaauaaaagagcuc

SEQ ID NO: 541993 - RNA, 17 nt, Chlamydophila pneumoniae J138
ugaauggcucugucacu

SEQ ID NO: 541994 - RNA, 19 nt, Chlamydophila pneumoniae J138
ugaauuagggcuuuuacuc

SEQ ID NO: 541995 - RNA, 19 nt, Chlamydophila pneumoniae J138
ugaaugccugccaauccaa

SEQ ID NO: 541996 - RNA, 18 nt, Chlamydophila pneumoniae J138
ugaaugcaacagagucag

SEQ ID NO: 541997 - RNA, 19 nt, Chlamydophila pneumoniae J138
ugaaugcagcacggaacaa

SEQ ID NO: 541998 - RNA, 14 nt, Chlamydophila pneumoniae J138
ugaaugauuuccau

SEQ ID NO: 541999 - RNA, 15 nt, Chlamydophila pneumoniae J138
ugaaugauuuccaua

SEQ ID NO: 542000 - RNA, 10 nt, Chlamydophila pneumoniae J138
ugaaugaucc

SEQ ID NO: 542001 - RNA, 19 nt, Chlamydophila pneumoniae J138
ugaaugagcuucacaucuu

SEQ ID NO: 542002 - RNA, 13 nt, Chlamydophila pneumoniae J138
ugaaucuucaaga

SEQ ID NO: 542003 - RNA, 15 nt, Chlamydophila pneumoniae J138
ugaaucucuucugua

SEQ ID NO: 542004 - RNA, 22 nt, Chlamydophila pneumoniae J138
ugaaucgaagaacagaggaucu

SEQ ID NO: 542005 - RNA, 13 nt, Chlamydophila pneumoniae J138
ugaaucagcuuau

SEQ ID NO: 542006 - RNA, 15 nt, Chlamydophila pneumoniae J138
ugaaucacaucuaaa

SEQ ID NO: 542007 - RNA, 16 nt, Chlamydophila pneumoniae J138
ugacacucagcuccca

SEQ ID NO: 542008 - RNA, 23 nt, Chlamydophila pneumoniae J138
ugacacucuaucauaucuucaaa

SEQ ID NO: 542009 - RNA, 15 nt, Chlamydophila pneumoniae J138
ugacacggcguagag

SEQ ID NO: 542010 - RNA, 22 nt, Chlamydophila pneumoniae J138
ugacacaggagguucauucuca

SEQ ID NO: 542011 - RNA, 15 nt, Chlamydophila pneumoniae J138
ugacagcugagaaau

SEQ ID NO: 542012 - RNA, 21 nt, Chlamydophila pneumoniae J138
ugacagcuccauuuaaaugga

SEQ ID NO: 542013 - RNA, 23 nt, Chlamydophila pneumoniae J138
ugacagaccuugcauuagauuca

SEQ ID NO: 542014 - RNA, 21 nt, Chlamydophila pneumoniae J138
ugacacaacucuuaaaucgcu

SEQ ID NO: 542015 - RNA, 23 nt, Chlamydophila pneumoniae J138
ugacaaucgcuguaaauucagug

SEQ ID NO: 542016 - RNA, 18 nt, Chlamydophila pneumoniae J138
ugacaaucgcuguaaauu

SEQ ID NO: 542017 - RNA, 16 nt, Chlamydophila pneumoniae J138
ugacaauccgcauauu

SEQ ID NO: 542018 - RNA, 14 nt, Chlamydophila pneumoniae J138
ugacaauaagaaaa

SEQ ID NO: 542019 - RNA, 13 nt, Chlamydophila pneumoniae J138
ugacaaauuuauc

SEQ ID NO: 542020 - RNA, 15 nt, Chlamydophila pneumoniae J138
ugacaacagagacaa

SEQ ID NO: 542021 - RNA, 16 nt, Chlamydophila pneumoniae J138
ugacaaauaaacugac

SEQ ID NO: 542022 - RNA, 15 nt, Chlamydophila pneumoniae J138
ugaccaguggcagga

SEQ ID NO: 542023 - RNA, 13 nt, Chlamydophila pneumoniae J138
ugaccaguggcag

SEQ ID NO: 542024 - RNA, 21 nt, Chlamydophila pneumoniae J138
ugaccaucaaugagaucugca

SEQ ID NO: 542025 - RNA, 16 nt, Chlamydophila pneumoniae J138
ugaaauaugagaucga

SEQ ID NO: 542026 - RNA, 17 nt, Chlamydophila pneumoniae J138
ugaaauaguguuucuuu

SEQ ID NO: 542027 - RNA, 20 nt, Chlamydophila pneumoniae J138
ugaaauacuccacuuuuuuc

SEQ ID NO: 542028 - RNA, 17 nt, Chlamydophila pneumoniae J138
ugaaaguacaggcucca

SEQ ID NO: 542029 - RNA, 21 nt, Chlamydophila pneumoniae J138
ugaaaguacaggcuccaucac

SEQ ID NO: 542030 - RNA, 13 nt, Chlamydophila pneumoniae J138
ugaaaguacagaa

SEQ ID NO: 542031 - RNA, 18 nt, Chlamydophila pneumoniae J138
ugaaagucagcaagucau

SEQ ID NO: 542032 - RNA, 18 nt, Chlamydophila pneumoniae J138
ugaaaccuucucucuuaa

SEQ ID NO: 542033 - RNA, 17 nt, Chlamydophila pneumoniae J138
ugaaacuuuaggauuca

SEQ ID NO: 542034 - RNA, 20 nt, Chlamydophila pneumoniae J138
ugaaacuuuuuuucuucucu

SEQ ID NO: 542035 - RNA, 21 nt, Chlamydophila pneumoniae J138
ugaaacuuuuuuucuucucua

SEQ ID NO: 542036 - RNA, 19 nt, Chlamydophila pneumoniae J138
ugaaagauuauucuagagu

SEQ ID NO: 542037 - RNA, 17 nt, Chlamydophila pneumoniae J138
ucuucguuagagaagag

SEQ ID NO: 542038 - RNA, 21 nt, Chlamydophila pneumoniae J138
ucuucguaagcugcaaucuca

SEQ ID NO: 542039 - RNA, 20 nt, Chlamydophila pneumoniae J138
ugaaaccguaacugaggcaa

SEQ ID NO: 542040 - RNA, 17 nt, Chlamydophila pneumoniae J138
ugaaaccguaacugagg

SEQ ID NO: 542041 - RNA, 15 nt, Chlamydophila pneumoniae J138
ucuucguuuauaaca

SEQ ID NO: 542042 - RNA, 13 nt, Chlamydophila pneumoniae J138
ucuucuaaaacac

SEQ ID NO: 542043 - RNA, 20 nt, Chlamydophila pneumoniae J138
ugaaauuucugaaacaaugc

SEQ ID NO: 542044 - RNA, 21 nt, Chlamydophila pneumoniae J138
ugaaauuucugaaacaaugca

SEQ ID NO: 542045 - RNA, 19 nt, Chlamydophila pneumoniae J138
ugaaauuucugaaacaaug

SEQ ID NO: 542046 - RNA, 23 nt, Chlamydophila pneumoniae J138
ugaaauugaauggucucgaaauc

SEQ ID NO: 542047 - RNA, 12 nt, Chlamydophila pneumoniae J138
ugaaaucaaaaa

SEQ ID NO: 542048 - RNA, 17 nt, Chlamydophila pneumoniae J138
ugaaaucaaaaaaaacg

SEQ ID NO: 542049 - RNA, 14 nt, Chlamydophila pneumoniae J138
ugaacaaaaacugc

SEQ ID NO: 542050 - RNA, 14 nt, Chlamydophila pneumoniae J138
ugaacacucucuac

SEQ ID NO: 542051 - RNA, 13 nt, Chlamydophila pneumoniae J138
ugaacaucuccag

SEQ ID NO: 542052 - RNA, 23 nt, Chlamydophila pneumoniae J138
ugaagagucaaacuuauacacuc

SEQ ID NO: 542053 - RNA, 15 nt, Chlamydophila pneumoniae J138
ugaagagcauuuaaa

SEQ ID NO: 542054 - RNA, 18 nt, Chlamydophila pneumoniae J138
ugaacuuuuguacacaga

SEQ ID NO: 542055 - RNA, 22 nt, Chlamydophila pneumoniae J138
ugaagaacaaaaaaucaaucuu

SEQ ID NO: 542056 - RNA, 18 nt, Chlamydophila pneumoniae J138
ugaagagugguuccugaa

SEQ ID NO: 542057 - RNA, 18 nt, Chlamydophila pneumoniae J138
ugaagauggcaaggaaaa

SEQ ID NO: 542058 - RNA, 23 nt, Chlamydophila pneumoniae J138
ugaaggggugacccagagaaugu

SEQ ID NO: 542059 - RNA, 13 nt, Chlamydophila pneumoniae J138
ugaagcuccucac

SEQ ID NO: 542060 - RNA, 17 nt, Chlamydophila pneumoniae J138
ugaauaccguuucagga

SEQ ID NO: 542061 - RNA, 17 nt, Chlamydophila pneumoniae J138
ugaauaguagaguugac

SEQ ID NO: 542062 - RNA, 19 nt, Chlamydophila pneumoniae J138
ugaauaguagaguugacaa

SEQ ID NO: 542063 - RNA, 20 nt, Chlamydophila pneumoniae J138
ugaauagcucuuuucaugau

SEQ ID NO: 542064 - RNA, 13 nt, Chlamydophila pneumoniae J138
ugaauauaauucc

SEQ ID NO: 542065 - RNA, 17 nt, Chlamydophila pneumoniae J138
ugaauaugcuuuucaaa

SEQ ID NO: 542066 - RNA, 17 nt, Chlamydophila pneumoniae J138
ugaauaccagaagcaaa

SEQ ID NO: 542067 - RNA, 16 nt, Chlamydophila pneumoniae J138
ugaaguucucaaagac

SEQ ID NO: 542068 - RNA, 12 nt, Chlamydophila pneumoniae J138
ugaauaagauuu

SEQ ID NO: 542069 - RNA, 22 nt, Chlamydophila pneumoniae J138
ugaaguugagucgauuucccag

SEQ ID NO: 542070 - RNA, 19 nt, Chlamydophila pneumoniae J138
ugaaguugagucgauuucc

SEQ ID NO: 542071 - RNA, 21 nt, Chlamydophila pneumoniae J138
uccauacccaaauuucuucug

SEQ ID NO: 542072 - RNA, 20 nt, Chlamydophila pneumoniae J138
ucgccuuggguuugucucca

SEQ ID NO: 542073 - RNA, 23 nt, Chlamydophila pneumoniae J138
ucgccuuggguuugucuccaaau

SEQ ID NO: 542074 - RNA, 19 nt, Chlamydophila pneumoniae J138
ucgccuuccuuaacaacau

SEQ ID NO: 542075 - RNA, 14 nt, Chlamydophila pneumoniae J138
ucgcucuccucucg

SEQ ID NO: 542076 - RNA, 23 nt, Chlamydophila pneumoniae J138
ucgcucagcuaauuuaaaugccu

SEQ ID NO: 542077 - RNA, 17 nt, Chlamydophila pneumoniae J138
ucgcuccuaagcuuuua

SEQ ID NO: 542078 - RNA, 19 nt, Chlamydophila pneumoniae J138
ucgcuccuaauggaaacau

SEQ ID NO: 542079 - RNA, 16 nt, Chlamydophila pneumoniae J138
ucgcuacauaaaauga

SEQ ID NO: 542080 - RNA, 12 nt, Chlamydophila pneumoniae J138
ucgcuaccauau

SEQ ID NO: 542081 - RNA, 21 nt, Chlamydophila pneumoniae J138
ucgcuaacgcagcuuuagcuu

SEQ ID NO: 542082 - RNA, 17 nt, Chlamydophila pneumoniae J138
ucgcuagaucacaagaa

SEQ ID NO: 542083 - RNA, 18 nt, Chlamydophila pneumoniae J138
ucggaaaaaauagauccu

SEQ ID NO: 542084 - RNA, 22 nt, Chlamydophila pneumoniae J138
ucggaaaaaauagauccugaaa

SEQ ID NO: 542085 - RNA, 14 nt, Chlamydophila pneumoniae J138
ucgcuugugcaugc

SEQ ID NO: 542086 - RNA, 20 nt, Chlamydophila pneumoniae J138
ucgcuugugcaugcaucuua

SEQ ID NO: 542087 - RNA, 21 nt, Chlamydophila pneumoniae J138
ucggaagauagcccaaguugu

SEQ ID NO: 542088 - RNA, 13 nt, Chlamydophila pneumoniae J138
ucggagaccaaaa

SEQ ID NO: 542089 - RNA, 15 nt, Chlamydophila pneumoniae J138
ucggaguuaucaaaa

SEQ ID NO: 542090 - RNA, 19 nt, Chlamydophila pneumoniae J138
ucggaccuacguuuucucu

SEQ ID NO: 542091 - RNA, 19 nt, Chlamydophila pneumoniae J138
ucggacgauauuuagagag

SEQ ID NO: 542092 - RNA, 21 nt, Chlamydophila pneumoniae J138
ucggaucuuuucuuucuaaga

SEQ ID NO: 542093 - RNA, 14 nt, Chlamydophila pneumoniae J138
ucggaugagaucca

SEQ ID NO: 542094 - RNA, 21 nt, Chlamydophila pneumoniae J138
ucggcaauuguuaaaagaagg

SEQ ID NO: 542095 - RNA, 22 nt, Chlamydophila pneumoniae J138
ucgggaauaauaggauaagaaa

SEQ ID NO: 542096 - RNA, 19 nt, Chlamydophila pneumoniae J138
ucgguuauuuuuccagaaa

SEQ ID NO: 542097 - RNA, 22 nt, Chlamydophila pneumoniae J138
ucgguuaagaggugauacauag

SEQ ID NO: 542098 - RNA, 13 nt, Chlamydophila pneumoniae J138
ucgucauucugca

SEQ ID NO: 542099 - RNA, 14 nt, Chlamydophila pneumoniae J138
ucgucauucugcaa

SEQ ID NO: 542100 - RNA, 20 nt, Chlamydophila pneumoniae J138
ucgucaagcucugagaaaga

SEQ ID NO: 542101 - RNA, 11 nt, Chlamydophila pneumoniae J138
ucgucaaauuc

SEQ ID NO: 542102 - RNA, 15 nt, Chlamydophila pneumoniae J138
ucguaucuuuuugca

SEQ ID NO: 542103 - RNA, 17 nt, Chlamydophila pneumoniae J138
ucguacguggaaaguag

SEQ ID NO: 542104 - RNA, 20 nt, Chlamydophila pneumoniae J138
ucguagcaggcaucacuaau

SEQ ID NO: 542105 - RNA, 18 nt, Chlamydophila pneumoniae J138
ucguagacaacaagucuu

SEQ ID NO: 542106 - RNA, 16 nt, Chlamydophila pneumoniae J138
ucguaacgcuuuucua

SEQ ID NO: 542107 - RNA, 18 nt, Chlamydophila pneumoniae J138
ucguaacgcuuuucuaau

SEQ ID NO: 542108 - RNA, 21 nt, Chlamydophila pneumoniae J138
ucguaacuuccuuuuucugcu

SEQ ID NO: 542109 - RNA, 19 nt, Chlamydophila pneumoniae J138
ucguaauagcgacaugaga

SEQ ID NO: 542110 - RNA, 22 nt, Chlamydophila pneumoniae J138
ucguaauccuucuuucugcucu

SEQ ID NO: 542111 - RNA, 19 nt, Chlamydophila pneumoniae J138
ucguaauugcugaaaauga

SEQ ID NO: 542112 - RNA, 17 nt, Chlamydophila pneumoniae J138
ucguaaucuuuuuuaaa

SEQ ID NO: 542113 - RNA, 16 nt, Chlamydophila pneumoniae J138
ucgucuaaagaagauu

SEQ ID NO: 542114 - RNA, 20 nt, Chlamydophila pneumoniae J138
ucgucuuagaauccucuauc

SEQ ID NO: 542115 - RNA, 15 nt, Chlamydophila pneumoniae J138
ucgucuccaaaaauu

SEQ ID NO: 542116 - RNA, 15 nt, Chlamydophila pneumoniae J138
ucgucuuuuaaagag

SEQ ID NO: 542117 - RNA, 14 nt, Chlamydophila pneumoniae J138
ucgucuuuuaaaga

SEQ ID NO: 542118 - RNA, 19 nt, Chlamydophila pneumoniae J138
ucgugagcgaguaccucau

SEQ ID NO: 542119 - RNA, 21 nt, Chlamydophila pneumoniae J138
ucgugcuuagagccuucucau

SEQ ID NO: 542120 - RNA, 19 nt, Chlamydophila pneumoniae J138
ucgugggaggaauccuacg

SEQ ID NO: 542121 - RNA, 13 nt, Chlamydophila pneumoniae J138
ucguuuauaacau

SEQ ID NO: 542122 - RNA, 20 nt, Chlamydophila pneumoniae J138
ucguugguucaaauccgacu

SEQ ID NO: 542123 - RNA, 23 nt, Chlamydophila pneumoniae J138
ucguuucgcuuugauaauagucu

SEQ ID NO: 542124 - RNA, 21 nt, Chlamydophila pneumoniae J138
ucguuuccgaucauuuuugcu

SEQ ID NO: 542125 - RNA, 13 nt, Chlamydophila pneumoniae J138
ucguucaucuguc

SEQ ID NO: 542126 - RNA, 19 nt, Chlamydophila pneumoniae J138
ucguuaugaagcuucuuua

SEQ ID NO: 542127 - RNA, 20 nt, Chlamydophila pneumoniae J138
ucucauggauuacugaagau

SEQ ID NO: 542128 - RNA, 14 nt, Chlamydophila pneumoniae J138
ucucauguaacuga

SEQ ID NO: 542129 - RNA, 18 nt, Chlamydophila pneumoniae J138
ucuccaaaagcucuacaa

SEQ ID NO: 542130 - RNA, 16 nt, Chlamydophila pneumoniae J138
ucuccaaaagcucuac

SEQ ID NO: 542131 - RNA, 17 nt, Chlamydophila pneumoniae J138
ucuccaagauaauuaug

SEQ ID NO: 542132 - RNA, 19 nt, Chlamydophila pneumoniae J138
ucuccagaaauuuuuacaa

SEQ ID NO: 542133 - RNA, 15 nt, Chlamydophila pneumoniae J138
ucuccgaagacuacc

SEQ ID NO: 542134 - RNA, 12 nt, Chlamydophila pneumoniae J138
ucucccucuaaa

SEQ ID NO: 542135 - RNA, 18 nt, Chlamydophila pneumoniae J138
ucuccaguaucuucucuu

SEQ ID NO: 542136 - RNA, 17 nt, Chlamydophila pneumoniae J138
ucuccagguagcagagu

SEQ ID NO: 542137 - RNA, 14 nt, Chlamydophila pneumoniae J138
ucuccauccucagu

SEQ ID NO: 542138 - RNA, 16 nt, Chlamydophila pneumoniae J138
ucuccauccucagucu

SEQ ID NO: 542139 - RNA, 18 nt, Chlamydophila pneumoniae J138
ucucccaauauccagaaa

SEQ ID NO: 542140 - RNA, 18 nt, Chlamydophila pneumoniae J138
ucucccauagcaaugccu

SEQ ID NO: 542141 - RNA, 17 nt, Chlamydophila pneumoniae J138
ucuccggaacgcagagu

SEQ ID NO: 542142 - RNA, 19 nt, Chlamydophila pneumoniae J138
ucuccggaggucccucuaa

SEQ ID NO: 542143 - RNA, 18 nt, Chlamydophila pneumoniae J138
ucuccgggaacaacugug

SEQ ID NO: 542144 - RNA, 18 nt, Chlamydophila pneumoniae J138
ucuccuaaaccaucacuu

SEQ ID NO: 542145 - RNA, 13 nt, Chlamydophila pneumoniae J138
ucuccucaucaga

SEQ ID NO: 542146 - RNA, 23 nt, Chlamydophila pneumoniae J138
ucuccugcaaaaaguuucaaucu

SEQ ID NO: 542147 - RNA, 15 nt, Chlamydophila pneumoniae J138
ucuccuugauuuggg

SEQ ID NO: 542148 - RNA, 21 nt, Chlamydophila pneumoniae J138
ucuccuggagagcgaaauaga

SEQ ID NO: 542149 - RNA, 22 nt, Chlamydophila pneumoniae J138
ucucgacacuauguguuuccuu

SEQ ID NO: 542150 - RNA, 15 nt, Chlamydophila pneumoniae J138
ucucgacacuaugug

SEQ ID NO: 542151 - RNA, 17 nt, Chlamydophila pneumoniae J138
ucucgacacuauguguu

SEQ ID NO: 542152 - RNA, 12 nt, Chlamydophila pneumoniae J138
ucucgaagcuug

SEQ ID NO: 542153 - RNA, 14 nt, Chlamydophila pneumoniae J138
ucuccuuuaaauaa

SEQ ID NO: 542154 - RNA, 18 nt, Chlamydophila pneumoniae J138
ucuccuuuaaauaaaauc

SEQ ID NO: 542155 - RNA, 13 nt, Chlamydophila pneumoniae J138
ucucgaagaaaau

SEQ ID NO: 542156 - RNA, 14 nt, Chlamydophila pneumoniae J138
ucucgaagaaaaua

SEQ ID NO: 542157 - RNA, 22 nt, Chlamydophila pneumoniae J138
ucucgaagaaaauaaagaucuu

SEQ ID NO: 542158 - RNA, 19 nt, Chlamydophila pneumoniae J138
ucucgaacucugaaguaca

SEQ ID NO: 542159 - RNA, 16 nt, Chlamydophila pneumoniae J138
ucucgaaauccuaaaa

SEQ ID NO: 542160 - RNA, 17 nt, Chlamydophila pneumoniae J138
ucucgcuauuccauaaa

SEQ ID NO: 542161 - RNA, 19 nt, Chlamydophila pneumoniae J138
ucugacccuguagcgaaga

SEQ ID NO: 542162 - RNA, 22 nt, Chlamydophila pneumoniae J138
ucugacaauaacaugcgcagaa

SEQ ID NO: 542163 - RNA, 17 nt, Chlamydophila pneumoniae J138
ucugacaauaacaugcg

SEQ ID NO: 542164 - RNA, 12 nt, Chlamydophila pneumoniae J138
ucucuuuaaaaa

SEQ ID NO: 542165 - RNA, 19 nt, Chlamydophila pneumoniae J138
ucucuuuagcaaucucuuu

SEQ ID NO: 542166 - RNA, 13 nt, Chlamydophila pneumoniae J138
ucugaaacauaag

SEQ ID NO: 542167 - RNA, 20 nt, Chlamydophila pneumoniae J138
ucugaaacaaugcaucccug

SEQ ID NO: 542168 - RNA, 21 nt, Chlamydophila pneumoniae J138
ucugcaauuccgaagaagaaa

SEQ ID NO: 542169 - RNA, 19 nt, Chlamydophila pneumoniae J138
ucugcaaucugaaugccug

SEQ ID NO: 542170 - RNA, 15 nt, Chlamydophila pneumoniae J138
ucugcacggauauuc

SEQ ID NO: 542171 - RNA, 15 nt, Chlamydophila pneumoniae J138
ucugcagguaaggga

SEQ ID NO: 542172 - RNA, 12 nt, Chlamydophila pneumoniae J138
ucugcagcagau

SEQ ID NO: 542173 - RNA, 18 nt, Chlamydophila pneumoniae J138
ucugagcuugccuaccca

SEQ ID NO: 542174 - RNA, 18 nt, Chlamydophila pneumoniae J138
ucucucaagucuauuuga

SEQ ID NO: 542175 - RNA, 22 nt, Chlamydophila pneumoniae J138
ucucuccguccaguucuucauu

SEQ ID NO: 542176 - RNA, 19 nt, Chlamydophila pneumoniae J138
ucucuaugcgcucuaagag

SEQ ID NO: 542177 - RNA, 18 nt, Chlamydophila pneumoniae J138
ucucuaugcacaaaauaa

SEQ ID NO: 542178 - RNA, 16 nt, Chlamydophila pneumoniae J138
ucucuaugcgcucuaa

SEQ ID NO: 542179 - RNA, 17 nt, Chlamydophila pneumoniae J138
ucucuaugcacaaaaua

SEQ ID NO: 542180 - RNA, 22 nt, Chlamydophila pneumoniae J138
ucucuaugaacgauuucuuuua

SEQ ID NO: 542181 - RNA, 11 nt, Chlamydophila pneumoniae J138
ucucuaagaaa

SEQ ID NO: 542182 - RNA, 15 nt, Chlamydophila pneumoniae J138
ucucuaagaaauuuu

SEQ ID NO: 542183 - RNA, 19 nt, Chlamydophila pneumoniae J138
ucucgugaauuacaggccc

SEQ ID NO: 542184 - RNA, 19 nt, Chlamydophila pneumoniae J138
ucucugaccaucaaugaga

SEQ ID NO: 542185 - RNA, 13 nt, Chlamydophila pneumoniae J138
ucucucuuuccuu

SEQ ID NO: 542186 - RNA, 17 nt, Chlamydophila pneumoniae J138
ucucucugccuaccaaa

SEQ ID NO: 542187 - RNA, 19 nt, Chlamydophila pneumoniae J138
ucucuggcauaauccugaa

SEQ ID NO: 542188 - RNA, 15 nt, Chlamydophila pneumoniae J138
ucucuggaauacauu

SEQ ID NO: 542189 - RNA, 19 nt, Chlamydophila pneumoniae J138
ucucugcccccuguuugaa

SEQ ID NO: 542190 - RNA, 15 nt, Chlamydophila pneumoniae J138
ucucuucucuguugg

SEQ ID NO: 542191 - RNA, 13 nt, Chlamydophila pneumoniae J138
ucucuucuucuca

SEQ ID NO: 542192 - RNA, 21 nt, Chlamydophila pneumoniae J138
ucucuugccaaugcauuuguu

SEQ ID NO: 542193 - RNA, 19 nt, Chlamydophila pneumoniae J138
aaaugcuuguauaaaugcu

SEQ ID NO: 542194 - RNA, 15 nt, Chlamydophila pneumoniae J138
ucuuaucaagagcuc

SEQ ID NO: 542195 - RNA, 17 nt, Chlamydophila pneumoniae J138
ucuuaugaccaagaaca

SEQ ID NO: 542196 - RNA, 14 nt, Chlamydophila pneumoniae J138
ucuuaucuggagau

SEQ ID NO: 542197 - RNA, 15 nt, Chlamydophila pneumoniae J138
ucuuaucuucuaaaa

SEQ ID NO: 542198 - RNA, 16 nt, Chlamydophila pneumoniae J138
ucuuaucuaaagaaau

SEQ ID NO: 542199 - RNA, 19 nt, Chlamydophila pneumoniae J138
ucuguucugcuucuguaaa

SEQ ID NO: 542200 - RNA, 21 nt, Chlamydophila pneumoniae J138
ucuuaguaaagaaucacucuc

SEQ ID NO: 542201 - RNA, 22 nt, Chlamydophila pneumoniae J138
ucuuacuaaagaaagagucuca

SEQ ID NO: 542202 - RNA, 13 nt, Chlamydophila pneumoniae J138
ucuuccauaagau

SEQ ID NO: 542203 - RNA, 20 nt, Chlamydophila pneumoniae J138
ucuuccugaaucagcuuauc

SEQ ID NO: 542204 - RNA, 14 nt, Chlamydophila pneumoniae J138
ucuuccugcugcuu

SEQ ID NO: 542205 - RNA, 17 nt, Chlamydophila pneumoniae J138
ucuuccuucuucuucaa

SEQ ID NO: 542206 - RNA, 16 nt, Chlamydophila pneumoniae J138
ucuucggaucuguaau

SEQ ID NO: 542207 - RNA, 17 nt, Chlamydophila pneumoniae J138
ucuucggaucuguaaua

SEQ ID NO: 542208 - RNA, 23 nt, Chlamydophila pneumoniae J138
ucuucgcuggcauguuuaauauc

SEQ ID NO: 542209 - RNA, 14 nt, Chlamydophila pneumoniae J138
ucuuccaaagacug

SEQ ID NO: 542210 - RNA, 16 nt, Chlamydophila pneumoniae J138
ucuuccaaagacugag

SEQ ID NO: 542211 - RNA, 14 nt, Chlamydophila pneumoniae J138
ucuuccaacuucug

SEQ ID NO: 542212 - RNA, 16 nt, Chlamydophila pneumoniae J138
ucuuccacaauguuua

SEQ ID NO: 542213 - RNA, 21 nt, Chlamydophila pneumoniae J138
ucuucaauaggaauuagagaa

SEQ ID NO: 542214 - RNA, 17 nt, Chlamydophila pneumoniae J138
ucuguacaacaaaauuu

SEQ ID NO: 542215 - RNA, 17 nt, Chlamydophila pneumoniae J138
ucuguagauuuucccua

SEQ ID NO: 542216 - RNA, 16 nt, Chlamydophila pneumoniae J138
ucuguaguuuguucac

SEQ ID NO: 542217 - RNA, 22 nt, Chlamydophila pneumoniae J138
ucuguaguuuguucacuuggua

SEQ ID NO: 542218 - RNA, 15 nt, Chlamydophila pneumoniae J138
ucuguagguuuuucc

SEQ ID NO: 542219 - RNA, 14 nt, Chlamydophila pneumoniae J138
ucuguaguaaagcc

SEQ ID NO: 542220 - RNA, 20 nt, Chlamydophila pneumoniae J138
ucuguaagaaaaugaggaca

SEQ ID NO: 542221 - RNA, 23 nt, Chlamydophila pneumoniae J138
ucugguuuuucgauuuggaagau

SEQ ID NO: 542222 - RNA, 18 nt, Chlamydophila pneumoniae J138
ucugguuaagcaccauaa

SEQ ID NO: 542223 - RNA, 22 nt, Chlamydophila pneumoniae J138
ucuguaucgauaacgauuucuu

SEQ ID NO: 542224 - RNA, 17 nt, Chlamydophila pneumoniae J138
ucuguaucgauaguuuu

SEQ ID NO: 542225 - RNA, 22 nt, Chlamydophila pneumoniae J138
ucugucauuaaaaauuuaaaag

SEQ ID NO: 542226 - RNA, 20 nt, Chlamydophila pneumoniae J138
ucugugugacgacaaaucac

SEQ ID NO: 542227 - RNA, 20 nt, Chlamydophila pneumoniae J138
ucugugguuuuuauucuuaa

SEQ ID NO: 542228 - RNA, 16 nt, Chlamydophila pneumoniae J138
ucugugcaucagucag

SEQ ID NO: 542229 - RNA, 18 nt, Chlamydophila pneumoniae J138
ucuggcugagagaagcag

SEQ ID NO: 542230 - RNA, 13 nt, Chlamydophila pneumoniae J138
ucugcuugucuac

SEQ ID NO: 542231 - RNA, 20 nt, Chlamydophila pneumoniae J138
ucugcagguaagggaugcuc

SEQ ID NO: 542232 - RNA, 23 nt, Chlamydophila pneumoniae J138
ucugcagguaagggaugcucuag

SEQ ID NO: 542233 - RNA, 21 nt, Chlamydophila pneumoniae J138
aaaugcaguucuuguuaaagu

SEQ ID NO: 542234 - RNA, 16 nt, Chlamydophila pneumoniae J138
aaaugcacuuugaaua

SEQ ID NO: 542235 - RNA, 22 nt, Chlamydophila pneumoniae J138
aaaugcaaaccaaaaaaguaac

SEQ ID NO: 542236 - RNA, 23 nt, Chlamydophila pneumoniae J138
aaaugauuuggccaacaguguag

SEQ ID NO: 542237 - RNA, 19 nt, Chlamydophila pneumoniae J138
ucuagcuguuaauucccgu

SEQ ID NO: 542238 - RNA, 18 nt, Chlamydophila pneumoniae J138
ucuaggacagcacauaga

SEQ ID NO: 542239 - RNA, 18 nt, Chlamydophila pneumoniae J138
ucuagggacguuguaucc

SEQ ID NO: 542240 - RNA, 17 nt, Chlamydophila pneumoniae J138
ucuagguuucaggaaau

SEQ ID NO: 542241 - RNA, 22 nt, Chlamydophila pneumoniae J138
ucuagaaaagauucuaaaucaa

SEQ ID NO: 542242 - RNA, 23 nt, Chlamydophila pneumoniae J138
ucuagaaaaugaagagcuuccau

SEQ ID NO: 542243 - RNA, 17 nt, Chlamydophila pneumoniae J138
ucuagaaacaacugaaa

SEQ ID NO: 542244 - RNA, 13 nt, Chlamydophila pneumoniae J138
ucuagaacacuca

SEQ ID NO: 542245 - RNA, 17 nt, Chlamydophila pneumoniae J138
ucuagaacacucagaga

SEQ ID NO: 542246 - RNA, 20 nt, Chlamydophila pneumoniae J138
ucuagauauucugauucucc

SEQ ID NO: 542247 - RNA, 13 nt, Chlamydophila pneumoniae J138
ucuagaucuucaa

SEQ ID NO: 542248 - RNA, 13 nt, Chlamydophila pneumoniae J138
ucuagcaaaucua

SEQ ID NO: 542249 - RNA, 13 nt, Chlamydophila pneumoniae J138
ucuagauuuugag

SEQ ID NO: 542250 - RNA, 23 nt, Chlamydophila pneumoniae J138
ucuagcauaguguuccaaaacag

SEQ ID NO: 542251 - RNA, 22 nt, Chlamydophila pneumoniae J138
ucuagcaguugcaauaccaauu

SEQ ID NO: 542252 - RNA, 22 nt, Chlamydophila pneumoniae J138
ucuagccaauauagaagcugcu

SEQ ID NO: 542253 - RNA, 14 nt, Chlamydophila pneumoniae J138
ucuauccaucaucg

SEQ ID NO: 542254 - RNA, 16 nt, Chlamydophila pneumoniae J138
ucuaucuuuauuuaaa

SEQ ID NO: 542255 - RNA, 18 nt, Chlamydophila pneumoniae J138
ucuaucuacacacaugac

SEQ ID NO: 542256 - RNA, 17 nt, Chlamydophila pneumoniae J138
ucuaucugcacuuucuu

SEQ ID NO: 542257 - RNA, 22 nt, Chlamydophila pneumoniae J138
ucuauggucucccucacaagaa

SEQ ID NO: 542258 - RNA, 21 nt, Chlamydophila pneumoniae J138
ucuaugguaagggauccauga

SEQ ID NO: 542259 - RNA, 22 nt, Chlamydophila pneumoniae J138
ucuaugauaucaccagguccuu

SEQ ID NO: 542260 - RNA, 23 nt, Chlamydophila pneumoniae J138
ucuaugagaguaaguuuuuaauc

SEQ ID NO: 542261 - RNA, 17 nt, Chlamydophila pneumoniae J138
ucuaugagauaggaacu

SEQ ID NO: 542262 - RNA, 16 nt, Chlamydophila pneumoniae J138
aaaugcauuugccccu

SEQ ID NO: 542263 - RNA, 13 nt, Chlamydophila pneumoniae J138
ucuaguuuuucuu

SEQ ID NO: 542264 - RNA, 13 nt, Chlamydophila pneumoniae J138
ucuauaaauucaa

SEQ ID NO: 542265 - RNA, 15 nt, Chlamydophila pneumoniae J138
ucuauauauccugag

SEQ ID NO: 542266 - RNA, 14 nt, Chlamydophila pneumoniae J138
ucuauauauccuga

SEQ ID NO: 542267 - RNA, 13 nt, Chlamydophila pneumoniae J138
ucuauauauccug

SEQ ID NO: 542268 - RNA, 18 nt, Chlamydophila pneumoniae J138
ucuauaucauuaagaaga

SEQ ID NO: 542269 - RNA, 16 nt, Chlamydophila pneumoniae J138
ucuauagaucuugaaa

SEQ ID NO: 542270 - RNA, 12 nt, Chlamydophila pneumoniae J138
ucuauagaguag

SEQ ID NO: 542271 - RNA, 21 nt, Chlamydophila pneumoniae J138
ucuauacgcuuaacaugaaaa

SEQ ID NO: 542272 - RNA, 14 nt, Chlamydophila pneumoniae J138
ucuauagaucuuga

SEQ ID NO: 542273 - RNA, 13 nt, Chlamydophila pneumoniae J138
ucuauaguucaug

SEQ ID NO: 542274 - RNA, 13 nt, Chlamydophila pneumoniae J138
ucucaauaauaga

SEQ ID NO: 542275 - RNA, 14 nt, Chlamydophila pneumoniae J138
ucucaagaucuuca

SEQ ID NO: 542276 - RNA, 20 nt, Chlamydophila pneumoniae J138
ucucaagaguaggcaauaca

SEQ ID NO: 542277 - RNA, 17 nt, Chlamydophila pneumoniae J138
ucucaagaucuucauca

SEQ ID NO: 542278 - RNA, 15 nt, Chlamydophila pneumoniae J138
ucucaacgcaauagg

SEQ ID NO: 542279 - RNA, 20 nt, Chlamydophila pneumoniae J138
ucucaaagacaugagggcau

SEQ ID NO: 542280 - RNA, 14 nt, Chlamydophila pneumoniae J138
ucuauuuucaggag

SEQ ID NO: 542281 - RNA, 15 nt, Chlamydophila pneumoniae J138
ucuauuugaaaagaa

SEQ ID NO: 542282 - RNA, 14 nt, Chlamydophila pneumoniae J138
ucuauuucugccuu

SEQ ID NO: 542283 - RNA, 13 nt, Chlamydophila pneumoniae J138
ucuauuucauaua

SEQ ID NO: 542284 - RNA, 20 nt, Chlamydophila pneumoniae J138
ucuauuucauauaaaguuuc

SEQ ID NO: 542285 - RNA, 18 nt, Chlamydophila pneumoniae J138
ucuauucgcugucuagaa

SEQ ID NO: 542286 - RNA, 20 nt, Chlamydophila pneumoniae J138
ucuauucucuucauuuucuu

SEQ ID NO: 542287 - RNA, 16 nt, Chlamydophila pneumoniae J138
ucuauguuuugacaua

SEQ ID NO: 542288 - RNA, 13 nt, Chlamydophila pneumoniae J138
ucuauuaaaaaua

SEQ ID NO: 542289 - RNA, 19 nt, Chlamydophila pneumoniae J138
ucuauuaaggauuccuuga

SEQ ID NO: 542290 - RNA, 18 nt, Chlamydophila pneumoniae J138
ucucagaaagccuuugcu

SEQ ID NO: 542291 - RNA, 13 nt, Chlamydophila pneumoniae J138
ucucagaaagccu

SEQ ID NO: 542292 - RNA, 17 nt, Chlamydophila pneumoniae J138
ucucagcuucaucagaa

SEQ ID NO: 542293 - RNA, 17 nt, Chlamydophila pneumoniae J138
ucucaguuaaagagcau

SEQ ID NO: 542294 - RNA, 18 nt, Chlamydophila pneumoniae J138
ucucagugaacucuucaa

SEQ ID NO: 542295 - RNA, 14 nt, Chlamydophila pneumoniae J138
ucucauaaguauag

SEQ ID NO: 542296 - RNA, 13 nt, Chlamydophila pneumoniae J138
ucucaccagaagc

SEQ ID NO: 542297 - RNA, 19 nt, Chlamydophila pneumoniae J138
aaaugccuuaaauguauug

SEQ ID NO: 542298 - RNA, 13 nt, Chlamydophila pneumoniae J138
aaaugccugaaaa

SEQ ID NO: 542299 - RNA, 21 nt, Chlamydophila pneumoniae J138
aaaugccucuuucauacuaaa

SEQ ID NO: 542300 - RNA, 21 nt, Chlamydophila pneumoniae J138
ucuaacgcuuuuucaaacugu

SEQ ID NO: 542301 - RNA, 15 nt, Chlamydophila pneumoniae J138
ucuaagaaaaugaau

SEQ ID NO: 542302 - RNA, 18 nt, Chlamydophila pneumoniae J138
ucuaagaaucguucuuag

SEQ ID NO: 542303 - RNA, 16 nt, Chlamydophila pneumoniae J138
ucuaagacuucuggaa

SEQ ID NO: 542304 - RNA, 16 nt, Chlamydophila pneumoniae J138
aaaucuuaguccauga

SEQ ID NO: 542305 - RNA, 19 nt, Chlamydophila pneumoniae J138
ucuaaggcauuggaaaucu

SEQ ID NO: 542306 - RNA, 20 nt, Chlamydophila pneumoniae J138
ucuaagcugugcauuuucuu

SEQ ID NO: 542307 - RNA, 14 nt, Chlamydophila pneumoniae J138
aaaucuuacauaaa

SEQ ID NO: 542308 - RNA, 20 nt, Chlamydophila pneumoniae J138
ucuaaggacaaaucucccaa

SEQ ID NO: 542309 - RNA, 16 nt, Chlamydophila pneumoniae J138
ucuaagcuuauuucug

SEQ ID NO: 542310 - RNA, 19 nt, Chlamydophila pneumoniae J138
ucuaagcuuauuucuguag

SEQ ID NO: 542311 - RNA, 17 nt, Chlamydophila pneumoniae J138
ucuaagcgcucuucaau

SEQ ID NO: 542312 - RNA, 21 nt, Chlamydophila pneumoniae J138
ucuaagcugaaagaacacucc

SEQ ID NO: 542313 - RNA, 16 nt, Chlamydophila pneumoniae J138
aaaucuuccccuaaaa

SEQ ID NO: 542314 - RNA, 19 nt, Chlamydophila pneumoniae J138
aaaucuuccccuaaaaauu

SEQ ID NO: 542315 - RNA, 16 nt, Chlamydophila pneumoniae J138
aaaucuuucaauguaa

SEQ ID NO: 542316 - RNA, 13 nt, Chlamydophila pneumoniae J138
aaaugaagccaaa

SEQ ID NO: 542317 - RNA, 16 nt, Chlamydophila pneumoniae J138
ucuaaggcuuugccuu

SEQ ID NO: 542318 - RNA, 20 nt, Chlamydophila pneumoniae J138
ucuaaagaaauguaagaagg

SEQ ID NO: 542319 - RNA, 13 nt, Chlamydophila pneumoniae J138
ucuaaagaaaugu

SEQ ID NO: 542320 - RNA, 15 nt, Chlamydophila pneumoniae J138
ucuaaagcagaaucc

SEQ ID NO: 542321 - RNA, 17 nt, Chlamydophila pneumoniae J138
ucuaaagguuuuaaauu

SEQ ID NO: 542322 - RNA, 22 nt, Chlamydophila pneumoniae J138
ucuaaagguuuuaaauuuagag

SEQ ID NO: 542323 - RNA, 21 nt, Chlamydophila pneumoniae J138
ucuaaaggaagauauccuuuu

SEQ ID NO: 542324 - RNA, 18 nt, Chlamydophila pneumoniae J138
ucuaaauggaugaucucc

SEQ ID NO: 542325 - RNA, 19 nt, Chlamydophila pneumoniae J138
ucuaaaagcacuuaaaaaa

SEQ ID NO: 542326 - RNA, 21 nt, Chlamydophila pneumoniae J138
ucuaaaacaccugcccauuuu

SEQ ID NO: 542327 - RNA, 14 nt, Chlamydophila pneumoniae J138
ucuaaaaacucuuc

SEQ ID NO: 542328 - RNA, 16 nt, Chlamydophila pneumoniae J138
ucuaaaaugaaauacu

SEQ ID NO: 542329 - RNA, 23 nt, Chlamydophila pneumoniae J138
ucuacgauguuuucuuauccuug

SEQ ID NO: 542330 - RNA, 17 nt, Chlamydophila pneumoniae J138
ucuacgcggagaaugcu

SEQ ID NO: 542331 - RNA, 15 nt, Chlamydophila pneumoniae J138
ucuacgccaucccau

SEQ ID NO: 542332 - RNA, 18 nt, Chlamydophila pneumoniae J138
ucuacgcuauucuuaagc

SEQ ID NO: 542333 - RNA, 24 nt, Chlamydophila pneumoniae J138
ucuacuaggcgcauaugcuccaga

SEQ ID NO: 542334 - RNA, 22 nt, Chlamydophila pneumoniae J138
ucuacuaggcgcauaugcucca

SEQ ID NO: 542335 - RNA, 15 nt, Chlamydophila pneumoniae J138
ucuacuaaaaucuca

SEQ ID NO: 542336 - RNA, 23 nt, Chlamydophila pneumoniae J138
ucuacugaaaccuucucucuuaa

SEQ ID NO: 542337 - RNA, 22 nt, Chlamydophila pneumoniae J138
ucuacucuacaguaguaaauaa

SEQ ID NO: 542338 - RNA, 12 nt, Chlamydophila pneumoniae J138
aaaugagaggga

SEQ ID NO: 542339 - RNA, 12 nt, Chlamydophila pneumoniae J138
aaaugagagacg

SEQ ID NO: 542340 - RNA, 21 nt, Chlamydophila pneumoniae J138
ucuacccuucagaauucucaa

SEQ ID NO: 542341 - RNA, 16 nt, Chlamydophila pneumoniae J138
ucuacccccagcuucu

SEQ ID NO: 542342 - RNA, 17 nt, Chlamydophila pneumoniae J138
aaaugaauauaauucca

SEQ ID NO: 542343 - RNA, 19 nt, Chlamydophila pneumoniae J138
ucuaaugacagcugagaaa

SEQ ID NO: 542344 - RNA, 15 nt, Chlamydophila pneumoniae J138
ucuaauacguuuuua

SEQ ID NO: 542345 - RNA, 20 nt, Chlamydophila pneumoniae J138
ucuaauuugaugaucgaucc

SEQ ID NO: 542346 - RNA, 22 nt, Chlamydophila pneumoniae J138
ucuacagauaggguaagauugc

SEQ ID NO: 542347 - RNA, 17 nt, Chlamydophila pneumoniae J138
ucuacaguaguaaauaa

SEQ ID NO: 542348 - RNA, 18 nt, Chlamydophila pneumoniae J138
ucuacaucuucuuggcuu

SEQ ID NO: 542349 - RNA, 20 nt, Chlamydophila pneumoniae J138
ucuacaaacagauuuuucaa

SEQ ID NO: 542350 - RNA, 23 nt, Chlamydophila pneumoniae J138
ucuacaaugauauaaaagcugaa

SEQ ID NO: 542351 - RNA, 20 nt, Chlamydophila pneumoniae J138
ucuacacuguuguaauaaaa

SEQ ID NO: 542352 - RNA, 12 nt, Chlamydophila pneumoniae J138
ucuacagaauag

SEQ ID NO: 542353 - RNA, 17 nt, Chlamydophila pneumoniae J138
ucuacagaggaaucuau

SEQ ID NO: 542354 - RNA, 19 nt, Chlamydophila pneumoniae J138
uauccaugacuuuuguugc

SEQ ID NO: 542355 - RNA, 13 nt, Chlamydophila pneumoniae J138
uauuauugaauaa

SEQ ID NO: 542356 - RNA, 20 nt, Chlamydophila pneumoniae J138
uauucagguucugaaauugu

SEQ ID NO: 542357 - RNA, 15 nt, Chlamydophila pneumoniae J138
uauuccaucacaguu

SEQ ID NO: 542358 - RNA, 19 nt, Chlamydophila pneumoniae J138
uauuccucuuaggagagcu

SEQ ID NO: 542359 - RNA, 19 nt, Chlamydophila pneumoniae J138
uauuccuuggauuucuucu

SEQ ID NO: 542360 - RNA, 14 nt, Chlamydophila pneumoniae J138
uauuccaucacagu

SEQ ID NO: 542361 - RNA, 22 nt, Chlamydophila pneumoniae J138
uauuccauaaaaauguaauuuu

SEQ ID NO: 542362 - RNA, 13 nt, Chlamydophila pneumoniae J138
uauucucaggaac

SEQ ID NO: 542363 - RNA, 18 nt, Chlamydophila pneumoniae J138
uauucucuucauuuucuu

SEQ ID NO: 542364 - RNA, 20 nt, Chlamydophila pneumoniae J138
uauuuagcauuucucuauga

SEQ ID NO: 542365 - RNA, 18 nt, Chlamydophila pneumoniae J138
uauuuagagagaaacauc

SEQ ID NO: 542366 - RNA, 13 nt, Chlamydophila pneumoniae J138
uauuuagagagaa

SEQ ID NO: 542367 - RNA, 16 nt, Chlamydophila pneumoniae J138
uauuuacgaaaacauc

SEQ ID NO: 542368 - RNA, 17 nt, Chlamydophila pneumoniae J138
uauuuacgaaaacaucu

SEQ ID NO: 542369 - RNA, 20 nt, Chlamydophila pneumoniae J138
uauuuaccuacagauaugcu

SEQ ID NO: 542370 - RNA, 13 nt, Chlamydophila pneumoniae J138
uauugauagcuga

SEQ ID NO: 542371 - RNA, 20 nt, Chlamydophila pneumoniae J138
uauugauaaugauuccuaga

SEQ ID NO: 542372 - RNA, 16 nt, Chlamydophila pneumoniae J138
uauugaagucuucuug

SEQ ID NO: 542373 - RNA, 18 nt, Chlamydophila pneumoniae J138
uauugacuagcucucuug

SEQ ID NO: 542374 - RNA, 19 nt, Chlamydophila pneumoniae J138
uauugacuuuggucuucug

SEQ ID NO: 542375 - RNA, 14 nt, Chlamydophila pneumoniae J138
ucaaagacaggcuc

SEQ ID NO: 542376 - RNA, 18 nt, Chlamydophila pneumoniae J138
ucaaagacucaugaaaua

SEQ ID NO: 542377 - RNA, 21 nt, Chlamydophila pneumoniae J138
ucaaaggcaacgcgauuuuca

SEQ ID NO: 542378 - RNA, 21 nt, Chlamydophila pneumoniae J138
ucaaaggcaauagcagcagcg

SEQ ID NO: 542379 - RNA, 18 nt, Chlamydophila pneumoniae J138
ucaaacccucuccagaag

SEQ ID NO: 542380 - RNA, 16 nt, Chlamydophila pneumoniae J138
ucaaagaauacucuaa

SEQ ID NO: 542381 - RNA, 13 nt, Chlamydophila pneumoniae J138
ucaaaaagcuccc

SEQ ID NO: 542382 - RNA, 14 nt, Chlamydophila pneumoniae J138
ucaaaaagagagcc

SEQ ID NO: 542383 - RNA, 21 nt, Chlamydophila pneumoniae J138
ucaaaaaaaacgccauacuga

SEQ ID NO: 542384 - RNA, 13 nt, Chlamydophila pneumoniae J138
ucaaaaaaaagac

SEQ ID NO: 542385 - RNA, 24 nt, Chlamydophila pneumoniae J138
uauuuuuuacguucuuucuuucua

SEQ ID NO: 542386 - RNA, 14 nt, Chlamydophila pneumoniae J138
uauuuuuaaauaaa

SEQ ID NO: 542387 - RNA, 15 nt, Chlamydophila pneumoniae J138
uauuuugucuuuuua

SEQ ID NO: 542388 - RNA, 14 nt, Chlamydophila pneumoniae J138
uauuuuaaagucac

SEQ ID NO: 542389 - RNA, 22 nt, Chlamydophila pneumoniae J138
uauuugcaacaaucuuucuucu

SEQ ID NO: 542390 - RNA, 23 nt, Chlamydophila pneumoniae J138
uauuugcaacaaucuuucuucua

SEQ ID NO: 542391 - RNA, 21 nt, Chlamydophila pneumoniae J138
uauuuggacguacuaagauac

SEQ ID NO: 542392 - RNA, 16 nt, Chlamydophila pneumoniae J138
uauuugaauaaaggac

SEQ ID NO: 542393 - RNA, 12 nt, Chlamydophila pneumoniae J138
uauuucuuaauu

SEQ ID NO: 542394 - RNA, 13 nt, Chlamydophila pneumoniae J138
uauuucuauuauu

SEQ ID NO: 542395 - RNA, 14 nt, Chlamydophila pneumoniae J138
uauuucuauuauuu

SEQ ID NO: 542396 - RNA, 17 nt, Chlamydophila pneumoniae J138
uauuucucuaucaucaa

SEQ ID NO: 542397 - RNA, 15 nt, Chlamydophila pneumoniae J138
ucaagaacuccuuug

SEQ ID NO: 542398 - RNA, 16 nt, Chlamydophila pneumoniae J138
ucaacugguauagacu

SEQ ID NO: 542399 - RNA, 23 nt, Chlamydophila pneumoniae J138
ucaagaccuaagcucauaagaaa

SEQ ID NO: 542400 - RNA, 22 nt, Chlamydophila pneumoniae J138
ucaagaccuaagcucauaagaa

SEQ ID NO: 542401 - RNA, 18 nt, Chlamydophila pneumoniae J138
ucaagaguaggcaauaca

SEQ ID NO: 542402 - RNA, 15 nt, Chlamydophila pneumoniae J138
ucaagagcuuuuaca

SEQ ID NO: 542403 - RNA, 18 nt, Chlamydophila pneumoniae J138
ucaagaggagugaaagcu

SEQ ID NO: 542404 - RNA, 21 nt, Chlamydophila pneumoniae J138
ucaagagauagagauaaguca

SEQ ID NO: 542405 - RNA, 18 nt, Chlamydophila pneumoniae J138
ucaaaucuuucaaggaac

SEQ ID NO: 542406 - RNA, 22 nt, Chlamydophila pneumoniae J138
ucaaaucucauuccagcaucuu

SEQ ID NO: 542407 - RNA, 14 nt, Chlamydophila pneumoniae J138
ucaaguaagaaguc

SEQ ID NO: 542408 - RNA, 12 nt, Chlamydophila pneumoniae J138
ucaaggcaucua

SEQ ID NO: 542409 - RNA, 20 nt, Chlamydophila pneumoniae J138
ucaaggcaucuucuuugcca

SEQ ID NO: 542410 - RNA, 15 nt, Chlamydophila pneumoniae J138
ucaaggccuauagau

SEQ ID NO: 542411 - RNA, 16 nt, Chlamydophila pneumoniae J138
ucaagccacagagaau

SEQ ID NO: 542412 - RNA, 13 nt, Chlamydophila pneumoniae J138
ucaaucucuccuu

SEQ ID NO: 542413 - RNA, 18 nt, Chlamydophila pneumoniae J138
ucaaucucuuugacaucu

SEQ ID NO: 542414 - RNA, 17 nt, Chlamydophila pneumoniae J138
ucaauggcgauaaaugc

SEQ ID NO: 542415 - RNA, 15 nt, Chlamydophila pneumoniae J138
ucaaugaagaaaaau

SEQ ID NO: 542416 - RNA, 20 nt, Chlamydophila pneumoniae J138
ucaauccccugcaucucugc

SEQ ID NO: 542417 - RNA, 14 nt, Chlamydophila pneumoniae J138
ucaaucaaauucaa

SEQ ID NO: 542418 - RNA, 14 nt, Chlamydophila pneumoniae J138
ucacaaugaucuuu

SEQ ID NO: 542419 - RNA, 15 nt, Chlamydophila pneumoniae J138
ucacaagugcauuau

SEQ ID NO: 542420 - RNA, 22 nt, Chlamydophila pneumoniae J138
ucacaagcugguagacuucuug

SEQ ID NO: 542421 - RNA, 17 nt, Chlamydophila pneumoniae J138
ucacaagcaguaacugc

SEQ ID NO: 542422 - RNA, 19 nt, Chlamydophila pneumoniae J138
ucaauuucuucaucaauac

SEQ ID NO: 542423 - RNA, 12 nt, Chlamydophila pneumoniae J138
ucacaaagaauu

SEQ ID NO: 542424 - RNA, 23 nt, Chlamydophila pneumoniae J138
ucacaaaucuuccccuaaaaauu

SEQ ID NO: 542425 - RNA, 13 nt, Chlamydophila pneumoniae J138
ucaccaacuccuc

SEQ ID NO: 542426 - RNA, 15 nt, Chlamydophila pneumoniae J138
ucaccaacuccucua

SEQ ID NO: 542427 - RNA, 22 nt, Chlamydophila pneumoniae J138
ucacauuugcuuuaacagaagc

SEQ ID NO: 542428 - RNA, 18 nt, Chlamydophila pneumoniae J138
ucacacuacauucaggau

SEQ ID NO: 542429 - RNA, 21 nt, Chlamydophila pneumoniae J138
ucaccauuaagauaucugcuc

SEQ ID NO: 542430 - RNA, 20 nt, Chlamydophila pneumoniae J138
ucaccagaagcaacuaaacu

SEQ ID NO: 542431 - RNA, 20 nt, Chlamydophila pneumoniae J138
ucaccacaaaccucuaaaaa

SEQ ID NO: 542432 - RNA, 22 nt, Chlamydophila pneumoniae J138
ucaccgcgcauagcaacuacag

SEQ ID NO: 542433 - RNA, 18 nt, Chlamydophila pneumoniae J138
ucaccgcgcauagcaacu

SEQ ID NO: 542434 - RNA, 13 nt, Chlamydophila pneumoniae J138
ucaccuugugaga

SEQ ID NO: 542435 - RNA, 15 nt, Chlamydophila pneumoniae J138
ucaccuuagagugac

SEQ ID NO: 542436 - RNA, 13 nt, Chlamydophila pneumoniae J138
ucaccuuacaucc

SEQ ID NO: 542437 - RNA, 15 nt, Chlamydophila pneumoniae J138
ucaccuacaucagac

SEQ ID NO: 542438 - RNA, 16 nt, Chlamydophila pneumoniae J138
ucacucaaacccucuc

SEQ ID NO: 542439 - RNA, 15 nt, Chlamydophila pneumoniae J138
ucacuaagauaucuc

SEQ ID NO: 542440 - RNA, 14 nt, Chlamydophila pneumoniae J138
ucacguaagguguc

SEQ ID NO: 542441 - RNA, 14 nt, Chlamydophila pneumoniae J138
ucacgauuucggga

SEQ ID NO: 542442 - RNA, 15 nt, Chlamydophila pneumoniae J138
ucacgcucucgcuaa

SEQ ID NO: 542443 - RNA, 13 nt, Chlamydophila pneumoniae J138
uccagcuccauaa

SEQ ID NO: 542444 - RNA, 17 nt, Chlamydophila pneumoniae J138
uccagcgaggagaagua

SEQ ID NO: 542445 - RNA, 21 nt, Chlamydophila pneumoniae J138
uccagccugcaccagacccuc

SEQ ID NO: 542446 - RNA, 10 nt, Chlamydophila pneumoniae J138
uccagccccc

SEQ ID NO: 542447 - RNA, 20 nt, Chlamydophila pneumoniae J138
uccaguuuguugaucucuaa

SEQ ID NO: 542448 - RNA, 14 nt, Chlamydophila pneumoniae J138
uccaguuuuuuaaa

SEQ ID NO: 542449 - RNA, 16 nt, Chlamydophila pneumoniae J138
uccaguaucuucucuu

SEQ ID NO: 542450 - RNA, 18 nt, Chlamydophila pneumoniae J138
uccaguagaucuucugaa

SEQ ID NO: 542451 - RNA, 22 nt, Chlamydophila pneumoniae J138
uccaguagaucuucugaaauca

SEQ ID NO: 542452 - RNA, 12 nt, Chlamydophila pneumoniae J138
uccauaaaaaug

SEQ ID NO: 542453 - RNA, 20 nt, Chlamydophila pneumoniae J138
uccauaaaaauguaauuuuu

SEQ ID NO: 542454 - RNA, 19 nt, Chlamydophila pneumoniae J138
uccauaagcuuuucuucca

SEQ ID NO: 542455 - RNA, 20 nt, Chlamydophila pneumoniae J138
uccauaaugcugagaugguc

SEQ ID NO: 542456 - RNA, 18 nt, Chlamydophila pneumoniae J138
uccauaauuucuuucaca

SEQ ID NO: 542457 - RNA, 16 nt, Chlamydophila pneumoniae J138
uccauaauuucuuuca

SEQ ID NO: 542458 - RNA, 12 nt, Chlamydophila pneumoniae J138
uccauacaggcu

SEQ ID NO: 542459 - RNA, 15 nt, Chlamydophila pneumoniae J138
uccaggaauagaaag

SEQ ID NO: 542460 - RNA, 16 nt, Chlamydophila pneumoniae J138
uccagggacagaaguc

SEQ ID NO: 542461 - RNA, 22 nt, Chlamydophila pneumoniae J138
uccaggguagcgcuuuuuuaaa

SEQ ID NO: 542462 - RNA, 15 nt, Chlamydophila pneumoniae J138
uccagcuucuuucua

SEQ ID NO: 542463 - RNA, 16 nt, Chlamydophila pneumoniae J138
uccagauuagaaaaga

SEQ ID NO: 542464 - RNA, 21 nt, Chlamydophila pneumoniae J138
uccagagacaaagccacagcc

SEQ ID NO: 542465 - RNA, 18 nt, Chlamydophila pneumoniae J138
uccacgaaggaaucugau

SEQ ID NO: 542466 - RNA, 22 nt, Chlamydophila pneumoniae J138
uccaccgcucacacgaauaauu

SEQ ID NO: 542467 - RNA, 15 nt, Chlamydophila pneumoniae J138
uccaccaagacugaa

SEQ ID NO: 542468 - RNA, 20 nt, Chlamydophila pneumoniae J138
uccaaaggaaaauaaucuuc

SEQ ID NO: 542469 - RNA, 12 nt, Chlamydophila pneumoniae J138
uccaaauaaagc

SEQ ID NO: 542470 - RNA, 17 nt, Chlamydophila pneumoniae J138
uccaauuguaaaucauu

SEQ ID NO: 542471 - RNA, 14 nt, Chlamydophila pneumoniae J138
uccaauuuucuuca

SEQ ID NO: 542472 - RNA, 13 nt, Chlamydophila pneumoniae J138
uccacaagccucc

SEQ ID NO: 542473 - RNA, 18 nt, Chlamydophila pneumoniae J138
uccacagggucuaguuca

SEQ ID NO: 542474 - RNA, 19 nt, Chlamydophila pneumoniae J138
ucauuuaucugcguuucuu

SEQ ID NO: 542475 - RNA, 20 nt, Chlamydophila pneumoniae J138
ucauuuaucugcguuucuuu

SEQ ID NO: 542476 - RNA, 15 nt, Chlamydophila pneumoniae J138
ucauuuuaguuuuca

SEQ ID NO: 542477 - RNA, 15 nt, Chlamydophila pneumoniae J138
uccaaaaacuucuaa

SEQ ID NO: 542478 - RNA, 21 nt, Chlamydophila pneumoniae J138
uccaaaaaaugcuccugcaaa

SEQ ID NO: 542479 - RNA, 14 nt, Chlamydophila pneumoniae J138
uccaaaaaagagcc

SEQ ID NO: 542480 - RNA, 12 nt, Chlamydophila pneumoniae J138
ucauuuuuuaau

SEQ ID NO: 542481 - RNA, 13 nt, Chlamydophila pneumoniae J138
ucauuuuuuaaua

SEQ ID NO: 542482 - RNA, 17 nt, Chlamydophila pneumoniae J138
uccaaaagaccaaaaau

SEQ ID NO: 542483 - RNA, 16 nt, Chlamydophila pneumoniae J138
uccaaaauaaaaggag

SEQ ID NO: 542484 - RNA, 22 nt, Chlamydophila pneumoniae J138
uccaaaauaaucucgcaguccu

SEQ ID NO: 542485 - RNA, 12 nt, Chlamydophila pneumoniae J138
uccaaaaucauc

SEQ ID NO: 542486 - RNA, 12 nt, Chlamydophila pneumoniae J138
uccaaaacucaa

SEQ ID NO: 542487 - RNA, 14 nt, Chlamydophila pneumoniae J138
ucauuaccugcuaa

SEQ ID NO: 542488 - RNA, 16 nt, Chlamydophila pneumoniae J138
ucauuacggaggcaua

SEQ ID NO: 542489 - RNA, 11 nt, Chlamydophila pneumoniae J138
ucauuauuaaa

SEQ ID NO: 542490 - RNA, 12 nt, Chlamydophila pneumoniae J138
ucauuaagaucc

SEQ ID NO: 542491 - RNA, 13 nt, Chlamydophila pneumoniae J138
ucauuaaguacug

SEQ ID NO: 542492 - RNA, 18 nt, Chlamydophila pneumoniae J138
ucauuaauaauaucuaac

SEQ ID NO: 542493 - RNA, 14 nt, Chlamydophila pneumoniae J138
ucauuaauguugcu

SEQ ID NO: 542494 - RNA, 21 nt, Chlamydophila pneumoniae J138
ucauguccuccauggaaagaa

SEQ ID NO: 542495 - RNA, 16 nt, Chlamydophila pneumoniae J138
ucaugauaaaaauuuu

SEQ ID NO: 542496 - RNA, 20 nt, Chlamydophila pneumoniae J138
ucaugauauuuuuauuuaaa

SEQ ID NO: 542497 - RNA, 11 nt, Chlamydophila pneumoniae J138
ucaugaaagug

SEQ ID NO: 542498 - RNA, 13 nt, Chlamydophila pneumoniae J138
ucaugaaaaggau

SEQ ID NO: 542499 - RNA, 20 nt, Chlamydophila pneumoniae J138
ucaugccgcauuucuucaau

SEQ ID NO: 542500 - RNA, 17 nt, Chlamydophila pneumoniae J138
ucaugcgcuaccuuagu

SEQ ID NO: 542501 - RNA, 21 nt, Chlamydophila pneumoniae J138
ucaugcggacuuuauucucuu

SEQ ID NO: 542502 - RNA, 14 nt, Chlamydophila pneumoniae J138
ucaucuuccucuuu

SEQ ID NO: 542503 - RNA, 21 nt, Chlamydophila pneumoniae J138
ucaucugucauuaaaaauuua

SEQ ID NO: 542504 - RNA, 18 nt, Chlamydophila pneumoniae J138
ucaucuacgauguuuucu

SEQ ID NO: 542505 - RNA, 23 nt, Chlamydophila pneumoniae J138
ucaucucguugggcucauaaccc

SEQ ID NO: 542506 - RNA, 18 nt, Chlamydophila pneumoniae J138
ucaucacaauuuuaaaau

SEQ ID NO: 542507 - RNA, 17 nt, Chlamydophila pneumoniae J138
ucaucaaugguuaaaac

SEQ ID NO: 542508 - RNA, 15 nt, Chlamydophila pneumoniae J138
ucaucaaagcaaaga

SEQ ID NO: 542509 - RNA, 22 nt, Chlamydophila pneumoniae J138
ucauauuuugucuucaucauaa

SEQ ID NO: 542510 - RNA, 15 nt, Chlamydophila pneumoniae J138
ucauauuuaaaaggc

SEQ ID NO: 542511 - RNA, 15 nt, Chlamydophila pneumoniae J138
ucauauuuauuuaaa

SEQ ID NO: 542512 - RNA, 19 nt, Chlamydophila pneumoniae J138
ucauauaaaacgaucccua

SEQ ID NO: 542513 - RNA, 19 nt, Chlamydophila pneumoniae J138
ucauauaaaguuuccaagu

SEQ ID NO: 542514 - RNA, 23 nt, Chlamydophila pneumoniae J138
ucauacgccgugccuauagaaau

SEQ ID NO: 542515 - RNA, 15 nt, Chlamydophila pneumoniae J138
ucaucagcaaaacuc

SEQ ID NO: 542516 - RNA, 13 nt, Chlamydophila pneumoniae J138
ucaucagaagcuc

SEQ ID NO: 542517 - RNA, 12 nt, Chlamydophila pneumoniae J138
ucaucagaagug

SEQ ID NO: 542518 - RNA, 23 nt, Chlamydophila pneumoniae J138
ucaucagaaguggccuugccagu

SEQ ID NO: 542519 - RNA, 21 nt, Chlamydophila pneumoniae J138
ucaucagcuucccaauuguau

SEQ ID NO: 542520 - RNA, 19 nt, Chlamydophila pneumoniae J138
ucaucauaaauaggcucua

SEQ ID NO: 542521 - RNA, 16 nt, Chlamydophila pneumoniae J138
ucaucaguaaaagacu

SEQ ID NO: 542522 - RNA, 17 nt, Chlamydophila pneumoniae J138
ucauccagauuagaaaa

SEQ ID NO: 542523 - RNA, 14 nt, Chlamydophila pneumoniae J138
ucaucauuucuaca

SEQ ID NO: 542524 - RNA, 14 nt, Chlamydophila pneumoniae J138
ucauccccucagaa

SEQ ID NO: 542525 - RNA, 15 nt, Chlamydophila pneumoniae J138
ucauccccucagaaa

SEQ ID NO: 542526 - RNA, 23 nt, Chlamydophila pneumoniae J138
ucauccccucagaaaggagaucc

SEQ ID NO: 542527 - RNA, 16 nt, Chlamydophila pneumoniae J138
ucauccucaucaucag

SEQ ID NO: 542528 - RNA, 23 nt, Chlamydophila pneumoniae J138
ucauccuuuagcuguuucucugu

SEQ ID NO: 542529 - RNA, 13 nt, Chlamydophila pneumoniae J138
ucaucgauaggau

SEQ ID NO: 542530 - RNA, 16 nt, Chlamydophila pneumoniae J138
ucaucgcaaucaaaga

SEQ ID NO: 542531 - RNA, 21 nt, Chlamydophila pneumoniae J138
ucaucggaucuuuucuuucua

SEQ ID NO: 542532 - RNA, 18 nt, Chlamydophila pneumoniae J138
ucaucggcauaacuuuau

SEQ ID NO: 542533 - RNA, 21 nt, Chlamydophila pneumoniae J138
ucaucgcgagaggggaaccaa

SEQ ID NO: 542534 - RNA, 22 nt, Chlamydophila pneumoniae J138
ucaggauucuaaaaagaaaaga

SEQ ID NO: 542535 - RNA, 19 nt, Chlamydophila pneumoniae J138
ucagggggaaagccaagaa

SEQ ID NO: 542536 - RNA, 14 nt, Chlamydophila pneumoniae J138
ucaguaaauauuuu

SEQ ID NO: 542537 - RNA, 14 nt, Chlamydophila pneumoniae J138
ucauaaccugggca

SEQ ID NO: 542538 - RNA, 13 nt, Chlamydophila pneumoniae J138
ucauaagaaauuc

SEQ ID NO: 542539 - RNA, 23 nt, Chlamydophila pneumoniae J138
ucauaaagugcgagguaugaaua

SEQ ID NO: 542540 - RNA, 19 nt, Chlamydophila pneumoniae J138
ucauaaaguauauugacaa

SEQ ID NO: 542541 - RNA, 14 nt, Chlamydophila pneumoniae J138
ucauaaauaggcuc

SEQ ID NO: 542542 - RNA, 10 nt, Chlamydophila pneumoniae J138
ucauaaacaa

SEQ ID NO: 542543 - RNA, 15 nt, Chlamydophila pneumoniae J138
ucauaaacagcagug

SEQ ID NO: 542544 - RNA, 13 nt, Chlamydophila pneumoniae J138
ucauaaagaggaa

SEQ ID NO: 542545 - RNA, 14 nt, Chlamydophila pneumoniae J138
ucauaaagaggaau

SEQ ID NO: 542546 - RNA, 19 nt, Chlamydophila pneumoniae J138
ucauaaagaggaaugaaga

SEQ ID NO: 542547 - RNA, 18 nt, Chlamydophila pneumoniae J138
ucauaaagaggaaugaag

SEQ ID NO: 542548 - RNA, 16 nt, Chlamydophila pneumoniae J138
ucagcucaaguuggca

SEQ ID NO: 542549 - RNA, 19 nt, Chlamydophila pneumoniae J138
ucagcuagagcacauagaa

SEQ ID NO: 542550 - RNA, 21 nt, Chlamydophila pneumoniae J138
ucagcuaauuuaaaugccuua

SEQ ID NO: 542551 - RNA, 16 nt, Chlamydophila pneumoniae J138
ucagcuuguuuuugca

SEQ ID NO: 542552 - RNA, 16 nt, Chlamydophila pneumoniae J138
ucagcuuuaacaugcc

SEQ ID NO: 542553 - RNA, 19 nt, Chlamydophila pneumoniae J138
ucagcuucuugauguacag

SEQ ID NO: 542554 - RNA, 15 nt, Chlamydophila pneumoniae J138
ucagcuucuacagca

SEQ ID NO: 542555 - RNA, 14 nt, Chlamydophila pneumoniae J138
ucagcuucuugaug

SEQ ID NO: 542556 - RNA, 20 nt, Chlamydophila pneumoniae J138
ucagcuuaucuauagcauug

SEQ ID NO: 542557 - RNA, 16 nt, Chlamydophila pneumoniae J138
ucagcuggguaagucc

SEQ ID NO: 542558 - RNA, 19 nt, Chlamydophila pneumoniae J138
ucaggaaagguaguuuucu

SEQ ID NO: 542559 - RNA, 23 nt, Chlamydophila pneumoniae J138
ucaggaaagguaguuuucuucuu

SEQ ID NO: 542560 - RNA, 21 nt, Chlamydophila pneumoniae J138
ucaggaagaaaggauuggaug

SEQ ID NO: 542561 - RNA, 19 nt, Chlamydophila pneumoniae J138
ucagccugucuauaaaaua

SEQ ID NO: 542562 - RNA, 13 nt, Chlamydophila pneumoniae J138
ucacucuaugaga

SEQ ID NO: 542563 - RNA, 13 nt, Chlamydophila pneumoniae J138
ucacucuuuuauu

SEQ ID NO: 542564 - RNA, 23 nt, Chlamydophila pneumoniae J138
ucacugucggaaguuucagagcc

SEQ ID NO: 542565 - RNA, 16 nt, Chlamydophila pneumoniae J138
ucacuuauaagcugcu

SEQ ID NO: 542566 - RNA, 17 nt, Chlamydophila pneumoniae J138
ucacuuauaagcugcuu

SEQ ID NO: 542567 - RNA, 12 nt, Chlamydophila pneumoniae J138
uaggcccaagaa

SEQ ID NO: 542568 - RNA, 16 nt, Chlamydophila pneumoniae J138
uaggcagauagacaac

SEQ ID NO: 542569 - RNA, 22 nt, Chlamydophila pneumoniae J138
uaggcauacaguagaaacaugg

SEQ ID NO: 542570 - RNA, 22 nt, Chlamydophila pneumoniae J138
uaggcaguggcucuauagggga

SEQ ID NO: 542571 - RNA, 19 nt, Chlamydophila pneumoniae J138
uaggcacaucauuaucaua

SEQ ID NO: 542572 - RNA, 16 nt, Chlamydophila pneumoniae J138
uagggcauucuguaau

SEQ ID NO: 542573 - RNA, 18 nt, Chlamydophila pneumoniae J138
uagggcaggcggaaagga

SEQ ID NO: 542574 - RNA, 21 nt, Chlamydophila pneumoniae J138
uagggcaggcggaaaggaagg

SEQ ID NO: 542575 - RNA, 22 nt, Chlamydophila pneumoniae J138
uagggcaggcggaaaggaagga

SEQ ID NO: 542576 - RNA, 16 nt, Chlamydophila pneumoniae J138
uagggaagaaauuaac

SEQ ID NO: 542577 - RNA, 16 nt, Chlamydophila pneumoniae J138
uagggagugaggaauc

SEQ ID NO: 542578 - RNA, 19 nt, Chlamydophila pneumoniae J138
uaggcucuuuagcaaacau

SEQ ID NO: 542579 - RNA, 17 nt, Chlamydophila pneumoniae J138
uaggcuuaauaaacauc

SEQ ID NO: 542580 - RNA, 23 nt, Chlamydophila pneumoniae J138
uaggcuuuuuucuauuuucagga

SEQ ID NO: 542581 - RNA, 14 nt, Chlamydophila pneumoniae J138
uagggaaaaaguag

SEQ ID NO: 542582 - RNA, 14 nt, Chlamydophila pneumoniae J138
uagggguuucccug

SEQ ID NO: 542583 - RNA, 23 nt, Chlamydophila pneumoniae J138
uagggguagugaucugcagcaag

SEQ ID NO: 542584 - RNA, 23 nt, Chlamydophila pneumoniae J138
uaggggaauuaaacuuucuucuc

SEQ ID NO: 542585 - RNA, 24 nt, Chlamydophila pneumoniae J138
uagguaaggaaacgauuucuucuu

SEQ ID NO: 542586 - RNA, 21 nt, Chlamydophila pneumoniae J138
uaggguuugcaugccuauuaa

SEQ ID NO: 542587 - RNA, 13 nt, Chlamydophila pneumoniae J138
uaggguucucaaa

SEQ ID NO: 542588 - RNA, 22 nt, Chlamydophila pneumoniae J138
uaggugaaauauugaucuuucc

SEQ ID NO: 542589 - RNA, 13 nt, Chlamydophila pneumoniae J138
uagguuucaggaa

SEQ ID NO: 542590 - RNA, 16 nt, Chlamydophila pneumoniae J138
uaggugacccacgcau

SEQ ID NO: 542591 - RNA, 12 nt, Chlamydophila pneumoniae J138
uaggucuugucu

SEQ ID NO: 542592 - RNA, 14 nt, Chlamydophila pneumoniae J138
uaggucucuugcca

SEQ ID NO: 542593 - RNA, 19 nt, Chlamydophila pneumoniae J138
uaggucuuaaaguagccau

SEQ ID NO: 542594 - RNA, 22 nt, Chlamydophila pneumoniae J138
uaguaucgagcucuuuaagaac

SEQ ID NO: 542595 - RNA, 20 nt, Chlamydophila pneumoniae J138
uaguauuuuuaaauacagau

SEQ ID NO: 542596 - RNA, 22 nt, Chlamydophila pneumoniae J138
uaguaaagcauuggacaacgcu

SEQ ID NO: 542597 - RNA, 21 nt, Chlamydophila pneumoniae J138
uaguaaagccacauucuucug

SEQ ID NO: 542598 - RNA, 23 nt, Chlamydophila pneumoniae J138
uagguuugucgagcuuuaagaag

SEQ ID NO: 542599 - RNA, 17 nt, Chlamydophila pneumoniae J138
uaguaaaauaagaaauc

SEQ ID NO: 542600 - RNA, 13 nt, Chlamydophila pneumoniae J138
uaguucauggggu

SEQ ID NO: 542601 - RNA, 12 nt, Chlamydophila pneumoniae J138
uaguucauuagc

SEQ ID NO: 542602 - RNA, 20 nt, Chlamydophila pneumoniae J138
uaguucaucauauuuuucuu

SEQ ID NO: 542603 - RNA, 13 nt, Chlamydophila pneumoniae J138
uaguguugaauaa

SEQ ID NO: 542604 - RNA, 15 nt, Chlamydophila pneumoniae J138
uaguguuagaugaag

SEQ ID NO: 542605 - RNA, 14 nt, Chlamydophila pneumoniae J138
uaguuauuaauaaa

SEQ ID NO: 542606 - RNA, 21 nt, Chlamydophila pneumoniae J138
uagugucaucggcuucuccaa

SEQ ID NO: 542607 - RNA, 16 nt, Chlamydophila pneumoniae J138
uaguguauaucagcaa

SEQ ID NO: 542608 - RNA, 19 nt, Chlamydophila pneumoniae J138
uagugcauaccuuaccauc

SEQ ID NO: 542609 - RNA, 19 nt, Chlamydophila pneumoniae J138
uagugcgaugggaagagag

SEQ ID NO: 542610 - RNA, 23 nt, Chlamydophila pneumoniae J138
uagucaugauuuuucaaucaaua

SEQ ID NO: 542611 - RNA, 15 nt, Chlamydophila pneumoniae J138
uagucaaaaauucuu

SEQ ID NO: 542612 - RNA, 21 nt, Chlamydophila pneumoniae J138
uaguuuuugcuguuucuucug

SEQ ID NO: 542613 - RNA, 17 nt, Chlamydophila pneumoniae J138
uaguuuuuauuuuuaaa

SEQ ID NO: 542614 - RNA, 20 nt, Chlamydophila pneumoniae J138
uaguuuuuauuuuuaaauaa

SEQ ID NO: 542615 - RNA, 22 nt, Chlamydophila pneumoniae J138
uaguuugccuucuuaucuucua

SEQ ID NO: 542616 - RNA, 11 nt, Chlamydophila pneumoniae J138
uaguuuucaua

SEQ ID NO: 542617 - RNA, 22 nt, Chlamydophila pneumoniae J138
uauaaauucaagacuauagaaa

SEQ ID NO: 542618 - RNA, 13 nt, Chlamydophila pneumoniae J138
uauaaagaagaaa

SEQ ID NO: 542619 - RNA, 14 nt, Chlamydophila pneumoniae J138
uauauagagcagac

SEQ ID NO: 542620 - RNA, 19 nt, Chlamydophila pneumoniae J138
uauauaagauaauagagaa

SEQ ID NO: 542621 - RNA, 20 nt, Chlamydophila pneumoniae J138
uauaguauaauagugagcuc

SEQ ID NO: 542622 - RNA, 21 nt, Chlamydophila pneumoniae J138
uauaguagcgaauccagaauu

SEQ ID NO: 542623 - RNA, 18 nt, Chlamydophila pneumoniae J138
uauagagaauacauugcu

SEQ ID NO: 542624 - RNA, 17 nt, Chlamydophila pneumoniae J138
uauagauaugccucagg

SEQ ID NO: 542625 - RNA, 17 nt, Chlamydophila pneumoniae J138
uauagaagcugcugcua

SEQ ID NO: 542626 - RNA, 13 nt, Chlamydophila pneumoniae J138
uauagacaaugca

SEQ ID NO: 542627 - RNA, 15 nt, Chlamydophila pneumoniae J138
uauagcccucuccaa

SEQ ID NO: 542628 - RNA, 16 nt, Chlamydophila pneumoniae J138
uauagcguacaggaag

SEQ ID NO: 542629 - RNA, 21 nt, Chlamydophila pneumoniae J138
uauagauuuaagagucuugca

SEQ ID NO: 542630 - RNA, 16 nt, Chlamydophila pneumoniae J138
uauagauuuugugagg

SEQ ID NO: 542631 - RNA, 17 nt, Chlamydophila pneumoniae J138
uauaacugcauacaagg

SEQ ID NO: 542632 - RNA, 13 nt, Chlamydophila pneumoniae J138
uauaacucucuag

SEQ ID NO: 542633 - RNA, 17 nt, Chlamydophila pneumoniae J138
uauaccacuacugagcu

SEQ ID NO: 542634 - RNA, 16 nt, Chlamydophila pneumoniae J138
uauacaucccauucaa

SEQ ID NO: 542635 - RNA, 21 nt, Chlamydophila pneumoniae J138
uauaccaccccaaagcagauc

SEQ ID NO: 542636 - RNA, 15 nt, Chlamydophila pneumoniae J138
uauacgcuuaacaug

SEQ ID NO: 542637 - RNA, 19 nt, Chlamydophila pneumoniae J138
uauacguaauccagauugu

SEQ ID NO: 542638 - RNA, 16 nt, Chlamydophila pneumoniae J138
uauacuguuuuucuuc

SEQ ID NO: 542639 - RNA, 13 nt, Chlamydophila pneumoniae J138
uauacucucugua

SEQ ID NO: 542640 - RNA, 21 nt, Chlamydophila pneumoniae J138
uauacuguuuuucuuccacac

SEQ ID NO: 542641 - RNA, 15 nt, Chlamydophila pneumoniae J138
uauacuguuuuucuu

SEQ ID NO: 542642 - RNA, 22 nt, Chlamydophila pneumoniae J138
uauacuguuuuucuuccacaca

SEQ ID NO: 542643 - RNA, 15 nt, Chlamydophila pneumoniae J138
uaucaaaagguuuua

SEQ ID NO: 542644 - RNA, 19 nt, Chlamydophila pneumoniae J138
uaucaaaagguuuuauaaa

SEQ ID NO: 542645 - RNA, 23 nt, Chlamydophila pneumoniae J138
uaucaaagcauugcaaauaagcc

SEQ ID NO: 542646 - RNA, 17 nt, Chlamydophila pneumoniae J138
uauaucauuaagaagau

SEQ ID NO: 542647 - RNA, 18 nt, Chlamydophila pneumoniae J138
uauaucagcaaaaaacug

SEQ ID NO: 542648 - RNA, 21 nt, Chlamydophila pneumoniae J138
uauaucagcaaaaaacugcaa

SEQ ID NO: 542649 - RNA, 12 nt, Chlamydophila pneumoniae J138
uauauugacaac

SEQ ID NO: 542650 - RNA, 21 nt, Chlamydophila pneumoniae J138
uaucaaaaggaucguuuugug

SEQ ID NO: 542651 - RNA, 14 nt, Chlamydophila pneumoniae J138
uauauuuuuuccca

SEQ ID NO: 542652 - RNA, 16 nt, Chlamydophila pneumoniae J138
uauauuuuuuacauaa

SEQ ID NO: 542653 - RNA, 18 nt, Chlamydophila pneumoniae J138
uaucauuaagaagauucu

SEQ ID NO: 542654 - RNA, 19 nt, Chlamydophila pneumoniae J138
uaucaguauggcguuuuuu

SEQ ID NO: 542655 - RNA, 15 nt, Chlamydophila pneumoniae J138
uauccaaugagagag

SEQ ID NO: 542656 - RNA, 14 nt, Chlamydophila pneumoniae J138
uauccaaugagaga

SEQ ID NO: 542657 - RNA, 18 nt, Chlamydophila pneumoniae J138
uauccaccaagacugaau

SEQ ID NO: 542658 - RNA, 20 nt, Chlamydophila pneumoniae J138
uauccaaguccgugagagga

SEQ ID NO: 542659 - RNA, 21 nt, Chlamydophila pneumoniae J138
uaucauugcuauugaaaaauc

SEQ ID NO: 542660 - RNA, 23 nt, Chlamydophila pneumoniae J138
uagcccuagaguaaagaguagcc

SEQ ID NO: 542661 - RNA, 14 nt, Chlamydophila pneumoniae J138
uagccccuccaaca

SEQ ID NO: 542662 - RNA, 18 nt, Chlamydophila pneumoniae J138
uagcccgaaauucauuaa

SEQ ID NO: 542663 - RNA, 18 nt, Chlamydophila pneumoniae J138
uagccaucauagcaaacg

SEQ ID NO: 542664 - RNA, 23 nt, Chlamydophila pneumoniae J138
uagccauggcaucuaagccagag

SEQ ID NO: 542665 - RNA, 22 nt, Chlamydophila pneumoniae J138
uagccguaggguagccauccac

SEQ ID NO: 542666 - RNA, 14 nt, Chlamydophila pneumoniae J138
uagcgacaugagaa

SEQ ID NO: 542667 - RNA, 16 nt, Chlamydophila pneumoniae J138
uagcgcggucacuuca

SEQ ID NO: 542668 - RNA, 20 nt, Chlamydophila pneumoniae J138
uagcgcuuccagcuucuccc

SEQ ID NO: 542669 - RNA, 18 nt, Chlamydophila pneumoniae J138
uagcgcuuuuuuaaagug

SEQ ID NO: 542670 - RNA, 20 nt, Chlamydophila pneumoniae J138
uagcugagagauuuuuucau

SEQ ID NO: 542671 - RNA, 20 nt, Chlamydophila pneumoniae J138
uagcucuuugggauaaaaag

SEQ ID NO: 542672 - RNA, 15 nt, Chlamydophila pneumoniae J138
uagcucucuccugga

SEQ ID NO: 542673 - RNA, 16 nt, Chlamydophila pneumoniae J138
uagcucccguuccuuu

SEQ ID NO: 542674 - RNA, 18 nt, Chlamydophila pneumoniae J138
uagcugcucuuuuagaau

SEQ ID NO: 542675 - RNA, 20 nt, Chlamydophila pneumoniae J138
uagcgucucuucuuccucua

SEQ ID NO: 542676 - RNA, 18 nt, Chlamydophila pneumoniae J138
uagcuaacucggaaaaaa

SEQ ID NO: 542677 - RNA, 20 nt, Chlamydophila pneumoniae J138
uagcucaucuagaaagauuu

SEQ ID NO: 542678 - RNA, 19 nt, Chlamydophila pneumoniae J138
uagcucaggaaaacuuaau

SEQ ID NO: 542679 - RNA, 16 nt, Chlamydophila pneumoniae J138
uagcucaggaaaacuu

SEQ ID NO: 542680 - RNA, 18 nt, Chlamydophila pneumoniae J138
uagcucaaaucucauucc

SEQ ID NO: 542681 - RNA, 16 nt, Chlamydophila pneumoniae J138
uagcuacagauucuug

SEQ ID NO: 542682 - RNA, 15 nt, Chlamydophila pneumoniae J138
uagcuacaagucccc

SEQ ID NO: 542683 - RNA, 20 nt, Chlamydophila pneumoniae J138
uaggaucccugauuccuugg

SEQ ID NO: 542684 - RNA, 21 nt, Chlamydophila pneumoniae J138
uaggauagaggccuuuuagag

SEQ ID NO: 542685 - RNA, 16 nt, Chlamydophila pneumoniae J138
uaggaucugacuuccc

SEQ ID NO: 542686 - RNA, 12 nt, Chlamydophila pneumoniae J138
uaggauucggac

SEQ ID NO: 542687 - RNA, 18 nt, Chlamydophila pneumoniae J138
uaggacccguagccccuu

SEQ ID NO: 542688 - RNA, 18 nt, Chlamydophila pneumoniae J138
uaggacagcacauagagu

SEQ ID NO: 542689 - RNA, 13 nt, Chlamydophila pneumoniae J138
uaggagaagcccc

SEQ ID NO: 542690 - RNA, 18 nt, Chlamydophila pneumoniae J138
uaggagagcuugguuuuc

SEQ ID NO: 542691 - RNA, 21 nt, Chlamydophila pneumoniae J138
uaggagagcuugguuuucucc

SEQ ID NO: 542692 - RNA, 23 nt, Chlamydophila pneumoniae J138
uaggagagcuugguuuucuccuu

SEQ ID NO: 542693 - RNA, 14 nt, Chlamydophila pneumoniae J138
uaggauaagaaauu

SEQ ID NO: 542694 - RNA, 17 nt, Chlamydophila pneumoniae J138
uaggauaagaaauuaaa

SEQ ID NO: 542695 - RNA, 21 nt, Chlamydophila pneumoniae J138
uaggagggguaaaccaauuga

SEQ ID NO: 542696 - RNA, 16 nt, Chlamydophila pneumoniae J138
uaggagcauagacucu

SEQ ID NO: 542697 - RNA, 22 nt, Chlamydophila pneumoniae J138
uaggaaaagcauagucgucuuu

SEQ ID NO: 542698 - RNA, 18 nt, Chlamydophila pneumoniae J138
uagcuuuuaguuucccac

SEQ ID NO: 542699 - RNA, 20 nt, Chlamydophila pneumoniae J138
uaggaauaacaccaaaagaa

SEQ ID NO: 542700 - RNA, 15 nt, Chlamydophila pneumoniae J138
uaggaagcucuucua

SEQ ID NO: 542701 - RNA, 18 nt, Chlamydophila pneumoniae J138
uaggaagcucuucuacuu

SEQ ID NO: 542702 - RNA, 20 nt, Chlamydophila pneumoniae J138
uaggaacaugccaaauaucu

SEQ ID NO: 542703 - RNA, 23 nt, Chlamydophila pneumoniae J138
uaggaacaaagcucuccuucaga

SEQ ID NO: 542704 - RNA, 16 nt, Chlamydophila pneumoniae J138
uaggaacaaagcucuc

SEQ ID NO: 542705 - RNA, 14 nt, Chlamydophila pneumoniae J138
uaggaagaugaaua

SEQ ID NO: 542706 - RNA, 23 nt, Chlamydophila pneumoniae J138
uaggaagaugaauaccagaagca

SEQ ID NO: 542707 - RNA, 14 nt, Chlamydophila pneumoniae J138
uagauuuaaaugca

SEQ ID NO: 542708 - RNA, 14 nt, Chlamydophila pneumoniae J138
uagauuuucccuaa

SEQ ID NO: 542709 - RNA, 15 nt, Chlamydophila pneumoniae J138
uagauuuuucuuuua

SEQ ID NO: 542710 - RNA, 23 nt, Chlamydophila pneumoniae J138
uagcaaagcgauggcuauagaua

SEQ ID NO: 542711 - RNA, 16 nt, Chlamydophila pneumoniae J138
uagcaaguagcucucu

SEQ ID NO: 542712 - RNA, 20 nt, Chlamydophila pneumoniae J138
uagcaaucucuuucacaaag

SEQ ID NO: 542713 - RNA, 16 nt, Chlamydophila pneumoniae J138
uagcaaugauguuuuu

SEQ ID NO: 542714 - RNA, 22 nt, Chlamydophila pneumoniae J138
uagcaauucgguagagcuagaa

SEQ ID NO: 542715 - RNA, 18 nt, Chlamydophila pneumoniae J138
uagcaauucgguagagcu

SEQ ID NO: 542716 - RNA, 15 nt, Chlamydophila pneumoniae J138
uagcaccuaauaaag

SEQ ID NO: 542717 - RNA, 16 nt, Chlamydophila pneumoniae J138
uagcauaggcuaagac

SEQ ID NO: 542718 - RNA, 17 nt, Chlamydophila pneumoniae J138
uagcauaggcuaagacu

SEQ ID NO: 542719 - RNA, 20 nt, Chlamydophila pneumoniae J138
uagcauagccuuccauaucu

SEQ ID NO: 542720 - RNA, 13 nt, Chlamydophila pneumoniae J138
uagcauacaucgu

SEQ ID NO: 542721 - RNA, 20 nt, Chlamydophila pneumoniae J138
uagcauaaucuuuaacaaag

SEQ ID NO: 542722 - RNA, 23 nt, Chlamydophila pneumoniae J138
uagcaguauagagaagauuucua

SEQ ID NO: 542723 - RNA, 14 nt, Chlamydophila pneumoniae J138
uagcaguauagaga

SEQ ID NO: 542724 - RNA, 16 nt, Chlamydophila pneumoniae J138
uagcaggaguuuucaa

SEQ ID NO: 542725 - RNA, 13 nt, Chlamydophila pneumoniae J138
uagcagcaagaac

SEQ ID NO: 542726 - RNA, 18 nt, Chlamydophila pneumoniae J138
uagcagaguuuuucccuc

SEQ ID NO: 542727 - RNA, 13 nt, Chlamydophila pneumoniae J138
uagcagagccuca

SEQ ID NO: 542728 - RNA, 18 nt, Chlamydophila pneumoniae J138
uagccaaagacucuugaa

SEQ ID NO: 542729 - RNA, 16 nt, Chlamydophila pneumoniae J138
uagcauuucuuucucu

SEQ ID NO: 542730 - RNA, 17 nt, Chlamydophila pneumoniae J138
uagcauuucuuucucuu

SEQ ID NO: 542731 - RNA, 14 nt, Chlamydophila pneumoniae J138
uagcauuucucuau

SEQ ID NO: 542732 - RNA, 15 nt, Chlamydophila pneumoniae J138
uagcauuucuuucuc

SEQ ID NO: 542733 - RNA, 20 nt, Chlamydophila pneumoniae J138
uagcauugcuugcgcagcuu

SEQ ID NO: 542734 - RNA, 19 nt, Chlamydophila pneumoniae J138
uagcauugcuugcgcagcu

SEQ ID NO: 542735 - RNA, 13 nt, Chlamydophila pneumoniae J138
uagcauugcuugc

SEQ ID NO: 542736 - RNA, 14 nt, Chlamydophila pneumoniae J138
uagcauugcuugcg

SEQ ID NO: 542737 - RNA, 20 nt, Chlamydophila pneumoniae J138
uagccaauauagaagcugcu

SEQ ID NO: 542738 - RNA, 23 nt, Chlamydophila pneumoniae J138
uagcaucccuucuucuuuuagac

SEQ ID NO: 542739 - RNA, 17 nt, Chlamydophila pneumoniae J138
uagcaucccuucuucuu

SEQ ID NO: 542740 - RNA, 19 nt, Chlamydophila pneumoniae J138
uagcauacgacaguaauga

SEQ ID NO: 542741 - RNA, 19 nt, Chlamydophila pneumoniae J138
uagcauguucgauuuucuc

SEQ ID NO: 542742 - RNA, 16 nt, Chlamydophila pneumoniae J138
uagaguugacaauagg

SEQ ID NO: 542743 - RNA, 20 nt, Chlamydophila pneumoniae J138
uagaguucgcacuaauuucc

SEQ ID NO: 542744 - RNA, 16 nt, Chlamydophila pneumoniae J138
uagagugucuuccuug

SEQ ID NO: 542745 - RNA, 21 nt, Chlamydophila pneumoniae J138
uagagucucuuucagcucaag

SEQ ID NO: 542746 - RNA, 14 nt, Chlamydophila pneumoniae J138
uagagucucuuuca

SEQ ID NO: 542747 - RNA, 16 nt, Chlamydophila pneumoniae J138
uagaguugcuuuaugg

SEQ ID NO: 542748 - RNA, 14 nt, Chlamydophila pneumoniae J138
uagauaagaucucu

SEQ ID NO: 542749 - RNA, 13 nt, Chlamydophila pneumoniae J138
uagauaagaucuc

SEQ ID NO: 542750 - RNA, 21 nt, Chlamydophila pneumoniae J138
uagauacuuugcaauacacca

SEQ ID NO: 542751 - RNA, 15 nt, Chlamydophila pneumoniae J138
uagaguccacaguca

SEQ ID NO: 542752 - RNA, 16 nt, Chlamydophila pneumoniae J138
uagaguccacagucau

SEQ ID NO: 542753 - RNA, 16 nt, Chlamydophila pneumoniae J138
uagaguccaagguucu

SEQ ID NO: 542754 - RNA, 21 nt, Chlamydophila pneumoniae J138
uagaguauuagcgaguacuuu

SEQ ID NO: 542755 - RNA, 20 nt, Chlamydophila pneumoniae J138
uagaguacacagcacaagaa

SEQ ID NO: 542756 - RNA, 14 nt, Chlamydophila pneumoniae J138
uagaggaucuucaa

SEQ ID NO: 542757 - RNA, 16 nt, Chlamydophila pneumoniae J138
uagagggauuuguagg

SEQ ID NO: 542758 - RNA, 15 nt, Chlamydophila pneumoniae J138
uagagcuucuuuauc

SEQ ID NO: 542759 - RNA, 16 nt, Chlamydophila pneumoniae J138
uagaggccuuuuagag

SEQ ID NO: 542760 - RNA, 19 nt, Chlamydophila pneumoniae J138
uagagcuuucagaaaagaa

SEQ ID NO: 542761 - RNA, 18 nt, Chlamydophila pneumoniae J138
uagaggaaguguuucuuu

SEQ ID NO: 542762 - RNA, 23 nt, Chlamydophila pneumoniae J138
uagaggagacucuaguuuuucuu

SEQ ID NO: 542763 - RNA, 19 nt, Chlamydophila pneumoniae J138
uagagcacauagaaacagu

SEQ ID NO: 542764 - RNA, 17 nt, Chlamydophila pneumoniae J138
uagagcacauagaaaca

SEQ ID NO: 542765 - RNA, 18 nt, Chlamydophila pneumoniae J138
uagagcacauagaaacag

SEQ ID NO: 542766 - RNA, 11 nt, Chlamydophila pneumoniae J138
uagagccuaga

SEQ ID NO: 542767 - RNA, 18 nt, Chlamydophila pneumoniae J138
uagagccucuaagaaaau

SEQ ID NO: 542768 - RNA, 23 nt, Chlamydophila pneumoniae J138
uagagauuuuucuaggaaucuuu

SEQ ID NO: 542769 - RNA, 18 nt, Chlamydophila pneumoniae J138
uagagauuguaauuuccu

SEQ ID NO: 542770 - RNA, 22 nt, Chlamydophila pneumoniae J138
uagagauucauaaaacuguaau

SEQ ID NO: 542771 - RNA, 17 nt, Chlamydophila pneumoniae J138
uagagauccaaugacaa

SEQ ID NO: 542772 - RNA, 18 nt, Chlamydophila pneumoniae J138
uagagauaucaucaaaag

SEQ ID NO: 542773 - RNA, 16 nt, Chlamydophila pneumoniae J138
uagagauaucaucaaa

SEQ ID NO: 542774 - RNA, 22 nt, Chlamydophila pneumoniae J138
uagagagagucggcuuuagaaa

SEQ ID NO: 542775 - RNA, 23 nt, Chlamydophila pneumoniae J138
uagagagagucggcuuuagaaaa

SEQ ID NO: 542776 - RNA, 19 nt, Chlamydophila pneumoniae J138
uagagagaaggaauuaaaa

SEQ ID NO: 542777 - RNA, 18 nt, Chlamydophila pneumoniae J138
uagauaugccucaggucu

SEQ ID NO: 542778 - RNA, 13 nt, Chlamydophila pneumoniae J138
uagauaugccuca

SEQ ID NO: 542779 - RNA, 17 nt, Chlamydophila pneumoniae J138
uagaucacaagaaagaa

SEQ ID NO: 542780 - RNA, 14 nt, Chlamydophila pneumoniae J138
uagaucacaagaaa

SEQ ID NO: 542781 - RNA, 13 nt, Chlamydophila pneumoniae J138
uagaucacaagaa

SEQ ID NO: 542782 - RNA, 13 nt, Chlamydophila pneumoniae J138
uagaucacaucaa

SEQ ID NO: 542783 - RNA, 18 nt, Chlamydophila pneumoniae J138
uagaucccucaagcgauu

SEQ ID NO: 542784 - RNA, 22 nt, Chlamydophila pneumoniae J138
uagauccuauaguaauuucucc

SEQ ID NO: 542785 - RNA, 15 nt, Chlamydophila pneumoniae J138
uagaucccagaagaa

SEQ ID NO: 542786 - RNA, 20 nt, Chlamydophila pneumoniae J138
uagaucgucaagcucugaga

SEQ ID NO: 542787 - RNA, 17 nt, Chlamydophila pneumoniae J138
uagauccccuucauucu

SEQ ID NO: 542788 - RNA, 15 nt, Chlamydophila pneumoniae J138
uagaucuucugaaau

SEQ ID NO: 542789 - RNA, 18 nt, Chlamydophila pneumoniae J138
uagaucuucugaaaucaa

SEQ ID NO: 542790 - RNA, 19 nt, Chlamydophila pneumoniae J138
uagaucuuuucuacuucag

SEQ ID NO: 542791 - RNA, 12 nt, Chlamydophila pneumoniae J138
uagaucuucaau

SEQ ID NO: 542792 - RNA, 13 nt, Chlamydophila pneumoniae J138
uagaugucaguau

SEQ ID NO: 542793 - RNA, 23 nt, Chlamydophila pneumoniae J138
uagaucuuuucuacuucaggaaa

SEQ ID NO: 542794 - RNA, 21 nt, Chlamydophila pneumoniae J138
uagauucguuauccucgucuu

SEQ ID NO: 542795 - RNA, 18 nt, Chlamydophila pneumoniae J138
uagauucaugaaaugcuu

SEQ ID NO: 542796 - RNA, 21 nt, Chlamydophila pneumoniae J138
uagauguuaugaguuuuuaau

SEQ ID NO: 542797 - RNA, 13 nt, Chlamydophila pneumoniae J138
uagauuaaagaga

SEQ ID NO: 542798 - RNA, 17 nt, Chlamydophila pneumoniae J138
uacgaaaacaucuguau

SEQ ID NO: 542799 - RNA, 15 nt, Chlamydophila pneumoniae J138
uacgaacuaaaggaa

SEQ ID NO: 542800 - RNA, 19 nt, Chlamydophila pneumoniae J138
uaccugcauucauaaaaau

SEQ ID NO: 542801 - RNA, 20 nt, Chlamydophila pneumoniae J138
uaccugcauucauaaaaaug

SEQ ID NO: 542802 - RNA, 19 nt, Chlamydophila pneumoniae J138
uaccuuaguuuuuucuaag

SEQ ID NO: 542803 - RNA, 19 nt, Chlamydophila pneumoniae J138
uaccuguacgguaaaucca

SEQ ID NO: 542804 - RNA, 14 nt, Chlamydophila pneumoniae J138
uaccuguagcuaca

SEQ ID NO: 542805 - RNA, 16 nt, Chlamydophila pneumoniae J138
uaccuguagcuacaga

SEQ ID NO: 542806 - RNA, 15 nt, Chlamydophila pneumoniae J138
uaccguuuccuccuc

SEQ ID NO: 542807 - RNA, 21 nt, Chlamydophila pneumoniae J138
uaccuauauuuuuuacauaac

SEQ ID NO: 542808 - RNA, 19 nt, Chlamydophila pneumoniae J138
uaccuacuaaacccugucc

SEQ ID NO: 542809 - RNA, 14 nt, Chlamydophila pneumoniae J138
uaccaauaugcucu

SEQ ID NO: 542810 - RNA, 15 nt, Chlamydophila pneumoniae J138
uacgugaucaaaauu

SEQ ID NO: 542811 - RNA, 18 nt, Chlamydophila pneumoniae J138
uacggguaaccugaaagc

SEQ ID NO: 542812 - RNA, 15 nt, Chlamydophila pneumoniae J138
uacgguuucugggau

SEQ ID NO: 542813 - RNA, 20 nt, Chlamydophila pneumoniae J138
uacggaugggcacucuucca

SEQ ID NO: 542814 - RNA, 23 nt, Chlamydophila pneumoniae J138
uacggaaaauacagccagcagaa

SEQ ID NO: 542815 - RNA, 22 nt, Chlamydophila pneumoniae J138
uacgaugagguugagcaagaau

SEQ ID NO: 542816 - RNA, 12 nt, Chlamydophila pneumoniae J138
uacgcucuccau

SEQ ID NO: 542817 - RNA, 14 nt, Chlamydophila pneumoniae J138
uacgcuuuuuacug

SEQ ID NO: 542818 - RNA, 17 nt, Chlamydophila pneumoniae J138
uacgaucugcuuugcau

SEQ ID NO: 542819 - RNA, 20 nt, Chlamydophila pneumoniae J138
uacgauagccaucauaaaac

SEQ ID NO: 542820 - RNA, 13 nt, Chlamydophila pneumoniae J138
uacucauauuuug

SEQ ID NO: 542821 - RNA, 17 nt, Chlamydophila pneumoniae J138
uacguuggacugcaaga

SEQ ID NO: 542822 - RNA, 20 nt, Chlamydophila pneumoniae J138
uacguuggacugcaagagcc

SEQ ID NO: 542823 - RNA, 14 nt, Chlamydophila pneumoniae J138
uacguuuuucccuu

SEQ ID NO: 542824 - RNA, 23 nt, Chlamydophila pneumoniae J138
uacguuuuucccuuuaaaaguac

SEQ ID NO: 542825 - RNA, 12 nt, Chlamydophila pneumoniae J138
uacguuuucucu

SEQ ID NO: 542826 - RNA, 13 nt, Chlamydophila pneumoniae J138
uacguuuucucua

SEQ ID NO: 542827 - RNA, 12 nt, Chlamydophila pneumoniae J138
uacuaucgguuu

SEQ ID NO: 542828 - RNA, 22 nt, Chlamydophila pneumoniae J138
uagaacagcauggacuccaaga

SEQ ID NO: 542829 - RNA, 16 nt, Chlamydophila pneumoniae J138
uagaacacucagagau

SEQ ID NO: 542830 - RNA, 20 nt, Chlamydophila pneumoniae J138
uagaacagcauggacuccaa

SEQ ID NO: 542831 - RNA, 20 nt, Chlamydophila pneumoniae J138
uagaacauacacgucuaaga

SEQ ID NO: 542832 - RNA, 21 nt, Chlamydophila pneumoniae J138
uagaaauuccaauuuuugcau

SEQ ID NO: 542833 - RNA, 14 nt, Chlamydophila pneumoniae J138
uagaaauuccaauu

SEQ ID NO: 542834 - RNA, 14 nt, Chlamydophila pneumoniae J138
uagaaauucuaaga

SEQ ID NO: 542835 - RNA, 18 nt, Chlamydophila pneumoniae J138
uagaagccaccaucuguu

SEQ ID NO: 542836 - RNA, 22 nt, Chlamydophila pneumoniae J138
uagaagauccucaaagaguuuu

SEQ ID NO: 542837 - RNA, 14 nt, Chlamydophila pneumoniae J138
uagaagcccgcagu

SEQ ID NO: 542838 - RNA, 15 nt, Chlamydophila pneumoniae J138
uagaacuugggaugc

SEQ ID NO: 542839 - RNA, 19 nt, Chlamydophila pneumoniae J138
uagaacuugggaugcuacu

SEQ ID NO: 542840 - RNA, 12 nt, Chlamydophila pneumoniae J138
uagaagagaaag

SEQ ID NO: 542841 - RNA, 12 nt, Chlamydophila pneumoniae J138
uagaagacauuc

SEQ ID NO: 542842 - RNA, 15 nt, Chlamydophila pneumoniae J138
uagaaugaugcaagc

SEQ ID NO: 542843 - RNA, 13 nt, Chlamydophila pneumoniae J138
uagaaugaugcaa

SEQ ID NO: 542844 - RNA, 22 nt, Chlamydophila pneumoniae J138
uagaaucagagggacuccugug

SEQ ID NO: 542845 - RNA, 12 nt, Chlamydophila pneumoniae J138
uagaauccucua

SEQ ID NO: 542846 - RNA, 14 nt, Chlamydophila pneumoniae J138
uagaauccaaagac

SEQ ID NO: 542847 - RNA, 15 nt, Chlamydophila pneumoniae J138
uagaauccaaagacu

SEQ ID NO: 542848 - RNA, 16 nt, Chlamydophila pneumoniae J138
uagaaucacauaaaau

SEQ ID NO: 542849 - RNA, 16 nt, Chlamydophila pneumoniae J138
uagaauccugaucugu

SEQ ID NO: 542850 - RNA, 14 nt, Chlamydophila pneumoniae J138
uagaauccuucucc

SEQ ID NO: 542851 - RNA, 21 nt, Chlamydophila pneumoniae J138
uagaaucucugcccccuguuu

SEQ ID NO: 542852 - RNA, 16 nt, Chlamydophila pneumoniae J138
uagaaucucugugcca

SEQ ID NO: 542853 - RNA, 22 nt, Chlamydophila pneumoniae J138
uagaaucucugugccaucugua

SEQ ID NO: 542854 - RNA, 11 nt, Chlamydophila pneumoniae J138
uagaauagaag

SEQ ID NO: 542855 - RNA, 16 nt, Chlamydophila pneumoniae J138
uagaauacacagcuau

SEQ ID NO: 542856 - RNA, 18 nt, Chlamydophila pneumoniae J138
uagaaggggguucuaaga

SEQ ID NO: 542857 - RNA, 18 nt, Chlamydophila pneumoniae J138
uagaagguguuuuggcug

SEQ ID NO: 542858 - RNA, 18 nt, Chlamydophila pneumoniae J138
uagagaacgaacaguuca

SEQ ID NO: 542859 - RNA, 16 nt, Chlamydophila pneumoniae J138
uagacuuguauucuug

SEQ ID NO: 542860 - RNA, 19 nt, Chlamydophila pneumoniae J138
uagacuuguauucuugaga

SEQ ID NO: 542861 - RNA, 13 nt, Chlamydophila pneumoniae J138
uagagaagaggug

SEQ ID NO: 542862 - RNA, 20 nt, Chlamydophila pneumoniae J138
uagagacagccuguuuucuu

SEQ ID NO: 542863 - RNA, 21 nt, Chlamydophila pneumoniae J138
uagagacgaacgaagaaaacg

SEQ ID NO: 542864 - RNA, 13 nt, Chlamydophila pneumoniae J138
uagacgauuuucu

SEQ ID NO: 542865 - RNA, 17 nt, Chlamydophila pneumoniae J138
uagacgaggagaagucg

SEQ ID NO: 542866 - RNA, 18 nt, Chlamydophila pneumoniae J138
uagacgugcucucuucuu

SEQ ID NO: 542867 - RNA, 20 nt, Chlamydophila pneumoniae J138
uagacaugcgaagggaggag

SEQ ID NO: 542868 - RNA, 18 nt, Chlamydophila pneumoniae J138
uagacaggauggaaucag

SEQ ID NO: 542869 - RNA, 20 nt, Chlamydophila pneumoniae J138
uagaccccccauuccaaagc

SEQ ID NO: 542870 - RNA, 19 nt, Chlamydophila pneumoniae J138
uagaccaauaaauccaaaa

SEQ ID NO: 542871 - RNA, 17 nt, Chlamydophila pneumoniae J138
uagacaagacaccgaaa

SEQ ID NO: 542872 - RNA, 14 nt, Chlamydophila pneumoniae J138
uagacaagagagag

SEQ ID NO: 542873 - RNA, 16 nt, Chlamydophila pneumoniae J138
uagacaagagagagcu

SEQ ID NO: 542874 - RNA, 22 nt, Chlamydophila pneumoniae J138
uagacaacgcaggaagaacaag

SEQ ID NO: 542875 - RNA, 21 nt, Chlamydophila pneumoniae J138
uagacaacaagucuucccucu

SEQ ID NO: 542876 - RNA, 18 nt, Chlamydophila pneumoniae J138
uagacaacgcaggaagaa

SEQ ID NO: 542877 - RNA, 19 nt, Chlamydophila pneumoniae J138
uagacaauaccagauaaag

SEQ ID NO: 542878 - RNA, 14 nt, Chlamydophila pneumoniae J138
uagaauuuguccuu

SEQ ID NO: 542879 - RNA, 16 nt, Chlamydophila pneumoniae J138
uacuuuacacuauaag

SEQ ID NO: 542880 - RNA, 16 nt, Chlamydophila pneumoniae J138
uacuccgagcauuuua

SEQ ID NO: 542881 - RNA, 23 nt, Chlamydophila pneumoniae J138
uacuuacuaaaggugaaaguaca

SEQ ID NO: 542882 - RNA, 21 nt, Chlamydophila pneumoniae J138
uacuguagaguuuucuuucac

SEQ ID NO: 542883 - RNA, 19 nt, Chlamydophila pneumoniae J138
uacuuaagcacugaugaaa

SEQ ID NO: 542884 - RNA, 18 nt, Chlamydophila pneumoniae J138
uagaaaacgccaacugua

SEQ ID NO: 542885 - RNA, 18 nt, Chlamydophila pneumoniae J138
uagaaaagauaaaacauu

SEQ ID NO: 542886 - RNA, 19 nt, Chlamydophila pneumoniae J138
uagaaacauuuaagucauu

SEQ ID NO: 542887 - RNA, 14 nt, Chlamydophila pneumoniae J138
uagaaacugcuccu

SEQ ID NO: 542888 - RNA, 18 nt, Chlamydophila pneumoniae J138
uagaaaccaugaugcaau

SEQ ID NO: 542889 - RNA, 19 nt, Chlamydophila pneumoniae J138
uagaaaccaugaugcaaug

SEQ ID NO: 542890 - RNA, 23 nt, Chlamydophila pneumoniae J138
uagaaagacauccuucuuuaccu

SEQ ID NO: 542891 - RNA, 12 nt, Chlamydophila pneumoniae J138
uagaaagaccau

SEQ ID NO: 542892 - RNA, 14 nt, Chlamydophila pneumoniae J138
uagaaagacaaaaa

SEQ ID NO: 542893 - RNA, 14 nt, Chlamydophila pneumoniae J138
uagaaagaguccuu

SEQ ID NO: 542894 - RNA, 21 nt, Chlamydophila pneumoniae J138
uagaaagauuuauuuugucuu

SEQ ID NO: 542895 - RNA, 13 nt, Chlamydophila pneumoniae J138
uagaaaggaaucc

SEQ ID NO: 542896 - RNA, 23 nt, Chlamydophila pneumoniae J138
uagaaauauacucuugcuugcua

SEQ ID NO: 542897 - RNA, 20 nt, Chlamydophila pneumoniae J138
uagaaauaagcaucuagaau

SEQ ID NO: 542898 - RNA, 21 nt, Chlamydophila pneumoniae J138
uaauggaccagaugcuaaaga

SEQ ID NO: 542899 - RNA, 21 nt, Chlamydophila pneumoniae J138
uaaucuugaucagcaaucaca

SEQ ID NO: 542900 - RNA, 16 nt, Chlamydophila pneumoniae J138
uaaucuuuuuuaaagc

SEQ ID NO: 542901 - RNA, 19 nt, Chlamydophila pneumoniae J138
uaaugacagcugagaaauu

SEQ ID NO: 542902 - RNA, 14 nt, Chlamydophila pneumoniae J138
uaaucucaccagaa

SEQ ID NO: 542903 - RNA, 20 nt, Chlamydophila pneumoniae J138
uaauccuuucacaaagaauu

SEQ ID NO: 542904 - RNA, 21 nt, Chlamydophila pneumoniae J138
uaauccugaauggcucuguca

SEQ ID NO: 542905 - RNA, 19 nt, Chlamydophila pneumoniae J138
uaauccuguugucacuaag

SEQ ID NO: 542906 - RNA, 22 nt, Chlamydophila pneumoniae J138
uaauuuaaaugccuuaaaugua

SEQ ID NO: 542907 - RNA, 17 nt, Chlamydophila pneumoniae J138
uaauuuccuucuccaga

SEQ ID NO: 542908 - RNA, 17 nt, Chlamydophila pneumoniae J138
uaauuucccuaaaauga

SEQ ID NO: 542909 - RNA, 19 nt, Chlamydophila pneumoniae J138
uaauuucuccgucaagaac

SEQ ID NO: 542910 - RNA, 22 nt, Chlamydophila pneumoniae J138
uaauuucuaaauagaaaacaua

SEQ ID NO: 542911 - RNA, 15 nt, Chlamydophila pneumoniae J138
uaauuguagagagaa

SEQ ID NO: 542912 - RNA, 16 nt, Chlamydophila pneumoniae J138
uaauugugcucucuaa

SEQ ID NO: 542913 - RNA, 15 nt, Chlamydophila pneumoniae J138
uaauuaacguuucuu

SEQ ID NO: 542914 - RNA, 17 nt, Chlamydophila pneumoniae J138
uaauuaacguuucuucg

SEQ ID NO: 542915 - RNA, 12 nt, Chlamydophila pneumoniae J138
uaauuaaauaua

SEQ ID NO: 542916 - RNA, 14 nt, Chlamydophila pneumoniae J138
uaauuccaaaauaa

SEQ ID NO: 542917 - RNA, 22 nt, Chlamydophila pneumoniae J138
uaauucauauuuacgaaaacau

SEQ ID NO: 542918 - RNA, 18 nt, Chlamydophila pneumoniae J138
uacauaacacuuuguuuu

SEQ ID NO: 542919 - RNA, 16 nt, Chlamydophila pneumoniae J138
uacaguuuuuuucuaa

SEQ ID NO: 542920 - RNA, 12 nt, Chlamydophila pneumoniae J138
uacauaaaauga

SEQ ID NO: 542921 - RNA, 13 nt, Chlamydophila pneumoniae J138
uacauaguuuuua

SEQ ID NO: 542922 - RNA, 21 nt, Chlamydophila pneumoniae J138
uacauaguuuuuauuuuuaaa

SEQ ID NO: 542923 - RNA, 13 nt, Chlamydophila pneumoniae J138
uacauguaaacaa

SEQ ID NO: 542924 - RNA, 17 nt, Chlamydophila pneumoniae J138
uacaucuucuuggcuuu

SEQ ID NO: 542925 - RNA, 22 nt, Chlamydophila pneumoniae J138
uacauuugauucauaaagagga

SEQ ID NO: 542926 - RNA, 13 nt, Chlamydophila pneumoniae J138
uaccaaaauacca

SEQ ID NO: 542927 - RNA, 21 nt, Chlamydophila pneumoniae J138
uaccaagaugaagaaacuugu

SEQ ID NO: 542928 - RNA, 22 nt, Chlamydophila pneumoniae J138
uacaguuggcguuuucuagaaa

SEQ ID NO: 542929 - RNA, 20 nt, Chlamydophila pneumoniae J138
uacaguuuguaaaaagccua

SEQ ID NO: 542930 - RNA, 13 nt, Chlamydophila pneumoniae J138
uacaggccugaug

SEQ ID NO: 542931 - RNA, 17 nt, Chlamydophila pneumoniae J138
uacaggagaagcggaag

SEQ ID NO: 542932 - RNA, 14 nt, Chlamydophila pneumoniae J138
uacaggaauucuca

SEQ ID NO: 542933 - RNA, 17 nt, Chlamydophila pneumoniae J138
uacagcuucuuuuccag

SEQ ID NO: 542934 - RNA, 20 nt, Chlamydophila pneumoniae J138
uacagcguugcuaagcauag

SEQ ID NO: 542935 - RNA, 23 nt, Chlamydophila pneumoniae J138
uacagcgcuuucgggaauaauag

SEQ ID NO: 542936 - RNA, 14 nt, Chlamydophila pneumoniae J138
uacagcauaaaaau

SEQ ID NO: 542937 - RNA, 19 nt, Chlamydophila pneumoniae J138
uacagauguaaaugcuccu

SEQ ID NO: 542938 - RNA, 20 nt, Chlamydophila pneumoniae J138
uacagaucaggauucuaaaa

SEQ ID NO: 542939 - RNA, 21 nt, Chlamydophila pneumoniae J138
uacagaucaggauucuaaaaa

SEQ ID NO: 542940 - RNA, 14 nt, Chlamydophila pneumoniae J138
uacagauuucagau

SEQ ID NO: 542941 - RNA, 18 nt, Chlamydophila pneumoniae J138
uacagauuucuucuucag

SEQ ID NO: 542942 - RNA, 20 nt, Chlamydophila pneumoniae J138
uacaauuagagauucauaaa

SEQ ID NO: 542943 - RNA, 19 nt, Chlamydophila pneumoniae J138
uacacauugucucuuuuaa

SEQ ID NO: 542944 - RNA, 22 nt, Chlamydophila pneumoniae J138
uacaauuagagauucauaaaac

SEQ ID NO: 542945 - RNA, 17 nt, Chlamydophila pneumoniae J138
uacaaugauauaaaagc

SEQ ID NO: 542946 - RNA, 18 nt, Chlamydophila pneumoniae J138
uacaaucucgcuauucca

SEQ ID NO: 542947 - RNA, 17 nt, Chlamydophila pneumoniae J138
uacaaucucuagggaua

SEQ ID NO: 542948 - RNA, 22 nt, Chlamydophila pneumoniae J138
uacaaucucuagggauaauuaa

SEQ ID NO: 542949 - RNA, 13 nt, Chlamydophila pneumoniae J138
uaauuuuagcuuc

SEQ ID NO: 542950 - RNA, 13 nt, Chlamydophila pneumoniae J138
uacaauacuggag

SEQ ID NO: 542951 - RNA, 17 nt, Chlamydophila pneumoniae J138
uacacccgcaagcacuu

SEQ ID NO: 542952 - RNA, 19 nt, Chlamydophila pneumoniae J138
uacaccuacagaucaggau

SEQ ID NO: 542953 - RNA, 22 nt, Chlamydophila pneumoniae J138
uacagacugaagucguuuagau

SEQ ID NO: 542954 - RNA, 23 nt, Chlamydophila pneumoniae J138
uacagagggcuucauuccuacau

SEQ ID NO: 542955 - RNA, 21 nt, Chlamydophila pneumoniae J138
uacagagucuguguagccgua

SEQ ID NO: 542956 - RNA, 17 nt, Chlamydophila pneumoniae J138
uacagagggaauuucau

SEQ ID NO: 542957 - RNA, 18 nt, Chlamydophila pneumoniae J138
uacagaggaaucuauccu

SEQ ID NO: 542958 - RNA, 22 nt, Chlamydophila pneumoniae J138
uacagagggaauuucauguccu

SEQ ID NO: 542959 - RNA, 19 nt, Chlamydophila pneumoniae J138
uacagagggcuucauuccu

SEQ ID NO: 542960 - RNA, 14 nt, Chlamydophila pneumoniae J138
uacagauaucaaag

SEQ ID NO: 542961 - RNA, 18 nt, Chlamydophila pneumoniae J138
uacagaaaggcuuuucuu

SEQ ID NO: 542962 - RNA, 22 nt, Chlamydophila pneumoniae J138
uacagaaagagcuaaagaaacu

SEQ ID NO: 542963 - RNA, 21 nt, Chlamydophila pneumoniae J138
uacacuuauguucuaugagau

SEQ ID NO: 542964 - RNA, 23 nt, Chlamydophila pneumoniae J138
uacacuguuguaauaaaaucaug

SEQ ID NO: 542965 - RNA, 19 nt, Chlamydophila pneumoniae J138
gugccugguaaaggauauu

SEQ ID NO: 542966 - RNA, 15 nt, Chlamydophila pneumoniae J138
gugccaaaaaauuuu

SEQ ID NO: 542967 - RNA, 19 nt, Chlamydophila pneumoniae J138
gugccacccuuggcagagc

SEQ ID NO: 542968 - RNA, 14 nt, Chlamydophila pneumoniae J138
gugcauuuucuucu

SEQ ID NO: 542969 - RNA, 14 nt, Chlamydophila pneumoniae J138
gugcaugcaucuua

SEQ ID NO: 542970 - RNA, 15 nt, Chlamydophila pneumoniae J138
gugcagugaauccuu

SEQ ID NO: 542971 - RNA, 14 nt, Chlamydophila pneumoniae J138
gugcaucauuuuca

SEQ ID NO: 542972 - RNA, 20 nt, Chlamydophila pneumoniae J138
gucuagcaguugcaauacca

SEQ ID NO: 542973 - RNA, 21 nt, Chlamydophila pneumoniae J138
gucuauuugaaaagaaagaau

SEQ ID NO: 542974 - RNA, 16 nt, Chlamydophila pneumoniae J138
gugauauccaccuuac

SEQ ID NO: 542975 - RNA, 20 nt, Chlamydophila pneumoniae J138
gugauauccaccuuaccauc

SEQ ID NO: 542976 - RNA, 16 nt, Chlamydophila pneumoniae J138
gugaucaaagaacaau

SEQ ID NO: 542977 - RNA, 14 nt, Chlamydophila pneumoniae J138
gugauacuuuagaa

SEQ ID NO: 542978 - RNA, 23 nt, Chlamydophila pneumoniae J138
gucucacucuuuucuagaaacug

SEQ ID NO: 542979 - RNA, 20 nt, Chlamydophila pneumoniae J138
gugcuaggcucucgacacua

SEQ ID NO: 542980 - RNA, 15 nt, Chlamydophila pneumoniae J138
gugcucucuucuucu

SEQ ID NO: 542981 - RNA, 15 nt, Chlamydophila pneumoniae J138
gugcucggcacuuac

SEQ ID NO: 542982 - RNA, 13 nt, Chlamydophila pneumoniae J138
gugcugccaugac

SEQ ID NO: 542983 - RNA, 13 nt, Chlamydophila pneumoniae J138
guggucggcagaa

SEQ ID NO: 542984 - RNA, 15 nt, Chlamydophila pneumoniae J138
guguauaguauuuuu

SEQ ID NO: 542985 - RNA, 20 nt, Chlamydophila pneumoniae J138
guuauuaauaaauuuaucug

SEQ ID NO: 542986 - RNA, 19 nt, Chlamydophila pneumoniae J138
guuauuaauaaauuuaucu

SEQ ID NO: 542987 - RNA, 15 nt, Chlamydophila pneumoniae J138
guuauuaucaaagug

SEQ ID NO: 542988 - RNA, 21 nt, Chlamydophila pneumoniae J138
guuacggaacucauuaagaag

SEQ ID NO: 542989 - RNA, 20 nt, Chlamydophila pneumoniae J138
guuauaagugacuuuucuuc

SEQ ID NO: 542990 - RNA, 15 nt, Chlamydophila pneumoniae J138
guuaaucuaauuuua

SEQ ID NO: 542991 - RNA, 15 nt, Chlamydophila pneumoniae J138
guuaccaaaaacugg

SEQ ID NO: 542992 - RNA, 22 nt, Chlamydophila pneumoniae J138
guuacagcguugcuaagcauag

SEQ ID NO: 542993 - RNA, 21 nt, Chlamydophila pneumoniae J138
guuacagcguugcuaagcaua

SEQ ID NO: 542994 - RNA, 13 nt, Chlamydophila pneumoniae J138
guguuuccuuuuc

SEQ ID NO: 542995 - RNA, 15 nt, Chlamydophila pneumoniae J138
guucacuucaucgac

SEQ ID NO: 542996 - RNA, 19 nt, Chlamydophila pneumoniae J138
guucacuucaucgacagua

SEQ ID NO: 542997 - RNA, 19 nt, Chlamydophila pneumoniae J138
guucaauuucuauaguuca

SEQ ID NO: 542998 - RNA, 21 nt, Chlamydophila pneumoniae J138
guucauucucaugucuaaguc

SEQ ID NO: 542999 - RNA, 14 nt, Chlamydophila pneumoniae J138
guucauaauccaag

SEQ ID NO: 543000 - RNA, 16 nt, Chlamydophila pneumoniae J138
guucauaauccaagau

SEQ ID NO: 543001 - RNA, 20 nt, Chlamydophila pneumoniae J138
guucauaauccaagauacca

SEQ ID NO: 543002 - RNA, 18 nt, Chlamydophila pneumoniae J138
guuccucauccucaucau

SEQ ID NO: 543003 - RNA, 14 nt, Chlamydophila pneumoniae J138
guuccucauccuca

SEQ ID NO: 543004 - RNA, 18 nt, Chlamydophila pneumoniae J138
guucccuggaugaacucc

SEQ ID NO: 543005 - RNA, 20 nt, Chlamydophila pneumoniae J138
guucgacaacaacauaaaga

SEQ ID NO: 543006 - RNA, 17 nt, Chlamydophila pneumoniae J138
guucucuaugacuucuu

SEQ ID NO: 543007 - RNA, 19 nt, Chlamydophila pneumoniae J138
guucucuaugacuucuugu

SEQ ID NO: 543008 - RNA, 12 nt, Chlamydophila pneumoniae J138
guucuuuuugca

SEQ ID NO: 543009 - RNA, 17 nt, Chlamydophila pneumoniae J138
guucuuuuguuugucuu

SEQ ID NO: 543010 - RNA, 21 nt, Chlamydophila pneumoniae J138
guucuuucuagaaugaugcaa

SEQ ID NO: 543011 - RNA, 10 nt, Chlamydophila pneumoniae J138
guucuuucug

SEQ ID NO: 543012 - RNA, 16 nt, Chlamydophila pneumoniae J138
guucuuuacuacauga

SEQ ID NO: 543013 - RNA, 15 nt, Chlamydophila pneumoniae J138
guucuuucaauaaca

SEQ ID NO: 543014 - RNA, 17 nt, Chlamydophila pneumoniae J138
guucuuguaauaaaaga

SEQ ID NO: 543015 - RNA, 16 nt, Chlamydophila pneumoniae J138
guucuugaaguucuuc

SEQ ID NO: 543016 - RNA, 18 nt, Chlamydophila pneumoniae J138
guucuucuuuacucaagu

SEQ ID NO: 543017 - RNA, 15 nt, Chlamydophila pneumoniae J138
guugaccuuuuucau

SEQ ID NO: 543018 - RNA, 19 nt, Chlamydophila pneumoniae J138
guugcaacucucuuuaaac

SEQ ID NO: 543019 - RNA, 21 nt, Chlamydophila pneumoniae J138
guugcauuacgguuucuggga

SEQ ID NO: 543020 - RNA, 16 nt, Chlamydophila pneumoniae J138
guugccaaucuuucau

SEQ ID NO: 543021 - RNA, 12 nt, Chlamydophila pneumoniae J138
guuguacuuuua

SEQ ID NO: 543022 - RNA, 14 nt, Chlamydophila pneumoniae J138
guuguaauaaaaga

SEQ ID NO: 543023 - RNA, 16 nt, Chlamydophila pneumoniae J138
guuguauccagcucaa

SEQ ID NO: 543024 - RNA, 14 nt, Chlamydophila pneumoniae J138
guuguauccagcuc

SEQ ID NO: 543025 - RNA, 16 nt, Chlamydophila pneumoniae J138
guugggcucauaaccc

SEQ ID NO: 543026 - RNA, 14 nt, Chlamydophila pneumoniae J138
guuguuuuuugaga

SEQ ID NO: 543027 - RNA, 15 nt, Chlamydophila pneumoniae J138
guuguuuuugcugaa

SEQ ID NO: 543028 - RNA, 21 nt, Chlamydophila pneumoniae J138
guuuacagaugcaugauccua

SEQ ID NO: 543029 - RNA, 22 nt, Chlamydophila pneumoniae J138
guuuagcauagagcucuaaaaa

SEQ ID NO: 543030 - RNA, 16 nt, Chlamydophila pneumoniae J138
guuuaccugaaaaaac

SEQ ID NO: 543031 - RNA, 17 nt, Chlamydophila pneumoniae J138
guuuaccugaaaaaaca

SEQ ID NO: 543032 - RNA, 12 nt, Chlamydophila pneumoniae J138
guuuagguaggc

SEQ ID NO: 543033 - RNA, 15 nt, Chlamydophila pneumoniae J138
uaaaccuucaaugau

SEQ ID NO: 543034 - RNA, 19 nt, Chlamydophila pneumoniae J138
uaaaccuggcauugccaua

SEQ ID NO: 543035 - RNA, 18 nt, Chlamydophila pneumoniae J138
uaaacccuucaagcaaau

SEQ ID NO: 543036 - RNA, 22 nt, Chlamydophila pneumoniae J138
uaaacccuguccaacuaaaaca

SEQ ID NO: 543037 - RNA, 17 nt, Chlamydophila pneumoniae J138
uaaacccucagaacacg

SEQ ID NO: 543038 - RNA, 13 nt, Chlamydophila pneumoniae J138
uaaacuuucuucu

SEQ ID NO: 543039 - RNA, 15 nt, Chlamydophila pneumoniae J138
uaaagaaaagcaauc

SEQ ID NO: 543040 - RNA, 20 nt, Chlamydophila pneumoniae J138
uaaacuuuuuuucaaaucau

SEQ ID NO: 543041 - RNA, 21 nt, Chlamydophila pneumoniae J138
uaaacuuuguugggauuuuca

SEQ ID NO: 543042 - RNA, 16 nt, Chlamydophila pneumoniae J138
uaaagaaacuucugac

SEQ ID NO: 543043 - RNA, 15 nt, Chlamydophila pneumoniae J138
uaaagaaacuucuga

SEQ ID NO: 543044 - RNA, 14 nt, Chlamydophila pneumoniae J138
uaaagaaauucugg

SEQ ID NO: 543045 - RNA, 21 nt, Chlamydophila pneumoniae J138
uaaagaaggagguccuuggca

SEQ ID NO: 543046 - RNA, 23 nt, Chlamydophila pneumoniae J138
uaaagaagaaaccccaugucuga

SEQ ID NO: 543047 - RNA, 22 nt, Chlamydophila pneumoniae J138
uaaaauuguuuguaucaaagaa

SEQ ID NO: 543048 - RNA, 12 nt, Chlamydophila pneumoniae J138
uaaaauuucuag

SEQ ID NO: 543049 - RNA, 14 nt, Chlamydophila pneumoniae J138
uaaacaauuucaau

SEQ ID NO: 543050 - RNA, 14 nt, Chlamydophila pneumoniae J138
uaaacauaaagacc

SEQ ID NO: 543051 - RNA, 19 nt, Chlamydophila pneumoniae J138
uaaagcaaagauaaagaag

SEQ ID NO: 543052 - RNA, 20 nt, Chlamydophila pneumoniae J138
uaaagauuucguauagcugg

SEQ ID NO: 543053 - RNA, 14 nt, Chlamydophila pneumoniae J138
uaaagcaaaugccu

SEQ ID NO: 543054 - RNA, 21 nt, Chlamydophila pneumoniae J138
uaaagcaaagauaaagaaguu

SEQ ID NO: 543055 - RNA, 17 nt, Chlamydophila pneumoniae J138
uaaagcaaagauaaaga

SEQ ID NO: 543056 - RNA, 15 nt, Chlamydophila pneumoniae J138
uaaagaguagcccca

SEQ ID NO: 543057 - RNA, 21 nt, Chlamydophila pneumoniae J138
uaaagagcugauccagcucca

SEQ ID NO: 543058 - RNA, 13 nt, Chlamydophila pneumoniae J138
uaaagagcauccu

SEQ ID NO: 543059 - RNA, 16 nt, Chlamydophila pneumoniae J138
uaaagacucucuucca

SEQ ID NO: 543060 - RNA, 23 nt, Chlamydophila pneumoniae J138
uaaaggcauagauacaaacaucg

SEQ ID NO: 543061 - RNA, 12 nt, Chlamydophila pneumoniae J138
uaaagguuuuaa

SEQ ID NO: 543062 - RNA, 22 nt, Chlamydophila pneumoniae J138
uaaaggaccuguuuucuuuucu

SEQ ID NO: 543063 - RNA, 13 nt, Chlamydophila pneumoniae J138
uaaaggacauaga

SEQ ID NO: 543064 - RNA, 19 nt, Chlamydophila pneumoniae J138
uaaaggaaucucgggagaa

SEQ ID NO: 543065 - RNA, 13 nt, Chlamydophila pneumoniae J138
uaaagcuaacaac

SEQ ID NO: 543066 - RNA, 15 nt, Chlamydophila pneumoniae J138
uaaaggacauagacu

SEQ ID NO: 543067 - RNA, 20 nt, Chlamydophila pneumoniae J138
uaaauaaaaccacuucucug

SEQ ID NO: 543068 - RNA, 16 nt, Chlamydophila pneumoniae J138
uaaagguuuuaaauuu

SEQ ID NO: 543069 - RNA, 14 nt, Chlamydophila pneumoniae J138
uaaagguuuuaaau

SEQ ID NO: 543070 - RNA, 18 nt, Chlamydophila pneumoniae J138
uaaauacaggagaaucca

SEQ ID NO: 543071 - RNA, 23 nt, Chlamydophila pneumoniae J138
uaaauagaaaacauagagauucu

SEQ ID NO: 543072 - RNA, 18 nt, Chlamydophila pneumoniae J138
uaaauagaaaucuuaguc

SEQ ID NO: 543073 - RNA, 14 nt, Chlamydophila pneumoniae J138
uaaauagcucaguu

SEQ ID NO: 543074 - RNA, 12 nt, Chlamydophila pneumoniae J138
uaaauuugucau

SEQ ID NO: 543075 - RNA, 16 nt, Chlamydophila pneumoniae J138
uaaauuucauuugaaa

SEQ ID NO: 543076 - RNA, 20 nt, Chlamydophila pneumoniae J138
uaacaaccgccuuuauauaa

SEQ ID NO: 543077 - RNA, 14 nt, Chlamydophila pneumoniae J138
uaaauuuaagucac

SEQ ID NO: 543078 - RNA, 17 nt, Chlamydophila pneumoniae J138
uaaauuuaagucacuaa

SEQ ID NO: 543079 - RNA, 16 nt, Chlamydophila pneumoniae J138
uaaaugacgcacacga

SEQ ID NO: 543080 - RNA, 21 nt, Chlamydophila pneumoniae J138
uaaaugccucuuucauacuaa

SEQ ID NO: 543081 - RNA, 23 nt, Chlamydophila pneumoniae J138
uaaaugccucuuucauacuaaaa

SEQ ID NO: 543082 - RNA, 22 nt, Chlamydophila pneumoniae J138
uaaauguauaggcauuaauaac

SEQ ID NO: 543083 - RNA, 17 nt, Chlamydophila pneumoniae J138
uaaaugugaaaucguau

SEQ ID NO: 543084 - RNA, 20 nt, Chlamydophila pneumoniae J138
uaaaucaacuacaucuccaa

SEQ ID NO: 543085 - RNA, 20 nt, Chlamydophila pneumoniae J138
uaaaucaacaucacaaucgu

SEQ ID NO: 543086 - RNA, 12 nt, Chlamydophila pneumoniae J138
uaaaucaaaauu

SEQ ID NO: 543087 - RNA, 22 nt, Chlamydophila pneumoniae J138
uaaaucaaaauuuuuaguaauu

SEQ ID NO: 543088 - RNA, 14 nt, Chlamydophila pneumoniae J138
uaaaucuauaucca

SEQ ID NO: 543089 - RNA, 21 nt, Chlamydophila pneumoniae J138
uaaaucuauacccaguuguau

SEQ ID NO: 543090 - RNA, 17 nt, Chlamydophila pneumoniae J138
uaaaucuauacccaguu

SEQ ID NO: 543091 - RNA, 13 nt, Chlamydophila pneumoniae J138
uaacaucaagaau

SEQ ID NO: 543092 - RNA, 13 nt, Chlamydophila pneumoniae J138
uaacauaaaguca

SEQ ID NO: 543093 - RNA, 19 nt, Chlamydophila pneumoniae J138
uaacauuucguuuuuucuu

SEQ ID NO: 543094 - RNA, 20 nt, Chlamydophila pneumoniae J138
uaacauuucguuuuuucuua

SEQ ID NO: 543095 - RNA, 14 nt, Chlamydophila pneumoniae J138
uaaccaaaagaauu

SEQ ID NO: 543096 - RNA, 14 nt, Chlamydophila pneumoniae J138
uaaccaauaaacuu

SEQ ID NO: 543097 - RNA, 13 nt, Chlamydophila pneumoniae J138
uaacccaccagaa

SEQ ID NO: 543098 - RNA, 19 nt, Chlamydophila pneumoniae J138
uaacccaccagaaggaagg

SEQ ID NO: 543099 - RNA, 20 nt, Chlamydophila pneumoniae J138
uaaccuuugacaacaccaca

SEQ ID NO: 543100 - RNA, 19 nt, Chlamydophila pneumoniae J138
uaacgaagugaggagaaua

SEQ ID NO: 543101 - RNA, 20 nt, Chlamydophila pneumoniae J138
uaacgaagugaggagaauag

SEQ ID NO: 543102 - RNA, 16 nt, Chlamydophila pneumoniae J138
uaaccuccucaagaau

SEQ ID NO: 543103 - RNA, 13 nt, Chlamydophila pneumoniae J138
uaaccucuuuucu

SEQ ID NO: 543104 - RNA, 14 nt, Chlamydophila pneumoniae J138
uaaccucuuuucuu

SEQ ID NO: 543105 - RNA, 21 nt, Chlamydophila pneumoniae J138
uaaaaauaccaagaugucucc

SEQ ID NO: 543106 - RNA, 18 nt, Chlamydophila pneumoniae J138
uaaaaauagaaauaagca

SEQ ID NO: 543107 - RNA, 20 nt, Chlamydophila pneumoniae J138
uaaaaauagaaauaagcauc

SEQ ID NO: 543108 - RNA, 20 nt, Chlamydophila pneumoniae J138
uaaaaaguuuuuguucaucc

SEQ ID NO: 543109 - RNA, 19 nt, Chlamydophila pneumoniae J138
uaaaaacuucccaucuugu

SEQ ID NO: 543110 - RNA, 12 nt, Chlamydophila pneumoniae J138
uaaaaagaaaag

SEQ ID NO: 543111 - RNA, 11 nt, Chlamydophila pneumoniae J138
uaaaaaagaga

SEQ ID NO: 543112 - RNA, 14 nt, Chlamydophila pneumoniae J138
guuuuuucaauccu

SEQ ID NO: 543113 - RNA, 20 nt, Chlamydophila pneumoniae J138
guuuuuugaaaacuucaaaa

SEQ ID NO: 543114 - RNA, 15 nt, Chlamydophila pneumoniae J138
guuuuuaauuuucug

SEQ ID NO: 543115 - RNA, 12 nt, Chlamydophila pneumoniae J138
guuuuucuucca

SEQ ID NO: 543116 - RNA, 16 nt, Chlamydophila pneumoniae J138
guuuuugcuguuucuu

SEQ ID NO: 543117 - RNA, 22 nt, Chlamydophila pneumoniae J138
guuuuuggaaaaagccuuucuu

SEQ ID NO: 543118 - RNA, 21 nt, Chlamydophila pneumoniae J138
guuuuaauagcuaaagugaug

SEQ ID NO: 543119 - RNA, 16 nt, Chlamydophila pneumoniae J138
guuuuaauuguagaga

SEQ ID NO: 543120 - RNA, 21 nt, Chlamydophila pneumoniae J138
guuucuucugugcaucaguca

SEQ ID NO: 543121 - RNA, 22 nt, Chlamydophila pneumoniae J138
guuucaaacaauaguaaagcau

SEQ ID NO: 543122 - RNA, 14 nt, Chlamydophila pneumoniae J138
guuucuuuugcaaa

SEQ ID NO: 543123 - RNA, 11 nt, Chlamydophila pneumoniae J138
guuucuuucca

SEQ ID NO: 543124 - RNA, 21 nt, Chlamydophila pneumoniae J138
guuucuuuugauugaaacuuu

SEQ ID NO: 543125 - RNA, 15 nt, Chlamydophila pneumoniae J138
guuugaucuucucua

SEQ ID NO: 543126 - RNA, 22 nt, Chlamydophila pneumoniae J138
guuuucuagaaaagauucuaaa

SEQ ID NO: 543127 - RNA, 21 nt, Chlamydophila pneumoniae J138
guuuucggggucggagauugu

SEQ ID NO: 543128 - RNA, 12 nt, Chlamydophila pneumoniae J138
guuuucuuaucc

SEQ ID NO: 543129 - RNA, 21 nt, Chlamydophila pneumoniae J138
guuuucuguugcacuuuccgu

SEQ ID NO: 543130 - RNA, 15 nt, Chlamydophila pneumoniae J138
guuuuguuucaucuu

SEQ ID NO: 543131 - RNA, 16 nt, Chlamydophila pneumoniae J138
guuuuguuucaucuuc

SEQ ID NO: 543132 - RNA, 18 nt, Chlamydophila pneumoniae J138
guuuuguuucaucuucuu

SEQ ID NO: 543133 - RNA, 21 nt, Chlamydophila pneumoniae J138
aaaucauguccuucaaaaugu

SEQ ID NO: 543134 - RNA, 20 nt, Chlamydophila pneumoniae J138
uaaaacgagcaggguaauuu

SEQ ID NO: 543135 - RNA, 21 nt, Chlamydophila pneumoniae J138
uaaaacuccacgccaaaguac

SEQ ID NO: 543136 - RNA, 13 nt, Chlamydophila pneumoniae J138
uaaaacuccacgc

SEQ ID NO: 543137 - RNA, 20 nt, Chlamydophila pneumoniae J138
uaaaacugcgcuaucaucau

SEQ ID NO: 543138 - RNA, 17 nt, Chlamydophila pneumoniae J138
uaaaacuacaggaaaac

SEQ ID NO: 543139 - RNA, 21 nt, Chlamydophila pneumoniae J138
uaaaagaacauuaagaggaaa

SEQ ID NO: 543140 - RNA, 12 nt, Chlamydophila pneumoniae J138
uaaaagaaagaa

SEQ ID NO: 543141 - RNA, 23 nt, Chlamydophila pneumoniae J138
uaaaagcauuuuugggaaaagaa

SEQ ID NO: 543142 - RNA, 17 nt, Chlamydophila pneumoniae J138
uaaaagcccuaauucau

SEQ ID NO: 543143 - RNA, 16 nt, Chlamydophila pneumoniae J138
uaaaagagcucaaaaa

SEQ ID NO: 543144 - RNA, 20 nt, Chlamydophila pneumoniae J138
uaaaacaucagcaacauaaa

SEQ ID NO: 543145 - RNA, 21 nt, Chlamydophila pneumoniae J138
uaaaacccauguuucuuccug

SEQ ID NO: 543146 - RNA, 13 nt, Chlamydophila pneumoniae J138
uaaaacagaaauu

SEQ ID NO: 543147 - RNA, 21 nt, Chlamydophila pneumoniae J138
uaaaacaagaagaucaaagau

SEQ ID NO: 543148 - RNA, 19 nt, Chlamydophila pneumoniae J138
uaaaaauuucaugaggagc

SEQ ID NO: 543149 - RNA, 13 nt, Chlamydophila pneumoniae J138
uaaaaauauaucu

SEQ ID NO: 543150 - RNA, 14 nt, Chlamydophila pneumoniae J138
uaaaaauauaucuu

SEQ ID NO: 543151 - RNA, 16 nt, Chlamydophila pneumoniae J138
uaaaaauaggagaagc

SEQ ID NO: 543152 - RNA, 19 nt, Chlamydophila pneumoniae J138
uaaaaauuaaagugaaagc

SEQ ID NO: 543153 - RNA, 22 nt, Chlamydophila pneumoniae J138
uaaaaauggcacuugagcacau

SEQ ID NO: 543154 - RNA, 13 nt, Chlamydophila pneumoniae J138
uaaaaauuuaaaa

SEQ ID NO: 543155 - RNA, 19 nt, Chlamydophila pneumoniae J138
uaaaagguauuucucucca

SEQ ID NO: 543156 - RNA, 16 nt, Chlamydophila pneumoniae J138
uaaaaguuuuuuauuu

SEQ ID NO: 543157 - RNA, 17 nt, Chlamydophila pneumoniae J138
uaaaaguucagcaagga

SEQ ID NO: 543158 - RNA, 17 nt, Chlamydophila pneumoniae J138
uaaaaguagcauccugu

SEQ ID NO: 543159 - RNA, 14 nt, Chlamydophila pneumoniae J138
uaaaauaagaaauc

SEQ ID NO: 543160 - RNA, 22 nt, Chlamydophila pneumoniae J138
uaaaauaaccccuccaaaauca

SEQ ID NO: 543161 - RNA, 16 nt, Chlamydophila pneumoniae J138
uaaaauaauuuuauua

SEQ ID NO: 543162 - RNA, 21 nt, Chlamydophila pneumoniae J138
uaaaauaaccccuccaaaauc

SEQ ID NO: 543163 - RNA, 12 nt, Chlamydophila pneumoniae J138
uaaaauaagaaa

SEQ ID NO: 543164 - RNA, 13 nt, Chlamydophila pneumoniae J138
uaaaauagacauu

SEQ ID NO: 543165 - RNA, 18 nt, Chlamydophila pneumoniae J138
uaaaaucuccucucucaa

SEQ ID NO: 543166 - RNA, 19 nt, Chlamydophila pneumoniae J138
uaaaaucuucuggagggag

SEQ ID NO: 543167 - RNA, 14 nt, Chlamydophila pneumoniae J138
uaaaaucuuucaau

SEQ ID NO: 543168 - RNA, 22 nt, Chlamydophila pneumoniae J138
uaaaaugauuuggccaacagug

SEQ ID NO: 543169 - RNA, 21 nt, Chlamydophila pneumoniae J138
uaaaauggugaagaauaauag

SEQ ID NO: 543170 - RNA, 19 nt, Chlamydophila pneumoniae J138
uaaaaugggaucagaaaau

SEQ ID NO: 543171 - RNA, 23 nt, Chlamydophila pneumoniae J138
uaaaauggguuugcuuuucauuu

SEQ ID NO: 543172 - RNA, 20 nt, Chlamydophila pneumoniae J138
uaaaaugcgguaauagguuu

SEQ ID NO: 543173 - RNA, 18 nt, Chlamydophila pneumoniae J138
uaaaaugugucuugcuga

SEQ ID NO: 543174 - RNA, 20 nt, Chlamydophila pneumoniae J138
uaaaaucaagccacagagaa

SEQ ID NO: 543175 - RNA, 14 nt, Chlamydophila pneumoniae J138
uaaaaucaacaagu

SEQ ID NO: 543176 - RNA, 23 nt, Chlamydophila pneumoniae J138
uaaaauaugcucgugcgacugcu

SEQ ID NO: 543177 - RNA, 18 nt, Chlamydophila pneumoniae J138
uaaaauaucggauuuuac

SEQ ID NO: 543178 - RNA, 19 nt, Chlamydophila pneumoniae J138
guagaauccuucucccucu

SEQ ID NO: 543179 - RNA, 22 nt, Chlamydophila pneumoniae J138
guagaauccuucucccucuaaa

SEQ ID NO: 543180 - RNA, 19 nt, Chlamydophila pneumoniae J138
guagaaggggguucuaaga

SEQ ID NO: 543181 - RNA, 16 nt, Chlamydophila pneumoniae J138
guagaauaacgcaagg

SEQ ID NO: 543182 - RNA, 17 nt, Chlamydophila pneumoniae J138
guagaacuucucaagaa

SEQ ID NO: 543183 - RNA, 12 nt, Chlamydophila pneumoniae J138
guacuuuuugcc

SEQ ID NO: 543184 - RNA, 19 nt, Chlamydophila pneumoniae J138
guacuuccccaaacaugga

SEQ ID NO: 543185 - RNA, 14 nt, Chlamydophila pneumoniae J138
guacuucuuacccu

SEQ ID NO: 543186 - RNA, 19 nt, Chlamydophila pneumoniae J138
guacuaauuacagaauccc

SEQ ID NO: 543187 - RNA, 20 nt, Chlamydophila pneumoniae J138
guagacaacaagucuucccu

SEQ ID NO: 543188 - RNA, 18 nt, Chlamydophila pneumoniae J138
guagacaacaagucuucc

SEQ ID NO: 543189 - RNA, 18 nt, Chlamydophila pneumoniae J138
guagaucauaaacagcag

SEQ ID NO: 543190 - RNA, 15 nt, Chlamydophila pneumoniae J138
guagccccagcaacc

SEQ ID NO: 543191 - RNA, 20 nt, Chlamydophila pneumoniae J138
guagaucuucugaaaucaaa

SEQ ID NO: 543192 - RNA, 19 nt, Chlamydophila pneumoniae J138
guagaucuucugaaaucaa

SEQ ID NO: 543193 - RNA, 12 nt, Chlamydophila pneumoniae J138
guagauccauga

SEQ ID NO: 543194 - RNA, 23 nt, Chlamydophila pneumoniae J138
guagccgaggcgauuuucaugga

SEQ ID NO: 543195 - RNA, 11 nt, Chlamydophila pneumoniae J138
guagccccagc

SEQ ID NO: 543196 - RNA, 23 nt, Chlamydophila pneumoniae J138
guagccccggucgucuuagaauc

SEQ ID NO: 543197 - RNA, 18 nt, Chlamydophila pneumoniae J138
guaggaugugaaggauca

SEQ ID NO: 543198 - RNA, 12 nt, Chlamydophila pneumoniae J138
guaggagcagcg

SEQ ID NO: 543199 - RNA, 18 nt, Chlamydophila pneumoniae J138
guaggaccuacugggaaa

SEQ ID NO: 543200 - RNA, 18 nt, Chlamydophila pneumoniae J138
guagcucaggaaaacuua

SEQ ID NO: 543201 - RNA, 15 nt, Chlamydophila pneumoniae J138
guagcuauucucaaa

SEQ ID NO: 543202 - RNA, 19 nt, Chlamydophila pneumoniae J138
guagcgucucuucuuccuc

SEQ ID NO: 543203 - RNA, 22 nt, Chlamydophila pneumoniae J138
guagcuacggagagguuaugua

SEQ ID NO: 543204 - RNA, 21 nt, Chlamydophila pneumoniae J138
guaguaaggagagacuguguu

SEQ ID NO: 543205 - RNA, 21 nt, Chlamydophila pneumoniae J138
guaggcauacaguagaaacau

SEQ ID NO: 543206 - RNA, 16 nt, Chlamydophila pneumoniae J138
guagugcuaucauaac

SEQ ID NO: 543207 - RNA, 17 nt, Chlamydophila pneumoniae J138
guaguggugaacuaaau

SEQ ID NO: 543208 - RNA, 18 nt, Chlamydophila pneumoniae J138
guagucaaaaauucuucg

SEQ ID NO: 543209 - RNA, 18 nt, Chlamydophila pneumoniae J138
guauauucugaaauuucu

SEQ ID NO: 543210 - RNA, 21 nt, Chlamydophila pneumoniae J138
guauauccacgaucuagaaga

SEQ ID NO: 543211 - RNA, 21 nt, Chlamydophila pneumoniae J138
guauaucagcaaaaaacugca

SEQ ID NO: 543212 - RNA, 18 nt, Chlamydophila pneumoniae J138
guauauccacgaucuaga

SEQ ID NO: 543213 - RNA, 23 nt, Chlamydophila pneumoniae J138
guauauaagauaauagagaagaa

SEQ ID NO: 543214 - RNA, 21 nt, Chlamydophila pneumoniae J138
guauauaaaagaggaagauga

SEQ ID NO: 543215 - RNA, 19 nt, Chlamydophila pneumoniae J138
guauauaagauaauagaga

SEQ ID NO: 543216 - RNA, 13 nt, Chlamydophila pneumoniae J138
guauagaaacacc

SEQ ID NO: 543217 - RNA, 20 nt, Chlamydophila pneumoniae J138
guauaccauguuaucaagac

SEQ ID NO: 543218 - RNA, 14 nt, Chlamydophila pneumoniae J138
guauagauuuuccg

SEQ ID NO: 543219 - RNA, 19 nt, Chlamydophila pneumoniae J138
guauagagcgguucuuucu

SEQ ID NO: 543220 - RNA, 15 nt, Chlamydophila pneumoniae J138
guauagagaagauuu

SEQ ID NO: 543221 - RNA, 22 nt, Chlamydophila pneumoniae J138
guauagacuccuuaacaaccgc

SEQ ID NO: 543222 - RNA, 18 nt, Chlamydophila pneumoniae J138
guauagcuggcaaugaua

SEQ ID NO: 543223 - RNA, 13 nt, Chlamydophila pneumoniae J138
guauaggcauuaa

SEQ ID NO: 543224 - RNA, 17 nt, Chlamydophila pneumoniae J138
guauagcuggcaaugau

SEQ ID NO: 543225 - RNA, 22 nt, Chlamydophila pneumoniae J138
guauaaaguuuguaaaaacugu

SEQ ID NO: 543226 - RNA, 17 nt, Chlamydophila pneumoniae J138
guaguuugccuucuuau

SEQ ID NO: 543227 - RNA, 17 nt, Chlamydophila pneumoniae J138
guaguuucuaaaacaga

SEQ ID NO: 543228 - RNA, 13 nt, Chlamydophila pneumoniae J138
guaguucuugcca

SEQ ID NO: 543229 - RNA, 22 nt, Chlamydophila pneumoniae J138
guauaacaucuaaaaaugcacu

SEQ ID NO: 543230 - RNA, 13 nt, Chlamydophila pneumoniae J138
guauaacaucuaa

SEQ ID NO: 543231 - RNA, 20 nt, Chlamydophila pneumoniae J138
guauaacaucuaaaaaugca

SEQ ID NO: 543232 - RNA, 15 nt, Chlamydophila pneumoniae J138
guauacaucccauuc

SEQ ID NO: 543233 - RNA, 19 nt, Chlamydophila pneumoniae J138
guaucgagcucuuuaagaa

SEQ ID NO: 543234 - RNA, 21 nt, Chlamydophila pneumoniae J138
guaucgagcucuuuaagaacu

SEQ ID NO: 543235 - RNA, 13 nt, Chlamydophila pneumoniae J138
guauccuugauuu

SEQ ID NO: 543236 - RNA, 17 nt, Chlamydophila pneumoniae J138
guaucuagcuuugucuc

SEQ ID NO: 543237 - RNA, 17 nt, Chlamydophila pneumoniae J138
guaugaggagauaaaga

SEQ ID NO: 543238 - RNA, 13 nt, Chlamydophila pneumoniae J138
guaucuuuuugca

SEQ ID NO: 543239 - RNA, 19 nt, Chlamydophila pneumoniae J138
guaucuuuuugcagauccc

SEQ ID NO: 543240 - RNA, 20 nt, Chlamydophila pneumoniae J138
guaucagcaagcccuccagu

SEQ ID NO: 543241 - RNA, 23 nt, Chlamydophila pneumoniae J138
guaucaauaaugacucuagagua

SEQ ID NO: 543242 - RNA, 23 nt, Chlamydophila pneumoniae J138
guauccgcugcccaugcuuaucu

SEQ ID NO: 543243 - RNA, 19 nt, Chlamydophila pneumoniae J138
guauuuucuucaacauaca

SEQ ID NO: 543244 - RNA, 16 nt, Chlamydophila pneumoniae J138
guauuuugcaaaugaa

SEQ ID NO: 543245 - RNA, 21 nt, Chlamydophila pneumoniae J138
gucaaaauaucauucacuauu

SEQ ID NO: 543246 - RNA, 17 nt, Chlamydophila pneumoniae J138
gucaaauacuucuccug

SEQ ID NO: 543247 - RNA, 14 nt, Chlamydophila pneumoniae J138
guauuuaaauucug

SEQ ID NO: 543248 - RNA, 20 nt, Chlamydophila pneumoniae J138
guauuguguucccucuucuu

SEQ ID NO: 543249 - RNA, 19 nt, Chlamydophila pneumoniae J138
guauucaacacggacacua

SEQ ID NO: 543250 - RNA, 22 nt, Chlamydophila pneumoniae J138
guauugcaaauacguccuguga

SEQ ID NO: 543251 - RNA, 13 nt, Chlamydophila pneumoniae J138
guauucuguaaga

SEQ ID NO: 543252 - RNA, 17 nt, Chlamydophila pneumoniae J138
guauucuguaagaaucc

SEQ ID NO: 543253 - RNA, 15 nt, Chlamydophila pneumoniae J138
guauuccuuggauuu

SEQ ID NO: 543254 - RNA, 16 nt, Chlamydophila pneumoniae J138
guaugaucaagaggag

SEQ ID NO: 543255 - RNA, 19 nt, Chlamydophila pneumoniae J138
guaugagcuccaaaauaau

SEQ ID NO: 543256 - RNA, 19 nt, Chlamydophila pneumoniae J138
guauggaauucaaacuccu

SEQ ID NO: 543257 - RNA, 21 nt, Chlamydophila pneumoniae J138
guauggauuucuccagcagcu

SEQ ID NO: 543258 - RNA, 11 nt, Chlamydophila pneumoniae J138
gucacuucaau

SEQ ID NO: 543259 - RNA, 21 nt, Chlamydophila pneumoniae J138
gucaccuuaauggcuccuacu

SEQ ID NO: 543260 - RNA, 19 nt, Chlamydophila pneumoniae J138
gucacacugcgagagaaag

SEQ ID NO: 543261 - RNA, 16 nt, Chlamydophila pneumoniae J138
gucacagcauuuucuc

SEQ ID NO: 543262 - RNA, 17 nt, Chlamydophila pneumoniae J138
gucacagcauuuucucu

SEQ ID NO: 543263 - RNA, 16 nt, Chlamydophila pneumoniae J138
gucaauaagcuugcca

SEQ ID NO: 543264 - RNA, 22 nt, Chlamydophila pneumoniae J138
gucaauaagcuugccagcagaa

SEQ ID NO: 543265 - RNA, 18 nt, Chlamydophila pneumoniae J138
gucaggaacccuggauga

SEQ ID NO: 543266 - RNA, 13 nt, Chlamydophila pneumoniae J138
gucaguaaaacac

SEQ ID NO: 543267 - RNA, 15 nt, Chlamydophila pneumoniae J138
gucaugauuuuucaa

SEQ ID NO: 543268 - RNA, 16 nt, Chlamydophila pneumoniae J138
gucaugauuuuucaau

SEQ ID NO: 543269 - RNA, 16 nt, Chlamydophila pneumoniae J138
gucauuaccugcuaaa

SEQ ID NO: 543270 - RNA, 21 nt, Chlamydophila pneumoniae J138
gucauugccuugcugcauacu

SEQ ID NO: 543271 - RNA, 22 nt, Chlamydophila pneumoniae J138
gucauucuauggucucccucac

SEQ ID NO: 543272 - RNA, 15 nt, Chlamydophila pneumoniae J138
gucccacaaaugaua

SEQ ID NO: 543273 - RNA, 12 nt, Chlamydophila pneumoniae J138
gucccaaucaag

SEQ ID NO: 543274 - RNA, 21 nt, Chlamydophila pneumoniae J138
guccauuucauguaagaaugu

SEQ ID NO: 543275 - RNA, 14 nt, Chlamydophila pneumoniae J138
guccgaagccuuca

SEQ ID NO: 543276 - RNA, 14 nt, Chlamydophila pneumoniae J138
gucgaaagaucaga

SEQ ID NO: 543277 - RNA, 15 nt, Chlamydophila pneumoniae J138
guccuguuaagaugu

SEQ ID NO: 543278 - RNA, 15 nt, Chlamydophila pneumoniae J138
guccuggcgaugcca

SEQ ID NO: 543279 - RNA, 15 nt, Chlamydophila pneumoniae J138
guccucuaugguuuu

SEQ ID NO: 543280 - RNA, 15 nt, Chlamydophila pneumoniae J138
gucgcaucaaugacu

SEQ ID NO: 543281 - RNA, 17 nt, Chlamydophila pneumoniae J138
gucgcaguaaugccaau

SEQ ID NO: 543282 - RNA, 14 nt, Chlamydophila pneumoniae J138
gucgagaaccucca

SEQ ID NO: 543283 - RNA, 16 nt, Chlamydophila pneumoniae J138
gucgagaaccuccacc

SEQ ID NO: 543284 - RNA, 17 nt, Chlamydophila pneumoniae J138
gucgagaaccuccacca

SEQ ID NO: 543285 - RNA, 13 nt, Chlamydophila pneumoniae J138
gucggaguuuuuu

SEQ ID NO: 543286 - RNA, 16 nt, Chlamydophila pneumoniae J138
gucggagauuguuuca

SEQ ID NO: 543287 - RNA, 21 nt, Chlamydophila pneumoniae J138
gucuacagaggaaucuauccu

SEQ ID NO: 543288 - RNA, 18 nt, Chlamydophila pneumoniae J138
gucuaagaaucguucuua

SEQ ID NO: 543289 - RNA, 12 nt, Chlamydophila pneumoniae J138
gucuaaucccca

SEQ ID NO: 543290 - RNA, 13 nt, Chlamydophila pneumoniae J138
gucuaaagaagau

SEQ ID NO: 543291 - RNA, 21 nt, Chlamydophila pneumoniae J138
gucuaaagauuggaauauaau

SEQ ID NO: 543292 - RNA, 18 nt, Chlamydophila pneumoniae J138
ggugagaucgaaaaauac

SEQ ID NO: 543293 - RNA, 16 nt, Chlamydophila pneumoniae J138
gguggaacuauccugu

SEQ ID NO: 543294 - RNA, 18 nt, Chlamydophila pneumoniae J138
ggugcuguuguaauaaaa

SEQ ID NO: 543295 - RNA, 17 nt, Chlamydophila pneumoniae J138
gguggguagccaggaug

SEQ ID NO: 543296 - RNA, 18 nt, Chlamydophila pneumoniae J138
ggugggaagccuggaaau

SEQ ID NO: 543297 - RNA, 22 nt, Chlamydophila pneumoniae J138
gguucuccacaugcccaaacau

SEQ ID NO: 543298 - RNA, 19 nt, Chlamydophila pneumoniae J138
gguuccuggauuuaggaug

SEQ ID NO: 543299 - RNA, 22 nt, Chlamydophila pneumoniae J138
gguucauuuccaaauucuugca

SEQ ID NO: 543300 - RNA, 22 nt, Chlamydophila pneumoniae J138
gguuccacagagaccuucucuu

SEQ ID NO: 543301 - RNA, 13 nt, Chlamydophila pneumoniae J138
gguuaaaauagac

SEQ ID NO: 543302 - RNA, 17 nt, Chlamydophila pneumoniae J138
gguguauaguauuuuua

SEQ ID NO: 543303 - RNA, 13 nt, Chlamydophila pneumoniae J138
gguucuuucuaga

SEQ ID NO: 543304 - RNA, 22 nt, Chlamydophila pneumoniae J138
gguuguacuuuuacugaaauua

SEQ ID NO: 543305 - RNA, 19 nt, Chlamydophila pneumoniae J138
gguuucuuuuuuuauaaag

SEQ ID NO: 543306 - RNA, 17 nt, Chlamydophila pneumoniae J138
gguuucuuuccaucaua

SEQ ID NO: 543307 - RNA, 18 nt, Chlamydophila pneumoniae J138
guaaaaaauacaggaauc

SEQ ID NO: 543308 - RNA, 13 nt, Chlamydophila pneumoniae J138
gguuuuuccaacu

SEQ ID NO: 543309 - RNA, 15 nt, Chlamydophila pneumoniae J138
guaaaacacaaauag

SEQ ID NO: 543310 - RNA, 21 nt, Chlamydophila pneumoniae J138
guaaaacacaaauagcaagag

SEQ ID NO: 543311 - RNA, 11 nt, Chlamydophila pneumoniae J138
guaaaacacaa

SEQ ID NO: 543312 - RNA, 13 nt, Chlamydophila pneumoniae J138
guaaaaagaaaga

SEQ ID NO: 543313 - RNA, 12 nt, Chlamydophila pneumoniae J138
guaaaaauauag

SEQ ID NO: 543314 - RNA, 13 nt, Chlamydophila pneumoniae J138
guaccuaggaucu

SEQ ID NO: 543315 - RNA, 19 nt, Chlamydophila pneumoniae J138
guacgcaaguaaagaaauu

SEQ ID NO: 543316 - RNA, 18 nt, Chlamydophila pneumoniae J138
guacgcaaguaaagaaau

SEQ ID NO: 543317 - RNA, 21 nt, Chlamydophila pneumoniae J138
guaccuucucgucauucugca

SEQ ID NO: 543318 - RNA, 17 nt, Chlamydophila pneumoniae J138
guaccacauacucuuca

SEQ ID NO: 543319 - RNA, 16 nt, Chlamydophila pneumoniae J138
guaccacauacucuuc

SEQ ID NO: 543320 - RNA, 14 nt, Chlamydophila pneumoniae J138
guaccaagaaaaua

SEQ ID NO: 543321 - RNA, 12 nt, Chlamydophila pneumoniae J138
guaccaagaaaa

SEQ ID NO: 543322 - RNA, 18 nt, Chlamydophila pneumoniae J138
guacaggaaguccaugua

SEQ ID NO: 543323 - RNA, 23 nt, Chlamydophila pneumoniae J138
guacagaccguccuccccauaca

SEQ ID NO: 543324 - RNA, 14 nt, Chlamydophila pneumoniae J138
guaauccuucuuuc

SEQ ID NO: 543325 - RNA, 22 nt, Chlamydophila pneumoniae J138
guaauccuaauuccuucaaagc

SEQ ID NO: 543326 - RNA, 21 nt, Chlamydophila pneumoniae J138
guaaucaugauaaaaauuuuc

SEQ ID NO: 543327 - RNA, 24 nt, Chlamydophila pneumoniae J138
aaauagauaagucgaaucuaaaaa

SEQ ID NO: 543328 - RNA, 15 nt, Chlamydophila pneumoniae J138
aaauagagaaacuuu

SEQ ID NO: 543329 - RNA, 15 nt, Chlamydophila pneumoniae J138
aaauagaaggccagu

SEQ ID NO: 543330 - RNA, 12 nt, Chlamydophila pneumoniae J138
aaauagaagcca

SEQ ID NO: 543331 - RNA, 19 nt, Chlamydophila pneumoniae J138
guaaucuuuuuuaaagcua

SEQ ID NO: 543332 - RNA, 15 nt, Chlamydophila pneumoniae J138
guaaugcuuagccau

SEQ ID NO: 543333 - RNA, 14 nt, Chlamydophila pneumoniae J138
guaaugccagcagc

SEQ ID NO: 543334 - RNA, 19 nt, Chlamydophila pneumoniae J138
guacaagcuucaucaaaac

SEQ ID NO: 543335 - RNA, 17 nt, Chlamydophila pneumoniae J138
guacaagcuucaucaaa

SEQ ID NO: 543336 - RNA, 20 nt, Chlamydophila pneumoniae J138
guacacauugucucuuuuaa

SEQ ID NO: 543337 - RNA, 22 nt, Chlamydophila pneumoniae J138
guaauuauuuucuacacuguug

SEQ ID NO: 543338 - RNA, 20 nt, Chlamydophila pneumoniae J138
guaauuccaaaauaaaagga

SEQ ID NO: 543339 - RNA, 14 nt, Chlamydophila pneumoniae J138
guaauuacagaucu

SEQ ID NO: 543340 - RNA, 14 nt, Chlamydophila pneumoniae J138
guaaccugaaagcg

SEQ ID NO: 543341 - RNA, 12 nt, Chlamydophila pneumoniae J138
guaacuaauaau

SEQ ID NO: 543342 - RNA, 20 nt, Chlamydophila pneumoniae J138
guaagacuaaaaaagagacc

SEQ ID NO: 543343 - RNA, 15 nt, Chlamydophila pneumoniae J138
guaagacuaaaaaag

SEQ ID NO: 543344 - RNA, 22 nt, Chlamydophila pneumoniae J138
guaagaacguauacgucccaca

SEQ ID NO: 543345 - RNA, 18 nt, Chlamydophila pneumoniae J138
guaagaaggcagagaacu

SEQ ID NO: 543346 - RNA, 21 nt, Chlamydophila pneumoniae J138
guaagcagugugcugauuuua

SEQ ID NO: 543347 - RNA, 22 nt, Chlamydophila pneumoniae J138
guaagcagugugcugauuuuaa

SEQ ID NO: 543348 - RNA, 17 nt, Chlamydophila pneumoniae J138
guaacucuuaagaauaa

SEQ ID NO: 543349 - RNA, 19 nt, Chlamydophila pneumoniae J138
guaauagcaggaguuuuca

SEQ ID NO: 543350 - RNA, 18 nt, Chlamydophila pneumoniae J138
guaauagguuucaauaga

SEQ ID NO: 543351 - RNA, 21 nt, Chlamydophila pneumoniae J138
guaauagguuucaauagaagc

SEQ ID NO: 543352 - RNA, 22 nt, Chlamydophila pneumoniae J138
guaauagacaacgcaggaagaa

SEQ ID NO: 543353 - RNA, 17 nt, Chlamydophila pneumoniae J138
guaaggcgaaaucuuca

SEQ ID NO: 543354 - RNA, 18 nt, Chlamydophila pneumoniae J138
guaagcugcaaucucaaa

SEQ ID NO: 543355 - RNA, 22 nt, Chlamydophila pneumoniae J138
guaaguacacauugucucuuuu

SEQ ID NO: 543356 - RNA, 12 nt, Chlamydophila pneumoniae J138
guaagggaugcu

SEQ ID NO: 543357 - RNA, 15 nt, Chlamydophila pneumoniae J138
guaaguacacauugu

SEQ ID NO: 543358 - RNA, 17 nt, Chlamydophila pneumoniae J138
guaaacagcaaaguaau

SEQ ID NO: 543359 - RNA, 20 nt, Chlamydophila pneumoniae J138
guaaaacugcgcuaucauca

SEQ ID NO: 543360 - RNA, 16 nt, Chlamydophila pneumoniae J138
guaaaacuacaggaaa

SEQ ID NO: 543361 - RNA, 15 nt, Chlamydophila pneumoniae J138
guaaaagcccuaauu

SEQ ID NO: 543362 - RNA, 19 nt, Chlamydophila pneumoniae J138
guaaagcauuggacaacgc

SEQ ID NO: 543363 - RNA, 18 nt, Chlamydophila pneumoniae J138
guaaagccacauucuucu

SEQ ID NO: 543364 - RNA, 14 nt, Chlamydophila pneumoniae J138
guaaagagcuucuu

SEQ ID NO: 543365 - RNA, 14 nt, Chlamydophila pneumoniae J138
guaaaguaugcaua

SEQ ID NO: 543366 - RNA, 17 nt, Chlamydophila pneumoniae J138
guaaagguuguaaggac

SEQ ID NO: 543367 - RNA, 12 nt, Chlamydophila pneumoniae J138
guaaagaaaagc

SEQ ID NO: 543368 - RNA, 15 nt, Chlamydophila pneumoniae J138
guaaagaaaagcaau

SEQ ID NO: 543369 - RNA, 16 nt, Chlamydophila pneumoniae J138
guaacauccauagaga

SEQ ID NO: 543370 - RNA, 18 nt, Chlamydophila pneumoniae J138
guaaccaacaucaaagaa

SEQ ID NO: 543371 - RNA, 19 nt, Chlamydophila pneumoniae J138
guaaccaacaucaaagaau

SEQ ID NO: 543372 - RNA, 14 nt, Chlamydophila pneumoniae J138
guaaccacaggauc

SEQ ID NO: 543373 - RNA, 20 nt, Chlamydophila pneumoniae J138
guaaauuuuuccuucaacac

SEQ ID NO: 543374 - RNA, 17 nt, Chlamydophila pneumoniae J138
guaaauguuuugcgaua

SEQ ID NO: 543375 - RNA, 21 nt, Chlamydophila pneumoniae J138
guaaaugccucuuucauacua

SEQ ID NO: 543376 - RNA, 13 nt, Chlamydophila pneumoniae J138
guaaauaauaacc

SEQ ID NO: 543377 - RNA, 21 nt, Chlamydophila pneumoniae J138
guaaauacaaaacaaaagcca

SEQ ID NO: 543378 - RNA, 21 nt, Chlamydophila pneumoniae J138
guaaauauuuuaccauugaga

SEQ ID NO: 543379 - RNA, 17 nt, Chlamydophila pneumoniae J138
gaucacauagaaaacau

SEQ ID NO: 543380 - RNA, 13 nt, Chlamydophila pneumoniae J138
gaucacagggaca

SEQ ID NO: 543381 - RNA, 16 nt, Chlamydophila pneumoniae J138
gaucacaagaaagaau

SEQ ID NO: 543382 - RNA, 16 nt, Chlamydophila pneumoniae J138
gcaacuaaacucucca

SEQ ID NO: 543383 - RNA, 22 nt, Chlamydophila pneumoniae J138
gcaacuaaacugggaagaccac

SEQ ID NO: 543384 - RNA, 16 nt, Chlamydophila pneumoniae J138
gcaacucuuuaggucu

SEQ ID NO: 543385 - RNA, 18 nt, Chlamydophila pneumoniae J138
gcaagaaguguauuuaaa

SEQ ID NO: 543386 - RNA, 18 nt, Chlamydophila pneumoniae J138
gcaagcacuuguuuuuuc

SEQ ID NO: 543387 - RNA, 15 nt, Chlamydophila pneumoniae J138
gcaagaucuaacuuc

SEQ ID NO: 543388 - RNA, 18 nt, Chlamydophila pneumoniae J138
gcaagaucuaacuucacc

SEQ ID NO: 543389 - RNA, 17 nt, Chlamydophila pneumoniae J138
gcaagagcucuugagaa

SEQ ID NO: 543390 - RNA, 23 nt, Chlamydophila pneumoniae J138
gcaagcccuccaguuuuacgaac

SEQ ID NO: 543391 - RNA, 16 nt, Chlamydophila pneumoniae J138
gcaagccgcaaaccau

SEQ ID NO: 543392 - RNA, 13 nt, Chlamydophila pneumoniae J138
gcaaggagcuuuu

SEQ ID NO: 543393 - RNA, 13 nt, Chlamydophila pneumoniae J138
gcaaggcaaugau

SEQ ID NO: 543394 - RNA, 19 nt, Chlamydophila pneumoniae J138
gcaagcuucuuguuuuugu

SEQ ID NO: 543395 - RNA, 21 nt, Chlamydophila pneumoniae J138
gcaagcucuggauugaaagag

SEQ ID NO: 543396 - RNA, 17 nt, Chlamydophila pneumoniae J138
gcaaggggaguuuucuu

SEQ ID NO: 543397 - RNA, 15 nt, Chlamydophila pneumoniae J138
gcaagggcggagaau

SEQ ID NO: 543398 - RNA, 22 nt, Chlamydophila pneumoniae J138
gcaaguuguugauaauuacaga

SEQ ID NO: 543399 - RNA, 18 nt, Chlamydophila pneumoniae J138
gcaaguaaucaugauaaa

SEQ ID NO: 543400 - RNA, 14 nt, Chlamydophila pneumoniae J138
gcaaguaaagaaau

SEQ ID NO: 543401 - RNA, 22 nt, Chlamydophila pneumoniae J138
gcaaguaaucaugauaaaaauu

SEQ ID NO: 543402 - RNA, 21 nt, Chlamydophila pneumoniae J138
gcaauacaccaagggaugcca

SEQ ID NO: 543403 - RNA, 14 nt, Chlamydophila pneumoniae J138
gcaauauauccagg

SEQ ID NO: 543404 - RNA, 15 nt, Chlamydophila pneumoniae J138
gcaauaucuauagaa

SEQ ID NO: 543405 - RNA, 17 nt, Chlamydophila pneumoniae J138
gcaauaucuauagaagg

SEQ ID NO: 543406 - RNA, 23 nt, Chlamydophila pneumoniae J138
gcaauauuuugacguaaugcaga

SEQ ID NO: 543407 - RNA, 17 nt, Chlamydophila pneumoniae J138
gcaauccaggaauagaa

SEQ ID NO: 543408 - RNA, 17 nt, Chlamydophila pneumoniae J138
gcaauccaguagaucuu

SEQ ID NO: 543409 - RNA, 14 nt, Chlamydophila pneumoniae J138
gcaaucagcaacau

SEQ ID NO: 543410 - RNA, 21 nt, Chlamydophila pneumoniae J138
gcaaucagugcugccaugaca

SEQ ID NO: 543411 - RNA, 23 nt, Chlamydophila pneumoniae J138
gcaaucugcagguaagggaugcu

SEQ ID NO: 543412 - RNA, 16 nt, Chlamydophila pneumoniae J138
gcaaucugaaugccug

SEQ ID NO: 543413 - RNA, 23 nt, Chlamydophila pneumoniae J138
gcaaucguguuuuccugagcuuu

SEQ ID NO: 543414 - RNA, 22 nt, Chlamydophila pneumoniae J138
gcaaucuuugaucgcuugugca

SEQ ID NO: 543415 - RNA, 15 nt, Chlamydophila pneumoniae J138
gcaaugauauccuca

SEQ ID NO: 543416 - RNA, 16 nt, Chlamydophila pneumoniae J138
gcaaugcuucuucagc

SEQ ID NO: 543417 - RNA, 15 nt, Chlamydophila pneumoniae J138
gcaaugcuucuucag

SEQ ID NO: 543418 - RNA, 16 nt, Chlamydophila pneumoniae J138
gcaauuccgaagaaga

SEQ ID NO: 543419 - RNA, 20 nt, Chlamydophila pneumoniae J138
gcaauucgguagagcuagaa

SEQ ID NO: 543420 - RNA, 19 nt, Chlamydophila pneumoniae J138
gcaauuucuccuaggucua

SEQ ID NO: 543421 - RNA, 15 nt, Chlamydophila pneumoniae J138
gcaauuuucucaaua

SEQ ID NO: 543422 - RNA, 16 nt, Chlamydophila pneumoniae J138
gcacaaaauaaaaccc

SEQ ID NO: 543423 - RNA, 12 nt, Chlamydophila pneumoniae J138
gcacaaaauaaa

SEQ ID NO: 543424 - RNA, 17 nt, Chlamydophila pneumoniae J138
gcaccaaagaugcgcuc

SEQ ID NO: 543425 - RNA, 23 nt, Chlamydophila pneumoniae J138
gcacaucgcguauagaugcagca

SEQ ID NO: 543426 - RNA, 13 nt, Chlamydophila pneumoniae J138
gcacauaagauga

SEQ ID NO: 543427 - RNA, 14 nt, Chlamydophila pneumoniae J138
gcacagcaaugaca

SEQ ID NO: 543428 - RNA, 17 nt, Chlamydophila pneumoniae J138
gcaccauaauggauacc

SEQ ID NO: 543429 - RNA, 18 nt, Chlamydophila pneumoniae J138
gcaccaauugcagucacu

SEQ ID NO: 543430 - RNA, 19 nt, Chlamydophila pneumoniae J138
gcaccacgaccuacaccau

SEQ ID NO: 543431 - RNA, 15 nt, Chlamydophila pneumoniae J138
gcacgcuuucgucua

SEQ ID NO: 543432 - RNA, 17 nt, Chlamydophila pneumoniae J138
gcaccuuuaggaagcug

SEQ ID NO: 543433 - RNA, 17 nt, Chlamydophila pneumoniae J138
gcacucucugcagggaa

SEQ ID NO: 543434 - RNA, 14 nt, Chlamydophila pneumoniae J138
gcacugaugaaaaa

SEQ ID NO: 543435 - RNA, 10 nt, Chlamydophila pneumoniae J138
gcacuuuccg

SEQ ID NO: 543436 - RNA, 21 nt, Chlamydophila pneumoniae J138
gcacuugcucuuuaauaaggc

SEQ ID NO: 543437 - RNA, 17 nt, Chlamydophila pneumoniae J138
gcacuuaaaaaacuucc

SEQ ID NO: 543438 - RNA, 13 nt, Chlamydophila pneumoniae J138
gcacuuacuucaa

SEQ ID NO: 543439 - RNA, 20 nt, Chlamydophila pneumoniae J138
gcagaaguccuaucaaagca

SEQ ID NO: 543440 - RNA, 17 nt, Chlamydophila pneumoniae J138
gcagaaguaaccgccug

SEQ ID NO: 543441 - RNA, 19 nt, Chlamydophila pneumoniae J138
gcagaagguuccacagaga

SEQ ID NO: 543442 - RNA, 20 nt, Chlamydophila pneumoniae J138
gcagagaaauuaacagagcg

SEQ ID NO: 543443 - RNA, 22 nt, Chlamydophila pneumoniae J138
gcagagaacuuucgucuuugcu

SEQ ID NO: 543444 - RNA, 23 nt, Chlamydophila pneumoniae J138
gcagagucucaguugagaaccuu

SEQ ID NO: 543445 - RNA, 14 nt, Chlamydophila pneumoniae J138
gcagaguccuucuu

SEQ ID NO: 543446 - RNA, 19 nt, Chlamydophila pneumoniae J138
gcagaguuuuucccucgcu

SEQ ID NO: 543447 - RNA, 15 nt, Chlamydophila pneumoniae J138
gcagauacuaaacuc

SEQ ID NO: 543448 - RNA, 19 nt, Chlamydophila pneumoniae J138
gcagauagacaaccuagaa

SEQ ID NO: 543449 - RNA, 16 nt, Chlamydophila pneumoniae J138
gcagauagcuuacaga

SEQ ID NO: 543450 - RNA, 18 nt, Chlamydophila pneumoniae J138
gcagaguccuucuuuucc

SEQ ID NO: 543451 - RNA, 19 nt, Chlamydophila pneumoniae J138
gcagagccgucuacuuuug

SEQ ID NO: 543452 - RNA, 18 nt, Chlamydophila pneumoniae J138
gcagagaugcuaacaacu

SEQ ID NO: 543453 - RNA, 21 nt, Chlamydophila pneumoniae J138
gcagaucauaucggcagcagc

SEQ ID NO: 543454 - RNA, 17 nt, Chlamydophila pneumoniae J138
gcagcacucuuuuucua

SEQ ID NO: 543455 - RNA, 21 nt, Chlamydophila pneumoniae J138
gcagcauaaguuagccuggcu

SEQ ID NO: 543456 - RNA, 22 nt, Chlamydophila pneumoniae J138
gcagcgugaauaucaucacuaa

SEQ ID NO: 543457 - RNA, 20 nt, Chlamydophila pneumoniae J138
gcaggcaucacuaaucucag

SEQ ID NO: 543458 - RNA, 18 nt, Chlamydophila pneumoniae J138
gcagggaauccuguaaca

SEQ ID NO: 543459 - RNA, 14 nt, Chlamydophila pneumoniae J138
gcagguucuugaau

SEQ ID NO: 543460 - RNA, 13 nt, Chlamydophila pneumoniae J138
gcauaauuuuucu

SEQ ID NO: 543461 - RNA, 15 nt, Chlamydophila pneumoniae J138
gcauaauuuuucuua

SEQ ID NO: 543462 - RNA, 18 nt, Chlamydophila pneumoniae J138
gcaguagguaagaagcug

SEQ ID NO: 543463 - RNA, 17 nt, Chlamydophila pneumoniae J138
gcaucacgaaaaggaga

SEQ ID NO: 543464 - RNA, 23 nt, Chlamydophila pneumoniae J138
gcaucacggaguguuugaagaug

SEQ ID NO: 543465 - RNA, 15 nt, Chlamydophila pneumoniae J138
gcaucagaaucguuc

SEQ ID NO: 543466 - RNA, 19 nt, Chlamydophila pneumoniae J138
gcaucagaaucguucccau

SEQ ID NO: 543467 - RNA, 23 nt, Chlamydophila pneumoniae J138
gcauauaaagacucucuuccaaa

SEQ ID NO: 543468 - RNA, 14 nt, Chlamydophila pneumoniae J138
gcauauaaagacuc

SEQ ID NO: 543469 - RNA, 17 nt, Chlamydophila pneumoniae J138
gcaucgcuaucagcugg

SEQ ID NO: 543470 - RNA, 16 nt, Chlamydophila pneumoniae J138
gcaugucguaggaagu

SEQ ID NO: 543471 - RNA, 18 nt, Chlamydophila pneumoniae J138
gcaugaacgugcaucucu

SEQ ID NO: 543472 - RNA, 16 nt, Chlamydophila pneumoniae J138
gcaucuuuucaaaaga

SEQ ID NO: 543473 - RNA, 16 nt, Chlamydophila pneumoniae J138
gcauuaucuaagaaua

SEQ ID NO: 543474 - RNA, 15 nt, Chlamydophila pneumoniae J138
gcauucucaauucug

SEQ ID NO: 543475 - RNA, 22 nt, Chlamydophila pneumoniae J138
gcauuuaaacuaagaauaccua

SEQ ID NO: 543476 - RNA, 16 nt, Chlamydophila pneumoniae J138
gcauuuaaacuaagaa

SEQ ID NO: 543477 - RNA, 21 nt, Chlamydophila pneumoniae J138
gcauuguuuguccuaggagag

SEQ ID NO: 543478 - RNA, 22 nt, Chlamydophila pneumoniae J138
gcauugaauccuucuauagcaa

SEQ ID NO: 543479 - RNA, 15 nt, Chlamydophila pneumoniae J138
gcauugggaaggauc

SEQ ID NO: 543480 - RNA, 20 nt, Chlamydophila pneumoniae J138
gccaagauacuacuuacaag

SEQ ID NO: 543481 - RNA, 19 nt, Chlamydophila pneumoniae J138
gccaaaccaugaggcugcu

SEQ ID NO: 543482 - RNA, 17 nt, Chlamydophila pneumoniae J138
gccaaaauuuccuaccu

SEQ ID NO: 543483 - RNA, 16 nt, Chlamydophila pneumoniae J138
gccaaggucuucccga

SEQ ID NO: 543484 - RNA, 18 nt, Chlamydophila pneumoniae J138
gccaaucccuaagguuuc

SEQ ID NO: 543485 - RNA, 22 nt, Chlamydophila pneumoniae J138
gccaaucccuaagguuuccaug

SEQ ID NO: 543486 - RNA, 12 nt, Chlamydophila pneumoniae J138
gccacagagaau

SEQ ID NO: 543487 - RNA, 22 nt, Chlamydophila pneumoniae J138
gccacuaaguuuaggcaggaag

SEQ ID NO: 543488 - RNA, 18 nt, Chlamydophila pneumoniae J138
gccaguucuugaaacucu

SEQ ID NO: 543489 - RNA, 18 nt, Chlamydophila pneumoniae J138
gccauaaauacaggccug

SEQ ID NO: 543490 - RNA, 13 nt, Chlamydophila pneumoniae J138
gccauaauaaagg

SEQ ID NO: 543491 - RNA, 13 nt, Chlamydophila pneumoniae J138
gccauaacacuuu

SEQ ID NO: 543492 - RNA, 16 nt, Chlamydophila pneumoniae J138
gccauuuucuaagaga

SEQ ID NO: 543493 - RNA, 15 nt, Chlamydophila pneumoniae J138
gccauuuucuaagag

SEQ ID NO: 543494 - RNA, 17 nt, Chlamydophila pneumoniae J138
gccaugucuaaaggagu

SEQ ID NO: 543495 - RNA, 15 nt, Chlamydophila pneumoniae J138
gccauucuuaucugc

SEQ ID NO: 543496 - RNA, 15 nt, Chlamydophila pneumoniae J138
gccauugaucagaau

SEQ ID NO: 543497 - RNA, 23 nt, Chlamydophila pneumoniae J138
gcccaaguuguagugaaugagcu

SEQ ID NO: 543498 - RNA, 23 nt, Chlamydophila pneumoniae J138
gcccgaaucuuucaaaagaaauc

SEQ ID NO: 543499 - RNA, 14 nt, Chlamydophila pneumoniae J138
gcccccaggcugca

SEQ ID NO: 543500 - RNA, 17 nt, Chlamydophila pneumoniae J138
gccccgaauuguauucg

SEQ ID NO: 543501 - RNA, 21 nt, Chlamydophila pneumoniae J138
gcccuauaguauaauagugag

SEQ ID NO: 543502 - RNA, 14 nt, Chlamydophila pneumoniae J138
gcccuauaguauaa

SEQ ID NO: 543503 - RNA, 23 nt, Chlamydophila pneumoniae J138
gcccgucuuagaauccaaagacu

SEQ ID NO: 543504 - RNA, 14 nt, Chlamydophila pneumoniae J138
gcccuguucuaugc

SEQ ID NO: 543505 - RNA, 14 nt, Chlamydophila pneumoniae J138
aaagcuauuucucu

SEQ ID NO: 543506 - RNA, 18 nt, Chlamydophila pneumoniae J138
aaagcugcuuuuucuacu

SEQ ID NO: 543507 - RNA, 20 nt, Chlamydophila pneumoniae J138
aaagcuagucuucuuagaaa

SEQ ID NO: 543508 - RNA, 16 nt, Chlamydophila pneumoniae J138
aaagcuauauaggguu

SEQ ID NO: 543509 - RNA, 22 nt, Chlamydophila pneumoniae J138
gccuaaagcuccgagaaacaac

SEQ ID NO: 543510 - RNA, 20 nt, Chlamydophila pneumoniae J138
gccuaaagcuccgagaaaca

SEQ ID NO: 543511 - RNA, 19 nt, Chlamydophila pneumoniae J138
gccuaaagcuccgagaaac

SEQ ID NO: 543512 - RNA, 14 nt, Chlamydophila pneumoniae J138
gccggcgguggaaa

SEQ ID NO: 543513 - RNA, 17 nt, Chlamydophila pneumoniae J138
gcgauacaauaaacaac

SEQ ID NO: 543514 - RNA, 16 nt, Chlamydophila pneumoniae J138
gcgauacaauaaacaa

SEQ ID NO: 543515 - RNA, 20 nt, Chlamydophila pneumoniae J138
gcgacuugccaaucuuccuu

SEQ ID NO: 543516 - RNA, 14 nt, Chlamydophila pneumoniae J138
gcgacgucaucaua

SEQ ID NO: 543517 - RNA, 14 nt, Chlamydophila pneumoniae J138
gcgaccugcaaaug

SEQ ID NO: 543518 - RNA, 17 nt, Chlamydophila pneumoniae J138
gcgacaugagaaaucuu

SEQ ID NO: 543519 - RNA, 18 nt, Chlamydophila pneumoniae J138
gcgaauccagaauuuucu

SEQ ID NO: 543520 - RNA, 16 nt, Chlamydophila pneumoniae J138
gcgaauccuagagaac

SEQ ID NO: 543521 - RNA, 14 nt, Chlamydophila pneumoniae J138
gcgacaagacaaug

SEQ ID NO: 543522 - RNA, 18 nt, Chlamydophila pneumoniae J138
gccugaugucuccauaca

SEQ ID NO: 543523 - RNA, 19 nt, Chlamydophila pneumoniae J138
gccugaaauccugggcaau

SEQ ID NO: 543524 - RNA, 12 nt, Chlamydophila pneumoniae J138
gccucacagaau

SEQ ID NO: 543525 - RNA, 21 nt, Chlamydophila pneumoniae J138
gccugucuuaucuaaagaaau

SEQ ID NO: 543526 - RNA, 18 nt, Chlamydophila pneumoniae J138
gccuguaaagaaggaggu

SEQ ID NO: 543527 - RNA, 22 nt, Chlamydophila pneumoniae J138
gccuggaggcgguggcaugcca

SEQ ID NO: 543528 - RNA, 12 nt, Chlamydophila pneumoniae J138
gccuucauucca

SEQ ID NO: 543529 - RNA, 17 nt, Chlamydophila pneumoniae J138
gccuuagcagcacccau

SEQ ID NO: 543530 - RNA, 15 nt, Chlamydophila pneumoniae J138
gccuuacggccccug

SEQ ID NO: 543531 - RNA, 23 nt, Chlamydophila pneumoniae J138
gccuuccauaucuagaaguuuaa

SEQ ID NO: 543532 - RNA, 19 nt, Chlamydophila pneumoniae J138
gccuucucauugcggcacc

SEQ ID NO: 543533 - RNA, 13 nt, Chlamydophila pneumoniae J138
gcgcuacagugac

SEQ ID NO: 543534 - RNA, 21 nt, Chlamydophila pneumoniae J138
gcggagaauaucaucuuccuc

SEQ ID NO: 543535 - RNA, 20 nt, Chlamydophila pneumoniae J138
gcggagaauaucaucuuccu

SEQ ID NO: 543536 - RNA, 15 nt, Chlamydophila pneumoniae J138
gcggaucuucuucug

SEQ ID NO: 543537 - RNA, 17 nt, Chlamydophila pneumoniae J138
gcggucucauguaacug

SEQ ID NO: 543538 - RNA, 16 nt, Chlamydophila pneumoniae J138
gcgguuuuggauagaa

SEQ ID NO: 543539 - RNA, 23 nt, Chlamydophila pneumoniae J138
gcguacucuucuuuggaugcuaa

SEQ ID NO: 543540 - RNA, 19 nt, Chlamydophila pneumoniae J138
gcgucuccuugauuuggga

SEQ ID NO: 543541 - RNA, 17 nt, Chlamydophila pneumoniae J138
gcgucguaaucuuuuuu

SEQ ID NO: 543542 - RNA, 22 nt, Chlamydophila pneumoniae J138
gcgucaauaagcuugccagcag

SEQ ID NO: 543543 - RNA, 14 nt, Chlamydophila pneumoniae J138
gcgucacauuuguu

SEQ ID NO: 543544 - RNA, 22 nt, Chlamydophila pneumoniae J138
gcguugauuccaaugacgggag

SEQ ID NO: 543545 - RNA, 22 nt, Chlamydophila pneumoniae J138
gcguuuuuuuugauuucagaag

SEQ ID NO: 543546 - RNA, 18 nt, Chlamydophila pneumoniae J138
gcguuuuuugaaaauuuu

SEQ ID NO: 543547 - RNA, 13 nt, Chlamydophila pneumoniae J138
gcguuucuuucug

SEQ ID NO: 543548 - RNA, 21 nt, Chlamydophila pneumoniae J138
gcguuucgacgagaaggaaga

SEQ ID NO: 543549 - RNA, 19 nt, Chlamydophila pneumoniae J138
gcuaaacuuuuuuucaaau

SEQ ID NO: 543550 - RNA, 18 nt, Chlamydophila pneumoniae J138
gcuaaagcaggagcauca

SEQ ID NO: 543551 - RNA, 17 nt, Chlamydophila pneumoniae J138
gcuaaaggaucauuaaa

SEQ ID NO: 543552 - RNA, 21 nt, Chlamydophila pneumoniae J138
gcuaaaggaucauuaaagucc

SEQ ID NO: 543553 - RNA, 22 nt, Chlamydophila pneumoniae J138
gcuaacagaaucugguuuaaua

SEQ ID NO: 543554 - RNA, 15 nt, Chlamydophila pneumoniae J138
gcuaacgacauugaa

SEQ ID NO: 543555 - RNA, 17 nt, Chlamydophila pneumoniae J138
gcuaagagcaucuuugg

SEQ ID NO: 543556 - RNA, 21 nt, Chlamydophila pneumoniae J138
gcuaagaucuuuagaauaaga

SEQ ID NO: 543557 - RNA, 12 nt, Chlamydophila pneumoniae J138
gcuaaggauucc

SEQ ID NO: 543558 - RNA, 19 nt, Chlamydophila pneumoniae J138
gcuaagcauuuuacgaauu

SEQ ID NO: 543559 - RNA, 16 nt, Chlamydophila pneumoniae J138
gcuacguacaauuaaa

SEQ ID NO: 543560 - RNA, 19 nt, Chlamydophila pneumoniae J138
gcuacgugaucaaaauuau

SEQ ID NO: 543561 - RNA, 20 nt, Chlamydophila pneumoniae J138
gcuaccuuaguuuuuucuaa

SEQ ID NO: 543562 - RNA, 17 nt, Chlamydophila pneumoniae J138
gcuacauaaaaugagcu

SEQ ID NO: 543563 - RNA, 19 nt, Chlamydophila pneumoniae J138
gcuaauguugucucauggg

SEQ ID NO: 543564 - RNA, 19 nt, Chlamydophila pneumoniae J138
gcuaauuuaaaugccuuaa

SEQ ID NO: 543565 - RNA, 19 nt, Chlamydophila pneumoniae J138
gcuaucaaccauaaagaau

SEQ ID NO: 543566 - RNA, 22 nt, Chlamydophila pneumoniae J138
gcuaucagcuggguaaguccac

SEQ ID NO: 543567 - RNA, 20 nt, Chlamydophila pneumoniae J138
gcuaucagcuggguaagucc

SEQ ID NO: 543568 - RNA, 18 nt, Chlamydophila pneumoniae J138
gcuauaccuauauagaga

SEQ ID NO: 543569 - RNA, 22 nt, Chlamydophila pneumoniae J138
gcuaucaacaucccccgggaag

SEQ ID NO: 543570 - RNA, 18 nt, Chlamydophila pneumoniae J138
gcuauacaaccacuuccu

SEQ ID NO: 543571 - RNA, 20 nt, Chlamydophila pneumoniae J138
gcuauacagaaaagaaugug

SEQ ID NO: 543572 - RNA, 15 nt, Chlamydophila pneumoniae J138
gcuaggaagaugaau

SEQ ID NO: 543573 - RNA, 13 nt, Chlamydophila pneumoniae J138
gcuagcuccagca

SEQ ID NO: 543574 - RNA, 17 nt, Chlamydophila pneumoniae J138
gcuagcucuuaaaugug

SEQ ID NO: 543575 - RNA, 12 nt, Chlamydophila pneumoniae J138
gcuagucuuucu

SEQ ID NO: 543576 - RNA, 16 nt, Chlamydophila pneumoniae J138
gcuagagcagcuguag

SEQ ID NO: 543577 - RNA, 22 nt, Chlamydophila pneumoniae J138
gcuagaucacaagaaagaaugg

SEQ ID NO: 543578 - RNA, 22 nt, Chlamydophila pneumoniae J138
gcuagaguccaagguucuggga

SEQ ID NO: 543579 - RNA, 15 nt, Chlamydophila pneumoniae J138
gcuagaaaaucauac

SEQ ID NO: 543580 - RNA, 16 nt, Chlamydophila pneumoniae J138
gcuaugucuguuccca

SEQ ID NO: 543581 - RNA, 20 nt, Chlamydophila pneumoniae J138
gcuauguaggcagauagaca

SEQ ID NO: 543582 - RNA, 13 nt, Chlamydophila pneumoniae J138
gcuaucuccagaa

SEQ ID NO: 543583 - RNA, 23 nt, Chlamydophila pneumoniae J138
gcuaugaggaacugggcauagug

SEQ ID NO: 543584 - RNA, 14 nt, Chlamydophila pneumoniae J138
gcuaugaugagaac

SEQ ID NO: 543585 - RNA, 22 nt, Chlamydophila pneumoniae J138
gcuauuuuccucuauauuuuuu

SEQ ID NO: 543586 - RNA, 16 nt, Chlamydophila pneumoniae J138
gcucacuuacgaaucu

SEQ ID NO: 543587 - RNA, 21 nt, Chlamydophila pneumoniae J138
gcucccaugugcugaagacca

SEQ ID NO: 543588 - RNA, 20 nt, Chlamydophila pneumoniae J138
gcuccagaaacgcagcuuuc

SEQ ID NO: 543589 - RNA, 16 nt, Chlamydophila pneumoniae J138
gcucaguaaauauuuu

SEQ ID NO: 543590 - RNA, 16 nt, Chlamydophila pneumoniae J138
gcucggaaaucaggga

SEQ ID NO: 543591 - RNA, 19 nt, Chlamydophila pneumoniae J138
gcucguacuguuccuacag

SEQ ID NO: 543592 - RNA, 16 nt, Chlamydophila pneumoniae J138
gcucguaauccuucuu

SEQ ID NO: 543593 - RNA, 20 nt, Chlamydophila pneumoniae J138
gcucuaaacucucuuccuuc

SEQ ID NO: 543594 - RNA, 21 nt, Chlamydophila pneumoniae J138
gcucuaaacucucuuccuucu

SEQ ID NO: 543595 - RNA, 18 nt, Chlamydophila pneumoniae J138
gcucuaagcugugcauuu

SEQ ID NO: 543596 - RNA, 19 nt, Chlamydophila pneumoniae J138
gcucucaaggucacagcau

SEQ ID NO: 543597 - RNA, 12 nt, Chlamydophila pneumoniae J138
gcucuccauggc

SEQ ID NO: 543598 - RNA, 13 nt, Chlamydophila pneumoniae J138
gcucucuucuucu

SEQ ID NO: 543599 - RNA, 16 nt, Chlamydophila pneumoniae J138
gcucucuucuucucag

SEQ ID NO: 543600 - RNA, 12 nt, Chlamydophila pneumoniae J138
gcucuggagauu

SEQ ID NO: 543601 - RNA, 14 nt, Chlamydophila pneumoniae J138
gcucuuaauuucug

SEQ ID NO: 543602 - RNA, 15 nt, Chlamydophila pneumoniae J138
gcucuuacuucuggu

SEQ ID NO: 543603 - RNA, 19 nt, Chlamydophila pneumoniae J138
gcucuugagaaagcuucua

SEQ ID NO: 543604 - RNA, 17 nt, Chlamydophila pneumoniae J138
gcucuuuaggauagagg

SEQ ID NO: 543605 - RNA, 21 nt, Chlamydophila pneumoniae J138
gcucuuuagcaaacauuuuua

SEQ ID NO: 543606 - RNA, 20 nt, Chlamydophila pneumoniae J138
gcucuuugggauaaaaaguu

SEQ ID NO: 543607 - RNA, 16 nt, Chlamydophila pneumoniae J138
gcucuuuuaacuuaaa

SEQ ID NO: 543608 - RNA, 17 nt, Chlamydophila pneumoniae J138
gcugacaucuccaagau

SEQ ID NO: 543609 - RNA, 12 nt, Chlamydophila pneumoniae J138
gcugauaaaaua

SEQ ID NO: 543610 - RNA, 13 nt, Chlamydophila pneumoniae J138
gcugcuucagaaa

SEQ ID NO: 543611 - RNA, 18 nt, Chlamydophila pneumoniae J138
gcugcugauccaaaagcg

SEQ ID NO: 543612 - RNA, 16 nt, Chlamydophila pneumoniae J138
gcugcucuuuuagaau

SEQ ID NO: 543613 - RNA, 17 nt, Chlamydophila pneumoniae J138
gcugcucuuuuagaaug

SEQ ID NO: 543614 - RNA, 16 nt, Chlamydophila pneumoniae J138
gcugcugaauauaguu

SEQ ID NO: 543615 - RNA, 11 nt, Chlamydophila pneumoniae J138
gcugcuuugac

SEQ ID NO: 543616 - RNA, 19 nt, Chlamydophila pneumoniae J138
gcugcgucaauaagcuugc

SEQ ID NO: 543617 - RNA, 21 nt, Chlamydophila pneumoniae J138
aaagcugugguaucgauguaa

SEQ ID NO: 543618 - RNA, 17 nt, Chlamydophila pneumoniae J138
aaagcuguauugggaau

SEQ ID NO: 543619 - RNA, 17 nt, Chlamydophila pneumoniae J138
aaagcuuuuuucucuug

SEQ ID NO: 543620 - RNA, 13 nt, Chlamydophila pneumoniae J138
aaagcuuuugcua

SEQ ID NO: 543621 - RNA, 14 nt, Chlamydophila pneumoniae J138
aaaggaaaauaauc

SEQ ID NO: 543622 - RNA, 15 nt, Chlamydophila pneumoniae J138
aaaggaaaauaaucu

SEQ ID NO: 543623 - RNA, 23 nt, Chlamydophila pneumoniae J138
aaagcuuguuccacuugcucuuu

SEQ ID NO: 543624 - RNA, 12 nt, Chlamydophila pneumoniae J138
aaagcuugagaa

SEQ ID NO: 543625 - RNA, 14 nt, Chlamydophila pneumoniae J138
aaagcuucuuucuu

SEQ ID NO: 543626 - RNA, 23 nt, Chlamydophila pneumoniae J138
aaagcuuaucccauaaauguaua

SEQ ID NO: 543627 - RNA, 15 nt, Chlamydophila pneumoniae J138
gcuguacagaacaau

SEQ ID NO: 543628 - RNA, 23 nt, Chlamydophila pneumoniae J138
gcuuugggcaucucucuuuaaaa

SEQ ID NO: 543629 - RNA, 15 nt, Chlamydophila pneumoniae J138
gcuuugcuuaaaaag

SEQ ID NO: 543630 - RNA, 21 nt, Chlamydophila pneumoniae J138
gcuuuuaauguguucuuaucg

SEQ ID NO: 543631 - RNA, 19 nt, Chlamydophila pneumoniae J138
gcuuugugaguucuuccuu

SEQ ID NO: 543632 - RNA, 20 nt, Chlamydophila pneumoniae J138
gcuuugugaguucuuccuuc

SEQ ID NO: 543633 - RNA, 16 nt, Chlamydophila pneumoniae J138
gcuuugauaauagucu

SEQ ID NO: 543634 - RNA, 14 nt, Chlamydophila pneumoniae J138
gcuuugcaucccua

SEQ ID NO: 543635 - RNA, 15 nt, Chlamydophila pneumoniae J138
gcuuucuagcugcuc

SEQ ID NO: 543636 - RNA, 20 nt, Chlamydophila pneumoniae J138
gcuuucuagggcaucuuuua

SEQ ID NO: 543637 - RNA, 18 nt, Chlamydophila pneumoniae J138
gcuuuuguuuuguauuua

SEQ ID NO: 543638 - RNA, 17 nt, Chlamydophila pneumoniae J138
gcuuuugugauaccucc

SEQ ID NO: 543639 - RNA, 15 nt, Chlamydophila pneumoniae J138
gcuuuucuucuuuag

SEQ ID NO: 543640 - RNA, 18 nt, Chlamydophila pneumoniae J138
gcuuuugagauucaaaag

SEQ ID NO: 543641 - RNA, 14 nt, Chlamydophila pneumoniae J138
gcuuuucauuuuua

SEQ ID NO: 543642 - RNA, 13 nt, Chlamydophila pneumoniae J138
gcuuuuccuucug

SEQ ID NO: 543643 - RNA, 12 nt, Chlamydophila pneumoniae J138
gcuuuucuuuuu

SEQ ID NO: 543644 - RNA, 14 nt, Chlamydophila pneumoniae J138
gcuuuucuuuuucu

SEQ ID NO: 543645 - RNA, 12 nt, Chlamydophila pneumoniae J138
ggaaaaaauaga

SEQ ID NO: 543646 - RNA, 22 nt, Chlamydophila pneumoniae J138
ggaaaaccaugaguuuuucaga

SEQ ID NO: 543647 - RNA, 22 nt, Chlamydophila pneumoniae J138
gcuuuuuuaaaguguguaaaug

SEQ ID NO: 543648 - RNA, 13 nt, Chlamydophila pneumoniae J138
gcuuuuugaauga

SEQ ID NO: 543649 - RNA, 16 nt, Chlamydophila pneumoniae J138
gcuuuuugaaugaucc

SEQ ID NO: 543650 - RNA, 13 nt, Chlamydophila pneumoniae J138
ggaaaaggaggag

SEQ ID NO: 543651 - RNA, 22 nt, Chlamydophila pneumoniae J138
ggaaacagugguaugcuuuucc

SEQ ID NO: 543652 - RNA, 17 nt, Chlamydophila pneumoniae J138
ggaaacauagaaucauu

SEQ ID NO: 543653 - RNA, 22 nt, Chlamydophila pneumoniae J138
ggaaaauucaguauaagaugcu

SEQ ID NO: 543654 - RNA, 16 nt, Chlamydophila pneumoniae J138
ggaaacguucuuucaa

SEQ ID NO: 543655 - RNA, 19 nt, Chlamydophila pneumoniae J138
ggaaagaaacuacacgcac

SEQ ID NO: 543656 - RNA, 17 nt, Chlamydophila pneumoniae J138
ggaaagccaagaagaug

SEQ ID NO: 543657 - RNA, 20 nt, Chlamydophila pneumoniae J138
ggaagacucucaucagcaaa

SEQ ID NO: 543658 - RNA, 14 nt, Chlamydophila pneumoniae J138
ggaagacuuuuuaa

SEQ ID NO: 543659 - RNA, 13 nt, Chlamydophila pneumoniae J138
ggaagaagaagaa

SEQ ID NO: 543660 - RNA, 14 nt, Chlamydophila pneumoniae J138
ggaacgcucucuag

SEQ ID NO: 543661 - RNA, 21 nt, Chlamydophila pneumoniae J138
ggaagaugaauaccagaagca

SEQ ID NO: 543662 - RNA, 14 nt, Chlamydophila pneumoniae J138
ggaagcaaagaaaa

SEQ ID NO: 543663 - RNA, 20 nt, Chlamydophila pneumoniae J138
ggaagaugaauaccagaagc

SEQ ID NO: 543664 - RNA, 21 nt, Chlamydophila pneumoniae J138
ggaagcuuaucaagaagcuga

SEQ ID NO: 543665 - RNA, 19 nt, Chlamydophila pneumoniae J138
ggaagcuguacuugauauu

SEQ ID NO: 543666 - RNA, 16 nt, Chlamydophila pneumoniae J138
ggaagcuuaucaagaa

SEQ ID NO: 543667 - RNA, 18 nt, Chlamydophila pneumoniae J138
ggaauaggcucuuuagca

SEQ ID NO: 543668 - RNA, 17 nt, Chlamydophila pneumoniae J138
ggaccacaauuccuaaa

SEQ ID NO: 543669 - RNA, 18 nt, Chlamydophila pneumoniae J138
ggaccuaagggcucuccu

SEQ ID NO: 543670 - RNA, 22 nt, Chlamydophila pneumoniae J138
aaaggggaacaacaucaugaaa

SEQ ID NO: 543671 - RNA, 22 nt, Chlamydophila pneumoniae J138
ggaaucccugcacucuuucaga

SEQ ID NO: 543672 - RNA, 15 nt, Chlamydophila pneumoniae J138
ggaaucccuuuuuaa

SEQ ID NO: 543673 - RNA, 22 nt, Chlamydophila pneumoniae J138
ggaauccuuuggaagcuaucau

SEQ ID NO: 543674 - RNA, 20 nt, Chlamydophila pneumoniae J138
ggaauccccaauguuuuccu

SEQ ID NO: 543675 - RNA, 20 nt, Chlamydophila pneumoniae J138
ggaaucucgggagaacaugc

SEQ ID NO: 543676 - RNA, 17 nt, Chlamydophila pneumoniae J138
ggaaucucgggagaaca

SEQ ID NO: 543677 - RNA, 14 nt, Chlamydophila pneumoniae J138
ggacuaaacaagaa

SEQ ID NO: 543678 - RNA, 12 nt, Chlamydophila pneumoniae J138
ggacgugggaga

SEQ ID NO: 543679 - RNA, 15 nt, Chlamydophila pneumoniae J138
ggacgcacauuuaga

SEQ ID NO: 543680 - RNA, 14 nt, Chlamydophila pneumoniae J138
ggagaauagcaagc

SEQ ID NO: 543681 - RNA, 15 nt, Chlamydophila pneumoniae J138
ggagaauagcaagca

SEQ ID NO: 543682 - RNA, 23 nt, Chlamydophila pneumoniae J138
ggagaacaauaucagcagcuucu

SEQ ID NO: 543683 - RNA, 14 nt, Chlamydophila pneumoniae J138
ggacuacugaaaca

SEQ ID NO: 543684 - RNA, 22 nt, Chlamydophila pneumoniae J138
ggacuccaagaauagcaggaag

SEQ ID NO: 543685 - RNA, 22 nt, Chlamydophila pneumoniae J138
aaagguugcuaagaucuuuaga

SEQ ID NO: 543686 - RNA, 17 nt, Chlamydophila pneumoniae J138
aaagguugauuggaucu

SEQ ID NO: 543687 - RNA, 15 nt, Chlamydophila pneumoniae J138
aaaguaaaaaauaca

SEQ ID NO: 543688 - RNA, 22 nt, Chlamydophila pneumoniae J138
ggagaugcuauuuacugaaaca

SEQ ID NO: 543689 - RNA, 22 nt, Chlamydophila pneumoniae J138
ggagaagcuaagggaaauccac

SEQ ID NO: 543690 - RNA, 13 nt, Chlamydophila pneumoniae J138
ggagggaaacacc

SEQ ID NO: 543691 - RNA, 16 nt, Chlamydophila pneumoniae J138
ggagcuacugaaagau

SEQ ID NO: 543692 - RNA, 12 nt, Chlamydophila pneumoniae J138
ggagcuucuaag

SEQ ID NO: 543693 - RNA, 18 nt, Chlamydophila pneumoniae J138
ggauagcauacgacagua

SEQ ID NO: 543694 - RNA, 18 nt, Chlamydophila pneumoniae J138
ggauauacaauccagaau

SEQ ID NO: 543695 - RNA, 24 nt, Chlamydophila pneumoniae J138
ggauaucugagcauaacuugaaga

SEQ ID NO: 543696 - RNA, 22 nt, Chlamydophila pneumoniae J138
ggcaacaagagcgcauuuuaca

SEQ ID NO: 543697 - RNA, 20 nt, Chlamydophila pneumoniae J138
ggcaacaacgccuacaugga

SEQ ID NO: 543698 - RNA, 13 nt, Chlamydophila pneumoniae J138
ggcaauagcuuug

SEQ ID NO: 543699 - RNA, 15 nt, Chlamydophila pneumoniae J138
ggcaauagcuuugaa

SEQ ID NO: 543700 - RNA, 20 nt, Chlamydophila pneumoniae J138
ggcaauagcuuugaagagca

SEQ ID NO: 543701 - RNA, 17 nt, Chlamydophila pneumoniae J138
ggcaaugaucaaaaaug

SEQ ID NO: 543702 - RNA, 15 nt, Chlamydophila pneumoniae J138
ggcaaucuaaaauca

SEQ ID NO: 543703 - RNA, 19 nt, Chlamydophila pneumoniae J138
ggcaccaacacuuuuaaag

SEQ ID NO: 543704 - RNA, 21 nt, Chlamydophila pneumoniae J138
ggcagugugggcaaugcuugu

SEQ ID NO: 543705 - RNA, 19 nt, Chlamydophila pneumoniae J138
ggcaguagguaagaagcug

SEQ ID NO: 543706 - RNA, 15 nt, Chlamydophila pneumoniae J138
ggcauacucuuugca

SEQ ID NO: 543707 - RNA, 19 nt, Chlamydophila pneumoniae J138
ggcauacaguagaaacaug

SEQ ID NO: 543708 - RNA, 18 nt, Chlamydophila pneumoniae J138
ggcauaaaaaaguccuac

SEQ ID NO: 543709 - RNA, 16 nt, Chlamydophila pneumoniae J138
ggcaugaaagauaaug

SEQ ID NO: 543710 - RNA, 19 nt, Chlamydophila pneumoniae J138
aaaguuaaugcaagcaacu

SEQ ID NO: 543711 - RNA, 20 nt, Chlamydophila pneumoniae J138
aaaguuagguagauagaaau

SEQ ID NO: 543712 - RNA, 23 nt, Chlamydophila pneumoniae J138
aaaguuagguagauagaaauucu

SEQ ID NO: 543713 - RNA, 14 nt, Chlamydophila pneumoniae J138
aaagugugaggaga

SEQ ID NO: 543714 - RNA, 15 nt, Chlamydophila pneumoniae J138
aaaguuuaugacaca

SEQ ID NO: 543715 - RNA, 15 nt, Chlamydophila pneumoniae J138
aaaguuuccaaguga

SEQ ID NO: 543716 - RNA, 18 nt, Chlamydophila pneumoniae J138
aaaguugaggaaaggagg

SEQ ID NO: 543717 - RNA, 17 nt, Chlamydophila pneumoniae J138
aaaguugaggaaaggag

SEQ ID NO: 543718 - RNA, 15 nt, Chlamydophila pneumoniae J138
aaaguugaggaaagg

SEQ ID NO: 543719 - RNA, 16 nt, Chlamydophila pneumoniae J138
aaaguugaggaaagga

SEQ ID NO: 543720 - RNA, 13 nt, Chlamydophila pneumoniae J138
aaaguugaacuga

SEQ ID NO: 543721 - RNA, 20 nt, Chlamydophila pneumoniae J138
aaaguuuguagcauuucuuu

SEQ ID NO: 543722 - RNA, 21 nt, Chlamydophila pneumoniae J138
aaauaaaaaaacccucaaaga

SEQ ID NO: 543723 - RNA, 18 nt, Chlamydophila pneumoniae J138
ggccuauagcaaagaaca

SEQ ID NO: 543724 - RNA, 16 nt, Chlamydophila pneumoniae J138
aaauaaaaucaagcca

SEQ ID NO: 543725 - RNA, 17 nt, Chlamydophila pneumoniae J138
aaauaaaguccuccaug

SEQ ID NO: 543726 - RNA, 23 nt, Chlamydophila pneumoniae J138
aaauacgugcuugaauauuucca

SEQ ID NO: 543727 - RNA, 20 nt, Chlamydophila pneumoniae J138
aaauacuuaggaauuuuucu

SEQ ID NO: 543728 - RNA, 18 nt, Chlamydophila pneumoniae J138
ggcuaaaggaucauuaaa

SEQ ID NO: 543729 - RNA, 19 nt, Chlamydophila pneumoniae J138
ggcuaaauaaaccacgaau

SEQ ID NO: 543730 - RNA, 24 nt, Chlamydophila pneumoniae J138
ggcuauaauuaacguuucuucgca

SEQ ID NO: 543731 - RNA, 14 nt, Chlamydophila pneumoniae J138
ggcuauagaauaca

SEQ ID NO: 543732 - RNA, 11 nt, Chlamydophila pneumoniae J138
ggcucaaagaa

SEQ ID NO: 543733 - RNA, 21 nt, Chlamydophila pneumoniae J138
ggcguuccagcuccuuuugaa

SEQ ID NO: 543734 - RNA, 13 nt, Chlamydophila pneumoniae J138
gaagaagggacuu

SEQ ID NO: 543735 - RNA, 18 nt, Chlamydophila pneumoniae J138
gaagaauuucgucuucau

SEQ ID NO: 543736 - RNA, 21 nt, Chlamydophila pneumoniae J138
gaagacaaguaaacagcaaag

SEQ ID NO: 543737 - RNA, 17 nt, Chlamydophila pneumoniae J138
gaagaauuucauaagag

SEQ ID NO: 543738 - RNA, 17 nt, Chlamydophila pneumoniae J138
gaagacaggagcuacug

SEQ ID NO: 543739 - RNA, 15 nt, Chlamydophila pneumoniae J138
gaacaugccaaauau

SEQ ID NO: 543740 - RNA, 17 nt, Chlamydophila pneumoniae J138
gaacaugccugaaaaca

SEQ ID NO: 543741 - RNA, 16 nt, Chlamydophila pneumoniae J138
gaagaacuuagcaaug

SEQ ID NO: 543742 - RNA, 14 nt, Chlamydophila pneumoniae J138
gaagaugauauucu

SEQ ID NO: 543743 - RNA, 18 nt, Chlamydophila pneumoniae J138
gaagaucuugaacagaga

SEQ ID NO: 543744 - RNA, 18 nt, Chlamydophila pneumoniae J138
gaagaucucccgaugagg

SEQ ID NO: 543745 - RNA, 13 nt, Chlamydophila pneumoniae J138
gaagagcuuccau

SEQ ID NO: 543746 - RNA, 13 nt, Chlamydophila pneumoniae J138
gaagauccugagu

SEQ ID NO: 543747 - RNA, 22 nt, Chlamydophila pneumoniae J138
gaagaccccucuugcuuuuccg

SEQ ID NO: 543748 - RNA, 20 nt, Chlamydophila pneumoniae J138
gaagagcaauuaagaaacua

SEQ ID NO: 543749 - RNA, 19 nt, Chlamydophila pneumoniae J138
gaagagcaauuaagaaacu

SEQ ID NO: 543750 - RNA, 20 nt, Chlamydophila pneumoniae J138
gaagagcauuuaaaacggcu

SEQ ID NO: 543751 - RNA, 15 nt, Chlamydophila pneumoniae J138
gaagcaaagaaaauu

SEQ ID NO: 543752 - RNA, 17 nt, Chlamydophila pneumoniae J138
gaagauggcaaggaaaa

SEQ ID NO: 543753 - RNA, 14 nt, Chlamydophila pneumoniae J138
gaagauucaaagaa

SEQ ID NO: 543754 - RNA, 12 nt, Chlamydophila pneumoniae J138
gaagauucaagc

SEQ ID NO: 543755 - RNA, 13 nt, Chlamydophila pneumoniae J138
gaagauucuuuaa

SEQ ID NO: 543756 - RNA, 23 nt, Chlamydophila pneumoniae J138
gaagauguauaaggauaucuucu

SEQ ID NO: 543757 - RNA, 14 nt, Chlamydophila pneumoniae J138
gaagccaccaucug

SEQ ID NO: 543758 - RNA, 17 nt, Chlamydophila pneumoniae J138
gaagcagggaaaaugcg

SEQ ID NO: 543759 - RNA, 15 nt, Chlamydophila pneumoniae J138
gaagcaguuuaggua

SEQ ID NO: 543760 - RNA, 16 nt, Chlamydophila pneumoniae J138
gaagccuucauuccau

SEQ ID NO: 543761 - RNA, 22 nt, Chlamydophila pneumoniae J138
gaagcucacucuuuaaaaaccc

SEQ ID NO: 543762 - RNA, 23 nt, Chlamydophila pneumoniae J138
gaagcuaucauuauacuucguua

SEQ ID NO: 543763 - RNA, 21 nt, Chlamydophila pneumoniae J138
aaagauaguuauuaauaaauu

SEQ ID NO: 543764 - RNA, 20 nt, Chlamydophila pneumoniae J138
aaagauagcgacgucaucau

SEQ ID NO: 543765 - RNA, 21 nt, Chlamydophila pneumoniae J138
aaagauagcgacgucaucaua

SEQ ID NO: 543766 - RNA, 16 nt, Chlamydophila pneumoniae J138
gaaguuacgugagaac

SEQ ID NO: 543767 - RNA, 15 nt, Chlamydophila pneumoniae J138
gaaguuuaaacgucu

SEQ ID NO: 543768 - RNA, 23 nt, Chlamydophila pneumoniae J138
gaaguugaaaugagugagaaugc

SEQ ID NO: 543769 - RNA, 19 nt, Chlamydophila pneumoniae J138
gaaguugaaaugagugaga

SEQ ID NO: 543770 - RNA, 21 nt, Chlamydophila pneumoniae J138
gaaguugaaaugagugagaau

SEQ ID NO: 543771 - RNA, 15 nt, Chlamydophila pneumoniae J138
gaauaauuaaaucgu

SEQ ID NO: 543772 - RNA, 16 nt, Chlamydophila pneumoniae J138
gaagcugcuucuucag

SEQ ID NO: 543773 - RNA, 18 nt, Chlamydophila pneumoniae J138
gaagcugcucguuuuagc

SEQ ID NO: 543774 - RNA, 13 nt, Chlamydophila pneumoniae J138
gaagcugcugcua

SEQ ID NO: 543775 - RNA, 15 nt, Chlamydophila pneumoniae J138
gaagcugacaaauag

SEQ ID NO: 543776 - RNA, 17 nt, Chlamydophila pneumoniae J138
gaagcucuucuacuuua

SEQ ID NO: 543777 - RNA, 14 nt, Chlamydophila pneumoniae J138
gaagcuucaaugau

SEQ ID NO: 543778 - RNA, 15 nt, Chlamydophila pneumoniae J138
gaagguuuauuagaa

SEQ ID NO: 543779 - RNA, 15 nt, Chlamydophila pneumoniae J138
gaaguagggucccuu

SEQ ID NO: 543780 - RNA, 19 nt, Chlamydophila pneumoniae J138
gaaguauucgauuccugag

SEQ ID NO: 543781 - RNA, 21 nt, Chlamydophila pneumoniae J138
gaagguguuuuggcugcuuuu

SEQ ID NO: 543782 - RNA, 18 nt, Chlamydophila pneumoniae J138
gaagguguggguacaggg

SEQ ID NO: 543783 - RNA, 18 nt, Chlamydophila pneumoniae J138
gaagucccacaaaugaua

SEQ ID NO: 543784 - RNA, 22 nt, Chlamydophila pneumoniae J138
gaaguccuagggagugaggaau

SEQ ID NO: 543785 - RNA, 15 nt, Chlamydophila pneumoniae J138
gaagucagugcuucu

SEQ ID NO: 543786 - RNA, 17 nt, Chlamydophila pneumoniae J138
gaaguccagacuuuccu

SEQ ID NO: 543787 - RNA, 18 nt, Chlamydophila pneumoniae J138
gaaucacguccacaagcu

SEQ ID NO: 543788 - RNA, 13 nt, Chlamydophila pneumoniae J138
gaaucacucucua

SEQ ID NO: 543789 - RNA, 18 nt, Chlamydophila pneumoniae J138
gaauaugcuuuucaaaua

SEQ ID NO: 543790 - RNA, 14 nt, Chlamydophila pneumoniae J138
gaauaucaucuucc

SEQ ID NO: 543791 - RNA, 18 nt, Chlamydophila pneumoniae J138
gaauaucaucacuaagau

SEQ ID NO: 543792 - RNA, 17 nt, Chlamydophila pneumoniae J138
gaauaucuuuugaaucu

SEQ ID NO: 543793 - RNA, 18 nt, Chlamydophila pneumoniae J138
aaagaucgugaucaaaga

SEQ ID NO: 543794 - RNA, 15 nt, Chlamydophila pneumoniae J138
gaauagcucuuuuca

SEQ ID NO: 543795 - RNA, 12 nt, Chlamydophila pneumoniae J138
gaauagcucugg

SEQ ID NO: 543796 - RNA, 14 nt, Chlamydophila pneumoniae J138
gaauacucuagguu

SEQ ID NO: 543797 - RNA, 12 nt, Chlamydophila pneumoniae J138
gaauauaauucc

SEQ ID NO: 543798 - RNA, 12 nt, Chlamydophila pneumoniae J138
gaauauagacuu

SEQ ID NO: 543799 - RNA, 12 nt, Chlamydophila pneumoniae J138
gaauaguuguga

SEQ ID NO: 543800 - RNA, 17 nt, Chlamydophila pneumoniae J138
gaaucucgggagaacau

SEQ ID NO: 543801 - RNA, 21 nt, Chlamydophila pneumoniae J138
gaaucucauaaguauagagag

SEQ ID NO: 543802 - RNA, 18 nt, Chlamydophila pneumoniae J138
gaaucucauaaguauaga

SEQ ID NO: 543803 - RNA, 15 nt, Chlamydophila pneumoniae J138
gaaucuccucaucag

SEQ ID NO: 543804 - RNA, 17 nt, Chlamydophila pneumoniae J138
gaaucuccucaucagaa

SEQ ID NO: 543805 - RNA, 23 nt, Chlamydophila pneumoniae J138
gaaucuccauuuagaaugaccgc

SEQ ID NO: 543806 - RNA, 21 nt, Chlamydophila pneumoniae J138
gaaucuccucgucugauagag

SEQ ID NO: 543807 - RNA, 19 nt, Chlamydophila pneumoniae J138
gaaugccaaaccucuuagc

SEQ ID NO: 543808 - RNA, 14 nt, Chlamydophila pneumoniae J138
gaaucagauuagag

SEQ ID NO: 543809 - RNA, 17 nt, Chlamydophila pneumoniae J138
gaauccgaucauaauua

SEQ ID NO: 543810 - RNA, 14 nt, Chlamydophila pneumoniae J138
gaaucggaucuuca

SEQ ID NO: 543811 - RNA, 14 nt, Chlamydophila pneumoniae J138
gaaucguucccauc

SEQ ID NO: 543812 - RNA, 18 nt, Chlamydophila pneumoniae J138
gacaaucaacauucuucu

SEQ ID NO: 543813 - RNA, 15 nt, Chlamydophila pneumoniae J138
gacacagagcuucua

SEQ ID NO: 543814 - RNA, 15 nt, Chlamydophila pneumoniae J138
gacaagacaaugacu

SEQ ID NO: 543815 - RNA, 22 nt, Chlamydophila pneumoniae J138
gacaauauagaaaucgacaggg

SEQ ID NO: 543816 - RNA, 14 nt, Chlamydophila pneumoniae J138
gacaaauaaguccu

SEQ ID NO: 543817 - RNA, 17 nt, Chlamydophila pneumoniae J138
gacaaaggguuucuuuc

SEQ ID NO: 543818 - RNA, 16 nt, Chlamydophila pneumoniae J138
gaauuuucuuuugcag

SEQ ID NO: 543819 - RNA, 22 nt, Chlamydophila pneumoniae J138
gaauuuucucauagcuuccugu

SEQ ID NO: 543820 - RNA, 19 nt, Chlamydophila pneumoniae J138
gaauuuucagccugucuau

SEQ ID NO: 543821 - RNA, 20 nt, Chlamydophila pneumoniae J138
gacaaaucacgacgucauca

SEQ ID NO: 543822 - RNA, 17 nt, Chlamydophila pneumoniae J138
gacaacaagucuucccu

SEQ ID NO: 543823 - RNA, 20 nt, Chlamydophila pneumoniae J138
gacaacagagacaagaccgu

SEQ ID NO: 543824 - RNA, 19 nt, Chlamydophila pneumoniae J138
gaauggucucgaaauccua

SEQ ID NO: 543825 - RNA, 23 nt, Chlamydophila pneumoniae J138
gaauucaaacuccuuuuaaaauu

SEQ ID NO: 543826 - RNA, 20 nt, Chlamydophila pneumoniae J138
gaauucauccagauuagaaa

SEQ ID NO: 543827 - RNA, 17 nt, Chlamydophila pneumoniae J138
gaauucauuaagauccu

SEQ ID NO: 543828 - RNA, 20 nt, Chlamydophila pneumoniae J138
gaauuccucccagcccuaua

SEQ ID NO: 543829 - RNA, 15 nt, Chlamydophila pneumoniae J138
gaauucuuuuccugc

SEQ ID NO: 543830 - RNA, 15 nt, Chlamydophila pneumoniae J138
gaauucuuugccaag

SEQ ID NO: 543831 - RNA, 21 nt, Chlamydophila pneumoniae J138
gaauuucuccaguaucuucuc

SEQ ID NO: 543832 - RNA, 18 nt, Chlamydophila pneumoniae J138
gaauuugccugaaauccu

SEQ ID NO: 543833 - RNA, 20 nt, Chlamydophila pneumoniae J138
gaauuugauuuuucaaauuc

SEQ ID NO: 543834 - RNA, 19 nt, Chlamydophila pneumoniae J138
gacacgaauuccaagaucu

SEQ ID NO: 543835 - RNA, 22 nt, Chlamydophila pneumoniae J138
gacacaggagguucauucucau

SEQ ID NO: 543836 - RNA, 20 nt, Chlamydophila pneumoniae J138
gacacgccuccuucaaagau

SEQ ID NO: 543837 - RNA, 14 nt, Chlamydophila pneumoniae J138
gacacgcuuuccua

SEQ ID NO: 543838 - RNA, 23 nt, Chlamydophila pneumoniae J138
gacacuauguguuuccuuuucuc

SEQ ID NO: 543839 - RNA, 11 nt, Chlamydophila pneumoniae J138
gacacuaugug

SEQ ID NO: 543840 - RNA, 15 nt, Chlamydophila pneumoniae J138
gacacuccucagaau

SEQ ID NO: 543841 - RNA, 17 nt, Chlamydophila pneumoniae J138
gacagcagcauuuucua

SEQ ID NO: 543842 - RNA, 20 nt, Chlamydophila pneumoniae J138
gacauauccaaugagagaga

SEQ ID NO: 543843 - RNA, 18 nt, Chlamydophila pneumoniae J138
gacauacucgucaaauuc

SEQ ID NO: 543844 - RNA, 15 nt, Chlamydophila pneumoniae J138
gacaucuaauuuuaa

SEQ ID NO: 543845 - RNA, 14 nt, Chlamydophila pneumoniae J138
gacaggagcuacug

SEQ ID NO: 543846 - RNA, 21 nt, Chlamydophila pneumoniae J138
gacagcugagaaauuccuaaa

SEQ ID NO: 543847 - RNA, 17 nt, Chlamydophila pneumoniae J138
gaccaguggcaggaaug

SEQ ID NO: 543848 - RNA, 22 nt, Chlamydophila pneumoniae J138
gaccacuacuuaaagcuugaga

SEQ ID NO: 543849 - RNA, 20 nt, Chlamydophila pneumoniae J138
gaccaacagauaggauggag

SEQ ID NO: 543850 - RNA, 18 nt, Chlamydophila pneumoniae J138
gaccaacuccucaaaaga

SEQ ID NO: 543851 - RNA, 13 nt, Chlamydophila pneumoniae J138
gaccaaauagaga

SEQ ID NO: 543852 - RNA, 22 nt, Chlamydophila pneumoniae J138
gaccagaugcuaaagagucuuc

SEQ ID NO: 543853 - RNA, 17 nt, Chlamydophila pneumoniae J138
gaccagaugauuuuuug

SEQ ID NO: 543854 - RNA, 23 nt, Chlamydophila pneumoniae J138
gaccagaugauuuuuugaauccu

SEQ ID NO: 543855 - RNA, 20 nt, Chlamydophila pneumoniae J138
gaccgcaaggagucacuggc

SEQ ID NO: 543856 - RNA, 20 nt, Chlamydophila pneumoniae J138
gaccguccuccccauacaua

SEQ ID NO: 543857 - RNA, 17 nt, Chlamydophila pneumoniae J138
gaccuacuuauuguucu

SEQ ID NO: 543858 - RNA, 19 nt, Chlamydophila pneumoniae J138
gaccucuagcucaaaucuc

SEQ ID NO: 543859 - RNA, 21 nt, Chlamydophila pneumoniae J138
gaccucuguagguuuuuccaa

SEQ ID NO: 543860 - RNA, 21 nt, Chlamydophila pneumoniae J138
gaccuguuuucuuuucugaag

SEQ ID NO: 543861 - RNA, 20 nt, Chlamydophila pneumoniae J138
gaccuuccuuaucuucagaa

SEQ ID NO: 543862 - RNA, 20 nt, Chlamydophila pneumoniae J138
gaccuucucaagaucuucau

SEQ ID NO: 543863 - RNA, 12 nt, Chlamydophila pneumoniae J138
gacgacaaauca

SEQ ID NO: 543864 - RNA, 14 nt, Chlamydophila pneumoniae J138
gacgacaaaucacg

SEQ ID NO: 543865 - RNA, 15 nt, Chlamydophila pneumoniae J138
gacgacaaggagucg

SEQ ID NO: 543866 - RNA, 22 nt, Chlamydophila pneumoniae J138
gacgagcccuagauagcaaauc

SEQ ID NO: 543867 - RNA, 23 nt, Chlamydophila pneumoniae J138
gacgagaacaugaccuuuaggaa

SEQ ID NO: 543868 - RNA, 15 nt, Chlamydophila pneumoniae J138
gacguaaaaagaaag

SEQ ID NO: 543869 - RNA, 20 nt, Chlamydophila pneumoniae J138
gacgucuucuuagaagagaa

SEQ ID NO: 543870 - RNA, 21 nt, Chlamydophila pneumoniae J138
gacgucaucauaggaaacgcc

SEQ ID NO: 543871 - RNA, 21 nt, Chlamydophila pneumoniae J138
gacgcacuucuucaagaaaug

SEQ ID NO: 543872 - RNA, 22 nt, Chlamydophila pneumoniae J138
gacgcacuucuucaagaaaugc

SEQ ID NO: 543873 - RNA, 16 nt, Chlamydophila pneumoniae J138
gacgcggaacucucuu

SEQ ID NO: 543874 - RNA, 22 nt, Chlamydophila pneumoniae J138
gacgcggaacucucuuccccca

SEQ ID NO: 543875 - RNA, 10 nt, Chlamydophila pneumoniae J138
gacugaaacu

SEQ ID NO: 543876 - RNA, 19 nt, Chlamydophila pneumoniae J138
gacucucacugaguguccc

SEQ ID NO: 543877 - RNA, 14 nt, Chlamydophila pneumoniae J138
gacucucaucagca

SEQ ID NO: 543878 - RNA, 21 nt, Chlamydophila pneumoniae J138
gacucugccaugucuaaagga

SEQ ID NO: 543879 - RNA, 22 nt, Chlamydophila pneumoniae J138
gacucuaguuuuucuuuagaga

SEQ ID NO: 543880 - RNA, 14 nt, Chlamydophila pneumoniae J138
gacucuagaguacc

SEQ ID NO: 543881 - RNA, 16 nt, Chlamydophila pneumoniae J138
gacucuaauucagaaa

SEQ ID NO: 543882 - RNA, 21 nt, Chlamydophila pneumoniae J138
gacucgccgaaaguaucuuca

SEQ ID NO: 543883 - RNA, 14 nt, Chlamydophila pneumoniae J138
gacuaaaaaagaga

SEQ ID NO: 543884 - RNA, 21 nt, Chlamydophila pneumoniae J138
gacguuguugcaauucuucau

SEQ ID NO: 543885 - RNA, 11 nt, Chlamydophila pneumoniae J138
gacucccaagg

SEQ ID NO: 543886 - RNA, 20 nt, Chlamydophila pneumoniae J138
gacguugcgaacagcuccug

SEQ ID NO: 543887 - RNA, 17 nt, Chlamydophila pneumoniae J138
gacugcagauugcacuu

SEQ ID NO: 543888 - RNA, 18 nt, Chlamydophila pneumoniae J138
gacugcugacaucuccaa

SEQ ID NO: 543889 - RNA, 14 nt, Chlamydophila pneumoniae J138
gacugcuagagucc

SEQ ID NO: 543890 - RNA, 17 nt, Chlamydophila pneumoniae J138
gacugcucuuucauuuc

SEQ ID NO: 543891 - RNA, 16 nt, Chlamydophila pneumoniae J138
gacugucuaugaucca

SEQ ID NO: 543892 - RNA, 19 nt, Chlamydophila pneumoniae J138
gacuucgaugucuuuccag

SEQ ID NO: 543893 - RNA, 15 nt, Chlamydophila pneumoniae J138
gacuucgcaaauuuu

SEQ ID NO: 543894 - RNA, 20 nt, Chlamydophila pneumoniae J138
gacuucaccuugaaguuuuu

SEQ ID NO: 543895 - RNA, 14 nt, Chlamydophila pneumoniae J138
gacuguuuguuuau

SEQ ID NO: 543896 - RNA, 22 nt, Chlamydophila pneumoniae J138
gacuucuggaagcuguuguucu

SEQ ID NO: 543897 - RNA, 13 nt, Chlamydophila pneumoniae J138
gacuucucaaaga

SEQ ID NO: 543898 - RNA, 16 nt, Chlamydophila pneumoniae J138
gacuugcaagcuucuu

SEQ ID NO: 543899 - RNA, 20 nt, Chlamydophila pneumoniae J138
gacuugcaagcuucuuguuu

SEQ ID NO: 543900 - RNA, 13 nt, Chlamydophila pneumoniae J138
gacuuguucuuca

SEQ ID NO: 543901 - RNA, 23 nt, Chlamydophila pneumoniae J138
gacuuuagaaauuccaauuuuug

SEQ ID NO: 543902 - RNA, 12 nt, Chlamydophila pneumoniae J138
gacuuuccucuc

SEQ ID NO: 543903 - RNA, 19 nt, Chlamydophila pneumoniae J138
gagaaaagguaacauugga

SEQ ID NO: 543904 - RNA, 16 nt, Chlamydophila pneumoniae J138
gagaaagagugccaag

SEQ ID NO: 543905 - RNA, 20 nt, Chlamydophila pneumoniae J138
gagaaaguagagacaucgua

SEQ ID NO: 543906 - RNA, 20 nt, Chlamydophila pneumoniae J138
aaagauuugcgaaucuaaga

SEQ ID NO: 543907 - RNA, 21 nt, Chlamydophila pneumoniae J138
gagaacaugcccccacaaaac

SEQ ID NO: 543908 - RNA, 14 nt, Chlamydophila pneumoniae J138
gagaacauguuucu

SEQ ID NO: 543909 - RNA, 21 nt, Chlamydophila pneumoniae J138
aaagcaaagauaaagaaguuu

SEQ ID NO: 543910 - RNA, 14 nt, Chlamydophila pneumoniae J138
aaagcaaaaauucu

SEQ ID NO: 543911 - RNA, 20 nt, Chlamydophila pneumoniae J138
aaagcaaucguguuuuccug

SEQ ID NO: 543912 - RNA, 18 nt, Chlamydophila pneumoniae J138
aaagcaauuucuccuagg

SEQ ID NO: 543913 - RNA, 21 nt, Chlamydophila pneumoniae J138
aaagcaauuucuccuaggucu

SEQ ID NO: 543914 - RNA, 21 nt, Chlamydophila pneumoniae J138
gagaaauuuuuaauuuuucua

SEQ ID NO: 543915 - RNA, 17 nt, Chlamydophila pneumoniae J138
gagaacguagcagaggc

SEQ ID NO: 543916 - RNA, 15 nt, Chlamydophila pneumoniae J138
gagaacuuccugauu

SEQ ID NO: 543917 - RNA, 22 nt, Chlamydophila pneumoniae J138
gagaacuuuaacgaagaaggga

SEQ ID NO: 543918 - RNA, 16 nt, Chlamydophila pneumoniae J138
gagaaucuccucauca

SEQ ID NO: 543919 - RNA, 22 nt, Chlamydophila pneumoniae J138
gagaauacgaucugcuuugcau

SEQ ID NO: 543920 - RNA, 15 nt, Chlamydophila pneumoniae J138
gagaaugacuuuaga

SEQ ID NO: 543921 - RNA, 16 nt, Chlamydophila pneumoniae J138
gagaaugcccuguucu

SEQ ID NO: 543922 - RNA, 23 nt, Chlamydophila pneumoniae J138
gagaauauggccuagcuuucuug

SEQ ID NO: 543923 - RNA, 21 nt, Chlamydophila pneumoniae J138
gagaauacucuagguuuucuc

SEQ ID NO: 543924 - RNA, 20 nt, Chlamydophila pneumoniae J138
gagacccaacaguucuuucu

SEQ ID NO: 543925 - RNA, 19 nt, Chlamydophila pneumoniae J138
gagacaaguucaucaaaua

SEQ ID NO: 543926 - RNA, 12 nt, Chlamydophila pneumoniae J138
gagaauuuucau

SEQ ID NO: 543927 - RNA, 22 nt, Chlamydophila pneumoniae J138
gagaauguucccaaauagaaaa

SEQ ID NO: 543928 - RNA, 22 nt, Chlamydophila pneumoniae J138
gagaauugaaaauugcccauug

SEQ ID NO: 543929 - RNA, 13 nt, Chlamydophila pneumoniae J138
gagagagcuggac

SEQ ID NO: 543930 - RNA, 12 nt, Chlamydophila pneumoniae J138
gagagaggggag

SEQ ID NO: 543931 - RNA, 19 nt, Chlamydophila pneumoniae J138
gagagagucggcuuuagaa

SEQ ID NO: 543932 - RNA, 14 nt, Chlamydophila pneumoniae J138
gagagcaagauaau

SEQ ID NO: 543933 - RNA, 16 nt, Chlamydophila pneumoniae J138
gagacugcaaaggaag

SEQ ID NO: 543934 - RNA, 17 nt, Chlamydophila pneumoniae J138
gagacugcaaaggaagg

SEQ ID NO: 543935 - RNA, 18 nt, Chlamydophila pneumoniae J138
gagacucuaguuuuucuu

SEQ ID NO: 543936 - RNA, 13 nt, Chlamydophila pneumoniae J138
gagacguuguugc

SEQ ID NO: 543937 - RNA, 19 nt, Chlamydophila pneumoniae J138
gagacuugaucuacaaaaa

SEQ ID NO: 543938 - RNA, 15 nt, Chlamydophila pneumoniae J138
gagacuuccucuuca

SEQ ID NO: 543939 - RNA, 22 nt, Chlamydophila pneumoniae J138
gagacuguguuuuuaggaguug

SEQ ID NO: 543940 - RNA, 14 nt, Chlamydophila pneumoniae J138
gagagaaucgagaa

SEQ ID NO: 543941 - RNA, 13 nt, Chlamydophila pneumoniae J138
gagagagacccgu

SEQ ID NO: 543942 - RNA, 15 nt, Chlamydophila pneumoniae J138
gagaucacagggaca

SEQ ID NO: 543943 - RNA, 21 nt, Chlamydophila pneumoniae J138
gagauaucaucaaaagauaug

SEQ ID NO: 543944 - RNA, 21 nt, Chlamydophila pneumoniae J138
gagaucuuuuugccaguucuu

SEQ ID NO: 543945 - RNA, 15 nt, Chlamydophila pneumoniae J138
gagaucauuagcauc

SEQ ID NO: 543946 - RNA, 19 nt, Chlamydophila pneumoniae J138
gagauacguuccagccugu

SEQ ID NO: 543947 - RNA, 22 nt, Chlamydophila pneumoniae J138
gagaguucuuguaauaaaagaa

SEQ ID NO: 543948 - RNA, 14 nt, Chlamydophila pneumoniae J138
gagaugcuaacaac

SEQ ID NO: 543949 - RNA, 17 nt, Chlamydophila pneumoniae J138
gagaugcuucuaaacaa

SEQ ID NO: 543950 - RNA, 21 nt, Chlamydophila pneumoniae J138
gagaugccauaagcaagcaac

SEQ ID NO: 543951 - RNA, 16 nt, Chlamydophila pneumoniae J138
gagcacauagaaacag

SEQ ID NO: 543952 - RNA, 15 nt, Chlamydophila pneumoniae J138
gagcagaaacuccag

SEQ ID NO: 543953 - RNA, 18 nt, Chlamydophila pneumoniae J138
gagcagaaacuccaaaau

SEQ ID NO: 543954 - RNA, 15 nt, Chlamydophila pneumoniae J138
aaagcagauccugcu

SEQ ID NO: 543955 - RNA, 12 nt, Chlamydophila pneumoniae J138
aaagcagcgaag

SEQ ID NO: 543956 - RNA, 16 nt, Chlamydophila pneumoniae J138
gagccggaacuucagg

SEQ ID NO: 543957 - RNA, 23 nt, Chlamydophila pneumoniae J138
gagcuggaagacuugcucugaag

SEQ ID NO: 543958 - RNA, 22 nt, Chlamydophila pneumoniae J138
gagcugcugguccuaaaaaaag

SEQ ID NO: 543959 - RNA, 15 nt, Chlamydophila pneumoniae J138
gagcuuccauagcuu

SEQ ID NO: 543960 - RNA, 15 nt, Chlamydophila pneumoniae J138
gagcuugucuuccac

SEQ ID NO: 543961 - RNA, 17 nt, Chlamydophila pneumoniae J138
gagcuucuuuaucuagc

SEQ ID NO: 543962 - RNA, 15 nt, Chlamydophila pneumoniae J138
gaggacgcagagaug

SEQ ID NO: 543963 - RNA, 12 nt, Chlamydophila pneumoniae J138
gaggaaugaucc

SEQ ID NO: 543964 - RNA, 13 nt, Chlamydophila pneumoniae J138
gaggaaugaagag

SEQ ID NO: 543965 - RNA, 22 nt, Chlamydophila pneumoniae J138
gaggaaucauaaccaaaagaau

SEQ ID NO: 543966 - RNA, 21 nt, Chlamydophila pneumoniae J138
gaggaaucugaaucucauaag

SEQ ID NO: 543967 - RNA, 12 nt, Chlamydophila pneumoniae J138
gaggaaugaaga

SEQ ID NO: 543968 - RNA, 11 nt, Chlamydophila pneumoniae J138
gaggcaaagau

SEQ ID NO: 543969 - RNA, 14 nt, Chlamydophila pneumoniae J138
gaggcuagaaaauc

SEQ ID NO: 543970 - RNA, 22 nt, Chlamydophila pneumoniae J138
gaggcuucugagcuugccuacc

SEQ ID NO: 543971 - RNA, 20 nt, Chlamydophila pneumoniae J138
gagguucgcagaacuucucc

SEQ ID NO: 543972 - RNA, 16 nt, Chlamydophila pneumoniae J138
gagguucgcagaacuu

SEQ ID NO: 543973 - RNA, 23 nt, Chlamydophila pneumoniae J138
gagguuucgaagcguuaacaacu

SEQ ID NO: 543974 - RNA, 21 nt, Chlamydophila pneumoniae J138
gagugccaagagcaucacaaa

SEQ ID NO: 543975 - RNA, 13 nt, Chlamydophila pneumoniae J138
gagucucuuucag

SEQ ID NO: 543976 - RNA, 21 nt, Chlamydophila pneumoniae J138
gagucucacucuuuucuagaa

SEQ ID NO: 543977 - RNA, 19 nt, Chlamydophila pneumoniae J138
gagucccuugucaacaaaa

SEQ ID NO: 543978 - RNA, 22 nt, Chlamydophila pneumoniae J138
gaguuuuuuucuuauagggaau

SEQ ID NO: 543979 - RNA, 15 nt, Chlamydophila pneumoniae J138
gauaaaucccgaaca

SEQ ID NO: 543980 - RNA, 15 nt, Chlamydophila pneumoniae J138
gauaaauccccacca

SEQ ID NO: 543981 - RNA, 19 nt, Chlamydophila pneumoniae J138
gaguuggagaauugaaaau

SEQ ID NO: 543982 - RNA, 22 nt, Chlamydophila pneumoniae J138
gaguugccaggaaacguucuuu

SEQ ID NO: 543983 - RNA, 16 nt, Chlamydophila pneumoniae J138
gaguucuuuuguuugu

SEQ ID NO: 543984 - RNA, 18 nt, Chlamydophila pneumoniae J138
gaguucuuguaauaaaag

SEQ ID NO: 543985 - RNA, 23 nt, Chlamydophila pneumoniae J138
gaguuccaagacaauaaaaaaga

SEQ ID NO: 543986 - RNA, 22 nt, Chlamydophila pneumoniae J138
gagugcguacucuucuuuggau

SEQ ID NO: 543987 - RNA, 22 nt, Chlamydophila pneumoniae J138
gagugcucuaccccacgcuaaa

SEQ ID NO: 543988 - RNA, 19 nt, Chlamydophila pneumoniae J138
gauaaugucuccaucggaa

SEQ ID NO: 543989 - RNA, 17 nt, Chlamydophila pneumoniae J138
gauaaugauuccuagaa

SEQ ID NO: 543990 - RNA, 20 nt, Chlamydophila pneumoniae J138
gauaaugaaguuugcaugca

SEQ ID NO: 543991 - RNA, 10 nt, Chlamydophila pneumoniae J138
gauaaugauu

SEQ ID NO: 543992 - RNA, 15 nt, Chlamydophila pneumoniae J138
gauaaucagaggagc

SEQ ID NO: 543993 - RNA, 16 nt, Chlamydophila pneumoniae J138
gauaaucagaggagcc

SEQ ID NO: 543994 - RNA, 14 nt, Chlamydophila pneumoniae J138
gauaaguucuucca

SEQ ID NO: 543995 - RNA, 13 nt, Chlamydophila pneumoniae J138
gauaaggaccagg

SEQ ID NO: 543996 - RNA, 14 nt, Chlamydophila pneumoniae J138
gauacccaucuaga

SEQ ID NO: 543997 - RNA, 16 nt, Chlamydophila pneumoniae J138
gauaccggcaaauaaa

SEQ ID NO: 543998 - RNA, 16 nt, Chlamydophila pneumoniae J138
gauaccaaaauaccau

SEQ ID NO: 543999 - RNA, 15 nt, Chlamydophila pneumoniae J138
gauacaucaucagaa

SEQ ID NO: 544000 - RNA, 18 nt, Chlamydophila pneumoniae J138
aaagcaucuuguauugcu

SEQ ID NO: 544001 - RNA, 16 nt, Chlamydophila pneumoniae J138
aaagcaugaugccauu

SEQ ID NO: 544002 - RNA, 14 nt, Chlamydophila pneumoniae J138
aaagcauugcaaau

SEQ ID NO: 544003 - RNA, 18 nt, Chlamydophila pneumoniae J138
aaagccaagaagauguag

SEQ ID NO: 544004 - RNA, 22 nt, Chlamydophila pneumoniae J138
aaagcauagucgucuuuuaaag

SEQ ID NO: 544005 - RNA, 22 nt, Chlamydophila pneumoniae J138
aaagcauacuuauauuggcuuu

SEQ ID NO: 544006 - RNA, 22 nt, Chlamydophila pneumoniae J138
aaagcagugugccaauuuuugu

SEQ ID NO: 544007 - RNA, 23 nt, Chlamydophila pneumoniae J138
gauagcgucuguuaacucagaga

SEQ ID NO: 544008 - RNA, 18 nt, Chlamydophila pneumoniae J138
gauagcuaaaccuucaga

SEQ ID NO: 544009 - RNA, 15 nt, Chlamydophila pneumoniae J138
gauauauuuuuaaag

SEQ ID NO: 544010 - RNA, 11 nt, Chlamydophila pneumoniae J138
gauaucaccag

SEQ ID NO: 544011 - RNA, 24 nt, Chlamydophila pneumoniae J138
gauagcauugucgaguauaauuga

SEQ ID NO: 544012 - RNA, 21 nt, Chlamydophila pneumoniae J138
gauaccucuccgucauauuua

SEQ ID NO: 544013 - RNA, 20 nt, Chlamydophila pneumoniae J138
gauacgugcagugaauccuu

SEQ ID NO: 544014 - RNA, 23 nt, Chlamydophila pneumoniae J138
gauacgugcagugaauccuucca

SEQ ID NO: 544015 - RNA, 13 nt, Chlamydophila pneumoniae J138
gauacguggaacu

SEQ ID NO: 544016 - RNA, 23 nt, Chlamydophila pneumoniae J138
gauauucugauucuccguccccc

SEQ ID NO: 544017 - RNA, 22 nt, Chlamydophila pneumoniae J138
gaucaauauagagaacuccauu

SEQ ID NO: 544018 - RNA, 19 nt, Chlamydophila pneumoniae J138
gaucaaauuccuucucaga

SEQ ID NO: 544019 - RNA, 19 nt, Chlamydophila pneumoniae J138
gauaucggaccuacguuuu

SEQ ID NO: 544020 - RNA, 15 nt, Chlamydophila pneumoniae J138
gauaucgaccuuaaa

SEQ ID NO: 544021 - RNA, 16 nt, Chlamydophila pneumoniae J138
gauauccaccuuacca

SEQ ID NO: 544022 - RNA, 16 nt, Chlamydophila pneumoniae J138
gauaucccacagaaau

SEQ ID NO: 544023 - RNA, 21 nt, Chlamydophila pneumoniae J138
gaaauuaacagagcgccucca

SEQ ID NO: 544024 - RNA, 12 nt, Chlamydophila pneumoniae J138
gaaauuaacaga

SEQ ID NO: 544025 - RNA, 23 nt, Chlamydophila pneumoniae J138
aaagagcccaaaaacacucaaau

SEQ ID NO: 544026 - RNA, 19 nt, Chlamydophila pneumoniae J138
gaaauuaaagcuaacaacu

SEQ ID NO: 544027 - RNA, 16 nt, Chlamydophila pneumoniae J138
aaagagcucaaaaagu

SEQ ID NO: 544028 - RNA, 20 nt, Chlamydophila pneumoniae J138
aaagaggaagaugauauucu

SEQ ID NO: 544029 - RNA, 14 nt, Chlamydophila pneumoniae J138
aaagaggaaugaag

SEQ ID NO: 544030 - RNA, 17 nt, Chlamydophila pneumoniae J138
gaacaaagcucuccuuc

SEQ ID NO: 544031 - RNA, 21 nt, Chlamydophila pneumoniae J138
gaaauuuaggucgacuuccuu

SEQ ID NO: 544032 - RNA, 22 nt, Chlamydophila pneumoniae J138
gaaauguaagaaggcagagaac

SEQ ID NO: 544033 - RNA, 17 nt, Chlamydophila pneumoniae J138
gaaaugcucuucugcag

SEQ ID NO: 544034 - RNA, 20 nt, Chlamydophila pneumoniae J138
gaaaucguaucuuuuugcag

SEQ ID NO: 544035 - RNA, 16 nt, Chlamydophila pneumoniae J138
gaaaucugcucuacuu

SEQ ID NO: 544036 - RNA, 23 nt, Chlamydophila pneumoniae J138
gaacacccccgcagcuucucuag

SEQ ID NO: 544037 - RNA, 21 nt, Chlamydophila pneumoniae J138
gaacagaggaucuagaaaaug

SEQ ID NO: 544038 - RNA, 20 nt, Chlamydophila pneumoniae J138
gaacacccccgcagcuucuc

SEQ ID NO: 544039 - RNA, 23 nt, Chlamydophila pneumoniae J138
gaacagccucugugguuuuuauu

SEQ ID NO: 544040 - RNA, 15 nt, Chlamydophila pneumoniae J138
gaacauccuucacuc

SEQ ID NO: 544041 - RNA, 21 nt, Chlamydophila pneumoniae J138
gaacaguauaaucagaaguga

SEQ ID NO: 544042 - RNA, 16 nt, Chlamydophila pneumoniae J138
gaaauauaacucucua

SEQ ID NO: 544043 - RNA, 17 nt, Chlamydophila pneumoniae J138
gaaacgcagcuuuccuu

SEQ ID NO: 544044 - RNA, 22 nt, Chlamydophila pneumoniae J138
gaaacgcccuucaggacaugcc

SEQ ID NO: 544045 - RNA, 21 nt, Chlamydophila pneumoniae J138
gaaacuuuuuuucuucucuaa

SEQ ID NO: 544046 - RNA, 18 nt, Chlamydophila pneumoniae J138
gaaagagcuaaagaaacu

SEQ ID NO: 544047 - RNA, 17 nt, Chlamydophila pneumoniae J138
gaaagagcuaaagaaac

SEQ ID NO: 544048 - RNA, 17 nt, Chlamydophila pneumoniae J138
gaaagaacuacuuaaau

SEQ ID NO: 544049 - RNA, 19 nt, Chlamydophila pneumoniae J138
gaaagaagagaauacgauc

SEQ ID NO: 544050 - RNA, 16 nt, Chlamydophila pneumoniae J138
gaaagcccaugagaug

SEQ ID NO: 544051 - RNA, 17 nt, Chlamydophila pneumoniae J138
gaaagccaagaagaugu

SEQ ID NO: 544052 - RNA, 23 nt, Chlamydophila pneumoniae J138
gaaagaucagaggaaucuaagaa

SEQ ID NO: 544053 - RNA, 21 nt, Chlamydophila pneumoniae J138
gaaagccuuugcucacuguuu

SEQ ID NO: 544054 - RNA, 23 nt, Chlamydophila pneumoniae J138
gaaaauaucaccuacaucagacu

SEQ ID NO: 544055 - RNA, 23 nt, Chlamydophila pneumoniae J138
gaaaauaguacgcuuuuuacuga

SEQ ID NO: 544056 - RNA, 16 nt, Chlamydophila pneumoniae J138
gaaaaucaacucucca

SEQ ID NO: 544057 - RNA, 16 nt, Chlamydophila pneumoniae J138
gaaaaucaagaagaga

SEQ ID NO: 544058 - RNA, 18 nt, Chlamydophila pneumoniae J138
gaaaaucaagaagagaaa

SEQ ID NO: 544059 - RNA, 11 nt, Chlamydophila pneumoniae J138
gaaaaauccug

SEQ ID NO: 544060 - RNA, 13 nt, Chlamydophila pneumoniae J138
gaaaaaucccugu

SEQ ID NO: 544061 - RNA, 16 nt, Chlamydophila pneumoniae J138
gaaacaaccaucccau

SEQ ID NO: 544062 - RNA, 24 nt, Chlamydophila pneumoniae J138
gaaacaucggagaacuuccugauu

SEQ ID NO: 544063 - RNA, 19 nt, Chlamydophila pneumoniae J138
gaaacauagaaucauugag

SEQ ID NO: 544064 - RNA, 24 nt, Chlamydophila pneumoniae J138
gaaacacuuuggauaggauaggag

SEQ ID NO: 544065 - RNA, 13 nt, Chlamydophila pneumoniae J138
gaaacacucauga

SEQ ID NO: 544066 - RNA, 20 nt, Chlamydophila pneumoniae J138
gaaacacucaugaaagugcu

SEQ ID NO: 544067 - RNA, 19 nt, Chlamydophila pneumoniae J138
gaaacaccguuaauuuuug

SEQ ID NO: 544068 - RNA, 23 nt, Chlamydophila pneumoniae J138
gaaacauggcgguguuuccuucg

SEQ ID NO: 544069 - RNA, 17 nt, Chlamydophila pneumoniae J138
gaaacccgcaacucuuu

SEQ ID NO: 544070 - RNA, 15 nt, Chlamydophila pneumoniae J138
gaaaccaugaugcaa

SEQ ID NO: 544071 - RNA, 22 nt, Chlamydophila pneumoniae J138
gaaacccauaaugguacaauac

SEQ ID NO: 544072 - RNA, 23 nt, Chlamydophila pneumoniae J138
gaaaccggacugacuucuaugau

SEQ ID NO: 544073 - RNA, 16 nt, Chlamydophila pneumoniae J138
gaaaaaccuucuccaa

SEQ ID NO: 544074 - RNA, 23 nt, Chlamydophila pneumoniae J138
gaaaaaccccuagaacuuuacaa

SEQ ID NO: 544075 - RNA, 11 nt, Chlamydophila pneumoniae J138
gaaaaaauucu

SEQ ID NO: 544076 - RNA, 15 nt, Chlamydophila pneumoniae J138
gaaaaaauagauccu

SEQ ID NO: 544077 - RNA, 18 nt, Chlamydophila pneumoniae J138
cuuuuuuuauauaaagau

SEQ ID NO: 544078 - RNA, 21 nt, Chlamydophila pneumoniae J138
cuuuuuuucuucucuaagaaa

SEQ ID NO: 544079 - RNA, 12 nt, Chlamydophila pneumoniae J138
cuuuuuccaaaa

SEQ ID NO: 544080 - RNA, 15 nt, Chlamydophila pneumoniae J138
cuuuuugccacaacu

SEQ ID NO: 544081 - RNA, 15 nt, Chlamydophila pneumoniae J138
cuuuuugccaauuuu

SEQ ID NO: 544082 - RNA, 20 nt, Chlamydophila pneumoniae J138
cuuuuugauuagaguuuuug

SEQ ID NO: 544083 - RNA, 17 nt, Chlamydophila pneumoniae J138
cuuuugacaauaagaaa

SEQ ID NO: 544084 - RNA, 15 nt, Chlamydophila pneumoniae J138
cuuuugcaaaucuuc

SEQ ID NO: 544085 - RNA, 13 nt, Chlamydophila pneumoniae J138
cuuuugcaaguuu

SEQ ID NO: 544086 - RNA, 19 nt, Chlamydophila pneumoniae J138
cuuuugaagauccugagua

SEQ ID NO: 544087 - RNA, 17 nt, Chlamydophila pneumoniae J138
cuuuugaagauccugag

SEQ ID NO: 544088 - RNA, 16 nt, Chlamydophila pneumoniae J138
cuuuuagguagagaau

SEQ ID NO: 544089 - RNA, 20 nt, Chlamydophila pneumoniae J138
cuuuuagagccuuuucagau

SEQ ID NO: 544090 - RNA, 17 nt, Chlamydophila pneumoniae J138
cuuuuuaucaugagaau

SEQ ID NO: 544091 - RNA, 19 nt, Chlamydophila pneumoniae J138
cuuggauuucuucuucuaa

SEQ ID NO: 544092 - RNA, 19 nt, Chlamydophila pneumoniae J138
cuuggaugggaaucuugaa

SEQ ID NO: 544093 - RNA, 15 nt, Chlamydophila pneumoniae J138
cuuggcauacucuau

SEQ ID NO: 544094 - RNA, 15 nt, Chlamydophila pneumoniae J138
cuugggacauuuccc

SEQ ID NO: 544095 - RNA, 19 nt, Chlamydophila pneumoniae J138
cuugggcaaauaggagagc

SEQ ID NO: 544096 - RNA, 14 nt, Chlamydophila pneumoniae J138
cuuguacauccuug

SEQ ID NO: 544097 - RNA, 21 nt, Chlamydophila pneumoniae J138
cuuguagcucccguuccuuua

SEQ ID NO: 544098 - RNA, 18 nt, Chlamydophila pneumoniae J138
cuuguaagacuaaaaaag

SEQ ID NO: 544099 - RNA, 21 nt, Chlamydophila pneumoniae J138
cuuguaagacuaaaaaagaga

SEQ ID NO: 544100 - RNA, 19 nt, Chlamydophila pneumoniae J138
cuuguaaguuacggaacuc

SEQ ID NO: 544101 - RNA, 20 nt, Chlamydophila pneumoniae J138
cuugucacacugcgagagaa

SEQ ID NO: 544102 - RNA, 18 nt, Chlamydophila pneumoniae J138
cuuggucggaguuuuuuu

SEQ ID NO: 544103 - RNA, 19 nt, Chlamydophila pneumoniae J138
cuuggucgaucaagguguu

SEQ ID NO: 544104 - RNA, 19 nt, Chlamydophila pneumoniae J138
cuugguagcgucucuucuu

SEQ ID NO: 544105 - RNA, 20 nt, Chlamydophila pneumoniae J138
cuugguaggaugucgcuuuu

SEQ ID NO: 544106 - RNA, 18 nt, Chlamydophila pneumoniae J138
cuuguucuucuugauuaa

SEQ ID NO: 544107 - RNA, 13 nt, Chlamydophila pneumoniae J138
cuuguucuucauu

SEQ ID NO: 544108 - RNA, 18 nt, Chlamydophila pneumoniae J138
cuuguucuaaaaugaaau

SEQ ID NO: 544109 - RNA, 15 nt, Chlamydophila pneumoniae J138
aaagaaauauuaacc

SEQ ID NO: 544110 - RNA, 12 nt, Chlamydophila pneumoniae J138
aaagaacacucc

SEQ ID NO: 544111 - RNA, 12 nt, Chlamydophila pneumoniae J138
aaagaacagcac

SEQ ID NO: 544112 - RNA, 19 nt, Chlamydophila pneumoniae J138
aaagaacuuaaaauucaaa

SEQ ID NO: 544113 - RNA, 22 nt, Chlamydophila pneumoniae J138
cuuguuggcauagcgagaacac

SEQ ID NO: 544114 - RNA, 18 nt, Chlamydophila pneumoniae J138
cuuuaaaaauauaucuuc

SEQ ID NO: 544115 - RNA, 18 nt, Chlamydophila pneumoniae J138
cuuguuuuccuguguggu

SEQ ID NO: 544116 - RNA, 18 nt, Chlamydophila pneumoniae J138
cuugucgcgacaagacaa

SEQ ID NO: 544117 - RNA, 19 nt, Chlamydophila pneumoniae J138
cuugucgcgacaagacaau

SEQ ID NO: 544118 - RNA, 16 nt, Chlamydophila pneumoniae J138
cuugucuaggagcuuc

SEQ ID NO: 544119 - RNA, 17 nt, Chlamydophila pneumoniae J138
aaacuuuuuuucuucuc

SEQ ID NO: 544120 - RNA, 19 nt, Chlamydophila pneumoniae J138
aaacuuuuuuucaaaucau

SEQ ID NO: 544121 - RNA, 16 nt, Chlamydophila pneumoniae J138
aaacuuuuuuucuucu

SEQ ID NO: 544122 - RNA, 22 nt, Chlamydophila pneumoniae J138
aaagaaacuucugacccuguag

SEQ ID NO: 544123 - RNA, 19 nt, Chlamydophila pneumoniae J138
cuugugcuaaagcaggagc

SEQ ID NO: 544124 - RNA, 22 nt, Chlamydophila pneumoniae J138
cuugugcuaaagcaggagcauc

SEQ ID NO: 544125 - RNA, 22 nt, Chlamydophila pneumoniae J138
cuugugcaucuauaauuaaucc

SEQ ID NO: 544126 - RNA, 23 nt, Chlamydophila pneumoniae J138
cuugugguuuuucuccucuuucu

SEQ ID NO: 544127 - RNA, 18 nt, Chlamydophila pneumoniae J138
cuugugguuagaggaagc

SEQ ID NO: 544128 - RNA, 14 nt, Chlamydophila pneumoniae J138
cuuuccuuagcauu

SEQ ID NO: 544129 - RNA, 16 nt, Chlamydophila pneumoniae J138
cuuuccuaaaauaauu

SEQ ID NO: 544130 - RNA, 16 nt, Chlamydophila pneumoniae J138
cuuuccguugaugaca

SEQ ID NO: 544131 - RNA, 16 nt, Chlamydophila pneumoniae J138
cuuucugcucuucuau

SEQ ID NO: 544132 - RNA, 14 nt, Chlamydophila pneumoniae J138
cuuucugcuugucu

SEQ ID NO: 544133 - RNA, 16 nt, Chlamydophila pneumoniae J138
cuuucugcuugucuac

SEQ ID NO: 544134 - RNA, 15 nt, Chlamydophila pneumoniae J138
cuuugaauaaugcau

SEQ ID NO: 544135 - RNA, 21 nt, Chlamydophila pneumoniae J138
cuuugaauaaugcaucccccg

SEQ ID NO: 544136 - RNA, 16 nt, Chlamydophila pneumoniae J138
cuuugcuuauuucccc

SEQ ID NO: 544137 - RNA, 23 nt, Chlamydophila pneumoniae J138
cuuugcuuauuuccccgaacaaa

SEQ ID NO: 544138 - RNA, 23 nt, Chlamydophila pneumoniae J138
cuuugcgaacgaagacuuguucu

SEQ ID NO: 544139 - RNA, 15 nt, Chlamydophila pneumoniae J138
cuuugagaucuugaa

SEQ ID NO: 544140 - RNA, 17 nt, Chlamydophila pneumoniae J138
cuuugagaucuugaaug

SEQ ID NO: 544141 - RNA, 16 nt, Chlamydophila pneumoniae J138
cuuugagucuuuuuca

SEQ ID NO: 544142 - RNA, 15 nt, Chlamydophila pneumoniae J138
cuuugaguuaagcaa

SEQ ID NO: 544143 - RNA, 15 nt, Chlamydophila pneumoniae J138
cuuugagucuuuuuc

SEQ ID NO: 544144 - RNA, 17 nt, Chlamydophila pneumoniae J138
cuuugccaacagcuggg

SEQ ID NO: 544145 - RNA, 23 nt, Chlamydophila pneumoniae J138
cuuuuaagacaauauaagcacca

SEQ ID NO: 544146 - RNA, 19 nt, Chlamydophila pneumoniae J138
cuuuuaauguguucuuauc

SEQ ID NO: 544147 - RNA, 19 nt, Chlamydophila pneumoniae J138
aaagaauucagagaaagcc

SEQ ID NO: 544148 - RNA, 17 nt, Chlamydophila pneumoniae J138
aaagaauuaagaagaag

SEQ ID NO: 544149 - RNA, 21 nt, Chlamydophila pneumoniae J138
aaagaauuguaguucuuugaa

SEQ ID NO: 544150 - RNA, 17 nt, Chlamydophila pneumoniae J138
aaagaaugacacagaga

SEQ ID NO: 544151 - RNA, 18 nt, Chlamydophila pneumoniae J138
aaagaaugacacagagaa

SEQ ID NO: 544152 - RNA, 15 nt, Chlamydophila pneumoniae J138
aaagacaaaaaaucu

SEQ ID NO: 544153 - RNA, 20 nt, Chlamydophila pneumoniae J138
aaagacaaaaaaucugaucu

SEQ ID NO: 544154 - RNA, 22 nt, Chlamydophila pneumoniae J138
aaagaagguugagacguaacca

SEQ ID NO: 544155 - RNA, 15 nt, Chlamydophila pneumoniae J138
aaagaagguccaugu

SEQ ID NO: 544156 - RNA, 14 nt, Chlamydophila pneumoniae J138
aaagaagauucaag

SEQ ID NO: 544157 - RNA, 12 nt, Chlamydophila pneumoniae J138
aaagaagauuca

SEQ ID NO: 544158 - RNA, 16 nt, Chlamydophila pneumoniae J138
aaagaauacucauauu

SEQ ID NO: 544159 - RNA, 21 nt, Chlamydophila pneumoniae J138
aaagaauagccgacaugcuuu

SEQ ID NO: 544160 - RNA, 20 nt, Chlamydophila pneumoniae J138
cuuuaagaagcacuucuuua

SEQ ID NO: 544161 - RNA, 16 nt, Chlamydophila pneumoniae J138
cuuuaacuucuaaaag

SEQ ID NO: 544162 - RNA, 19 nt, Chlamydophila pneumoniae J138
cuuuaagguugcuuuucua

SEQ ID NO: 544163 - RNA, 16 nt, Chlamydophila pneumoniae J138
cuuuaagauuuuuaga

SEQ ID NO: 544164 - RNA, 12 nt, Chlamydophila pneumoniae J138
cuuuacuacaug

SEQ ID NO: 544165 - RNA, 20 nt, Chlamydophila pneumoniae J138
cuuuauggcucaacuuaagu

SEQ ID NO: 544166 - RNA, 18 nt, Chlamydophila pneumoniae J138
cuuuauggcucaacuuaa

SEQ ID NO: 544167 - RNA, 23 nt, Chlamydophila pneumoniae J138
cuuuaucuagcucuucaagguac

SEQ ID NO: 544168 - RNA, 16 nt, Chlamydophila pneumoniae J138
cuuuaguuaacuccuu

SEQ ID NO: 544169 - RNA, 17 nt, Chlamydophila pneumoniae J138
cuuuaguuaacuccuuc

SEQ ID NO: 544170 - RNA, 16 nt, Chlamydophila pneumoniae J138
cuuucaaaccacggau

SEQ ID NO: 544171 - RNA, 22 nt, Chlamydophila pneumoniae J138
cuuuauuuugaugcuucuuuca

SEQ ID NO: 544172 - RNA, 17 nt, Chlamydophila pneumoniae J138
cuuucaaccuccgcucu

SEQ ID NO: 544173 - RNA, 12 nt, Chlamydophila pneumoniae J138
cuuucacuuccc

SEQ ID NO: 544174 - RNA, 20 nt, Chlamydophila pneumoniae J138
cuuuccacguacgagaucag

SEQ ID NO: 544175 - RNA, 14 nt, Chlamydophila pneumoniae J138
cuucucaaagacaa

SEQ ID NO: 544176 - RNA, 14 nt, Chlamydophila pneumoniae J138
cuucuccagagcaa

SEQ ID NO: 544177 - RNA, 17 nt, Chlamydophila pneumoniae J138
cuucuccagagcaagau

SEQ ID NO: 544178 - RNA, 15 nt, Chlamydophila pneumoniae J138
cuucuccaaauaaag

SEQ ID NO: 544179 - RNA, 14 nt, Chlamydophila pneumoniae J138
cuucuccaacccca

SEQ ID NO: 544180 - RNA, 14 nt, Chlamydophila pneumoniae J138
cuucucccuguauu

SEQ ID NO: 544181 - RNA, 16 nt, Chlamydophila pneumoniae J138
cuucuccucgcaaucc

SEQ ID NO: 544182 - RNA, 19 nt, Chlamydophila pneumoniae J138
cuucucuaagaaauuuucu

SEQ ID NO: 544183 - RNA, 22 nt, Chlamydophila pneumoniae J138
cuucucgguuuaaggcaauaga

SEQ ID NO: 544184 - RNA, 19 nt, Chlamydophila pneumoniae J138
cuucucgucauucugcaag

SEQ ID NO: 544185 - RNA, 15 nt, Chlamydophila pneumoniae J138
cuucugaauagcucu

SEQ ID NO: 544186 - RNA, 19 nt, Chlamydophila pneumoniae J138
cuucugaaaucaaaaaaaa

SEQ ID NO: 544187 - RNA, 20 nt, Chlamydophila pneumoniae J138
cuucucuguugggagcuucc

SEQ ID NO: 544188 - RNA, 15 nt, Chlamydophila pneumoniae J138
cuucucucuuaaauu

SEQ ID NO: 544189 - RNA, 14 nt, Chlamydophila pneumoniae J138
cuucugacaauaac

SEQ ID NO: 544190 - RNA, 16 nt, Chlamydophila pneumoniae J138
cuucugacaauaacau

SEQ ID NO: 544191 - RNA, 19 nt, Chlamydophila pneumoniae J138
cuucuagguauuuguuuca

SEQ ID NO: 544192 - RNA, 17 nt, Chlamydophila pneumoniae J138
cuucuagguauuuguuu

SEQ ID NO: 544193 - RNA, 16 nt, Chlamydophila pneumoniae J138
cuucuauuuuuuugga

SEQ ID NO: 544194 - RNA, 15 nt, Chlamydophila pneumoniae J138
cuucuauuucuauua

SEQ ID NO: 544195 - RNA, 22 nt, Chlamydophila pneumoniae J138
cuucuaugguaaucaccuuaga

SEQ ID NO: 544196 - RNA, 14 nt, Chlamydophila pneumoniae J138
cuucuaugaauuga

SEQ ID NO: 544197 - RNA, 18 nt, Chlamydophila pneumoniae J138
cuucuaugauaucaccag

SEQ ID NO: 544198 - RNA, 12 nt, Chlamydophila pneumoniae J138
cuucuaaacaau

SEQ ID NO: 544199 - RNA, 20 nt, Chlamydophila pneumoniae J138
cuucuaaggaaauuacaauc

SEQ ID NO: 544200 - RNA, 17 nt, Chlamydophila pneumoniae J138
cuucguaucuucgaggc

SEQ ID NO: 544201 - RNA, 20 nt, Chlamydophila pneumoniae J138
cuucuaaagcugcuuuuucu

SEQ ID NO: 544202 - RNA, 15 nt, Chlamydophila pneumoniae J138
cuucguuucgcuuug

SEQ ID NO: 544203 - RNA, 22 nt, Chlamydophila pneumoniae J138
cuucguuagaaaccaugaugca

SEQ ID NO: 544204 - RNA, 10 nt, Chlamydophila pneumoniae J138
cuucuguaaa

SEQ ID NO: 544205 - RNA, 20 nt, Chlamydophila pneumoniae J138
cuucuguaauuuuuuucaaa

SEQ ID NO: 544206 - RNA, 23 nt, Chlamydophila pneumoniae J138
cuucuguaauuuuuuucaaagga

SEQ ID NO: 544207 - RNA, 17 nt, Chlamydophila pneumoniae J138
cuucugugcaucaguca

SEQ ID NO: 544208 - RNA, 16 nt, Chlamydophila pneumoniae J138
cuucuggcugagagaa

SEQ ID NO: 544209 - RNA, 22 nt, Chlamydophila pneumoniae J138
cuucuucagcuuuuucaauagc

SEQ ID NO: 544210 - RNA, 14 nt, Chlamydophila pneumoniae J138
cuucuucagagcuc

SEQ ID NO: 544211 - RNA, 15 nt, Chlamydophila pneumoniae J138
cuucuucagcuuuuu

SEQ ID NO: 544212 - RNA, 13 nt, Chlamydophila pneumoniae J138
cuucuucagcuuu

SEQ ID NO: 544213 - RNA, 17 nt, Chlamydophila pneumoniae J138
cuucuuagccaaaauuu

SEQ ID NO: 544214 - RNA, 16 nt, Chlamydophila pneumoniae J138
cuucuuaguaaagaau

SEQ ID NO: 544215 - RNA, 17 nt, Chlamydophila pneumoniae J138
cuucuugcaaucuuuga

SEQ ID NO: 544216 - RNA, 12 nt, Chlamydophila pneumoniae J138
cuucuugcaaag

SEQ ID NO: 544217 - RNA, 23 nt, Chlamydophila pneumoniae J138
cuucuucuaaagcugcuuuuucu

SEQ ID NO: 544218 - RNA, 20 nt, Chlamydophila pneumoniae J138
cuucuucuggcugagagaag

SEQ ID NO: 544219 - RNA, 22 nt, Chlamydophila pneumoniae J138
cuucuucuggcugagagaagca

SEQ ID NO: 544220 - RNA, 15 nt, Chlamydophila pneumoniae J138
cuucuucggaucugu

SEQ ID NO: 544221 - RNA, 19 nt, Chlamydophila pneumoniae J138
cuugaaauugcucuugcuc

SEQ ID NO: 544222 - RNA, 11 nt, Chlamydophila pneumoniae J138
cuugaacagag

SEQ ID NO: 544223 - RNA, 13 nt, Chlamydophila pneumoniae J138
cuugaaacucuau

SEQ ID NO: 544224 - RNA, 23 nt, Chlamydophila pneumoniae J138
cuugaaaguacaggcuccaucac

SEQ ID NO: 544225 - RNA, 13 nt, Chlamydophila pneumoniae J138
cuucuuucaaagc

SEQ ID NO: 544226 - RNA, 18 nt, Chlamydophila pneumoniae J138
cuucuuucaauagcuucc

SEQ ID NO: 544227 - RNA, 14 nt, Chlamydophila pneumoniae J138
cuucuuucugcucu

SEQ ID NO: 544228 - RNA, 15 nt, Chlamydophila pneumoniae J138
cuucuuuccauagau

SEQ ID NO: 544229 - RNA, 20 nt, Chlamydophila pneumoniae J138
cuucuuuccauaaagcccca

SEQ ID NO: 544230 - RNA, 22 nt, Chlamydophila pneumoniae J138
cuucuuuuagacgugcucucuu

SEQ ID NO: 544231 - RNA, 15 nt, Chlamydophila pneumoniae J138
cuugaaguucucaaa

SEQ ID NO: 544232 - RNA, 14 nt, Chlamydophila pneumoniae J138
cuugaaguuuuuuc

SEQ ID NO: 544233 - RNA, 15 nt, Chlamydophila pneumoniae J138
cuugaaguuuuuucu

SEQ ID NO: 544234 - RNA, 13 nt, Chlamydophila pneumoniae J138
cuugaagaucucc

SEQ ID NO: 544235 - RNA, 15 nt, Chlamydophila pneumoniae J138
cuugacaaauaaguc

SEQ ID NO: 544236 - RNA, 23 nt, Chlamydophila pneumoniae J138
cuugaccucaucagaaguggccu

SEQ ID NO: 544237 - RNA, 19 nt, Chlamydophila pneumoniae J138
cuugaccucaucagaagug

SEQ ID NO: 544238 - RNA, 22 nt, Chlamydophila pneumoniae J138
cuugacuaaauccaccaaugau

SEQ ID NO: 544239 - RNA, 20 nt, Chlamydophila pneumoniae J138
cuugacggcaggacucuuua

SEQ ID NO: 544240 - RNA, 18 nt, Chlamydophila pneumoniae J138
cuugagcauccaaaaugu

SEQ ID NO: 544241 - RNA, 23 nt, Chlamydophila pneumoniae J138
cuugagccaacagguucacuuca

SEQ ID NO: 544242 - RNA, 14 nt, Chlamydophila pneumoniae J138
cuugacucuaauuc

SEQ ID NO: 544243 - RNA, 23 nt, Chlamydophila pneumoniae J138
cuugaggaccuuccuuaucuuca

SEQ ID NO: 544244 - RNA, 23 nt, Chlamydophila pneumoniae J138
cuugaggaggauugacaaucgcu

SEQ ID NO: 544245 - RNA, 15 nt, Chlamydophila pneumoniae J138
cuugauauuguucuu

SEQ ID NO: 544246 - RNA, 14 nt, Chlamydophila pneumoniae J138
cuugauauuugucu

SEQ ID NO: 544247 - RNA, 12 nt, Chlamydophila pneumoniae J138
cuugaucaggau

SEQ ID NO: 544248 - RNA, 18 nt, Chlamydophila pneumoniae J138
cuugauccuuuccaagaa

SEQ ID NO: 544249 - RNA, 16 nt, Chlamydophila pneumoniae J138
cuugauacugaauccc

SEQ ID NO: 544250 - RNA, 20 nt, Chlamydophila pneumoniae J138
cuugauaaaacgcuauuguu

SEQ ID NO: 544251 - RNA, 13 nt, Chlamydophila pneumoniae J138
cuugaucuacaaa

SEQ ID NO: 544252 - RNA, 15 nt, Chlamydophila pneumoniae J138
cuugaucuacaaaaa

SEQ ID NO: 544253 - RNA, 16 nt, Chlamydophila pneumoniae J138
cuugcaaucuuugaag

SEQ ID NO: 544254 - RNA, 18 nt, Chlamydophila pneumoniae J138
cuugauuuguuuagcaua

SEQ ID NO: 544255 - RNA, 21 nt, Chlamydophila pneumoniae J138
cuugcaaaacagcaucaggau

SEQ ID NO: 544256 - RNA, 18 nt, Chlamydophila pneumoniae J138
cuugcauuuuuuggaaua

SEQ ID NO: 544257 - RNA, 15 nt, Chlamydophila pneumoniae J138
cuugcgacauaacca

SEQ ID NO: 544258 - RNA, 14 nt, Chlamydophila pneumoniae J138
aaacuuucuucucu

SEQ ID NO: 544259 - RNA, 13 nt, Chlamydophila pneumoniae J138
aaacuuucuucuc

SEQ ID NO: 544260 - RNA, 23 nt, Chlamydophila pneumoniae J138
aaacuuguuaggaaaauucuuaa

SEQ ID NO: 544261 - RNA, 22 nt, Chlamydophila pneumoniae J138
aaacuuguuuucguaagagaau

SEQ ID NO: 544262 - RNA, 12 nt, Chlamydophila pneumoniae J138
aaacuucuugug

SEQ ID NO: 544263 - RNA, 21 nt, Chlamydophila pneumoniae J138
cuugcugcccaaauugagaaa

SEQ ID NO: 544264 - RNA, 23 nt, Chlamydophila pneumoniae J138
cuugcuuugugaguucuuccuuc

SEQ ID NO: 544265 - RNA, 16 nt, Chlamydophila pneumoniae J138
cuugcuuuuaacgcua

SEQ ID NO: 544266 - RNA, 18 nt, Chlamydophila pneumoniae J138
cuugcuuauccaaguguu

SEQ ID NO: 544267 - RNA, 17 nt, Chlamydophila pneumoniae J138
cuugcugauuucuuuuu

SEQ ID NO: 544268 - RNA, 17 nt, Chlamydophila pneumoniae J138
cuugcucugaagcucgg

SEQ ID NO: 544269 - RNA, 14 nt, Chlamydophila pneumoniae J138
cuuaauauaaaaga

SEQ ID NO: 544270 - RNA, 17 nt, Chlamydophila pneumoniae J138
cuuaaccuccucaagaa

SEQ ID NO: 544271 - RNA, 18 nt, Chlamydophila pneumoniae J138
cuuaaccuccucaagaau

SEQ ID NO: 544272 - RNA, 20 nt, Chlamydophila pneumoniae J138
cuuaacaaccgccuuuauau

SEQ ID NO: 544273 - RNA, 20 nt, Chlamydophila pneumoniae J138
aaacuggcggauugcuuugc

SEQ ID NO: 544274 - RNA, 14 nt, Chlamydophila pneumoniae J138
aaacugcuccugaa

SEQ ID NO: 544275 - RNA, 22 nt, Chlamydophila pneumoniae J138
cuguuuuuugaaaacuucaaaa

SEQ ID NO: 544276 - RNA, 21 nt, Chlamydophila pneumoniae J138
cuguuuuucuuccacacaacu

SEQ ID NO: 544277 - RNA, 23 nt, Chlamydophila pneumoniae J138
cuuaaagguaaagcuucuuucuc

SEQ ID NO: 544278 - RNA, 23 nt, Chlamydophila pneumoniae J138
cuuaaagguaaaacuacaggaaa

SEQ ID NO: 544279 - RNA, 14 nt, Chlamydophila pneumoniae J138
cuuaaaacaugaga

SEQ ID NO: 544280 - RNA, 12 nt, Chlamydophila pneumoniae J138
cuuaaagaguuu

SEQ ID NO: 544281 - RNA, 23 nt, Chlamydophila pneumoniae J138
cuguuucaacauaacaugagaaa

SEQ ID NO: 544282 - RNA, 19 nt, Chlamydophila pneumoniae J138
cuguuuauggauuaucuua

SEQ ID NO: 544283 - RNA, 18 nt, Chlamydophila pneumoniae J138
cuguuccugaguacuuug

SEQ ID NO: 544284 - RNA, 20 nt, Chlamydophila pneumoniae J138
cuuagagcgaauguagccaa

SEQ ID NO: 544285 - RNA, 17 nt, Chlamydophila pneumoniae J138
cuuagcaaugaaggcca

SEQ ID NO: 544286 - RNA, 12 nt, Chlamydophila pneumoniae J138
cuuagagaauug

SEQ ID NO: 544287 - RNA, 22 nt, Chlamydophila pneumoniae J138
cuuacugaagaaguaagcgauu

SEQ ID NO: 544288 - RNA, 20 nt, Chlamydophila pneumoniae J138
cuuaaugguagcuuaagaau

SEQ ID NO: 544289 - RNA, 19 nt, Chlamydophila pneumoniae J138
cuuacauuggcuuguaccg

SEQ ID NO: 544290 - RNA, 16 nt, Chlamydophila pneumoniae J138
cuuacauccaauuuug

SEQ ID NO: 544291 - RNA, 14 nt, Chlamydophila pneumoniae J138
cuuaugcucauuaa

SEQ ID NO: 544292 - RNA, 14 nt, Chlamydophila pneumoniae J138
cuuauccucagggg

SEQ ID NO: 544293 - RNA, 15 nt, Chlamydophila pneumoniae J138
cuuauccugaacauc

SEQ ID NO: 544294 - RNA, 13 nt, Chlamydophila pneumoniae J138
cuuauccuuuuca

SEQ ID NO: 544295 - RNA, 16 nt, Chlamydophila pneumoniae J138
cuuauguuaaaaauac

SEQ ID NO: 544296 - RNA, 22 nt, Chlamydophila pneumoniae J138
cuuauguuaaaaauaccaagau

SEQ ID NO: 544297 - RNA, 22 nt, Chlamydophila pneumoniae J138
cuuaugguuuuucaguuguuuc

SEQ ID NO: 544298 - RNA, 17 nt, Chlamydophila pneumoniae J138
cuuauguagauugaucc

SEQ ID NO: 544299 - RNA, 21 nt, Chlamydophila pneumoniae J138
cuuauguagauugauccagcc

SEQ ID NO: 544300 - RNA, 19 nt, Chlamydophila pneumoniae J138
cuuauauuggcuuucuaca

SEQ ID NO: 544301 - RNA, 17 nt, Chlamydophila pneumoniae J138
cuuaucaagagcucgua

SEQ ID NO: 544302 - RNA, 18 nt, Chlamydophila pneumoniae J138
cuuaggaauuuuucuagu

SEQ ID NO: 544303 - RNA, 16 nt, Chlamydophila pneumoniae J138
cuuaggauucuuauca

SEQ ID NO: 544304 - RNA, 20 nt, Chlamydophila pneumoniae J138
cuuaggauucuuaucacaaa

SEQ ID NO: 544305 - RNA, 19 nt, Chlamydophila pneumoniae J138
cuuagggccguauucccag

SEQ ID NO: 544306 - RNA, 16 nt, Chlamydophila pneumoniae J138
cuuaggguucucaaag

SEQ ID NO: 544307 - RNA, 17 nt, Chlamydophila pneumoniae J138
aaacuucuaacuguaca

SEQ ID NO: 544308 - RNA, 16 nt, Chlamydophila pneumoniae J138
aaacuucaguuguugc

SEQ ID NO: 544309 - RNA, 13 nt, Chlamydophila pneumoniae J138
aaacuucaaaagu

SEQ ID NO: 544310 - RNA, 23 nt, Chlamydophila pneumoniae J138
cuuccaacggacauuuucaagcu

SEQ ID NO: 544311 - RNA, 12 nt, Chlamydophila pneumoniae J138
aaacuucucuag

SEQ ID NO: 544312 - RNA, 18 nt, Chlamydophila pneumoniae J138
cuucccucaugaagaauu

SEQ ID NO: 544313 - RNA, 21 nt, Chlamydophila pneumoniae J138
cuuccuacggcaagaaucgcc

SEQ ID NO: 544314 - RNA, 13 nt, Chlamydophila pneumoniae J138
cuuccuccaaaau

SEQ ID NO: 544315 - RNA, 16 nt, Chlamydophila pneumoniae J138
cuuccugcuccucuuc

SEQ ID NO: 544316 - RNA, 18 nt, Chlamydophila pneumoniae J138
cuucgacuucaccuugaa

SEQ ID NO: 544317 - RNA, 21 nt, Chlamydophila pneumoniae J138
cuucgacuucaccuugaaguu

SEQ ID NO: 544318 - RNA, 15 nt, Chlamydophila pneumoniae J138
cuucaggacaugccu

SEQ ID NO: 544319 - RNA, 18 nt, Chlamydophila pneumoniae J138
cuucaggacgcacauuua

SEQ ID NO: 544320 - RNA, 20 nt, Chlamydophila pneumoniae J138
cuucaggauuacggaaaaua

SEQ ID NO: 544321 - RNA, 21 nt, Chlamydophila pneumoniae J138
cuucaggugaaggaagaucuu

SEQ ID NO: 544322 - RNA, 21 nt, Chlamydophila pneumoniae J138
cuucagcacgaauaaagcccu

SEQ ID NO: 544323 - RNA, 14 nt, Chlamydophila pneumoniae J138
cuucauuccaugag

SEQ ID NO: 544324 - RNA, 14 nt, Chlamydophila pneumoniae J138
cuucauuaucuucg

SEQ ID NO: 544325 - RNA, 14 nt, Chlamydophila pneumoniae J138
cuucauugcaaaaa

SEQ ID NO: 544326 - RNA, 17 nt, Chlamydophila pneumoniae J138
cuucaaugauuucuuua

SEQ ID NO: 544327 - RNA, 15 nt, Chlamydophila pneumoniae J138
cuucaaugauguguu

SEQ ID NO: 544328 - RNA, 18 nt, Chlamydophila pneumoniae J138
cuucaaugacuucuggau

SEQ ID NO: 544329 - RNA, 19 nt, Chlamydophila pneumoniae J138
cuucacucguugccaaucu

SEQ ID NO: 544330 - RNA, 18 nt, Chlamydophila pneumoniae J138
cuucaauccccugcaucu

SEQ ID NO: 544331 - RNA, 19 nt, Chlamydophila pneumoniae J138
cuucaagagcuuuuacaaa

SEQ ID NO: 544332 - RNA, 16 nt, Chlamydophila pneumoniae J138
cuucaagaaaaacccc

SEQ ID NO: 544333 - RNA, 19 nt, Chlamydophila pneumoniae J138
cgggaucguagcaggcauc

SEQ ID NO: 544334 - RNA, 15 nt, Chlamydophila pneumoniae J138
cgggaucuaaaagca

SEQ ID NO: 544335 - RNA, 15 nt, Chlamydophila pneumoniae J138
cgggagcucuuucuu

SEQ ID NO: 544336 - RNA, 21 nt, Chlamydophila pneumoniae J138
cgggaauaauaggauaagaaa

SEQ ID NO: 544337 - RNA, 13 nt, Chlamydophila pneumoniae J138
cggcuuuagaaaa

SEQ ID NO: 544338 - RNA, 12 nt, Chlamydophila pneumoniae J138
cggcuuuuccag

SEQ ID NO: 544339 - RNA, 23 nt, Chlamydophila pneumoniae J138
cggguucauuuccaaauucuugc

SEQ ID NO: 544340 - RNA, 21 nt, Chlamydophila pneumoniae J138
cgggucaggaggugguggagc

SEQ ID NO: 544341 - RNA, 16 nt, Chlamydophila pneumoniae J138
cgguaaccugugaaaa

SEQ ID NO: 544342 - RNA, 20 nt, Chlamydophila pneumoniae J138
cgguaaggaggaaucuugau

SEQ ID NO: 544343 - RNA, 16 nt, Chlamydophila pneumoniae J138
cgguaaugccagcagc

SEQ ID NO: 544344 - RNA, 15 nt, Chlamydophila pneumoniae J138
cggucacuucaauua

SEQ ID NO: 544345 - RNA, 21 nt, Chlamydophila pneumoniae J138
cggucacguucuuagaaagcg

SEQ ID NO: 544346 - RNA, 16 nt, Chlamydophila pneumoniae J138
aaacuaggaaaagcau

SEQ ID NO: 544347 - RNA, 23 nt, Chlamydophila pneumoniae J138
aaacuagagaucuuuuuauuaaa

SEQ ID NO: 544348 - RNA, 14 nt, Chlamydophila pneumoniae J138
aaacuacauucuaa

SEQ ID NO: 544349 - RNA, 15 nt, Chlamydophila pneumoniae J138
aaacuaagaauaccu

SEQ ID NO: 544350 - RNA, 16 nt, Chlamydophila pneumoniae J138
aaacuaguucuucuuu

SEQ ID NO: 544351 - RNA, 14 nt, Chlamydophila pneumoniae J138
cguaaagaaaagca

SEQ ID NO: 544352 - RNA, 18 nt, Chlamydophila pneumoniae J138
cguaacugaggcaaagau

SEQ ID NO: 544353 - RNA, 14 nt, Chlamydophila pneumoniae J138
cguaaccacaggau

SEQ ID NO: 544354 - RNA, 20 nt, Chlamydophila pneumoniae J138
cguaacaauucgauguuaag

SEQ ID NO: 544355 - RNA, 13 nt, Chlamydophila pneumoniae J138
cgguuucugggau

SEQ ID NO: 544356 - RNA, 21 nt, Chlamydophila pneumoniae J138
cgguuuaaacagaucuuuauc

SEQ ID NO: 544357 - RNA, 16 nt, Chlamydophila pneumoniae J138
cggugggccucuuccc

SEQ ID NO: 544358 - RNA, 18 nt, Chlamydophila pneumoniae J138
cguccaguucuucauucc

SEQ ID NO: 544359 - RNA, 17 nt, Chlamydophila pneumoniae J138
cguccaguucuucauuc

SEQ ID NO: 544360 - RNA, 14 nt, Chlamydophila pneumoniae J138
cgucauauuuaaaa

SEQ ID NO: 544361 - RNA, 19 nt, Chlamydophila pneumoniae J138
cguccagccugcaccagac

SEQ ID NO: 544362 - RNA, 12 nt, Chlamydophila pneumoniae J138
cgucccacaaaa

SEQ ID NO: 544363 - RNA, 14 nt, Chlamydophila pneumoniae J138
cguauagaauagaa

SEQ ID NO: 544364 - RNA, 17 nt, Chlamydophila pneumoniae J138
cguauacgucccacaaa

SEQ ID NO: 544365 - RNA, 21 nt, Chlamydophila pneumoniae J138
cguauacgucccacaaaauuu

SEQ ID NO: 544366 - RNA, 20 nt, Chlamydophila pneumoniae J138
cguauggauuucuccagcag

SEQ ID NO: 544367 - RNA, 16 nt, Chlamydophila pneumoniae J138
cgucaaagguuuuaaa

SEQ ID NO: 544368 - RNA, 17 nt, Chlamydophila pneumoniae J138
cguaauccuucuuucug

SEQ ID NO: 544369 - RNA, 17 nt, Chlamydophila pneumoniae J138
cguaagcugcaaucuca

SEQ ID NO: 544370 - RNA, 19 nt, Chlamydophila pneumoniae J138
cguaagcugcaaucucaaa

SEQ ID NO: 544371 - RNA, 15 nt, Chlamydophila pneumoniae J138
cgucaaauucauuaa

SEQ ID NO: 544372 - RNA, 19 nt, Chlamydophila pneumoniae J138
cgucaaauucauuaagaac

SEQ ID NO: 544373 - RNA, 17 nt, Chlamydophila pneumoniae J138
cgucacauuuguuguca

SEQ ID NO: 544374 - RNA, 22 nt, Chlamydophila pneumoniae J138
cgucaguaaaacacaaauagca

SEQ ID NO: 544375 - RNA, 16 nt, Chlamydophila pneumoniae J138
cgucaguaaaacacaa

SEQ ID NO: 544376 - RNA, 13 nt, Chlamydophila pneumoniae J138
cgugacgugguuu

SEQ ID NO: 544377 - RNA, 13 nt, Chlamydophila pneumoniae J138
cgugaacaaaaac

SEQ ID NO: 544378 - RNA, 14 nt, Chlamydophila pneumoniae J138
cgugaacaaaaacu

SEQ ID NO: 544379 - RNA, 15 nt, Chlamydophila pneumoniae J138
cgugaacaaaaacug

SEQ ID NO: 544380 - RNA, 12 nt, Chlamydophila pneumoniae J138
cgugaacaaaau

SEQ ID NO: 544381 - RNA, 21 nt, Chlamydophila pneumoniae J138
cgucugcgauaggaucuucua

SEQ ID NO: 544382 - RNA, 17 nt, Chlamydophila pneumoniae J138
cgucuuagaauccucua

SEQ ID NO: 544383 - RNA, 15 nt, Chlamydophila pneumoniae J138
cgugcaaguucacac

SEQ ID NO: 544384 - RNA, 13 nt, Chlamydophila pneumoniae J138
cguguaaaagcuu

SEQ ID NO: 544385 - RNA, 21 nt, Chlamydophila pneumoniae J138
cguguacagaccguccucccc

SEQ ID NO: 544386 - RNA, 19 nt, Chlamydophila pneumoniae J138
cguguggguaaugccaaua

SEQ ID NO: 544387 - RNA, 19 nt, Chlamydophila pneumoniae J138
cguggagugcucuacccca

SEQ ID NO: 544388 - RNA, 16 nt, Chlamydophila pneumoniae J138
cguggcuuuuguauua

SEQ ID NO: 544389 - RNA, 13 nt, Chlamydophila pneumoniae J138
cguuaauaaagag

SEQ ID NO: 544390 - RNA, 19 nt, Chlamydophila pneumoniae J138
cguuccagccugugagcuc

SEQ ID NO: 544391 - RNA, 17 nt, Chlamydophila pneumoniae J138
cguuggacugcaagagc

SEQ ID NO: 544392 - RNA, 18 nt, Chlamydophila pneumoniae J138
cguuuauaacaucaagaa

SEQ ID NO: 544393 - RNA, 16 nt, Chlamydophila pneumoniae J138
cuaaaucuauacccag

SEQ ID NO: 544394 - RNA, 14 nt, Chlamydophila pneumoniae J138
cuaaauuaaauauc

SEQ ID NO: 544395 - RNA, 14 nt, Chlamydophila pneumoniae J138
cuaaauuaguaaau

SEQ ID NO: 544396 - RNA, 18 nt, Chlamydophila pneumoniae J138
cuaaauuaguaaaugccu

SEQ ID NO: 544397 - RNA, 14 nt, Chlamydophila pneumoniae J138
cuaaagcuuuugcu

SEQ ID NO: 544398 - RNA, 13 nt, Chlamydophila pneumoniae J138
cuaaaggaacugu

SEQ ID NO: 544399 - RNA, 19 nt, Chlamydophila pneumoniae J138
cuaaaggaacugugccaua

SEQ ID NO: 544400 - RNA, 19 nt, Chlamydophila pneumoniae J138
cuaaaguagaauccuucuc

SEQ ID NO: 544401 - RNA, 13 nt, Chlamydophila pneumoniae J138
cuaaagugucaua

SEQ ID NO: 544402 - RNA, 23 nt, Chlamydophila pneumoniae J138
cuaaaucaacuacaucuccaagc

SEQ ID NO: 544403 - RNA, 18 nt, Chlamydophila pneumoniae J138
cuaaauagagcggaacua

SEQ ID NO: 544404 - RNA, 16 nt, Chlamydophila pneumoniae J138
cuaaauagaaaacaua

SEQ ID NO: 544405 - RNA, 13 nt, Chlamydophila pneumoniae J138
cuaaaaacucuuc

SEQ ID NO: 544406 - RNA, 19 nt, Chlamydophila pneumoniae J138
cuaaaaaugcacuuugaau

SEQ ID NO: 544407 - RNA, 23 nt, Chlamydophila pneumoniae J138
cuaaaauaugcucgugcgacugc

SEQ ID NO: 544408 - RNA, 12 nt, Chlamydophila pneumoniae J138
cuaaacucucuu

SEQ ID NO: 544409 - RNA, 16 nt, Chlamydophila pneumoniae J138
cuaaacucucuuccuu

SEQ ID NO: 544410 - RNA, 12 nt, Chlamydophila pneumoniae J138
cuaaacucucca

SEQ ID NO: 544411 - RNA, 21 nt, Chlamydophila pneumoniae J138
cuaaacugggaagaccacgaa

SEQ ID NO: 544412 - RNA, 23 nt, Chlamydophila pneumoniae J138
cuaaagacgaagggaguuucccg

SEQ ID NO: 544413 - RNA, 20 nt, Chlamydophila pneumoniae J138
cuaaagaauuuguaacucuu

SEQ ID NO: 544414 - RNA, 22 nt, Chlamydophila pneumoniae J138
cuaaacuuuuuuucaaaucauc

SEQ ID NO: 544415 - RNA, 19 nt, Chlamydophila pneumoniae J138
cuaaagaauuuguaacucu

SEQ ID NO: 544416 - RNA, 21 nt, Chlamydophila pneumoniae J138
cuaaagauacuuaucuuuaaa

SEQ ID NO: 544417 - RNA, 11 nt, Chlamydophila pneumoniae J138
cuaaagagaug

SEQ ID NO: 544418 - RNA, 15 nt, Chlamydophila pneumoniae J138
cuaaagcagaauccc

SEQ ID NO: 544419 - RNA, 19 nt, Chlamydophila pneumoniae J138
cuaaagauacuuaucuuua

SEQ ID NO: 544420 - RNA, 16 nt, Chlamydophila pneumoniae J138
cuacgagcgcuuucuu

SEQ ID NO: 544421 - RNA, 21 nt, Chlamydophila pneumoniae J138
cuacgacuacaucuuguucug

SEQ ID NO: 544422 - RNA, 16 nt, Chlamydophila pneumoniae J138
cuacgacuacaucuug

SEQ ID NO: 544423 - RNA, 15 nt, Chlamydophila pneumoniae J138
cuacgaauccaaaaa

SEQ ID NO: 544424 - RNA, 17 nt, Chlamydophila pneumoniae J138
cuaaauuugucaucaca

SEQ ID NO: 544425 - RNA, 18 nt, Chlamydophila pneumoniae J138
cuacuuaaauccuaagca

SEQ ID NO: 544426 - RNA, 17 nt, Chlamydophila pneumoniae J138
cuacuguccauccaaau

SEQ ID NO: 544427 - RNA, 22 nt, Chlamydophila pneumoniae J138
cuacucuacaguaguaaauaau

SEQ ID NO: 544428 - RNA, 20 nt, Chlamydophila pneumoniae J138
cuagcagaaguccuaucaaa

SEQ ID NO: 544429 - RNA, 14 nt, Chlamydophila pneumoniae J138
cuagcuccagcauc

SEQ ID NO: 544430 - RNA, 15 nt, Chlamydophila pneumoniae J138
cuagcaccuaauaaa

SEQ ID NO: 544431 - RNA, 20 nt, Chlamydophila pneumoniae J138
cuagcaaaucuaaaaccuga

SEQ ID NO: 544432 - RNA, 21 nt, Chlamydophila pneumoniae J138
cuaggccgggauuuuaauuca

SEQ ID NO: 544433 - RNA, 22 nt, Chlamydophila pneumoniae J138
cuaggccuaaagaauuuguaac

SEQ ID NO: 544434 - RNA, 19 nt, Chlamydophila pneumoniae J138
cuaggcaugguaggagccg

SEQ ID NO: 544435 - RNA, 21 nt, Chlamydophila pneumoniae J138
cuaggcgcauaugcuccagaa

SEQ ID NO: 544436 - RNA, 20 nt, Chlamydophila pneumoniae J138
cuacuuuaaaguggcaaucu

SEQ ID NO: 544437 - RNA, 21 nt, Chlamydophila pneumoniae J138
cuacuugucugauuaguucuc

SEQ ID NO: 544438 - RNA, 21 nt, Chlamydophila pneumoniae J138
cuagagcuuucagaaaagaaa

SEQ ID NO: 544439 - RNA, 21 nt, Chlamydophila pneumoniae J138
cuagaguugcuuuauggcuca

SEQ ID NO: 544440 - RNA, 18 nt, Chlamydophila pneumoniae J138
cuagaguacccccgggcg

SEQ ID NO: 544441 - RNA, 19 nt, Chlamydophila pneumoniae J138
cuagagucacuagcagaag

SEQ ID NO: 544442 - RNA, 17 nt, Chlamydophila pneumoniae J138
cuagaggaucuucaagg

SEQ ID NO: 544443 - RNA, 17 nt, Chlamydophila pneumoniae J138
cuagaucacaagaaaga

SEQ ID NO: 544444 - RNA, 16 nt, Chlamydophila pneumoniae J138
cuagaucaaaacuccg

SEQ ID NO: 544445 - RNA, 12 nt, Chlamydophila pneumoniae J138
cuagaucuucaa

SEQ ID NO: 544446 - RNA, 15 nt, Chlamydophila pneumoniae J138
cuauccuguuucaac

SEQ ID NO: 544447 - RNA, 13 nt, Chlamydophila pneumoniae J138
cuauccaucaucg

SEQ ID NO: 544448 - RNA, 16 nt, Chlamydophila pneumoniae J138
cuaucauaucuucaaa

SEQ ID NO: 544449 - RNA, 22 nt, Chlamydophila pneumoniae J138
cuaucagagcgaucgcaaucag

SEQ ID NO: 544450 - RNA, 17 nt, Chlamydophila pneumoniae J138
cuaugauccgaaaacuc

SEQ ID NO: 544451 - RNA, 18 nt, Chlamydophila pneumoniae J138
cuaucgguuuaaacagau

SEQ ID NO: 544452 - RNA, 17 nt, Chlamydophila pneumoniae J138
cuaugcacaaaauaaaa

SEQ ID NO: 544453 - RNA, 23 nt, Chlamydophila pneumoniae J138
cuaugaugagaacguccucaccu

SEQ ID NO: 544454 - RNA, 15 nt, Chlamydophila pneumoniae J138
cuauguguucucgaa

SEQ ID NO: 544455 - RNA, 13 nt, Chlamydophila pneumoniae J138
cuauguguucucg

SEQ ID NO: 544456 - RNA, 15 nt, Chlamydophila pneumoniae J138
cuaugucuguuccca

SEQ ID NO: 544457 - RNA, 23 nt, Chlamydophila pneumoniae J138
cuaugugaugucgcgaaaguaaa

SEQ ID NO: 544458 - RNA, 20 nt, Chlamydophila pneumoniae J138
cuauggucucccucacaaga

SEQ ID NO: 544459 - RNA, 21 nt, Chlamydophila pneumoniae J138
cuauggucucccucacaagaa

SEQ ID NO: 544460 - RNA, 15 nt, Chlamydophila pneumoniae J138
cuauggugcaugccu

SEQ ID NO: 544461 - RNA, 12 nt, Chlamydophila pneumoniae J138
cuauaguagaag

SEQ ID NO: 544462 - RNA, 21 nt, Chlamydophila pneumoniae J138
cuauagucuguuuuggaaaga

SEQ ID NO: 544463 - RNA, 22 nt, Chlamydophila pneumoniae J138
cuauagucuguuuuggaaagaa

SEQ ID NO: 544464 - RNA, 18 nt, Chlamydophila pneumoniae J138
cuauacguaauccagauu

SEQ ID NO: 544465 - RNA, 19 nt, Chlamydophila pneumoniae J138
cuagggacuucucaaagac

SEQ ID NO: 544466 - RNA, 14 nt, Chlamydophila pneumoniae J138
cuagguucuuuucg

SEQ ID NO: 544467 - RNA, 14 nt, Chlamydophila pneumoniae J138
cuagguucuuuuuu

SEQ ID NO: 544468 - RNA, 11 nt, Chlamydophila pneumoniae J138
cuagguucucc

SEQ ID NO: 544469 - RNA, 20 nt, Chlamydophila pneumoniae J138
cuaguaagaaacccgcaacu

SEQ ID NO: 544470 - RNA, 23 nt, Chlamydophila pneumoniae J138
cuauagucuguuuuggaaagaag

SEQ ID NO: 544471 - RNA, 16 nt, Chlamydophila pneumoniae J138
cuauaucauuaagaag

SEQ ID NO: 544472 - RNA, 13 nt, Chlamydophila pneumoniae J138
cuauauuuuuucc

SEQ ID NO: 544473 - RNA, 14 nt, Chlamydophila pneumoniae J138
cuauauuuuuuccc

SEQ ID NO: 544474 - RNA, 19 nt, Chlamydophila pneumoniae J138
cuauaugaaugauuuccau

SEQ ID NO: 544475 - RNA, 20 nt, Chlamydophila pneumoniae J138
cuauaugaaugauuuccaua

SEQ ID NO: 544476 - RNA, 12 nt, Chlamydophila pneumoniae J138
cucacugagugu

SEQ ID NO: 544477 - RNA, 14 nt, Chlamydophila pneumoniae J138
cucacucuuuucua

SEQ ID NO: 544478 - RNA, 13 nt, Chlamydophila pneumoniae J138
cucacucuuuucu

SEQ ID NO: 544479 - RNA, 16 nt, Chlamydophila pneumoniae J138
cucacucuaugagaac

SEQ ID NO: 544480 - RNA, 13 nt, Chlamydophila pneumoniae J138
cucacaucuccuu

SEQ ID NO: 544481 - RNA, 20 nt, Chlamydophila pneumoniae J138
cucacacgaauaauuaaauc

SEQ ID NO: 544482 - RNA, 24 nt, Chlamydophila pneumoniae J138
cucacaucuccuuucaagagcagu

SEQ ID NO: 544483 - RNA, 15 nt, Chlamydophila pneumoniae J138
cucacaucuccuuuc

SEQ ID NO: 544484 - RNA, 17 nt, Chlamydophila pneumoniae J138
cucacauguuucacuua

SEQ ID NO: 544485 - RNA, 20 nt, Chlamydophila pneumoniae J138
cucaagucuauuugaaaaga

SEQ ID NO: 544486 - RNA, 17 nt, Chlamydophila pneumoniae J138
cucaaggucacagcauu

SEQ ID NO: 544487 - RNA, 22 nt, Chlamydophila pneumoniae J138
cucaaggucacagcauuuucuc

SEQ ID NO: 544488 - RNA, 15 nt, Chlamydophila pneumoniae J138
cucaaggucacagca

SEQ ID NO: 544489 - RNA, 20 nt, Chlamydophila pneumoniae J138
cucaaggcaucuagagucuc

SEQ ID NO: 544490 - RNA, 23 nt, Chlamydophila pneumoniae J138
cucaagauaaaucccacuaucug

SEQ ID NO: 544491 - RNA, 20 nt, Chlamydophila pneumoniae J138
cucaagaauaugaacugccu

SEQ ID NO: 544492 - RNA, 19 nt, Chlamydophila pneumoniae J138
cucaagaagaugauuggac

SEQ ID NO: 544493 - RNA, 13 nt, Chlamydophila pneumoniae J138
cuauuaagucacc

SEQ ID NO: 544494 - RNA, 19 nt, Chlamydophila pneumoniae J138
cucaaaucucauuccagca

SEQ ID NO: 544495 - RNA, 15 nt, Chlamydophila pneumoniae J138
cucagagaaaaucaa

SEQ ID NO: 544496 - RNA, 17 nt, Chlamydophila pneumoniae J138
cucagaauccauuuugc

SEQ ID NO: 544497 - RNA, 16 nt, Chlamydophila pneumoniae J138
cucaguaggagcagcg

SEQ ID NO: 544498 - RNA, 15 nt, Chlamydophila pneumoniae J138
cucagucacaauaua

SEQ ID NO: 544499 - RNA, 19 nt, Chlamydophila pneumoniae J138
cucagugaacucuucaaga

SEQ ID NO: 544500 - RNA, 22 nt, Chlamydophila pneumoniae J138
cucaucagaaguggccuugcca

SEQ ID NO: 544501 - RNA, 22 nt, Chlamydophila pneumoniae J138
cucaucauaaauaggcucuaca

SEQ ID NO: 544502 - RNA, 20 nt, Chlamydophila pneumoniae J138
cucaucagcaaaacucccga

SEQ ID NO: 544503 - RNA, 14 nt, Chlamydophila pneumoniae J138
cucaucagcaaccu

SEQ ID NO: 544504 - RNA, 18 nt, Chlamydophila pneumoniae J138
cucaucacguaagguguc

SEQ ID NO: 544505 - RNA, 20 nt, Chlamydophila pneumoniae J138
cucaucauccucaggaccua

SEQ ID NO: 544506 - RNA, 13 nt, Chlamydophila pneumoniae J138
cucaucauccuca

SEQ ID NO: 544507 - RNA, 14 nt, Chlamydophila pneumoniae J138
cucauagcuuccug

SEQ ID NO: 544508 - RNA, 18 nt, Chlamydophila pneumoniae J138
cucauagcuuccuguagu

SEQ ID NO: 544509 - RNA, 21 nt, Chlamydophila pneumoniae J138
cucauauuuugucuucaucau

SEQ ID NO: 544510 - RNA, 20 nt, Chlamydophila pneumoniae J138
cucaucacaauuuuaaaauc

SEQ ID NO: 544511 - RNA, 18 nt, Chlamydophila pneumoniae J138
cucaucacaauuuuaaaa

SEQ ID NO: 544512 - RNA, 20 nt, Chlamydophila pneumoniae J138
cucaucggaucuuuucuuuc

SEQ ID NO: 544513 - RNA, 18 nt, Chlamydophila pneumoniae J138
cucaucggaucuuuucuu

SEQ ID NO: 544514 - RNA, 16 nt, Chlamydophila pneumoniae J138
cucauccuaaauuaaa

SEQ ID NO: 544515 - RNA, 20 nt, Chlamydophila pneumoniae J138
cucauccuaaauuaaauauc

SEQ ID NO: 544516 - RNA, 22 nt, Chlamydophila pneumoniae J138
cucaucucgcaguccaaagacu

SEQ ID NO: 544517 - RNA, 20 nt, Chlamydophila pneumoniae J138
cucaugcggacuuuauucuc

SEQ ID NO: 544518 - RNA, 20 nt, Chlamydophila pneumoniae J138
cucauggauuacugaagauc

SEQ ID NO: 544519 - RNA, 16 nt, Chlamydophila pneumoniae J138
cuccauccucagucuc

SEQ ID NO: 544520 - RNA, 18 nt, Chlamydophila pneumoniae J138
cucccaaauuggagguca

SEQ ID NO: 544521 - RNA, 20 nt, Chlamydophila pneumoniae J138
cucccaacaagggaaagaaa

SEQ ID NO: 544522 - RNA, 16 nt, Chlamydophila pneumoniae J138
cucccaccaaggggcg

SEQ ID NO: 544523 - RNA, 16 nt, Chlamydophila pneumoniae J138
cucccaagacgagaac

SEQ ID NO: 544524 - RNA, 17 nt, Chlamydophila pneumoniae J138
cucccaauauccagaaa

SEQ ID NO: 544525 - RNA, 21 nt, Chlamydophila pneumoniae J138
cucccuggucuguauuuucuu

SEQ ID NO: 544526 - RNA, 16 nt, Chlamydophila pneumoniae J138
cuccgccuacaauacu

SEQ ID NO: 544527 - RNA, 16 nt, Chlamydophila pneumoniae J138
cuccuccuucugcaau

SEQ ID NO: 544528 - RNA, 17 nt, Chlamydophila pneumoniae J138
cuccucucucaauaaga

SEQ ID NO: 544529 - RNA, 23 nt, Chlamydophila pneumoniae J138
cuccucguuaauaagaaccucua

SEQ ID NO: 544530 - RNA, 19 nt, Chlamydophila pneumoniae J138
cuccucgucuaaagaagau

SEQ ID NO: 544531 - RNA, 15 nt, Chlamydophila pneumoniae J138
cuccucgucuaaaga

SEQ ID NO: 544532 - RNA, 22 nt, Chlamydophila pneumoniae J138
cuccuggaagaauuucauaaga

SEQ ID NO: 544533 - RNA, 18 nt, Chlamydophila pneumoniae J138
cuccugacucuuauugca

SEQ ID NO: 544534 - RNA, 23 nt, Chlamydophila pneumoniae J138
cuccugacucuuuuaagacaaua

SEQ ID NO: 544535 - RNA, 21 nt, Chlamydophila pneumoniae J138
cuccugaagcugagaauacaa

SEQ ID NO: 544536 - RNA, 16 nt, Chlamydophila pneumoniae J138
cuccugcaaaaaacca

SEQ ID NO: 544537 - RNA, 14 nt, Chlamydophila pneumoniae J138
cuccuuucaagagc

SEQ ID NO: 544538 - RNA, 13 nt, Chlamydophila pneumoniae J138
cuccuuuaaauaa

SEQ ID NO: 544539 - RNA, 19 nt, Chlamydophila pneumoniae J138
cucgaaacucuuugaggau

SEQ ID NO: 544540 - RNA, 19 nt, Chlamydophila pneumoniae J138
cuccuucaauacgcuagcu

SEQ ID NO: 544541 - RNA, 20 nt, Chlamydophila pneumoniae J138
cuccuugacuaaauccacca

SEQ ID NO: 544542 - RNA, 22 nt, Chlamydophila pneumoniae J138
cucgagauuuuuuauuuuuacu

SEQ ID NO: 544543 - RNA, 21 nt, Chlamydophila pneumoniae J138
cucgagcagaaacuccaaaau

SEQ ID NO: 544544 - RNA, 21 nt, Chlamydophila pneumoniae J138
cucgauacuguugauccuucu

SEQ ID NO: 544545 - RNA, 22 nt, Chlamydophila pneumoniae J138
cucgcuaaaguagaauccuucu

SEQ ID NO: 544546 - RNA, 16 nt, Chlamydophila pneumoniae J138
cucgcuauuccauaaa

SEQ ID NO: 544547 - RNA, 14 nt, Chlamydophila pneumoniae J138
cucggacagaaaga

SEQ ID NO: 544548 - RNA, 22 nt, Chlamydophila pneumoniae J138
cucggauggacuacugaaacac

SEQ ID NO: 544549 - RNA, 20 nt, Chlamydophila pneumoniae J138
cucggaguguuggugagacc

SEQ ID NO: 544550 - RNA, 20 nt, Chlamydophila pneumoniae J138
cucguagcuauuuuugagga

SEQ ID NO: 544551 - RNA, 19 nt, Chlamydophila pneumoniae J138
cucuagggauaauuaaacu

SEQ ID NO: 544552 - RNA, 21 nt, Chlamydophila pneumoniae J138
cucuagccaccaacaguccug

SEQ ID NO: 544553 - RNA, 17 nt, Chlamydophila pneumoniae J138
cucuagcucaaaucuca

SEQ ID NO: 544554 - RNA, 21 nt, Chlamydophila pneumoniae J138
cucuaugguuuucauugcagu

SEQ ID NO: 544555 - RNA, 12 nt, Chlamydophila pneumoniae J138
cucuaugagaac

SEQ ID NO: 544556 - RNA, 12 nt, Chlamydophila pneumoniae J138
cucuauauuuuu

SEQ ID NO: 544557 - RNA, 23 nt, Chlamydophila pneumoniae J138
cucuauagugcauaccuuaccau

SEQ ID NO: 544558 - RNA, 19 nt, Chlamydophila pneumoniae J138
cucuauauauccugaguga

SEQ ID NO: 544559 - RNA, 23 nt, Chlamydophila pneumoniae J138
cucuaucagggcuacgguaaaau

SEQ ID NO: 544560 - RNA, 13 nt, Chlamydophila pneumoniae J138
cucucaauaagau

SEQ ID NO: 544561 - RNA, 22 nt, Chlamydophila pneumoniae J138
cucucaucaaagcaaagagcaa

SEQ ID NO: 544562 - RNA, 13 nt, Chlamydophila pneumoniae J138
cucuccauggcuu

SEQ ID NO: 544563 - RNA, 11 nt, Chlamydophila pneumoniae J138
cucuccaaaag

SEQ ID NO: 544564 - RNA, 13 nt, Chlamydophila pneumoniae J138
cucuccaaaagcu

SEQ ID NO: 544565 - RNA, 13 nt, Chlamydophila pneumoniae J138
cucuccacagggu

SEQ ID NO: 544566 - RNA, 15 nt, Chlamydophila pneumoniae J138
cucuccacagggucu

SEQ ID NO: 544567 - RNA, 15 nt, Chlamydophila pneumoniae J138
cucuccugcaaaaag

SEQ ID NO: 544568 - RNA, 16 nt, Chlamydophila pneumoniae J138
cucuccugcaaaaagu

SEQ ID NO: 544569 - RNA, 14 nt, Chlamydophila pneumoniae J138
cucuccuccccacu

SEQ ID NO: 544570 - RNA, 14 nt, Chlamydophila pneumoniae J138
cucuccuaaaccau

SEQ ID NO: 544571 - RNA, 16 nt, Chlamydophila pneumoniae J138
cucuccuaaaccauca

SEQ ID NO: 544572 - RNA, 21 nt, Chlamydophila pneumoniae J138
cucuccguccaguucuucauu

SEQ ID NO: 544573 - RNA, 16 nt, Chlamydophila pneumoniae J138
cucucugccuaccaaa

SEQ ID NO: 544574 - RNA, 13 nt, Chlamydophila pneumoniae J138
cucucgcuaagca

SEQ ID NO: 544575 - RNA, 15 nt, Chlamydophila pneumoniae J138
cucucuugcuauacc

SEQ ID NO: 544576 - RNA, 21 nt, Chlamydophila pneumoniae J138
cucucuguagcacuucucagc

SEQ ID NO: 544577 - RNA, 21 nt, Chlamydophila pneumoniae J138
cucucuuuaaaccuggcauug

SEQ ID NO: 544578 - RNA, 18 nt, Chlamydophila pneumoniae J138
cucucuuuauauuuuuug

SEQ ID NO: 544579 - RNA, 23 nt, Chlamydophila pneumoniae J138
cucucuuuaaaaauauaucuuca

SEQ ID NO: 544580 - RNA, 17 nt, Chlamydophila pneumoniae J138
cucucuuuaaaaauaua

SEQ ID NO: 544581 - RNA, 15 nt, Chlamydophila pneumoniae J138
cucucuuuaucuuua

SEQ ID NO: 544582 - RNA, 12 nt, Chlamydophila pneumoniae J138
cucugaaggauu

SEQ ID NO: 544583 - RNA, 13 nt, Chlamydophila pneumoniae J138
cucugaacaggaa

SEQ ID NO: 544584 - RNA, 23 nt, Chlamydophila pneumoniae J138
cucugccuaccaaaguuuguagc

SEQ ID NO: 544585 - RNA, 16 nt, Chlamydophila pneumoniae J138
cucugcauauugcucu

SEQ ID NO: 544586 - RNA, 20 nt, Chlamydophila pneumoniae J138
cucugacacuccucagaauc

SEQ ID NO: 544587 - RNA, 20 nt, Chlamydophila pneumoniae J138
cucuucauugcaaaaaugaa

SEQ ID NO: 544588 - RNA, 22 nt, Chlamydophila pneumoniae J138
cucuucacuauuaggcuuuuuu

SEQ ID NO: 544589 - RNA, 21 nt, Chlamydophila pneumoniae J138
cucuucaauuucuucaucaau

SEQ ID NO: 544590 - RNA, 14 nt, Chlamydophila pneumoniae J138
cucuucaagagcuu

SEQ ID NO: 544591 - RNA, 14 nt, Chlamydophila pneumoniae J138
cucuguuuccuugu

SEQ ID NO: 544592 - RNA, 23 nt, Chlamydophila pneumoniae J138
cucuuaaaugugaaaucguaucu

SEQ ID NO: 544593 - RNA, 14 nt, Chlamydophila pneumoniae J138
cucuuaagaauaaa

SEQ ID NO: 544594 - RNA, 17 nt, Chlamydophila pneumoniae J138
cucuucaaagacaggcu

SEQ ID NO: 544595 - RNA, 21 nt, Chlamydophila pneumoniae J138
cucuuaucuggagaugcgcuc

SEQ ID NO: 544596 - RNA, 20 nt, Chlamydophila pneumoniae J138
cucuguguuuugaggaacuu

SEQ ID NO: 544597 - RNA, 17 nt, Chlamydophila pneumoniae J138
cucugugguuccuggau

SEQ ID NO: 544598 - RNA, 23 nt, Chlamydophila pneumoniae J138
cucugugguuuuuauucuuaaug

SEQ ID NO: 544599 - RNA, 16 nt, Chlamydophila pneumoniae J138
cucugugguuccugga

SEQ ID NO: 544600 - RNA, 11 nt, Chlamydophila pneumoniae J138
cucuguaguaa

SEQ ID NO: 544601 - RNA, 20 nt, Chlamydophila pneumoniae J138
cucugguauagaaacaccgu

SEQ ID NO: 544602 - RNA, 15 nt, Chlamydophila pneumoniae J138
cucugggaauuguuc

SEQ ID NO: 544603 - RNA, 21 nt, Chlamydophila pneumoniae J138
cucugggaagacucucaucag

SEQ ID NO: 544604 - RNA, 13 nt, Chlamydophila pneumoniae J138
cucuuccuucucc

SEQ ID NO: 544605 - RNA, 14 nt, Chlamydophila pneumoniae J138
cucuuccugcugcu

SEQ ID NO: 544606 - RNA, 14 nt, Chlamydophila pneumoniae J138
cucuucauuuucuu

SEQ ID NO: 544607 - RNA, 15 nt, Chlamydophila pneumoniae J138
cucuucauuuucuuu

SEQ ID NO: 544608 - RNA, 15 nt, Chlamydophila pneumoniae J138
cucuucuacuuuaag

SEQ ID NO: 544609 - RNA, 22 nt, Chlamydophila pneumoniae J138
cucuugcgucacauuuguuguc

SEQ ID NO: 544610 - RNA, 16 nt, Chlamydophila pneumoniae J138
cucuugcucuagucuu

SEQ ID NO: 544611 - RNA, 13 nt, Chlamydophila pneumoniae J138
cucuuuaaaaaau

SEQ ID NO: 544612 - RNA, 18 nt, Chlamydophila pneumoniae J138
cucuuuaaaaauagaaau

SEQ ID NO: 544613 - RNA, 14 nt, Chlamydophila pneumoniae J138
cucuuuaagaacuu

SEQ ID NO: 544614 - RNA, 21 nt, Chlamydophila pneumoniae J138
cucuuuaaaaauuaaagugaa

SEQ ID NO: 544615 - RNA, 18 nt, Chlamydophila pneumoniae J138
cucuuuaaauguugggau

SEQ ID NO: 544616 - RNA, 22 nt, Chlamydophila pneumoniae J138
cucuuuaauccaguuuuuuaaa

SEQ ID NO: 544617 - RNA, 20 nt, Chlamydophila pneumoniae J138
cugaaagaacacuccugacu

SEQ ID NO: 544618 - RNA, 20 nt, Chlamydophila pneumoniae J138
cucuuucauacuaaaaucuu

SEQ ID NO: 544619 - RNA, 19 nt, Chlamydophila pneumoniae J138
cucuuuagcaaacauuuuu

SEQ ID NO: 544620 - RNA, 21 nt, Chlamydophila pneumoniae J138
cucuuuagcaaacauuuuuau

SEQ ID NO: 544621 - RNA, 15 nt, Chlamydophila pneumoniae J138
cucuuuuaaagugag

SEQ ID NO: 544622 - RNA, 23 nt, Chlamydophila pneumoniae J138
cucuuugacaucuaauuuuaaau

SEQ ID NO: 544623 - RNA, 13 nt, Chlamydophila pneumoniae J138
cugaaauuaaguc

SEQ ID NO: 544624 - RNA, 15 nt, Chlamydophila pneumoniae J138
cugaaaucaaaaaaa

SEQ ID NO: 544625 - RNA, 16 nt, Chlamydophila pneumoniae J138
cugaaaucaaaaaaaa

SEQ ID NO: 544626 - RNA, 15 nt, Chlamydophila pneumoniae J138
cugaaaguacgcaua

SEQ ID NO: 544627 - RNA, 16 nt, Chlamydophila pneumoniae J138
cugaacaucuccagca

SEQ ID NO: 544628 - RNA, 20 nt, Chlamydophila pneumoniae J138
cugaaccaaaucuaucugca

SEQ ID NO: 544629 - RNA, 20 nt, Chlamydophila pneumoniae J138
cugaagauauauuuuuaaag

SEQ ID NO: 544630 - RNA, 15 nt, Chlamydophila pneumoniae J138
cugaagaggccugca

SEQ ID NO: 544631 - RNA, 15 nt, Chlamydophila pneumoniae J138
cugaagaccccucuu

SEQ ID NO: 544632 - RNA, 16 nt, Chlamydophila pneumoniae J138
cugaacuugauuuguu

SEQ ID NO: 544633 - RNA, 20 nt, Chlamydophila pneumoniae J138
cugaagaucccugagccugu

SEQ ID NO: 544634 - RNA, 10 nt, Chlamydophila pneumoniae J138
cugaagauuu

SEQ ID NO: 544635 - RNA, 13 nt, Chlamydophila pneumoniae J138
cugaagauuuuuu

SEQ ID NO: 544636 - RNA, 24 nt, Chlamydophila pneumoniae J138
cugaagcagcuucugcaggauuug

SEQ ID NO: 544637 - RNA, 20 nt, Chlamydophila pneumoniae J138
cugaccaucaaugagaucug

SEQ ID NO: 544638 - RNA, 15 nt, Chlamydophila pneumoniae J138
cugaagcugcaaacu

SEQ ID NO: 544639 - RNA, 17 nt, Chlamydophila pneumoniae J138
cugaagcugcaaacuga

SEQ ID NO: 544640 - RNA, 11 nt, Chlamydophila pneumoniae J138
cugaagcugca

SEQ ID NO: 544641 - RNA, 15 nt, Chlamydophila pneumoniae J138
cugacacuccucaga

SEQ ID NO: 544642 - RNA, 15 nt, Chlamydophila pneumoniae J138
cugacuauaaaaugc

SEQ ID NO: 544643 - RNA, 14 nt, Chlamydophila pneumoniae J138
cugacugcauagac

SEQ ID NO: 544644 - RNA, 13 nt, Chlamydophila pneumoniae J138
cugagcagcuucg

SEQ ID NO: 544645 - RNA, 16 nt, Chlamydophila pneumoniae J138
cugagcaacuucuucg

SEQ ID NO: 544646 - RNA, 23 nt, Chlamydophila pneumoniae J138
cugagcaacuucuucguuagaga

SEQ ID NO: 544647 - RNA, 17 nt, Chlamydophila pneumoniae J138
cugagcacgaguucucc

SEQ ID NO: 544648 - RNA, 17 nt, Chlamydophila pneumoniae J138
cugagaauacaacccuu

SEQ ID NO: 544649 - RNA, 18 nt, Chlamydophila pneumoniae J138
cugagaauacaacccuuu

SEQ ID NO: 544650 - RNA, 17 nt, Chlamydophila pneumoniae J138
cugagaccauacacaaa

SEQ ID NO: 544651 - RNA, 16 nt, Chlamydophila pneumoniae J138
cugagaccauaaaauc

SEQ ID NO: 544652 - RNA, 23 nt, Chlamydophila pneumoniae J138
cugagacauauugaagauauuau

SEQ ID NO: 544653 - RNA, 18 nt, Chlamydophila pneumoniae J138
cugagaccauaaaaucaa

SEQ ID NO: 544654 - RNA, 23 nt, Chlamydophila pneumoniae J138
cugagaguguuguuggagcagaa

SEQ ID NO: 544655 - RNA, 20 nt, Chlamydophila pneumoniae J138
cugauaaucagaggagccuc

SEQ ID NO: 544656 - RNA, 16 nt, Chlamydophila pneumoniae J138
cugagugauguuugac

SEQ ID NO: 544657 - RNA, 14 nt, Chlamydophila pneumoniae J138
cugauccagcucca

SEQ ID NO: 544658 - RNA, 17 nt, Chlamydophila pneumoniae J138
cugauccagcuccauaa

SEQ ID NO: 544659 - RNA, 23 nt, Chlamydophila pneumoniae J138
cugauucuccgucccccggcucu

SEQ ID NO: 544660 - RNA, 22 nt, Chlamydophila pneumoniae J138
cugaugccaagaaauauacugc

SEQ ID NO: 544661 - RNA, 16 nt, Chlamydophila pneumoniae J138
cugaugccuuuuucuu

SEQ ID NO: 544662 - RNA, 23 nt, Chlamydophila pneumoniae J138
cugcaaacgcaaugauuucucua

SEQ ID NO: 544663 - RNA, 22 nt, Chlamydophila pneumoniae J138
cugcaaacuccccaguuuucca

SEQ ID NO: 544664 - RNA, 17 nt, Chlamydophila pneumoniae J138
cugcgcuagcuccagca

SEQ ID NO: 544665 - RNA, 16 nt, Chlamydophila pneumoniae J138
cugcgcuagcuccagc

SEQ ID NO: 544666 - RNA, 13 nt, Chlamydophila pneumoniae J138
cugcgucaauaag

SEQ ID NO: 544667 - RNA, 20 nt, Chlamydophila pneumoniae J138
cugcguuaaacccuucaagc

SEQ ID NO: 544668 - RNA, 15 nt, Chlamydophila pneumoniae J138
cugcguuucuuucug

SEQ ID NO: 544669 - RNA, 15 nt, Chlamydophila pneumoniae J138
cugcuaaacagggaa

SEQ ID NO: 544670 - RNA, 19 nt, Chlamydophila pneumoniae J138
cugcuauacaaccacuucc

SEQ ID NO: 544671 - RNA, 22 nt, Chlamydophila pneumoniae J138
cugcucuauauauccugaguga

SEQ ID NO: 544672 - RNA, 21 nt, Chlamydophila pneumoniae J138
cugcucuauauauccugagug

SEQ ID NO: 544673 - RNA, 15 nt, Chlamydophila pneumoniae J138
cugcuccugaagcug

SEQ ID NO: 544674 - RNA, 13 nt, Chlamydophila pneumoniae J138
cugcuccugaagc

SEQ ID NO: 544675 - RNA, 17 nt, Chlamydophila pneumoniae J138
cugcucccuccuccucg

SEQ ID NO: 544676 - RNA, 16 nt, Chlamydophila pneumoniae J138
aaacucaaucucuuug

SEQ ID NO: 544677 - RNA, 13 nt, Chlamydophila pneumoniae J138
cugcugaaaucau

SEQ ID NO: 544678 - RNA, 22 nt, Chlamydophila pneumoniae J138
cuggaaaugaauauaauuccaa

SEQ ID NO: 544679 - RNA, 13 nt, Chlamydophila pneumoniae J138
cuggaauuuccca

SEQ ID NO: 544680 - RNA, 21 nt, Chlamydophila pneumoniae J138
cugcuuuuguuguuuuugcug

SEQ ID NO: 544681 - RNA, 22 nt, Chlamydophila pneumoniae J138
cuggaaagccaagcuuccaacu

SEQ ID NO: 544682 - RNA, 19 nt, Chlamydophila pneumoniae J138
cugcuuuuuugaucugaag

SEQ ID NO: 544683 - RNA, 15 nt, Chlamydophila pneumoniae J138
cugcuuuuuuucuag

SEQ ID NO: 544684 - RNA, 22 nt, Chlamydophila pneumoniae J138
cugcuucaaaacauaaccuccu

SEQ ID NO: 544685 - RNA, 19 nt, Chlamydophila pneumoniae J138
cugcuuacaauugaaaauu

SEQ ID NO: 544686 - RNA, 15 nt, Chlamydophila pneumoniae J138
cugcuucaaaacaua

SEQ ID NO: 544687 - RNA, 14 nt, Chlamydophila pneumoniae J138
cugcugcuuugaca

SEQ ID NO: 544688 - RNA, 16 nt, Chlamydophila pneumoniae J138
cugcugcuaagccaaa

SEQ ID NO: 544689 - RNA, 15 nt, Chlamydophila pneumoniae J138
cugcgccaugcacaa

SEQ ID NO: 544690 - RNA, 16 nt, Chlamydophila pneumoniae J138
cugcgcaaagaacuca

SEQ ID NO: 544691 - RNA, 15 nt, Chlamydophila pneumoniae J138
cugccucacagcuaa

SEQ ID NO: 544692 - RNA, 21 nt, Chlamydophila pneumoniae J138
cugccagagauucuucacaau

SEQ ID NO: 544693 - RNA, 19 nt, Chlamydophila pneumoniae J138
cugccagugacauaaucac

SEQ ID NO: 544694 - RNA, 13 nt, Chlamydophila pneumoniae J138
cugcauuccagga

SEQ ID NO: 544695 - RNA, 14 nt, Chlamydophila pneumoniae J138
cugcauguugcaaa

SEQ ID NO: 544696 - RNA, 18 nt, Chlamydophila pneumoniae J138
cugcauggcuuugugagc

SEQ ID NO: 544697 - RNA, 11 nt, Chlamydophila pneumoniae J138
cugcauggcuu

SEQ ID NO: 544698 - RNA, 19 nt, Chlamydophila pneumoniae J138
cugcaucccaccgacaaga

SEQ ID NO: 544699 - RNA, 17 nt, Chlamydophila pneumoniae J138
cugcagguaagggaugc

SEQ ID NO: 544700 - RNA, 23 nt, Chlamydophila pneumoniae J138
cugcaaucagugcugccaugaca

SEQ ID NO: 544701 - RNA, 13 nt, Chlamydophila pneumoniae J138
aaaaaaaucuucu

SEQ ID NO: 544702 - RNA, 12 nt, Chlamydophila pneumoniae J138
aaaaaauaaaau

SEQ ID NO: 544703 - RNA, 20 nt, Chlamydophila pneumoniae J138
aaaaaauacaggaaucuccu

SEQ ID NO: 544704 - RNA, 23 nt, Chlamydophila pneumoniae J138
aaaaaauaucuccguuaccaaaa

SEQ ID NO: 544705 - RNA, 13 nt, Chlamydophila pneumoniae J138
aaaaaacaguaga

SEQ ID NO: 544706 - RNA, 11 nt, Chlamydophila pneumoniae J138
aaaaaaucaau

SEQ ID NO: 544707 - RNA, 22 nt, Chlamydophila pneumoniae J138
aaaaaaucccagauuacaagag

SEQ ID NO: 544708 - RNA, 12 nt, Chlamydophila pneumoniae J138
aaaaaauucuaa

SEQ ID NO: 544709 - RNA, 21 nt, Chlamydophila pneumoniae J138
aaaaaaucuucuuagccaaaa

SEQ ID NO: 544710 - RNA, 19 nt, Chlamydophila pneumoniae J138
aaaaaaucucgagaagacc

SEQ ID NO: 544711 - RNA, 19 nt, Chlamydophila pneumoniae J138
aaaaaccagccaauaacau

SEQ ID NO: 544712 - RNA, 15 nt, Chlamydophila pneumoniae J138
aaacaaaagccauuc

SEQ ID NO: 544713 - RNA, 12 nt, Chlamydophila pneumoniae J138
aaacaaaaucuu

SEQ ID NO: 544714 - RNA, 15 nt, Chlamydophila pneumoniae J138
aaacaaaaucuuuua

SEQ ID NO: 544715 - RNA, 17 nt, Chlamydophila pneumoniae J138
aaaauuuugauaccucu

SEQ ID NO: 544716 - RNA, 15 nt, Chlamydophila pneumoniae J138
aaacaacagaaaugu

SEQ ID NO: 544717 - RNA, 15 nt, Chlamydophila pneumoniae J138
aaaauucaaaucccu

SEQ ID NO: 544718 - RNA, 14 nt, Chlamydophila pneumoniae J138
aaaauuuaaaaaaa

SEQ ID NO: 544719 - RNA, 19 nt, Chlamydophila pneumoniae J138
aaaauucccauagcaugag

SEQ ID NO: 544720 - RNA, 23 nt, Chlamydophila pneumoniae J138
aaaauucgguaguggugaacuaa

SEQ ID NO: 544721 - RNA, 14 nt, Chlamydophila pneumoniae J138
aaaaucuccucucu

SEQ ID NO: 544722 - RNA, 20 nt, Chlamydophila pneumoniae J138
aaaaucuacauguaaagcaa

SEQ ID NO: 544723 - RNA, 18 nt, Chlamydophila pneumoniae J138
aaaaucgugcuuagagcc

SEQ ID NO: 544724 - RNA, 21 nt, Chlamydophila pneumoniae J138
aaaaucguuuuauuuuaggag

SEQ ID NO: 544725 - RNA, 18 nt, Chlamydophila pneumoniae J138
aaaaugcuccugcaaaaa

SEQ ID NO: 544726 - RNA, 21 nt, Chlamydophila pneumoniae J138
aaaaugcgcacggauucuaaa

SEQ ID NO: 544727 - RNA, 20 nt, Chlamydophila pneumoniae J138
aaaauuauguauaaacucca

SEQ ID NO: 544728 - RNA, 14 nt, Chlamydophila pneumoniae J138
aaaauuauuaaacu

SEQ ID NO: 544729 - RNA, 18 nt, Chlamydophila pneumoniae J138
aaaaguugaggaaaggag

SEQ ID NO: 544730 - RNA, 18 nt, Chlamydophila pneumoniae J138
aaaaguucagcaaggaag

SEQ ID NO: 544731 - RNA, 17 nt, Chlamydophila pneumoniae J138
aaaauaaacauauucuc

SEQ ID NO: 544732 - RNA, 22 nt, Chlamydophila pneumoniae J138
aaaagcacuuaaaaaacuuccu

SEQ ID NO: 544733 - RNA, 20 nt, Chlamydophila pneumoniae J138
aaaaguaguuuuaagaaggu

SEQ ID NO: 544734 - RNA, 23 nt, Chlamydophila pneumoniae J138
aaaaguacgaccaacuccucaaa

SEQ ID NO: 544735 - RNA, 13 nt, Chlamydophila pneumoniae J138
aaaauagauccug

SEQ ID NO: 544736 - RNA, 20 nt, Chlamydophila pneumoniae J138
aaaauaggugacuucuuugc

SEQ ID NO: 544737 - RNA, 20 nt, Chlamydophila pneumoniae J138
aaaauaguacgcuuuuuacu

SEQ ID NO: 544738 - RNA, 16 nt, Chlamydophila pneumoniae J138
aaaaucaacucuccau

SEQ ID NO: 544739 - RNA, 21 nt, Chlamydophila pneumoniae J138
aaaaucaaauagauuuuuacu

SEQ ID NO: 544740 - RNA, 22 nt, Chlamydophila pneumoniae J138
aaaaucaagaagagaaaagaua

SEQ ID NO: 544741 - RNA, 15 nt, Chlamydophila pneumoniae J138
aaaacuacauucuaa

SEQ ID NO: 544742 - RNA, 20 nt, Chlamydophila pneumoniae J138
aaaaccaauuucuccgcuuu

SEQ ID NO: 544743 - RNA, 20 nt, Chlamydophila pneumoniae J138
aaaacgguaaauaucuuaac

SEQ ID NO: 544744 - RNA, 20 nt, Chlamydophila pneumoniae J138
aaaacugcgcuaucaucauu

SEQ ID NO: 544745 - RNA, 19 nt, Chlamydophila pneumoniae J138
aaaacuguguucaauagca

SEQ ID NO: 544746 - RNA, 13 nt, Chlamydophila pneumoniae J138
aaaacuucccauc

SEQ ID NO: 544747 - RNA, 23 nt, Chlamydophila pneumoniae J138
aaaacuucuugugauccuugcaa

SEQ ID NO: 544748 - RNA, 12 nt, Chlamydophila pneumoniae J138
aaaagaaagaau

SEQ ID NO: 544749 - RNA, 20 nt, Chlamydophila pneumoniae J138
aaaagaaagaagccuuccuu

SEQ ID NO: 544750 - RNA, 21 nt, Chlamydophila pneumoniae J138
aaaagaaagaagccuuccuug

SEQ ID NO: 544751 - RNA, 16 nt, Chlamydophila pneumoniae J138
aaaagaaaucaaacau

SEQ ID NO: 544752 - RNA, 21 nt, Chlamydophila pneumoniae J138
aaaagaacauuaagaggaaag

SEQ ID NO: 544753 - RNA, 22 nt, Chlamydophila pneumoniae J138
aaaagaauuccuaaaacgagca

SEQ ID NO: 544754 - RNA, 16 nt, Chlamydophila pneumoniae J138
aaaagacuuaccguuu

SEQ ID NO: 544755 - RNA, 13 nt, Chlamydophila pneumoniae J138
aaaagaccaaaaa

SEQ ID NO: 544756 - RNA, 15 nt, Chlamydophila pneumoniae J138
aaaagagcaagaugg

SEQ ID NO: 544757 - RNA, 20 nt, Chlamydophila pneumoniae J138
aaaagagaacauguuucuaa

SEQ ID NO: 544758 - RNA, 14 nt, Chlamydophila pneumoniae J138
aaaagauaaagcua

SEQ ID NO: 544759 - RNA, 12 nt, Chlamydophila pneumoniae J138
aaaagauaguga

SEQ ID NO: 544760 - RNA, 21 nt, Chlamydophila pneumoniae J138
aaaagcacuuaaaaaacuucc

SEQ ID NO: 544761 - RNA, 15 nt, Chlamydophila pneumoniae J138
aaaagcacuuaaaaa

SEQ ID NO: 544762 - RNA, 16 nt, Chlamydophila pneumoniae J138
aaaagauuuucccgug

SEQ ID NO: 544763 - RNA, 20 nt, Chlamydophila pneumoniae J138
aaaagaucggaguuaucaaa

SEQ ID NO: 544764 - RNA, 19 nt, Chlamydophila pneumoniae J138
aaaacaaucuaaagguuuu

SEQ ID NO: 544765 - RNA, 18 nt, Chlamydophila pneumoniae J138
aaaacacugcgcaaagaa

SEQ ID NO: 544766 - RNA, 13 nt, Chlamydophila pneumoniae J138
aaaacaucuguau

SEQ ID NO: 544767 - RNA, 17 nt, Chlamydophila pneumoniae J138
aaaaaucccuguucuag

SEQ ID NO: 544768 - RNA, 16 nt, Chlamydophila pneumoniae J138
aaaaaucccuguucua

SEQ ID NO: 544769 - RNA, 21 nt, Chlamydophila pneumoniae J138
aaaaauuuuauaggaauaaca

SEQ ID NO: 544770 - RNA, 15 nt, Chlamydophila pneumoniae J138
aaaacaaggcaaaaa

SEQ ID NO: 544771 - RNA, 12 nt, Chlamydophila pneumoniae J138
aaaaauauaucu

SEQ ID NO: 544772 - RNA, 23 nt, Chlamydophila pneumoniae J138
aaaaaucccagauuacaagaggu

SEQ ID NO: 544773 - RNA, 14 nt, Chlamydophila pneumoniae J138
aaaaauagauaagu

SEQ ID NO: 544774 - RNA, 15 nt, Chlamydophila pneumoniae J138
aaaaauagaaauaag

SEQ ID NO: 544775 - RNA, 16 nt, Chlamydophila pneumoniae J138
aaaaacccucaaagaa

SEQ ID NO: 544776 - RNA, 17 nt, Chlamydophila pneumoniae J138
aaaaauaaacauauucu

SEQ ID NO: 544777 - RNA, 22 nt, Chlamydophila pneumoniae J138
aaacgaugagcacauucaagau

SEQ ID NO: 544778 - RNA, 16 nt, Chlamydophila pneumoniae J138
aaacgaauuucuuguu

SEQ ID NO: 544779 - RNA, 17 nt, Chlamydophila pneumoniae J138
aaaccuucaaugauuuc

SEQ ID NO: 544780 - RNA, 16 nt, Chlamydophila pneumoniae J138
aaacgaaagcagugug

SEQ ID NO: 544781 - RNA, 14 nt, Chlamydophila pneumoniae J138
aaacgaaagcagug

SEQ ID NO: 544782 - RNA, 15 nt, Chlamydophila pneumoniae J138
aaacaagaaaaagca

SEQ ID NO: 544783 - RNA, 15 nt, Chlamydophila pneumoniae J138
aaacaagaagaucaa

SEQ ID NO: 544784 - RNA, 21 nt, Chlamydophila pneumoniae J138
aaacaacucccguuuuguugg

SEQ ID NO: 544785 - RNA, 17 nt, Chlamydophila pneumoniae J138
aaacuaaaucaacuaca

SEQ ID NO: 544786 - RNA, 22 nt, Chlamydophila pneumoniae J138
aaacuaaaucaacuacaucucc

SEQ ID NO: 544787 - RNA, 17 nt, Chlamydophila pneumoniae J138
aaacggcauuugccccu

SEQ ID NO: 544788 - RNA, 13 nt, Chlamydophila pneumoniae J138
aaacgcgagcuau

SEQ ID NO: 544789 - RNA, 16 nt, Chlamydophila pneumoniae J138
aaacgcucuccuagac

SEQ ID NO: 544790 - RNA, 13 nt, Chlamydophila pneumoniae J138
aaacucucuuccu

SEQ ID NO: 544791 - RNA, 18 nt, Chlamydophila pneumoniae J138
aaacucucuuccuucucc

SEQ ID NO: 544792 - RNA, 11 nt, Chlamydophila pneumoniae J138
aaacucucagg

SEQ ID NO: 544793 - RNA, 14 nt, Chlamydophila pneumoniae J138
aaacuccauuguug

SEQ ID NO: 544794 - RNA, 20 nt, Chlamydophila pneumoniae J138
aaacucugacgucuccaaca

SEQ ID NO: 544795 - RNA, 15 nt, Chlamydophila pneumoniae J138
aaacucuuugaggau

SEQ ID NO: 544796 - RNA, 17 nt, Chlamydophila pneumoniae J138
aaacuccggauucuuua

SEQ ID NO: 544797 - RNA, 12 nt, Chlamydophila pneumoniae J138
aaacuaggaaaa

SEQ ID NO: 544798 - RNA, 18 nt, Chlamydophila pneumoniae J138
aaacuaguucuucuuuac

SEQ ID NO: 544799 - RNA, 14 nt, Chlamydophila pneumoniae J138
aaacuaguucuucu

SEQ ID NO: 544800 - RNA, 19 nt, Chlamydophila pneumoniae J138
aaacuucccaucuuguucu

SEQ ID NO: 544801 - RNA, 20 nt, Chlamydophila pneumoniae J138
aaacuucgauuggaagcaaa

SEQ ID NO: 544802 - RNA, 22 nt, Chlamydophila pneumoniae J138
aaacuuccuaacuaucucuguu

SEQ ID NO: 544803 - RNA, 13 nt, Chlamydophila pneumoniae J138
aaacuucucagau

SEQ ID NO: 544804 - RNA, 17 nt, Chlamydophila pneumoniae J138
aaacuucuucucgguuu

SEQ ID NO: 544805 - RNA, 15 nt, Chlamydophila pneumoniae J138
aaacuuuaaaagcau

SEQ ID NO: 544806 - RNA, 19 nt, Chlamydophila pneumoniae J138
aaacugaugccaagaaaua

SEQ ID NO: 544807 - RNA, 13 nt, Chlamydophila pneumoniae J138
aaacugcuccuga

SEQ ID NO: 544808 - RNA, 14 nt, Chlamydophila pneumoniae J138
aaacugucauccuu

SEQ ID NO: 544809 - RNA, 17 nt, Chlamydophila pneumoniae J138
aaacuggcggauugcuu

SEQ ID NO: 544810 - RNA, 15 nt, Chlamydophila pneumoniae J138
aaacugucauguauc

SEQ ID NO: 544811 - RNA, 22 nt, Chlamydophila pneumoniae J138
aaacuguuaacaagauucucag

SEQ ID NO: 544812 - RNA, 23 nt, Chlamydophila pneumoniae J138
aaacuguuaacaagauucucagc

SEQ ID NO: 544813 - RNA, 12 nt, Chlamydophila pneumoniae J138
aaagccacagcc

SEQ ID NO: 544814 - RNA, 22 nt, Chlamydophila pneumoniae J138
aaagcagcgaagauuuagggaa

SEQ ID NO: 544815 - RNA, 19 nt, Chlamydophila pneumoniae J138
aaagcaucuuucaucaaug

SEQ ID NO: 544816 - RNA, 19 nt, Chlamydophila pneumoniae J138
aaagcacuuaaaaaacuuc

SEQ ID NO: 544817 - RNA, 22 nt, Chlamydophila pneumoniae J138
aaagauaaucuguaagaaaaug

SEQ ID NO: 544818 - RNA, 14 nt, Chlamydophila pneumoniae J138
aaagauaugucuug

SEQ ID NO: 544819 - RNA, 16 nt, Chlamydophila pneumoniae J138
aaagauaguuauuaau

SEQ ID NO: 544820 - RNA, 17 nt, Chlamydophila pneumoniae J138
aaagcaaaaugguuguu

SEQ ID NO: 544821 - RNA, 11 nt, Chlamydophila pneumoniae J138
aaagcaaagag

SEQ ID NO: 544822 - RNA, 15 nt, Chlamydophila pneumoniae J138
aaagauuucugcugu

SEQ ID NO: 544823 - RNA, 22 nt, Chlamydophila pneumoniae J138
aaagaucauggauucacaucuu

SEQ ID NO: 544824 - RNA, 23 nt, Chlamydophila pneumoniae J138
aaagagcuucuucuaaagcagaa

SEQ ID NO: 544825 - RNA, 12 nt, Chlamydophila pneumoniae J138
aaagagcuaaag

SEQ ID NO: 544826 - RNA, 14 nt, Chlamydophila pneumoniae J138
aaagagcaaggaac

SEQ ID NO: 544827 - RNA, 17 nt, Chlamydophila pneumoniae J138
aaagagcccaaaaacac

SEQ ID NO: 544828 - RNA, 20 nt, Chlamydophila pneumoniae J138
aaagagcucaaaaaguucca

SEQ ID NO: 544829 - RNA, 14 nt, Chlamydophila pneumoniae J138
aaagagcucaaaaa

SEQ ID NO: 544830 - RNA, 22 nt, Chlamydophila pneumoniae J138
aaagacucaugaaauaguguuu

SEQ ID NO: 544831 - RNA, 19 nt, Chlamydophila pneumoniae J138
aaagacucuugaauauuua

SEQ ID NO: 544832 - RNA, 19 nt, Chlamydophila pneumoniae J138
aaagacucucuuccaaaag

SEQ ID NO: 544833 - RNA, 19 nt, Chlamydophila pneumoniae J138
aaagacuucuuuauuauag

SEQ ID NO: 544834 - RNA, 22 nt, Chlamydophila pneumoniae J138
aaagaaguuuacaaauaaaaug

SEQ ID NO: 544835 - RNA, 23 nt, Chlamydophila pneumoniae J138
aaagaaguuuacaaauaaaauga

SEQ ID NO: 544836 - RNA, 14 nt, Chlamydophila pneumoniae J138
aaagaaguccuagg

SEQ ID NO: 544837 - RNA, 21 nt, Chlamydophila pneumoniae J138
aaagaaggucuuccaucucuu

SEQ ID NO: 544838 - RNA, 22 nt, Chlamydophila pneumoniae J138
aaacuuucuucucuaggaagau

SEQ ID NO: 544839 - RNA, 12 nt, Chlamydophila pneumoniae J138
aaacuuucuucu

SEQ ID NO: 544840 - RNA, 16 nt, Chlamydophila pneumoniae J138
aaaggaccuguuuucu

SEQ ID NO: 544841 - RNA, 17 nt, Chlamydophila pneumoniae J138
aaaggaccuguuuucuu

SEQ ID NO: 544842 - RNA, 19 nt, Chlamydophila pneumoniae J138
aaaggcaacaacgccuaca

SEQ ID NO: 544843 - RNA, 17 nt, Chlamydophila pneumoniae J138
aaaggaccauuaauuuc

SEQ ID NO: 544844 - RNA, 19 nt, Chlamydophila pneumoniae J138
aaaggaccacaauuccuaa

SEQ ID NO: 544845 - RNA, 20 nt, Chlamydophila pneumoniae J138
aaaggacauagacuuugagu

SEQ ID NO: 544846 - RNA, 15 nt, Chlamydophila pneumoniae J138
aaaggaauaugcucu

SEQ ID NO: 544847 - RNA, 22 nt, Chlamydophila pneumoniae J138
aaagcuguaaccaacaucaaag

SEQ ID NO: 544848 - RNA, 16 nt, Chlamydophila pneumoniae J138
aaagcuguauugggaa

SEQ ID NO: 544849 - RNA, 23 nt, Chlamydophila pneumoniae J138
aaaggaagggauguuuaauacaa

SEQ ID NO: 544850 - RNA, 22 nt, Chlamydophila pneumoniae J138
aaagccgauacccaucuagaaa

SEQ ID NO: 544851 - RNA, 23 nt, Chlamydophila pneumoniae J138
aaagcccucauccccucagaaag

SEQ ID NO: 544852 - RNA, 23 nt, Chlamydophila pneumoniae J138
aaagcccauuccugcaguauuau

SEQ ID NO: 544853 - RNA, 23 nt, Chlamydophila pneumoniae J138
aaagccggcccacucaaaagaag

SEQ ID NO: 544854 - RNA, 13 nt, Chlamydophila pneumoniae J138
aaagcuaaacaac

SEQ ID NO: 544855 - RNA, 19 nt, Chlamydophila pneumoniae J138
aaaggggcuccuaaagcau

SEQ ID NO: 544856 - RNA, 14 nt, Chlamydophila pneumoniae J138
aaagguuuugaagc

SEQ ID NO: 544857 - RNA, 16 nt, Chlamydophila pneumoniae J138
aaagguuuugaagcuc

SEQ ID NO: 544858 - RNA, 14 nt, Chlamydophila pneumoniae J138
aaagguuguaagga

SEQ ID NO: 544859 - RNA, 12 nt, Chlamydophila pneumoniae J138
aaagguugcuaa

SEQ ID NO: 544860 - RNA, 17 nt, Chlamydophila pneumoniae J138
aaagguuuuaaauuuag

SEQ ID NO: 544861 - RNA, 14 nt, Chlamydophila pneumoniae J138
aaagguuuuauaaa

SEQ ID NO: 544862 - RNA, 13 nt, Chlamydophila pneumoniae J138
aaagguuuuaaaa

SEQ ID NO: 544863 - RNA, 14 nt, Chlamydophila pneumoniae J138
aaagguuuuaaauu

SEQ ID NO: 544864 - RNA, 16 nt, Chlamydophila pneumoniae J138
aaagggcgcuucccua

SEQ ID NO: 544865 - RNA, 17 nt, Chlamydophila pneumoniae J138
aaagggaauuuucucau

SEQ ID NO: 544866 - RNA, 23 nt, Chlamydophila pneumoniae J138
aaaguaccuuuaacccgcuugca

SEQ ID NO: 544867 - RNA, 17 nt, Chlamydophila pneumoniae J138
aaaguaccuaggaucua

SEQ ID NO: 544868 - RNA, 12 nt, Chlamydophila pneumoniae J138
aaaguacuacaa

SEQ ID NO: 544869 - RNA, 14 nt, Chlamydophila pneumoniae J138
aaaguaaaaaauac

SEQ ID NO: 544870 - RNA, 18 nt, Chlamydophila pneumoniae J138
aaaguacaggcuccauca

SEQ ID NO: 544871 - RNA, 18 nt, Chlamydophila pneumoniae J138
aaaguauuccucuuagga

SEQ ID NO: 544872 - RNA, 22 nt, Chlamydophila pneumoniae J138
aaagucaaauacuucuccugaa

SEQ ID NO: 544873 - RNA, 18 nt, Chlamydophila pneumoniae J138
aaagucacggcgaaagcu

SEQ ID NO: 544874 - RNA, 18 nt, Chlamydophila pneumoniae J138
aaagucacucaaacccuc

SEQ ID NO: 544875 - RNA, 14 nt, Chlamydophila pneumoniae J138
aaaucagacuuaaa

SEQ ID NO: 544876 - RNA, 15 nt, Chlamydophila pneumoniae J138
aaaucagaauccuga

SEQ ID NO: 544877 - RNA, 13 nt, Chlamydophila pneumoniae J138
aaaucaacaucac

SEQ ID NO: 544878 - RNA, 16 nt, Chlamydophila pneumoniae J138
aaaucaacaucacaau

SEQ ID NO: 544879 - RNA, 21 nt, Chlamydophila pneumoniae J138
aaaucaacucuccauccucag

SEQ ID NO: 544880 - RNA, 14 nt, Chlamydophila pneumoniae J138
aaaucaacuacacu

SEQ ID NO: 544881 - RNA, 18 nt, Chlamydophila pneumoniae J138
aaaucaagccacagagaa

SEQ ID NO: 544882 - RNA, 17 nt, Chlamydophila pneumoniae J138
aaaucaagccacagaga

SEQ ID NO: 544883 - RNA, 20 nt, Chlamydophila pneumoniae J138
aaaucaccagcauuaagaua

SEQ ID NO: 544884 - RNA, 19 nt, Chlamydophila pneumoniae J138
aaaucaccauauccaugac

SEQ ID NO: 544885 - RNA, 18 nt, Chlamydophila pneumoniae J138
aaauaggaucucucuuuc

SEQ ID NO: 544886 - RNA, 22 nt, Chlamydophila pneumoniae J138
aaauaggcucuacaggagaagc

SEQ ID NO: 544887 - RNA, 23 nt, Chlamydophila pneumoniae J138
aaauaggcucuacaggagaagcg

SEQ ID NO: 544888 - RNA, 21 nt, Chlamydophila pneumoniae J138
aaauaugagaucgaaucuuua

SEQ ID NO: 544889 - RNA, 11 nt, Chlamydophila pneumoniae J138
aaauaugaauu

SEQ ID NO: 544890 - RNA, 15 nt, Chlamydophila pneumoniae J138
aaaucaaacauuacc

SEQ ID NO: 544891 - RNA, 15 nt, Chlamydophila pneumoniae J138
aaaucaaaauuuuua

SEQ ID NO: 544892 - RNA, 17 nt, Chlamydophila pneumoniae J138
aaauauucuuggaagau

SEQ ID NO: 544893 - RNA, 19 nt, Chlamydophila pneumoniae J138
aaauauucuuucaaaccac

SEQ ID NO: 544894 - RNA, 14 nt, Chlamydophila pneumoniae J138
aaauacuccacuuu

SEQ ID NO: 544895 - RNA, 23 nt, Chlamydophila pneumoniae J138
aaauacguccagccugcaccaga

SEQ ID NO: 544896 - RNA, 14 nt, Chlamydophila pneumoniae J138
aaauacgcuuuucu

SEQ ID NO: 544897 - RNA, 15 nt, Chlamydophila pneumoniae J138
aaauacgcuuuucuu

SEQ ID NO: 544898 - RNA, 18 nt, Chlamydophila pneumoniae J138
aaauaaucuucaaaagac

SEQ ID NO: 544899 - RNA, 14 nt, Chlamydophila pneumoniae J138
aaauaggagagcac

SEQ ID NO: 544900 - RNA, 20 nt, Chlamydophila pneumoniae J138
aaauaggagagcacuuuuaa

SEQ ID NO: 544901 - RNA, 23 nt, Chlamydophila pneumoniae J138
aaauaggaaaguugcaacucucu

SEQ ID NO: 544902 - RNA, 21 nt, Chlamydophila pneumoniae J138
aaauaggaucucucuuuccuu

SEQ ID NO: 544903 - RNA, 12 nt, Chlamydophila pneumoniae J138
aaauaggaucuc

SEQ ID NO: 544904 - RNA, 19 nt, Chlamydophila pneumoniae J138
aaauagcaucccuucuucu

SEQ ID NO: 544905 - RNA, 16 nt, Chlamydophila pneumoniae J138
aaauacuucuccugaa

SEQ ID NO: 544906 - RNA, 13 nt, Chlamydophila pneumoniae J138
aaauacuucuccu

SEQ ID NO: 544907 - RNA, 13 nt, Chlamydophila pneumoniae J138
aaauaaaaggagc

SEQ ID NO: 544908 - RNA, 21 nt, Chlamydophila pneumoniae J138
aaaguccuccauguacaguuu

SEQ ID NO: 544909 - RNA, 20 nt, Chlamydophila pneumoniae J138
aaaguccaagaucaaacgaa

SEQ ID NO: 544910 - RNA, 20 nt, Chlamydophila pneumoniae J138
aaauaaccuagaaggaggag

SEQ ID NO: 544911 - RNA, 21 nt, Chlamydophila pneumoniae J138
aaauaagauuuuaagaccuuc

SEQ ID NO: 544912 - RNA, 18 nt, Chlamydophila pneumoniae J138
aaauaagccaguacuaaa

SEQ ID NO: 544913 - RNA, 19 nt, Chlamydophila pneumoniae J138
aaaucuaccgugaagauuu

SEQ ID NO: 544914 - RNA, 20 nt, Chlamydophila pneumoniae J138
aaaucuaucugcacuuucuu

SEQ ID NO: 544915 - RNA, 12 nt, Chlamydophila pneumoniae J138
aaaucucauuuc

SEQ ID NO: 544916 - RNA, 18 nt, Chlamydophila pneumoniae J138
aaaucauuuaaagcugaa

SEQ ID NO: 544917 - RNA, 21 nt, Chlamydophila pneumoniae J138
aaaucauuggaaccauaggau

SEQ ID NO: 544918 - RNA, 15 nt, Chlamydophila pneumoniae J138
aaaucgcauuacaaa

SEQ ID NO: 544919 - RNA, 20 nt, Chlamydophila pneumoniae J138
aaaucauaggcuauaauuaa

SEQ ID NO: 544920 - RNA, 20 nt, Chlamydophila pneumoniae J138
aaaucaucgcaaucaaagag

SEQ ID NO: 544921 - RNA, 22 nt, Chlamydophila pneumoniae J138
aaaugcuccugcaaaaaaccag

SEQ ID NO: 544922 - RNA, 15 nt, Chlamydophila pneumoniae J138
aaaugcgaggaaaaa

SEQ ID NO: 544923 - RNA, 12 nt, Chlamydophila pneumoniae J138
aaaugccuguac

SEQ ID NO: 544924 - RNA, 17 nt, Chlamydophila pneumoniae J138
aaaugccuuaaauguau

SEQ ID NO: 544925 - RNA, 15 nt, Chlamydophila pneumoniae J138
aaaaagcuaaacaac

SEQ ID NO: 544926 - RNA, 21 nt, Chlamydophila pneumoniae J138
aaaaagcugacacucagcucc

SEQ ID NO: 544927 - RNA, 19 nt, Chlamydophila pneumoniae J138
aaaaagccuaugauaaagc

SEQ ID NO: 544928 - RNA, 17 nt, Chlamydophila pneumoniae J138
aaaaagccaagaaaaca

SEQ ID NO: 544929 - RNA, 18 nt, Chlamydophila pneumoniae J138
aaaaaggacucuuucuau

SEQ ID NO: 544930 - RNA, 14 nt, Chlamydophila pneumoniae J138
aaaaagcuucuuuc

SEQ ID NO: 544931 - RNA, 22 nt, Chlamydophila pneumoniae J138
aaaugugcucggacagaaagau

SEQ ID NO: 544932 - RNA, 12 nt, Chlamydophila pneumoniae J138
aaauuaacagag

SEQ ID NO: 544933 - RNA, 16 nt, Chlamydophila pneumoniae J138
aaauuaaauucuuuuc

SEQ ID NO: 544934 - RNA, 21 nt, Chlamydophila pneumoniae J138
aaauguugauagguagaggca

SEQ ID NO: 544935 - RNA, 22 nt, Chlamydophila pneumoniae J138
aaauucaagacuauagaaaagg

SEQ ID NO: 544936 - RNA, 23 nt, Chlamydophila pneumoniae J138
aaauucucauaaccuaaggcaug

SEQ ID NO: 544937 - RNA, 23 nt, Chlamydophila pneumoniae J138
aaauucuagaccugccaagauac

SEQ ID NO: 544938 - RNA, 21 nt, Chlamydophila pneumoniae J138
aaauucuagguuucaggaaau

SEQ ID NO: 544939 - RNA, 14 nt, Chlamydophila pneumoniae J138
aaauuccuucucag

SEQ ID NO: 544940 - RNA, 12 nt, Chlamydophila pneumoniae J138
aaauuccucuug

SEQ ID NO: 544941 - RNA, 23 nt, Chlamydophila pneumoniae J138
augagcaucugagucauaagcuc

SEQ ID NO: 544942 - RNA, 17 nt, Chlamydophila pneumoniae J138
augagcacauucaagau

SEQ ID NO: 544943 - RNA, 15 nt, Chlamydophila pneumoniae J138
augaucuuuaggaaa

SEQ ID NO: 544944 - RNA, 20 nt, Chlamydophila pneumoniae J138
augaugccauugaucagaau

SEQ ID NO: 544945 - RNA, 15 nt, Chlamydophila pneumoniae J138
augauguuuuuuaac

SEQ ID NO: 544946 - RNA, 18 nt, Chlamydophila pneumoniae J138
augauuuucgguuacuuu

SEQ ID NO: 544947 - RNA, 16 nt, Chlamydophila pneumoniae J138
augcaaugguugucuu

SEQ ID NO: 544948 - RNA, 12 nt, Chlamydophila pneumoniae J138
augcacaaaaua

SEQ ID NO: 544949 - RNA, 16 nt, Chlamydophila pneumoniae J138
augcaacggagaaauu

SEQ ID NO: 544950 - RNA, 16 nt, Chlamydophila pneumoniae J138
augcaccauaauauaa

SEQ ID NO: 544951 - RNA, 19 nt, Chlamydophila pneumoniae J138
augccauugaucagaaucu

SEQ ID NO: 544952 - RNA, 16 nt, Chlamydophila pneumoniae J138
augcccuuuagggaau

SEQ ID NO: 544953 - RNA, 15 nt, Chlamydophila pneumoniae J138
augccaguuccuaaa

SEQ ID NO: 544954 - RNA, 16 nt, Chlamydophila pneumoniae J138
augccaguuccuaaag

SEQ ID NO: 544955 - RNA, 18 nt, Chlamydophila pneumoniae J138
augccauaaauacaggcc

SEQ ID NO: 544956 - RNA, 23 nt, Chlamydophila pneumoniae J138
augccucaggucugcugaggaga

SEQ ID NO: 544957 - RNA, 15 nt, Chlamydophila pneumoniae J138
augccucaggucugc

SEQ ID NO: 544958 - RNA, 21 nt, Chlamydophila pneumoniae J138
augccuacaggcaaggagagc

SEQ ID NO: 544959 - RNA, 17 nt, Chlamydophila pneumoniae J138
augccuaaauagcucag

SEQ ID NO: 544960 - RNA, 17 nt, Chlamydophila pneumoniae J138
augccuuaaauguauug

SEQ ID NO: 544961 - RNA, 21 nt, Chlamydophila pneumoniae J138
augccuggccaucaucaccag

SEQ ID NO: 544962 - RNA, 20 nt, Chlamydophila pneumoniae J138
augccucuuucauacuaaaa

SEQ ID NO: 544963 - RNA, 14 nt, Chlamydophila pneumoniae J138
augccugaaaacaa

SEQ ID NO: 544964 - RNA, 22 nt, Chlamydophila pneumoniae J138
augccucuuucauacuaaaauc

SEQ ID NO: 544965 - RNA, 20 nt, Chlamydophila pneumoniae J138
augcuccugcaaaaaaccag

SEQ ID NO: 544966 - RNA, 21 nt, Chlamydophila pneumoniae J138
augcuccuugggucuuuuuau

SEQ ID NO: 544967 - RNA, 13 nt, Chlamydophila pneumoniae J138
augcucuagaaaa

SEQ ID NO: 544968 - RNA, 20 nt, Chlamydophila pneumoniae J138
augcuugucgcgacaagaca

SEQ ID NO: 544969 - RNA, 15 nt, Chlamydophila pneumoniae J138
augcuuggcaauagc

SEQ ID NO: 544970 - RNA, 13 nt, Chlamydophila pneumoniae J138
augcuuaucuauc

SEQ ID NO: 544971 - RNA, 16 nt, Chlamydophila pneumoniae J138
auggaagagagcaaga

SEQ ID NO: 544972 - RNA, 13 nt, Chlamydophila pneumoniae J138
auggaaugccaaa

SEQ ID NO: 544973 - RNA, 16 nt, Chlamydophila pneumoniae J138
auggaaauagagaaac

SEQ ID NO: 544974 - RNA, 15 nt, Chlamydophila pneumoniae J138
auggaaacauagaau

SEQ ID NO: 544975 - RNA, 19 nt, Chlamydophila pneumoniae J138
auggauuaucuuagggaau

SEQ ID NO: 544976 - RNA, 14 nt, Chlamydophila pneumoniae J138
auggaugcuaaauu

SEQ ID NO: 544977 - RNA, 23 nt, Chlamydophila pneumoniae J138
auggaugucaccacgaacuucag

SEQ ID NO: 544978 - RNA, 15 nt, Chlamydophila pneumoniae J138
auggcacuugagcac

SEQ ID NO: 544979 - RNA, 18 nt, Chlamydophila pneumoniae J138
auggcauagcgaaaguca

SEQ ID NO: 544980 - RNA, 21 nt, Chlamydophila pneumoniae J138
auggcagcuuggaugggaauc

SEQ ID NO: 544981 - RNA, 18 nt, Chlamydophila pneumoniae J138
auggcagcuuggauggga

SEQ ID NO: 544982 - RNA, 15 nt, Chlamydophila pneumoniae J138
auggcccgauacaaa

SEQ ID NO: 544983 - RNA, 16 nt, Chlamydophila pneumoniae J138
auggcuggaaagccaa

SEQ ID NO: 544984 - RNA, 19 nt, Chlamydophila pneumoniae J138
augggcuuugcuaacagaa

SEQ ID NO: 544985 - RNA, 23 nt, Chlamydophila pneumoniae J138
auggguuuccuggucuccagaag

SEQ ID NO: 544986 - RNA, 22 nt, Chlamydophila pneumoniae J138
augguguucuucagcccacugu

SEQ ID NO: 544987 - RNA, 16 nt, Chlamydophila pneumoniae J138
auggugagauuucuaa

SEQ ID NO: 544988 - RNA, 15 nt, Chlamydophila pneumoniae J138
augguacaauacugg

SEQ ID NO: 544989 - RNA, 12 nt, Chlamydophila pneumoniae J138
auguaauuuuuu

SEQ ID NO: 544990 - RNA, 18 nt, Chlamydophila pneumoniae J138
auguacaagcuucaucaa

SEQ ID NO: 544991 - RNA, 12 nt, Chlamydophila pneumoniae J138
augguugcuucu

SEQ ID NO: 544992 - RNA, 18 nt, Chlamydophila pneumoniae J138
auuaucuccaaagaucau

SEQ ID NO: 544993 - RNA, 19 nt, Chlamydophila pneumoniae J138
auuaucguuucaguuuuau

SEQ ID NO: 544994 - RNA, 14 nt, Chlamydophila pneumoniae J138
auuaucuaagaaua

SEQ ID NO: 544995 - RNA, 18 nt, Chlamydophila pneumoniae J138
auuauuaaacgaauacug

SEQ ID NO: 544996 - RNA, 12 nt, Chlamydophila pneumoniae J138
auuauuaaacuc

SEQ ID NO: 544997 - RNA, 15 nt, Chlamydophila pneumoniae J138
aaaagcuaaacaacu

SEQ ID NO: 544998 - RNA, 11 nt, Chlamydophila pneumoniae J138
auuauuuuaaa

SEQ ID NO: 544999 - RNA, 15 nt, Chlamydophila pneumoniae J138
auuauuucuaaaaaa

SEQ ID NO: 545000 - RNA, 16 nt, Chlamydophila pneumoniae J138
auucaaacuccuuuua

SEQ ID NO: 545001 - RNA, 13 nt, Chlamydophila pneumoniae J138
auucaaaauagaa

SEQ ID NO: 545002 - RNA, 15 nt, Chlamydophila pneumoniae J138
auuagaguuugguuu

SEQ ID NO: 545003 - RNA, 22 nt, Chlamydophila pneumoniae J138
auuagcccuacgaauccaaaaa

SEQ ID NO: 545004 - RNA, 13 nt, Chlamydophila pneumoniae J138
aaaagccuuucuu

SEQ ID NO: 545005 - RNA, 12 nt, Chlamydophila pneumoniae J138
aaaagccuuucu

SEQ ID NO: 545006 - RNA, 15 nt, Chlamydophila pneumoniae J138
auuagaaucucugcc

SEQ ID NO: 545007 - RNA, 17 nt, Chlamydophila pneumoniae J138
auuaauacuuugccaac

SEQ ID NO: 545008 - RNA, 23 nt, Chlamydophila pneumoniae J138
aaaagcaaucguguuuuccugag

SEQ ID NO: 545009 - RNA, 12 nt, Chlamydophila pneumoniae J138
auuacagggaaa

SEQ ID NO: 545010 - RNA, 17 nt, Chlamydophila pneumoniae J138
auuacaucuaacucuaa

SEQ ID NO: 545011 - RNA, 18 nt, Chlamydophila pneumoniae J138
auuacaucuaacucuaau

SEQ ID NO: 545012 - RNA, 23 nt, Chlamydophila pneumoniae J138
auuaccugcuaaacuuuuuuuca

SEQ ID NO: 545013 - RNA, 17 nt, Chlamydophila pneumoniae J138
auuaccuuaucgccaac

SEQ ID NO: 545014 - RNA, 23 nt, Chlamydophila pneumoniae J138
auuacggaaaauacagccagcag

SEQ ID NO: 545015 - RNA, 17 nt, Chlamydophila pneumoniae J138
auuacucgcucugcacg

SEQ ID NO: 545016 - RNA, 17 nt, Chlamydophila pneumoniae J138
auuacuagaucccucaa

SEQ ID NO: 545017 - RNA, 16 nt, Chlamydophila pneumoniae J138
auguacauagaggaga

SEQ ID NO: 545018 - RNA, 16 nt, Chlamydophila pneumoniae J138
auguacagaaaauaag

SEQ ID NO: 545019 - RNA, 18 nt, Chlamydophila pneumoniae J138
auguacagaaaauaagaa

SEQ ID NO: 545020 - RNA, 16 nt, Chlamydophila pneumoniae J138
augucgcgaaaguaaa

SEQ ID NO: 545021 - RNA, 14 nt, Chlamydophila pneumoniae J138
augucgucucagaa

SEQ ID NO: 545022 - RNA, 17 nt, Chlamydophila pneumoniae J138
augucuaagucagaggu

SEQ ID NO: 545023 - RNA, 18 nt, Chlamydophila pneumoniae J138
augucuaagucagagguu

SEQ ID NO: 545024 - RNA, 15 nt, Chlamydophila pneumoniae J138
augucuuugaauaua

SEQ ID NO: 545025 - RNA, 20 nt, Chlamydophila pneumoniae J138
augucuuguugcaugggaau

SEQ ID NO: 545026 - RNA, 19 nt, Chlamydophila pneumoniae J138
augucuucauaugcucucc

SEQ ID NO: 545027 - RNA, 19 nt, Chlamydophila pneumoniae J138
augucuccaaagauacauu

SEQ ID NO: 545028 - RNA, 19 nt, Chlamydophila pneumoniae J138
augugacgcaagagacaag

SEQ ID NO: 545029 - RNA, 21 nt, Chlamydophila pneumoniae J138
augugcagaagguuccacaga

SEQ ID NO: 545030 - RNA, 13 nt, Chlamydophila pneumoniae J138
auguggcagaguc

SEQ ID NO: 545031 - RNA, 23 nt, Chlamydophila pneumoniae J138
augugucuugcugauuuuugcua

SEQ ID NO: 545032 - RNA, 17 nt, Chlamydophila pneumoniae J138
auguguuuccuuuucuc

SEQ ID NO: 545033 - RNA, 12 nt, Chlamydophila pneumoniae J138
auguuauggacu

SEQ ID NO: 545034 - RNA, 16 nt, Chlamydophila pneumoniae J138
auguucccaaauagaa

SEQ ID NO: 545035 - RNA, 14 nt, Chlamydophila pneumoniae J138
auguucgauuuucu

SEQ ID NO: 545036 - RNA, 21 nt, Chlamydophila pneumoniae J138
auguucuaugagauaggaacu

SEQ ID NO: 545037 - RNA, 14 nt, Chlamydophila pneumoniae J138
auguuuugacauag

SEQ ID NO: 545038 - RNA, 22 nt, Chlamydophila pneumoniae J138
auguuuguaguguugaauaaga

SEQ ID NO: 545039 - RNA, 20 nt, Chlamydophila pneumoniae J138
auguuuguaguguugaauaa

SEQ ID NO: 545040 - RNA, 22 nt, Chlamydophila pneumoniae J138
auuaaaucguauugacuuuggu

SEQ ID NO: 545041 - RNA, 19 nt, Chlamydophila pneumoniae J138
auuaaaucguacuucacuu

SEQ ID NO: 545042 - RNA, 18 nt, Chlamydophila pneumoniae J138
auuaaaucguacuucacu

SEQ ID NO: 545043 - RNA, 17 nt, Chlamydophila pneumoniae J138
auuaaaaauuuaaaaga

SEQ ID NO: 545044 - RNA, 19 nt, Chlamydophila pneumoniae J138
auuaacuaagauauguccg

SEQ ID NO: 545045 - RNA, 18 nt, Chlamydophila pneumoniae J138
auuaagauccuuuaaaga

SEQ ID NO: 545046 - RNA, 19 nt, Chlamydophila pneumoniae J138
auuaagauagacucucacu

SEQ ID NO: 545047 - RNA, 11 nt, Chlamydophila pneumoniae J138
auuaagauauc

SEQ ID NO: 545048 - RNA, 20 nt, Chlamydophila pneumoniae J138
auuaagauaaacagcacagg

SEQ ID NO: 545049 - RNA, 12 nt, Chlamydophila pneumoniae J138
auuaagaggagu

SEQ ID NO: 545050 - RNA, 20 nt, Chlamydophila pneumoniae J138
auuaagacucaauacuucag

SEQ ID NO: 545051 - RNA, 18 nt, Chlamydophila pneumoniae J138
auuaagaacaucuuccca

SEQ ID NO: 545052 - RNA, 14 nt, Chlamydophila pneumoniae J138
auuaagaagaagcu

SEQ ID NO: 545053 - RNA, 14 nt, Chlamydophila pneumoniae J138
auuaagaauggaug

SEQ ID NO: 545054 - RNA, 15 nt, Chlamydophila pneumoniae J138
auuaaggcuccagca

SEQ ID NO: 545055 - RNA, 17 nt, Chlamydophila pneumoniae J138
aaaagcuuuuuucucuu

SEQ ID NO: 545056 - RNA, 13 nt, Chlamydophila pneumoniae J138
aaaaggaggagga

SEQ ID NO: 545057 - RNA, 23 nt, Chlamydophila pneumoniae J138
aaaaggaggaggagcacuaggca

SEQ ID NO: 545058 - RNA, 18 nt, Chlamydophila pneumoniae J138
aaaagcuucuuucuuacu

SEQ ID NO: 545059 - RNA, 22 nt, Chlamydophila pneumoniae J138
aaaagcuucuuucuuacuaaag

SEQ ID NO: 545060 - RNA, 16 nt, Chlamydophila pneumoniae J138
aaaagcuucuuucuua

SEQ ID NO: 545061 - RNA, 14 nt, Chlamydophila pneumoniae J138
aaaagcuucuuucu

SEQ ID NO: 545062 - RNA, 22 nt, Chlamydophila pneumoniae J138
auucaugaaaugcuuucagugc

SEQ ID NO: 545063 - RNA, 15 nt, Chlamydophila pneumoniae J138
auucauuaagaacau

SEQ ID NO: 545064 - RNA, 13 nt, Chlamydophila pneumoniae J138
auucaugcaaaac

SEQ ID NO: 545065 - RNA, 18 nt, Chlamydophila pneumoniae J138
auuccauuauacuuuuuu

SEQ ID NO: 545066 - RNA, 17 nt, Chlamydophila pneumoniae J138
auuccagaaaaagaaca

SEQ ID NO: 545067 - RNA, 19 nt, Chlamydophila pneumoniae J138
auuccauagguuagaaaug

SEQ ID NO: 545068 - RNA, 22 nt, Chlamydophila pneumoniae J138
auuccauagguuagaaaugaaa

SEQ ID NO: 545069 - RNA, 17 nt, Chlamydophila pneumoniae J138
auuccaaaauaaaagga

SEQ ID NO: 545070 - RNA, 17 nt, Chlamydophila pneumoniae J138
auucauuuuuuaauaaa

SEQ ID NO: 545071 - RNA, 14 nt, Chlamydophila pneumoniae J138
auucauuuuuuaau

SEQ ID NO: 545072 - RNA, 14 nt, Chlamydophila pneumoniae J138
auuccaacuacaua

SEQ ID NO: 545073 - RNA, 13 nt, Chlamydophila pneumoniae J138
auuccaacaggga

SEQ ID NO: 545074 - RNA, 14 nt, Chlamydophila pneumoniae J138
auuccaauuuuugc

SEQ ID NO: 545075 - RNA, 20 nt, Chlamydophila pneumoniae J138
auucccaagaacuugagcac

SEQ ID NO: 545076 - RNA, 17 nt, Chlamydophila pneumoniae J138
auucccgggaugugguu

SEQ ID NO: 545077 - RNA, 20 nt, Chlamydophila pneumoniae J138
auucccggaggcaaagauca

SEQ ID NO: 545078 - RNA, 20 nt, Chlamydophila pneumoniae J138
auucccugacacagagcuuc

SEQ ID NO: 545079 - RNA, 23 nt, Chlamydophila pneumoniae J138
auuccuucauacguuuuuuuccu

SEQ ID NO: 545080 - RNA, 17 nt, Chlamydophila pneumoniae J138
auuccuuaaugguagcu

SEQ ID NO: 545081 - RNA, 16 nt, Chlamydophila pneumoniae J138
auuccuaaaacaagaa

SEQ ID NO: 545082 - RNA, 19 nt, Chlamydophila pneumoniae J138
auuccuaugaucagagaga

SEQ ID NO: 545083 - RNA, 17 nt, Chlamydophila pneumoniae J138
auucuccgccagaguuu

SEQ ID NO: 545084 - RNA, 18 nt, Chlamydophila pneumoniae J138
auucuaagcgcucuucaa

SEQ ID NO: 545085 - RNA, 15 nt, Chlamydophila pneumoniae J138
auucuaagagauccu

SEQ ID NO: 545086 - RNA, 13 nt, Chlamydophila pneumoniae J138
auucguuauccuc

SEQ ID NO: 545087 - RNA, 16 nt, Chlamydophila pneumoniae J138
auucgcuauagccuug

SEQ ID NO: 545088 - RNA, 18 nt, Chlamydophila pneumoniae J138
auuccuucauacguuuuu

SEQ ID NO: 545089 - RNA, 15 nt, Chlamydophila pneumoniae J138
auuccuuggcauacu

SEQ ID NO: 545090 - RNA, 21 nt, Chlamydophila pneumoniae J138
auucugagaaagaaguccuag

SEQ ID NO: 545091 - RNA, 15 nt, Chlamydophila pneumoniae J138
auucugagaaagaag

SEQ ID NO: 545092 - RNA, 20 nt, Chlamydophila pneumoniae J138
auucugauaaucagaggagc

SEQ ID NO: 545093 - RNA, 21 nt, Chlamydophila pneumoniae J138
auucugaagcugcaaacugau

SEQ ID NO: 545094 - RNA, 19 nt, Chlamydophila pneumoniae J138
auucugaagauauauuuuu

SEQ ID NO: 545095 - RNA, 12 nt, Chlamydophila pneumoniae J138
auucugaagcug

SEQ ID NO: 545096 - RNA, 21 nt, Chlamydophila pneumoniae J138
auucugauucuccgucccccg

SEQ ID NO: 545097 - RNA, 21 nt, Chlamydophila pneumoniae J138
auucugcccaaagcuaaaaug

SEQ ID NO: 545098 - RNA, 16 nt, Chlamydophila pneumoniae J138
auucugaagagagaau

SEQ ID NO: 545099 - RNA, 12 nt, Chlamydophila pneumoniae J138
auucucuucacu

SEQ ID NO: 545100 - RNA, 14 nt, Chlamydophila pneumoniae J138
auucucuucauuuu

SEQ ID NO: 545101 - RNA, 13 nt, Chlamydophila pneumoniae J138
auucucugacacu

SEQ ID NO: 545102 - RNA, 15 nt, Chlamydophila pneumoniae J138
auucuucgagagcau

SEQ ID NO: 545103 - RNA, 22 nt, Chlamydophila pneumoniae J138
auucuucauuguagaggucacu

SEQ ID NO: 545104 - RNA, 18 nt, Chlamydophila pneumoniae J138
auucugcuuuaucucuau

SEQ ID NO: 545105 - RNA, 12 nt, Chlamydophila pneumoniae J138
auucuucugucu

SEQ ID NO: 545106 - RNA, 17 nt, Chlamydophila pneumoniae J138
auucuucugucuguauu

SEQ ID NO: 545107 - RNA, 23 nt, Chlamydophila pneumoniae J138
auucuugagaguccugggguucu

SEQ ID NO: 545108 - RNA, 17 nt, Chlamydophila pneumoniae J138
auugaugcuuaagaguu

SEQ ID NO: 545109 - RNA, 20 nt, Chlamydophila pneumoniae J138
auugaaagagcuuugauuca

SEQ ID NO: 545110 - RNA, 19 nt, Chlamydophila pneumoniae J138
auugaaaccguaacugagg

SEQ ID NO: 545111 - RNA, 20 nt, Chlamydophila pneumoniae J138
auucuuuuucuauuaaaaau

SEQ ID NO: 545112 - RNA, 15 nt, Chlamydophila pneumoniae J138
auucuuuaaucuauc

SEQ ID NO: 545113 - RNA, 21 nt, Chlamydophila pneumoniae J138
auugcaaauuucauuuagaca

SEQ ID NO: 545114 - RNA, 14 nt, Chlamydophila pneumoniae J138
auugcaaaauuuaa

SEQ ID NO: 545115 - RNA, 14 nt, Chlamydophila pneumoniae J138
auugcaaaguacua

SEQ ID NO: 545116 - RNA, 17 nt, Chlamydophila pneumoniae J138
auugcaaaguacuacaa

SEQ ID NO: 545117 - RNA, 22 nt, Chlamydophila pneumoniae J138
auugcaaucugguuaagcacca

SEQ ID NO: 545118 - RNA, 20 nt, Chlamydophila pneumoniae J138
auugcauuaagauaaacauu

SEQ ID NO: 545119 - RNA, 21 nt, Chlamydophila pneumoniae J138
auugccuucuucuuguucuuc

SEQ ID NO: 545120 - RNA, 19 nt, Chlamydophila pneumoniae J138
auugccgugaguugcaauu

SEQ ID NO: 545121 - RNA, 14 nt, Chlamydophila pneumoniae J138
auugcuaagcauuu

SEQ ID NO: 545122 - RNA, 15 nt, Chlamydophila pneumoniae J138
auugcuaagcauuuu

SEQ ID NO: 545123 - RNA, 20 nt, Chlamydophila pneumoniae J138
auugcugccaggcuuaaaua

SEQ ID NO: 545124 - RNA, 18 nt, Chlamydophila pneumoniae J138
auugcgggcucaaagaaa

SEQ ID NO: 545125 - RNA, 13 nt, Chlamydophila pneumoniae J138
auugcugucagaa

SEQ ID NO: 545126 - RNA, 16 nt, Chlamydophila pneumoniae J138
auugggagguucgcag

SEQ ID NO: 545127 - RNA, 12 nt, Chlamydophila pneumoniae J138
aaaagggaagcu

SEQ ID NO: 545128 - RNA, 13 nt, Chlamydophila pneumoniae J138
auuguagagagua

SEQ ID NO: 545129 - RNA, 16 nt, Chlamydophila pneumoniae J138
auuguaauuuccuuag

SEQ ID NO: 545130 - RNA, 21 nt, Chlamydophila pneumoniae J138
auuguaaaucauuggaaccau

SEQ ID NO: 545131 - RNA, 14 nt, Chlamydophila pneumoniae J138
auuguuaucaggaa

SEQ ID NO: 545132 - RNA, 15 nt, Chlamydophila pneumoniae J138
auuguucaaaaauag

SEQ ID NO: 545133 - RNA, 23 nt, Chlamydophila pneumoniae J138
auuguucuuuacuacaugaggau

SEQ ID NO: 545134 - RNA, 15 nt, Chlamydophila pneumoniae J138
auuguguguuuucau

SEQ ID NO: 545135 - RNA, 19 nt, Chlamydophila pneumoniae J138
auugucucaacauuucuca

SEQ ID NO: 545136 - RNA, 20 nt, Chlamydophila pneumoniae J138
auuuaaaugccuuaaaugua

SEQ ID NO: 545137 - RNA, 13 nt, Chlamydophila pneumoniae J138
auuuaaauaaaac

SEQ ID NO: 545138 - RNA, 15 nt, Chlamydophila pneumoniae J138
auuuaacaacaugcg

SEQ ID NO: 545139 - RNA, 19 nt, Chlamydophila pneumoniae J138
auuguuggaauugcauuaa

SEQ ID NO: 545140 - RNA, 13 nt, Chlamydophila pneumoniae J138
auuguuguugcau

SEQ ID NO: 545141 - RNA, 22 nt, Chlamydophila pneumoniae J138
aaaagucucuagggaaaggagc

SEQ ID NO: 545142 - RNA, 16 nt, Chlamydophila pneumoniae J138
aaaaguaguuuuaaga

SEQ ID NO: 545143 - RNA, 17 nt, Chlamydophila pneumoniae J138
aaaagucaugaggacug

SEQ ID NO: 545144 - RNA, 18 nt, Chlamydophila pneumoniae J138
aaaagucaugaggacugu

SEQ ID NO: 545145 - RNA, 19 nt, Chlamydophila pneumoniae J138
auuuccggguucauuucca

SEQ ID NO: 545146 - RNA, 19 nt, Chlamydophila pneumoniae J138
auuuccccaugaaaauaca

SEQ ID NO: 545147 - RNA, 15 nt, Chlamydophila pneumoniae J138
auuucccuaaaauga

SEQ ID NO: 545148 - RNA, 17 nt, Chlamydophila pneumoniae J138
auuucgucaaagguuuu

SEQ ID NO: 545149 - RNA, 15 nt, Chlamydophila pneumoniae J138
auuucgugaacaaaa

SEQ ID NO: 545150 - RNA, 17 nt, Chlamydophila pneumoniae J138
auuucucuaucaucaau

SEQ ID NO: 545151 - RNA, 23 nt, Chlamydophila pneumoniae J138
auuucucuaagcagccucuucuc

SEQ ID NO: 545152 - RNA, 21 nt, Chlamydophila pneumoniae J138
auuucuggagaaugccccuuc

SEQ ID NO: 545153 - RNA, 18 nt, Chlamydophila pneumoniae J138
auuucuguaguucuugcc

SEQ ID NO: 545154 - RNA, 21 nt, Chlamydophila pneumoniae J138
auuucuuuuugccaauuuuca

SEQ ID NO: 545155 - RNA, 23 nt, Chlamydophila pneumoniae J138
auuucuugagucugaacauucuu

SEQ ID NO: 545156 - RNA, 16 nt, Chlamydophila pneumoniae J138
auuugaacaugaggau

SEQ ID NO: 545157 - RNA, 16 nt, Chlamydophila pneumoniae J138
auuucuuacaagacaa

SEQ ID NO: 545158 - RNA, 15 nt, Chlamydophila pneumoniae J138
auuucuguucugcuu

SEQ ID NO: 545159 - RNA, 11 nt, Chlamydophila pneumoniae J138
auuucuucuuc

SEQ ID NO: 545160 - RNA, 21 nt, Chlamydophila pneumoniae J138
auuucuucaauaggaauuaga

SEQ ID NO: 545161 - RNA, 15 nt, Chlamydophila pneumoniae J138
auuuuaaauuuuguu

SEQ ID NO: 545162 - RNA, 22 nt, Chlamydophila pneumoniae J138
auuuuacuugcgauacaauaaa

SEQ ID NO: 545163 - RNA, 14 nt, Chlamydophila pneumoniae J138
auuuuaauucaaaa

SEQ ID NO: 545164 - RNA, 17 nt, Chlamydophila pneumoniae J138
auuuuaguaagaucgcu

SEQ ID NO: 545165 - RNA, 22 nt, Chlamydophila pneumoniae J138
auuuuagcuccgaggcuucuga

SEQ ID NO: 545166 - RNA, 18 nt, Chlamydophila pneumoniae J138
auuuuagcuucuuuuuuu

SEQ ID NO: 545167 - RNA, 22 nt, Chlamydophila pneumoniae J138
auuuuaggaagcuuaucaagaa

SEQ ID NO: 545168 - RNA, 19 nt, Chlamydophila pneumoniae J138
auuuuagaacuucaaugaa

SEQ ID NO: 545169 - RNA, 22 nt, Chlamydophila pneumoniae J138
auuuuagauacgcuuacaaaua

SEQ ID NO: 545170 - RNA, 22 nt, Chlamydophila pneumoniae J138
auuuuaucugcgacaaaaaugc

SEQ ID NO: 545171 - RNA, 15 nt, Chlamydophila pneumoniae J138
auuuucauagcagcu

SEQ ID NO: 545172 - RNA, 19 nt, Chlamydophila pneumoniae J138
auuuucaugauauuuuuau

SEQ ID NO: 545173 - RNA, 15 nt, Chlamydophila pneumoniae J138
auuuuugaauaugau

SEQ ID NO: 545174 - RNA, 14 nt, Chlamydophila pneumoniae J138
auuuuuccuccucc

SEQ ID NO: 545175 - RNA, 21 nt, Chlamydophila pneumoniae J138
auuuuucgagaauauacagau

SEQ ID NO: 545176 - RNA, 13 nt, Chlamydophila pneumoniae J138
caaaaaaguaacu

SEQ ID NO: 545177 - RNA, 17 nt, Chlamydophila pneumoniae J138
caaaaaagggaucuccu

SEQ ID NO: 545178 - RNA, 14 nt, Chlamydophila pneumoniae J138
auuuuuuccuuaau

SEQ ID NO: 545179 - RNA, 20 nt, Chlamydophila pneumoniae J138
auuuucuagaaacaacugaa

SEQ ID NO: 545180 - RNA, 15 nt, Chlamydophila pneumoniae J138
auuuucuaaagauuu

SEQ ID NO: 545181 - RNA, 22 nt, Chlamydophila pneumoniae J138
auuuuucaagaacuccuuugag

SEQ ID NO: 545182 - RNA, 15 nt, Chlamydophila pneumoniae J138
auuuuucaagaacuc

SEQ ID NO: 545183 - RNA, 13 nt, Chlamydophila pneumoniae J138
auuuuuccagaaa

SEQ ID NO: 545184 - RNA, 14 nt, Chlamydophila pneumoniae J138
auuuuuccagaaau

SEQ ID NO: 545185 - RNA, 14 nt, Chlamydophila pneumoniae J138
auuuuuaaauacag

SEQ ID NO: 545186 - RNA, 15 nt, Chlamydophila pneumoniae J138
auuuuuaaauacaga

SEQ ID NO: 545187 - RNA, 17 nt, Chlamydophila pneumoniae J138
caauggaaauagagaaa

SEQ ID NO: 545188 - RNA, 21 nt, Chlamydophila pneumoniae J138
caaugcuugucgcgacaagac

SEQ ID NO: 545189 - RNA, 17 nt, Chlamydophila pneumoniae J138
caaucugguuaagcacc

SEQ ID NO: 545190 - RNA, 20 nt, Chlamydophila pneumoniae J138
caauguuaaucuaauuuuag

SEQ ID NO: 545191 - RNA, 20 nt, Chlamydophila pneumoniae J138
caauuccgaagaagaaagga

SEQ ID NO: 545192 - RNA, 20 nt, Chlamydophila pneumoniae J138
caauuccuaaaacaagaaga

SEQ ID NO: 545193 - RNA, 15 nt, Chlamydophila pneumoniae J138
caauuccgaagaaga

SEQ ID NO: 545194 - RNA, 17 nt, Chlamydophila pneumoniae J138
caauucuuaaaaagcua

SEQ ID NO: 545195 - RNA, 21 nt, Chlamydophila pneumoniae J138
caauucuuaaaaagcuaaaca

SEQ ID NO: 545196 - RNA, 18 nt, Chlamydophila pneumoniae J138
caauucuguaucgauagu

SEQ ID NO: 545197 - RNA, 15 nt, Chlamydophila pneumoniae J138
caauucuucaugcug

SEQ ID NO: 545198 - RNA, 16 nt, Chlamydophila pneumoniae J138
caauucgguagagcua

SEQ ID NO: 545199 - RNA, 22 nt, Chlamydophila pneumoniae J138
caauuccguacgcuauaaauaa

SEQ ID NO: 545200 - RNA, 17 nt, Chlamydophila pneumoniae J138
caauuccuaaaacaaga

SEQ ID NO: 545201 - RNA, 20 nt, Chlamydophila pneumoniae J138
caauugcucguauuagaguu

SEQ ID NO: 545202 - RNA, 20 nt, Chlamydophila pneumoniae J138
caauugguggagcucauuua

SEQ ID NO: 545203 - RNA, 15 nt, Chlamydophila pneumoniae J138
caauuguaaauacaa

SEQ ID NO: 545204 - RNA, 18 nt, Chlamydophila pneumoniae J138
caauuguaaauacaaaac

SEQ ID NO: 545205 - RNA, 17 nt, Chlamydophila pneumoniae J138
caauuuccugcauggcu

SEQ ID NO: 545206 - RNA, 16 nt, Chlamydophila pneumoniae J138
caauuuggauuuaugu

SEQ ID NO: 545207 - RNA, 13 nt, Chlamydophila pneumoniae J138
caauuugcguugc

SEQ ID NO: 545208 - RNA, 15 nt, Chlamydophila pneumoniae J138
cacaacucauccuaa

SEQ ID NO: 545209 - RNA, 21 nt, Chlamydophila pneumoniae J138
cacaagggauucuuguuggau

SEQ ID NO: 545210 - RNA, 22 nt, Chlamydophila pneumoniae J138
cacaauccucacuauuaauacu

SEQ ID NO: 545211 - RNA, 23 nt, Chlamydophila pneumoniae J138
cacaauauaaaugcuauuuuccu

SEQ ID NO: 545212 - RNA, 19 nt, Chlamydophila pneumoniae J138
cacacgaucuucggaauac

SEQ ID NO: 545213 - RNA, 16 nt, Chlamydophila pneumoniae J138
cacaaucuaaauaaga

SEQ ID NO: 545214 - RNA, 13 nt, Chlamydophila pneumoniae J138
cacaaucgcauca

SEQ ID NO: 545215 - RNA, 19 nt, Chlamydophila pneumoniae J138
cacagauguaaucuugauc

SEQ ID NO: 545216 - RNA, 23 nt, Chlamydophila pneumoniae J138
cacagaucguaaucuguauaugc

SEQ ID NO: 545217 - RNA, 15 nt, Chlamydophila pneumoniae J138
cacagauaggaacca

SEQ ID NO: 545218 - RNA, 15 nt, Chlamydophila pneumoniae J138
cacagaaugauaaga

SEQ ID NO: 545219 - RNA, 20 nt, Chlamydophila pneumoniae J138
cacagaaugauaagaaagcu

SEQ ID NO: 545220 - RNA, 18 nt, Chlamydophila pneumoniae J138
cacagcuaaucauagcca

SEQ ID NO: 545221 - RNA, 17 nt, Chlamydophila pneumoniae J138
cacagcuaaucaaucca

SEQ ID NO: 545222 - RNA, 17 nt, Chlamydophila pneumoniae J138
cacauagaaacagucua

SEQ ID NO: 545223 - RNA, 17 nt, Chlamydophila pneumoniae J138
cacauacaguacgcaaa

SEQ ID NO: 545224 - RNA, 13 nt, Chlamydophila pneumoniae J138
cacauaguuuaau

SEQ ID NO: 545225 - RNA, 17 nt, Chlamydophila pneumoniae J138
cacaucauuaucauaaa

SEQ ID NO: 545226 - RNA, 14 nt, Chlamydophila pneumoniae J138
cacaucaaagcaau

SEQ ID NO: 545227 - RNA, 17 nt, Chlamydophila pneumoniae J138
cacauuaagcaaucccc

SEQ ID NO: 545228 - RNA, 15 nt, Chlamydophila pneumoniae J138
caccaaaagaauacu

SEQ ID NO: 545229 - RNA, 15 nt, Chlamydophila pneumoniae J138
caccaaaaauuccgu

SEQ ID NO: 545230 - RNA, 17 nt, Chlamydophila pneumoniae J138
cacauuccaagaaaaau

SEQ ID NO: 545231 - RNA, 18 nt, Chlamydophila pneumoniae J138
cacauuugcuuuaacaga

SEQ ID NO: 545232 - RNA, 15 nt, Chlamydophila pneumoniae J138
caccaacaacaauaa

SEQ ID NO: 545233 - RNA, 19 nt, Chlamydophila pneumoniae J138
caccacgaacuucagcaag

SEQ ID NO: 545234 - RNA, 13 nt, Chlamydophila pneumoniae J138
aaaauaaaaggag

SEQ ID NO: 545235 - RNA, 14 nt, Chlamydophila pneumoniae J138
aaaauaaaaggagc

SEQ ID NO: 545236 - RNA, 22 nt, Chlamydophila pneumoniae J138
caccuaauaaagaagguugaga

SEQ ID NO: 545237 - RNA, 18 nt, Chlamydophila pneumoniae J138
caccuaaaguuugagcua

SEQ ID NO: 545238 - RNA, 12 nt, Chlamydophila pneumoniae J138
aaaauaaacucu

SEQ ID NO: 545239 - RNA, 14 nt, Chlamydophila pneumoniae J138
aaaauaaauuuuau

SEQ ID NO: 545240 - RNA, 17 nt, Chlamydophila pneumoniae J138
cacgaauuucuaacuua

SEQ ID NO: 545241 - RNA, 13 nt, Chlamydophila pneumoniae J138
aaaauagauaagu

SEQ ID NO: 545242 - RNA, 13 nt, Chlamydophila pneumoniae J138
aaaauagacauuc

SEQ ID NO: 545243 - RNA, 23 nt, Chlamydophila pneumoniae J138
aaaauagaaauaagcaucuagaa

SEQ ID NO: 545244 - RNA, 17 nt, Chlamydophila pneumoniae J138
cacgaggccauccuuuu

SEQ ID NO: 545245 - RNA, 17 nt, Chlamydophila pneumoniae J138
cacgaucuucggaauac

SEQ ID NO: 545246 - RNA, 23 nt, Chlamydophila pneumoniae J138
aaaauacauagguaaaaccagca

SEQ ID NO: 545247 - RNA, 18 nt, Chlamydophila pneumoniae J138
aaaauaauuuuauuaguu

SEQ ID NO: 545248 - RNA, 15 nt, Chlamydophila pneumoniae J138
caccuuacauccaau

SEQ ID NO: 545249 - RNA, 14 nt, Chlamydophila pneumoniae J138
caccuuacauccaa

SEQ ID NO: 545250 - RNA, 19 nt, Chlamydophila pneumoniae J138
cacgccuccuucaaagaua

SEQ ID NO: 545251 - RNA, 23 nt, Chlamydophila pneumoniae J138
cacgcucacgagucccuucuuuc

SEQ ID NO: 545252 - RNA, 13 nt, Chlamydophila pneumoniae J138
cacggauucuaaa

SEQ ID NO: 545253 - RNA, 17 nt, Chlamydophila pneumoniae J138
cacggauuuucucuaca

SEQ ID NO: 545254 - RNA, 16 nt, Chlamydophila pneumoniae J138
caauacagauguaaau

SEQ ID NO: 545255 - RNA, 17 nt, Chlamydophila pneumoniae J138
caauacagauguaaaug

SEQ ID NO: 545256 - RNA, 21 nt, Chlamydophila pneumoniae J138
caauaagcuugccagcagaag

SEQ ID NO: 545257 - RNA, 19 nt, Chlamydophila pneumoniae J138
caauaagcuugccagcaga

SEQ ID NO: 545258 - RNA, 20 nt, Chlamydophila pneumoniae J138
caauaagcuugccagcagaa

SEQ ID NO: 545259 - RNA, 18 nt, Chlamydophila pneumoniae J138
caauaagcuugccagcag

SEQ ID NO: 545260 - RNA, 19 nt, Chlamydophila pneumoniae J138
caauaauaacgcuccaaug

SEQ ID NO: 545261 - RNA, 23 nt, Chlamydophila pneumoniae J138
caauaaaaggguagcgaaugaaa

SEQ ID NO: 545262 - RNA, 23 nt, Chlamydophila pneumoniae J138
caauaaaaggcuauuguguuuuu

SEQ ID NO: 545263 - RNA, 22 nt, Chlamydophila pneumoniae J138
caauaaacgagacugcaaagga

SEQ ID NO: 545264 - RNA, 16 nt, Chlamydophila pneumoniae J138
caaguuuuuucaaucc

SEQ ID NO: 545265 - RNA, 13 nt, Chlamydophila pneumoniae J138
caaguuucuuuug

SEQ ID NO: 545266 - RNA, 20 nt, Chlamydophila pneumoniae J138
caaguucaucaaauaaggcu

SEQ ID NO: 545267 - RNA, 19 nt, Chlamydophila pneumoniae J138
caaggagucacuggcauca

SEQ ID NO: 545268 - RNA, 21 nt, Chlamydophila pneumoniae J138
caaggaguccaugcuaaaacu

SEQ ID NO: 545269 - RNA, 17 nt, Chlamydophila pneumoniae J138
caaggauuaugaauccu

SEQ ID NO: 545270 - RNA, 21 nt, Chlamydophila pneumoniae J138
caaggcaaaaaguugaggaaa

SEQ ID NO: 545271 - RNA, 17 nt, Chlamydophila pneumoniae J138
caaguaugguccauaau

SEQ ID NO: 545272 - RNA, 15 nt, Chlamydophila pneumoniae J138
caaguguguauugua

SEQ ID NO: 545273 - RNA, 18 nt, Chlamydophila pneumoniae J138
caagugcucaguaaauau

SEQ ID NO: 545274 - RNA, 21 nt, Chlamydophila pneumoniae J138
caauauagagaacuccauuca

SEQ ID NO: 545275 - RNA, 14 nt, Chlamydophila pneumoniae J138
caauauagaaaucg

SEQ ID NO: 545276 - RNA, 17 nt, Chlamydophila pneumoniae J138
caauacuaaaacuacaa

SEQ ID NO: 545277 - RNA, 20 nt, Chlamydophila pneumoniae J138
caauacgccgggccacuuca

SEQ ID NO: 545278 - RNA, 15 nt, Chlamydophila pneumoniae J138
caaucacacuacauu

SEQ ID NO: 545279 - RNA, 18 nt, Chlamydophila pneumoniae J138
caaucaacauucuucugu

SEQ ID NO: 545280 - RNA, 18 nt, Chlamydophila pneumoniae J138
caauccaacaaagaugac

SEQ ID NO: 545281 - RNA, 13 nt, Chlamydophila pneumoniae J138
caaucagugcugc

SEQ ID NO: 545282 - RNA, 19 nt, Chlamydophila pneumoniae J138
caauccaguagaucuucug

SEQ ID NO: 545283 - RNA, 21 nt, Chlamydophila pneumoniae J138
caaucuaaaaucacacuaaau

SEQ ID NO: 545284 - RNA, 14 nt, Chlamydophila pneumoniae J138
caaucuaaauaaga

SEQ ID NO: 545285 - RNA, 16 nt, Chlamydophila pneumoniae J138
caaucugcugaaggga

SEQ ID NO: 545286 - RNA, 13 nt, Chlamydophila pneumoniae J138
caaucuaaaauca

SEQ ID NO: 545287 - RNA, 19 nt, Chlamydophila pneumoniae J138
caauccccugcaucucugc

SEQ ID NO: 545288 - RNA, 13 nt, Chlamydophila pneumoniae J138
caauccuuccuua

SEQ ID NO: 545289 - RNA, 19 nt, Chlamydophila pneumoniae J138
caacgcuucuuuuuggaua

SEQ ID NO: 545290 - RNA, 13 nt, Chlamydophila pneumoniae J138
caacggacauuuu

SEQ ID NO: 545291 - RNA, 13 nt, Chlamydophila pneumoniae J138
caacgcuucuuuu

SEQ ID NO: 545292 - RNA, 23 nt, Chlamydophila pneumoniae J138
caaccuagaaucacauaaaauaa

SEQ ID NO: 545293 - RNA, 22 nt, Chlamydophila pneumoniae J138
caacgguguucauaaucagaac

SEQ ID NO: 545294 - RNA, 15 nt, Chlamydophila pneumoniae J138
caacucguuucagca

SEQ ID NO: 545295 - RNA, 20 nt, Chlamydophila pneumoniae J138
caacucuacaagugucugag

SEQ ID NO: 545296 - RNA, 21 nt, Chlamydophila pneumoniae J138
caacucauccuaaauuaaaua

SEQ ID NO: 545297 - RNA, 13 nt, Chlamydophila pneumoniae J138
caacucuccaucc

SEQ ID NO: 545298 - RNA, 23 nt, Chlamydophila pneumoniae J138
caacucucuuuaaaccuggcauu

SEQ ID NO: 545299 - RNA, 15 nt, Chlamydophila pneumoniae J138
caacucuucagcagg

SEQ ID NO: 545300 - RNA, 14 nt, Chlamydophila pneumoniae J138
caacucuuuaauug

SEQ ID NO: 545301 - RNA, 13 nt, Chlamydophila pneumoniae J138
caacucuuuaauu

SEQ ID NO: 545302 - RNA, 21 nt, Chlamydophila pneumoniae J138
caagaauagcaggaaggaaua

SEQ ID NO: 545303 - RNA, 21 nt, Chlamydophila pneumoniae J138
caagaauagccauaauuagaa

SEQ ID NO: 545304 - RNA, 18 nt, Chlamydophila pneumoniae J138
caagaaucacugcgugau

SEQ ID NO: 545305 - RNA, 19 nt, Chlamydophila pneumoniae J138
caagaauccgaucauaauu

SEQ ID NO: 545306 - RNA, 16 nt, Chlamydophila pneumoniae J138
caagacaauaaaaaag

SEQ ID NO: 545307 - RNA, 15 nt, Chlamydophila pneumoniae J138
caagacaauaaaaaa

SEQ ID NO: 545308 - RNA, 13 nt, Chlamydophila pneumoniae J138
caagacaaaguug

SEQ ID NO: 545309 - RNA, 24 nt, Chlamydophila pneumoniae J138
caagaauuucuucuuuccauagau

SEQ ID NO: 545310 - RNA, 20 nt, Chlamydophila pneumoniae J138
caagacaaaaaagggaucuc

SEQ ID NO: 545311 - RNA, 17 nt, Chlamydophila pneumoniae J138
caagaauuucuucuuuc

SEQ ID NO: 545312 - RNA, 14 nt, Chlamydophila pneumoniae J138
caagaucaaacgaa

SEQ ID NO: 545313 - RNA, 20 nt, Chlamydophila pneumoniae J138
caagauacuacuuacaagaa

SEQ ID NO: 545314 - RNA, 18 nt, Chlamydophila pneumoniae J138
caagagacaagaaaauau

SEQ ID NO: 545315 - RNA, 21 nt, Chlamydophila pneumoniae J138
caagagacaagaaaauaucac

SEQ ID NO: 545316 - RNA, 16 nt, Chlamydophila pneumoniae J138
caagagacaagaaaau

SEQ ID NO: 545317 - RNA, 22 nt, Chlamydophila pneumoniae J138
caagaguuucgaauucaaugag

SEQ ID NO: 545318 - RNA, 21 nt, Chlamydophila pneumoniae J138
caagaccacuuaggguucuca

SEQ ID NO: 545319 - RNA, 14 nt, Chlamydophila pneumoniae J138
caagcucaagagca

SEQ ID NO: 545320 - RNA, 14 nt, Chlamydophila pneumoniae J138
caagaucuccgccu

SEQ ID NO: 545321 - RNA, 16 nt, Chlamydophila pneumoniae J138
caagauggcaacaacu

SEQ ID NO: 545322 - RNA, 23 nt, Chlamydophila pneumoniae J138
caagcaguaacugcaaagagaau

SEQ ID NO: 545323 - RNA, 16 nt, Chlamydophila pneumoniae J138
caagcaguaacugcaa

SEQ ID NO: 545324 - RNA, 22 nt, Chlamydophila pneumoniae J138
caagcaggugugugguaaaaau

SEQ ID NO: 545325 - RNA, 22 nt, Chlamydophila pneumoniae J138
caagcauccuagaacuugggau

SEQ ID NO: 545326 - RNA, 23 nt, Chlamydophila pneumoniae J138
caaauuuaucggcuaaagaaaag

SEQ ID NO: 545327 - RNA, 19 nt, Chlamydophila pneumoniae J138
caaauuuaucggcuaaaga

SEQ ID NO: 545328 - RNA, 17 nt, Chlamydophila pneumoniae J138
caaauuucuucuggaua

SEQ ID NO: 545329 - RNA, 13 nt, Chlamydophila pneumoniae J138
caaauguucucuc

SEQ ID NO: 545330 - RNA, 18 nt, Chlamydophila pneumoniae J138
caaauuccuucucagaaa

SEQ ID NO: 545331 - RNA, 13 nt, Chlamydophila pneumoniae J138
caaauucauuaag

SEQ ID NO: 545332 - RNA, 21 nt, Chlamydophila pneumoniae J138
caaaucucauuccagcaucuu

SEQ ID NO: 545333 - RNA, 22 nt, Chlamydophila pneumoniae J138
caaauguucucuccagcugugg

SEQ ID NO: 545334 - RNA, 22 nt, Chlamydophila pneumoniae J138
caaaguaggauugauaaauuug

SEQ ID NO: 545335 - RNA, 21 nt, Chlamydophila pneumoniae J138
caaaucaucgcaaucaaagag

SEQ ID NO: 545336 - RNA, 21 nt, Chlamydophila pneumoniae J138
caaaucauuuaaagcugaaau

SEQ ID NO: 545337 - RNA, 18 nt, Chlamydophila pneumoniae J138
caacaugcgcguauaagg

SEQ ID NO: 545338 - RNA, 20 nt, Chlamydophila pneumoniae J138
caacauugaguugguuuugu

SEQ ID NO: 545339 - RNA, 18 nt, Chlamydophila pneumoniae J138
caaccaucccauauggau

SEQ ID NO: 545340 - RNA, 19 nt, Chlamydophila pneumoniae J138
caacccuauuuaaggacgu

SEQ ID NO: 545341 - RNA, 21 nt, Chlamydophila pneumoniae J138
caacaaaggcuccaaacgcaa

SEQ ID NO: 545342 - RNA, 13 nt, Chlamydophila pneumoniae J138
caacauaaagaag

SEQ ID NO: 545343 - RNA, 13 nt, Chlamydophila pneumoniae J138
caacauaacauga

SEQ ID NO: 545344 - RNA, 22 nt, Chlamydophila pneumoniae J138
caacaguguagccuuucuuuuu

SEQ ID NO: 545345 - RNA, 15 nt, Chlamydophila pneumoniae J138
caacaguaauuauuu

SEQ ID NO: 545346 - RNA, 18 nt, Chlamydophila pneumoniae J138
caaacggaacuaaagaga

SEQ ID NO: 545347 - RNA, 20 nt, Chlamydophila pneumoniae J138
caaacgaauuucuuguucca

SEQ ID NO: 545348 - RNA, 21 nt, Chlamydophila pneumoniae J138
caaacuuucuuuucuauauuc

SEQ ID NO: 545349 - RNA, 23 nt, Chlamydophila pneumoniae J138
caaacuuguuuucguaagagaau

SEQ ID NO: 545350 - RNA, 18 nt, Chlamydophila pneumoniae J138
caaacuuguuuucguaag

SEQ ID NO: 545351 - RNA, 21 nt, Chlamydophila pneumoniae J138
caaacuuggucauuauaguag

SEQ ID NO: 545352 - RNA, 13 nt, Chlamydophila pneumoniae J138
caaacaagaagcg

SEQ ID NO: 545353 - RNA, 14 nt, Chlamydophila pneumoniae J138
caaacauuuuuaag

SEQ ID NO: 545354 - RNA, 16 nt, Chlamydophila pneumoniae J138
caaacauuuuuaagga

SEQ ID NO: 545355 - RNA, 21 nt, Chlamydophila pneumoniae J138
caaaccacggauuuucucuac

SEQ ID NO: 545356 - RNA, 20 nt, Chlamydophila pneumoniae J138
caaaccacggauuuucucua

SEQ ID NO: 545357 - RNA, 23 nt, Chlamydophila pneumoniae J138
caaaccagguagagugucuuccu

SEQ ID NO: 545358 - RNA, 13 nt, Chlamydophila pneumoniae J138
caaaccucuaaaa

SEQ ID NO: 545359 - RNA, 14 nt, Chlamydophila pneumoniae J138
caaaccucuaaaaa

SEQ ID NO: 545360 - RNA, 14 nt, Chlamydophila pneumoniae J138
caaagacucaugaa

SEQ ID NO: 545361 - RNA, 16 nt, Chlamydophila pneumoniae J138
caaagacugagcuucu

SEQ ID NO: 545362 - RNA, 11 nt, Chlamydophila pneumoniae J138
caaagaucagu

SEQ ID NO: 545363 - RNA, 13 nt, Chlamydophila pneumoniae J138
caaagauuccuaa

SEQ ID NO: 545364 - RNA, 16 nt, Chlamydophila pneumoniae J138
caaagaugcgcucgga

SEQ ID NO: 545365 - RNA, 17 nt, Chlamydophila pneumoniae J138
caaagacaucuccugca

SEQ ID NO: 545366 - RNA, 19 nt, Chlamydophila pneumoniae J138
caaagaaaauucucagauu

SEQ ID NO: 545367 - RNA, 21 nt, Chlamydophila pneumoniae J138
caaagaacuuaaaauucaaau

SEQ ID NO: 545368 - RNA, 17 nt, Chlamydophila pneumoniae J138
caaagaacucaacuuuu

SEQ ID NO: 545369 - RNA, 13 nt, Chlamydophila pneumoniae J138
caaagacaggcuc

SEQ ID NO: 545370 - RNA, 20 nt, Chlamydophila pneumoniae J138
caaagacaggcucaugaaau

SEQ ID NO: 545371 - RNA, 23 nt, Chlamydophila pneumoniae J138
caaagacaggcucaugaaauuuc

SEQ ID NO: 545372 - RNA, 19 nt, Chlamydophila pneumoniae J138
caaaggaccacaauuccua

SEQ ID NO: 545373 - RNA, 19 nt, Chlamydophila pneumoniae J138
caaaggagaaagaauugua

SEQ ID NO: 545374 - RNA, 14 nt, Chlamydophila pneumoniae J138
caaaggagaaagaa

SEQ ID NO: 545375 - RNA, 20 nt, Chlamydophila pneumoniae J138
caaagccggcccacucaaaa

SEQ ID NO: 545376 - RNA, 17 nt, Chlamydophila pneumoniae J138
caaagccggcccacuca

SEQ ID NO: 545377 - RNA, 20 nt, Chlamydophila pneumoniae J138
caaagauuucugcuguguua

SEQ ID NO: 545378 - RNA, 12 nt, Chlamydophila pneumoniae J138
caaagauuccua

SEQ ID NO: 545379 - RNA, 14 nt, Chlamydophila pneumoniae J138
caaagcaaagagca

SEQ ID NO: 545380 - RNA, 15 nt, Chlamydophila pneumoniae J138
caaagcaaagagcaa

SEQ ID NO: 545381 - RNA, 12 nt, Chlamydophila pneumoniae J138
caaagcaaagag

SEQ ID NO: 545382 - RNA, 21 nt, Chlamydophila pneumoniae J138
caaaagaauuccuaaaacgag

SEQ ID NO: 545383 - RNA, 15 nt, Chlamydophila pneumoniae J138
caaaagaauuaagaa

SEQ ID NO: 545384 - RNA, 22 nt, Chlamydophila pneumoniae J138
caaaaccuggauugauccacag

SEQ ID NO: 545385 - RNA, 21 nt, Chlamydophila pneumoniae J138
caaaacgauccuguuccccug

SEQ ID NO: 545386 - RNA, 15 nt, Chlamydophila pneumoniae J138
caaaaaauuuuauag

SEQ ID NO: 545387 - RNA, 20 nt, Chlamydophila pneumoniae J138
caaaaggcacagcaaugaca

SEQ ID NO: 545388 - RNA, 18 nt, Chlamydophila pneumoniae J138
caaaagcucuacaagcuc

SEQ ID NO: 545389 - RNA, 18 nt, Chlamydophila pneumoniae J138
caaaagccauuccauauc

SEQ ID NO: 545390 - RNA, 15 nt, Chlamydophila pneumoniae J138
caaaagguuuuauaa

SEQ ID NO: 545391 - RNA, 16 nt, Chlamydophila pneumoniae J138
caaaagucaugaggac

SEQ ID NO: 545392 - RNA, 18 nt, Chlamydophila pneumoniae J138
caaaagucaugaggacug

SEQ ID NO: 545393 - RNA, 22 nt, Chlamydophila pneumoniae J138
caaaauguuuaucgacucuucc

SEQ ID NO: 545394 - RNA, 22 nt, Chlamydophila pneumoniae J138
caaaaugucuuuuucaauugcu

SEQ ID NO: 545395 - RNA, 17 nt, Chlamydophila pneumoniae J138
aucaugagaauuuucau

SEQ ID NO: 545396 - RNA, 15 nt, Chlamydophila pneumoniae J138
aucaugauaaaaauu

SEQ ID NO: 545397 - RNA, 10 nt, Chlamydophila pneumoniae J138
aucaucuccc

SEQ ID NO: 545398 - RNA, 19 nt, Chlamydophila pneumoniae J138
aucaucucccaaauagcua

SEQ ID NO: 545399 - RNA, 16 nt, Chlamydophila pneumoniae J138
aucauaccgacaagca

SEQ ID NO: 545400 - RNA, 13 nt, Chlamydophila pneumoniae J138
aucauaccgacaa

SEQ ID NO: 545401 - RNA, 19 nt, Chlamydophila pneumoniae J138
aaaacuccacgccaaagua

SEQ ID NO: 545402 - RNA, 21 nt, Chlamydophila pneumoniae J138
aaaacucaaggaguuuuaacu

SEQ ID NO: 545403 - RNA, 20 nt, Chlamydophila pneumoniae J138
aaaacuauaaaagccagggc

SEQ ID NO: 545404 - RNA, 20 nt, Chlamydophila pneumoniae J138
aucauggacaagcaaaagca

SEQ ID NO: 545405 - RNA, 21 nt, Chlamydophila pneumoniae J138
aucauggucccuauagaacau

SEQ ID NO: 545406 - RNA, 14 nt, Chlamydophila pneumoniae J138
aucauguagcagag

SEQ ID NO: 545407 - RNA, 21 nt, Chlamydophila pneumoniae J138
aaaacuccgcacuugcucuuu

SEQ ID NO: 545408 - RNA, 16 nt, Chlamydophila pneumoniae J138
aaaacugcaaaaagau

SEQ ID NO: 545409 - RNA, 19 nt, Chlamydophila pneumoniae J138
aaaacugcgcuaucaucau

SEQ ID NO: 545410 - RNA, 23 nt, Chlamydophila pneumoniae J138
aaaagaaccuaggaaauccuccu

SEQ ID NO: 545411 - RNA, 11 nt, Chlamydophila pneumoniae J138
aucauucuuua

SEQ ID NO: 545412 - RNA, 14 nt, Chlamydophila pneumoniae J138
aaaagaaucucuga

SEQ ID NO: 545413 - RNA, 13 nt, Chlamydophila pneumoniae J138
auccacagauacg

SEQ ID NO: 545414 - RNA, 23 nt, Chlamydophila pneumoniae J138
auccacagacugcaggaaauuau

SEQ ID NO: 545415 - RNA, 14 nt, Chlamydophila pneumoniae J138
auccacauccuugu

SEQ ID NO: 545416 - RNA, 15 nt, Chlamydophila pneumoniae J138
auccaacaaagauga

SEQ ID NO: 545417 - RNA, 19 nt, Chlamydophila pneumoniae J138
auccaaagccugaaaaaua

SEQ ID NO: 545418 - RNA, 13 nt, Chlamydophila pneumoniae J138
auccaaagccuga

SEQ ID NO: 545419 - RNA, 18 nt, Chlamydophila pneumoniae J138
auccaaacgguuaaugaa

SEQ ID NO: 545420 - RNA, 13 nt, Chlamydophila pneumoniae J138
auccagcucaagg

SEQ ID NO: 545421 - RNA, 17 nt, Chlamydophila pneumoniae J138
auccagcaacaaccaaa

SEQ ID NO: 545422 - RNA, 20 nt, Chlamydophila pneumoniae J138
auccagcaacaaccaaaaga

SEQ ID NO: 545423 - RNA, 20 nt, Chlamydophila pneumoniae J138
auccagauuguucaaaaaua

SEQ ID NO: 545424 - RNA, 19 nt, Chlamydophila pneumoniae J138
auccaguagaucuucugaa

SEQ ID NO: 545425 - RNA, 16 nt, Chlamydophila pneumoniae J138
aucccacagaaauguc

SEQ ID NO: 545426 - RNA, 17 nt, Chlamydophila pneumoniae J138
auccccaccaacaaugc

SEQ ID NO: 545427 - RNA, 23 nt, Chlamydophila pneumoniae J138
aucccaagggagaggucugcucu

SEQ ID NO: 545428 - RNA, 15 nt, Chlamydophila pneumoniae J138
aucccaaacuucuuc

SEQ ID NO: 545429 - RNA, 22 nt, Chlamydophila pneumoniae J138
auccguagugagguuugcaauu

SEQ ID NO: 545430 - RNA, 17 nt, Chlamydophila pneumoniae J138
auccuaaauuaaauauc

SEQ ID NO: 545431 - RNA, 22 nt, Chlamydophila pneumoniae J138
auccuagagaaugugcucggca

SEQ ID NO: 545432 - RNA, 18 nt, Chlamydophila pneumoniae J138
auccuaagagauuuucca

SEQ ID NO: 545433 - RNA, 18 nt, Chlamydophila pneumoniae J138
auccucaggaccuaaggg

SEQ ID NO: 545434 - RNA, 15 nt, Chlamydophila pneumoniae J138
auccucacuagagau

SEQ ID NO: 545435 - RNA, 15 nt, Chlamydophila pneumoniae J138
auccuccgccuguca

SEQ ID NO: 545436 - RNA, 22 nt, Chlamydophila pneumoniae J138
auccuccuagguucuuuuuuug

SEQ ID NO: 545437 - RNA, 23 nt, Chlamydophila pneumoniae J138
auccucugcugcgacacgaauuu

SEQ ID NO: 545438 - RNA, 19 nt, Chlamydophila pneumoniae J138
auccucggcaucuuuggca

SEQ ID NO: 545439 - RNA, 17 nt, Chlamydophila pneumoniae J138
auccugaaaguacagaa

SEQ ID NO: 545440 - RNA, 22 nt, Chlamydophila pneumoniae J138
auccugaacaucuccagcagca

SEQ ID NO: 545441 - RNA, 19 nt, Chlamydophila pneumoniae J138
auccugcaaagcccccucc

SEQ ID NO: 545442 - RNA, 23 nt, Chlamydophila pneumoniae J138
auccugcaaagcccccuccccca

SEQ ID NO: 545443 - RNA, 18 nt, Chlamydophila pneumoniae J138
auccugaguaaaaucaua

SEQ ID NO: 545444 - RNA, 21 nt, Chlamydophila pneumoniae J138
auccuuaucuugcugcccaaa

SEQ ID NO: 545445 - RNA, 20 nt, Chlamydophila pneumoniae J138
auccuuccaagugcucagua

SEQ ID NO: 545446 - RNA, 21 nt, Chlamydophila pneumoniae J138
auccuucacucguugccaauc

SEQ ID NO: 545447 - RNA, 18 nt, Chlamydophila pneumoniae J138
auccuuucacaaagaauu

SEQ ID NO: 545448 - RNA, 17 nt, Chlamydophila pneumoniae J138
auccuuucacaaagaau

SEQ ID NO: 545449 - RNA, 16 nt, Chlamydophila pneumoniae J138
auccuuucacaaagaa

SEQ ID NO: 545450 - RNA, 19 nt, Chlamydophila pneumoniae J138
auccuuucacaaagaauuc

SEQ ID NO: 545451 - RNA, 15 nt, Chlamydophila pneumoniae J138
auccuuuggaagcua

SEQ ID NO: 545452 - RNA, 20 nt, Chlamydophila pneumoniae J138
auccuuuggaagcuaucauu

SEQ ID NO: 545453 - RNA, 19 nt, Chlamydophila pneumoniae J138
auccuuuuuguaguaagau

SEQ ID NO: 545454 - RNA, 20 nt, Chlamydophila pneumoniae J138
aucgagcucuuuaagaacuu

SEQ ID NO: 545455 - RNA, 14 nt, Chlamydophila pneumoniae J138
aucgaucucugugg

SEQ ID NO: 545456 - RNA, 23 nt, Chlamydophila pneumoniae J138
aucgaucucugugguuccuggau

SEQ ID NO: 545457 - RNA, 20 nt, Chlamydophila pneumoniae J138
aucgcaucaaaaaauacaua

SEQ ID NO: 545458 - RNA, 12 nt, Chlamydophila pneumoniae J138
aucgcaucaaaa

SEQ ID NO: 545459 - RNA, 15 nt, Chlamydophila pneumoniae J138
aucgcaaauuuccau

SEQ ID NO: 545460 - RNA, 20 nt, Chlamydophila pneumoniae J138
aucgcaaucagcaacaucgu

SEQ ID NO: 545461 - RNA, 15 nt, Chlamydophila pneumoniae J138
aucgcaaucaaagag

SEQ ID NO: 545462 - RNA, 18 nt, Chlamydophila pneumoniae J138
aucgccuuccuuaacaac

SEQ ID NO: 545463 - RNA, 20 nt, Chlamydophila pneumoniae J138
aucgccgcuugaggaggauu

SEQ ID NO: 545464 - RNA, 15 nt, Chlamydophila pneumoniae J138
aucgcccaauuuuua

SEQ ID NO: 545465 - RNA, 12 nt, Chlamydophila pneumoniae J138
aucggauuuuac

SEQ ID NO: 545466 - RNA, 20 nt, Chlamydophila pneumoniae J138
aucggauuuuacucccugaa

SEQ ID NO: 545467 - RNA, 20 nt, Chlamydophila pneumoniae J138
aucggaucuuuucuuucuaa

SEQ ID NO: 545468 - RNA, 20 nt, Chlamydophila pneumoniae J138
aucgugauugcugucagaac

SEQ ID NO: 545469 - RNA, 21 nt, Chlamydophila pneumoniae J138
aucguguuuuccugagcuuuu

SEQ ID NO: 545470 - RNA, 15 nt, Chlamydophila pneumoniae J138
aucguuaucaaaagg

SEQ ID NO: 545471 - RNA, 20 nt, Chlamydophila pneumoniae J138
aucguuuuguggcuuuucua

SEQ ID NO: 545472 - RNA, 20 nt, Chlamydophila pneumoniae J138
aucuaaaaacuucccaucuu

SEQ ID NO: 545473 - RNA, 19 nt, Chlamydophila pneumoniae J138
aucuaaccaaccuuguuga

SEQ ID NO: 545474 - RNA, 16 nt, Chlamydophila pneumoniae J138
aucuaacgucagcugu

SEQ ID NO: 545475 - RNA, 20 nt, Chlamydophila pneumoniae J138
aucuaaagguuuuaaauuua

SEQ ID NO: 545476 - RNA, 17 nt, Chlamydophila pneumoniae J138
aucuaaauaagauuuua

SEQ ID NO: 545477 - RNA, 14 nt, Chlamydophila pneumoniae J138
aucuaaaggaagau

SEQ ID NO: 545478 - RNA, 13 nt, Chlamydophila pneumoniae J138
aucuaaaaucaca

SEQ ID NO: 545479 - RNA, 23 nt, Chlamydophila pneumoniae J138
aucuaagaugguuauuauugcuu

SEQ ID NO: 545480 - RNA, 18 nt, Chlamydophila pneumoniae J138
aucuaagaugguuauuau

SEQ ID NO: 545481 - RNA, 15 nt, Chlamydophila pneumoniae J138
aucuaagaauaugga

SEQ ID NO: 545482 - RNA, 21 nt, Chlamydophila pneumoniae J138
aucuacauauucguguaaauc

SEQ ID NO: 545483 - RNA, 17 nt, Chlamydophila pneumoniae J138
aucuaccgugaagauuu

SEQ ID NO: 545484 - RNA, 21 nt, Chlamydophila pneumoniae J138
aucugcaauuccgaagaagaa

SEQ ID NO: 545485 - RNA, 17 nt, Chlamydophila pneumoniae J138
aucugcauaauuuuucu

SEQ ID NO: 545486 - RNA, 19 nt, Chlamydophila pneumoniae J138
aucugcagguaagggaugc

SEQ ID NO: 545487 - RNA, 21 nt, Chlamydophila pneumoniae J138
aucugaugcaccauaauauaa

SEQ ID NO: 545488 - RNA, 19 nt, Chlamydophila pneumoniae J138
aucugagcauaacuugaag

SEQ ID NO: 545489 - RNA, 21 nt, Chlamydophila pneumoniae J138
aucugagcauaacuugaagaa

SEQ ID NO: 545490 - RNA, 17 nt, Chlamydophila pneumoniae J138
aucucuucuguaggaac

SEQ ID NO: 545491 - RNA, 22 nt, Chlamydophila pneumoniae J138
aucucguagcucaggaaaacuu

SEQ ID NO: 545492 - RNA, 22 nt, Chlamydophila pneumoniae J138
aucucguagcuauuuuugagga

SEQ ID NO: 545493 - RNA, 20 nt, Chlamydophila pneumoniae J138
aucucguacguggaaaguag

SEQ ID NO: 545494 - RNA, 18 nt, Chlamydophila pneumoniae J138
aucucgggagaacaugcc

SEQ ID NO: 545495 - RNA, 15 nt, Chlamydophila pneumoniae J138
aucucuaguucuaga

SEQ ID NO: 545496 - RNA, 24 nt, Chlamydophila pneumoniae J138
aucucuaccgaacagagcgucuau

SEQ ID NO: 545497 - RNA, 13 nt, Chlamydophila pneumoniae J138
aucucuccagcuu

SEQ ID NO: 545498 - RNA, 22 nt, Chlamydophila pneumoniae J138
aucucugugccaucuguagacc

SEQ ID NO: 545499 - RNA, 23 nt, Chlamydophila pneumoniae J138
aucucuagggauaauuaaacucu

SEQ ID NO: 545500 - RNA, 20 nt, Chlamydophila pneumoniae J138
aucuccgauagagauucuuu

SEQ ID NO: 545501 - RNA, 22 nt, Chlamydophila pneumoniae J138
aucuccgcauggcguaaugcuc

SEQ ID NO: 545502 - RNA, 21 nt, Chlamydophila pneumoniae J138
aucucaagaguaggcaauaca

SEQ ID NO: 545503 - RNA, 13 nt, Chlamydophila pneumoniae J138
aucucaaaaucaa

SEQ ID NO: 545504 - RNA, 16 nt, Chlamydophila pneumoniae J138
aucucaaaaucaaaua

SEQ ID NO: 545505 - RNA, 11 nt, Chlamydophila pneumoniae J138
aucuucucuau

SEQ ID NO: 545506 - RNA, 16 nt, Chlamydophila pneumoniae J138
aucuucugaaaucaaa

SEQ ID NO: 545507 - RNA, 17 nt, Chlamydophila pneumoniae J138
aucuucucuuaugaagu

SEQ ID NO: 545508 - RNA, 13 nt, Chlamydophila pneumoniae J138
aucuucugaaauc

SEQ ID NO: 545509 - RNA, 15 nt, Chlamydophila pneumoniae J138
aucuugaacagagac

SEQ ID NO: 545510 - RNA, 23 nt, Chlamydophila pneumoniae J138
aucuugaacagagacuuccucuu

SEQ ID NO: 545511 - RNA, 13 nt, Chlamydophila pneumoniae J138
aucuugaaaagau

SEQ ID NO: 545512 - RNA, 15 nt, Chlamydophila pneumoniae J138
aucuucuuugccaau

SEQ ID NO: 545513 - RNA, 16 nt, Chlamydophila pneumoniae J138
aucuugagaaaagaac

SEQ ID NO: 545514 - RNA, 13 nt, Chlamydophila pneumoniae J138
aucuugaacagag

SEQ ID NO: 545515 - RNA, 21 nt, Chlamydophila pneumoniae J138
aucuucuuagccaaaauuucc

SEQ ID NO: 545516 - RNA, 19 nt, Chlamydophila pneumoniae J138
aucuucuuagccaaaauuu

SEQ ID NO: 545517 - RNA, 19 nt, Chlamydophila pneumoniae J138
aucuucuggguucuccaca

SEQ ID NO: 545518 - RNA, 22 nt, Chlamydophila pneumoniae J138
aucuucuucuggcugagagaag

SEQ ID NO: 545519 - RNA, 15 nt, Chlamydophila pneumoniae J138
aucuugauuaggaac

SEQ ID NO: 545520 - RNA, 14 nt, Chlamydophila pneumoniae J138
aucuugauaaaaga

SEQ ID NO: 545521 - RNA, 19 nt, Chlamydophila pneumoniae J138
aucuugagccacuuuuaau

SEQ ID NO: 545522 - RNA, 23 nt, Chlamydophila pneumoniae J138
aucuugcugcccaaauugagaaa

SEQ ID NO: 545523 - RNA, 17 nt, Chlamydophila pneumoniae J138
aucuuuaaauucgccaa

SEQ ID NO: 545524 - RNA, 18 nt, Chlamydophila pneumoniae J138
aucuuuaaauucgccaaa

SEQ ID NO: 545525 - RNA, 17 nt, Chlamydophila pneumoniae J138
aucuuuaagauuuuuag

SEQ ID NO: 545526 - RNA, 21 nt, Chlamydophila pneumoniae J138
aucuuuaagauuuuuagaaua

SEQ ID NO: 545527 - RNA, 14 nt, Chlamydophila pneumoniae J138
aucuuuagaaucaa

SEQ ID NO: 545528 - RNA, 19 nt, Chlamydophila pneumoniae J138
aucuuuaguuuaccugaaa

SEQ ID NO: 545529 - RNA, 19 nt, Chlamydophila pneumoniae J138
aucuuguaaguuacggaac

SEQ ID NO: 545530 - RNA, 12 nt, Chlamydophila pneumoniae J138
aucuuuuuuaaa

SEQ ID NO: 545531 - RNA, 14 nt, Chlamydophila pneumoniae J138
aucuuuuuuaaagc

SEQ ID NO: 545532 - RNA, 16 nt, Chlamydophila pneumoniae J138
aucuuuuuuaaagcua

SEQ ID NO: 545533 - RNA, 22 nt, Chlamydophila pneumoniae J138
aucuuuucuuguaagacuaaaa

SEQ ID NO: 545534 - RNA, 22 nt, Chlamydophila pneumoniae J138
aucuuuucuagaaaacgccaac

SEQ ID NO: 545535 - RNA, 14 nt, Chlamydophila pneumoniae J138
aucuuuucuacuuc

SEQ ID NO: 545536 - RNA, 17 nt, Chlamydophila pneumoniae J138
aucuuuggguucuucca

SEQ ID NO: 545537 - RNA, 20 nt, Chlamydophila pneumoniae J138
aucuuuggguucuuccauaa

SEQ ID NO: 545538 - RNA, 18 nt, Chlamydophila pneumoniae J138
aucuuuggcacaauccuc

SEQ ID NO: 545539 - RNA, 15 nt, Chlamydophila pneumoniae J138
aucuuucucuaaaau

SEQ ID NO: 545540 - RNA, 21 nt, Chlamydophila pneumoniae J138
aucuuugagaucuugaaugau

SEQ ID NO: 545541 - RNA, 15 nt, Chlamydophila pneumoniae J138
aucuuugaacaaaaa

SEQ ID NO: 545542 - RNA, 20 nt, Chlamydophila pneumoniae J138
augaauaccagaagcaaagg

SEQ ID NO: 545543 - RNA, 14 nt, Chlamydophila pneumoniae J138
augaauaccagaag

SEQ ID NO: 545544 - RNA, 16 nt, Chlamydophila pneumoniae J138
augacaacagagacaa

SEQ ID NO: 545545 - RNA, 23 nt, Chlamydophila pneumoniae J138
augaagagaguucucucuucacu

SEQ ID NO: 545546 - RNA, 12 nt, Chlamydophila pneumoniae J138
augaagaaaaau

SEQ ID NO: 545547 - RNA, 18 nt, Chlamydophila pneumoniae J138
augaagaacuacucucau

SEQ ID NO: 545548 - RNA, 14 nt, Chlamydophila pneumoniae J138
augaaagcuguauu

SEQ ID NO: 545549 - RNA, 22 nt, Chlamydophila pneumoniae J138
augagaacgucuaaagacgaag

SEQ ID NO: 545550 - RNA, 17 nt, Chlamydophila pneumoniae J138
augagaacguaagcuuu

SEQ ID NO: 545551 - RNA, 13 nt, Chlamydophila pneumoniae J138
augagauccaaag

SEQ ID NO: 545552 - RNA, 13 nt, Chlamydophila pneumoniae J138
augagaugggcua

SEQ ID NO: 545553 - RNA, 19 nt, Chlamydophila pneumoniae J138
augagauccaaagccugaa

SEQ ID NO: 545554 - RNA, 14 nt, Chlamydophila pneumoniae J138
augagaguaaguuu

SEQ ID NO: 545555 - RNA, 17 nt, Chlamydophila pneumoniae J138
augagaguuucuaaugu

SEQ ID NO: 545556 - RNA, 16 nt, Chlamydophila pneumoniae J138
augaccuuuagcugcu

SEQ ID NO: 545557 - RNA, 22 nt, Chlamydophila pneumoniae J138
augacggauccuagaauaggaa

SEQ ID NO: 545558 - RNA, 15 nt, Chlamydophila pneumoniae J138
augaccuuuaggaac

SEQ ID NO: 545559 - RNA, 13 nt, Chlamydophila pneumoniae J138
augaccuuauagu

SEQ ID NO: 545560 - RNA, 18 nt, Chlamydophila pneumoniae J138
augacaaguaucuacaca

SEQ ID NO: 545561 - RNA, 19 nt, Chlamydophila pneumoniae J138
auauguccgugagcaacaa

SEQ ID NO: 545562 - RNA, 14 nt, Chlamydophila pneumoniae J138
auaugucuugcuuu

SEQ ID NO: 545563 - RNA, 23 nt, Chlamydophila pneumoniae J138
auauggguguaaauuuuuccuuc

SEQ ID NO: 545564 - RNA, 21 nt, Chlamydophila pneumoniae J138
auauggcugucacggaagaac

SEQ ID NO: 545565 - RNA, 17 nt, Chlamydophila pneumoniae J138
auaugcucgugcgacug

SEQ ID NO: 545566 - RNA, 16 nt, Chlamydophila pneumoniae J138
auaugcuuuucaaaua

SEQ ID NO: 545567 - RNA, 14 nt, Chlamydophila pneumoniae J138
auauggaauggcuu

SEQ ID NO: 545568 - RNA, 17 nt, Chlamydophila pneumoniae J138
auauuaacccaccagaa

SEQ ID NO: 545569 - RNA, 16 nt, Chlamydophila pneumoniae J138
aucaacuacaucucca

SEQ ID NO: 545570 - RNA, 22 nt, Chlamydophila pneumoniae J138
aucaaccgaagauccuagagaa

SEQ ID NO: 545571 - RNA, 14 nt, Chlamydophila pneumoniae J138
aucaacauucuucu

SEQ ID NO: 545572 - RNA, 13 nt, Chlamydophila pneumoniae J138
aucaaccaaaaug

SEQ ID NO: 545573 - RNA, 12 nt, Chlamydophila pneumoniae J138
aucaaagaauua

SEQ ID NO: 545574 - RNA, 15 nt, Chlamydophila pneumoniae J138
aucaaagaaagugaa

SEQ ID NO: 545575 - RNA, 17 nt, Chlamydophila pneumoniae J138
aucaaagaacaauaaaa

SEQ ID NO: 545576 - RNA, 14 nt, Chlamydophila pneumoniae J138
aucaaagcaaagag

SEQ ID NO: 545577 - RNA, 17 nt, Chlamydophila pneumoniae J138
aucaaagcaaagagcaa

SEQ ID NO: 545578 - RNA, 16 nt, Chlamydophila pneumoniae J138
aucaaagauuccuaag

SEQ ID NO: 545579 - RNA, 17 nt, Chlamydophila pneumoniae J138
aucaaagcaaaagucau

SEQ ID NO: 545580 - RNA, 21 nt, Chlamydophila pneumoniae J138
aucaaaggcugcuugagacuu

SEQ ID NO: 545581 - RNA, 16 nt, Chlamydophila pneumoniae J138
aucaaagaucugaauu

SEQ ID NO: 545582 - RNA, 16 nt, Chlamydophila pneumoniae J138
aucaaauagauuuuua

SEQ ID NO: 545583 - RNA, 14 nt, Chlamydophila pneumoniae J138
aucaaaaaaaagac

SEQ ID NO: 545584 - RNA, 19 nt, Chlamydophila pneumoniae J138
aucaaaaaaaacgccauac

SEQ ID NO: 545585 - RNA, 22 nt, Chlamydophila pneumoniae J138
aucaaaaacacugcgcaaagaa

SEQ ID NO: 545586 - RNA, 15 nt, Chlamydophila pneumoniae J138
auauuuuuauuuaaa

SEQ ID NO: 545587 - RNA, 16 nt, Chlamydophila pneumoniae J138
auauuuacgaaaacau

SEQ ID NO: 545588 - RNA, 17 nt, Chlamydophila pneumoniae J138
auauucucgaaaaauuu

SEQ ID NO: 545589 - RNA, 13 nt, Chlamydophila pneumoniae J138
auauucuaaaggg

SEQ ID NO: 545590 - RNA, 23 nt, Chlamydophila pneumoniae J138
aucagaacaacgcugcuucucua

SEQ ID NO: 545591 - RNA, 12 nt, Chlamydophila pneumoniae J138
aucagaaaugaa

SEQ ID NO: 545592 - RNA, 19 nt, Chlamydophila pneumoniae J138
aucagaagguaaauuuuua

SEQ ID NO: 545593 - RNA, 21 nt, Chlamydophila pneumoniae J138
aucagaagguaaauuuuuaaa

SEQ ID NO: 545594 - RNA, 22 nt, Chlamydophila pneumoniae J138
aucagaagccaccaaaaauucc

SEQ ID NO: 545595 - RNA, 21 nt, Chlamydophila pneumoniae J138
aucagaauccugaguaaaauc

SEQ ID NO: 545596 - RNA, 16 nt, Chlamydophila pneumoniae J138
aucagaaucuaaguaa

SEQ ID NO: 545597 - RNA, 18 nt, Chlamydophila pneumoniae J138
aucagaaucuaaguaaaa

SEQ ID NO: 545598 - RNA, 14 nt, Chlamydophila pneumoniae J138
aucagcacacugcu

SEQ ID NO: 545599 - RNA, 22 nt, Chlamydophila pneumoniae J138
aucaggauucuaaaaagaaaag

SEQ ID NO: 545600 - RNA, 17 nt, Chlamydophila pneumoniae J138
aucaggauucuaaaaag

SEQ ID NO: 545601 - RNA, 19 nt, Chlamydophila pneumoniae J138
aucaggauucuaaaaagaa

SEQ ID NO: 545602 - RNA, 18 nt, Chlamydophila pneumoniae J138
aucaggagucucuggaag

SEQ ID NO: 545603 - RNA, 15 nt, Chlamydophila pneumoniae J138
aaaacgguaaauauc

SEQ ID NO: 545604 - RNA, 15 nt, Chlamydophila pneumoniae J138
aaaacggauagggcu

SEQ ID NO: 545605 - RNA, 22 nt, Chlamydophila pneumoniae J138
aaaacggcuguacuuccccaaa

SEQ ID NO: 545606 - RNA, 17 nt, Chlamydophila pneumoniae J138
aaaacgagcaggguaau

SEQ ID NO: 545607 - RNA, 17 nt, Chlamydophila pneumoniae J138
aucaguucauuuuggca

SEQ ID NO: 545608 - RNA, 19 nt, Chlamydophila pneumoniae J138
aucaguuccauuuucaggc

SEQ ID NO: 545609 - RNA, 16 nt, Chlamydophila pneumoniae J138
aucaguaaaagacuga

SEQ ID NO: 545610 - RNA, 14 nt, Chlamydophila pneumoniae J138
aucagggacucuuu

SEQ ID NO: 545611 - RNA, 15 nt, Chlamydophila pneumoniae J138
aucacgaaaaggaga

SEQ ID NO: 545612 - RNA, 17 nt, Chlamydophila pneumoniae J138
aucacgaaaaggagaau

SEQ ID NO: 545613 - RNA, 15 nt, Chlamydophila pneumoniae J138
aucacaauuuuaaaa

SEQ ID NO: 545614 - RNA, 12 nt, Chlamydophila pneumoniae J138
aucacaucaguu

SEQ ID NO: 545615 - RNA, 19 nt, Chlamydophila pneumoniae J138
aucacauuccaagaaaaau

SEQ ID NO: 545616 - RNA, 13 nt, Chlamydophila pneumoniae J138
aucacacuuucau

SEQ ID NO: 545617 - RNA, 22 nt, Chlamydophila pneumoniae J138
aucacacuuaaagguaaaacua

SEQ ID NO: 545618 - RNA, 14 nt, Chlamydophila pneumoniae J138
aucacauaaaucaa

SEQ ID NO: 545619 - RNA, 17 nt, Chlamydophila pneumoniae J138
aucacauaaaucaacau

SEQ ID NO: 545620 - RNA, 21 nt, Chlamydophila pneumoniae J138
aucacaguuaagacgcagaaa

SEQ ID NO: 545621 - RNA, 16 nt, Chlamydophila pneumoniae J138
aucacagcaaucugca

SEQ ID NO: 545622 - RNA, 12 nt, Chlamydophila pneumoniae J138
auacauuccuag

SEQ ID NO: 545623 - RNA, 23 nt, Chlamydophila pneumoniae J138
auacauugcugccaggcuuaaau

SEQ ID NO: 545624 - RNA, 19 nt, Chlamydophila pneumoniae J138
auacaucccauucaauaau

SEQ ID NO: 545625 - RNA, 23 nt, Chlamydophila pneumoniae J138
auacaucaccacugcuccaauuu

SEQ ID NO: 545626 - RNA, 19 nt, Chlamydophila pneumoniae J138
auacaucaccacugcucca

SEQ ID NO: 545627 - RNA, 16 nt, Chlamydophila pneumoniae J138
auacaucaaaaugcug

SEQ ID NO: 545628 - RNA, 22 nt, Chlamydophila pneumoniae J138
auacaucccauucaauaauuuc

SEQ ID NO: 545629 - RNA, 15 nt, Chlamydophila pneumoniae J138
auacauagguaaaac

SEQ ID NO: 545630 - RNA, 14 nt, Chlamydophila pneumoniae J138
auacaguuggcguu

SEQ ID NO: 545631 - RNA, 14 nt, Chlamydophila pneumoniae J138
auacaguagaaaca

SEQ ID NO: 545632 - RNA, 15 nt, Chlamydophila pneumoniae J138
auacaguagaaacau

SEQ ID NO: 545633 - RNA, 16 nt, Chlamydophila pneumoniae J138
auacaguacgcaaagu

SEQ ID NO: 545634 - RNA, 11 nt, Chlamydophila pneumoniae J138
auaccacagcu

SEQ ID NO: 545635 - RNA, 21 nt, Chlamydophila pneumoniae J138
auaccagauaaagcaaagaua

SEQ ID NO: 545636 - RNA, 17 nt, Chlamydophila pneumoniae J138
auaccagaagcaaaggu

SEQ ID NO: 545637 - RNA, 23 nt, Chlamydophila pneumoniae J138
auaccaagaugucuccaaagaua

SEQ ID NO: 545638 - RNA, 16 nt, Chlamydophila pneumoniae J138
auaccaagaugaagaa

SEQ ID NO: 545639 - RNA, 15 nt, Chlamydophila pneumoniae J138
auaccaaggcugcug

SEQ ID NO: 545640 - RNA, 15 nt, Chlamydophila pneumoniae J138
auaccaaaauaccau

SEQ ID NO: 545641 - RNA, 13 nt, Chlamydophila pneumoniae J138
auaccaaaauuau

SEQ ID NO: 545642 - RNA, 16 nt, Chlamydophila pneumoniae J138
auacccacaaagauca

SEQ ID NO: 545643 - RNA, 17 nt, Chlamydophila pneumoniae J138
auagaauacacagcuau

SEQ ID NO: 545644 - RNA, 14 nt, Chlamydophila pneumoniae J138
auagaauagaaugu

SEQ ID NO: 545645 - RNA, 15 nt, Chlamydophila pneumoniae J138
auagaauacacagcu

SEQ ID NO: 545646 - RNA, 22 nt, Chlamydophila pneumoniae J138
auagaaggcaucccgaacgcua

SEQ ID NO: 545647 - RNA, 17 nt, Chlamydophila pneumoniae J138
auagagagaaugacuuu

SEQ ID NO: 545648 - RNA, 15 nt, Chlamydophila pneumoniae J138
auagacacuugcuua

SEQ ID NO: 545649 - RNA, 20 nt, Chlamydophila pneumoniae J138
auagacauucccuaaagcug

SEQ ID NO: 545650 - RNA, 23 nt, Chlamydophila pneumoniae J138
auagacauucccuaaagcugcca

SEQ ID NO: 545651 - RNA, 20 nt, Chlamydophila pneumoniae J138
auagaacgaauuucaacagc

SEQ ID NO: 545652 - RNA, 20 nt, Chlamydophila pneumoniae J138
auagaaauaagcaucuagaa

SEQ ID NO: 545653 - RNA, 14 nt, Chlamydophila pneumoniae J138
auagaaaugagaga

SEQ ID NO: 545654 - RNA, 22 nt, Chlamydophila pneumoniae J138
auagaaauucuguagauacuau

SEQ ID NO: 545655 - RNA, 17 nt, Chlamydophila pneumoniae J138
auacuguuuuucuucca

SEQ ID NO: 545656 - RNA, 18 nt, Chlamydophila pneumoniae J138
auacuguuaacaaguacc

SEQ ID NO: 545657 - RNA, 18 nt, Chlamydophila pneumoniae J138
auagaaaguacagauuuc

SEQ ID NO: 545658 - RNA, 13 nt, Chlamydophila pneumoniae J138
auacgcuuuucuu

SEQ ID NO: 545659 - RNA, 22 nt, Chlamydophila pneumoniae J138
auacgguauaccauguuaucaa

SEQ ID NO: 545660 - RNA, 17 nt, Chlamydophila pneumoniae J138
auacgugcuugaauauu

SEQ ID NO: 545661 - RNA, 15 nt, Chlamydophila pneumoniae J138
auacguccagccugc

SEQ ID NO: 545662 - RNA, 22 nt, Chlamydophila pneumoniae J138
auaccuagagcucugaaauaaa

SEQ ID NO: 545663 - RNA, 12 nt, Chlamydophila pneumoniae J138
auaccuacuaaa

SEQ ID NO: 545664 - RNA, 16 nt, Chlamydophila pneumoniae J138
auacguuuuuuuccuu

SEQ ID NO: 545665 - RNA, 13 nt, Chlamydophila pneumoniae J138
auacguuuuuccc

SEQ ID NO: 545666 - RNA, 15 nt, Chlamydophila pneumoniae J138
auacuacucucauca

SEQ ID NO: 545667 - RNA, 19 nt, Chlamydophila pneumoniae J138
auacuaagaagcucacucu

SEQ ID NO: 545668 - RNA, 18 nt, Chlamydophila pneumoniae J138
auaguccuagcagagaaa

SEQ ID NO: 545669 - RNA, 15 nt, Chlamydophila pneumoniae J138
auaguguuccaaaac

SEQ ID NO: 545670 - RNA, 19 nt, Chlamydophila pneumoniae J138
auaguuaaauuuccaaaga

SEQ ID NO: 545671 - RNA, 19 nt, Chlamydophila pneumoniae J138
auauaaaugcuauuuuccu

SEQ ID NO: 545672 - RNA, 19 nt, Chlamydophila pneumoniae J138
auauagggagacuuugcca

SEQ ID NO: 545673 - RNA, 17 nt, Chlamydophila pneumoniae J138
auauccaaugagagaga

SEQ ID NO: 545674 - RNA, 18 nt, Chlamydophila pneumoniae J138
auauccguagguguuaag

SEQ ID NO: 545675 - RNA, 18 nt, Chlamydophila pneumoniae J138
auaucauuaagaagauuc

SEQ ID NO: 545676 - RNA, 13 nt, Chlamydophila pneumoniae J138
auaucagcuucuu

SEQ ID NO: 545677 - RNA, 13 nt, Chlamydophila pneumoniae J138
auaucagcaaaaa

SEQ ID NO: 545678 - RNA, 20 nt, Chlamydophila pneumoniae J138
auaucaccagguccuucugg

SEQ ID NO: 545679 - RNA, 15 nt, Chlamydophila pneumoniae J138
auaggcaaguguuuu

SEQ ID NO: 545680 - RNA, 16 nt, Chlamydophila pneumoniae J138
auaggauccaggaguu

SEQ ID NO: 545681 - RNA, 16 nt, Chlamydophila pneumoniae J138
auaggaauuagagaaa

SEQ ID NO: 545682 - RNA, 13 nt, Chlamydophila pneumoniae J138
auaggauaagaaa

SEQ ID NO: 545683 - RNA, 15 nt, Chlamydophila pneumoniae J138
auaggauaagaaauu

SEQ ID NO: 545684 - RNA, 21 nt, Chlamydophila pneumoniae J138
auaggaauaacaccaaaagaa

SEQ ID NO: 545685 - RNA, 17 nt, Chlamydophila pneumoniae J138
auagcuggaucuucuga

SEQ ID NO: 545686 - RNA, 21 nt, Chlamydophila pneumoniae J138
auagcuggggauuaguagcua

SEQ ID NO: 545687 - RNA, 23 nt, Chlamydophila pneumoniae J138
auaggaaacgcccuucuuaguaa

SEQ ID NO: 545688 - RNA, 19 nt, Chlamydophila pneumoniae J138
auagcuuacuuagaacuau

SEQ ID NO: 545689 - RNA, 15 nt, Chlamydophila pneumoniae J138
auagcuuccuguagu

SEQ ID NO: 545690 - RNA, 17 nt, Chlamydophila pneumoniae J138
auagcuuccuguaguga

SEQ ID NO: 545691 - RNA, 14 nt, Chlamydophila pneumoniae J138
auagagcucuaaaa

SEQ ID NO: 545692 - RNA, 15 nt, Chlamydophila pneumoniae J138
auagagcucuaaaaa

SEQ ID NO: 545693 - RNA, 16 nt, Chlamydophila pneumoniae J138
auagagcugccaaugu

SEQ ID NO: 545694 - RNA, 13 nt, Chlamydophila pneumoniae J138
auagagcucuaaa

SEQ ID NO: 545695 - RNA, 23 nt, Chlamydophila pneumoniae J138
auagagccuccuccuucugcaau

SEQ ID NO: 545696 - RNA, 18 nt, Chlamydophila pneumoniae J138
auagagagcgcagagucu

SEQ ID NO: 545697 - RNA, 21 nt, Chlamydophila pneumoniae J138
auagagagcgccuaaacccac

SEQ ID NO: 545698 - RNA, 18 nt, Chlamydophila pneumoniae J138
auagccaucauagcaaac

SEQ ID NO: 545699 - RNA, 17 nt, Chlamydophila pneumoniae J138
auagccaucauagcaaa

SEQ ID NO: 545700 - RNA, 21 nt, Chlamydophila pneumoniae J138
auagagcuucuuuaucuagcu

SEQ ID NO: 545701 - RNA, 17 nt, Chlamydophila pneumoniae J138
auagaggaccgaaaaac

SEQ ID NO: 545702 - RNA, 15 nt, Chlamydophila pneumoniae J138
auagcccgaaauuca

SEQ ID NO: 545703 - RNA, 21 nt, Chlamydophila pneumoniae J138
auagccgacaugcuuuccuuc

SEQ ID NO: 545704 - RNA, 16 nt, Chlamydophila pneumoniae J138
auagggccauuagcaa

SEQ ID NO: 545705 - RNA, 20 nt, Chlamydophila pneumoniae J138
auagggaucuccuugagaga

SEQ ID NO: 545706 - RNA, 22 nt, Chlamydophila pneumoniae J138
auaggcucuuuagcaaacauuu

SEQ ID NO: 545707 - RNA, 20 nt, Chlamydophila pneumoniae J138
auaggccaagagcuugucuu

SEQ ID NO: 545708 - RNA, 13 nt, Chlamydophila pneumoniae J138
auagguagaggca

SEQ ID NO: 545709 - RNA, 19 nt, Chlamydophila pneumoniae J138
auagggcaggcggaaagga

SEQ ID NO: 545710 - RNA, 18 nt, Chlamydophila pneumoniae J138
auaguaaacagaagugcu

SEQ ID NO: 545711 - RNA, 14 nt, Chlamydophila pneumoniae J138
auaguauuuuuaaa

SEQ ID NO: 545712 - RNA, 15 nt, Chlamydophila pneumoniae J138
auaguauuuuuaaau

SEQ ID NO: 545713 - RNA, 21 nt, Chlamydophila pneumoniae J138
auaguagcgaauccagaauuu

SEQ ID NO: 545714 - RNA, 16 nt, Chlamydophila pneumoniae J138
agucacaaauuuuugc

SEQ ID NO: 545715 - RNA, 16 nt, Chlamydophila pneumoniae J138
agucaccuuacaucca

SEQ ID NO: 545716 - RNA, 24 nt, Chlamydophila pneumoniae J138
agucacggcgaaagcuacagcuaa

SEQ ID NO: 545717 - RNA, 18 nt, Chlamydophila pneumoniae J138
agucagccaagacaaaaa

SEQ ID NO: 545718 - RNA, 22 nt, Chlamydophila pneumoniae J138
agucacuaaagauacuuaucuu

SEQ ID NO: 545719 - RNA, 15 nt, Chlamydophila pneumoniae J138
aguacuucuuacccu

SEQ ID NO: 545720 - RNA, 21 nt, Chlamydophila pneumoniae J138
aguacuucuuacccuaauuug

SEQ ID NO: 545721 - RNA, 16 nt, Chlamydophila pneumoniae J138
aguagaacugcgaagg

SEQ ID NO: 545722 - RNA, 19 nt, Chlamydophila pneumoniae J138
aguagaauccuucucccuc

SEQ ID NO: 545723 - RNA, 10 nt, Chlamydophila pneumoniae J138
aguccacauc

SEQ ID NO: 545724 - RNA, 13 nt, Chlamydophila pneumoniae J138
aguccaagaucaa

SEQ ID NO: 545725 - RNA, 14 nt, Chlamydophila pneumoniae J138
aguccaagaucaaa

SEQ ID NO: 545726 - RNA, 16 nt, Chlamydophila pneumoniae J138
aguccaagaucaaacg

SEQ ID NO: 545727 - RNA, 23 nt, Chlamydophila pneumoniae J138
agucauguccguucgagagguuc

SEQ ID NO: 545728 - RNA, 16 nt, Chlamydophila pneumoniae J138
agucauuagcaagagc

SEQ ID NO: 545729 - RNA, 16 nt, Chlamydophila pneumoniae J138
agucauuaucacagau

SEQ ID NO: 545730 - RNA, 16 nt, Chlamydophila pneumoniae J138
aguccagacuuuccuc

SEQ ID NO: 545731 - RNA, 15 nt, Chlamydophila pneumoniae J138
aguccagacuuuccu

SEQ ID NO: 545732 - RNA, 17 nt, Chlamydophila pneumoniae J138
agucagguaaagagcuu

SEQ ID NO: 545733 - RNA, 16 nt, Chlamydophila pneumoniae J138
agucauaagcucuauu

SEQ ID NO: 545734 - RNA, 23 nt, Chlamydophila pneumoniae J138
aguccaucggggcggacuauguu

SEQ ID NO: 545735 - RNA, 18 nt, Chlamydophila pneumoniae J138
agucccuugucaacaaaa

SEQ ID NO: 545736 - RNA, 23 nt, Chlamydophila pneumoniae J138
aguccuuuaccaucgucuccaaa

SEQ ID NO: 545737 - RNA, 13 nt, Chlamydophila pneumoniae J138
aguccuucuuuuc

SEQ ID NO: 545738 - RNA, 22 nt, Chlamydophila pneumoniae J138
aguccuucuucccagccuugau

SEQ ID NO: 545739 - RNA, 19 nt, Chlamydophila pneumoniae J138
agucgugagaagcaucuuc

SEQ ID NO: 545740 - RNA, 16 nt, Chlamydophila pneumoniae J138
agugacaccaacaaca

SEQ ID NO: 545741 - RNA, 17 nt, Chlamydophila pneumoniae J138
agugacaccaacaacaa

SEQ ID NO: 545742 - RNA, 15 nt, Chlamydophila pneumoniae J138
agugaacuuuuguac

SEQ ID NO: 545743 - RNA, 20 nt, Chlamydophila pneumoniae J138
agugaacucuucaagagcuu

SEQ ID NO: 545744 - RNA, 17 nt, Chlamydophila pneumoniae J138
agugaacacucucuacc

SEQ ID NO: 545745 - RNA, 16 nt, Chlamydophila pneumoniae J138
agugacuuccuccaaa

SEQ ID NO: 545746 - RNA, 14 nt, Chlamydophila pneumoniae J138
agugacuuuucuuc

SEQ ID NO: 545747 - RNA, 17 nt, Chlamydophila pneumoniae J138
agugaccauagcauaga

SEQ ID NO: 545748 - RNA, 23 nt, Chlamydophila pneumoniae J138
agucucauggauuacugaagauc

SEQ ID NO: 545749 - RNA, 13 nt, Chlamydophila pneumoniae J138
agucuauuugaaa

SEQ ID NO: 545750 - RNA, 12 nt, Chlamydophila pneumoniae J138
agucucauggau

SEQ ID NO: 545751 - RNA, 16 nt, Chlamydophila pneumoniae J138
agucucaguugagaac

SEQ ID NO: 545752 - RNA, 21 nt, Chlamydophila pneumoniae J138
agucugguuuuucuccugacu

SEQ ID NO: 545753 - RNA, 18 nt, Chlamydophila pneumoniae J138
agucugugagaaauaggu

SEQ ID NO: 545754 - RNA, 15 nt, Chlamydophila pneumoniae J138
agucuugcgccagca

SEQ ID NO: 545755 - RNA, 23 nt, Chlamydophila pneumoniae J138
agucuugcgccagcaaagauuaa

SEQ ID NO: 545756 - RNA, 21 nt, Chlamydophila pneumoniae J138
agucuugcgccagcaaagauu

SEQ ID NO: 545757 - RNA, 17 nt, Chlamydophila pneumoniae J138
agucuugaguucuuuug

SEQ ID NO: 545758 - RNA, 19 nt, Chlamydophila pneumoniae J138
agucuucuuagaaagacua

SEQ ID NO: 545759 - RNA, 16 nt, Chlamydophila pneumoniae J138
agucuucccucuccuu

SEQ ID NO: 545760 - RNA, 21 nt, Chlamydophila pneumoniae J138
agugaggccuccauuucuagg

SEQ ID NO: 545761 - RNA, 15 nt, Chlamydophila pneumoniae J138
agugauaaggaagaa

SEQ ID NO: 545762 - RNA, 19 nt, Chlamydophila pneumoniae J138
agugcucaguaaauauuuu

SEQ ID NO: 545763 - RNA, 15 nt, Chlamydophila pneumoniae J138
agugcuuucaggagu

SEQ ID NO: 545764 - RNA, 19 nt, Chlamydophila pneumoniae J138
aguggacuauagaugccau

SEQ ID NO: 545765 - RNA, 14 nt, Chlamydophila pneumoniae J138
agugggaauguugu

SEQ ID NO: 545766 - RNA, 18 nt, Chlamydophila pneumoniae J138
aguggcuuauagagagaa

SEQ ID NO: 545767 - RNA, 19 nt, Chlamydophila pneumoniae J138
aguggcuuauagagagaau

SEQ ID NO: 545768 - RNA, 18 nt, Chlamydophila pneumoniae J138
aguguucgagcaucucaa

SEQ ID NO: 545769 - RNA, 15 nt, Chlamydophila pneumoniae J138
aguguguuucaaaca

SEQ ID NO: 545770 - RNA, 16 nt, Chlamydophila pneumoniae J138
aguguguuucaaacaa

SEQ ID NO: 545771 - RNA, 21 nt, Chlamydophila pneumoniae J138
agugugguuuaccuuguuuuc

SEQ ID NO: 545772 - RNA, 19 nt, Chlamydophila pneumoniae J138
agugugacugcagagaaau

SEQ ID NO: 545773 - RNA, 23 nt, Chlamydophila pneumoniae J138
agugucuaagauauagagagagu

SEQ ID NO: 545774 - RNA, 15 nt, Chlamydophila pneumoniae J138
agugucuaagauaua

SEQ ID NO: 545775 - RNA, 23 nt, Chlamydophila pneumoniae J138
aguguaacauugaccuaaaggaa

SEQ ID NO: 545776 - RNA, 22 nt, Chlamydophila pneumoniae J138
aguguuguuggagcagaaacuc

SEQ ID NO: 545777 - RNA, 16 nt, Chlamydophila pneumoniae J138
aguguuucuuuaucua

SEQ ID NO: 545778 - RNA, 16 nt, Chlamydophila pneumoniae J138
aguuaaagagcauccu

SEQ ID NO: 545779 - RNA, 19 nt, Chlamydophila pneumoniae J138
aguuaacuguguaugaauc

SEQ ID NO: 545780 - RNA, 20 nt, Chlamydophila pneumoniae J138
aguuagguagauagaaauuc

SEQ ID NO: 545781 - RNA, 17 nt, Chlamydophila pneumoniae J138
aguucauaaccugggca

SEQ ID NO: 545782 - RNA, 22 nt, Chlamydophila pneumoniae J138
aguucaucauauuuuucuugaa

SEQ ID NO: 545783 - RNA, 20 nt, Chlamydophila pneumoniae J138
aguuccgcggccaucauuaa

SEQ ID NO: 545784 - RNA, 20 nt, Chlamydophila pneumoniae J138
aguuccuuauuguagagagu

SEQ ID NO: 545785 - RNA, 14 nt, Chlamydophila pneumoniae J138
aguuccgauaaaga

SEQ ID NO: 545786 - RNA, 16 nt, Chlamydophila pneumoniae J138
aguucgcacuaauuuc

SEQ ID NO: 545787 - RNA, 17 nt, Chlamydophila pneumoniae J138
aguucgcggaucuucuu

SEQ ID NO: 545788 - RNA, 19 nt, Chlamydophila pneumoniae J138
aguucgcgaccugugauuu

SEQ ID NO: 545789 - RNA, 13 nt, Chlamydophila pneumoniae J138
aguucuuucugcu

SEQ ID NO: 545790 - RNA, 17 nt, Chlamydophila pneumoniae J138
aguucuuuuguuugucu

SEQ ID NO: 545791 - RNA, 22 nt, Chlamydophila pneumoniae J138
aguucuuguaauaaaagaacau

SEQ ID NO: 545792 - RNA, 12 nt, Chlamydophila pneumoniae J138
aguugaaaugag

SEQ ID NO: 545793 - RNA, 21 nt, Chlamydophila pneumoniae J138
aguugaaaugagugagaaugc

SEQ ID NO: 545794 - RNA, 20 nt, Chlamydophila pneumoniae J138
aguugaacugacaccaggag

SEQ ID NO: 545795 - RNA, 15 nt, Chlamydophila pneumoniae J138
aguugaggaaaggag

SEQ ID NO: 545796 - RNA, 13 nt, Chlamydophila pneumoniae J138
aguugaggaaagg

SEQ ID NO: 545797 - RNA, 22 nt, Chlamydophila pneumoniae J138
aguugagaaccuucacaagaaa

SEQ ID NO: 545798 - RNA, 16 nt, Chlamydophila pneumoniae J138
aguugaccuuuuucau

SEQ ID NO: 545799 - RNA, 15 nt, Chlamydophila pneumoniae J138
aguuggaucauucuu

SEQ ID NO: 545800 - RNA, 21 nt, Chlamydophila pneumoniae J138
aguuggaucaaggaguacucu

SEQ ID NO: 545801 - RNA, 21 nt, Chlamydophila pneumoniae J138
auaaagaucgggucuacaaca

SEQ ID NO: 545802 - RNA, 12 nt, Chlamydophila pneumoniae J138
auaaagaggcuc

SEQ ID NO: 545803 - RNA, 12 nt, Chlamydophila pneumoniae J138
auaaagagcuga

SEQ ID NO: 545804 - RNA, 13 nt, Chlamydophila pneumoniae J138
auaaagaauuccc

SEQ ID NO: 545805 - RNA, 22 nt, Chlamydophila pneumoniae J138
auaaagaaguuuacaaauaaaa

SEQ ID NO: 545806 - RNA, 12 nt, Chlamydophila pneumoniae J138
auaaagaagaaa

SEQ ID NO: 545807 - RNA, 22 nt, Chlamydophila pneumoniae J138
auaaacuucaaugaagaaaaau

SEQ ID NO: 545808 - RNA, 21 nt, Chlamydophila pneumoniae J138
auaaacauauucuccuuacca

SEQ ID NO: 545809 - RNA, 19 nt, Chlamydophila pneumoniae J138
auaaacuccacgaauucuu

SEQ ID NO: 545810 - RNA, 16 nt, Chlamydophila pneumoniae J138
auaaaggcucuuuuag

SEQ ID NO: 545811 - RNA, 20 nt, Chlamydophila pneumoniae J138
auaaauggaggauacucaca

SEQ ID NO: 545812 - RNA, 21 nt, Chlamydophila pneumoniae J138
auaaaugcuauuuuccucuau

SEQ ID NO: 545813 - RNA, 19 nt, Chlamydophila pneumoniae J138
auaaauucaggacccuuuu

SEQ ID NO: 545814 - RNA, 20 nt, Chlamydophila pneumoniae J138
auaaaaggguagcgaaugaa

SEQ ID NO: 545815 - RNA, 17 nt, Chlamydophila pneumoniae J138
auaaaaggguagcgaau

SEQ ID NO: 545816 - RNA, 17 nt, Chlamydophila pneumoniae J138
auaaaagagcucaaaaa

SEQ ID NO: 545817 - RNA, 16 nt, Chlamydophila pneumoniae J138
auaaaaauuaagaacc

SEQ ID NO: 545818 - RNA, 15 nt, Chlamydophila pneumoniae J138
auaaaaauguaauuu

SEQ ID NO: 545819 - RNA, 15 nt, Chlamydophila pneumoniae J138
aguuggcguuuucua

SEQ ID NO: 545820 - RNA, 17 nt, Chlamydophila pneumoniae J138
aguuggcguuuucuaga

SEQ ID NO: 545821 - RNA, 23 nt, Chlamydophila pneumoniae J138
aguugguugcagucguauucagg

SEQ ID NO: 545822 - RNA, 19 nt, Chlamydophila pneumoniae J138
aguuuucgauacacaagau

SEQ ID NO: 545823 - RNA, 14 nt, Chlamydophila pneumoniae J138
aguuguaauuucuu

SEQ ID NO: 545824 - RNA, 16 nt, Chlamydophila pneumoniae J138
aguuuugaggauuucu

SEQ ID NO: 545825 - RNA, 15 nt, Chlamydophila pneumoniae J138
aguuuugaaaucaaa

SEQ ID NO: 545826 - RNA, 12 nt, Chlamydophila pneumoniae J138
aguuuuuuagag

SEQ ID NO: 545827 - RNA, 22 nt, Chlamydophila pneumoniae J138
aguuuuuuaaauaccuagagcu

SEQ ID NO: 545828 - RNA, 19 nt, Chlamydophila pneumoniae J138
aguuuuuguucauccagaa

SEQ ID NO: 545829 - RNA, 17 nt, Chlamydophila pneumoniae J138
aguuuuuuucuaaauuu

SEQ ID NO: 545830 - RNA, 13 nt, Chlamydophila pneumoniae J138
auaaaaaagagag

SEQ ID NO: 545831 - RNA, 19 nt, Chlamydophila pneumoniae J138
auaaugcucacuucuuugc

SEQ ID NO: 545832 - RNA, 18 nt, Chlamydophila pneumoniae J138
auaauuauguagaucuac

SEQ ID NO: 545833 - RNA, 15 nt, Chlamydophila pneumoniae J138
auaauuagagagaau

SEQ ID NO: 545834 - RNA, 14 nt, Chlamydophila pneumoniae J138
auaauuagaacagc

SEQ ID NO: 545835 - RNA, 15 nt, Chlamydophila pneumoniae J138
auaauuagaacagca

SEQ ID NO: 545836 - RNA, 12 nt, Chlamydophila pneumoniae J138
auaauuaaacuc

SEQ ID NO: 545837 - RNA, 14 nt, Chlamydophila pneumoniae J138
auaaucaaccaaaa

SEQ ID NO: 545838 - RNA, 21 nt, Chlamydophila pneumoniae J138
auaauauuuuuuuaagaucuc

SEQ ID NO: 545839 - RNA, 18 nt, Chlamydophila pneumoniae J138
auaauaucgguuccuaua

SEQ ID NO: 545840 - RNA, 14 nt, Chlamydophila pneumoniae J138
auaauccaagauac

SEQ ID NO: 545841 - RNA, 13 nt, Chlamydophila pneumoniae J138
auaaucaauccac

SEQ ID NO: 545842 - RNA, 13 nt, Chlamydophila pneumoniae J138
auaaucaaccaaa

SEQ ID NO: 545843 - RNA, 16 nt, Chlamydophila pneumoniae J138
auaagucaaaaugugc

SEQ ID NO: 545844 - RNA, 19 nt, Chlamydophila pneumoniae J138
auaauagagaagaagcaaa

SEQ ID NO: 545845 - RNA, 16 nt, Chlamydophila pneumoniae J138
auaagccaguacuaaa

SEQ ID NO: 545846 - RNA, 20 nt, Chlamydophila pneumoniae J138
auaagcaggaaaagcaaaau

SEQ ID NO: 545847 - RNA, 14 nt, Chlamydophila pneumoniae J138
auaagauuuugaaa

SEQ ID NO: 545848 - RNA, 16 nt, Chlamydophila pneumoniae J138
auaagcaagcaacuga

SEQ ID NO: 545849 - RNA, 15 nt, Chlamydophila pneumoniae J138
auaagauccaaaaau

SEQ ID NO: 545850 - RNA, 14 nt, Chlamydophila pneumoniae J138
auaagauccaaaaa

SEQ ID NO: 545851 - RNA, 13 nt, Chlamydophila pneumoniae J138
auaagaucaauau

SEQ ID NO: 545852 - RNA, 15 nt, Chlamydophila pneumoniae J138
auaagauauucaaga

SEQ ID NO: 545853 - RNA, 15 nt, Chlamydophila pneumoniae J138
auaagauagcucuug

SEQ ID NO: 545854 - RNA, 23 nt, Chlamydophila pneumoniae J138
auaagaucucgugaauuacaggc

SEQ ID NO: 545855 - RNA, 14 nt, Chlamydophila pneumoniae J138
auaaggcuuuucug

SEQ ID NO: 545856 - RNA, 14 nt, Chlamydophila pneumoniae J138
auaaggcuugagga

SEQ ID NO: 545857 - RNA, 21 nt, Chlamydophila pneumoniae J138
auaaggauguuguggaucaga

SEQ ID NO: 545858 - RNA, 19 nt, Chlamydophila pneumoniae J138
auaaggauucugagaaguu

SEQ ID NO: 545859 - RNA, 18 nt, Chlamydophila pneumoniae J138
auaaggagauuccuaaac

SEQ ID NO: 545860 - RNA, 18 nt, Chlamydophila pneumoniae J138
auaagcuugccagcagaa

SEQ ID NO: 545861 - RNA, 23 nt, Chlamydophila pneumoniae J138
auaacuccaggggauaaaacuau

SEQ ID NO: 545862 - RNA, 21 nt, Chlamydophila pneumoniae J138
auaacuccacuaccaaggcag

SEQ ID NO: 545863 - RNA, 20 nt, Chlamydophila pneumoniae J138
auaacuugagccaacagguu

SEQ ID NO: 545864 - RNA, 20 nt, Chlamydophila pneumoniae J138
auaacuuugcaugaggagac

SEQ ID NO: 545865 - RNA, 14 nt, Chlamydophila pneumoniae J138
auaagaccagaaag

SEQ ID NO: 545866 - RNA, 16 nt, Chlamydophila pneumoniae J138
auaagagacauuucuu

SEQ ID NO: 545867 - RNA, 17 nt, Chlamydophila pneumoniae J138
auaagauaauagagaag

SEQ ID NO: 545868 - RNA, 17 nt, Chlamydophila pneumoniae J138
auaagauaaagaauucu

SEQ ID NO: 545869 - RNA, 20 nt, Chlamydophila pneumoniae J138
agcgucucuucuuccucuac

SEQ ID NO: 545870 - RNA, 16 nt, Chlamydophila pneumoniae J138
agcgucguguuuucac

SEQ ID NO: 545871 - RNA, 13 nt, Chlamydophila pneumoniae J138
agcucccucuaga

SEQ ID NO: 545872 - RNA, 18 nt, Chlamydophila pneumoniae J138
agcuccgaggcuucugag

SEQ ID NO: 545873 - RNA, 15 nt, Chlamydophila pneumoniae J138
agcuccguaauggag

SEQ ID NO: 545874 - RNA, 20 nt, Chlamydophila pneumoniae J138
agcuccucacaucuccuuuc

SEQ ID NO: 545875 - RNA, 22 nt, Chlamydophila pneumoniae J138
agcucggauggacuacugaaac

SEQ ID NO: 545876 - RNA, 16 nt, Chlamydophila pneumoniae J138
agcucgagaucuuuuu

SEQ ID NO: 545877 - RNA, 15 nt, Chlamydophila pneumoniae J138
agcucgaccucuagc

SEQ ID NO: 545878 - RNA, 21 nt, Chlamydophila pneumoniae J138
agcucgaggucuuuucuuuuu

SEQ ID NO: 545879 - RNA, 21 nt, Chlamydophila pneumoniae J138
agcucgaaucacgaauaaggc

SEQ ID NO: 545880 - RNA, 13 nt, Chlamydophila pneumoniae J138
agcuccuggauau

SEQ ID NO: 545881 - RNA, 12 nt, Chlamydophila pneumoniae J138
agcucuggagau

SEQ ID NO: 545882 - RNA, 15 nt, Chlamydophila pneumoniae J138
agcucucgacgaaca

SEQ ID NO: 545883 - RNA, 15 nt, Chlamydophila pneumoniae J138
agcucuauuucugcc

SEQ ID NO: 545884 - RNA, 23 nt, Chlamydophila pneumoniae J138
agcucuaaaaaagauaaagcuac

SEQ ID NO: 545885 - RNA, 23 nt, Chlamydophila pneumoniae J138
agcucuaauucuucuacagaaua

SEQ ID NO: 545886 - RNA, 18 nt, Chlamydophila pneumoniae J138
agcucuagggguuucccu

SEQ ID NO: 545887 - RNA, 18 nt, Chlamydophila pneumoniae J138
agcucucgacgaacaugc

SEQ ID NO: 545888 - RNA, 23 nt, Chlamydophila pneumoniae J138
agcugagguagcaucucucucca

SEQ ID NO: 545889 - RNA, 15 nt, Chlamydophila pneumoniae J138
agcugacuccuugua

SEQ ID NO: 545890 - RNA, 19 nt, Chlamydophila pneumoniae J138
agcugacaacaaaugugac

SEQ ID NO: 545891 - RNA, 14 nt, Chlamydophila pneumoniae J138
agcugaauccaggu

SEQ ID NO: 545892 - RNA, 14 nt, Chlamydophila pneumoniae J138
agcucuuucuugga

SEQ ID NO: 545893 - RNA, 15 nt, Chlamydophila pneumoniae J138
agcucuuucauaaga

SEQ ID NO: 545894 - RNA, 16 nt, Chlamydophila pneumoniae J138
agcugaaaucauggaa

SEQ ID NO: 545895 - RNA, 22 nt, Chlamydophila pneumoniae J138
agcucuucagcaagucgguaau

SEQ ID NO: 545896 - RNA, 13 nt, Chlamydophila pneumoniae J138
agcuguuguucug

SEQ ID NO: 545897 - RNA, 20 nt, Chlamydophila pneumoniae J138
agcuguuuacuuuucucuuu

SEQ ID NO: 545898 - RNA, 21 nt, Chlamydophila pneumoniae J138
agcuguugcguuugagcuaag

SEQ ID NO: 545899 - RNA, 20 nt, Chlamydophila pneumoniae J138
agcuggggauggucuucccc

SEQ ID NO: 545900 - RNA, 12 nt, Chlamydophila pneumoniae J138
agcugugguggu

SEQ ID NO: 545901 - RNA, 19 nt, Chlamydophila pneumoniae J138
agcugcaaucucaaaauca

SEQ ID NO: 545902 - RNA, 17 nt, Chlamydophila pneumoniae J138
agcuucaaaaagcuccc

SEQ ID NO: 545903 - RNA, 20 nt, Chlamydophila pneumoniae J138
agcuucuuuaucuagcucuu

SEQ ID NO: 545904 - RNA, 17 nt, Chlamydophila pneumoniae J138
agcuucuuucuaggccg

SEQ ID NO: 545905 - RNA, 22 nt, Chlamydophila pneumoniae J138
agcuucuuguuuuuguggacaa

SEQ ID NO: 545906 - RNA, 18 nt, Chlamydophila pneumoniae J138
agcuucuucaacgaggaa

SEQ ID NO: 545907 - RNA, 22 nt, Chlamydophila pneumoniae J138
agcuuuuuucucuugcuucaga

SEQ ID NO: 545908 - RNA, 12 nt, Chlamydophila pneumoniae J138
agcuuuuugcuu

SEQ ID NO: 545909 - RNA, 18 nt, Chlamydophila pneumoniae J138
agcuuuuugcuuuucccu

SEQ ID NO: 545910 - RNA, 18 nt, Chlamydophila pneumoniae J138
agcuuuauugauagcuga

SEQ ID NO: 545911 - RNA, 17 nt, Chlamydophila pneumoniae J138
agcuuucguuuucuagc

SEQ ID NO: 545912 - RNA, 18 nt, Chlamydophila pneumoniae J138
agcuuuaacaugccaaaa

SEQ ID NO: 545913 - RNA, 20 nt, Chlamydophila pneumoniae J138
agcuuguuuuugcaaggcaa

SEQ ID NO: 545914 - RNA, 11 nt, Chlamydophila pneumoniae J138
aggaaucacug

SEQ ID NO: 545915 - RNA, 15 nt, Chlamydophila pneumoniae J138
aggaauagagaaaga

SEQ ID NO: 545916 - RNA, 17 nt, Chlamydophila pneumoniae J138
aggaauagagaaagagu

SEQ ID NO: 545917 - RNA, 21 nt, Chlamydophila pneumoniae J138
aggaauaacaccaaaagaaua

SEQ ID NO: 545918 - RNA, 24 nt, Chlamydophila pneumoniae J138
aggaaaauucaguauaagaugcug

SEQ ID NO: 545919 - RNA, 15 nt, Chlamydophila pneumoniae J138
aggaaacguucuuuc

SEQ ID NO: 545920 - RNA, 15 nt, Chlamydophila pneumoniae J138
aggaaacagugguau

SEQ ID NO: 545921 - RNA, 14 nt, Chlamydophila pneumoniae J138
aggaaaagcaaaau

SEQ ID NO: 545922 - RNA, 12 nt, Chlamydophila pneumoniae J138
agcuuuuuucuc

SEQ ID NO: 545923 - RNA, 20 nt, Chlamydophila pneumoniae J138
aggaaucuugaugaccucua

SEQ ID NO: 545924 - RNA, 23 nt, Chlamydophila pneumoniae J138
aggaaucuugaugaccucuauac

SEQ ID NO: 545925 - RNA, 23 nt, Chlamydophila pneumoniae J138
aggaccagguguagguuccugcu

SEQ ID NO: 545926 - RNA, 20 nt, Chlamydophila pneumoniae J138
aggaccagguguagguuccu

SEQ ID NO: 545927 - RNA, 13 nt, Chlamydophila pneumoniae J138
aggaccaggugua

SEQ ID NO: 545928 - RNA, 19 nt, Chlamydophila pneumoniae J138
aggaccuuggacucuaggg

SEQ ID NO: 545929 - RNA, 15 nt, Chlamydophila pneumoniae J138
aggaccugugaguaa

SEQ ID NO: 545930 - RNA, 16 nt, Chlamydophila pneumoniae J138
aggacguaaaaagaaa

SEQ ID NO: 545931 - RNA, 19 nt, Chlamydophila pneumoniae J138
aggacgcacauuuagaagu

SEQ ID NO: 545932 - RNA, 22 nt, Chlamydophila pneumoniae J138
aggauagcaauucgguagagcu

SEQ ID NO: 545933 - RNA, 16 nt, Chlamydophila pneumoniae J138
aggauacucacagagu

SEQ ID NO: 545934 - RNA, 21 nt, Chlamydophila pneumoniae J138
aggauagaccccccauuccaa

SEQ ID NO: 545935 - RNA, 18 nt, Chlamydophila pneumoniae J138
aggauaaguucuuccaaa

SEQ ID NO: 545936 - RNA, 20 nt, Chlamydophila pneumoniae J138
aggaguuuucaagucuguaa

SEQ ID NO: 545937 - RNA, 20 nt, Chlamydophila pneumoniae J138
aggauaaccaucaaucacuc

SEQ ID NO: 545938 - RNA, 12 nt, Chlamydophila pneumoniae J138
aggaguuuucca

SEQ ID NO: 545939 - RNA, 16 nt, Chlamydophila pneumoniae J138
aggaggauuuccuagg

SEQ ID NO: 545940 - RNA, 21 nt, Chlamydophila pneumoniae J138
aggacguaacguagucaaaaa

SEQ ID NO: 545941 - RNA, 18 nt, Chlamydophila pneumoniae J138
aggaguauagcaugaucu

SEQ ID NO: 545942 - RNA, 13 nt, Chlamydophila pneumoniae J138
aggagguggugga

SEQ ID NO: 545943 - RNA, 15 nt, Chlamydophila pneumoniae J138
aggaucugguugagg

SEQ ID NO: 545944 - RNA, 14 nt, Chlamydophila pneumoniae J138
aggaucuucuauuu

SEQ ID NO: 545945 - RNA, 17 nt, Chlamydophila pneumoniae J138
aggaucauuaaagucca

SEQ ID NO: 545946 - RNA, 16 nt, Chlamydophila pneumoniae J138
aggauggaaucaggga

SEQ ID NO: 545947 - RNA, 17 nt, Chlamydophila pneumoniae J138
aggauguuguggaucag

SEQ ID NO: 545948 - RNA, 14 nt, Chlamydophila pneumoniae J138
aggcaaagauuucc

SEQ ID NO: 545949 - RNA, 12 nt, Chlamydophila pneumoniae J138
aggcaaagauca

SEQ ID NO: 545950 - RNA, 20 nt, Chlamydophila pneumoniae J138
aggcaggccacuuccuauaa

SEQ ID NO: 545951 - RNA, 21 nt, Chlamydophila pneumoniae J138
aggcagauagacaaccuagaa

SEQ ID NO: 545952 - RNA, 13 nt, Chlamydophila pneumoniae J138
aggcaucacuaau

SEQ ID NO: 545953 - RNA, 22 nt, Chlamydophila pneumoniae J138
aggcucuacaggagaagcggaa

SEQ ID NO: 545954 - RNA, 21 nt, Chlamydophila pneumoniae J138
aggcucuuaucgugacucuua

SEQ ID NO: 545955 - RNA, 14 nt, Chlamydophila pneumoniae J138
aggcucuuuuagag

SEQ ID NO: 545956 - RNA, 14 nt, Chlamydophila pneumoniae J138
aggcuauuguguuu

SEQ ID NO: 545957 - RNA, 21 nt, Chlamydophila pneumoniae J138
aggcugccagagauucuucac

SEQ ID NO: 545958 - RNA, 16 nt, Chlamydophila pneumoniae J138
aggcugcacacauccu

SEQ ID NO: 545959 - RNA, 21 nt, Chlamydophila pneumoniae J138
aggcuguccuugcagcccugc

SEQ ID NO: 545960 - RNA, 19 nt, Chlamydophila pneumoniae J138
aggcugucguuaccguuuc

SEQ ID NO: 545961 - RNA, 12 nt, Chlamydophila pneumoniae J138
agggaucccaaa

SEQ ID NO: 545962 - RNA, 10 nt, Chlamydophila pneumoniae J138
agggauccca

SEQ ID NO: 545963 - RNA, 17 nt, Chlamydophila pneumoniae J138
aggcuuaauaaacauca

SEQ ID NO: 545964 - RNA, 15 nt, Chlamydophila pneumoniae J138
agggaugcucuagaa

SEQ ID NO: 545965 - RNA, 15 nt, Chlamydophila pneumoniae J138
agggaugcagaucau

SEQ ID NO: 545966 - RNA, 12 nt, Chlamydophila pneumoniae J138
agggaugggauc

SEQ ID NO: 545967 - RNA, 22 nt, Chlamydophila pneumoniae J138
agggcauucuguaauuuugaga

SEQ ID NO: 545968 - RNA, 23 nt, Chlamydophila pneumoniae J138
agggggaucuucagagagaacag

SEQ ID NO: 545969 - RNA, 18 nt, Chlamydophila pneumoniae J138
agggggaucuucagagag

SEQ ID NO: 545970 - RNA, 13 nt, Chlamydophila pneumoniae J138
aggggcuuuccuu

SEQ ID NO: 545971 - RNA, 14 nt, Chlamydophila pneumoniae J138
aggggaagaggaau

SEQ ID NO: 545972 - RNA, 15 nt, Chlamydophila pneumoniae J138
aggguucucaaagau

SEQ ID NO: 545973 - RNA, 15 nt, Chlamydophila pneumoniae J138
aggguguuugcauag

SEQ ID NO: 545974 - RNA, 15 nt, Chlamydophila pneumoniae J138
agguaaaauaaagag

SEQ ID NO: 545975 - RNA, 21 nt, Chlamydophila pneumoniae J138
aggguugugucucugaagacc

SEQ ID NO: 545976 - RNA, 17 nt, Chlamydophila pneumoniae J138
agggucgcugauaaaau

SEQ ID NO: 545977 - RNA, 23 nt, Chlamydophila pneumoniae J138
agggucggauuuagauuaaagag

SEQ ID NO: 545978 - RNA, 20 nt, Chlamydophila pneumoniae J138
agguauugcaaauuucauuu

SEQ ID NO: 545979 - RNA, 15 nt, Chlamydophila pneumoniae J138
agguaaccagagagc

SEQ ID NO: 545980 - RNA, 23 nt, Chlamydophila pneumoniae J138
agguauuuccuucuguuuucaca

SEQ ID NO: 545981 - RNA, 16 nt, Chlamydophila pneumoniae J138
agguaaauuuuuaaaa

SEQ ID NO: 545982 - RNA, 19 nt, Chlamydophila pneumoniae J138
agguaaauuuuuaaaacuc

SEQ ID NO: 545983 - RNA, 21 nt, Chlamydophila pneumoniae J138
aggucagcaaggggaguuuuc

SEQ ID NO: 545984 - RNA, 15 nt, Chlamydophila pneumoniae J138
aggucagcccugccu

SEQ ID NO: 545985 - RNA, 15 nt, Chlamydophila pneumoniae J138
aggucuuuucuuuuu

SEQ ID NO: 545986 - RNA, 14 nt, Chlamydophila pneumoniae J138
aggugaaaguacag

SEQ ID NO: 545987 - RNA, 17 nt, Chlamydophila pneumoniae J138
aggucugcugaggagag

SEQ ID NO: 545988 - RNA, 14 nt, Chlamydophila pneumoniae J138
agguuagaagggag

SEQ ID NO: 545989 - RNA, 16 nt, Chlamydophila pneumoniae J138
agguuagaagggaggu

SEQ ID NO: 545990 - RNA, 20 nt, Chlamydophila pneumoniae J138
agguuuuuccaacuucaacu

SEQ ID NO: 545991 - RNA, 23 nt, Chlamydophila pneumoniae J138
agguuuugaagcuccucacaucu

SEQ ID NO: 545992 - RNA, 17 nt, Chlamydophila pneumoniae J138
agguuccugcuugauuu

SEQ ID NO: 545993 - RNA, 21 nt, Chlamydophila pneumoniae J138
agguuauuuaauccaaaaacu

SEQ ID NO: 545994 - RNA, 23 nt, Chlamydophila pneumoniae J138
aguaaauauuuuaccauugagau

SEQ ID NO: 545995 - RNA, 14 nt, Chlamydophila pneumoniae J138
aguaacugcaaaga

SEQ ID NO: 545996 - RNA, 13 nt, Chlamydophila pneumoniae J138
aguaacuaucuac

SEQ ID NO: 545997 - RNA, 15 nt, Chlamydophila pneumoniae J138
aguaagaagucuuca

SEQ ID NO: 545998 - RNA, 15 nt, Chlamydophila pneumoniae J138
aguacaggcuccauc

SEQ ID NO: 545999 - RNA, 13 nt, Chlamydophila pneumoniae J138
aguaaggagagac

SEQ ID NO: 546000 - RNA, 17 nt, Chlamydophila pneumoniae J138
aguaaggaacaauguaa

SEQ ID NO: 546001 - RNA, 19 nt, Chlamydophila pneumoniae J138
aguaaggaacaauguaaau

SEQ ID NO: 546002 - RNA, 23 nt, Chlamydophila pneumoniae J138
aguacgaccaacuccucaaaaga

SEQ ID NO: 546003 - RNA, 16 nt, Chlamydophila pneumoniae J138
aguacgauccaucuca

SEQ ID NO: 546004 - RNA, 23 nt, Chlamydophila pneumoniae J138
aguaccuucucgucauucugcaa

SEQ ID NO: 546005 - RNA, 16 nt, Chlamydophila pneumoniae J138
aguaccuaggaucuac

SEQ ID NO: 546006 - RNA, 18 nt, Chlamydophila pneumoniae J138
aguaccuaggaucuacau

SEQ ID NO: 546007 - RNA, 18 nt, Chlamydophila pneumoniae J138
aguacauuaucacagcaa

SEQ ID NO: 546008 - RNA, 19 nt, Chlamydophila pneumoniae J138
accaagaugucuccaaaga

SEQ ID NO: 546009 - RNA, 15 nt, Chlamydophila pneumoniae J138
accaacugagcuauu

SEQ ID NO: 546010 - RNA, 23 nt, Chlamydophila pneumoniae J138
accagauaaagcaaagauaaaga

SEQ ID NO: 546011 - RNA, 15 nt, Chlamydophila pneumoniae J138
accagcauuaagaua

SEQ ID NO: 546012 - RNA, 19 nt, Chlamydophila pneumoniae J138
accaggagcuccuccuuga

SEQ ID NO: 546013 - RNA, 16 nt, Chlamydophila pneumoniae J138
accaggagcuccuccu

SEQ ID NO: 546014 - RNA, 20 nt, Chlamydophila pneumoniae J138
accagguagagugucuuccu

SEQ ID NO: 546015 - RNA, 18 nt, Chlamydophila pneumoniae J138
accauccgacuuuccuca

SEQ ID NO: 546016 - RNA, 12 nt, Chlamydophila pneumoniae J138
accauaaaacaa

SEQ ID NO: 546017 - RNA, 19 nt, Chlamydophila pneumoniae J138
acccccuggcugggcuaca

SEQ ID NO: 546018 - RNA, 20 nt, Chlamydophila pneumoniae J138
accccaaucaguucaucuag

SEQ ID NO: 546019 - RNA, 14 nt, Chlamydophila pneumoniae J138
acccauaaucccua

SEQ ID NO: 546020 - RNA, 22 nt, Chlamydophila pneumoniae J138
acccauguuucuuccugaauca

SEQ ID NO: 546021 - RNA, 18 nt, Chlamydophila pneumoniae J138
acccaguuguauccagcu

SEQ ID NO: 546022 - RNA, 20 nt, Chlamydophila pneumoniae J138
accaucugcguuuaaggguu

SEQ ID NO: 546023 - RNA, 19 nt, Chlamydophila pneumoniae J138
accaugaagguagccgagg

SEQ ID NO: 546024 - RNA, 16 nt, Chlamydophila pneumoniae J138
acccacgcaugccucu

SEQ ID NO: 546025 - RNA, 20 nt, Chlamydophila pneumoniae J138
acccagagaauguucccaaa

SEQ ID NO: 546026 - RNA, 21 nt, Chlamydophila pneumoniae J138
acccagagaauguucccaaau

SEQ ID NO: 546027 - RNA, 13 nt, Chlamydophila pneumoniae J138
acccacuccagaa

SEQ ID NO: 546028 - RNA, 18 nt, Chlamydophila pneumoniae J138
acccugggcucacucuaa

SEQ ID NO: 546029 - RNA, 20 nt, Chlamydophila pneumoniae J138
acccuuuauacuguuuuucu

SEQ ID NO: 546030 - RNA, 21 nt, Chlamydophila pneumoniae J138
acccucaaagaauacucuaag

SEQ ID NO: 546031 - RNA, 19 nt, Chlamydophila pneumoniae J138
accgaaaaaccuucuccaa

SEQ ID NO: 546032 - RNA, 20 nt, Chlamydophila pneumoniae J138
accgaaucucuccagcuuga

SEQ ID NO: 546033 - RNA, 16 nt, Chlamydophila pneumoniae J138
accgaaucucuccagc

SEQ ID NO: 546034 - RNA, 21 nt, Chlamydophila pneumoniae J138
accgacauacucgucaaauuc

SEQ ID NO: 546035 - RNA, 19 nt, Chlamydophila pneumoniae J138
accgagcuuuuugcuuuuc

SEQ ID NO: 546036 - RNA, 21 nt, Chlamydophila pneumoniae J138
accgcaaaaagcuucuuucuu

SEQ ID NO: 546037 - RNA, 18 nt, Chlamydophila pneumoniae J138
accggacugacuucuaug

SEQ ID NO: 546038 - RNA, 17 nt, Chlamydophila pneumoniae J138
accguaaagaaaagcaa

SEQ ID NO: 546039 - RNA, 16 nt, Chlamydophila pneumoniae J138
accguaaagaaaagca

SEQ ID NO: 546040 - RNA, 18 nt, Chlamydophila pneumoniae J138
accguaaagaaaagcaau

SEQ ID NO: 546041 - RNA, 19 nt, Chlamydophila pneumoniae J138
accguaacugaggcaaaga

SEQ ID NO: 546042 - RNA, 17 nt, Chlamydophila pneumoniae J138
accuacguuuucucuau

SEQ ID NO: 546043 - RNA, 20 nt, Chlamydophila pneumoniae J138
accuacuaaacccuguccaa

SEQ ID NO: 546044 - RNA, 13 nt, Chlamydophila pneumoniae J138
accuacuuauugu

SEQ ID NO: 546045 - RNA, 22 nt, Chlamydophila pneumoniae J138
accuacagaucaggauucuaaa

SEQ ID NO: 546046 - RNA, 20 nt, Chlamydophila pneumoniae J138
accuauuugcaacaaucuuu

SEQ ID NO: 546047 - RNA, 15 nt, Chlamydophila pneumoniae J138
accucaaagccaucu

SEQ ID NO: 546048 - RNA, 13 nt, Chlamydophila pneumoniae J138
accuaauacagga

SEQ ID NO: 546049 - RNA, 15 nt, Chlamydophila pneumoniae J138
accguuuccuccucu

SEQ ID NO: 546050 - RNA, 18 nt, Chlamydophila pneumoniae J138
accugcaaaugaagggau

SEQ ID NO: 546051 - RNA, 14 nt, Chlamydophila pneumoniae J138
accuugaaguuuuu

SEQ ID NO: 546052 - RNA, 21 nt, Chlamydophila pneumoniae J138
accuugagacaaagaaucccc

SEQ ID NO: 546053 - RNA, 13 nt, Chlamydophila pneumoniae J138
accuucacaagaa

SEQ ID NO: 546054 - RNA, 16 nt, Chlamydophila pneumoniae J138
accuucacaagaaaac

SEQ ID NO: 546055 - RNA, 13 nt, Chlamydophila pneumoniae J138
acgacaaaucacg

SEQ ID NO: 546056 - RNA, 14 nt, Chlamydophila pneumoniae J138
acgacaaggacagg

SEQ ID NO: 546057 - RNA, 22 nt, Chlamydophila pneumoniae J138
acgaauugcuugcgcaucagca

SEQ ID NO: 546058 - RNA, 24 nt, Chlamydophila pneumoniae J138
acgaauguguugcucuaccaacug

SEQ ID NO: 546059 - RNA, 23 nt, Chlamydophila pneumoniae J138
acgaaaaucuacacgcuauagca

SEQ ID NO: 546060 - RNA, 18 nt, Chlamydophila pneumoniae J138
accuuugguagaaagaca

SEQ ID NO: 546061 - RNA, 22 nt, Chlamydophila pneumoniae J138
accuuugguagaaagacaaaaa

SEQ ID NO: 546062 - RNA, 15 nt, Chlamydophila pneumoniae J138
accuuuggauucaga

SEQ ID NO: 546063 - RNA, 14 nt, Chlamydophila pneumoniae J138
acgaauaauuaaau

SEQ ID NO: 546064 - RNA, 15 nt, Chlamydophila pneumoniae J138
acgaaagcagugugc

SEQ ID NO: 546065 - RNA, 15 nt, Chlamydophila pneumoniae J138
acgaaagcacauaag

SEQ ID NO: 546066 - RNA, 16 nt, Chlamydophila pneumoniae J138
acgaaucguuucucug

SEQ ID NO: 546067 - RNA, 16 nt, Chlamydophila pneumoniae J138
acgaauccaaaaaaga

SEQ ID NO: 546068 - RNA, 20 nt, Chlamydophila pneumoniae J138
acgacguuuaauuccuugga

SEQ ID NO: 546069 - RNA, 16 nt, Chlamydophila pneumoniae J138
acgacgucaucaccau

SEQ ID NO: 546070 - RNA, 16 nt, Chlamydophila pneumoniae J138
acgaccucgaauuccu

SEQ ID NO: 546071 - RNA, 21 nt, Chlamydophila pneumoniae J138
acgagcaugcuaagcaucaga

SEQ ID NO: 546072 - RNA, 17 nt, Chlamydophila pneumoniae J138
acgacucugccaugucu

SEQ ID NO: 546073 - RNA, 18 nt, Chlamydophila pneumoniae J138
acgacucugccaugucua

SEQ ID NO: 546074 - RNA, 17 nt, Chlamydophila pneumoniae J138
acgauaguacuuauccu

SEQ ID NO: 546075 - RNA, 22 nt, Chlamydophila pneumoniae J138
acgauauuugggauauuggaga

SEQ ID NO: 546076 - RNA, 21 nt, Chlamydophila pneumoniae J138
acgaucacauuccaagaaaaa

SEQ ID NO: 546077 - RNA, 18 nt, Chlamydophila pneumoniae J138
acgcccacggaaagcaca

SEQ ID NO: 546078 - RNA, 13 nt, Chlamydophila pneumoniae J138
acgcccaugucuu

SEQ ID NO: 546079 - RNA, 19 nt, Chlamydophila pneumoniae J138
acgccuucaagucgagaaa

SEQ ID NO: 546080 - RNA, 13 nt, Chlamydophila pneumoniae J138
acgccuucaaguc

SEQ ID NO: 546081 - RNA, 18 nt, Chlamydophila pneumoniae J138
acgccuccuucaaagaua

SEQ ID NO: 546082 - RNA, 17 nt, Chlamydophila pneumoniae J138
acgcucccuaugccagu

SEQ ID NO: 546083 - RNA, 20 nt, Chlamydophila pneumoniae J138
acgggcaauauauccaggau

SEQ ID NO: 546084 - RNA, 22 nt, Chlamydophila pneumoniae J138
acguauagguugaauaaauuuu

SEQ ID NO: 546085 - RNA, 19 nt, Chlamydophila pneumoniae J138
acguccucaccuugugaga

SEQ ID NO: 546086 - RNA, 21 nt, Chlamydophila pneumoniae J138
acguccauuucauguaagaau

SEQ ID NO: 546087 - RNA, 15 nt, Chlamydophila pneumoniae J138
acgucagcuguccuc

SEQ ID NO: 546088 - RNA, 12 nt, Chlamydophila pneumoniae J138
acgugguuuuug

SEQ ID NO: 546089 - RNA, 16 nt, Chlamydophila pneumoniae J138
acgucuccaacagucu

SEQ ID NO: 546090 - RNA, 16 nt, Chlamydophila pneumoniae J138
acgucuaaagacgaag

SEQ ID NO: 546091 - RNA, 18 nt, Chlamydophila pneumoniae J138
acguucccacgagcacaa

SEQ ID NO: 546092 - RNA, 16 nt, Chlamydophila pneumoniae J138
acuacucucaucaagg

SEQ ID NO: 546093 - RNA, 21 nt, Chlamydophila pneumoniae J138
acuacugagcuucuauuucua

SEQ ID NO: 546094 - RNA, 18 nt, Chlamydophila pneumoniae J138
acuaggcaugguaggagc

SEQ ID NO: 546095 - RNA, 21 nt, Chlamydophila pneumoniae J138
acuacuguagaguuuucuuuc

SEQ ID NO: 546096 - RNA, 21 nt, Chlamydophila pneumoniae J138
acuacuuaaagcuugagaaaa

SEQ ID NO: 546097 - RNA, 12 nt, Chlamydophila pneumoniae J138
acuagaaaaaau

SEQ ID NO: 546098 - RNA, 20 nt, Chlamydophila pneumoniae J138
acuagcucucuugcuauacc

SEQ ID NO: 546099 - RNA, 14 nt, Chlamydophila pneumoniae J138
acuaggaaaagcau

SEQ ID NO: 546100 - RNA, 22 nt, Chlamydophila pneumoniae J138
acuaggaaaagcauagucgucu

SEQ ID NO: 546101 - RNA, 20 nt, Chlamydophila pneumoniae J138
acuaucauggacaagcaaaa

SEQ ID NO: 546102 - RNA, 11 nt, Chlamydophila pneumoniae J138
acuaucuacac

SEQ ID NO: 546103 - RNA, 15 nt, Chlamydophila pneumoniae J138
acuaucuacacagua

SEQ ID NO: 546104 - RNA, 19 nt, Chlamydophila pneumoniae J138
acuaucgguuuaaacagau

SEQ ID NO: 546105 - RNA, 16 nt, Chlamydophila pneumoniae J138
acuaucgcaaauuucc

SEQ ID NO: 546106 - RNA, 19 nt, Chlamydophila pneumoniae J138
acucacauuugcuuuaaca

SEQ ID NO: 546107 - RNA, 22 nt, Chlamydophila pneumoniae J138
acucacagaguucgcgaccugu

SEQ ID NO: 546108 - RNA, 19 nt, Chlamydophila pneumoniae J138
acucacaaacaacagaaau

SEQ ID NO: 546109 - RNA, 15 nt, Chlamydophila pneumoniae J138
acuauguuauccaua

SEQ ID NO: 546110 - RNA, 15 nt, Chlamydophila pneumoniae J138
acuaugguaagcauu

SEQ ID NO: 546111 - RNA, 20 nt, Chlamydophila pneumoniae J138
acucaaauucaaaauagaag

SEQ ID NO: 546112 - RNA, 16 nt, Chlamydophila pneumoniae J138
acucaaauucaaaaua

SEQ ID NO: 546113 - RNA, 21 nt, Chlamydophila pneumoniae J138
acucaaaucuuucaaggaaca

SEQ ID NO: 546114 - RNA, 15 nt, Chlamydophila pneumoniae J138
acucaugaaagugcu

SEQ ID NO: 546115 - RNA, 13 nt, Chlamydophila pneumoniae J138
acuccacuuuuuu

SEQ ID NO: 546116 - RNA, 14 nt, Chlamydophila pneumoniae J138
acuccacuuuuuuc

SEQ ID NO: 546117 - RNA, 14 nt, Chlamydophila pneumoniae J138
acuccagaaaguau

SEQ ID NO: 546118 - RNA, 17 nt, Chlamydophila pneumoniae J138
acuccaagucagccaag

SEQ ID NO: 546119 - RNA, 21 nt, Chlamydophila pneumoniae J138
acuccaagucagccaagacaa

SEQ ID NO: 546120 - RNA, 21 nt, Chlamydophila pneumoniae J138
acucaggauauauagagcaga

SEQ ID NO: 546121 - RNA, 22 nt, Chlamydophila pneumoniae J138
acucagcgcaucacgaaaagga

SEQ ID NO: 546122 - RNA, 23 nt, Chlamydophila pneumoniae J138
acucagcguucgcucucuuuaaa

SEQ ID NO: 546123 - RNA, 14 nt, Chlamydophila pneumoniae J138
acucagagauugcc

SEQ ID NO: 546124 - RNA, 13 nt, Chlamydophila pneumoniae J138
acucagagaaaau

SEQ ID NO: 546125 - RNA, 15 nt, Chlamydophila pneumoniae J138
acucagagaaaauca

SEQ ID NO: 546126 - RNA, 12 nt, Chlamydophila pneumoniae J138
acucagagauug

SEQ ID NO: 546127 - RNA, 12 nt, Chlamydophila pneumoniae J138
acucaucacaau

SEQ ID NO: 546128 - RNA, 14 nt, Chlamydophila pneumoniae J138
acucaucaguaaaa

SEQ ID NO: 546129 - RNA, 16 nt, Chlamydophila pneumoniae J138
acuccauucagauggu

SEQ ID NO: 546130 - RNA, 16 nt, Chlamydophila pneumoniae J138
acuccgagcauuuuac

SEQ ID NO: 546131 - RNA, 16 nt, Chlamydophila pneumoniae J138
acuccaggggauaaaa

SEQ ID NO: 546132 - RNA, 21 nt, Chlamydophila pneumoniae J138
acuccuuugagucuuuuucag

SEQ ID NO: 546133 - RNA, 14 nt, Chlamydophila pneumoniae J138
acuccugacucuua

SEQ ID NO: 546134 - RNA, 19 nt, Chlamydophila pneumoniae J138
acucgccauaauagucucu

SEQ ID NO: 546135 - RNA, 17 nt, Chlamydophila pneumoniae J138
acucgccgaaaguaucu

SEQ ID NO: 546136 - RNA, 23 nt, Chlamydophila pneumoniae J138
acugacuucuaugauaucaccag

SEQ ID NO: 546137 - RNA, 21 nt, Chlamydophila pneumoniae J138
acugaauaguagaguugacaa

SEQ ID NO: 546138 - RNA, 24 nt, Chlamydophila pneumoniae J138
acugaagagcaauuaagaaacuag

SEQ ID NO: 546139 - RNA, 18 nt, Chlamydophila pneumoniae J138
acugaacgccaucuccac

SEQ ID NO: 546140 - RNA, 16 nt, Chlamydophila pneumoniae J138
acucucaucagcaaaa

SEQ ID NO: 546141 - RNA, 14 nt, Chlamydophila pneumoniae J138
acucgucaaauuca

SEQ ID NO: 546142 - RNA, 19 nt, Chlamydophila pneumoniae J138
acucguguggaucacguaa

SEQ ID NO: 546143 - RNA, 15 nt, Chlamydophila pneumoniae J138
acucuagguuuucuc

SEQ ID NO: 546144 - RNA, 17 nt, Chlamydophila pneumoniae J138
acucuagguuuucucuu

SEQ ID NO: 546145 - RNA, 22 nt, Chlamydophila pneumoniae J138
acucuaugaucuacagauaggg

SEQ ID NO: 546146 - RNA, 16 nt, Chlamydophila pneumoniae J138
acucuagggucaagaa

SEQ ID NO: 546147 - RNA, 21 nt, Chlamydophila pneumoniae J138
acugcuacuuuaaaguggcaa

SEQ ID NO: 546148 - RNA, 14 nt, Chlamydophila pneumoniae J138
acugcucaaugaca

SEQ ID NO: 546149 - RNA, 19 nt, Chlamydophila pneumoniae J138
acugcuuacaauugaaaau

SEQ ID NO: 546150 - RNA, 22 nt, Chlamydophila pneumoniae J138
acugaugccaagaaauauacug

SEQ ID NO: 546151 - RNA, 18 nt, Chlamydophila pneumoniae J138
acugccagcgaucacaua

SEQ ID NO: 546152 - RNA, 13 nt, Chlamydophila pneumoniae J138
acugcagauugca

SEQ ID NO: 546153 - RNA, 15 nt, Chlamydophila pneumoniae J138
acugggaaaucuaaa

SEQ ID NO: 546154 - RNA, 16 nt, Chlamydophila pneumoniae J138
acugcuucaaaacaua

SEQ ID NO: 546155 - RNA, 17 nt, Chlamydophila pneumoniae J138
acuggcgacuugccaau

SEQ ID NO: 546156 - RNA, 18 nt, Chlamydophila pneumoniae J138
acuguuaacaagauucuc

SEQ ID NO: 546157 - RNA, 18 nt, Chlamydophila pneumoniae J138
acuguguucaauagcaaa

SEQ ID NO: 546158 - RNA, 15 nt, Chlamydophila pneumoniae J138
acuguguaugaauca

SEQ ID NO: 546159 - RNA, 17 nt, Chlamydophila pneumoniae J138
acuguguucaauagcaa

SEQ ID NO: 546160 - RNA, 14 nt, Chlamydophila pneumoniae J138
acuguccauccaaa

SEQ ID NO: 546161 - RNA, 21 nt, Chlamydophila pneumoniae J138
acugucauguauccgaaaucu

SEQ ID NO: 546162 - RNA, 22 nt, Chlamydophila pneumoniae J138
acuguaaauuucauuugaaaua

SEQ ID NO: 546163 - RNA, 22 nt, Chlamydophila pneumoniae J138
acuguuuguuuauuaucuacag

SEQ ID NO: 546164 - RNA, 19 nt, Chlamydophila pneumoniae J138
acuguuuuuuaucuccuga

SEQ ID NO: 546165 - RNA, 15 nt, Chlamydophila pneumoniae J138
acuguuuuucuucca

SEQ ID NO: 546166 - RNA, 19 nt, Chlamydophila pneumoniae J138
acuguuuguuuauuaucua

SEQ ID NO: 546167 - RNA, 21 nt, Chlamydophila pneumoniae J138
acuguuuguuuauuaucuaca

SEQ ID NO: 546168 - RNA, 24 nt, Chlamydophila pneumoniae J138
acuuaggguucucaaagaucaucu

SEQ ID NO: 546169 - RNA, 14 nt, Chlamydophila pneumoniae J138
acuuaauccuguag

SEQ ID NO: 546170 - RNA, 13 nt, Chlamydophila pneumoniae J138
acuuaagauacuu

SEQ ID NO: 546171 - RNA, 19 nt, Chlamydophila pneumoniae J138
agcaacgcaugacgcuuuu

SEQ ID NO: 546172 - RNA, 22 nt, Chlamydophila pneumoniae J138
agcaacgcaugacgcuuuucca

SEQ ID NO: 546173 - RNA, 17 nt, Chlamydophila pneumoniae J138
agauuaugaugccucau

SEQ ID NO: 546174 - RNA, 14 nt, Chlamydophila pneumoniae J138
agcaacuaaacucu

SEQ ID NO: 546175 - RNA, 20 nt, Chlamydophila pneumoniae J138
agcaacuacagagggcuuca

SEQ ID NO: 546176 - RNA, 23 nt, Chlamydophila pneumoniae J138
agcaacuucuucguuagagaaga

SEQ ID NO: 546177 - RNA, 23 nt, Chlamydophila pneumoniae J138
agcaaguuguugauaauuacaga

SEQ ID NO: 546178 - RNA, 15 nt, Chlamydophila pneumoniae J138
agcaaguagcucucu

SEQ ID NO: 546179 - RNA, 18 nt, Chlamydophila pneumoniae J138
agcaaggggaguuuucuu

SEQ ID NO: 546180 - RNA, 19 nt, Chlamydophila pneumoniae J138
agcaaggggaguuuucuua

SEQ ID NO: 546181 - RNA, 17 nt, Chlamydophila pneumoniae J138
agcaagagcucuugaga

SEQ ID NO: 546182 - RNA, 17 nt, Chlamydophila pneumoniae J138
agcaagauuuuguagga

SEQ ID NO: 546183 - RNA, 12 nt, Chlamydophila pneumoniae J138
agcaagauggca

SEQ ID NO: 546184 - RNA, 13 nt, Chlamydophila pneumoniae J138
agcaagagcucuu

SEQ ID NO: 546185 - RNA, 19 nt, Chlamydophila pneumoniae J138
agcaagaaaauaggugacu

SEQ ID NO: 546186 - RNA, 15 nt, Chlamydophila pneumoniae J138
agcaagaaucacugc

SEQ ID NO: 546187 - RNA, 21 nt, Chlamydophila pneumoniae J138
agcaaucccccagcauucacu

SEQ ID NO: 546188 - RNA, 18 nt, Chlamydophila pneumoniae J138
agcaaucguguuuuccug

SEQ ID NO: 546189 - RNA, 16 nt, Chlamydophila pneumoniae J138
agcaaugauguuuuuu

SEQ ID NO: 546190 - RNA, 20 nt, Chlamydophila pneumoniae J138
agcaaugccucuaauacguu

SEQ ID NO: 546191 - RNA, 13 nt, Chlamydophila pneumoniae J138
agcaauaucugug

SEQ ID NO: 546192 - RNA, 20 nt, Chlamydophila pneumoniae J138
agcaauaucuauagaaggca

SEQ ID NO: 546193 - RNA, 18 nt, Chlamydophila pneumoniae J138
agcaauucgguagagcua

SEQ ID NO: 546194 - RNA, 19 nt, Chlamydophila pneumoniae J138
agcaauggcuuuuuuuguc

SEQ ID NO: 546195 - RNA, 22 nt, Chlamydophila pneumoniae J138
agcacauacaguacgcaaagua

SEQ ID NO: 546196 - RNA, 14 nt, Chlamydophila pneumoniae J138
agcaccauaaugga

SEQ ID NO: 546197 - RNA, 20 nt, Chlamydophila pneumoniae J138
agcagaaguccuaucaaagc

SEQ ID NO: 546198 - RNA, 18 nt, Chlamydophila pneumoniae J138
agcagaaucauaaucugc

SEQ ID NO: 546199 - RNA, 13 nt, Chlamydophila pneumoniae J138
agcacuuaaaaaa

SEQ ID NO: 546200 - RNA, 22 nt, Chlamydophila pneumoniae J138
agcacuuaaaaaacuuccuaac

SEQ ID NO: 546201 - RNA, 17 nt, Chlamydophila pneumoniae J138
agcacgcacuaaucuau

SEQ ID NO: 546202 - RNA, 14 nt, Chlamydophila pneumoniae J138
agcacgcacuaauc

SEQ ID NO: 546203 - RNA, 19 nt, Chlamydophila pneumoniae J138
agcacgagcgggagaauca

SEQ ID NO: 546204 - RNA, 14 nt, Chlamydophila pneumoniae J138
agcagccucuucuc

SEQ ID NO: 546205 - RNA, 14 nt, Chlamydophila pneumoniae J138
aaaaccuucuccaa

SEQ ID NO: 546206 - RNA, 23 nt, Chlamydophila pneumoniae J138
agcagaccucucccuugggauuc

SEQ ID NO: 546207 - RNA, 16 nt, Chlamydophila pneumoniae J138
agcagacgaauaacua

SEQ ID NO: 546208 - RNA, 17 nt, Chlamydophila pneumoniae J138
agcagcuucgcaaucuu

SEQ ID NO: 546209 - RNA, 22 nt, Chlamydophila pneumoniae J138
agcagcugucaauccaacaaag

SEQ ID NO: 546210 - RNA, 21 nt, Chlamydophila pneumoniae J138
agcauccuguagagcaagauu

SEQ ID NO: 546211 - RNA, 17 nt, Chlamydophila pneumoniae J138
agcauccuguagagcaa

SEQ ID NO: 546212 - RNA, 20 nt, Chlamydophila pneumoniae J138
agcaggugugugguaaaaau

SEQ ID NO: 546213 - RNA, 14 nt, Chlamydophila pneumoniae J138
agcauaaacaaagc

SEQ ID NO: 546214 - RNA, 12 nt, Chlamydophila pneumoniae J138
agcauaaaaauu

SEQ ID NO: 546215 - RNA, 17 nt, Chlamydophila pneumoniae J138
agcaguugcaauaccaa

SEQ ID NO: 546216 - RNA, 21 nt, Chlamydophila pneumoniae J138
agcauuuucucugagcagcuu

SEQ ID NO: 546217 - RNA, 22 nt, Chlamydophila pneumoniae J138
agcauuuuacgaaucuuuuuca

SEQ ID NO: 546218 - RNA, 16 nt, Chlamydophila pneumoniae J138
agcauuucuuucucuu

SEQ ID NO: 546219 - RNA, 21 nt, Chlamydophila pneumoniae J138
agcauuucucuaugagaacgu

SEQ ID NO: 546220 - RNA, 22 nt, Chlamydophila pneumoniae J138
agcauuguuuguccuaggagag

SEQ ID NO: 546221 - RNA, 23 nt, Chlamydophila pneumoniae J138
agcauucccgacucaaucaaauu

SEQ ID NO: 546222 - RNA, 18 nt, Chlamydophila pneumoniae J138
agcauucugcuagagcuu

SEQ ID NO: 546223 - RNA, 16 nt, Chlamydophila pneumoniae J138
agcauucugcuagagc

SEQ ID NO: 546224 - RNA, 17 nt, Chlamydophila pneumoniae J138
agcauucugcuagagcu

SEQ ID NO: 546225 - RNA, 21 nt, Chlamydophila pneumoniae J138
agcaucugagucauaagcucu

SEQ ID NO: 546226 - RNA, 22 nt, Chlamydophila pneumoniae J138
agcaucugagucauaagcucua

SEQ ID NO: 546227 - RNA, 20 nt, Chlamydophila pneumoniae J138
agcauguucgauuuucucuu

SEQ ID NO: 546228 - RNA, 15 nt, Chlamydophila pneumoniae J138
agcaugugcagaagg

SEQ ID NO: 546229 - RNA, 13 nt, Chlamydophila pneumoniae J138
agcauuaggaaag

SEQ ID NO: 546230 - RNA, 18 nt, Chlamydophila pneumoniae J138
agccacauucuucugaua

SEQ ID NO: 546231 - RNA, 17 nt, Chlamydophila pneumoniae J138
agccagcagaaggcugc

SEQ ID NO: 546232 - RNA, 19 nt, Chlamydophila pneumoniae J138
agccaaauaccaaggcugc

SEQ ID NO: 546233 - RNA, 17 nt, Chlamydophila pneumoniae J138
agccaaagucacucaaa

SEQ ID NO: 546234 - RNA, 17 nt, Chlamydophila pneumoniae J138
agccacagagaauugca

SEQ ID NO: 546235 - RNA, 13 nt, Chlamydophila pneumoniae J138
agcccuauagaaa

SEQ ID NO: 546236 - RNA, 18 nt, Chlamydophila pneumoniae J138
agccgauguugcagaaug

SEQ ID NO: 546237 - RNA, 20 nt, Chlamydophila pneumoniae J138
agcccuccaguuuuacgaac

SEQ ID NO: 546238 - RNA, 19 nt, Chlamydophila pneumoniae J138
agcccucgguuauuuuucc

SEQ ID NO: 546239 - RNA, 23 nt, Chlamydophila pneumoniae J138
agccucgagcagaaacuccaaaa

SEQ ID NO: 546240 - RNA, 19 nt, Chlamydophila pneumoniae J138
agccucccgaagacaaugu

SEQ ID NO: 546241 - RNA, 20 nt, Chlamydophila pneumoniae J138
agccucccgaagacaauguc

SEQ ID NO: 546242 - RNA, 22 nt, Chlamydophila pneumoniae J138
agccucacagaauuguuuuguu

SEQ ID NO: 546243 - RNA, 16 nt, Chlamydophila pneumoniae J138
agccuaugauaaagcc

SEQ ID NO: 546244 - RNA, 20 nt, Chlamydophila pneumoniae J138
agccuuagcagcacccauaa

SEQ ID NO: 546245 - RNA, 23 nt, Chlamydophila pneumoniae J138
agccuuacggccccuggaauuuc

SEQ ID NO: 546246 - RNA, 14 nt, Chlamydophila pneumoniae J138
agccucuucucuac

SEQ ID NO: 546247 - RNA, 12 nt, Chlamydophila pneumoniae J138
agccuuccuugu

SEQ ID NO: 546248 - RNA, 13 nt, Chlamydophila pneumoniae J138
agccuucauucca

SEQ ID NO: 546249 - RNA, 15 nt, Chlamydophila pneumoniae J138
agccuuggcucuaga

SEQ ID NO: 546250 - RNA, 21 nt, Chlamydophila pneumoniae J138
agccuuguaaauaguauacaa

SEQ ID NO: 546251 - RNA, 21 nt, Chlamydophila pneumoniae J138
agccuugauugaacagucuug

SEQ ID NO: 546252 - RNA, 20 nt, Chlamydophila pneumoniae J138
agcgaaccaaagucaugucc

SEQ ID NO: 546253 - RNA, 20 nt, Chlamydophila pneumoniae J138
agcgcucgugggaggaaucc

SEQ ID NO: 546254 - RNA, 22 nt, Chlamydophila pneumoniae J138
agcgcuuucuuuuauuaaggga

SEQ ID NO: 546255 - RNA, 21 nt, Chlamydophila pneumoniae J138
agcggaacguauccuugauuu

SEQ ID NO: 546256 - RNA, 21 nt, Chlamydophila pneumoniae J138
agcggaagcaccgccugaccu

SEQ ID NO: 546257 - RNA, 15 nt, Chlamydophila pneumoniae J138
agcggcaacauaauc

SEQ ID NO: 546258 - RNA, 18 nt, Chlamydophila pneumoniae J138
agcgguagcgucuagcua

SEQ ID NO: 546259 - RNA, 20 nt, Chlamydophila pneumoniae J138
agcguauaggaaacugucau

SEQ ID NO: 546260 - RNA, 22 nt, Chlamydophila pneumoniae J138
agcguauccgcugcccaugcuu

SEQ ID NO: 546261 - RNA, 16 nt, Chlamydophila pneumoniae J138
agaauuucgucuucau

SEQ ID NO: 546262 - RNA, 14 nt, Chlamydophila pneumoniae J138
agaauuuguccuuu

SEQ ID NO: 546263 - RNA, 14 nt, Chlamydophila pneumoniae J138
agaccuaaaaaggu

SEQ ID NO: 546264 - RNA, 17 nt, Chlamydophila pneumoniae J138
agaccguccuccccaua

SEQ ID NO: 546265 - RNA, 15 nt, Chlamydophila pneumoniae J138
aaaacauaucccaua

SEQ ID NO: 546266 - RNA, 21 nt, Chlamydophila pneumoniae J138
agaccuaacgcaacauccauu

SEQ ID NO: 546267 - RNA, 14 nt, Chlamydophila pneumoniae J138
agacgaaagagauu

SEQ ID NO: 546268 - RNA, 23 nt, Chlamydophila pneumoniae J138
agacgcuagguugcaugcuugaa

SEQ ID NO: 546269 - RNA, 19 nt, Chlamydophila pneumoniae J138
agacucaugaaauaguguu

SEQ ID NO: 546270 - RNA, 21 nt, Chlamydophila pneumoniae J138
agacucacauuugcuuuaaca

SEQ ID NO: 546271 - RNA, 13 nt, Chlamydophila pneumoniae J138
agacucagagaaa

SEQ ID NO: 546272 - RNA, 14 nt, Chlamydophila pneumoniae J138
agacucagagaaaa

SEQ ID NO: 546273 - RNA, 18 nt, Chlamydophila pneumoniae J138
agacucagagaaaaucaa

SEQ ID NO: 546274 - RNA, 18 nt, Chlamydophila pneumoniae J138
agacuagagucacuagca

SEQ ID NO: 546275 - RNA, 23 nt, Chlamydophila pneumoniae J138
agacuggucuaacuuagagcgaa

SEQ ID NO: 546276 - RNA, 21 nt, Chlamydophila pneumoniae J138
agacuuaaaguacguccugau

SEQ ID NO: 546277 - RNA, 19 nt, Chlamydophila pneumoniae J138
agacuuccucuucaauuuc

SEQ ID NO: 546278 - RNA, 20 nt, Chlamydophila pneumoniae J138
agacuucgaugucuuuccag

SEQ ID NO: 546279 - RNA, 15 nt, Chlamydophila pneumoniae J138
agacucucaucagca

SEQ ID NO: 546280 - RNA, 23 nt, Chlamydophila pneumoniae J138
agacucucacugagugucccaug

SEQ ID NO: 546281 - RNA, 13 nt, Chlamydophila pneumoniae J138
agacugaaaagau

SEQ ID NO: 546282 - RNA, 19 nt, Chlamydophila pneumoniae J138
agacucuaguuuuucuuua

SEQ ID NO: 546283 - RNA, 16 nt, Chlamydophila pneumoniae J138
agacucucuuccaaaa

SEQ ID NO: 546284 - RNA, 16 nt, Chlamydophila pneumoniae J138
agacugcaaaggaagg

SEQ ID NO: 546285 - RNA, 18 nt, Chlamydophila pneumoniae J138
agagacaagaaaauauca

SEQ ID NO: 546286 - RNA, 12 nt, Chlamydophila pneumoniae J138
agagaccuucuc

SEQ ID NO: 546287 - RNA, 20 nt, Chlamydophila pneumoniae J138
agagacaucguauauaagau

SEQ ID NO: 546288 - RNA, 16 nt, Chlamydophila pneumoniae J138
agagacuguagccuuu

SEQ ID NO: 546289 - RNA, 13 nt, Chlamydophila pneumoniae J138
agagaaugcccug

SEQ ID NO: 546290 - RNA, 21 nt, Chlamydophila pneumoniae J138
agagaauccuuuuuaggaaag

SEQ ID NO: 546291 - RNA, 18 nt, Chlamydophila pneumoniae J138
agagaaucuccucaucag

SEQ ID NO: 546292 - RNA, 19 nt, Chlamydophila pneumoniae J138
agagaaucuccucaucaga

SEQ ID NO: 546293 - RNA, 18 nt, Chlamydophila pneumoniae J138
agagaaucgagaacaguu

SEQ ID NO: 546294 - RNA, 22 nt, Chlamydophila pneumoniae J138
agagaauacucuagguuuucuc

SEQ ID NO: 546295 - RNA, 20 nt, Chlamydophila pneumoniae J138
agagaagagguguccauaau

SEQ ID NO: 546296 - RNA, 15 nt, Chlamydophila pneumoniae J138
agagaagaagcaaaa

SEQ ID NO: 546297 - RNA, 14 nt, Chlamydophila pneumoniae J138
agagaagacaggag

SEQ ID NO: 546298 - RNA, 13 nt, Chlamydophila pneumoniae J138
agacuuuccucuc

SEQ ID NO: 546299 - RNA, 14 nt, Chlamydophila pneumoniae J138
agacuuguauucuu

SEQ ID NO: 546300 - RNA, 17 nt, Chlamydophila pneumoniae J138
agacuuguucagcuaga

SEQ ID NO: 546301 - RNA, 15 nt, Chlamydophila pneumoniae J138
agagaacgaacaguu

SEQ ID NO: 546302 - RNA, 23 nt, Chlamydophila pneumoniae J138
agagauuuuucuaggaaucuuuu

SEQ ID NO: 546303 - RNA, 14 nt, Chlamydophila pneumoniae J138
agagauucuacaaa

SEQ ID NO: 546304 - RNA, 21 nt, Chlamydophila pneumoniae J138
agagauuuuccauaggaacaa

SEQ ID NO: 546305 - RNA, 22 nt, Chlamydophila pneumoniae J138
agagauuuuccauaggaacaaa

SEQ ID NO: 546306 - RNA, 23 nt, Chlamydophila pneumoniae J138
agagauagggggacaccugaaga

SEQ ID NO: 546307 - RNA, 17 nt, Chlamydophila pneumoniae J138
agagauucauaaaacug

SEQ ID NO: 546308 - RNA, 15 nt, Chlamydophila pneumoniae J138
agagagccuuuccua

SEQ ID NO: 546309 - RNA, 18 nt, Chlamydophila pneumoniae J138
agagagaucacuguauuu

SEQ ID NO: 546310 - RNA, 18 nt, Chlamydophila pneumoniae J138
agagaguuuguaacucaa

SEQ ID NO: 546311 - RNA, 17 nt, Chlamydophila pneumoniae J138
agagaguucucucuuca

SEQ ID NO: 546312 - RNA, 20 nt, Chlamydophila pneumoniae J138
agagaguauuuacaaggauu

SEQ ID NO: 546313 - RNA, 17 nt, Chlamydophila pneumoniae J138
agagagucggcuuuaga

SEQ ID NO: 546314 - RNA, 22 nt, Chlamydophila pneumoniae J138
agagagucggcuuuagaaaagu

SEQ ID NO: 546315 - RNA, 23 nt, Chlamydophila pneumoniae J138
agagagucuucguuucuuugagu

SEQ ID NO: 546316 - RNA, 19 nt, Chlamydophila pneumoniae J138
agagcccuugugcaucuau

SEQ ID NO: 546317 - RNA, 17 nt, Chlamydophila pneumoniae J138
agagcgcguuucaaaua

SEQ ID NO: 546318 - RNA, 16 nt, Chlamydophila pneumoniae J138
agagcgcguuucaaau

SEQ ID NO: 546319 - RNA, 13 nt, Chlamydophila pneumoniae J138
agagcuaugauga

SEQ ID NO: 546320 - RNA, 12 nt, Chlamydophila pneumoniae J138
agagcuagaaug

SEQ ID NO: 546321 - RNA, 13 nt, Chlamydophila pneumoniae J138
agauccaugaaca

SEQ ID NO: 546322 - RNA, 15 nt, Chlamydophila pneumoniae J138
agauccgauauacuu

SEQ ID NO: 546323 - RNA, 19 nt, Chlamydophila pneumoniae J138
agaucccgggaguuuucag

SEQ ID NO: 546324 - RNA, 13 nt, Chlamydophila pneumoniae J138
agaucccagaaga

SEQ ID NO: 546325 - RNA, 22 nt, Chlamydophila pneumoniae J138
agaucgaucucugugguuccug

SEQ ID NO: 546326 - RNA, 17 nt, Chlamydophila pneumoniae J138
agaucguuagagaccca

SEQ ID NO: 546327 - RNA, 23 nt, Chlamydophila pneumoniae J138
agaucuacaagacuacgacagaa

SEQ ID NO: 546328 - RNA, 14 nt, Chlamydophila pneumoniae J138
agaucuacaucaaa

SEQ ID NO: 546329 - RNA, 15 nt, Chlamydophila pneumoniae J138
agaucuacaucaaau

SEQ ID NO: 546330 - RNA, 11 nt, Chlamydophila pneumoniae J138
agaucuugaac

SEQ ID NO: 546331 - RNA, 15 nt, Chlamydophila pneumoniae J138
agaucuugaacagag

SEQ ID NO: 546332 - RNA, 16 nt, Chlamydophila pneumoniae J138
agaucuucugaaauca

SEQ ID NO: 546333 - RNA, 22 nt, Chlamydophila pneumoniae J138
agaucugcaaacgcaaugauuu

SEQ ID NO: 546334 - RNA, 18 nt, Chlamydophila pneumoniae J138
agaucuccgccuacaaua

SEQ ID NO: 546335 - RNA, 20 nt, Chlamydophila pneumoniae J138
agaucucuguguuuugagga

SEQ ID NO: 546336 - RNA, 20 nt, Chlamydophila pneumoniae J138
agaucucgucuuggaaugcu

SEQ ID NO: 546337 - RNA, 15 nt, Chlamydophila pneumoniae J138
agaugcuaacaacuc

SEQ ID NO: 546338 - RNA, 22 nt, Chlamydophila pneumoniae J138
agaugcgcucggauuucaugau

SEQ ID NO: 546339 - RNA, 14 nt, Chlamydophila pneumoniae J138
agaugaaguuccca

SEQ ID NO: 546340 - RNA, 23 nt, Chlamydophila pneumoniae J138
agaugaauaccagaagcaaaggu

SEQ ID NO: 546341 - RNA, 12 nt, Chlamydophila pneumoniae J138
agaugaagagug

SEQ ID NO: 546342 - RNA, 13 nt, Chlamydophila pneumoniae J138
agaugaagaaacu

SEQ ID NO: 546343 - RNA, 20 nt, Chlamydophila pneumoniae J138
agaugaacgucuaaacgcga

SEQ ID NO: 546344 - RNA, 20 nt, Chlamydophila pneumoniae J138
agaucuucugaaaucaaaaa

SEQ ID NO: 546345 - RNA, 16 nt, Chlamydophila pneumoniae J138
agaucuuuagaauaag

SEQ ID NO: 546346 - RNA, 17 nt, Chlamydophila pneumoniae J138
agaugcuucuaaacaau

SEQ ID NO: 546347 - RNA, 23 nt, Chlamydophila pneumoniae J138
agaugcuucuaaacaauuucaau

SEQ ID NO: 546348 - RNA, 16 nt, Chlamydophila pneumoniae J138
agaugggcuaacuuau

SEQ ID NO: 546349 - RNA, 21 nt, Chlamydophila pneumoniae J138
agauguaaagagcaacaguaa

SEQ ID NO: 546350 - RNA, 14 nt, Chlamydophila pneumoniae J138
agaguccaagguuc

SEQ ID NO: 546351 - RNA, 16 nt, Chlamydophila pneumoniae J138
agaguccugggguucu

SEQ ID NO: 546352 - RNA, 16 nt, Chlamydophila pneumoniae J138
agagugaccauagcau

SEQ ID NO: 546353 - RNA, 23 nt, Chlamydophila pneumoniae J138
agagucuugcagacggggaucua

SEQ ID NO: 546354 - RNA, 18 nt, Chlamydophila pneumoniae J138
agagucuuugaugcuaaa

SEQ ID NO: 546355 - RNA, 23 nt, Chlamydophila pneumoniae J138
agagucuucguuucuuugaguua

SEQ ID NO: 546356 - RNA, 23 nt, Chlamydophila pneumoniae J138
agagucucacucuuuucuagaaa

SEQ ID NO: 546357 - RNA, 18 nt, Chlamydophila pneumoniae J138
aaaaccacuucucuguau

SEQ ID NO: 546358 - RNA, 20 nt, Chlamydophila pneumoniae J138
aaaaccacagaaugauaaga

SEQ ID NO: 546359 - RNA, 16 nt, Chlamydophila pneumoniae J138
agagcuuccauuggaa

SEQ ID NO: 546360 - RNA, 14 nt, Chlamydophila pneumoniae J138
agagcuucuaaaaa

SEQ ID NO: 546361 - RNA, 20 nt, Chlamydophila pneumoniae J138
agaguuuuuuagaggagcuu

SEQ ID NO: 546362 - RNA, 18 nt, Chlamydophila pneumoniae J138
agaguuuuuuagaggagc

SEQ ID NO: 546363 - RNA, 20 nt, Chlamydophila pneumoniae J138
agaguuucgaauucaaugag

SEQ ID NO: 546364 - RNA, 20 nt, Chlamydophila pneumoniae J138
agaguggucauugccuugcu

SEQ ID NO: 546365 - RNA, 20 nt, Chlamydophila pneumoniae J138
agauaaucuguaagaaaaug

SEQ ID NO: 546366 - RNA, 14 nt, Chlamydophila pneumoniae J138
agaucacaagaaag

SEQ ID NO: 546367 - RNA, 15 nt, Chlamydophila pneumoniae J138
agaucaauauagaga

SEQ ID NO: 546368 - RNA, 17 nt, Chlamydophila pneumoniae J138
agaucacaucaagauag

SEQ ID NO: 546369 - RNA, 23 nt, Chlamydophila pneumoniae J138
agaucaaguccucgccgcugccc

SEQ ID NO: 546370 - RNA, 12 nt, Chlamydophila pneumoniae J138
agauauagagag

SEQ ID NO: 546371 - RNA, 19 nt, Chlamydophila pneumoniae J138
agauaguucacaagugcau

SEQ ID NO: 546372 - RNA, 14 nt, Chlamydophila pneumoniae J138
agaucaaaacuccg

SEQ ID NO: 546373 - RNA, 15 nt, Chlamydophila pneumoniae J138
agauaguuauuaaua

SEQ ID NO: 546374 - RNA, 11 nt, Chlamydophila pneumoniae J138
agauagucuug

SEQ ID NO: 546375 - RNA, 22 nt, Chlamydophila pneumoniae J138
agauaggaacucacaaacaaca

SEQ ID NO: 546376 - RNA, 18 nt, Chlamydophila pneumoniae J138
agauaggauggaguacuu

SEQ ID NO: 546377 - RNA, 16 nt, Chlamydophila pneumoniae J138
agauagguuuuuguaa

SEQ ID NO: 546378 - RNA, 21 nt, Chlamydophila pneumoniae J138
agauaguauuuuugaaaccaa

SEQ ID NO: 546379 - RNA, 24 nt, Chlamydophila pneumoniae J138
agaacuuucgucuuugcuuucuag

SEQ ID NO: 546380 - RNA, 19 nt, Chlamydophila pneumoniae J138
agaacuuucgucuuugcuu

SEQ ID NO: 546381 - RNA, 13 nt, Chlamydophila pneumoniae J138
agaacguaagcuu

SEQ ID NO: 546382 - RNA, 16 nt, Chlamydophila pneumoniae J138
agaagaaccucauuuu

SEQ ID NO: 546383 - RNA, 16 nt, Chlamydophila pneumoniae J138
agaagaagcaaaagau

SEQ ID NO: 546384 - RNA, 18 nt, Chlamydophila pneumoniae J138
agaagacuagcuuuucau

SEQ ID NO: 546385 - RNA, 21 nt, Chlamydophila pneumoniae J138
agaagacaggagcuacugaaa

SEQ ID NO: 546386 - RNA, 15 nt, Chlamydophila pneumoniae J138
agaagagaaaagaua

SEQ ID NO: 546387 - RNA, 19 nt, Chlamydophila pneumoniae J138
agaagacucccaaggaaau

SEQ ID NO: 546388 - RNA, 20 nt, Chlamydophila pneumoniae J138
agaacauguuucuaagcuga

SEQ ID NO: 546389 - RNA, 21 nt, Chlamydophila pneumoniae J138
agaacaugaccuuuaggaacu

SEQ ID NO: 546390 - RNA, 20 nt, Chlamydophila pneumoniae J138
agaacaucuucccaccccug

SEQ ID NO: 546391 - RNA, 13 nt, Chlamydophila pneumoniae J138
agaacaacgcugc

SEQ ID NO: 546392 - RNA, 21 nt, Chlamydophila pneumoniae J138
agaacaacgcugcuucucuac

SEQ ID NO: 546393 - RNA, 14 nt, Chlamydophila pneumoniae J138
agaaccuguuuuuc

SEQ ID NO: 546394 - RNA, 16 nt, Chlamydophila pneumoniae J138
agaaccuguuuuucua

SEQ ID NO: 546395 - RNA, 15 nt, Chlamydophila pneumoniae J138
agaaccuucacaaga

SEQ ID NO: 546396 - RNA, 11 nt, Chlamydophila pneumoniae J138
agaaccuccac

SEQ ID NO: 546397 - RNA, 12 nt, Chlamydophila pneumoniae J138
agaaccuccacc

SEQ ID NO: 546398 - RNA, 12 nt, Chlamydophila pneumoniae J138
agaacgaauuuc

SEQ ID NO: 546399 - RNA, 12 nt, Chlamydophila pneumoniae J138
agaaacaacuug

SEQ ID NO: 546400 - RNA, 17 nt, Chlamydophila pneumoniae J138
aaaacaccugcccauuu

SEQ ID NO: 546401 - RNA, 17 nt, Chlamydophila pneumoniae J138
agaaacuaguucuucuu

SEQ ID NO: 546402 - RNA, 20 nt, Chlamydophila pneumoniae J138
aaaacagauaagacaauaaa

SEQ ID NO: 546403 - RNA, 16 nt, Chlamydophila pneumoniae J138
agaaaucgacagggga

SEQ ID NO: 546404 - RNA, 17 nt, Chlamydophila pneumoniae J138
agaaauguaagaaggca

SEQ ID NO: 546405 - RNA, 16 nt, Chlamydophila pneumoniae J138
agaaauguugauaggu

SEQ ID NO: 546406 - RNA, 17 nt, Chlamydophila pneumoniae J138
agaacaaaaaaucaauc

SEQ ID NO: 546407 - RNA, 15 nt, Chlamydophila pneumoniae J138
agaaugcccuguucu

SEQ ID NO: 546408 - RNA, 23 nt, Chlamydophila pneumoniae J138
agaaucguucuuagcgcauguau

SEQ ID NO: 546409 - RNA, 16 nt, Chlamydophila pneumoniae J138
agaaucuauagaacua

SEQ ID NO: 546410 - RNA, 17 nt, Chlamydophila pneumoniae J138
agaaucuccauuuagaa

SEQ ID NO: 546411 - RNA, 18 nt, Chlamydophila pneumoniae J138
agaaucuccauuuagaau

SEQ ID NO: 546412 - RNA, 20 nt, Chlamydophila pneumoniae J138
agaaucucugaccaucaaug

SEQ ID NO: 546413 - RNA, 13 nt, Chlamydophila pneumoniae J138
agaauucagagaa

SEQ ID NO: 546414 - RNA, 21 nt, Chlamydophila pneumoniae J138
agaaugcuguaaucgagagaa

SEQ ID NO: 546415 - RNA, 15 nt, Chlamydophila pneumoniae J138
agaauaugaacugcc

SEQ ID NO: 546416 - RNA, 21 nt, Chlamydophila pneumoniae J138
agaauauggccuagcuuucuu

SEQ ID NO: 546417 - RNA, 23 nt, Chlamydophila pneumoniae J138
agaaucaucugguauucuaggua

SEQ ID NO: 546418 - RNA, 19 nt, Chlamydophila pneumoniae J138
agaauaggaacaaagcucu

SEQ ID NO: 546419 - RNA, 17 nt, Chlamydophila pneumoniae J138
agaauacucuagguuuu

SEQ ID NO: 546420 - RNA, 16 nt, Chlamydophila pneumoniae J138
agaauaccuauagguu

SEQ ID NO: 546421 - RNA, 15 nt, Chlamydophila pneumoniae J138
agaauacaacccuuu

SEQ ID NO: 546422 - RNA, 14 nt, Chlamydophila pneumoniae J138
agaauacaaacaag

SEQ ID NO: 546423 - RNA, 13 nt, Chlamydophila pneumoniae J138
agaauaaucucuu

SEQ ID NO: 546424 - RNA, 18 nt, Chlamydophila pneumoniae J138
agaauacaaacaagaagc

SEQ ID NO: 546425 - RNA, 19 nt, Chlamydophila pneumoniae J138
agaagugaucuugagaaaa

SEQ ID NO: 546426 - RNA, 15 nt, Chlamydophila pneumoniae J138
agaaguggccuugcc

SEQ ID NO: 546427 - RNA, 22 nt, Chlamydophila pneumoniae J138
agaaguccuaucaaagcaaaag

SEQ ID NO: 546428 - RNA, 17 nt, Chlamydophila pneumoniae J138
agaaguuuacaaauaaa

SEQ ID NO: 546429 - RNA, 20 nt, Chlamydophila pneumoniae J138
agaaguuugauaagcuaaca

SEQ ID NO: 546430 - RNA, 14 nt, Chlamydophila pneumoniae J138
agaagagucauuau

SEQ ID NO: 546431 - RNA, 17 nt, Chlamydophila pneumoniae J138
agaagagguaauaauag

SEQ ID NO: 546432 - RNA, 14 nt, Chlamydophila pneumoniae J138
agaagcauugagga

SEQ ID NO: 546433 - RNA, 21 nt, Chlamydophila pneumoniae J138
acuuuuuucccuccaccagaa

SEQ ID NO: 546434 - RNA, 13 nt, Chlamydophila pneumoniae J138
acuuuuuucccuc

SEQ ID NO: 546435 - RNA, 14 nt, Chlamydophila pneumoniae J138
acuuuuuuguuaau

SEQ ID NO: 546436 - RNA, 16 nt, Chlamydophila pneumoniae J138
acuuuuuuucuucucu

SEQ ID NO: 546437 - RNA, 19 nt, Chlamydophila pneumoniae J138
agaaaaucaacucuccauc

SEQ ID NO: 546438 - RNA, 14 nt, Chlamydophila pneumoniae J138
agaaaauaucaccu

SEQ ID NO: 546439 - RNA, 22 nt, Chlamydophila pneumoniae J138
agaaaaucucuaagaaucuaua

SEQ ID NO: 546440 - RNA, 18 nt, Chlamydophila pneumoniae J138
agaaaaucugcagcagau

SEQ ID NO: 546441 - RNA, 20 nt, Chlamydophila pneumoniae J138
acuuuuugccacaacucauc

SEQ ID NO: 546442 - RNA, 15 nt, Chlamydophila pneumoniae J138
acuuuccucucuuua

SEQ ID NO: 546443 - RNA, 17 nt, Chlamydophila pneumoniae J138
acuuuccucucuuuaua

SEQ ID NO: 546444 - RNA, 17 nt, Chlamydophila pneumoniae J138
acuuuccguagccuuac

SEQ ID NO: 546445 - RNA, 18 nt, Chlamydophila pneumoniae J138
acuuucccuucuaaggaa

SEQ ID NO: 546446 - RNA, 12 nt, Chlamydophila pneumoniae J138
acuuuccucucu

SEQ ID NO: 546447 - RNA, 15 nt, Chlamydophila pneumoniae J138
acuuucuucucuagg

SEQ ID NO: 546448 - RNA, 14 nt, Chlamydophila pneumoniae J138
acuuucuucucuag

SEQ ID NO: 546449 - RNA, 16 nt, Chlamydophila pneumoniae J138
acuuugaccagaugau

SEQ ID NO: 546450 - RNA, 21 nt, Chlamydophila pneumoniae J138
acuuugaccagaugauuuuuu

SEQ ID NO: 546451 - RNA, 15 nt, Chlamydophila pneumoniae J138
acuuugccauuucua

SEQ ID NO: 546452 - RNA, 18 nt, Chlamydophila pneumoniae J138
acuuugauuguauagcuu

SEQ ID NO: 546453 - RNA, 17 nt, Chlamydophila pneumoniae J138
acuuugcaauacaccaa

SEQ ID NO: 546454 - RNA, 24 nt, Chlamydophila pneumoniae J138
acuuugauuguauagcuuacuuag

SEQ ID NO: 546455 - RNA, 16 nt, Chlamydophila pneumoniae J138
acuuuuacugaaauua

SEQ ID NO: 546456 - RNA, 21 nt, Chlamydophila pneumoniae J138
acuuuuaauauuugagaagau

SEQ ID NO: 546457 - RNA, 15 nt, Chlamydophila pneumoniae J138
acuuugugauuacag

SEQ ID NO: 546458 - RNA, 21 nt, Chlamydophila pneumoniae J138
acuuuaaucaagccuaaaucu

SEQ ID NO: 546459 - RNA, 14 nt, Chlamydophila pneumoniae J138
acuuuauucucuuc

SEQ ID NO: 546460 - RNA, 22 nt, Chlamydophila pneumoniae J138
acuuuagaaauuccaauuuuug

SEQ ID NO: 546461 - RNA, 23 nt, Chlamydophila pneumoniae J138
acuuuacuucggaugagauccaa

SEQ ID NO: 546462 - RNA, 15 nt, Chlamydophila pneumoniae J138
acuuuauagaaagua

SEQ ID NO: 546463 - RNA, 15 nt, Chlamydophila pneumoniae J138
acuugcccaaaaguu

SEQ ID NO: 546464 - RNA, 21 nt, Chlamydophila pneumoniae J138
acuugcuuuuuugaaagcugg

SEQ ID NO: 546465 - RNA, 15 nt, Chlamydophila pneumoniae J138
acuugcucuuuaaua

SEQ ID NO: 546466 - RNA, 17 nt, Chlamydophila pneumoniae J138
acuugcucuuuaauaag

SEQ ID NO: 546467 - RNA, 13 nt, Chlamydophila pneumoniae J138
acuugcucuuuag

SEQ ID NO: 546468 - RNA, 16 nt, Chlamydophila pneumoniae J138
acuugcucugaagcuc

SEQ ID NO: 546469 - RNA, 16 nt, Chlamydophila pneumoniae J138
acuuaguuuugaaaag

SEQ ID NO: 546470 - RNA, 14 nt, Chlamydophila pneumoniae J138
acuuaguuuugaaa

SEQ ID NO: 546471 - RNA, 15 nt, Chlamydophila pneumoniae J138
acuuaguuuugaaaa

SEQ ID NO: 546472 - RNA, 19 nt, Chlamydophila pneumoniae J138
acuugcauggauccuucau

SEQ ID NO: 546473 - RNA, 23 nt, Chlamydophila pneumoniae J138
acuuguaccguaaagaaaagcaa

SEQ ID NO: 546474 - RNA, 18 nt, Chlamydophila pneumoniae J138
acuuguucagcuagagca

SEQ ID NO: 546475 - RNA, 21 nt, Chlamydophila pneumoniae J138
accaaacuuucuuuucuauau

SEQ ID NO: 546476 - RNA, 22 nt, Chlamydophila pneumoniae J138
accaaacuuucuuuucuauauu

SEQ ID NO: 546477 - RNA, 19 nt, Chlamydophila pneumoniae J138
accaaaagaauuccuaaaa

SEQ ID NO: 546478 - RNA, 22 nt, Chlamydophila pneumoniae J138
accaaaaaaguaacuaucuaca

SEQ ID NO: 546479 - RNA, 22 nt, Chlamydophila pneumoniae J138
accaaaaauuccguuaagaugu

SEQ ID NO: 546480 - RNA, 15 nt, Chlamydophila pneumoniae J138
accaaauaauuaaau

SEQ ID NO: 546481 - RNA, 14 nt, Chlamydophila pneumoniae J138
accaaauccuccug

SEQ ID NO: 546482 - RNA, 13 nt, Chlamydophila pneumoniae J138
accaaaucuaucu

SEQ ID NO: 546483 - RNA, 19 nt, Chlamydophila pneumoniae J138
accaaagucgauacccaaa

SEQ ID NO: 546484 - RNA, 19 nt, Chlamydophila pneumoniae J138
accaaagugacuuccucca

SEQ ID NO: 546485 - RNA, 15 nt, Chlamydophila pneumoniae J138
accaacaucaaagaa

SEQ ID NO: 546486 - RNA, 16 nt, Chlamydophila pneumoniae J138
accaacaucaaagaau

SEQ ID NO: 546487 - RNA, 14 nt, Chlamydophila pneumoniae J138
acauuguuuaaguc

SEQ ID NO: 546488 - RNA, 23 nt, Chlamydophila pneumoniae J138
acauuguuuaaguccuucuuccc

SEQ ID NO: 546489 - RNA, 22 nt, Chlamydophila pneumoniae J138
acauuaccguucccuaaaguaa

SEQ ID NO: 546490 - RNA, 22 nt, Chlamydophila pneumoniae J138
acauuagcgacgacgacgccua

SEQ ID NO: 546491 - RNA, 21 nt, Chlamydophila pneumoniae J138
acauucuucugucuguauuuc

SEQ ID NO: 546492 - RNA, 15 nt, Chlamydophila pneumoniae J138
acauucuuaauaucu

SEQ ID NO: 546493 - RNA, 19 nt, Chlamydophila pneumoniae J138
acauuuuucaauaaccaga

SEQ ID NO: 546494 - RNA, 20 nt, Chlamydophila pneumoniae J138
acauuuaagucauuagcaag

SEQ ID NO: 546495 - RNA, 13 nt, Chlamydophila pneumoniae J138
acauuuagaagua

SEQ ID NO: 546496 - RNA, 18 nt, Chlamydophila pneumoniae J138
acauuugcagacacaaaa

SEQ ID NO: 546497 - RNA, 11 nt, Chlamydophila pneumoniae J138
acaucaaugau

SEQ ID NO: 546498 - RNA, 13 nt, Chlamydophila pneumoniae J138
acaucaauuuuac

SEQ ID NO: 546499 - RNA, 22 nt, Chlamydophila pneumoniae J138
acauaauaagcaggaaaagcaa

SEQ ID NO: 546500 - RNA, 13 nt, Chlamydophila pneumoniae J138
acauccuguaguu

SEQ ID NO: 546501 - RNA, 18 nt, Chlamydophila pneumoniae J138
acauccuggagcaugaga

SEQ ID NO: 546502 - RNA, 17 nt, Chlamydophila pneumoniae J138
acauccuggagcaugag

SEQ ID NO: 546503 - RNA, 12 nt, Chlamydophila pneumoniae J138
acauccucacua

SEQ ID NO: 546504 - RNA, 19 nt, Chlamydophila pneumoniae J138
acaucaugauauugcguuu

SEQ ID NO: 546505 - RNA, 18 nt, Chlamydophila pneumoniae J138
acaugcucaagaagauga

SEQ ID NO: 546506 - RNA, 15 nt, Chlamydophila pneumoniae J138
acaugcucaagaaga

SEQ ID NO: 546507 - RNA, 20 nt, Chlamydophila pneumoniae J138
acauguaaacaaaagcagac

SEQ ID NO: 546508 - RNA, 20 nt, Chlamydophila pneumoniae J138
acaugaggcacauguaggau

SEQ ID NO: 546509 - RNA, 22 nt, Chlamydophila pneumoniae J138
acaugagggcaugccuaucuau

SEQ ID NO: 546510 - RNA, 13 nt, Chlamydophila pneumoniae J138
acaugagaaauac

SEQ ID NO: 546511 - RNA, 13 nt, Chlamydophila pneumoniae J138
acaugcccaaaca

SEQ ID NO: 546512 - RNA, 12 nt, Chlamydophila pneumoniae J138
acaugaggauac

SEQ ID NO: 546513 - RNA, 19 nt, Chlamydophila pneumoniae J138
acaugcgaagggaggagaa

SEQ ID NO: 546514 - RNA, 15 nt, Chlamydophila pneumoniae J138
acaucugugauuaau

SEQ ID NO: 546515 - RNA, 16 nt, Chlamydophila pneumoniae J138
acaugacaaauaaacu

SEQ ID NO: 546516 - RNA, 17 nt, Chlamydophila pneumoniae J138
acaugacaaauaaacug

SEQ ID NO: 546517 - RNA, 19 nt, Chlamydophila pneumoniae J138
acaugacaaauaaacugac

SEQ ID NO: 546518 - RNA, 12 nt, Chlamydophila pneumoniae J138
acaucuccuuuc

SEQ ID NO: 546519 - RNA, 10 nt, Chlamydophila pneumoniae J138
acaucuccag

SEQ ID NO: 546520 - RNA, 12 nt, Chlamydophila pneumoniae J138
acaucuccugca

SEQ ID NO: 546521 - RNA, 14 nt, Chlamydophila pneumoniae J138
acaucuaacucuaa

SEQ ID NO: 546522 - RNA, 22 nt, Chlamydophila pneumoniae J138
acagggccugagaccauaaaau

SEQ ID NO: 546523 - RNA, 13 nt, Chlamydophila pneumoniae J138
acaguaauuauuu

SEQ ID NO: 546524 - RNA, 23 nt, Chlamydophila pneumoniae J138
acaguagaggaauucuggaacau

SEQ ID NO: 546525 - RNA, 22 nt, Chlamydophila pneumoniae J138
acaguaggcgaugcaaauucca

SEQ ID NO: 546526 - RNA, 23 nt, Chlamydophila pneumoniae J138
acaguccuuuaccaucgucucca

SEQ ID NO: 546527 - RNA, 20 nt, Chlamydophila pneumoniae J138
acagugguaugcuuuuccuu

SEQ ID NO: 546528 - RNA, 16 nt, Chlamydophila pneumoniae J138
acagugacacgcuuuc

SEQ ID NO: 546529 - RNA, 19 nt, Chlamydophila pneumoniae J138
acaguuggcguuuucuaga

SEQ ID NO: 546530 - RNA, 16 nt, Chlamydophila pneumoniae J138
acaguucuuucugcuu

SEQ ID NO: 546531 - RNA, 19 nt, Chlamydophila pneumoniae J138
acaguuuguaaaaagccua

SEQ ID NO: 546532 - RNA, 16 nt, Chlamydophila pneumoniae J138
acaguuuguaaaaagc

SEQ ID NO: 546533 - RNA, 19 nt, Chlamydophila pneumoniae J138
acauaaagaagguuucuag

SEQ ID NO: 546534 - RNA, 20 nt, Chlamydophila pneumoniae J138
acauaaaucaacaucacaau

SEQ ID NO: 546535 - RNA, 19 nt, Chlamydophila pneumoniae J138
acauaaaucaacaucacaa

SEQ ID NO: 546536 - RNA, 12 nt, Chlamydophila pneumoniae J138
acauaaaucaac

SEQ ID NO: 546537 - RNA, 19 nt, Chlamydophila pneumoniae J138
acauaaagacccuucuuuc

SEQ ID NO: 546538 - RNA, 14 nt, Chlamydophila pneumoniae J138
acauaacaugagaa

SEQ ID NO: 546539 - RNA, 15 nt, Chlamydophila pneumoniae J138
acauaacacuuuguu

SEQ ID NO: 546540 - RNA, 23 nt, Chlamydophila pneumoniae J138
acaggcuccucugcuaagcacaa

SEQ ID NO: 546541 - RNA, 18 nt, Chlamydophila pneumoniae J138
acagcuucuuuuccagca

SEQ ID NO: 546542 - RNA, 15 nt, Chlamydophila pneumoniae J138
acagcuucuuuucca

SEQ ID NO: 546543 - RNA, 17 nt, Chlamydophila pneumoniae J138
acagcuccauuuaaaug

SEQ ID NO: 546544 - RNA, 20 nt, Chlamydophila pneumoniae J138
acagcuaaucauagccauca

SEQ ID NO: 546545 - RNA, 13 nt, Chlamydophila pneumoniae J138
acagcuaaucaua

SEQ ID NO: 546546 - RNA, 14 nt, Chlamydophila pneumoniae J138
acagcuaauacauc

SEQ ID NO: 546547 - RNA, 22 nt, Chlamydophila pneumoniae J138
acagcuaaucaauccaagaaua

SEQ ID NO: 546548 - RNA, 20 nt, Chlamydophila pneumoniae J138
acagcaaucugcagguaagg

SEQ ID NO: 546549 - RNA, 20 nt, Chlamydophila pneumoniae J138
acaauucgauguuaaggcuu

SEQ ID NO: 546550 - RNA, 20 nt, Chlamydophila pneumoniae J138
acaauuccuaaaacaagaag

SEQ ID NO: 546551 - RNA, 22 nt, Chlamydophila pneumoniae J138
acaauuccguacgcuauaaaua

SEQ ID NO: 546552 - RNA, 13 nt, Chlamydophila pneumoniae J138
acaauuccuaaaa

SEQ ID NO: 546553 - RNA, 12 nt, Chlamydophila pneumoniae J138
acaauuuuaaaa

SEQ ID NO: 546554 - RNA, 20 nt, Chlamydophila pneumoniae J138
acaauuuuaaaaucuccucu

SEQ ID NO: 546555 - RNA, 22 nt, Chlamydophila pneumoniae J138
acaaugcgauacgaaggaucau

SEQ ID NO: 546556 - RNA, 22 nt, Chlamydophila pneumoniae J138
acaauccucacuauuaauacuu

SEQ ID NO: 546557 - RNA, 15 nt, Chlamydophila pneumoniae J138
acaaguugagagaga

SEQ ID NO: 546558 - RNA, 19 nt, Chlamydophila pneumoniae J138
acaaguugacgcacuucuu

SEQ ID NO: 546559 - RNA, 15 nt, Chlamydophila pneumoniae J138
acaaguucuaccuau

SEQ ID NO: 546560 - RNA, 19 nt, Chlamydophila pneumoniae J138
acaaguaauuccccuuuaa

SEQ ID NO: 546561 - RNA, 23 nt, Chlamydophila pneumoniae J138
acaauaccaucucuuucuauuuc

SEQ ID NO: 546562 - RNA, 16 nt, Chlamydophila pneumoniae J138
acaauaccaucucuuu

SEQ ID NO: 546563 - RNA, 17 nt, Chlamydophila pneumoniae J138
acaauaccaucucuuuc

SEQ ID NO: 546564 - RNA, 17 nt, Chlamydophila pneumoniae J138
acaacgcaggaagaaca

SEQ ID NO: 546565 - RNA, 22 nt, Chlamydophila pneumoniae J138
acaagcuucaucaaaacauaau

SEQ ID NO: 546566 - RNA, 19 nt, Chlamydophila pneumoniae J138
acaagcuucaucaaaacau

SEQ ID NO: 546567 - RNA, 20 nt, Chlamydophila pneumoniae J138
acaagcuuccuuggucuuau

SEQ ID NO: 546568 - RNA, 15 nt, Chlamydophila pneumoniae J138
acaagcuucaucaaa

SEQ ID NO: 546569 - RNA, 15 nt, Chlamydophila pneumoniae J138
acaaggucuuuuccu

SEQ ID NO: 546570 - RNA, 17 nt, Chlamydophila pneumoniae J138
acaagggauucuuguug

SEQ ID NO: 546571 - RNA, 14 nt, Chlamydophila pneumoniae J138
acaccaaauccugc

SEQ ID NO: 546572 - RNA, 16 nt, Chlamydophila pneumoniae J138
acaccaacaacaauaa

SEQ ID NO: 546573 - RNA, 17 nt, Chlamydophila pneumoniae J138
acaccaaaagaauacuc

SEQ ID NO: 546574 - RNA, 19 nt, Chlamydophila pneumoniae J138
acacaacucuuaaaucgcu

SEQ ID NO: 546575 - RNA, 12 nt, Chlamydophila pneumoniae J138
acacaaauagca

SEQ ID NO: 546576 - RNA, 17 nt, Chlamydophila pneumoniae J138
acacaaaaagcuuuuuu

SEQ ID NO: 546577 - RNA, 15 nt, Chlamydophila pneumoniae J138
acaccauuuuugaau

SEQ ID NO: 546578 - RNA, 13 nt, Chlamydophila pneumoniae J138
acacgacgaggac

SEQ ID NO: 546579 - RNA, 21 nt, Chlamydophila pneumoniae J138
acacgaauuucuaacuuaaua

SEQ ID NO: 546580 - RNA, 13 nt, Chlamydophila pneumoniae J138
acacgaauaauua

SEQ ID NO: 546581 - RNA, 16 nt, Chlamydophila pneumoniae J138
acacgaauaauuaaau

SEQ ID NO: 546582 - RNA, 15 nt, Chlamydophila pneumoniae J138
acacgaggagccucu

SEQ ID NO: 546583 - RNA, 19 nt, Chlamydophila pneumoniae J138
acacgcacuugcuuaucca

SEQ ID NO: 546584 - RNA, 19 nt, Chlamydophila pneumoniae J138
acacgccuccuucaaagau

SEQ ID NO: 546585 - RNA, 21 nt, Chlamydophila pneumoniae J138
acacgcuugugguuagaggaa

SEQ ID NO: 546586 - RNA, 21 nt, Chlamydophila pneumoniae J138
acaaccuagaaucacauaaaa

SEQ ID NO: 546587 - RNA, 22 nt, Chlamydophila pneumoniae J138
acaacaaacuaccagaugccuu

SEQ ID NO: 546588 - RNA, 21 nt, Chlamydophila pneumoniae J138
acaaauuuaucggcuaaagaa

SEQ ID NO: 546589 - RNA, 18 nt, Chlamydophila pneumoniae J138
acaacaccacagaggucg

SEQ ID NO: 546590 - RNA, 13 nt, Chlamydophila pneumoniae J138
acaacaauaauac

SEQ ID NO: 546591 - RNA, 17 nt, Chlamydophila pneumoniae J138
acaacaacauaaagaag

SEQ ID NO: 546592 - RNA, 22 nt, Chlamydophila pneumoniae J138
acaacaguugcggagaugccau

SEQ ID NO: 546593 - RNA, 13 nt, Chlamydophila pneumoniae J138
acaacagagacaa

SEQ ID NO: 546594 - RNA, 14 nt, Chlamydophila pneumoniae J138
acaacagagacaag

SEQ ID NO: 546595 - RNA, 19 nt, Chlamydophila pneumoniae J138
acaacaccucccaccaagg

SEQ ID NO: 546596 - RNA, 19 nt, Chlamydophila pneumoniae J138
acaaaugugacgcaagaga

SEQ ID NO: 546597 - RNA, 21 nt, Chlamydophila pneumoniae J138
acaaaugugacgcaagagaca

SEQ ID NO: 546598 - RNA, 14 nt, Chlamydophila pneumoniae J138
acaaauggcaugaa

SEQ ID NO: 546599 - RNA, 19 nt, Chlamydophila pneumoniae J138
acaaauuaccuugagacaa

SEQ ID NO: 546600 - RNA, 19 nt, Chlamydophila pneumoniae J138
acaaaugcgguaucuccgg

SEQ ID NO: 546601 - RNA, 17 nt, Chlamydophila pneumoniae J138
acaaaguaggauugaua

SEQ ID NO: 546602 - RNA, 14 nt, Chlamydophila pneumoniae J138
acaaauaaacugac

SEQ ID NO: 546603 - RNA, 13 nt, Chlamydophila pneumoniae J138
acaaauaaaauga

SEQ ID NO: 546604 - RNA, 20 nt, Chlamydophila pneumoniae J138
acaaaauucaugcaaaacaa

SEQ ID NO: 546605 - RNA, 15 nt, Chlamydophila pneumoniae J138
acaaacaacagaaau

SEQ ID NO: 546606 - RNA, 23 nt, Chlamydophila pneumoniae J138
acaaacagauuuuucaagaacuc

SEQ ID NO: 546607 - RNA, 18 nt, Chlamydophila pneumoniae J138
acaaacagauuuuucaag

SEQ ID NO: 546608 - RNA, 12 nt, Chlamydophila pneumoniae J138
acaaacaucgaa

SEQ ID NO: 546609 - RNA, 19 nt, Chlamydophila pneumoniae J138
acaaacaucgaaaccacag

SEQ ID NO: 546610 - RNA, 22 nt, Chlamydophila pneumoniae J138
acaaacaucgaaaccacagcaa

SEQ ID NO: 546611 - RNA, 21 nt, Chlamydophila pneumoniae J138
acaaacuaacauagauaaggu

SEQ ID NO: 546612 - RNA, 18 nt, Chlamydophila pneumoniae J138
acaaaagucucuagggaa

SEQ ID NO: 546613 - RNA, 23 nt, Chlamydophila pneumoniae J138
acaaaagguauugcaaauuucau

SEQ ID NO: 546614 - RNA, 18 nt, Chlamydophila pneumoniae J138
acaaaaccuggauugauc

SEQ ID NO: 546615 - RNA, 13 nt, Chlamydophila pneumoniae J138
acaaaaaaucaau

SEQ ID NO: 546616 - RNA, 17 nt, Chlamydophila pneumoniae J138
acaaaaaauaaaaucaa

SEQ ID NO: 546617 - RNA, 15 nt, Chlamydophila pneumoniae J138
acaaaaacugcgcua

SEQ ID NO: 546618 - RNA, 15 nt, Chlamydophila pneumoniae J138
acaaaaaggacucuu

SEQ ID NO: 546619 - RNA, 12 nt, Chlamydophila pneumoniae J138
acaaaaaugccu

SEQ ID NO: 546620 - RNA, 23 nt, Chlamydophila pneumoniae J138
aaucuugagcauccaaaaugucu

SEQ ID NO: 546621 - RNA, 23 nt, Chlamydophila pneumoniae J138
aaugcaaaccaaaaaaguaacua

SEQ ID NO: 546622 - RNA, 20 nt, Chlamydophila pneumoniae J138
aaugcgaugcggucagaaac

SEQ ID NO: 546623 - RNA, 19 nt, Chlamydophila pneumoniae J138
aaugcagauagcuuacaga

SEQ ID NO: 546624 - RNA, 15 nt, Chlamydophila pneumoniae J138
aaugguuccugaagc

SEQ ID NO: 546625 - RNA, 16 nt, Chlamydophila pneumoniae J138
aauggcaugaaagaua

SEQ ID NO: 546626 - RNA, 19 nt, Chlamydophila pneumoniae J138
aaugcggaccuuaagauga

SEQ ID NO: 546627 - RNA, 16 nt, Chlamydophila pneumoniae J138
aauggaaauagagaaa

SEQ ID NO: 546628 - RNA, 17 nt, Chlamydophila pneumoniae J138
aaugugcuuuugguucu

SEQ ID NO: 546629 - RNA, 16 nt, Chlamydophila pneumoniae J138
aaugugcucggcacuu

SEQ ID NO: 546630 - RNA, 22 nt, Chlamydophila pneumoniae J138
aaugugucuugcugauuuuugc

SEQ ID NO: 546631 - RNA, 20 nt, Chlamydophila pneumoniae J138
aauguucccaaauagaaaau

SEQ ID NO: 546632 - RNA, 18 nt, Chlamydophila pneumoniae J138
aauguccaacucagcuuu

SEQ ID NO: 546633 - RNA, 18 nt, Chlamydophila pneumoniae J138
aaugucgucucagaaaaa

SEQ ID NO: 546634 - RNA, 22 nt, Chlamydophila pneumoniae J138
aaugucgguuuguuaaacccaa

SEQ ID NO: 546635 - RNA, 19 nt, Chlamydophila pneumoniae J138
aaugugacgcaagagacaa

SEQ ID NO: 546636 - RNA, 18 nt, Chlamydophila pneumoniae J138
aauguuuggccaacagcu

SEQ ID NO: 546637 - RNA, 19 nt, Chlamydophila pneumoniae J138
aauguuuggccaacagcua

SEQ ID NO: 546638 - RNA, 23 nt, Chlamydophila pneumoniae J138
aauguuuuccucgaguauggcaa

SEQ ID NO: 546639 - RNA, 22 nt, Chlamydophila pneumoniae J138
aauguugcuaagcgaaccaaag

SEQ ID NO: 546640 - RNA, 22 nt, Chlamydophila pneumoniae J138
aauguuuagaauuuguccuuug

SEQ ID NO: 546641 - RNA, 20 nt, Chlamydophila pneumoniae J138
aauguuuaucgacucuucca

SEQ ID NO: 546642 - RNA, 16 nt, Chlamydophila pneumoniae J138
aauuaacagagcgccu

SEQ ID NO: 546643 - RNA, 14 nt, Chlamydophila pneumoniae J138
aauuaacaacacuu

SEQ ID NO: 546644 - RNA, 15 nt, Chlamydophila pneumoniae J138
aauuaaauauauaaa

SEQ ID NO: 546645 - RNA, 19 nt, Chlamydophila pneumoniae J138
aauuaaacuuucuucucua

SEQ ID NO: 546646 - RNA, 14 nt, Chlamydophila pneumoniae J138
aauuaaacuuucuu

SEQ ID NO: 546647 - RNA, 22 nt, Chlamydophila pneumoniae J138
aauugucugaggacaguauucc

SEQ ID NO: 546648 - RNA, 21 nt, Chlamydophila pneumoniae J138
aauuguaucuguauccuuccu

SEQ ID NO: 546649 - RNA, 13 nt, Chlamydophila pneumoniae J138
aauuguagagaga

SEQ ID NO: 546650 - RNA, 12 nt, Chlamydophila pneumoniae J138
aauuguagagag

SEQ ID NO: 546651 - RNA, 22 nt, Chlamydophila pneumoniae J138
aauugcagucacuacuguucua

SEQ ID NO: 546652 - RNA, 21 nt, Chlamydophila pneumoniae J138
aaaacaagcuuuuaauguguu

SEQ ID NO: 546653 - RNA, 17 nt, Chlamydophila pneumoniae J138
aaaacaacauucguuag

SEQ ID NO: 546654 - RNA, 11 nt, Chlamydophila pneumoniae J138
aaaacaagaag

SEQ ID NO: 546655 - RNA, 15 nt, Chlamydophila pneumoniae J138
aauugcucuugcucu

SEQ ID NO: 546656 - RNA, 16 nt, Chlamydophila pneumoniae J138
aauugcucuugcucua

SEQ ID NO: 546657 - RNA, 21 nt, Chlamydophila pneumoniae J138
aauugcuggaggccaaagaac

SEQ ID NO: 546658 - RNA, 16 nt, Chlamydophila pneumoniae J138
aauugcuguuccauaa

SEQ ID NO: 546659 - RNA, 22 nt, Chlamydophila pneumoniae J138
aauugcuguuccauaauuuuag

SEQ ID NO: 546660 - RNA, 18 nt, Chlamydophila pneumoniae J138
aauuggcguaauaauucc

SEQ ID NO: 546661 - RNA, 14 nt, Chlamydophila pneumoniae J138
aauuaucagagaca

SEQ ID NO: 546662 - RNA, 17 nt, Chlamydophila pneumoniae J138
aauuauccagaaagauu

SEQ ID NO: 546663 - RNA, 13 nt, Chlamydophila pneumoniae J138
aauuauccagaaa

SEQ ID NO: 546664 - RNA, 13 nt, Chlamydophila pneumoniae J138
aauuaacagagcg

SEQ ID NO: 546665 - RNA, 19 nt, Chlamydophila pneumoniae J138
aauuaucuccaaagaucau

SEQ ID NO: 546666 - RNA, 13 nt, Chlamydophila pneumoniae J138
aauucagagaaag

SEQ ID NO: 546667 - RNA, 20 nt, Chlamydophila pneumoniae J138
aauucaggacccuuuuccuc

SEQ ID NO: 546668 - RNA, 21 nt, Chlamydophila pneumoniae J138
aauucauccagauuagaaaag

SEQ ID NO: 546669 - RNA, 13 nt, Chlamydophila pneumoniae J138
aauucauauuuac

SEQ ID NO: 546670 - RNA, 15 nt, Chlamydophila pneumoniae J138
aauucaugcaaaaca

SEQ ID NO: 546671 - RNA, 21 nt, Chlamydophila pneumoniae J138
aauuccccguguuuggagaag

SEQ ID NO: 546672 - RNA, 22 nt, Chlamydophila pneumoniae J138
aauuccauagguuagaaaugaa

SEQ ID NO: 546673 - RNA, 15 nt, Chlamydophila pneumoniae J138
aauuccaauuuuugc

SEQ ID NO: 546674 - RNA, 15 nt, Chlamydophila pneumoniae J138
aauuccagaaaaaga

SEQ ID NO: 546675 - RNA, 18 nt, Chlamydophila pneumoniae J138
aauucugaagauauauuu

SEQ ID NO: 546676 - RNA, 18 nt, Chlamydophila pneumoniae J138
aauucucugacacuccuc

SEQ ID NO: 546677 - RNA, 14 nt, Chlamydophila pneumoniae J138
aauucucagaaagc

SEQ ID NO: 546678 - RNA, 22 nt, Chlamydophila pneumoniae J138
aauucucugacacuccucagaa

SEQ ID NO: 546679 - RNA, 23 nt, Chlamydophila pneumoniae J138
aauucuauuuauuuuauuaguuu

SEQ ID NO: 546680 - RNA, 19 nt, Chlamydophila pneumoniae J138
aauucucgagcagcugcac

SEQ ID NO: 546681 - RNA, 22 nt, Chlamydophila pneumoniae J138
aauuccuucucagaaagauauc

SEQ ID NO: 546682 - RNA, 14 nt, Chlamydophila pneumoniae J138
aauuccuuggauuc

SEQ ID NO: 546683 - RNA, 18 nt, Chlamydophila pneumoniae J138
aauuccuucucagaaaga

SEQ ID NO: 546684 - RNA, 18 nt, Chlamydophila pneumoniae J138
aauucgaauucucagaaa

SEQ ID NO: 546685 - RNA, 19 nt, Chlamydophila pneumoniae J138
aaucacuuaauaauguuuu

SEQ ID NO: 546686 - RNA, 20 nt, Chlamydophila pneumoniae J138
aaucagaggagccuccauaa

SEQ ID NO: 546687 - RNA, 14 nt, Chlamydophila pneumoniae J138
aaucagaggagccu

SEQ ID NO: 546688 - RNA, 13 nt, Chlamydophila pneumoniae J138
aaucagaggagcc

SEQ ID NO: 546689 - RNA, 14 nt, Chlamydophila pneumoniae J138
aaucagaagugauc

SEQ ID NO: 546690 - RNA, 21 nt, Chlamydophila pneumoniae J138
aaucacucuaugaucuacaga

SEQ ID NO: 546691 - RNA, 12 nt, Chlamydophila pneumoniae J138
aaucacucucua

SEQ ID NO: 546692 - RNA, 17 nt, Chlamydophila pneumoniae J138
aaucaccauauccauga

SEQ ID NO: 546693 - RNA, 15 nt, Chlamydophila pneumoniae J138
aaucaccaauuuuuu

SEQ ID NO: 546694 - RNA, 16 nt, Chlamydophila pneumoniae J138
aaucaccaauuuuuuc

SEQ ID NO: 546695 - RNA, 19 nt, Chlamydophila pneumoniae J138
aaucacaucaguuccauuu

SEQ ID NO: 546696 - RNA, 14 nt, Chlamydophila pneumoniae J138
aaucaaccaaaaug

SEQ ID NO: 546697 - RNA, 11 nt, Chlamydophila pneumoniae J138
aaucaaauuca

SEQ ID NO: 546698 - RNA, 20 nt, Chlamydophila pneumoniae J138
aaucaagccacagagaauug

SEQ ID NO: 546699 - RNA, 16 nt, Chlamydophila pneumoniae J138
aaucaagccacagaga

SEQ ID NO: 546700 - RNA, 17 nt, Chlamydophila pneumoniae J138
aaucaagaguuucgaau

SEQ ID NO: 546701 - RNA, 22 nt, Chlamydophila pneumoniae J138
aaucaauccuauggcagcagga

SEQ ID NO: 546702 - RNA, 13 nt, Chlamydophila pneumoniae J138
aaucaauccaaga

SEQ ID NO: 546703 - RNA, 13 nt, Chlamydophila pneumoniae J138
aaucaauaaaaug

SEQ ID NO: 546704 - RNA, 15 nt, Chlamydophila pneumoniae J138
aauauucuuggaaga

SEQ ID NO: 546705 - RNA, 19 nt, Chlamydophila pneumoniae J138
aauauuuuaccauugagau

SEQ ID NO: 546706 - RNA, 18 nt, Chlamydophila pneumoniae J138
aauauuugagaagauaug

SEQ ID NO: 546707 - RNA, 23 nt, Chlamydophila pneumoniae J138
aauagcaggaaggaauagagaaa

SEQ ID NO: 546708 - RNA, 17 nt, Chlamydophila pneumoniae J138
aauagcaguauagagaa

SEQ ID NO: 546709 - RNA, 21 nt, Chlamydophila pneumoniae J138
aauagcaucccuucuucuuuu

SEQ ID NO: 546710 - RNA, 18 nt, Chlamydophila pneumoniae J138
aauauguacugaugugaa

SEQ ID NO: 546711 - RNA, 18 nt, Chlamydophila pneumoniae J138
aauauggguguaaauuuu

SEQ ID NO: 546712 - RNA, 16 nt, Chlamydophila pneumoniae J138
aaucgcaucaaaaaau

SEQ ID NO: 546713 - RNA, 16 nt, Chlamydophila pneumoniae J138
aaaaauucuuuaggga

SEQ ID NO: 546714 - RNA, 19 nt, Chlamydophila pneumoniae J138
aaaaauuuaaaagauuccu

SEQ ID NO: 546715 - RNA, 18 nt, Chlamydophila pneumoniae J138
aaucuaccgugaagauuu

SEQ ID NO: 546716 - RNA, 13 nt, Chlamydophila pneumoniae J138
aaucuaagaaucu

SEQ ID NO: 546717 - RNA, 21 nt, Chlamydophila pneumoniae J138
aaucuaaguaaaacugcgcua

SEQ ID NO: 546718 - RNA, 20 nt, Chlamydophila pneumoniae J138
aaucucaccagaagcaacua

SEQ ID NO: 546719 - RNA, 22 nt, Chlamydophila pneumoniae J138
aaucucauuccagcaucuucuc

SEQ ID NO: 546720 - RNA, 13 nt, Chlamydophila pneumoniae J138
aaucucuccuuga

SEQ ID NO: 546721 - RNA, 15 nt, Chlamydophila pneumoniae J138
aaucuguaagaaaau

SEQ ID NO: 546722 - RNA, 18 nt, Chlamydophila pneumoniae J138
aaucuuaugggagaagcu

SEQ ID NO: 546723 - RNA, 17 nt, Chlamydophila pneumoniae J138
aaucuuaugggagaagc

SEQ ID NO: 546724 - RNA, 15 nt, Chlamydophila pneumoniae J138
aaucuuacauaaacc

SEQ ID NO: 546725 - RNA, 13 nt, Chlamydophila pneumoniae J138
aaucuuccccuaa

SEQ ID NO: 546726 - RNA, 17 nt, Chlamydophila pneumoniae J138
aaucuucgauuguaacu

SEQ ID NO: 546727 - RNA, 20 nt, Chlamydophila pneumoniae J138
aaucuuccuuaaccuccuca

SEQ ID NO: 546728 - RNA, 20 nt, Chlamydophila pneumoniae J138
aaucucuucuguaggaacaa

SEQ ID NO: 546729 - RNA, 21 nt, Chlamydophila pneumoniae J138
aaucucuuuaaaaauuaaagu

SEQ ID NO: 546730 - RNA, 13 nt, Chlamydophila pneumoniae J138
aaucugaaucuca

SEQ ID NO: 546731 - RNA, 16 nt, Chlamydophila pneumoniae J138
aaucugaaucucauaa

SEQ ID NO: 546732 - RNA, 21 nt, Chlamydophila pneumoniae J138
aaucugaaugccugccaaucc

SEQ ID NO: 546733 - RNA, 11 nt, Chlamydophila pneumoniae J138
aaucugauuca

SEQ ID NO: 546734 - RNA, 12 nt, Chlamydophila pneumoniae J138
aaucuggaagca

SEQ ID NO: 546735 - RNA, 19 nt, Chlamydophila pneumoniae J138
aaucuggggcuuccagaaa

SEQ ID NO: 546736 - RNA, 14 nt, Chlamydophila pneumoniae J138
aaucugcaagauua

SEQ ID NO: 546737 - RNA, 20 nt, Chlamydophila pneumoniae J138
aaucccugcacucuuucaga

SEQ ID NO: 546738 - RNA, 15 nt, Chlamydophila pneumoniae J138
aaucccugcacucuu

SEQ ID NO: 546739 - RNA, 19 nt, Chlamydophila pneumoniae J138
aaucccuguguguuuuuuc

SEQ ID NO: 546740 - RNA, 23 nt, Chlamydophila pneumoniae J138
aaucccuguucuagcaaaucuaa

SEQ ID NO: 546741 - RNA, 21 nt, Chlamydophila pneumoniae J138
aauccgauaagauaaagaauu

SEQ ID NO: 546742 - RNA, 21 nt, Chlamydophila pneumoniae J138
aauccuuccuuacaagcuucc

SEQ ID NO: 546743 - RNA, 12 nt, Chlamydophila pneumoniae J138
aauccuuccuua

SEQ ID NO: 546744 - RNA, 14 nt, Chlamydophila pneumoniae J138
aauccuucucccuc

SEQ ID NO: 546745 - RNA, 12 nt, Chlamydophila pneumoniae J138
aauccuucuuuc

SEQ ID NO: 546746 - RNA, 22 nt, Chlamydophila pneumoniae J138
aauccuaaaaaggguuccucuu

SEQ ID NO: 546747 - RNA, 19 nt, Chlamydophila pneumoniae J138
aauccuguucuacauagau

SEQ ID NO: 546748 - RNA, 17 nt, Chlamydophila pneumoniae J138
aaucgauaacguugccu

SEQ ID NO: 546749 - RNA, 19 nt, Chlamydophila pneumoniae J138
aaucgagagaagaaauucu

SEQ ID NO: 546750 - RNA, 16 nt, Chlamydophila pneumoniae J138
aauccuucuauagcaa

SEQ ID NO: 546751 - RNA, 21 nt, Chlamydophila pneumoniae J138
aauccagcaacaaccaaaaga

SEQ ID NO: 546752 - RNA, 18 nt, Chlamydophila pneumoniae J138
aauccauucugagaaaga

SEQ ID NO: 546753 - RNA, 20 nt, Chlamydophila pneumoniae J138
aauccauucugagaaagaag

SEQ ID NO: 546754 - RNA, 15 nt, Chlamydophila pneumoniae J138
aauccauucugagaa

SEQ ID NO: 546755 - RNA, 22 nt, Chlamydophila pneumoniae J138
aauccauuuugcccacuucuac

SEQ ID NO: 546756 - RNA, 17 nt, Chlamydophila pneumoniae J138
aaucccgugcuaggaag

SEQ ID NO: 546757 - RNA, 21 nt, Chlamydophila pneumoniae J138
aauccaaaaaaugcuccugca

SEQ ID NO: 546758 - RNA, 14 nt, Chlamydophila pneumoniae J138
aauccaaaaaagag

SEQ ID NO: 546759 - RNA, 17 nt, Chlamydophila pneumoniae J138
aauccaaagacuuuuua

SEQ ID NO: 546760 - RNA, 16 nt, Chlamydophila pneumoniae J138
aauccacgcuccucua

SEQ ID NO: 546761 - RNA, 19 nt, Chlamydophila pneumoniae J138
aauccagauuguucaaaaa

SEQ ID NO: 546762 - RNA, 19 nt, Chlamydophila pneumoniae J138
aauccagaauuuucugcga

SEQ ID NO: 546763 - RNA, 23 nt, Chlamydophila pneumoniae J138
aaucagcaacaucguuaauauaa

SEQ ID NO: 546764 - RNA, 15 nt, Chlamydophila pneumoniae J138
aaucaugauaaaaau

SEQ ID NO: 546765 - RNA, 20 nt, Chlamydophila pneumoniae J138
aaucaugccgagauuuuuac

SEQ ID NO: 546766 - RNA, 20 nt, Chlamydophila pneumoniae J138
aacacagauaggaaccacuu

SEQ ID NO: 546767 - RNA, 15 nt, Chlamydophila pneumoniae J138
aaaaaguaacuaucu

SEQ ID NO: 546768 - RNA, 18 nt, Chlamydophila pneumoniae J138
aaaaaguaguuuuaagaa

SEQ ID NO: 546769 - RNA, 21 nt, Chlamydophila pneumoniae J138
aacaccaucacauccuguagu

SEQ ID NO: 546770 - RNA, 18 nt, Chlamydophila pneumoniae J138
aaauucuguaaagugaaa

SEQ ID NO: 546771 - RNA, 12 nt, Chlamydophila pneumoniae J138
aaauucuguaaa

SEQ ID NO: 546772 - RNA, 20 nt, Chlamydophila pneumoniae J138
aaauucuggaauuucccaua

SEQ ID NO: 546773 - RNA, 15 nt, Chlamydophila pneumoniae J138
aaauucuuaaaacug

SEQ ID NO: 546774 - RNA, 21 nt, Chlamydophila pneumoniae J138
aaauucuuaacaauauaugcu

SEQ ID NO: 546775 - RNA, 17 nt, Chlamydophila pneumoniae J138
aaauucuucgagagcau

SEQ ID NO: 546776 - RNA, 19 nt, Chlamydophila pneumoniae J138
aacaaguaccaagaaaaua

SEQ ID NO: 546777 - RNA, 23 nt, Chlamydophila pneumoniae J138
aacaauaaacgagacugcaaagg

SEQ ID NO: 546778 - RNA, 16 nt, Chlamydophila pneumoniae J138
aacaaucuuucuucua

SEQ ID NO: 546779 - RNA, 15 nt, Chlamydophila pneumoniae J138
aacaaugcaucccug

SEQ ID NO: 546780 - RNA, 15 nt, Chlamydophila pneumoniae J138
aacaauguaaauuga

SEQ ID NO: 546781 - RNA, 18 nt, Chlamydophila pneumoniae J138
aacaccguuaauuuuugc

SEQ ID NO: 546782 - RNA, 22 nt, Chlamydophila pneumoniae J138
aacacugcgcaaagaacucaac

SEQ ID NO: 546783 - RNA, 21 nt, Chlamydophila pneumoniae J138
aacacugaacgccaucuccac

SEQ ID NO: 546784 - RNA, 21 nt, Chlamydophila pneumoniae J138
aacacucucuaccaucaugaa

SEQ ID NO: 546785 - RNA, 20 nt, Chlamydophila pneumoniae J138
aacacgccugcgaaagcgag

SEQ ID NO: 546786 - RNA, 16 nt, Chlamydophila pneumoniae J138
aacacgucgaacauga

SEQ ID NO: 546787 - RNA, 23 nt, Chlamydophila pneumoniae J138
aacacgucacuggggcauaagaa

SEQ ID NO: 546788 - RNA, 20 nt, Chlamydophila pneumoniae J138
aacagauuuuucaagaacuc

SEQ ID NO: 546789 - RNA, 14 nt, Chlamydophila pneumoniae J138
aacagcaacacucg

SEQ ID NO: 546790 - RNA, 18 nt, Chlamydophila pneumoniae J138
aacagcacucacgcucuc

SEQ ID NO: 546791 - RNA, 15 nt, Chlamydophila pneumoniae J138
aacagcacucucugc

SEQ ID NO: 546792 - RNA, 16 nt, Chlamydophila pneumoniae J138
aacagaaauugcuucu

SEQ ID NO: 546793 - RNA, 13 nt, Chlamydophila pneumoniae J138
aacacuuuuaaag

SEQ ID NO: 546794 - RNA, 15 nt, Chlamydophila pneumoniae J138
aacagagcgccucca

SEQ ID NO: 546795 - RNA, 19 nt, Chlamydophila pneumoniae J138
aacauacacgucuaagaau

SEQ ID NO: 546796 - RNA, 19 nt, Chlamydophila pneumoniae J138
aacagccuagcaaaacugu

SEQ ID NO: 546797 - RNA, 14 nt, Chlamydophila pneumoniae J138
aacaucaugaaaua

SEQ ID NO: 546798 - RNA, 15 nt, Chlamydophila pneumoniae J138
aacaucaugaaauac

SEQ ID NO: 546799 - RNA, 20 nt, Chlamydophila pneumoniae J138
aacauauucuccuuaccaau

SEQ ID NO: 546800 - RNA, 22 nt, Chlamydophila pneumoniae J138
aacauauucuccuuaccaauau

SEQ ID NO: 546801 - RNA, 14 nt, Chlamydophila pneumoniae J138
aacaugagauacgu

SEQ ID NO: 546802 - RNA, 23 nt, Chlamydophila pneumoniae J138
aacaugacggugcuguuguaaua

SEQ ID NO: 546803 - RNA, 14 nt, Chlamydophila pneumoniae J138
aacaugaaguuguu

SEQ ID NO: 546804 - RNA, 21 nt, Chlamydophila pneumoniae J138
aacaucccccgggaagcuguc

SEQ ID NO: 546805 - RNA, 17 nt, Chlamydophila pneumoniae J138
aacauucuucugucugu

SEQ ID NO: 546806 - RNA, 16 nt, Chlamydophila pneumoniae J138
aacauugaguugguuu

SEQ ID NO: 546807 - RNA, 20 nt, Chlamydophila pneumoniae J138
aacauuggagucuaaaaaau

SEQ ID NO: 546808 - RNA, 16 nt, Chlamydophila pneumoniae J138
aaccaacaucaaagaa

SEQ ID NO: 546809 - RNA, 23 nt, Chlamydophila pneumoniae J138
aaccaaccuuguugaaaggcuga

SEQ ID NO: 546810 - RNA, 21 nt, Chlamydophila pneumoniae J138
aaccaaucuugagcauccaaa

SEQ ID NO: 546811 - RNA, 22 nt, Chlamydophila pneumoniae J138
aaccaaucuugagcauccaaaa

SEQ ID NO: 546812 - RNA, 17 nt, Chlamydophila pneumoniae J138
aaccaauuucuccgcuu

SEQ ID NO: 546813 - RNA, 19 nt, Chlamydophila pneumoniae J138
aaccauucaucuaggggag

SEQ ID NO: 546814 - RNA, 19 nt, Chlamydophila pneumoniae J138
aaccaucacuuccuguugu

SEQ ID NO: 546815 - RNA, 19 nt, Chlamydophila pneumoniae J138
aaccacuguccaugcacga

SEQ ID NO: 546816 - RNA, 23 nt, Chlamydophila pneumoniae J138
aacccaauucuuaaaaagcuaaa

SEQ ID NO: 546817 - RNA, 17 nt, Chlamydophila pneumoniae J138
aacccaccagaaggaag

SEQ ID NO: 546818 - RNA, 18 nt, Chlamydophila pneumoniae J138
aacccaccagaaggaagg

SEQ ID NO: 546819 - RNA, 19 nt, Chlamydophila pneumoniae J138
aaccgagacuauuuuggaa

SEQ ID NO: 546820 - RNA, 14 nt, Chlamydophila pneumoniae J138
aaccgaaacuucuc

SEQ ID NO: 546821 - RNA, 17 nt, Chlamydophila pneumoniae J138
aaccgaaacuucucaga

SEQ ID NO: 546822 - RNA, 16 nt, Chlamydophila pneumoniae J138
aacccugggcucacuc

SEQ ID NO: 546823 - RNA, 16 nt, Chlamydophila pneumoniae J138
aacccuuuaaugauca

SEQ ID NO: 546824 - RNA, 22 nt, Chlamydophila pneumoniae J138
aacccuuuaaugaucacgugga

SEQ ID NO: 546825 - RNA, 14 nt, Chlamydophila pneumoniae J138
aacccuuuaaugau

SEQ ID NO: 546826 - RNA, 14 nt, Chlamydophila pneumoniae J138
aacccuauuuaagg

SEQ ID NO: 546827 - RNA, 15 nt, Chlamydophila pneumoniae J138
aacccucaaagaaua

SEQ ID NO: 546828 - RNA, 20 nt, Chlamydophila pneumoniae J138
aacccuaguucauuagcuaa

SEQ ID NO: 546829 - RNA, 14 nt, Chlamydophila pneumoniae J138
aacccucagaacac

SEQ ID NO: 546830 - RNA, 22 nt, Chlamydophila pneumoniae J138
aaccgcaaaaagcuucuuucuu

SEQ ID NO: 546831 - RNA, 21 nt, Chlamydophila pneumoniae J138
aacgcccuucaggacaugccu

SEQ ID NO: 546832 - RNA, 17 nt, Chlamydophila pneumoniae J138
aacgcccuucuuaguaa

SEQ ID NO: 546833 - RNA, 23 nt, Chlamydophila pneumoniae J138
aacgaucgucaguaaaacacaaa

SEQ ID NO: 546834 - RNA, 13 nt, Chlamydophila pneumoniae J138
aacgcuuuucuaa

SEQ ID NO: 546835 - RNA, 15 nt, Chlamydophila pneumoniae J138
aacgcuuagagaauu

SEQ ID NO: 546836 - RNA, 23 nt, Chlamydophila pneumoniae J138
aacggaacuaaagagaucacagg

SEQ ID NO: 546837 - RNA, 13 nt, Chlamydophila pneumoniae J138
aacgguaaauauc

SEQ ID NO: 546838 - RNA, 22 nt, Chlamydophila pneumoniae J138
aacgguugucucgaaacucuuu

SEQ ID NO: 546839 - RNA, 15 nt, Chlamydophila pneumoniae J138
aacuaccagaugccu

SEQ ID NO: 546840 - RNA, 16 nt, Chlamydophila pneumoniae J138
aacuacauaauaagca

SEQ ID NO: 546841 - RNA, 18 nt, Chlamydophila pneumoniae J138
aacuacucucauucaccu

SEQ ID NO: 546842 - RNA, 17 nt, Chlamydophila pneumoniae J138
aacuacuuaaauccuaa

SEQ ID NO: 546843 - RNA, 19 nt, Chlamydophila pneumoniae J138
aacuaaauucuuaacaaua

SEQ ID NO: 546844 - RNA, 15 nt, Chlamydophila pneumoniae J138
aacuaaauucuuaac

SEQ ID NO: 546845 - RNA, 19 nt, Chlamydophila pneumoniae J138
aacuaagaauaccuauagg

SEQ ID NO: 546846 - RNA, 22 nt, Chlamydophila pneumoniae J138
aacuaaaaugguaaaccuaccu

SEQ ID NO: 546847 - RNA, 15 nt, Chlamydophila pneumoniae J138
aacuaaaacagccua

SEQ ID NO: 546848 - RNA, 15 nt, Chlamydophila pneumoniae J138
aacuaaaaguuuuuu

SEQ ID NO: 546849 - RNA, 17 nt, Chlamydophila pneumoniae J138
aacuaaaucaacuacau

SEQ ID NO: 546850 - RNA, 19 nt, Chlamydophila pneumoniae J138
aacgugauugcugcugcua

SEQ ID NO: 546851 - RNA, 15 nt, Chlamydophila pneumoniae J138
aacgugcugcgaauu

SEQ ID NO: 546852 - RNA, 14 nt, Chlamydophila pneumoniae J138
aacguggggaaauu

SEQ ID NO: 546853 - RNA, 12 nt, Chlamydophila pneumoniae J138
aacguacuuagg

SEQ ID NO: 546854 - RNA, 22 nt, Chlamydophila pneumoniae J138
aacguaagcuuuuuaccaauaa

SEQ ID NO: 546855 - RNA, 17 nt, Chlamydophila pneumoniae J138
aacguagcuacaaaauu

SEQ ID NO: 546856 - RNA, 20 nt, Chlamydophila pneumoniae J138
aacguauccuugauuuuaaa

SEQ ID NO: 546857 - RNA, 14 nt, Chlamydophila pneumoniae J138
aacucaacuuuuuu

SEQ ID NO: 546858 - RNA, 13 nt, Chlamydophila pneumoniae J138
aacugcaaaaaga

SEQ ID NO: 546859 - RNA, 23 nt, Chlamydophila pneumoniae J138
aacugcgcuagcuccagcaucac

SEQ ID NO: 546860 - RNA, 15 nt, Chlamydophila pneumoniae J138
aacugcauaaucuca

SEQ ID NO: 546861 - RNA, 22 nt, Chlamydophila pneumoniae J138
aacugcuacuuuaaaguggcaa

SEQ ID NO: 546862 - RNA, 16 nt, Chlamydophila pneumoniae J138
aacugcuccugaagcu

SEQ ID NO: 546863 - RNA, 18 nt, Chlamydophila pneumoniae J138
aacugcuuggucacacca

SEQ ID NO: 546864 - RNA, 18 nt, Chlamydophila pneumoniae J138
aacuggcaaucuaaaauc

SEQ ID NO: 546865 - RNA, 19 nt, Chlamydophila pneumoniae J138
aacuggcaaucuaaaauca

SEQ ID NO: 546866 - RNA, 23 nt, Chlamydophila pneumoniae J138
aacugggcauaguggcucagugu

SEQ ID NO: 546867 - RNA, 16 nt, Chlamydophila pneumoniae J138
aacuucaaugaaagcu

SEQ ID NO: 546868 - RNA, 18 nt, Chlamydophila pneumoniae J138
aacuuaucgaaugcugca

SEQ ID NO: 546869 - RNA, 14 nt, Chlamydophila pneumoniae J138
aacuugaauaccaa

SEQ ID NO: 546870 - RNA, 17 nt, Chlamydophila pneumoniae J138
aacuugaagaaguacaa

SEQ ID NO: 546871 - RNA, 22 nt, Chlamydophila pneumoniae J138
aacuugaagaaguacaagugaa

SEQ ID NO: 546872 - RNA, 23 nt, Chlamydophila pneumoniae J138
aacuucuguaucgacuguacaaa

SEQ ID NO: 546873 - RNA, 18 nt, Chlamydophila pneumoniae J138
aacuucuucguuagagaa

SEQ ID NO: 546874 - RNA, 14 nt, Chlamydophila pneumoniae J138
aacuucuucguuag

SEQ ID NO: 546875 - RNA, 20 nt, Chlamydophila pneumoniae J138
aacuucuugugauccuugca

SEQ ID NO: 546876 - RNA, 17 nt, Chlamydophila pneumoniae J138
aacuuggugagcagcuu

SEQ ID NO: 546877 - RNA, 20 nt, Chlamydophila pneumoniae J138
aacuugcuuuuuugaaagcu

SEQ ID NO: 546878 - RNA, 19 nt, Chlamydophila pneumoniae J138
aagaaaagugugaggagac

SEQ ID NO: 546879 - RNA, 21 nt, Chlamydophila pneumoniae J138
aagaaaaagcaucuaugggcu

SEQ ID NO: 546880 - RNA, 14 nt, Chlamydophila pneumoniae J138
aagaaaauaaagau

SEQ ID NO: 546881 - RNA, 24 nt, Chlamydophila pneumoniae J138
aagaaaggauuggaugagaauuuc

SEQ ID NO: 546882 - RNA, 11 nt, Chlamydophila pneumoniae J138
aagaaaugccc

SEQ ID NO: 546883 - RNA, 15 nt, Chlamydophila pneumoniae J138
aagaaauuaacaaca

SEQ ID NO: 546884 - RNA, 17 nt, Chlamydophila pneumoniae J138
aagaaauucugacuaua

SEQ ID NO: 546885 - RNA, 13 nt, Chlamydophila pneumoniae J138
aagaacaguuugc

SEQ ID NO: 546886 - RNA, 13 nt, Chlamydophila pneumoniae J138
aagaacagcagaa

SEQ ID NO: 546887 - RNA, 13 nt, Chlamydophila pneumoniae J138
aagaacagcacuc

SEQ ID NO: 546888 - RNA, 16 nt, Chlamydophila pneumoniae J138
aagaacagcacucucu

SEQ ID NO: 546889 - RNA, 18 nt, Chlamydophila pneumoniae J138
aagaacccgauacauccu

SEQ ID NO: 546890 - RNA, 20 nt, Chlamydophila pneumoniae J138
aagaaccucuaauuugauga

SEQ ID NO: 546891 - RNA, 21 nt, Chlamydophila pneumoniae J138
aagaagcagcacucuuuuucu

SEQ ID NO: 546892 - RNA, 20 nt, Chlamydophila pneumoniae J138
aagaagcucguacuguuccu

SEQ ID NO: 546893 - RNA, 19 nt, Chlamydophila pneumoniae J138
aagaagcucuaucuuuggu

SEQ ID NO: 546894 - RNA, 14 nt, Chlamydophila pneumoniae J138
aagaagcagcacuc

SEQ ID NO: 546895 - RNA, 15 nt, Chlamydophila pneumoniae J138
aagaagaaccucauu

SEQ ID NO: 546896 - RNA, 22 nt, Chlamydophila pneumoniae J138
aagaagacuagcuuuucauguu

SEQ ID NO: 546897 - RNA, 15 nt, Chlamydophila pneumoniae J138
aagaagagaaaagau

SEQ ID NO: 546898 - RNA, 17 nt, Chlamydophila pneumoniae J138
aagaacugaagagucaa

SEQ ID NO: 546899 - RNA, 15 nt, Chlamydophila pneumoniae J138
aagaacgucaccauu

SEQ ID NO: 546900 - RNA, 15 nt, Chlamydophila pneumoniae J138
aagaacuuuagggaa

SEQ ID NO: 546901 - RNA, 19 nt, Chlamydophila pneumoniae J138
aagaacuuuagggaagaaa

SEQ ID NO: 546902 - RNA, 20 nt, Chlamydophila pneumoniae J138
aagaacuuaaaauucaaauc

SEQ ID NO: 546903 - RNA, 18 nt, Chlamydophila pneumoniae J138
aagaacuuaaaauucaaa

SEQ ID NO: 546904 - RNA, 12 nt, Chlamydophila pneumoniae J138
aagaagaagaaa

SEQ ID NO: 546905 - RNA, 13 nt, Chlamydophila pneumoniae J138
aagaacuccuuug

SEQ ID NO: 546906 - RNA, 16 nt, Chlamydophila pneumoniae J138
aagaagcucacucuuu

SEQ ID NO: 546907 - RNA, 18 nt, Chlamydophila pneumoniae J138
aagaagguccaugucuaa

SEQ ID NO: 546908 - RNA, 16 nt, Chlamydophila pneumoniae J138
aagaaguacaagugaa

SEQ ID NO: 546909 - RNA, 17 nt, Chlamydophila pneumoniae J138
aagaagguuuauuagaa

SEQ ID NO: 546910 - RNA, 21 nt, Chlamydophila pneumoniae J138
aagaagguuuauuagaaguau

SEQ ID NO: 546911 - RNA, 13 nt, Chlamydophila pneumoniae J138
aagaagguugaga

SEQ ID NO: 546912 - RNA, 13 nt, Chlamydophila pneumoniae J138
aagaauaaaauag

SEQ ID NO: 546913 - RNA, 18 nt, Chlamydophila pneumoniae J138
aagaauagcguagaggac

SEQ ID NO: 546914 - RNA, 17 nt, Chlamydophila pneumoniae J138
aauaacaccaaaagaau

SEQ ID NO: 546915 - RNA, 20 nt, Chlamydophila pneumoniae J138
aauaaacugacguuuuuccc

SEQ ID NO: 546916 - RNA, 20 nt, Chlamydophila pneumoniae J138
aaguuuuuucucucuuuauc

SEQ ID NO: 546917 - RNA, 20 nt, Chlamydophila pneumoniae J138
aaguuuugcucucuagauuu

SEQ ID NO: 546918 - RNA, 21 nt, Chlamydophila pneumoniae J138
aaguuuuuuaagugcuuuuag

SEQ ID NO: 546919 - RNA, 20 nt, Chlamydophila pneumoniae J138
aaguuuugauuuugcaguga

SEQ ID NO: 546920 - RNA, 13 nt, Chlamydophila pneumoniae J138
aauaaaagcaccc

SEQ ID NO: 546921 - RNA, 15 nt, Chlamydophila pneumoniae J138
aauaaaauuuaaaaa

SEQ ID NO: 546922 - RNA, 18 nt, Chlamydophila pneumoniae J138
aauaaaauuuaaaaaaau

SEQ ID NO: 546923 - RNA, 15 nt, Chlamydophila pneumoniae J138
aaguguauuuaaauu

SEQ ID NO: 546924 - RNA, 14 nt, Chlamydophila pneumoniae J138
aaguuagccuggcu

SEQ ID NO: 546925 - RNA, 20 nt, Chlamydophila pneumoniae J138
aagugucugaguuagcuuuu

SEQ ID NO: 546926 - RNA, 23 nt, Chlamydophila pneumoniae J138
aaguucggcgccuucaaaaaaca

SEQ ID NO: 546927 - RNA, 12 nt, Chlamydophila pneumoniae J138
aaguuccuucag

SEQ ID NO: 546928 - RNA, 16 nt, Chlamydophila pneumoniae J138
aaguuagguagauaga

SEQ ID NO: 546929 - RNA, 21 nt, Chlamydophila pneumoniae J138
aaguugcaacucucuuuaaac

SEQ ID NO: 546930 - RNA, 19 nt, Chlamydophila pneumoniae J138
aaguucuuggaaaaaagga

SEQ ID NO: 546931 - RNA, 14 nt, Chlamydophila pneumoniae J138
aaguuuaggcagga

SEQ ID NO: 546932 - RNA, 20 nt, Chlamydophila pneumoniae J138
aaguuuguagcagcaagaac

SEQ ID NO: 546933 - RNA, 15 nt, Chlamydophila pneumoniae J138
aaguuugcaugcaac

SEQ ID NO: 546934 - RNA, 19 nt, Chlamydophila pneumoniae J138
aaguuugauaagcuaacac

SEQ ID NO: 546935 - RNA, 14 nt, Chlamydophila pneumoniae J138
aaguaacgauaaga

SEQ ID NO: 546936 - RNA, 20 nt, Chlamydophila pneumoniae J138
aaguaacuaucuacacagua

SEQ ID NO: 546937 - RNA, 21 nt, Chlamydophila pneumoniae J138
aaguaaaucagacuuaaagua

SEQ ID NO: 546938 - RNA, 14 nt, Chlamydophila pneumoniae J138
aagguuuuaaauuu

SEQ ID NO: 546939 - RNA, 18 nt, Chlamydophila pneumoniae J138
aagugaucuugagaaaag

SEQ ID NO: 546940 - RNA, 14 nt, Chlamydophila pneumoniae J138
aagugaucagaaau

SEQ ID NO: 546941 - RNA, 16 nt, Chlamydophila pneumoniae J138
aagugcucaguaaaua

SEQ ID NO: 546942 - RNA, 20 nt, Chlamydophila pneumoniae J138
aagugcuuucaggaguucuu

SEQ ID NO: 546943 - RNA, 22 nt, Chlamydophila pneumoniae J138
aauacauagguaaaaccagcau

SEQ ID NO: 546944 - RNA, 15 nt, Chlamydophila pneumoniae J138
aauacgaucugcuuu

SEQ ID NO: 546945 - RNA, 15 nt, Chlamydophila pneumoniae J138
aauacgcuuuucuuc

SEQ ID NO: 546946 - RNA, 22 nt, Chlamydophila pneumoniae J138
aauacuaagaagcucacucuuu

SEQ ID NO: 546947 - RNA, 16 nt, Chlamydophila pneumoniae J138
aauacuccacuuuuuu

SEQ ID NO: 546948 - RNA, 19 nt, Chlamydophila pneumoniae J138
aauacuccacuuuuuuccc

SEQ ID NO: 546949 - RNA, 14 nt, Chlamydophila pneumoniae J138
aauacuccacuuuu

SEQ ID NO: 546950 - RNA, 22 nt, Chlamydophila pneumoniae J138
aauacuggagagguaaccagag

SEQ ID NO: 546951 - RNA, 18 nt, Chlamydophila pneumoniae J138
aauacucuagguuuucuc

SEQ ID NO: 546952 - RNA, 12 nt, Chlamydophila pneumoniae J138
aauacucuguuu

SEQ ID NO: 546953 - RNA, 14 nt, Chlamydophila pneumoniae J138
aauacuuaauccug

SEQ ID NO: 546954 - RNA, 19 nt, Chlamydophila pneumoniae J138
aauacuuaggaauuuuucu

SEQ ID NO: 546955 - RNA, 21 nt, Chlamydophila pneumoniae J138
aauacuuaggaauuuuucuag

SEQ ID NO: 546956 - RNA, 13 nt, Chlamydophila pneumoniae J138
aauacuucuccug

SEQ ID NO: 546957 - RNA, 15 nt, Chlamydophila pneumoniae J138
aauacuucuccugaa

SEQ ID NO: 546958 - RNA, 20 nt, Chlamydophila pneumoniae J138
aauagaaaagguauuaggaa

SEQ ID NO: 546959 - RNA, 14 nt, Chlamydophila pneumoniae J138
aauagaaauaagca

SEQ ID NO: 546960 - RNA, 21 nt, Chlamydophila pneumoniae J138
aauagaacgaauuucaacagc

SEQ ID NO: 546961 - RNA, 13 nt, Chlamydophila pneumoniae J138
aauagagaaacuu

SEQ ID NO: 546962 - RNA, 20 nt, Chlamydophila pneumoniae J138
aauagaggaccgaaaaaccu

SEQ ID NO: 546963 - RNA, 22 nt, Chlamydophila pneumoniae J138
aauagagaaagagugccaagag

SEQ ID NO: 546964 - RNA, 19 nt, Chlamydophila pneumoniae J138
aauaaucaaccaaaaugca

SEQ ID NO: 546965 - RNA, 13 nt, Chlamydophila pneumoniae J138
aauaauuaaauau

SEQ ID NO: 546966 - RNA, 12 nt, Chlamydophila pneumoniae J138
aauaauuaaaua

SEQ ID NO: 546967 - RNA, 12 nt, Chlamydophila pneumoniae J138
aauaauuaaauc

SEQ ID NO: 546968 - RNA, 16 nt, Chlamydophila pneumoniae J138
aauacagcauaaaaau

SEQ ID NO: 546969 - RNA, 17 nt, Chlamydophila pneumoniae J138
aauacagccagcagaag

SEQ ID NO: 546970 - RNA, 13 nt, Chlamydophila pneumoniae J138
aauacaggagaau

SEQ ID NO: 546971 - RNA, 19 nt, Chlamydophila pneumoniae J138
aauacaaaacaaaagccau

SEQ ID NO: 546972 - RNA, 16 nt, Chlamydophila pneumoniae J138
aagaugaauaccagaa

SEQ ID NO: 546973 - RNA, 22 nt, Chlamydophila pneumoniae J138
aagaugaauaccagaagcaaag

SEQ ID NO: 546974 - RNA, 20 nt, Chlamydophila pneumoniae J138
aagaugacgagcccuagaua

SEQ ID NO: 546975 - RNA, 17 nt, Chlamydophila pneumoniae J138
aagaucuugaacagaga

SEQ ID NO: 546976 - RNA, 18 nt, Chlamydophila pneumoniae J138
aagaucuugguuaugcua

SEQ ID NO: 546977 - RNA, 19 nt, Chlamydophila pneumoniae J138
aagaauuaccgcgagccau

SEQ ID NO: 546978 - RNA, 23 nt, Chlamydophila pneumoniae J138
aagaauuccuaaaacgagcaggg

SEQ ID NO: 546979 - RNA, 15 nt, Chlamydophila pneumoniae J138
aagaauucagagaaa

SEQ ID NO: 546980 - RNA, 18 nt, Chlamydophila pneumoniae J138
aagaucuccgaagacuac

SEQ ID NO: 546981 - RNA, 20 nt, Chlamydophila pneumoniae J138
aagaauguagcuguuccaag

SEQ ID NO: 546982 - RNA, 21 nt, Chlamydophila pneumoniae J138
aagaauguagcuguuccaaga

SEQ ID NO: 546983 - RNA, 16 nt, Chlamydophila pneumoniae J138
aagauggcaaggaaaa

SEQ ID NO: 546984 - RNA, 18 nt, Chlamydophila pneumoniae J138
aagauggcaaggaaaauu

SEQ ID NO: 546985 - RNA, 17 nt, Chlamydophila pneumoniae J138
aagauucaaagaagucg

SEQ ID NO: 546986 - RNA, 15 nt, Chlamydophila pneumoniae J138
aagauucaaagaagu

SEQ ID NO: 546987 - RNA, 19 nt, Chlamydophila pneumoniae J138
aagauuauuuguuucuucc

SEQ ID NO: 546988 - RNA, 24 nt, Chlamydophila pneumoniae J138
aagauugcagguagauccuauagu

SEQ ID NO: 546989 - RNA, 11 nt, Chlamydophila pneumoniae J138
aagauuccuaa

SEQ ID NO: 546990 - RNA, 22 nt, Chlamydophila pneumoniae J138
aagauuccuaacuucugaagga

SEQ ID NO: 546991 - RNA, 19 nt, Chlamydophila pneumoniae J138
aagauuuauuuugucuuuu

SEQ ID NO: 546992 - RNA, 20 nt, Chlamydophila pneumoniae J138
aagauuuuaggggguuuuuc

SEQ ID NO: 546993 - RNA, 18 nt, Chlamydophila pneumoniae J138
aagauuuuguaggaacau

SEQ ID NO: 546994 - RNA, 13 nt, Chlamydophila pneumoniae J138
aagcaaaaacuuu

SEQ ID NO: 546995 - RNA, 12 nt, Chlamydophila pneumoniae J138
aagcaaaaguca

SEQ ID NO: 546996 - RNA, 13 nt, Chlamydophila pneumoniae J138
aagcaaaagauca

SEQ ID NO: 546997 - RNA, 13 nt, Chlamydophila pneumoniae J138
aagcaaaagcaag

SEQ ID NO: 546998 - RNA, 17 nt, Chlamydophila pneumoniae J138
aagcaaagauaaagaag

SEQ ID NO: 546999 - RNA, 17 nt, Chlamydophila pneumoniae J138
aagcaacuaaacucucc

SEQ ID NO: 547000 - RNA, 18 nt, Chlamydophila pneumoniae J138
aagcaacuaaacucucca

SEQ ID NO: 547001 - RNA, 22 nt, Chlamydophila pneumoniae J138
aagcacauacaguacgcaaagu

SEQ ID NO: 547002 - RNA, 17 nt, Chlamydophila pneumoniae J138
aagcaccacgaccuaca

SEQ ID NO: 547003 - RNA, 15 nt, Chlamydophila pneumoniae J138
aagcaauauuucugu

SEQ ID NO: 547004 - RNA, 13 nt, Chlamydophila pneumoniae J138
aagcaauaucugu

SEQ ID NO: 547005 - RNA, 20 nt, Chlamydophila pneumoniae J138
aagcaauaucuauagaaggc

SEQ ID NO: 547006 - RNA, 22 nt, Chlamydophila pneumoniae J138
aagcaaucccccagcauucacu

SEQ ID NO: 547007 - RNA, 14 nt, Chlamydophila pneumoniae J138
aagcacuuaaaaaa

SEQ ID NO: 547008 - RNA, 12 nt, Chlamydophila pneumoniae J138
aagcacugauga

SEQ ID NO: 547009 - RNA, 19 nt, Chlamydophila pneumoniae J138
aagcagaaacuuuaaaagc

SEQ ID NO: 547010 - RNA, 13 nt, Chlamydophila pneumoniae J138
aagcagaaacuuu

SEQ ID NO: 547011 - RNA, 19 nt, Chlamydophila pneumoniae J138
aagcacuuguuuuuucuuc

SEQ ID NO: 547012 - RNA, 18 nt, Chlamydophila pneumoniae J138
aagcagauccugcuucua

SEQ ID NO: 547013 - RNA, 14 nt, Chlamydophila pneumoniae J138
aagcagauagagcu

SEQ ID NO: 547014 - RNA, 13 nt, Chlamydophila pneumoniae J138
aagcauagcccga

SEQ ID NO: 547015 - RNA, 22 nt, Chlamydophila pneumoniae J138
aagcauagucgucuuuuaaaga

SEQ ID NO: 547016 - RNA, 16 nt, Chlamydophila pneumoniae J138
aagcauagucgucuuu

SEQ ID NO: 547017 - RNA, 18 nt, Chlamydophila pneumoniae J138
aagcaucuuucaucaaug

SEQ ID NO: 547018 - RNA, 22 nt, Chlamydophila pneumoniae J138
aagcaggugugugguaaaaaua

SEQ ID NO: 547019 - RNA, 20 nt, Chlamydophila pneumoniae J138
aagcauucugcuagagcuuu

SEQ ID NO: 547020 - RNA, 15 nt, Chlamydophila pneumoniae J138
aagcauugcaaauaa

SEQ ID NO: 547021 - RNA, 18 nt, Chlamydophila pneumoniae J138
aagcauucugcuagagcu

SEQ ID NO: 547022 - RNA, 18 nt, Chlamydophila pneumoniae J138
aagccacauucuucugau

SEQ ID NO: 547023 - RNA, 21 nt, Chlamydophila pneumoniae J138
aagcccucauccccucagaaa

SEQ ID NO: 547024 - RNA, 20 nt, Chlamydophila pneumoniae J138
aagcccucauccccucagaa

SEQ ID NO: 547025 - RNA, 14 nt, Chlamydophila pneumoniae J138
aagcccauuccugc

SEQ ID NO: 547026 - RNA, 20 nt, Chlamydophila pneumoniae J138
aagccccacccacuccagaa

SEQ ID NO: 547027 - RNA, 21 nt, Chlamydophila pneumoniae J138
aagccauuugguaguuuuuca

SEQ ID NO: 547028 - RNA, 20 nt, Chlamydophila pneumoniae J138
aagguccaugucuaaagauu

SEQ ID NO: 547029 - RNA, 20 nt, Chlamydophila pneumoniae J138
aagguaguuuucuucuuuaa

SEQ ID NO: 547030 - RNA, 16 nt, Chlamydophila pneumoniae J138
aagguagcuagcguuu

SEQ ID NO: 547031 - RNA, 17 nt, Chlamydophila pneumoniae J138
aagguagaguccacagu

SEQ ID NO: 547032 - RNA, 18 nt, Chlamydophila pneumoniae J138
aagguauuucucuccaca

SEQ ID NO: 547033 - RNA, 14 nt, Chlamydophila pneumoniae J138
aaggucacagcauu

SEQ ID NO: 547034 - RNA, 15 nt, Chlamydophila pneumoniae J138
aagguagaguccaca

SEQ ID NO: 547035 - RNA, 16 nt, Chlamydophila pneumoniae J138
aagguauuaggaagua

SEQ ID NO: 547036 - RNA, 14 nt, Chlamydophila pneumoniae J138
aagguuuccaugag

SEQ ID NO: 547037 - RNA, 17 nt, Chlamydophila pneumoniae J138
aagguuuccaugagaau

SEQ ID NO: 547038 - RNA, 22 nt, Chlamydophila pneumoniae J138
aagguugcuaagaucuuuagaa

SEQ ID NO: 547039 - RNA, 23 nt, Chlamydophila pneumoniae J138
aaggcaaaaaguugaggaaagga

SEQ ID NO: 547040 - RNA, 19 nt, Chlamydophila pneumoniae J138
aaggcaaaaaguugaggaa

SEQ ID NO: 547041 - RNA, 16 nt, Chlamydophila pneumoniae J138
aaggauuggaugagaa

SEQ ID NO: 547042 - RNA, 17 nt, Chlamydophila pneumoniae J138
aaggauucuaugaggac

SEQ ID NO: 547043 - RNA, 12 nt, Chlamydophila pneumoniae J138
aaggcaagaugu

SEQ ID NO: 547044 - RNA, 18 nt, Chlamydophila pneumoniae J138
aaggcggcuuuuugcaag

SEQ ID NO: 547045 - RNA, 18 nt, Chlamydophila pneumoniae J138
aaggcgccuaacaacuuu

SEQ ID NO: 547046 - RNA, 16 nt, Chlamydophila pneumoniae J138
aagguaaaacuacagg

SEQ ID NO: 547047 - RNA, 17 nt, Chlamydophila pneumoniae J138
aagguaaauuuuuaaaa

SEQ ID NO: 547048 - RNA, 21 nt, Chlamydophila pneumoniae J138
aagguaacauccauagagaac

SEQ ID NO: 547049 - RNA, 15 nt, Chlamydophila pneumoniae J138
aaggguuguugccag

SEQ ID NO: 547050 - RNA, 16 nt, Chlamydophila pneumoniae J138
aagggaggagaacuuc

SEQ ID NO: 547051 - RNA, 14 nt, Chlamydophila pneumoniae J138
aagggaucuccuuc

SEQ ID NO: 547052 - RNA, 14 nt, Chlamydophila pneumoniae J138
aagggauucuuguu

SEQ ID NO: 547053 - RNA, 21 nt, Chlamydophila pneumoniae J138
aagcuaacaacuucugacaau

SEQ ID NO: 547054 - RNA, 19 nt, Chlamydophila pneumoniae J138
aagcucgaccucuagcuca

SEQ ID NO: 547055 - RNA, 16 nt, Chlamydophila pneumoniae J138
aagcucgaccucuagc

SEQ ID NO: 547056 - RNA, 15 nt, Chlamydophila pneumoniae J138
aagcucuacaagcuc

SEQ ID NO: 547057 - RNA, 16 nt, Chlamydophila pneumoniae J138
aagcucguacuguucc

SEQ ID NO: 547058 - RNA, 14 nt, Chlamydophila pneumoniae J138
aagcucuccuucag

SEQ ID NO: 547059 - RNA, 16 nt, Chlamydophila pneumoniae J138
aagcucuucuacuuua

SEQ ID NO: 547060 - RNA, 19 nt, Chlamydophila pneumoniae J138
aagcucuucuacuuuaaga

SEQ ID NO: 547061 - RNA, 17 nt, Chlamydophila pneumoniae J138
aagcuaacaccucuuca

SEQ ID NO: 547062 - RNA, 22 nt, Chlamydophila pneumoniae J138
aagcguauagaauagaauguau

SEQ ID NO: 547063 - RNA, 18 nt, Chlamydophila pneumoniae J138
aagcggaguccuucuugc

SEQ ID NO: 547064 - RNA, 23 nt, Chlamydophila pneumoniae J138
aagcuuuucuuccaaagacugag

SEQ ID NO: 547065 - RNA, 17 nt, Chlamydophila pneumoniae J138
aagcuuuuaauguguuc

SEQ ID NO: 547066 - RNA, 17 nt, Chlamydophila pneumoniae J138
aagcuucaucaaaacau

SEQ ID NO: 547067 - RNA, 19 nt, Chlamydophila pneumoniae J138
aagcuuauuucuguaguuc

SEQ ID NO: 547068 - RNA, 15 nt, Chlamydophila pneumoniae J138
aagcuucaaugaugu

SEQ ID NO: 547069 - RNA, 21 nt, Chlamydophila pneumoniae J138
aaggaggaggagcacuaggca

SEQ ID NO: 547070 - RNA, 16 nt, Chlamydophila pneumoniae J138
aaggagguccuuggca

SEQ ID NO: 547071 - RNA, 14 nt, Chlamydophila pneumoniae J138
aaggauucugagaa

SEQ ID NO: 547072 - RNA, 21 nt, Chlamydophila pneumoniae J138
aaggauucugagaaguuaaga

SEQ ID NO: 547073 - RNA, 14 nt, Chlamydophila pneumoniae J138
aaggagauuccuaa

SEQ ID NO: 547074 - RNA, 13 nt, Chlamydophila pneumoniae J138
aaggagagaaaau

SEQ ID NO: 547075 - RNA, 18 nt, Chlamydophila pneumoniae J138
aaggacucuuucuauagc

SEQ ID NO: 547076 - RNA, 14 nt, Chlamydophila pneumoniae J138
aagcuguacuugau

SEQ ID NO: 547077 - RNA, 22 nt, Chlamydophila pneumoniae J138
aagcuguacuugauauuguucu

SEQ ID NO: 547078 - RNA, 23 nt, Chlamydophila pneumoniae J138
aagcuguacuugauauuguucuu

SEQ ID NO: 547079 - RNA, 19 nt, Chlamydophila pneumoniae J138
aagcuguauugggaaugga

SEQ ID NO: 547080 - RNA, 18 nt, Chlamydophila pneumoniae J138
aagcugccagugacauaa

SEQ ID NO: 547081 - RNA, 22 nt, Chlamydophila pneumoniae J138
aagcugagguagcaucucucuc

SEQ ID NO: 547082 - RNA, 18 nt, Chlamydophila pneumoniae J138
aagcugagguagcaucuc

SEQ ID NO: 547083 - RNA, 22 nt, Chlamydophila pneumoniae J138
cggcauuucuccacaugccugc

SEQ ID NO: 547084 - RNA, 19 nt, Chlamydophila pneumoniae J138
cgcuaagcucuuaauuucu

SEQ ID NO: 547085 - RNA, 21 nt, Chlamydophila pneumoniae J138
cgcuugugguuagaggaagca

SEQ ID NO: 547086 - RNA, 22 nt, Chlamydophila pneumoniae J138
cgcuuuuucuugaaaaauccug

SEQ ID NO: 547087 - RNA, 11 nt, Chlamydophila pneumoniae J138
cgcuuuugcua

SEQ ID NO: 547088 - RNA, 23 nt, Chlamydophila pneumoniae J138
cggaaaauacagccagcagaagg

SEQ ID NO: 547089 - RNA, 14 nt, Chlamydophila pneumoniae J138
cggaacucauuaag

SEQ ID NO: 547090 - RNA, 13 nt, Chlamydophila pneumoniae J138
cggaacuaaagag

SEQ ID NO: 547091 - RNA, 23 nt, Chlamydophila pneumoniae J138
cggaacucucuucccccagaccu

SEQ ID NO: 547092 - RNA, 17 nt, Chlamydophila pneumoniae J138
cggacuccugaugcucc

SEQ ID NO: 547093 - RNA, 17 nt, Chlamydophila pneumoniae J138
cggagaacuuccugauu

SEQ ID NO: 547094 - RNA, 22 nt, Chlamydophila pneumoniae J138
cggacuucacaaagaaccauag

SEQ ID NO: 547095 - RNA, 22 nt, Chlamydophila pneumoniae J138
cggagcaucuuuucaaaagaaa

SEQ ID NO: 547096 - RNA, 14 nt, Chlamydophila pneumoniae J138
cggacaacaacagc

SEQ ID NO: 547097 - RNA, 19 nt, Chlamydophila pneumoniae J138
cggacaaugcuaucuccag

SEQ ID NO: 547098 - RNA, 16 nt, Chlamydophila pneumoniae J138
cggaauacuucuccuc

SEQ ID NO: 547099 - RNA, 22 nt, Chlamydophila pneumoniae J138
cggacauaccuacuaaacccug

SEQ ID NO: 547100 - RNA, 14 nt, Chlamydophila pneumoniae J138
cggaguuaucaaaa

SEQ ID NO: 547101 - RNA, 16 nt, Chlamydophila pneumoniae J138
cggauccuagaauagg

SEQ ID NO: 547102 - RNA, 17 nt, Chlamydophila pneumoniae J138
cggaucccguaaaagaa

SEQ ID NO: 547103 - RNA, 12 nt, Chlamydophila pneumoniae J138
cggaucuguaau

SEQ ID NO: 547104 - RNA, 20 nt, Chlamydophila pneumoniae J138
cggaucuuaggauucuuauc

SEQ ID NO: 547105 - RNA, 23 nt, Chlamydophila pneumoniae J138
cggaugaccuucucaagaucuuc

SEQ ID NO: 547106 - RNA, 22 nt, Chlamydophila pneumoniae J138
cggaugugccgugacuccagaa

SEQ ID NO: 547107 - RNA, 15 nt, Chlamydophila pneumoniae J138
cggcaacauaaucau

SEQ ID NO: 547108 - RNA, 20 nt, Chlamydophila pneumoniae J138
cggauuuuacucccugaagu

SEQ ID NO: 547109 - RNA, 13 nt, Chlamydophila pneumoniae J138
cggauuuucucua

SEQ ID NO: 547110 - RNA, 19 nt, Chlamydophila pneumoniae J138
cggcaacuacuguagaguu

SEQ ID NO: 547111 - RNA, 23 nt, Chlamydophila pneumoniae J138
cgcgagugugacugcagagaaau

SEQ ID NO: 547112 - RNA, 13 nt, Chlamydophila pneumoniae J138
cgcgaagcuuucc

SEQ ID NO: 547113 - RNA, 21 nt, Chlamydophila pneumoniae J138
cgcgauuuucaaccaagguug

SEQ ID NO: 547114 - RNA, 12 nt, Chlamydophila pneumoniae J138
cgcguauuuucg

SEQ ID NO: 547115 - RNA, 21 nt, Chlamydophila pneumoniae J138
cgauaucucuaccgaacagag

SEQ ID NO: 547116 - RNA, 17 nt, Chlamydophila pneumoniae J138
cgcaaaccaucugcguu

SEQ ID NO: 547117 - RNA, 12 nt, Chlamydophila pneumoniae J138
cgcaaagaacuc

SEQ ID NO: 547118 - RNA, 22 nt, Chlamydophila pneumoniae J138
cgauuguaaaaguagcauccug

SEQ ID NO: 547119 - RNA, 16 nt, Chlamydophila pneumoniae J138
cgauuguaauuucuag

SEQ ID NO: 547120 - RNA, 22 nt, Chlamydophila pneumoniae J138
cgauucucguguagaauucacu

SEQ ID NO: 547121 - RNA, 20 nt, Chlamydophila pneumoniae J138
cgauucucguguagaauuca

SEQ ID NO: 547122 - RNA, 16 nt, Chlamydophila pneumoniae J138
cgcaaaucuuacauaa

SEQ ID NO: 547123 - RNA, 21 nt, Chlamydophila pneumoniae J138
cgcaagagacaagaaaauauc

SEQ ID NO: 547124 - RNA, 22 nt, Chlamydophila pneumoniae J138
cgcaacuuaagauacuucucca

SEQ ID NO: 547125 - RNA, 24 nt, Chlamydophila pneumoniae J138
cgcaagcacuuguuuuuucuucug

SEQ ID NO: 547126 - RNA, 21 nt, Chlamydophila pneumoniae J138
cgcaagcacuuguuuuuucuu

SEQ ID NO: 547127 - RNA, 21 nt, Chlamydophila pneumoniae J138
cgcacaccagcucgagaucuu

SEQ ID NO: 547128 - RNA, 22 nt, Chlamydophila pneumoniae J138
cgcacuucuucaagaaaugccc

SEQ ID NO: 547129 - RNA, 15 nt, Chlamydophila pneumoniae J138
cgcauuacaaauggc

SEQ ID NO: 547130 - RNA, 21 nt, Chlamydophila pneumoniae J138
cgcaugccucuuggugcuuug

SEQ ID NO: 547131 - RNA, 15 nt, Chlamydophila pneumoniae J138
cgccaaaccaugagg

SEQ ID NO: 547132 - RNA, 14 nt, Chlamydophila pneumoniae J138
cgcaucuagaagca

SEQ ID NO: 547133 - RNA, 16 nt, Chlamydophila pneumoniae J138
cgcaucauggucccua

SEQ ID NO: 547134 - RNA, 17 nt, Chlamydophila pneumoniae J138
cgcaucacgaaaaggag

SEQ ID NO: 547135 - RNA, 16 nt, Chlamydophila pneumoniae J138
cgcauaugcuccagaa

SEQ ID NO: 547136 - RNA, 17 nt, Chlamydophila pneumoniae J138
aaacgguaaauaucuua

SEQ ID NO: 547137 - RNA, 19 nt, Chlamydophila pneumoniae J138
aaacggcuguacuucccca

SEQ ID NO: 547138 - RNA, 18 nt, Chlamydophila pneumoniae J138
cgacuguacaaaugcauc

SEQ ID NO: 547139 - RNA, 16 nt, Chlamydophila pneumoniae J138
cgacucugccaugucu

SEQ ID NO: 547140 - RNA, 16 nt, Chlamydophila pneumoniae J138
cgacuacaucuuguuc

SEQ ID NO: 547141 - RNA, 21 nt, Chlamydophila pneumoniae J138
cgacguuuugcuguggaauuu

SEQ ID NO: 547142 - RNA, 18 nt, Chlamydophila pneumoniae J138
cgaauagaaaagguauua

SEQ ID NO: 547143 - RNA, 14 nt, Chlamydophila pneumoniae J138
cgagaacguagcag

SEQ ID NO: 547144 - RNA, 13 nt, Chlamydophila pneumoniae J138
cgagaaccuccac

SEQ ID NO: 547145 - RNA, 21 nt, Chlamydophila pneumoniae J138
cgagaaccuccaccaggagcu

SEQ ID NO: 547146 - RNA, 23 nt, Chlamydophila pneumoniae J138
cgacuuccuccaauaaucacugu

SEQ ID NO: 547147 - RNA, 13 nt, Chlamydophila pneumoniae J138
cgacuugccaauc

SEQ ID NO: 547148 - RNA, 18 nt, Chlamydophila pneumoniae J138
cgagaguugccaggaaac

SEQ ID NO: 547149 - RNA, 19 nt, Chlamydophila pneumoniae J138
cgagaguugccaggaaacg

SEQ ID NO: 547150 - RNA, 22 nt, Chlamydophila pneumoniae J138
cgagaggaaaucccgagauaug

SEQ ID NO: 547151 - RNA, 17 nt, Chlamydophila pneumoniae J138
cgagacugcaaaggaag

SEQ ID NO: 547152 - RNA, 17 nt, Chlamydophila pneumoniae J138
cgagacuauuuuggaaa

SEQ ID NO: 547153 - RNA, 15 nt, Chlamydophila pneumoniae J138
cgagauaugaagaga

SEQ ID NO: 547154 - RNA, 15 nt, Chlamydophila pneumoniae J138
cgagauaucgauagu

SEQ ID NO: 547155 - RNA, 16 nt, Chlamydophila pneumoniae J138
cgagaugaacauaauu

SEQ ID NO: 547156 - RNA, 16 nt, Chlamydophila pneumoniae J138
cgagaucuuugagauc

SEQ ID NO: 547157 - RNA, 16 nt, Chlamydophila pneumoniae J138
cgagaucauuagcauc

SEQ ID NO: 547158 - RNA, 19 nt, Chlamydophila pneumoniae J138
cgagaucauuagcaucauc

SEQ ID NO: 547159 - RNA, 22 nt, Chlamydophila pneumoniae J138
cgagaucauuagcaucaucucc

SEQ ID NO: 547160 - RNA, 18 nt, Chlamydophila pneumoniae J138
cgagauccuccuggaaga

SEQ ID NO: 547161 - RNA, 16 nt, Chlamydophila pneumoniae J138
cgagcagaaacuccaa

SEQ ID NO: 547162 - RNA, 23 nt, Chlamydophila pneumoniae J138
aaacgcuccguauacugcugcua

SEQ ID NO: 547163 - RNA, 22 nt, Chlamydophila pneumoniae J138
cgagcaucucaagaguaggcaa

SEQ ID NO: 547164 - RNA, 19 nt, Chlamydophila pneumoniae J138
cgaggucuuuucuuuuuag

SEQ ID NO: 547165 - RNA, 15 nt, Chlamydophila pneumoniae J138
cgagugccuucuuca

SEQ ID NO: 547166 - RNA, 22 nt, Chlamydophila pneumoniae J138
cgagucccuucuuucaauagcu

SEQ ID NO: 547167 - RNA, 15 nt, Chlamydophila pneumoniae J138
cgagucccuucuuuc

SEQ ID NO: 547168 - RNA, 15 nt, Chlamydophila pneumoniae J138
cgaguaguccugacg

SEQ ID NO: 547169 - RNA, 22 nt, Chlamydophila pneumoniae J138
cgaguucgcggaucuucuucug

SEQ ID NO: 547170 - RNA, 17 nt, Chlamydophila pneumoniae J138
cgauagcaaugauguuu

SEQ ID NO: 547171 - RNA, 19 nt, Chlamydophila pneumoniae J138
cgauagagauucuuucucg

SEQ ID NO: 547172 - RNA, 20 nt, Chlamydophila pneumoniae J138
cgagcuaccagaacaccauc

SEQ ID NO: 547173 - RNA, 17 nt, Chlamydophila pneumoniae J138
cgagcucgcaaaagcug

SEQ ID NO: 547174 - RNA, 22 nt, Chlamydophila pneumoniae J138
cgagcgggagaaucaauaaaag

SEQ ID NO: 547175 - RNA, 13 nt, Chlamydophila pneumoniae J138
aaacgcucuccua

SEQ ID NO: 547176 - RNA, 15 nt, Chlamydophila pneumoniae J138
ccacugaccugauac

SEQ ID NO: 547177 - RNA, 17 nt, Chlamydophila pneumoniae J138
ccagcucgagaucuuuu

SEQ ID NO: 547178 - RNA, 14 nt, Chlamydophila pneumoniae J138
ccagcuccuuuuga

SEQ ID NO: 547179 - RNA, 17 nt, Chlamydophila pneumoniae J138
ccaggaauagaaagaca

SEQ ID NO: 547180 - RNA, 22 nt, Chlamydophila pneumoniae J138
ccaggaauagaaagacauccuu

SEQ ID NO: 547181 - RNA, 15 nt, Chlamydophila pneumoniae J138
ccaggaauagaaaga

SEQ ID NO: 547182 - RNA, 17 nt, Chlamydophila pneumoniae J138
ccaggaaacguucuuuc

SEQ ID NO: 547183 - RNA, 22 nt, Chlamydophila pneumoniae J138
ccaggaaacguucuuucaauaa

SEQ ID NO: 547184 - RNA, 14 nt, Chlamydophila pneumoniae J138
ccagcuucuuucua

SEQ ID NO: 547185 - RNA, 22 nt, Chlamydophila pneumoniae J138
ccagcuucuuucuaggccggga

SEQ ID NO: 547186 - RNA, 16 nt, Chlamydophila pneumoniae J138
ccagcuguggugguga

SEQ ID NO: 547187 - RNA, 15 nt, Chlamydophila pneumoniae J138
ccagcugugguggug

SEQ ID NO: 547188 - RNA, 17 nt, Chlamydophila pneumoniae J138
ccaggacguaaaaagaa

SEQ ID NO: 547189 - RNA, 22 nt, Chlamydophila pneumoniae J138
ccaggagacuaaaagaauaaua

SEQ ID NO: 547190 - RNA, 15 nt, Chlamydophila pneumoniae J138
ccaggagcuccuccu

SEQ ID NO: 547191 - RNA, 14 nt, Chlamydophila pneumoniae J138
ccaggauggcuccu

SEQ ID NO: 547192 - RNA, 15 nt, Chlamydophila pneumoniae J138
ccagggaucuucauc

SEQ ID NO: 547193 - RNA, 23 nt, Chlamydophila pneumoniae J138
ccagggaucuucaucccuacccu

SEQ ID NO: 547194 - RNA, 10 nt, Chlamydophila pneumoniae J138
ccauaacagu

SEQ ID NO: 547195 - RNA, 19 nt, Chlamydophila pneumoniae J138
ccauaacagcacucacgcu

SEQ ID NO: 547196 - RNA, 20 nt, Chlamydophila pneumoniae J138
ccauaaagccccacccacuc

SEQ ID NO: 547197 - RNA, 16 nt, Chlamydophila pneumoniae J138
ccauaaagaauucccc

SEQ ID NO: 547198 - RNA, 17 nt, Chlamydophila pneumoniae J138
ccaguuucuugauauuu

SEQ ID NO: 547199 - RNA, 17 nt, Chlamydophila pneumoniae J138
ccauagaguucgcacua

SEQ ID NO: 547200 - RNA, 16 nt, Chlamydophila pneumoniae J138
ccauagaguaucuaaa

SEQ ID NO: 547201 - RNA, 19 nt, Chlamydophila pneumoniae J138
ccauaaggagauuccuaaa

SEQ ID NO: 547202 - RNA, 20 nt, Chlamydophila pneumoniae J138
ccauaagcuuuucuuccaaa

SEQ ID NO: 547203 - RNA, 16 nt, Chlamydophila pneumoniae J138
ccauaaguucacgauu

SEQ ID NO: 547204 - RNA, 13 nt, Chlamydophila pneumoniae J138
ccauaauaaaggu

SEQ ID NO: 547205 - RNA, 17 nt, Chlamydophila pneumoniae J138
ccauaagcuuuucuucc

SEQ ID NO: 547206 - RNA, 15 nt, Chlamydophila pneumoniae J138
ccauaagaucaauau

SEQ ID NO: 547207 - RNA, 21 nt, Chlamydophila pneumoniae J138
ccauaaccgucacuguuuucc

SEQ ID NO: 547208 - RNA, 16 nt, Chlamydophila pneumoniae J138
ccauaucaaagaucug

SEQ ID NO: 547209 - RNA, 14 nt, Chlamydophila pneumoniae J138
ccaucaagguauug

SEQ ID NO: 547210 - RNA, 19 nt, Chlamydophila pneumoniae J138
aaacaagaagaucaaagau

SEQ ID NO: 547211 - RNA, 14 nt, Chlamydophila pneumoniae J138
ccaucacuuccugu

SEQ ID NO: 547212 - RNA, 17 nt, Chlamydophila pneumoniae J138
ccaucacuuccuguugu

SEQ ID NO: 547213 - RNA, 18 nt, Chlamydophila pneumoniae J138
ccaucaucgaagaacuua

SEQ ID NO: 547214 - RNA, 13 nt, Chlamydophila pneumoniae J138
ccaucaucaccag

SEQ ID NO: 547215 - RNA, 16 nt, Chlamydophila pneumoniae J138
aaacaagcuuuuaaug

SEQ ID NO: 547216 - RNA, 20 nt, Chlamydophila pneumoniae J138
ccaucucaugcggacuuuau

SEQ ID NO: 547217 - RNA, 20 nt, Chlamydophila pneumoniae J138
ccaucucuuucuauuucguc

SEQ ID NO: 547218 - RNA, 17 nt, Chlamydophila pneumoniae J138
ccaugaguuuuucagau

SEQ ID NO: 547219 - RNA, 19 nt, Chlamydophila pneumoniae J138
cccaaauagcuacagcgcu

SEQ ID NO: 547220 - RNA, 15 nt, Chlamydophila pneumoniae J138
cccaaagcuaaaaug

SEQ ID NO: 547221 - RNA, 17 nt, Chlamydophila pneumoniae J138
cccaaagaggggagcua

SEQ ID NO: 547222 - RNA, 16 nt, Chlamydophila pneumoniae J138
ccauuuagacaagaca

SEQ ID NO: 547223 - RNA, 18 nt, Chlamydophila pneumoniae J138
ccauuucauguaagaaug

SEQ ID NO: 547224 - RNA, 19 nt, Chlamydophila pneumoniae J138
ccauuucauguaagaaugu

SEQ ID NO: 547225 - RNA, 16 nt, Chlamydophila pneumoniae J138
cccaauauccagaaau

SEQ ID NO: 547226 - RNA, 22 nt, Chlamydophila pneumoniae J138
ccauugaucagaaucuaaguaa

SEQ ID NO: 547227 - RNA, 14 nt, Chlamydophila pneumoniae J138
ccauucuuaucugc

SEQ ID NO: 547228 - RNA, 20 nt, Chlamydophila pneumoniae J138
ccauucagauggucagucuc

SEQ ID NO: 547229 - RNA, 14 nt, Chlamydophila pneumoniae J138
ccauucacaaaucu

SEQ ID NO: 547230 - RNA, 18 nt, Chlamydophila pneumoniae J138
ccauucacaaaucuuccc

SEQ ID NO: 547231 - RNA, 14 nt, Chlamydophila pneumoniae J138
ccaugcuuaucuau

SEQ ID NO: 547232 - RNA, 19 nt, Chlamydophila pneumoniae J138
ccaugcuaauaauuccuga

SEQ ID NO: 547233 - RNA, 11 nt, Chlamydophila pneumoniae J138
cccaccagaag

SEQ ID NO: 547234 - RNA, 21 nt, Chlamydophila pneumoniae J138
cccaccaaagugacuuccucc

SEQ ID NO: 547235 - RNA, 16 nt, Chlamydophila pneumoniae J138
cccaccauucuugaag

SEQ ID NO: 547236 - RNA, 12 nt, Chlamydophila pneumoniae J138
cccacuucuacc

SEQ ID NO: 547237 - RNA, 13 nt, Chlamydophila pneumoniae J138
cccacuccagaaa

SEQ ID NO: 547238 - RNA, 11 nt, Chlamydophila pneumoniae J138
cccauuccugc

SEQ ID NO: 547239 - RNA, 12 nt, Chlamydophila pneumoniae J138
cccauguuucuu

SEQ ID NO: 547240 - RNA, 14 nt, Chlamydophila pneumoniae J138
ccccacgcuaaacu

SEQ ID NO: 547241 - RNA, 14 nt, Chlamydophila pneumoniae J138
ccccuacagcagaa

SEQ ID NO: 547242 - RNA, 21 nt, Chlamydophila pneumoniae J138
ccccuggcguucaggauuuag

SEQ ID NO: 547243 - RNA, 22 nt, Chlamydophila pneumoniae J138
aaacaccguuaauuuuugcuaa

SEQ ID NO: 547244 - RNA, 17 nt, Chlamydophila pneumoniae J138
aaacacugaacgccauc

SEQ ID NO: 547245 - RNA, 23 nt, Chlamydophila pneumoniae J138
cccuggauagcauacgacaguaa

SEQ ID NO: 547246 - RNA, 16 nt, Chlamydophila pneumoniae J138
cccugcggacagaaac

SEQ ID NO: 547247 - RNA, 16 nt, Chlamydophila pneumoniae J138
cccugcaucucugcau

SEQ ID NO: 547248 - RNA, 15 nt, Chlamydophila pneumoniae J138
cccuucuucuucagc

SEQ ID NO: 547249 - RNA, 12 nt, Chlamydophila pneumoniae J138
cccuucuaauac

SEQ ID NO: 547250 - RNA, 12 nt, Chlamydophila pneumoniae J138
cccuucuuagua

SEQ ID NO: 547251 - RNA, 13 nt, Chlamydophila pneumoniae J138
cccuugaaucaua

SEQ ID NO: 547252 - RNA, 17 nt, Chlamydophila pneumoniae J138
cccuugcaaaaguuguc

SEQ ID NO: 547253 - RNA, 23 nt, Chlamydophila pneumoniae J138
cccuuuauacuguuuuucuucca

SEQ ID NO: 547254 - RNA, 23 nt, Chlamydophila pneumoniae J138
cccuuuaaaaguacgaccaacuc

SEQ ID NO: 547255 - RNA, 21 nt, Chlamydophila pneumoniae J138
cccuguccaacuaaaacagcc

SEQ ID NO: 547256 - RNA, 13 nt, Chlamydophila pneumoniae J138
cccuuucugcaau

SEQ ID NO: 547257 - RNA, 20 nt, Chlamydophila pneumoniae J138
aaacaucggagaacuuccug

SEQ ID NO: 547258 - RNA, 19 nt, Chlamydophila pneumoniae J138
aaacaucggagaacuuccu

SEQ ID NO: 547259 - RNA, 19 nt, Chlamydophila pneumoniae J138
aaacauuuuuaaggaaagu

SEQ ID NO: 547260 - RNA, 18 nt, Chlamydophila pneumoniae J138
aaacauuuuuauuuccuu

SEQ ID NO: 547261 - RNA, 16 nt, Chlamydophila pneumoniae J138
aaaccaauugagcucu

SEQ ID NO: 547262 - RNA, 20 nt, Chlamydophila pneumoniae J138
aaaccacagaaugauaagaa

SEQ ID NO: 547263 - RNA, 22 nt, Chlamydophila pneumoniae J138
ccgacaagcuucguccugacac

SEQ ID NO: 547264 - RNA, 15 nt, Chlamydophila pneumoniae J138
ccgaguccuaaaauu

SEQ ID NO: 547265 - RNA, 15 nt, Chlamydophila pneumoniae J138
ccgagcuuuuugcuu

SEQ ID NO: 547266 - RNA, 21 nt, Chlamydophila pneumoniae J138
ccgaugaggguaucucgucau

SEQ ID NO: 547267 - RNA, 16 nt, Chlamydophila pneumoniae J138
ccgcagcaaaaauaug

SEQ ID NO: 547268 - RNA, 16 nt, Chlamydophila pneumoniae J138
ccgccuuuauauaaag

SEQ ID NO: 547269 - RNA, 14 nt, Chlamydophila pneumoniae J138
ccgccuuucuaccc

SEQ ID NO: 547270 - RNA, 20 nt, Chlamydophila pneumoniae J138
ccgccuugacggguugugaa

SEQ ID NO: 547271 - RNA, 15 nt, Chlamydophila pneumoniae J138
ccggaaggaguucuu

SEQ ID NO: 547272 - RNA, 15 nt, Chlamydophila pneumoniae J138
aaaccguaggauucu

SEQ ID NO: 547273 - RNA, 23 nt, Chlamydophila pneumoniae J138
aaaccguaacugaggcaaagauu

SEQ ID NO: 547274 - RNA, 16 nt, Chlamydophila pneumoniae J138
aaaccguaacugaggc

SEQ ID NO: 547275 - RNA, 13 nt, Chlamydophila pneumoniae J138
aaaccucuaaaaa

SEQ ID NO: 547276 - RNA, 14 nt, Chlamydophila pneumoniae J138
ccguaacugaggca

SEQ ID NO: 547277 - RNA, 14 nt, Chlamydophila pneumoniae J138
ccguaaaagaacgu

SEQ ID NO: 547278 - RNA, 14 nt, Chlamydophila pneumoniae J138
ccguauucccaggu

SEQ ID NO: 547279 - RNA, 21 nt, Chlamydophila pneumoniae J138
ccguauuuuuuacguucuuuc

SEQ ID NO: 547280 - RNA, 12 nt, Chlamydophila pneumoniae J138
aaacgaaagcag

SEQ ID NO: 547281 - RNA, 15 nt, Chlamydophila pneumoniae J138
aaacgaaagcagugu

SEQ ID NO: 547282 - RNA, 12 nt, Chlamydophila pneumoniae J138
aaacgaauacug

SEQ ID NO: 547283 - RNA, 14 nt, Chlamydophila pneumoniae J138
aaaccuucucucuu

SEQ ID NO: 547284 - RNA, 17 nt, Chlamydophila pneumoniae J138
aaaccuucagauccgau

SEQ ID NO: 547285 - RNA, 17 nt, Chlamydophila pneumoniae J138
ccgugagauacuuuaaa

SEQ ID NO: 547286 - RNA, 17 nt, Chlamydophila pneumoniae J138
ccgugacuccagaaggu

SEQ ID NO: 547287 - RNA, 14 nt, Chlamydophila pneumoniae J138
ccgugaacaaaaac

SEQ ID NO: 547288 - RNA, 12 nt, Chlamydophila pneumoniae J138
ccguccucccca

SEQ ID NO: 547289 - RNA, 20 nt, Chlamydophila pneumoniae J138
ccuaugacggauccuagaau

SEQ ID NO: 547290 - RNA, 19 nt, Chlamydophila pneumoniae J138
ccuauggcagcaggaauaa

SEQ ID NO: 547291 - RNA, 19 nt, Chlamydophila pneumoniae J138
ccucaaagaguuuuuuaga

SEQ ID NO: 547292 - RNA, 16 nt, Chlamydophila pneumoniae J138
ccucaagauaaauccc

SEQ ID NO: 547293 - RNA, 19 nt, Chlamydophila pneumoniae J138
ccucacuaacggcaguaug

SEQ ID NO: 547294 - RNA, 15 nt, Chlamydophila pneumoniae J138
aaacgcccuucagga

SEQ ID NO: 547295 - RNA, 18 nt, Chlamydophila pneumoniae J138
aaacgcccuucaggacau

SEQ ID NO: 547296 - RNA, 21 nt, Chlamydophila pneumoniae J138
aaacgcccucuagaagacaca

SEQ ID NO: 547297 - RNA, 16 nt, Chlamydophila pneumoniae J138
ccuccucuucuucauc

SEQ ID NO: 547298 - RNA, 13 nt, Chlamydophila pneumoniae J138
ccuccugcagggg

SEQ ID NO: 547299 - RNA, 13 nt, Chlamydophila pneumoniae J138
ccucgccaaacca

SEQ ID NO: 547300 - RNA, 18 nt, Chlamydophila pneumoniae J138
ccuccucuucuauucuga

SEQ ID NO: 547301 - RNA, 12 nt, Chlamydophila pneumoniae J138
ccuccucuucuu

SEQ ID NO: 547302 - RNA, 20 nt, Chlamydophila pneumoniae J138
ccucuaaggacaaaucuccc

SEQ ID NO: 547303 - RNA, 18 nt, Chlamydophila pneumoniae J138
ccucuaaggacaaaucuc

SEQ ID NO: 547304 - RNA, 15 nt, Chlamydophila pneumoniae J138
ccucuaaaaacccua

SEQ ID NO: 547305 - RNA, 15 nt, Chlamydophila pneumoniae J138
ccucuccuugaaaau

SEQ ID NO: 547306 - RNA, 20 nt, Chlamydophila pneumoniae J138
ccucucucaagucuauuuga

SEQ ID NO: 547307 - RNA, 20 nt, Chlamydophila pneumoniae J138
ccucuacgcuauucuuaagc

SEQ ID NO: 547308 - RNA, 23 nt, Chlamydophila pneumoniae J138
ccucucaugaaauuuucuaagag

SEQ ID NO: 547309 - RNA, 22 nt, Chlamydophila pneumoniae J138
ccucucaugaaauuuucuaaga

SEQ ID NO: 547310 - RNA, 18 nt, Chlamydophila pneumoniae J138
ccucuauccaucaucgaa

SEQ ID NO: 547311 - RNA, 20 nt, Chlamydophila pneumoniae J138
ccucuugaggaccuuccuua

SEQ ID NO: 547312 - RNA, 12 nt, Chlamydophila pneumoniae J138
ccucuucuucau

SEQ ID NO: 547313 - RNA, 18 nt, Chlamydophila pneumoniae J138
ccucuucuucccuuucaa

SEQ ID NO: 547314 - RNA, 14 nt, Chlamydophila pneumoniae J138
ccucuugcuuuucc

SEQ ID NO: 547315 - RNA, 22 nt, Chlamydophila pneumoniae J138
ccucugggaagacucucaucag

SEQ ID NO: 547316 - RNA, 20 nt, Chlamydophila pneumoniae J138
ccucugggaagacucucauc

SEQ ID NO: 547317 - RNA, 17 nt, Chlamydophila pneumoniae J138
ccugaaauccugggcaa

SEQ ID NO: 547318 - RNA, 16 nt, Chlamydophila pneumoniae J138
ccugaacaucuccagc

SEQ ID NO: 547319 - RNA, 13 nt, Chlamydophila pneumoniae J138
ccugaaaguacag

SEQ ID NO: 547320 - RNA, 12 nt, Chlamydophila pneumoniae J138
ccugaagaugag

SEQ ID NO: 547321 - RNA, 22 nt, Chlamydophila pneumoniae J138
ccugaguauuuugcaaaugaaa

SEQ ID NO: 547322 - RNA, 14 nt, Chlamydophila pneumoniae J138
ccugaguaaaauca

SEQ ID NO: 547323 - RNA, 23 nt, Chlamydophila pneumoniae J138
ccugaguacuuugugauuacagc

SEQ ID NO: 547324 - RNA, 17 nt, Chlamydophila pneumoniae J138
ccugauacgcagcuaga

SEQ ID NO: 547325 - RNA, 18 nt, Chlamydophila pneumoniae J138
ccugagaccauaaaauca

SEQ ID NO: 547326 - RNA, 12 nt, Chlamydophila pneumoniae J138
ccugagaguguu

SEQ ID NO: 547327 - RNA, 20 nt, Chlamydophila pneumoniae J138
ccugagaaaaguugccuaaa

SEQ ID NO: 547328 - RNA, 21 nt, Chlamydophila pneumoniae J138
ccugacucuuuuaagacaaua

SEQ ID NO: 547329 - RNA, 15 nt, Chlamydophila pneumoniae J138
ccugcauucauaaaa

SEQ ID NO: 547330 - RNA, 13 nt, Chlamydophila pneumoniae J138
ccugcauggcuuu

SEQ ID NO: 547331 - RNA, 21 nt, Chlamydophila pneumoniae J138
ccugcggaaggcuaaaaccua

SEQ ID NO: 547332 - RNA, 17 nt, Chlamydophila pneumoniae J138
ccugauuccauccuguc

SEQ ID NO: 547333 - RNA, 13 nt, Chlamydophila pneumoniae J138
ccugaugccuuuu

SEQ ID NO: 547334 - RNA, 21 nt, Chlamydophila pneumoniae J138
ccugaucuguagguguaauua

SEQ ID NO: 547335 - RNA, 14 nt, Chlamydophila pneumoniae J138
ccugaucuucuuga

SEQ ID NO: 547336 - RNA, 16 nt, Chlamydophila pneumoniae J138
ccugcaaacuccccag

SEQ ID NO: 547337 - RNA, 19 nt, Chlamydophila pneumoniae J138
ccugguuugacuccucgcu

SEQ ID NO: 547338 - RNA, 15 nt, Chlamydophila pneumoniae J138
ccuguaacacccucc

SEQ ID NO: 547339 - RNA, 13 nt, Chlamydophila pneumoniae J138
ccuguaacacccu

SEQ ID NO: 547340 - RNA, 16 nt, Chlamydophila pneumoniae J138
ccuguauuaaagaauc

SEQ ID NO: 547341 - RNA, 21 nt, Chlamydophila pneumoniae J138
ccuguauuaaagaaucuaacu

SEQ ID NO: 547342 - RNA, 20 nt, Chlamydophila pneumoniae J138
ccugcuaaacuuuuuuucaa

SEQ ID NO: 547343 - RNA, 21 nt, Chlamydophila pneumoniae J138
ccugugugguuggauccaucg

SEQ ID NO: 547344 - RNA, 19 nt, Chlamydophila pneumoniae J138
ccugugauagguagcagcc

SEQ ID NO: 547345 - RNA, 20 nt, Chlamydophila pneumoniae J138
ccugugagucugaugcccac

SEQ ID NO: 547346 - RNA, 13 nt, Chlamydophila pneumoniae J138
ccugugauuuccu

SEQ ID NO: 547347 - RNA, 16 nt, Chlamydophila pneumoniae J138
ccuguuuuauugggaa

SEQ ID NO: 547348 - RNA, 19 nt, Chlamydophila pneumoniae J138
ccuuaaagagaaucuccuc

SEQ ID NO: 547349 - RNA, 22 nt, Chlamydophila pneumoniae J138
ccuguuuucuuuucugaagauu

SEQ ID NO: 547350 - RNA, 23 nt, Chlamydophila pneumoniae J138
ccuucguaacgcuuuucuaauag

SEQ ID NO: 547351 - RNA, 11 nt, Chlamydophila pneumoniae J138
ccuucucccuc

SEQ ID NO: 547352 - RNA, 14 nt, Chlamydophila pneumoniae J138
ccuucucagaaaga

SEQ ID NO: 547353 - RNA, 15 nt, Chlamydophila pneumoniae J138
ccuucucauugcggc

SEQ ID NO: 547354 - RNA, 18 nt, Chlamydophila pneumoniae J138
ccuuaacaaccgccuuua

SEQ ID NO: 547355 - RNA, 17 nt, Chlamydophila pneumoniae J138
ccuuaaccuccucaaga

SEQ ID NO: 547356 - RNA, 15 nt, Chlamydophila pneumoniae J138
ccuuaguuuuuucua

SEQ ID NO: 547357 - RNA, 18 nt, Chlamydophila pneumoniae J138
ccuuagcauuaggaaagu

SEQ ID NO: 547358 - RNA, 18 nt, Chlamydophila pneumoniae J138
ccuuaggcuuaauaaaca

SEQ ID NO: 547359 - RNA, 15 nt, Chlamydophila pneumoniae J138
ccuucugcaaucagu

SEQ ID NO: 547360 - RNA, 16 nt, Chlamydophila pneumoniae J138
ccuucucgucauucug

SEQ ID NO: 547361 - RNA, 13 nt, Chlamydophila pneumoniae J138
ccuugcagcccug

SEQ ID NO: 547362 - RNA, 20 nt, Chlamydophila pneumoniae J138
ccuugcauuagauucagcac

SEQ ID NO: 547363 - RNA, 18 nt, Chlamydophila pneumoniae J138
ccuuuucagauuuuuuaa

SEQ ID NO: 547364 - RNA, 19 nt, Chlamydophila pneumoniae J138
ccuuuucagauuuuuuaac

SEQ ID NO: 547365 - RNA, 20 nt, Chlamydophila pneumoniae J138
ccuuuguuuuaucuuuaguu

SEQ ID NO: 547366 - RNA, 17 nt, Chlamydophila pneumoniae J138
ccuuucuuuugcuuuuc

SEQ ID NO: 547367 - RNA, 14 nt, Chlamydophila pneumoniae J138
ccuuucuuuugcuu

SEQ ID NO: 547368 - RNA, 18 nt, Chlamydophila pneumoniae J138
ccuuugagucuuuuucag

SEQ ID NO: 547369 - RNA, 14 nt, Chlamydophila pneumoniae J138
ccuugguaucccaa

SEQ ID NO: 547370 - RNA, 23 nt, Chlamydophila pneumoniae J138
ccuuucucuuccgauuaacuuua

SEQ ID NO: 547371 - RNA, 19 nt, Chlamydophila pneumoniae J138
ccuuuuucugcuucuccaa

SEQ ID NO: 547372 - RNA, 18 nt, Chlamydophila pneumoniae J138
cgaaaaacgguaaauauc

SEQ ID NO: 547373 - RNA, 13 nt, Chlamydophila pneumoniae J138
cgaaaaucuacac

SEQ ID NO: 547374 - RNA, 15 nt, Chlamydophila pneumoniae J138
cgaaaccacagcaaa

SEQ ID NO: 547375 - RNA, 19 nt, Chlamydophila pneumoniae J138
cgaaaccggacugacuucu

SEQ ID NO: 547376 - RNA, 18 nt, Chlamydophila pneumoniae J138
cgaaacucuuugaggaua

SEQ ID NO: 547377 - RNA, 20 nt, Chlamydophila pneumoniae J138
cgaaagucccgcaacuaaac

SEQ ID NO: 547378 - RNA, 13 nt, Chlamydophila pneumoniae J138
cgaaagaucagag

SEQ ID NO: 547379 - RNA, 15 nt, Chlamydophila pneumoniae J138
cgaaauccuaaaaag

SEQ ID NO: 547380 - RNA, 19 nt, Chlamydophila pneumoniae J138
cgaacacgucgaacaugac

SEQ ID NO: 547381 - RNA, 14 nt, Chlamydophila pneumoniae J138
cgaacaugccugaa

SEQ ID NO: 547382 - RNA, 18 nt, Chlamydophila pneumoniae J138
cgaacaguucauguugcu

SEQ ID NO: 547383 - RNA, 21 nt, Chlamydophila pneumoniae J138
cgaagacaaugucgucucaga

SEQ ID NO: 547384 - RNA, 22 nt, Chlamydophila pneumoniae J138
cgaagagcccucuucacuuaua

SEQ ID NO: 547385 - RNA, 17 nt, Chlamydophila pneumoniae J138
cgaagacucaaagaacu

SEQ ID NO: 547386 - RNA, 15 nt, Chlamydophila pneumoniae J138
cgaagacuuguucuu

SEQ ID NO: 547387 - RNA, 22 nt, Chlamydophila pneumoniae J138
cgaagacuuguucuucauuauu

SEQ ID NO: 547388 - RNA, 18 nt, Chlamydophila pneumoniae J138
cgaagcgccgcauuacag

SEQ ID NO: 547389 - RNA, 20 nt, Chlamydophila pneumoniae J138
cgaaggggaagaggaaugcc

SEQ ID NO: 547390 - RNA, 14 nt, Chlamydophila pneumoniae J138
cgaaguccuggauu

SEQ ID NO: 547391 - RNA, 20 nt, Chlamydophila pneumoniae J138
caugcuugaggaauucuuua

SEQ ID NO: 547392 - RNA, 22 nt, Chlamydophila pneumoniae J138
cauggaagugcggcucucuuca

SEQ ID NO: 547393 - RNA, 20 nt, Chlamydophila pneumoniae J138
cauggauucacaucuuaaaa

SEQ ID NO: 547394 - RNA, 15 nt, Chlamydophila pneumoniae J138
cauggauucacaucu

SEQ ID NO: 547395 - RNA, 19 nt, Chlamydophila pneumoniae J138
cauggacaagcaaaagcaa

SEQ ID NO: 547396 - RNA, 15 nt, Chlamydophila pneumoniae J138
cauggacuccaagaa

SEQ ID NO: 547397 - RNA, 15 nt, Chlamydophila pneumoniae J138
cauggauauggaaug

SEQ ID NO: 547398 - RNA, 17 nt, Chlamydophila pneumoniae J138
cauggauauggaauggc

SEQ ID NO: 547399 - RNA, 22 nt, Chlamydophila pneumoniae J138
caucuucacuaaaugacgcaca

SEQ ID NO: 547400 - RNA, 17 nt, Chlamydophila pneumoniae J138
caucuucacuaaaugac

SEQ ID NO: 547401 - RNA, 15 nt, Chlamydophila pneumoniae J138
cauggcuggaaagcc

SEQ ID NO: 547402 - RNA, 17 nt, Chlamydophila pneumoniae J138
cauggcuggaaagccaa

SEQ ID NO: 547403 - RNA, 19 nt, Chlamydophila pneumoniae J138
cauggcuggaaagccaagc

SEQ ID NO: 547404 - RNA, 17 nt, Chlamydophila pneumoniae J138
cauggcccgauacaaau

SEQ ID NO: 547405 - RNA, 22 nt, Chlamydophila pneumoniae J138
cauggcuuugugagcugcuggu

SEQ ID NO: 547406 - RNA, 16 nt, Chlamydophila pneumoniae J138
cauguaacugaaagua

SEQ ID NO: 547407 - RNA, 19 nt, Chlamydophila pneumoniae J138
cauguacaguuuguaaaaa

SEQ ID NO: 547408 - RNA, 14 nt, Chlamydophila pneumoniae J138
caugugcugaagac

SEQ ID NO: 547409 - RNA, 11 nt, Chlamydophila pneumoniae J138
caugucuaagu

SEQ ID NO: 547410 - RNA, 18 nt, Chlamydophila pneumoniae J138
caugucuaagucagaggu

SEQ ID NO: 547411 - RNA, 12 nt, Chlamydophila pneumoniae J138
cauuaaguacug

SEQ ID NO: 547412 - RNA, 18 nt, Chlamydophila pneumoniae J138
cauguuaagcguauagaa

SEQ ID NO: 547413 - RNA, 20 nt, Chlamydophila pneumoniae J138
cauuaagcucaaaauuuccu

SEQ ID NO: 547414 - RNA, 22 nt, Chlamydophila pneumoniae J138
cauuacgguuucugggaugcac

SEQ ID NO: 547415 - RNA, 23 nt, Chlamydophila pneumoniae J138
cauuacggaggcauaaucuccaa

SEQ ID NO: 547416 - RNA, 21 nt, Chlamydophila pneumoniae J138
cauuagcaagagcucuugaga

SEQ ID NO: 547417 - RNA, 15 nt, Chlamydophila pneumoniae J138
cauuauacuuuuuuu

SEQ ID NO: 547418 - RNA, 19 nt, Chlamydophila pneumoniae J138
cauuauacuuuuuuuauau

SEQ ID NO: 547419 - RNA, 15 nt, Chlamydophila pneumoniae J138
cauucaauaauuuca

SEQ ID NO: 547420 - RNA, 17 nt, Chlamydophila pneumoniae J138
cauuccgagcugcaaac

SEQ ID NO: 547421 - RNA, 23 nt, Chlamydophila pneumoniae J138
cauugcaaauaagccaguacuaa

SEQ ID NO: 547422 - RNA, 17 nt, Chlamydophila pneumoniae J138
cauugucucuuuuaaag

SEQ ID NO: 547423 - RNA, 23 nt, Chlamydophila pneumoniae J138
cauuguuuaaguccuucuuccca

SEQ ID NO: 547424 - RNA, 21 nt, Chlamydophila pneumoniae J138
cauuguuuggcaguucacuga

SEQ ID NO: 547425 - RNA, 16 nt, Chlamydophila pneumoniae J138
cauuuaaacuaagaau

SEQ ID NO: 547426 - RNA, 14 nt, Chlamydophila pneumoniae J138
cauuuaaagcugaa

SEQ ID NO: 547427 - RNA, 20 nt, Chlamydophila pneumoniae J138
cauuuaaagcugaaauucuu

SEQ ID NO: 547428 - RNA, 18 nt, Chlamydophila pneumoniae J138
cauuuaaacuaagaauac

SEQ ID NO: 547429 - RNA, 23 nt, Chlamydophila pneumoniae J138
cauuguuuguccuaggagagcua

SEQ ID NO: 547430 - RNA, 19 nt, Chlamydophila pneumoniae J138
cauuggcuccuaaggaaac

SEQ ID NO: 547431 - RNA, 22 nt, Chlamydophila pneumoniae J138
cauuucuaucaguucauuuugg

SEQ ID NO: 547432 - RNA, 18 nt, Chlamydophila pneumoniae J138
cauuucuacacgccacaa

SEQ ID NO: 547433 - RNA, 15 nt, Chlamydophila pneumoniae J138
cauuugauucauaaa

SEQ ID NO: 547434 - RNA, 14 nt, Chlamydophila pneumoniae J138
cauuugcuuuaaca

SEQ ID NO: 547435 - RNA, 18 nt, Chlamydophila pneumoniae J138
cauuucgauaacacuucu

SEQ ID NO: 547436 - RNA, 16 nt, Chlamydophila pneumoniae J138
cauuucauguaagaau

SEQ ID NO: 547437 - RNA, 17 nt, Chlamydophila pneumoniae J138
cauuuagacaaucuacg

SEQ ID NO: 547438 - RNA, 16 nt, Chlamydophila pneumoniae J138
cauuuagauaaagaaa

SEQ ID NO: 547439 - RNA, 19 nt, Chlamydophila pneumoniae J138
cauuuaucugcguuucuuu

SEQ ID NO: 547440 - RNA, 17 nt, Chlamydophila pneumoniae J138
ccaaagcuauuucucua

SEQ ID NO: 547441 - RNA, 20 nt, Chlamydophila pneumoniae J138
ccaaagcuauuucucuauca

SEQ ID NO: 547442 - RNA, 15 nt, Chlamydophila pneumoniae J138
ccaaaggaaaauaau

SEQ ID NO: 547443 - RNA, 14 nt, Chlamydophila pneumoniae J138
ccaaagcuucuuuc

SEQ ID NO: 547444 - RNA, 23 nt, Chlamydophila pneumoniae J138
ccaaagugacuuccuccaaaauu

SEQ ID NO: 547445 - RNA, 21 nt, Chlamydophila pneumoniae J138
ccaaagucacucaaacccucu

SEQ ID NO: 547446 - RNA, 18 nt, Chlamydophila pneumoniae J138
ccaaagucacucaaaccc

SEQ ID NO: 547447 - RNA, 19 nt, Chlamydophila pneumoniae J138
ccaaagucacucaaacccu

SEQ ID NO: 547448 - RNA, 17 nt, Chlamydophila pneumoniae J138
ccaaagugacuuccucc

SEQ ID NO: 547449 - RNA, 18 nt, Chlamydophila pneumoniae J138
cauuuucaggcugaacca

SEQ ID NO: 547450 - RNA, 15 nt, Chlamydophila pneumoniae J138
ccaaauccuccgccu

SEQ ID NO: 547451 - RNA, 12 nt, Chlamydophila pneumoniae J138
ccaaauccuccg

SEQ ID NO: 547452 - RNA, 15 nt, Chlamydophila pneumoniae J138
ccaacaguucuuucu

SEQ ID NO: 547453 - RNA, 16 nt, Chlamydophila pneumoniae J138
ccaacaguucuuucug

SEQ ID NO: 547454 - RNA, 15 nt, Chlamydophila pneumoniae J138
ccaacaguguagccu

SEQ ID NO: 547455 - RNA, 17 nt, Chlamydophila pneumoniae J138
ccaacaagggaaagaaa

SEQ ID NO: 547456 - RNA, 20 nt, Chlamydophila pneumoniae J138
ccaagcuuccaacuuuugaa

SEQ ID NO: 547457 - RNA, 14 nt, Chlamydophila pneumoniae J138
ccaagcaagaagug

SEQ ID NO: 547458 - RNA, 17 nt, Chlamydophila pneumoniae J138
ccaacggcauaggauug

SEQ ID NO: 547459 - RNA, 19 nt, Chlamydophila pneumoniae J138
ccaacaucagcuguugcgu

SEQ ID NO: 547460 - RNA, 15 nt, Chlamydophila pneumoniae J138
ccaauauagaagcug

SEQ ID NO: 547461 - RNA, 14 nt, Chlamydophila pneumoniae J138
ccaauacuaaaacu

SEQ ID NO: 547462 - RNA, 18 nt, Chlamydophila pneumoniae J138
ccaauacagcauaaaaau

SEQ ID NO: 547463 - RNA, 19 nt, Chlamydophila pneumoniae J138
ccaagucagccaagacaaa

SEQ ID NO: 547464 - RNA, 14 nt, Chlamydophila pneumoniae J138
ccaaucgauaacgu

SEQ ID NO: 547465 - RNA, 22 nt, Chlamydophila pneumoniae J138
ccaauccauucugagaaagaag

SEQ ID NO: 547466 - RNA, 17 nt, Chlamydophila pneumoniae J138
ccaauaugcucugccau

SEQ ID NO: 547467 - RNA, 17 nt, Chlamydophila pneumoniae J138
ccacacaggauuguuau

SEQ ID NO: 547468 - RNA, 15 nt, Chlamydophila pneumoniae J138
ccacacaacucguuu

SEQ ID NO: 547469 - RNA, 16 nt, Chlamydophila pneumoniae J138
ccacagacugcaggaa

SEQ ID NO: 547470 - RNA, 14 nt, Chlamydophila pneumoniae J138
ccacaggaaugaaa

SEQ ID NO: 547471 - RNA, 23 nt, Chlamydophila pneumoniae J138
ccacagccaaguucguuggccca

SEQ ID NO: 547472 - RNA, 23 nt, Chlamydophila pneumoniae J138
ccaauuguaucuguauccuuccu

SEQ ID NO: 547473 - RNA, 20 nt, Chlamydophila pneumoniae J138
ccaauugcagucacuacugu

SEQ ID NO: 547474 - RNA, 22 nt, Chlamydophila pneumoniae J138
ccaaugggaauuugauuuuuca

SEQ ID NO: 547475 - RNA, 13 nt, Chlamydophila pneumoniae J138
ccaauuuuuuccc

SEQ ID NO: 547476 - RNA, 17 nt, Chlamydophila pneumoniae J138
ccaaugcuauuggaaca

SEQ ID NO: 547477 - RNA, 19 nt, Chlamydophila pneumoniae J138
ccaauguggugauuucuuu

SEQ ID NO: 547478 - RNA, 18 nt, Chlamydophila pneumoniae J138
ccaccaggagcuccuccu

SEQ ID NO: 547479 - RNA, 14 nt, Chlamydophila pneumoniae J138
ccacagggucuagu

SEQ ID NO: 547480 - RNA, 22 nt, Chlamydophila pneumoniae J138
ccacgaguucgcggaucuucuu

SEQ ID NO: 547481 - RNA, 23 nt, Chlamydophila pneumoniae J138
ccacgaguucgcggaucuucuuc

SEQ ID NO: 547482 - RNA, 22 nt, Chlamydophila pneumoniae J138
ccacgaccugcaaacuccccag

SEQ ID NO: 547483 - RNA, 14 nt, Chlamydophila pneumoniae J138
ccacgaauucuuua

SEQ ID NO: 547484 - RNA, 15 nt, Chlamydophila pneumoniae J138
ccacgggucaggagg

SEQ ID NO: 547485 - RNA, 13 nt, Chlamydophila pneumoniae J138
ccacguccauuuc

SEQ ID NO: 547486 - RNA, 20 nt, Chlamydophila pneumoniae J138
ccacuacugagcuucuauuu

SEQ ID NO: 547487 - RNA, 22 nt, Chlamydophila pneumoniae J138
ccacuaaguuuaggcaggaagu

SEQ ID NO: 547488 - RNA, 16 nt, Chlamydophila pneumoniae J138
ccacggauuuucucua

SEQ ID NO: 547489 - RNA, 21 nt, Chlamydophila pneumoniae J138
caguguuauuuggacguacua

SEQ ID NO: 547490 - RNA, 18 nt, Chlamydophila pneumoniae J138
caguguauuguuugcuau

SEQ ID NO: 547491 - RNA, 14 nt, Chlamydophila pneumoniae J138
caguuaaagagcau

SEQ ID NO: 547492 - RNA, 16 nt, Chlamydophila pneumoniae J138
caguucaucuagauga

SEQ ID NO: 547493 - RNA, 21 nt, Chlamydophila pneumoniae J138
caguucauguugcucauccuu

SEQ ID NO: 547494 - RNA, 13 nt, Chlamydophila pneumoniae J138
cagguagucccuu

SEQ ID NO: 547495 - RNA, 20 nt, Chlamydophila pneumoniae J138
caguggacggggagagccau

SEQ ID NO: 547496 - RNA, 15 nt, Chlamydophila pneumoniae J138
caguucgacaaccaa

SEQ ID NO: 547497 - RNA, 23 nt, Chlamydophila pneumoniae J138
caguugaugagaaaaagaaucuc

SEQ ID NO: 547498 - RNA, 11 nt, Chlamydophila pneumoniae J138
caguucuucau

SEQ ID NO: 547499 - RNA, 22 nt, Chlamydophila pneumoniae J138
caguucuucauuccaggauucu

SEQ ID NO: 547500 - RNA, 22 nt, Chlamydophila pneumoniae J138
caguucuuguuaaaguaaaaaa

SEQ ID NO: 547501 - RNA, 15 nt, Chlamydophila pneumoniae J138
caguucuuucugcuu

SEQ ID NO: 547502 - RNA, 13 nt, Chlamydophila pneumoniae J138
caguugcggagau

SEQ ID NO: 547503 - RNA, 22 nt, Chlamydophila pneumoniae J138
caguuuuaucggcaauuguuaa

SEQ ID NO: 547504 - RNA, 14 nt, Chlamydophila pneumoniae J138
cauaaaaaaagcua

SEQ ID NO: 547505 - RNA, 12 nt, Chlamydophila pneumoniae J138
caguuguuucua

SEQ ID NO: 547506 - RNA, 22 nt, Chlamydophila pneumoniae J138
caguuguauccagcucaaggca

SEQ ID NO: 547507 - RNA, 17 nt, Chlamydophila pneumoniae J138
cauaagcuuuucuucca

SEQ ID NO: 547508 - RNA, 15 nt, Chlamydophila pneumoniae J138
cauaagcucuauuuc

SEQ ID NO: 547509 - RNA, 19 nt, Chlamydophila pneumoniae J138
cauaagagacauuucuuga

SEQ ID NO: 547510 - RNA, 20 nt, Chlamydophila pneumoniae J138
cauaagaucaauauagagaa

SEQ ID NO: 547511 - RNA, 15 nt, Chlamydophila pneumoniae J138
cauaacuugaagaag

SEQ ID NO: 547512 - RNA, 11 nt, Chlamydophila pneumoniae J138
cauaacugugc

SEQ ID NO: 547513 - RNA, 11 nt, Chlamydophila pneumoniae J138
cauaagaacuc

SEQ ID NO: 547514 - RNA, 17 nt, Chlamydophila pneumoniae J138
cauaagaacucuauuug

SEQ ID NO: 547515 - RNA, 19 nt, Chlamydophila pneumoniae J138
cauaagaacucuauuuggc

SEQ ID NO: 547516 - RNA, 18 nt, Chlamydophila pneumoniae J138
cauaacgggguugucucu

SEQ ID NO: 547517 - RNA, 22 nt, Chlamydophila pneumoniae J138
cauaacauuuagauaaagaaag

SEQ ID NO: 547518 - RNA, 13 nt, Chlamydophila pneumoniae J138
cauaacauugcuu

SEQ ID NO: 547519 - RNA, 12 nt, Chlamydophila pneumoniae J138
cauaacccaaag

SEQ ID NO: 547520 - RNA, 20 nt, Chlamydophila pneumoniae J138
cauaacgacaugccuuggua

SEQ ID NO: 547521 - RNA, 20 nt, Chlamydophila pneumoniae J138
cauaaccuuugacaacacca

SEQ ID NO: 547522 - RNA, 21 nt, Chlamydophila pneumoniae J138
cauaaauaggcucuacaggag

SEQ ID NO: 547523 - RNA, 21 nt, Chlamydophila pneumoniae J138
cauaaauguauaggcauuaau

SEQ ID NO: 547524 - RNA, 19 nt, Chlamydophila pneumoniae J138
cauaaauacgugcuugaau

SEQ ID NO: 547525 - RNA, 21 nt, Chlamydophila pneumoniae J138
cauaaaguucggcgccuucaa

SEQ ID NO: 547526 - RNA, 22 nt, Chlamydophila pneumoniae J138
cauaaaguucggcgccuucaaa

SEQ ID NO: 547527 - RNA, 21 nt, Chlamydophila pneumoniae J138
cauaaagaucuuuauuuuuaa

SEQ ID NO: 547528 - RNA, 19 nt, Chlamydophila pneumoniae J138
cauaaaggcucuuuuagag

SEQ ID NO: 547529 - RNA, 22 nt, Chlamydophila pneumoniae J138
cauaaaggcgucgccccaugaa

SEQ ID NO: 547530 - RNA, 15 nt, Chlamydophila pneumoniae J138
cauaaaggcucuuuu

SEQ ID NO: 547531 - RNA, 16 nt, Chlamydophila pneumoniae J138
cauaaagacccuucuu

SEQ ID NO: 547532 - RNA, 19 nt, Chlamydophila pneumoniae J138
cauaaagacccuucuuucc

SEQ ID NO: 547533 - RNA, 19 nt, Chlamydophila pneumoniae J138
cauaaacuccuaggggaau

SEQ ID NO: 547534 - RNA, 15 nt, Chlamydophila pneumoniae J138
cauaaacaauucaug

SEQ ID NO: 547535 - RNA, 20 nt, Chlamydophila pneumoniae J138
cauaaacaucgcagcaggau

SEQ ID NO: 547536 - RNA, 20 nt, Chlamydophila pneumoniae J138
cauaaucucaccagaagcaa

SEQ ID NO: 547537 - RNA, 12 nt, Chlamydophila pneumoniae J138
cauaaucuccaa

SEQ ID NO: 547538 - RNA, 16 nt, Chlamydophila pneumoniae J138
cauaaugagacagaca

SEQ ID NO: 547539 - RNA, 16 nt, Chlamydophila pneumoniae J138
cauaauuagagagaau

SEQ ID NO: 547540 - RNA, 21 nt, Chlamydophila pneumoniae J138
cauaaucacacucguagccuu

SEQ ID NO: 547541 - RNA, 12 nt, Chlamydophila pneumoniae J138
cauaauccaaga

SEQ ID NO: 547542 - RNA, 20 nt, Chlamydophila pneumoniae J138
cauaauccugaauggcucug

SEQ ID NO: 547543 - RNA, 21 nt, Chlamydophila pneumoniae J138
cauaauaagcaggaaaagcaa

SEQ ID NO: 547544 - RNA, 20 nt, Chlamydophila pneumoniae J138
cauaauaagcaggaaaagca

SEQ ID NO: 547545 - RNA, 15 nt, Chlamydophila pneumoniae J138
cauaaguauagagag

SEQ ID NO: 547546 - RNA, 15 nt, Chlamydophila pneumoniae J138
cauaaguuagccugg

SEQ ID NO: 547547 - RNA, 20 nt, Chlamydophila pneumoniae J138
cauaauauaauaguggcuau

SEQ ID NO: 547548 - RNA, 13 nt, Chlamydophila pneumoniae J138
cauaauagucucu

SEQ ID NO: 547549 - RNA, 18 nt, Chlamydophila pneumoniae J138
cauacaucguauccaaau

SEQ ID NO: 547550 - RNA, 18 nt, Chlamydophila pneumoniae J138
cauacaugcuaauccagc

SEQ ID NO: 547551 - RNA, 19 nt, Chlamydophila pneumoniae J138
cauacaugcuaauccagca

SEQ ID NO: 547552 - RNA, 21 nt, Chlamydophila pneumoniae J138
cauacaggcuccucugcuaag

SEQ ID NO: 547553 - RNA, 23 nt, Chlamydophila pneumoniae J138
cauacaggcuccucugcuaagca

SEQ ID NO: 547554 - RNA, 14 nt, Chlamydophila pneumoniae J138
cauaauuuuucuua

SEQ ID NO: 547555 - RNA, 17 nt, Chlamydophila pneumoniae J138
cauacacaaaucauuua

SEQ ID NO: 547556 - RNA, 17 nt, Chlamydophila pneumoniae J138
cauacaccccaguuucu

SEQ ID NO: 547557 - RNA, 23 nt, Chlamydophila pneumoniae J138
cauacgccgugccuauagaaauu

SEQ ID NO: 547558 - RNA, 17 nt, Chlamydophila pneumoniae J138
cauacccuucuucuuca

SEQ ID NO: 547559 - RNA, 20 nt, Chlamydophila pneumoniae J138
cauaucuccuuuaaauaaaa

SEQ ID NO: 547560 - RNA, 21 nt, Chlamydophila pneumoniae J138
cauauccaaugagagagagac

SEQ ID NO: 547561 - RNA, 15 nt, Chlamydophila pneumoniae J138
cauaguggcucagug

SEQ ID NO: 547562 - RNA, 18 nt, Chlamydophila pneumoniae J138
cauagucgucuuuuaaag

SEQ ID NO: 547563 - RNA, 16 nt, Chlamydophila pneumoniae J138
cauacuacucucauca

SEQ ID NO: 547564 - RNA, 14 nt, Chlamydophila pneumoniae J138
cauacgguauacca

SEQ ID NO: 547565 - RNA, 12 nt, Chlamydophila pneumoniae J138
cauacgguauac

SEQ ID NO: 547566 - RNA, 22 nt, Chlamydophila pneumoniae J138
cauauggauugucgaugaggga

SEQ ID NO: 547567 - RNA, 14 nt, Chlamydophila pneumoniae J138
cauaugcucucccg

SEQ ID NO: 547568 - RNA, 18 nt, Chlamydophila pneumoniae J138
cauauuuacgaaaacauc

SEQ ID NO: 547569 - RNA, 12 nt, Chlamydophila pneumoniae J138
caucaagagaua

SEQ ID NO: 547570 - RNA, 17 nt, Chlamydophila pneumoniae J138
cauauuuauuuaaacca

SEQ ID NO: 547571 - RNA, 12 nt, Chlamydophila pneumoniae J138
caucaaaaagau

SEQ ID NO: 547572 - RNA, 13 nt, Chlamydophila pneumoniae J138
caucaaaacauaa

SEQ ID NO: 547573 - RNA, 23 nt, Chlamydophila pneumoniae J138
caucaaaagauaugucuugcuuu

SEQ ID NO: 547574 - RNA, 16 nt, Chlamydophila pneumoniae J138
caucaggauucucucu

SEQ ID NO: 547575 - RNA, 17 nt, Chlamydophila pneumoniae J138
caucagacugaagagca

SEQ ID NO: 547576 - RNA, 18 nt, Chlamydophila pneumoniae J138
caucagaagccaccaaaa

SEQ ID NO: 547577 - RNA, 14 nt, Chlamydophila pneumoniae J138
caucagaaguggcc

SEQ ID NO: 547578 - RNA, 18 nt, Chlamydophila pneumoniae J138
caucacgaggagcuuuua

SEQ ID NO: 547579 - RNA, 14 nt, Chlamydophila pneumoniae J138
caucacgaggagcu

SEQ ID NO: 547580 - RNA, 21 nt, Chlamydophila pneumoniae J138
caucaaugcgauuacuucacg

SEQ ID NO: 547581 - RNA, 23 nt, Chlamydophila pneumoniae J138
caucaaugauaucgccuuccuua

SEQ ID NO: 547582 - RNA, 22 nt, Chlamydophila pneumoniae J138
caucaaugagaucugcaaacgc

SEQ ID NO: 547583 - RNA, 17 nt, Chlamydophila pneumoniae J138
caucauccucaggaccu

SEQ ID NO: 547584 - RNA, 12 nt, Chlamydophila pneumoniae J138
caucaucaccag

SEQ ID NO: 547585 - RNA, 12 nt, Chlamydophila pneumoniae J138
caucaucgagcu

SEQ ID NO: 547586 - RNA, 18 nt, Chlamydophila pneumoniae J138
caucaucuccugaagcca

SEQ ID NO: 547587 - RNA, 20 nt, Chlamydophila pneumoniae J138
caucaugaaauacccgcacc

SEQ ID NO: 547588 - RNA, 20 nt, Chlamydophila pneumoniae J138
caucaguggcgacugcaaca

SEQ ID NO: 547589 - RNA, 21 nt, Chlamydophila pneumoniae J138
caucauaaagugcgagguaug

SEQ ID NO: 547590 - RNA, 22 nt, Chlamydophila pneumoniae J138
caucccuagggaaagcaucuuu

SEQ ID NO: 547591 - RNA, 12 nt, Chlamydophila pneumoniae J138
caucccuucuuc

SEQ ID NO: 547592 - RNA, 15 nt, Chlamydophila pneumoniae J138
cauccgaagacucaa

SEQ ID NO: 547593 - RNA, 19 nt, Chlamydophila pneumoniae J138
cauccugucuauuucuuaa

SEQ ID NO: 547594 - RNA, 18 nt, Chlamydophila pneumoniae J138
caucgacaaguaccuucu

SEQ ID NO: 547595 - RNA, 19 nt, Chlamydophila pneumoniae J138
caucgcaguuccauagcua

SEQ ID NO: 547596 - RNA, 14 nt, Chlamydophila pneumoniae J138
caucuaaaaaugca

SEQ ID NO: 547597 - RNA, 20 nt, Chlamydophila pneumoniae J138
caucuaacgucagcuguccu

SEQ ID NO: 547598 - RNA, 19 nt, Chlamydophila pneumoniae J138
caucgguucggucucuucu

SEQ ID NO: 547599 - RNA, 23 nt, Chlamydophila pneumoniae J138
caucgguucggucucuucucugu

SEQ ID NO: 547600 - RNA, 24 nt, Chlamydophila pneumoniae J138
caucgguucggucucuucucuguu

SEQ ID NO: 547601 - RNA, 17 nt, Chlamydophila pneumoniae J138
caucucacaagcauccu

SEQ ID NO: 547602 - RNA, 15 nt, Chlamydophila pneumoniae J138
caucuccaagauaau

SEQ ID NO: 547603 - RNA, 22 nt, Chlamydophila pneumoniae J138
caucuacgauguuuucuuaucc

SEQ ID NO: 547604 - RNA, 17 nt, Chlamydophila pneumoniae J138
caucuacgauguuuucu

SEQ ID NO: 547605 - RNA, 15 nt, Chlamydophila pneumoniae J138
caucuaacucuaauc

SEQ ID NO: 547606 - RNA, 22 nt, Chlamydophila pneumoniae J138
caucuagaaagauuuauuuugu

SEQ ID NO: 547607 - RNA, 22 nt, Chlamydophila pneumoniae J138
caucuagaagcauucucaauuc

SEQ ID NO: 547608 - RNA, 14 nt, Chlamydophila pneumoniae J138
caucugucauuaaa

SEQ ID NO: 547609 - RNA, 21 nt, Chlamydophila pneumoniae J138
caucugucauuaaaaauuuaa

SEQ ID NO: 547610 - RNA, 23 nt, Chlamydophila pneumoniae J138
caucugucauuaaaaauuuaaaa

SEQ ID NO: 547611 - RNA, 23 nt, Chlamydophila pneumoniae J138
caucuuaucaagagcucguaauc

SEQ ID NO: 547612 - RNA, 22 nt, Chlamydophila pneumoniae J138
caucuggaauggccacagcuau

SEQ ID NO: 547613 - RNA, 13 nt, Chlamydophila pneumoniae J138
caucuccugaagc

SEQ ID NO: 547614 - RNA, 22 nt, Chlamydophila pneumoniae J138
caucucguugggcucauaaccc

SEQ ID NO: 547615 - RNA, 11 nt, Chlamydophila pneumoniae J138
caucucucucc

SEQ ID NO: 547616 - RNA, 12 nt, Chlamydophila pneumoniae J138
cacuagcagaag

SEQ ID NO: 547617 - RNA, 13 nt, Chlamydophila pneumoniae J138
cacuacuguucua

SEQ ID NO: 547618 - RNA, 15 nt, Chlamydophila pneumoniae J138
cacuacuuaaagcuu

SEQ ID NO: 547619 - RNA, 20 nt, Chlamydophila pneumoniae J138
cacuauguguuuccuuuucu

SEQ ID NO: 547620 - RNA, 12 nt, Chlamydophila pneumoniae J138
cacuauuaauac

SEQ ID NO: 547621 - RNA, 14 nt, Chlamydophila pneumoniae J138
cacucagcucccau

SEQ ID NO: 547622 - RNA, 13 nt, Chlamydophila pneumoniae J138
cacuccaaaacuc

SEQ ID NO: 547623 - RNA, 17 nt, Chlamydophila pneumoniae J138
cacguuugacaaauuua

SEQ ID NO: 547624 - RNA, 16 nt, Chlamydophila pneumoniae J138
cacguuugacaaauuu

SEQ ID NO: 547625 - RNA, 15 nt, Chlamydophila pneumoniae J138
cacguucugcaacaa

SEQ ID NO: 547626 - RNA, 17 nt, Chlamydophila pneumoniae J138
cacuaacggcaguaugc

SEQ ID NO: 547627 - RNA, 18 nt, Chlamydophila pneumoniae J138
cacuaaguuuaggcagga

SEQ ID NO: 547628 - RNA, 15 nt, Chlamydophila pneumoniae J138
cacuaaccgaugaua

SEQ ID NO: 547629 - RNA, 17 nt, Chlamydophila pneumoniae J138
cacuacauuauaaucac

SEQ ID NO: 547630 - RNA, 17 nt, Chlamydophila pneumoniae J138
cacucuuucagaaagaa

SEQ ID NO: 547631 - RNA, 13 nt, Chlamydophila pneumoniae J138
cacucuuucugua

SEQ ID NO: 547632 - RNA, 12 nt, Chlamydophila pneumoniae J138
cacucuuuucua

SEQ ID NO: 547633 - RNA, 22 nt, Chlamydophila pneumoniae J138
cacugaacgccaucuccacagc

SEQ ID NO: 547634 - RNA, 18 nt, Chlamydophila pneumoniae J138
cacugaacgccaucucca

SEQ ID NO: 547635 - RNA, 15 nt, Chlamydophila pneumoniae J138
cacugaacgccaucu

SEQ ID NO: 547636 - RNA, 20 nt, Chlamydophila pneumoniae J138
cacugaacgccaucuccaca

SEQ ID NO: 547637 - RNA, 18 nt, Chlamydophila pneumoniae J138
cacucgauuauuucuugu

SEQ ID NO: 547638 - RNA, 13 nt, Chlamydophila pneumoniae J138
cacugcgagagaa

SEQ ID NO: 547639 - RNA, 14 nt, Chlamydophila pneumoniae J138
cacugaugaaaaag

SEQ ID NO: 547640 - RNA, 18 nt, Chlamydophila pneumoniae J138
cacugaugaaaaagcuga

SEQ ID NO: 547641 - RNA, 20 nt, Chlamydophila pneumoniae J138
cacuggggcauaagaacucu

SEQ ID NO: 547642 - RNA, 18 nt, Chlamydophila pneumoniae J138
cacuguaucagcaagccc

SEQ ID NO: 547643 - RNA, 16 nt, Chlamydophila pneumoniae J138
cacuuaggguucucaa

SEQ ID NO: 547644 - RNA, 17 nt, Chlamydophila pneumoniae J138
cacuuacuucaagaaaa

SEQ ID NO: 547645 - RNA, 16 nt, Chlamydophila pneumoniae J138
cacuuaacccuauggu

SEQ ID NO: 547646 - RNA, 18 nt, Chlamydophila pneumoniae J138
cacuuaaagguaaaacua

SEQ ID NO: 547647 - RNA, 19 nt, Chlamydophila pneumoniae J138
cacuuaaaaaacuuccuaa

SEQ ID NO: 547648 - RNA, 18 nt, Chlamydophila pneumoniae J138
cacuguuuuccagaaauc

SEQ ID NO: 547649 - RNA, 15 nt, Chlamydophila pneumoniae J138
cacuguuuugcuucu

SEQ ID NO: 547650 - RNA, 18 nt, Chlamydophila pneumoniae J138
cacuugcgguuuuggaua

SEQ ID NO: 547651 - RNA, 22 nt, Chlamydophila pneumoniae J138
cacuucuuugccguauagauuu

SEQ ID NO: 547652 - RNA, 20 nt, Chlamydophila pneumoniae J138
cacuugcauggauccuucau

SEQ ID NO: 547653 - RNA, 17 nt, Chlamydophila pneumoniae J138
cacuucuuuaggagcau

SEQ ID NO: 547654 - RNA, 14 nt, Chlamydophila pneumoniae J138
cacuucagcacgaa

SEQ ID NO: 547655 - RNA, 20 nt, Chlamydophila pneumoniae J138
aaaauaucauucacuauugu

SEQ ID NO: 547656 - RNA, 22 nt, Chlamydophila pneumoniae J138
aaaauaucuccguuaccaaaaa

SEQ ID NO: 547657 - RNA, 13 nt, Chlamydophila pneumoniae J138
cacuuugaauaau

SEQ ID NO: 547658 - RNA, 15 nt, Chlamydophila pneumoniae J138
aaaauauucuuucaa

SEQ ID NO: 547659 - RNA, 15 nt, Chlamydophila pneumoniae J138
cacuuuguuuuucaa

SEQ ID NO: 547660 - RNA, 14 nt, Chlamydophila pneumoniae J138
cagaaaaaucuaac

SEQ ID NO: 547661 - RNA, 18 nt, Chlamydophila pneumoniae J138
cagaaagaaggucuucca

SEQ ID NO: 547662 - RNA, 16 nt, Chlamydophila pneumoniae J138
cagaaagagcuaaaga

SEQ ID NO: 547663 - RNA, 21 nt, Chlamydophila pneumoniae J138
cagaaagaaggucuuccaucu

SEQ ID NO: 547664 - RNA, 19 nt, Chlamydophila pneumoniae J138
cagaaacuggcggauugcu

SEQ ID NO: 547665 - RNA, 20 nt, Chlamydophila pneumoniae J138
cagaaaggcuuuucuuuuuc

SEQ ID NO: 547666 - RNA, 15 nt, Chlamydophila pneumoniae J138
cagaaaggcuuuucu

SEQ ID NO: 547667 - RNA, 13 nt, Chlamydophila pneumoniae J138
cagaacuucucca

SEQ ID NO: 547668 - RNA, 22 nt, Chlamydophila pneumoniae J138
cagaagguaaauuuuuaaaacu

SEQ ID NO: 547669 - RNA, 17 nt, Chlamydophila pneumoniae J138
cagaagugaucuugaga

SEQ ID NO: 547670 - RNA, 15 nt, Chlamydophila pneumoniae J138
cagaagguuccacag

SEQ ID NO: 547671 - RNA, 16 nt, Chlamydophila pneumoniae J138
cagaagucuuggacgu

SEQ ID NO: 547672 - RNA, 14 nt, Chlamydophila pneumoniae J138
cagaaguuccuacu

SEQ ID NO: 547673 - RNA, 14 nt, Chlamydophila pneumoniae J138
cagaauuuuaucag

SEQ ID NO: 547674 - RNA, 13 nt, Chlamydophila pneumoniae J138
cagaaucuccauu

SEQ ID NO: 547675 - RNA, 15 nt, Chlamydophila pneumoniae J138
cagaaucuaugagag

SEQ ID NO: 547676 - RNA, 21 nt, Chlamydophila pneumoniae J138
cagaauauagacuuguauucu

SEQ ID NO: 547677 - RNA, 18 nt, Chlamydophila pneumoniae J138
cagaaucauaaucugcgu

SEQ ID NO: 547678 - RNA, 20 nt, Chlamydophila pneumoniae J138
cagaauccugaguaaaauca

SEQ ID NO: 547679 - RNA, 14 nt, Chlamydophila pneumoniae J138
cagaaucccgugcu

SEQ ID NO: 547680 - RNA, 19 nt, Chlamydophila pneumoniae J138
cagaauccugaguaaaauc

SEQ ID NO: 547681 - RNA, 13 nt, Chlamydophila pneumoniae J138
cagaccuaaaaag

SEQ ID NO: 547682 - RNA, 19 nt, Chlamydophila pneumoniae J138
cagaccucucccuugggau

SEQ ID NO: 547683 - RNA, 14 nt, Chlamydophila pneumoniae J138
cagacugaagagca

SEQ ID NO: 547684 - RNA, 21 nt, Chlamydophila pneumoniae J138
cagaguacgugaucucacgaa

SEQ ID NO: 547685 - RNA, 20 nt, Chlamydophila pneumoniae J138
cagaggucgauuugaacaug

SEQ ID NO: 547686 - RNA, 16 nt, Chlamydophila pneumoniae J138
cagagguuagaaggga

SEQ ID NO: 547687 - RNA, 14 nt, Chlamydophila pneumoniae J138
cagauaaaaagaag

SEQ ID NO: 547688 - RNA, 17 nt, Chlamydophila pneumoniae J138
cagaguuuuaaacugcu

SEQ ID NO: 547689 - RNA, 15 nt, Chlamydophila pneumoniae J138
cagaguuuaaagcuu

SEQ ID NO: 547690 - RNA, 13 nt, Chlamydophila pneumoniae J138
cagagcgccucca

SEQ ID NO: 547691 - RNA, 14 nt, Chlamydophila pneumoniae J138
cagagcgccuccac

SEQ ID NO: 547692 - RNA, 18 nt, Chlamydophila pneumoniae J138
cagagauugccaggagag

SEQ ID NO: 547693 - RNA, 16 nt, Chlamydophila pneumoniae J138
cagagaugcuucuaaa

SEQ ID NO: 547694 - RNA, 22 nt, Chlamydophila pneumoniae J138
aaaaucacacuuucauccaaac

SEQ ID NO: 547695 - RNA, 15 nt, Chlamydophila pneumoniae J138
aaaaucaaucuugau

SEQ ID NO: 547696 - RNA, 18 nt, Chlamydophila pneumoniae J138
aaaaucaagccacagaga

SEQ ID NO: 547697 - RNA, 24 nt, Chlamydophila pneumoniae J138
aaaaucaagaagagaaaagauagu

SEQ ID NO: 547698 - RNA, 14 nt, Chlamydophila pneumoniae J138
cagagaaaaucaac

SEQ ID NO: 547699 - RNA, 16 nt, Chlamydophila pneumoniae J138
cagauaggguaagauu

SEQ ID NO: 547700 - RNA, 18 nt, Chlamydophila pneumoniae J138
aaaaucgacuaucugcuu

SEQ ID NO: 547701 - RNA, 19 nt, Chlamydophila pneumoniae J138
cagaucaaugccuugcguu

SEQ ID NO: 547702 - RNA, 20 nt, Chlamydophila pneumoniae J138
cagauaggauggaguacuuc

SEQ ID NO: 547703 - RNA, 21 nt, Chlamydophila pneumoniae J138
aaaauccaggacuucgcaaau

SEQ ID NO: 547704 - RNA, 18 nt, Chlamydophila pneumoniae J138
cagauagagcuucuuuau

SEQ ID NO: 547705 - RNA, 21 nt, Chlamydophila pneumoniae J138
cagauacguuucccccauaaa

SEQ ID NO: 547706 - RNA, 22 nt, Chlamydophila pneumoniae J138
cagauaaagcaaagauaaagaa

SEQ ID NO: 547707 - RNA, 17 nt, Chlamydophila pneumoniae J138
aaaaucuuauuugaguu

SEQ ID NO: 547708 - RNA, 18 nt, Chlamydophila pneumoniae J138
aaaaucuucuggagggag

SEQ ID NO: 547709 - RNA, 15 nt, Chlamydophila pneumoniae J138
cagauugcacuugcg

SEQ ID NO: 547710 - RNA, 17 nt, Chlamydophila pneumoniae J138
cagauugcacuugcggu

SEQ ID NO: 547711 - RNA, 20 nt, Chlamydophila pneumoniae J138
cagaucauaucggcagcagc

SEQ ID NO: 547712 - RNA, 20 nt, Chlamydophila pneumoniae J138
cagaucccgggaguuuucag

SEQ ID NO: 547713 - RNA, 11 nt, Chlamydophila pneumoniae J138
cagauccugcu

SEQ ID NO: 547714 - RNA, 23 nt, Chlamydophila pneumoniae J138
cagcaaagcgaccugcaaaugaa

SEQ ID NO: 547715 - RNA, 18 nt, Chlamydophila pneumoniae J138
cagcaaagacauccaagc

SEQ ID NO: 547716 - RNA, 21 nt, Chlamydophila pneumoniae J138
aaaaugaggacacaacucuuu

SEQ ID NO: 547717 - RNA, 14 nt, Chlamydophila pneumoniae J138
aaaaugauucauaa

SEQ ID NO: 547718 - RNA, 18 nt, Chlamydophila pneumoniae J138
aaaaugcacuuugaauaa

SEQ ID NO: 547719 - RNA, 19 nt, Chlamydophila pneumoniae J138
aaaaugcuccugcaaaaaa

SEQ ID NO: 547720 - RNA, 23 nt, Chlamydophila pneumoniae J138
aaaaugcuccugcaaaaaaccag

SEQ ID NO: 547721 - RNA, 20 nt, Chlamydophila pneumoniae J138
aaaaugcgaggaaaaaggag

SEQ ID NO: 547722 - RNA, 17 nt, Chlamydophila pneumoniae J138
aaaaugcccguccccuc

SEQ ID NO: 547723 - RNA, 21 nt, Chlamydophila pneumoniae J138
cagcaccuuuaggaagcugua

SEQ ID NO: 547724 - RNA, 20 nt, Chlamydophila pneumoniae J138
cagcaccuuuaggaagcugu

SEQ ID NO: 547725 - RNA, 22 nt, Chlamydophila pneumoniae J138
aaaauggugaagaauaauagca

SEQ ID NO: 547726 - RNA, 14 nt, Chlamydophila pneumoniae J138
cagcacucuuuuuc

SEQ ID NO: 547727 - RNA, 14 nt, Chlamydophila pneumoniae J138
cagcagcauuuucu

SEQ ID NO: 547728 - RNA, 13 nt, Chlamydophila pneumoniae J138
cagcagaugaaac

SEQ ID NO: 547729 - RNA, 14 nt, Chlamydophila pneumoniae J138
cagcguuucuaggg

SEQ ID NO: 547730 - RNA, 11 nt, Chlamydophila pneumoniae J138
cagcuucuuga

SEQ ID NO: 547731 - RNA, 21 nt, Chlamydophila pneumoniae J138
cagcuucucuaguuguaauuu

SEQ ID NO: 547732 - RNA, 15 nt, Chlamydophila pneumoniae J138
cagcuucuacagcau

SEQ ID NO: 547733 - RNA, 17 nt, Chlamydophila pneumoniae J138
cagcuucuauugcugua

SEQ ID NO: 547734 - RNA, 18 nt, Chlamydophila pneumoniae J138
cagcuggguaaguccaca

SEQ ID NO: 547735 - RNA, 16 nt, Chlamydophila pneumoniae J138
cagcuucgcaaucuuu

SEQ ID NO: 547736 - RNA, 20 nt, Chlamydophila pneumoniae J138
caggaaaacgcccucuagaa

SEQ ID NO: 547737 - RNA, 14 nt, Chlamydophila pneumoniae J138
caggaaaagcaaaa

SEQ ID NO: 547738 - RNA, 17 nt, Chlamydophila pneumoniae J138
cagcuuuagcuuuuacu

SEQ ID NO: 547739 - RNA, 18 nt, Chlamydophila pneumoniae J138
caggaaacguucuuucaa

SEQ ID NO: 547740 - RNA, 17 nt, Chlamydophila pneumoniae J138
caggaaagaauaggggu

SEQ ID NO: 547741 - RNA, 23 nt, Chlamydophila pneumoniae J138
caggaaauaauuuguuuagaaaa

SEQ ID NO: 547742 - RNA, 18 nt, Chlamydophila pneumoniae J138
caggaauucucaucggca

SEQ ID NO: 547743 - RNA, 15 nt, Chlamydophila pneumoniae J138
caggacaugccuuag

SEQ ID NO: 547744 - RNA, 20 nt, Chlamydophila pneumoniae J138
caggaccugugaguaaaaug

SEQ ID NO: 547745 - RNA, 17 nt, Chlamydophila pneumoniae J138
caggagcuagaagagcg

SEQ ID NO: 547746 - RNA, 15 nt, Chlamydophila pneumoniae J138
caggagcuccuccuu

SEQ ID NO: 547747 - RNA, 11 nt, Chlamydophila pneumoniae J138
caggaggcgcg

SEQ ID NO: 547748 - RNA, 20 nt, Chlamydophila pneumoniae J138
caggaggugguggagcuugu

SEQ ID NO: 547749 - RNA, 22 nt, Chlamydophila pneumoniae J138
caggaucccaaguaugguccau

SEQ ID NO: 547750 - RNA, 17 nt, Chlamydophila pneumoniae J138
caggaguuuuccuaaau

SEQ ID NO: 547751 - RNA, 22 nt, Chlamydophila pneumoniae J138
caggaguuccgcggccaucauu

SEQ ID NO: 547752 - RNA, 16 nt, Chlamydophila pneumoniae J138
caggaguucuugauuc

SEQ ID NO: 547753 - RNA, 19 nt, Chlamydophila pneumoniae J138
caggauuacggaaaauaca

SEQ ID NO: 547754 - RNA, 19 nt, Chlamydophila pneumoniae J138
caggauucuauaacuacaa

SEQ ID NO: 547755 - RNA, 18 nt, Chlamydophila pneumoniae J138
caggauucuaaaaagaaa

SEQ ID NO: 547756 - RNA, 13 nt, Chlamydophila pneumoniae J138
caggauuuuccau

SEQ ID NO: 547757 - RNA, 15 nt, Chlamydophila pneumoniae J138
caggauuuuccauua

SEQ ID NO: 547758 - RNA, 16 nt, Chlamydophila pneumoniae J138
aaacaaaagccauucc

SEQ ID NO: 547759 - RNA, 23 nt, Chlamydophila pneumoniae J138
caggggaugugauguucugcugc

SEQ ID NO: 547760 - RNA, 22 nt, Chlamydophila pneumoniae J138
caggguuucucggauccuccaa

SEQ ID NO: 547761 - RNA, 14 nt, Chlamydophila pneumoniae J138
cagguaaacaacaa

SEQ ID NO: 547762 - RNA, 19 nt, Chlamydophila pneumoniae J138
cagguagagugucuuccuu

SEQ ID NO: 547763 - RNA, 21 nt, Chlamydophila pneumoniae J138
cagguagauccuauaguaauu

SEQ ID NO: 547764 - RNA, 14 nt, Chlamydophila pneumoniae J138
cagguaguaggaca

SEQ ID NO: 547765 - RNA, 21 nt, Chlamydophila pneumoniae J138
cagguaagggaugcucuagaa

SEQ ID NO: 547766 - RNA, 14 nt, Chlamydophila pneumoniae J138
caggcuacauaguu

SEQ ID NO: 547767 - RNA, 20 nt, Chlamydophila pneumoniae J138
cagccuugauugaacagucu

SEQ ID NO: 547768 - RNA, 22 nt, Chlamydophila pneumoniae J138
cagccugugagcucucgacgaa

SEQ ID NO: 547769 - RNA, 11 nt, Chlamydophila pneumoniae J138
cagccagcaga

SEQ ID NO: 547770 - RNA, 20 nt, Chlamydophila pneumoniae J138
aaaauuaaagugaaagcaac

SEQ ID NO: 547771 - RNA, 16 nt, Chlamydophila pneumoniae J138
aaaauuaagaacccga

SEQ ID NO: 547772 - RNA, 20 nt, Chlamydophila pneumoniae J138
aaaauuaagaacccgauaca

SEQ ID NO: 547773 - RNA, 19 nt, Chlamydophila pneumoniae J138
aaaauuaucuccaaagauc

SEQ ID NO: 547774 - RNA, 20 nt, Chlamydophila pneumoniae J138
aaaauucaaaucccugaugc

SEQ ID NO: 547775 - RNA, 13 nt, Chlamydophila pneumoniae J138
cagcguauaggaa

SEQ ID NO: 547776 - RNA, 18 nt, Chlamydophila pneumoniae J138
cagcguagguuugcugcu

SEQ ID NO: 547777 - RNA, 19 nt, Chlamydophila pneumoniae J138
cagcgguugccuuucucuu

SEQ ID NO: 547778 - RNA, 22 nt, Chlamydophila pneumoniae J138
cagcgugaauaucaucacuaag

SEQ ID NO: 547779 - RNA, 15 nt, Chlamydophila pneumoniae J138
aaaauucaugcaaaa

SEQ ID NO: 547780 - RNA, 17 nt, Chlamydophila pneumoniae J138
aaaauucaugcaaaaca

SEQ ID NO: 547781 - RNA, 17 nt, Chlamydophila pneumoniae J138
aaaauucuguaaaguga

SEQ ID NO: 547782 - RNA, 18 nt, Chlamydophila pneumoniae J138
aaaauucuucgagagcau

SEQ ID NO: 547783 - RNA, 23 nt, Chlamydophila pneumoniae J138
aaaauucgaauucucagaaagcc

SEQ ID NO: 547784 - RNA, 22 nt, Human
uuaagaaucuuuauaguucuac

SEQ ID NO: 547785 - RNA, 17 nt, Human
ugagaugcuagaacucc

SEQ ID NO: 547786 - RNA, 23 nt, Human
uaaaauggugugaccacugcaga

SEQ ID NO: 547787 - RNA, 13 nt, Human
guucuauaacaac

SEQ ID NO: 547788 - RNA, 18 nt, Human
ccucuggcuccagcuggc

SEQ ID NO: 547789 - RNA, 13 nt, Human
cuacuuccccuuc

SEQ ID NO: 547790 - RNA, 14 nt, Human
gagcucagcccugg

SEQ ID NO: 547791 - RNA, 20 nt, Human
gcccagcuugaaaccuucac

SEQ ID NO: 547792 - RNA, 16 nt, Human
gccccgucccccucug

SEQ ID NO: 547793 - RNA, 19 nt, Human
gccccgucccccucuggcu

SEQ ID NO: 547794 - RNA, 18 nt, Human
aaccauuuuuacuugggu

SEQ ID NO: 547795 - RNA, 22 nt, Human
aacagugauuaccagggacuga

SEQ ID NO: 547796 - RNA, 16 nt, Human
aacacaugauccugca

SEQ ID NO: 547797 - RNA, 19 nt, Human
aagcagggacuugaaccca

SEQ ID NO: 547798 - RNA, 22 nt, Human
aagcucuaucaccaaggagcca

SEQ ID NO: 547799 - RNA, 12 nt, Human
accuuacuucuu

SEQ ID NO: 547800 - RNA, 22 nt, Human
acgaugggcuuucccaacagcu

SEQ ID NO: 547801 - RNA, 14 nt, Human
agcaagauaauaaa

SEQ ID NO: 547802 - RNA, 21 nt, Human
acuugaacccgggaggcagag

SEQ ID NO: 547803 - RNA, 12 nt, Human
acuucagacaua

SEQ ID NO: 547804 - RNA, 17 nt, Human
agugagacucugucuca

SEQ ID NO: 547805 - RNA, 17 nt, Human
auccccaagccuggcaa

SEQ ID NO: 547806 - RNA, 16 nt, Human
caggaaguagaggagg

SEQ ID NO: 547807 - RNA, 19 nt, Human
ccuaacgaaguauccuuca

SEQ ID NO: 547808 - RNA, 20 nt, Human
ccaugaagauguagaggaga

SEQ ID NO: 547809 - RNA, 14 nt, Human
ccccagcccuccuu

SEQ ID NO: 547810 - RNA, 17 nt, Human
cuaauuccacagcugcu

SEQ ID NO: 547811 - RNA, 21 nt, Human
gagccugaucaccugcccugc

SEQ ID NO: 547812 - RNA, 13 nt, Human
gagcuugcagaga

SEQ ID NO: 547813 - RNA, 14 nt, Human
gacacuuaaaaaug

SEQ ID NO: 547814 - RNA, 15 nt, Human
gcuggccgggagccu

SEQ ID NO: 547815 - RNA, 12 nt, Human
gcccugcugagu

SEQ ID NO: 547816 - RNA, 22 nt, Human
uauuuuaaucaccaaggcugau

SEQ ID NO: 547817 - RNA, 15 nt, Human
uccaccuuacuucuu

SEQ ID NO: 547818 - RNA, 22 nt, Human
uaagaagugaaaaucuacacuc

SEQ ID NO: 547819 - RNA, 18 nt, Human
ggagccugaucaccugcc

SEQ ID NO: 547820 - RNA, 21 nt, Human
uggccuucggccuccauccug

SEQ ID NO: 547821 - RNA, 15 nt, Human
uccccuauccuacuu

SEQ ID NO: 547822 - RNA, 20 nt, Human
ugagacagcucugcauacuc

SEQ ID NO: 547823 - RNA, 21 nt, Human
uggucugugagaugcuagaac

SEQ ID NO: 547824 - RNA, 15 nt, Human
gguauuuuaaucacc

SEQ ID NO: 547825 - RNA, 16 nt, Human
gucucuacuaaaaaua

SEQ ID NO: 547826 - RNA, 15 nt, Human
gugccuguaaucaca

SEQ ID NO: 547827 - RNA, 19 nt, Human
aaagaucugcaacuacuau

SEQ ID NO: 547828 - RNA, 16 nt, Human
acacagauuugagcuc

SEQ ID NO: 547829 - RNA, 17 nt, Human
acagcuccaccuuacuu

SEQ ID NO: 547830 - RNA, 20 nt, Human
acagcuacuugggaggcuga

SEQ ID NO: 547831 - RNA, 14 nt, Human
acaacacacagauu

SEQ ID NO: 547832 - RNA, 12 nt, Human
acaacaaaagcg

SEQ ID NO: 547833 - RNA, 15 nt, Human
acccaaaaggcagaa

SEQ ID NO: 547834 - RNA, 13 nt, Human
accccugagcuug

SEQ ID NO: 547835 - RNA, 15 nt, Human
aaucacuugaacccg

SEQ ID NO: 547836 - RNA, 18 nt, Human
acauccuacaagacacag

SEQ ID NO: 547837 - RNA, 14 nt, Human
agccuggcaaggga

SEQ ID NO: 547838 - RNA, 18 nt, Human
aggcauuuaggccauggg

SEQ ID NO: 547839 - RNA, 15 nt, Human
aucuuuauaguucua

SEQ ID NO: 547840 - RNA, 16 nt, Human
cacuccagugagacag

SEQ ID NO: 547841 - RNA, 20 nt, Human
cacuccagccugagcgacag

SEQ ID NO: 547842 - RNA, 19 nt, Human
gcaauguaagacucgggau

SEQ ID NO: 547843 - RNA, 11 nt, Human
agccagacauc

SEQ ID NO: 547844 - RNA, 14 nt, Human
gaaacccugucucu

SEQ ID NO: 547845 - RNA, 21 nt, Human
ggcuccacuuggucugugaga

SEQ ID NO: 547846 - RNA, 20 nt, Human
ucugugagaugcuagaacuc

SEQ ID NO: 547847 - RNA, 17 nt, Human
uacagagacagaaagca

SEQ ID NO: 547848 - RNA, 13 nt, Human
ucaaaacuucaga

SEQ ID NO: 547849 - RNA, 18 nt, Human
ugcaugguuuagaaagcu

SEQ ID NO: 547850 - RNA, 19 nt, Human
agcccuccuuaucaaagga

SEQ ID NO: 547851 - RNA, 12 nt, Human
agcuacuuggga

SEQ ID NO: 547852 - RNA, 18 nt, Human
agcucugcccauccugcc

SEQ ID NO: 547853 - RNA, 14 nt, Human
agcuugcagagaug

SEQ ID NO: 547854 - RNA, 13 nt, Human
auuaaagaucugc

SEQ ID NO: 547855 - RNA, 18 nt, Human
augagguacugagaguga

SEQ ID NO: 547856 - RNA, 21 nt, Human
auccaacuuauauuucugcuu

SEQ ID NO: 547857 - RNA, 17 nt, Human
auuccacagcugcucaa

SEQ ID NO: 547858 - RNA, 17 nt, Human
caaauuuacagagacag

SEQ ID NO: 547859 - RNA, 17 nt, Human
cacagauuugagcucag

SEQ ID NO: 547860 - RNA, 12 nt, Human
cccaaauguuca

SEQ ID NO: 547861 - RNA, 15 nt, Human
caggaaguagaggag

SEQ ID NO: 547862 - RNA, 15 nt, Human
ugagcucagcccugg

SEQ ID NO: 547863 - RNA, 18 nt, Human
uucaauaucuuuuuuuua

SEQ ID NO: 547864 - RNA, 14 nt, Human
cuguaaucacagcu

SEQ ID NO: 547865 - RNA, 17 nt, Human
ccucuggcuccagcugg

SEQ ID NO: 547866 - RNA, 18 nt, Human
aucuacacuccagugaga

SEQ ID NO: 547867 - RNA, 17 nt, Human
uccauccugaggcucca

SEQ ID NO: 547868 - RNA, 17 nt, Human
caagaaaugaaagcagg

SEQ ID NO: 547869 - RNA, 23 nt, Human
acaacaaaagcgauuauuauuuu

SEQ ID NO: 547870 - RNA, 23 nt, Human
cagagguugcagugagccgagau

SEQ ID NO: 547871 - RNA, 23 nt, Human
gaaaaaguucugcagauaaacag

SEQ ID NO: 547872 - RNA, 21 nt, Human
ccuggugccucaccccuugcc

SEQ ID NO: 547873 - RNA, 21 nt, Human
cucuucuggguuccuuccucu

SEQ ID NO: 547874 - RNA, 15 nt, Human
auauuuuuuguuaaa

SEQ ID NO: 547875 - RNA, 12 nt, Human
aaaugaaagcag

SEQ ID NO: 547876 - RNA, 22 nt, Human
uugacccacaagaaaugaaagc

SEQ ID NO: 547877 - RNA, 13 nt, Human
agacacagugacc

SEQ ID NO: 547878 - RNA, 15 nt, Human
ggccuucggccucca

SEQ ID NO: 547879 - RNA, 15 nt, Human
gagaugcuagaacuc

SEQ ID NO: 547880 - RNA, 21 nt, Human
cuauguucuaagaagugaaaa

SEQ ID NO: 547881 - RNA, 17 nt, Human
guugcugggggggauug

SEQ ID NO: 547882 - RNA, 19 nt, Human
guacugagagugaacaaau

SEQ ID NO: 547883 - RNA, 19 nt, Human
aauuuuguuauguauauuu

SEQ ID NO: 547884 - RNA, 21 nt, Human
uccuacaagacacagugacca

SEQ ID NO: 547885 - RNA, 20 nt, Human
ugccccccagcccuccuuau

SEQ ID NO: 547886 - RNA, 16 nt, Human
ugccucaccccuugcc

SEQ ID NO: 547887 - RNA, 19 nt, Human
accauuuuggcaagcucua

SEQ ID NO: 547888 - RNA, 18 nt, Human
acuggacucaccuccccc

SEQ ID NO: 547889 - RNA, 14 nt, Human
agagacagaaagca

SEQ ID NO: 547890 - RNA, 17 nt, Human
caaaagcgauuauuauu

SEQ ID NO: 547891 - RNA, 22 nt, Human
auggaaauguuuacagaucccc

SEQ ID NO: 547892 - RNA, 14 nt, Human
cucccucccuuggg

SEQ ID NO: 547893 - RNA, 18 nt, Human
aaagaaaaucaggcuggc

SEQ ID NO: 547894 - RNA, 15 nt, Human
cuaagugcagccccg

SEQ ID NO: 547895 - RNA, 18 nt, Human
gccccgucccccucuggc

SEQ ID NO: 547896 - RNA, 21 nt, Human
ugggaggcugagaugggagaa

SEQ ID NO: 547897 - RNA, 19 nt, Human
agaugcuagaacucccuuu

SEQ ID NO: 547898 - RNA, 19 nt, Human
gagccugaucaccugcccu

SEQ ID NO: 547899 - RNA, 16 nt, Human
aaauaguuuaugauuc

SEQ ID NO: 547900 - RNA, 15 nt, Human
acauccuacaagaca

SEQ ID NO: 547901 - RNA, 15 nt, Human
cuaucuuugagcgcc

SEQ ID NO: 547902 - RNA, 16 nt, Human
cuucuggguuccuucc

SEQ ID NO: 547903 - RNA, 12 nt, Human
acucccugcccc

SEQ ID NO: 547904 - RNA, 15 nt, Human
cuggguuccuuccuc

SEQ ID NO: 547905 - RNA, 18 nt, Human
ucuucucauacuauuuaa

SEQ ID NO: 547906 - RNA, 17 nt, Human
cuuccuaauuccacagc

SEQ ID NO: 547907 - RNA, 22 nt, Human
augcagagguccacaacacaca

SEQ ID NO: 547908 - RNA, 12 nt, Human
agggauggggcu

SEQ ID NO: 547909 - RNA, 20 nt, Human
guucugcagauaaacaguag

SEQ ID NO: 547910 - RNA, 19 nt, Human
ccccugcaaagcccagcuu

SEQ ID NO: 547911 - RNA, 23 nt, Human
gggccuaugcagagguccacaac

SEQ ID NO: 547912 - RNA, 13 nt, Human
auccugaggcucc

SEQ ID NO: 547913 - RNA, 22 nt, Human
aauugacccacaagaaaugaaa

SEQ ID NO: 547914 - RNA, 20 nt, Human
acuaaauugacacuuaaaaa

SEQ ID NO: 547915 - RNA, 14 nt, Human
ccccugagcuugca

SEQ ID NO: 547916 - RNA, 16 nt, Human
cuacacuccagugaga

SEQ ID NO: 547917 - RNA, 20 nt, Human
cagcuggccgggagccugau

SEQ ID NO: 547918 - RNA, 14 nt, Human
uggacucaccuccc

SEQ ID NO: 547919 - RNA, 16 nt, Human
ggccuccauccugagg

SEQ ID NO: 547920 - RNA, 13 nt, Human
cucaccuccccca

SEQ ID NO: 547921 - RNA, 23 nt, Human
gaccccugagcuugcagagauga

SEQ ID NO: 547922 - RNA, 20 nt, Human
gagccucagucucccucccu

SEQ ID NO: 547923 - RNA, 18 nt, Human
cccacuagacccacugga

SEQ ID NO: 547924 - RNA, 17 nt, Human
uuauaucaauuuaaaaa

SEQ ID NO: 547925 - RNA, 19 nt, Human
ugaucaccugcccugcuga

SEQ ID NO: 547926 - RNA, 15 nt, Human
aagcaagauaauaaa

SEQ ID NO: 547927 - RNA, 13 nt, Human
agcccagcuugaa

SEQ ID NO: 547928 - RNA, 21 nt, Human
aaucaccaaggcugauuaaac

SEQ ID NO: 547929 - RNA, 16 nt, Human
caggaaguagaggagg

SEQ ID NO: 547930 - RNA, 23 nt, Human
uauaguucuacuccauuaaauau

SEQ ID NO: 547931 - RNA, 13 nt, Human
cuuaucaaaggac

SEQ ID NO: 547932 - RNA, 17 nt, Human
aagaaucuuuauaguuc

SEQ ID NO: 547933 - RNA, 13 nt, Human
acacuuaaaaaug

SEQ ID NO: 547934 - RNA, 16 nt, Human
cucaauaaaguacaag

SEQ ID NO: 547935 - RNA, 22 nt, Human
ggcagcuuuccucaaaacuuca

SEQ ID NO: 547936 - RNA, 16 nt, Human
gugagacagcucugca

SEQ ID NO: 547937 - RNA, 20 nt, Human
cccuuccuaauuccacagcu

SEQ ID NO: 547938 - RNA, 15 nt, Human
auccugccccugagc

SEQ ID NO: 547939 - RNA, 15 nt, Human
augggacagggagga

SEQ ID NO: 547940 - RNA, 14 nt, Human
acaagagcuuaaca

SEQ ID NO: 547941 - RNA, 14 nt, Human
cugagucccaggcu

SEQ ID NO: 547942 - RNA, 22 nt, Human
caaauuuacagagacagaaagc

SEQ ID NO: 547943 - RNA, 12 nt, Human
cccccagcccuc

SEQ ID NO: 547944 - RNA, 12 nt, Human
acacuuaaaaau

SEQ ID NO: 547945 - RNA, 22 nt, Human
cagcccuggugggcagagaggu

SEQ ID NO: 547946 - RNA, 14 nt, Human
uccacuuggucugu

SEQ ID NO: 547947 - RNA, 21 nt, Human
ucuucaacucccugcccccca

SEQ ID NO: 547948 - RNA, 23 nt, Human
cauuguggucacaggaaguagag

SEQ ID NO: 547949 - RNA, 15 nt, Human
accaaggcugauuaa

SEQ ID NO: 547950 - RNA, 17 nt, Human
agcucugcccauccugc

SEQ ID NO: 547951 - RNA, 14 nt, Human
ggaaguagaggagg

SEQ ID NO: 547952 - RNA, 18 nt, Human
cucuggccuucggccucc

SEQ ID NO: 547953 - RNA, 23 nt, Human
aauuuucauuguucuauaacaac

SEQ ID NO: 547954 - RNA, 15 nt, Human
aagccuggcaaggga

SEQ ID NO: 547955 - RNA, 17 nt, Human
gcaugguuuagaaagcu

SEQ ID NO: 547956 - RNA, 13 nt, Human
agccucagucucc

SEQ ID NO: 547957 - RNA, 20 nt, Human
ccauuguggucacaggaagu

SEQ ID NO: 547958 - RNA, 22 nt, Human
cuccugccuaagugcagccccg

SEQ ID NO: 547959 - RNA, 19 nt, Human
cugagccucagucucccuc

SEQ ID NO: 547960 - RNA, 18 nt, Human
acuuuaugcuaagugaaa

SEQ ID NO: 547961 - RNA, 19 nt, Human
caacaaaagcgauuauuau

SEQ ID NO: 547962 - RNA, 17 nt, Human
ccaaaagguauuuuaau

SEQ ID NO: 547963 - RNA, 19 nt, Human
caacuuauauuucugcuuu

SEQ ID NO: 547964 - RNA, 22 nt, Human
cucagcccuggugggcagagag

SEQ ID NO: 547965 - RNA, 15 nt, Human
uccaagccucauguc

SEQ ID NO: 547966 - RNA, 23 nt, Human
auaucuuuuuuuuaauaaaccau

SEQ ID NO: 547967 - RNA, 15 nt, Human
cucccuuggggccua

SEQ ID NO: 547968 - RNA, 14 nt, Human
uugacccacaagaa

SEQ ID NO: 547969 - RNA, 17 nt, Human
acucaccucccccaucu

SEQ ID NO: 547970 - RNA, 11 nt, Human
augggacaggg

SEQ ID NO: 547971 - RNA, 21 nt, Human
augucauuugcuggagcucug

SEQ ID NO: 547972 - RNA, 21 nt, Human
agucucccucccuuggggccu

SEQ ID NO: 547973 - RNA, 20 nt, Human
gagccugaucaccugcccug

SEQ ID NO: 547974 - RNA, 20 nt, Human
caaauguucaucaaugaaug

SEQ ID NO: 547975 - RNA, 16 nt, Human
ccugaucaccugcccu

SEQ ID NO: 547976 - RNA, 23 nt, Human
gcccuggugccucaccccuugcc

SEQ ID NO: 547977 - RNA, 17 nt, Human
cuuccucugagccuugg

SEQ ID NO: 547978 - RNA, 20 nt, Human
uuaagagaacaagcaaauau

SEQ ID NO: 547979 - RNA, 17 nt, Human
augccccgucccccucu

SEQ ID NO: 547980 - RNA, 19 nt, Human
auuucuucaacucccugcc

SEQ ID NO: 547981 - RNA, 20 nt, Human
aaggagccaaacauccuaca

SEQ ID NO: 547982 - RNA, 17 nt, Human
uggcuaagcaaaaugug

SEQ ID NO: 547983 - RNA, 14 nt, Human
uccauuaaauauaa

SEQ ID NO: 547984 - RNA, 20 nt, Human
aauaucuuuuuuuuaauaaa

SEQ ID NO: 547985 - RNA, 22 nt, Human
acauccuacaagacacagugac

SEQ ID NO: 547986 - RNA, 20 nt, Human
guuccuuccucugagccuug

SEQ ID NO: 547987 - RNA, 18 nt, Human
ccuugggaccccugagcu

SEQ ID NO: 547988 - RNA, 17 nt, Human
ucgggauuaguacacac

SEQ ID NO: 547989 - RNA, 14 nt, Human
agaugcuagaacuc

SEQ ID NO: 547990 - RNA, 20 nt, Human
ccccuauccuacuuccccuu

SEQ ID NO: 547991 - RNA, 16 nt, Human
agagaacaagcaaaua

SEQ ID NO: 547992 - RNA, 16 nt, Human
cagaagcaacccaaau

SEQ ID NO: 547993 - RNA, 16 nt, Human
uccugcaauuccacuu

SEQ ID NO: 547994 - RNA, 13 nt, Human
agcgacagugaga

SEQ ID NO: 547995 - RNA, 12 nt, Human
caacccaaaugu

SEQ ID NO: 547996 - RNA, 13 nt, Human
cccaaaaggcaga

SEQ ID NO: 547997 - RNA, 15 nt, Human
ccgucccccucuggc

SEQ ID NO: 547998 - RNA, 13 nt, Human
ccaaggaugcccc

SEQ ID NO: 547999 - RNA, 16 nt, Human
cuccauccugaggcuc

SEQ ID NO: 548000 - RNA, 17 nt, Human
auaucaauuuaaaaaaa

SEQ ID NO: 548001 - RNA, 21 nt, Human
uguaaaauggugugaccacug

SEQ ID NO: 548002 - RNA, 15 nt, Human
ucagucucccucccu

SEQ ID NO: 548003 - RNA, 15 nt, Human
auaucaauuuaaaaa

SEQ ID NO: 548004 - RNA, 16 nt, Human
ccucaaaacuucagac

SEQ ID NO: 548005 - RNA, 20 nt, Human
acuccagugagacagcucug

SEQ ID NO: 548006 - RNA, 16 nt, Human
ucuucaacucccugcc

SEQ ID NO: 548007 - RNA, 21 nt, Human
uuccuaauuccacagcugcuc

SEQ ID NO: 548008 - RNA, 17 nt, Human
cugaucaccugcccugc

SEQ ID NO: 548009 - RNA, 13 nt, Human
aaauauaaagcaa

SEQ ID NO: 548010 - RNA, 22 nt, Human
gaauuucuucaacucccugccc

SEQ ID NO: 548011 - RNA, 15 nt, Human
uccauccugaggcuc

SEQ ID NO: 548012 - RNA, 14 nt, Human
cuggagcucugccc

SEQ ID NO: 548013 - RNA, 23 nt, Human
acguaaucguguccccuauccua

SEQ ID NO: 548014 - RNA, 13 nt, Human
uaagugcagcccc

SEQ ID NO: 548015 - RNA, 13 nt, Human
caagcaaauauaa

SEQ ID NO: 548016 - RNA, 18 nt, Human
ugaaaaaguucugcagau

SEQ ID NO: 548017 - RNA, 21 nt, Human
agcaaauauaaacagcaacuu

SEQ ID NO: 548018 - RNA, 14 nt, Human
aauugaaaauggua

SEQ ID NO: 548019 - RNA, 17 nt, Human
aaauguucaucaaugaa

SEQ ID NO: 548020 - RNA, 13 nt, Human
cugagagugaaca

SEQ ID NO: 548021 - RNA, 19 nt, Human
ccaccugccuauauuuuuu

SEQ ID NO: 548022 - RNA, 19 nt, Human
cuaguaucaaaagaaagaa

SEQ ID NO: 548023 - RNA, 22 nt, Human
cuuccuaauuccacagcugcuc

SEQ ID NO: 548024 - RNA, 19 nt, Human
cccugccccccagcccucc

SEQ ID NO: 548025 - RNA, 16 nt, Human
cuucaacucccugccc

SEQ ID NO: 548026 - RNA, 16 nt, Human
gucuaucuuugagcgc

SEQ ID NO: 548027 - RNA, 20 nt, Human
acaagacccaaaaggcagaa

SEQ ID NO: 548028 - RNA, 20 nt, Human
ucuucuggguuccuuccucu

SEQ ID NO: 548029 - RNA, 23 nt, Human
agccuugggaccccugagcuugc

SEQ ID NO: 548030 - RNA, 22 nt, Human
ccucccuuggggccuaugcaga

SEQ ID NO: 548031 - RNA, 15 nt, Human
ccaaggagccaaaca

SEQ ID NO: 548032 - RNA, 13 nt, Human
ccccagcccuccu

SEQ ID NO: 548033 - RNA, 17 nt, Human
ccaacuuauauuucugc

SEQ ID NO: 548034 - RNA, 21 nt, Human
ccucccuuggggccuaugcag

SEQ ID NO: 548035 - RNA, 17 nt, Human
aaaguacaagagcuuaa

SEQ ID NO: 548036 - RNA, 16 nt, Human
cuagaacucccuuuca

SEQ ID NO: 548037 - RNA, 17 nt, Human
agguccacaacacacag

SEQ ID NO: 548038 - RNA, 12 nt, Human
cuacaagacaca

SEQ ID NO: 548039 - RNA, 11 nt, Human
gcaugguuuag

SEQ ID NO: 548040 - RNA, 11 nt, Human
ucaccugcccu

SEQ ID NO: 548041 - RNA, 22 nt, Human
acaagcaaauauaaacagcaac

SEQ ID NO: 548042 - RNA, 15 nt, Human
cugaaagaggaauga

SEQ ID NO: 548043 - RNA, 20 nt, Human
caagcucuaucaccaaggag

SEQ ID NO: 548044 - RNA, 19 nt, Human
aauguuuacagauccccaa

SEQ ID NO: 548045 - RNA, 15 nt, Human
cacuuggucugugag

SEQ ID NO: 548046 - RNA, 20 nt, Human
cugcacuccagccugagcga

SEQ ID NO: 548047 - RNA, 11 nt, Human
ugcagugagcc

SEQ ID NO: 548048 - RNA, 17 nt, Human
ucucuggccuucggccu

SEQ ID NO: 548049 - RNA, 13 nt, Human
ucuaagaagugaa

SEQ ID NO: 548050 - RNA, 15 nt, Human
ugcagauaaacagua

SEQ ID NO: 548051 - RNA, 21 nt, Human
cacuugaacccgggaggcaga

SEQ ID NO: 548052 - RNA, 18 nt, Human
ugagcucagcccuggugg

SEQ ID NO: 548053 - RNA, 15 nt, Human
ugccccccagcccuc

SEQ ID NO: 548054 - RNA, 14 nt, Human
ccaugggacaggga

SEQ ID NO: 548055 - RNA, 23 nt, Human
agcucugcccauccugccccuga

SEQ ID NO: 548056 - RNA, 19 nt, Human
gaggcagagguugcaguga

SEQ ID NO: 548057 - RNA, 14 nt, Human
ugaagauguagagg

SEQ ID NO: 548058 - RNA, 16 nt, Human
guucugcacacagcac

SEQ ID NO: 548059 - RNA, 15 nt, Human
cuucaacucccugcc

SEQ ID NO: 548060 - RNA, 23 nt, Human
cuucaacucccugccccccagcc

SEQ ID NO: 548061 - RNA, 12 nt, Human
ccaggcugagcc

SEQ ID NO: 548062 - RNA, 23 nt, Human
caccaaggagccaaacauccuac

SEQ ID NO: 548063 - RNA, 15 nt, Human
cuugaaaacuuuaug

SEQ ID NO: 548064 - RNA, 17 nt, Human
agaugggagaaucacuu

SEQ ID NO: 548065 - RNA, 17 nt, Human
gccuaagugcagccccg

SEQ ID NO: 548066 - RNA, 21 nt, Human
aaugaauggcuaagcaaaaug

SEQ ID NO: 548067 - RNA, 19 nt, Human
augcagagguccacaacac

SEQ ID NO: 548068 - RNA, 19 nt, Human
caaauauaaacagcaacuu

SEQ ID NO: 548069 - RNA, 19 nt, Human
uacaaaaaaaaaaaaaaau

SEQ ID NO: 548070 - RNA, 20 nt, Human
gaacguaaucguguccccua

SEQ ID NO: 548071 - RNA, 22 nt, Human
ugucucuacuaaaaauacaaaa

SEQ ID NO: 548072 - RNA, 20 nt, Human
ugagcgcccacuagacccac

SEQ ID NO: 548073 - RNA, 21 nt, Human
gggagccugaucaccugcccu

SEQ ID NO: 548074 - RNA, 16 nt, Human
ggaugccccguccccc

SEQ ID NO: 548075 - RNA, 23 nt, Human
gaggcauuuaggccaugggacag

SEQ ID NO: 548076 - RNA, 23 nt, Human
cacagauuugagcucagcccugg

SEQ ID NO: 548077 - RNA, 16 nt, Human
gccucagucucccucc

SEQ ID NO: 548078 - RNA, 21 nt, Human
aucuuuuuuuuaauaaaccau

SEQ ID NO: 548079 - RNA, 12 nt, Human
ggaggcugagau

SEQ ID NO: 548080 - RNA, 20 nt, Human
guccccuauccuacuucccc

SEQ ID NO: 548081 - RNA, 18 nt, Human
aagggaauuucuucaacu

SEQ ID NO: 548082 - RNA, 18 nt, Human
uaaauugacacuuaaaaa

SEQ ID NO: 548083 - RNA, 18 nt, Human
auuuaggccaugggacag

SEQ ID NO: 548084 - RNA, 17 nt, Human
ccugccccccagcccuc

SEQ ID NO: 548085 - RNA, 20 nt, Human
uccuaacaggaauuuucauu

SEQ ID NO: 548086 - RNA, 15 nt, Human
uguuaaaugauuuca

SEQ ID NO: 548087 - RNA, 19 nt, Human
aaugaauggcuaagcaaaa

SEQ ID NO: 548088 - RNA, 19 nt, Human
uucauuguucuauaacaac

SEQ ID NO: 548089 - RNA, 17 nt, Human
uuaaauggucaauuuug

SEQ ID NO: 548090 - RNA, 22 nt, Human
cugaggcuccacuuggucugug

SEQ ID NO: 548091 - RNA, 21 nt, Human
cgaaguauccuucagccugaa

SEQ ID NO: 548092 - RNA, 22 nt, Human
agacucgggauuaguacacacu

SEQ ID NO: 548093 - RNA, 22 nt, Human
gcagagagguagggauggggcu

SEQ ID NO: 548094 - RNA, 14 nt, Human
ucagucucccuccc

SEQ ID NO: 548095 - RNA, 21 nt, Human
ugcccauccugccccugagcc

SEQ ID NO: 548096 - RNA, 20 nt, Human
cacuagacccacuggacuca

SEQ ID NO: 548097 - RNA, 13 nt, Human
ccagcccuccuua

SEQ ID NO: 548098 - RNA, 15 nt, Human
accucccccaucucu

SEQ ID NO: 548099 - RNA, 15 nt, Human
ugagcgcccacuaga

SEQ ID NO: 548100 - RNA, 18 nt, Human
aaacagcaacuuguguuc

SEQ ID NO: 548101 - RNA, 15 nt, Human
gcagagguugcagug

SEQ ID NO: 548102 - RNA, 18 nt, Human
gagccucagucucccucc

SEQ ID NO: 548103 - RNA, 20 nt, Human
cugcacacagcacgggggcc

SEQ ID NO: 548104 - RNA, 20 nt, Human
ccagcuggccgggagccuga

SEQ ID NO: 548105 - RNA, 20 nt, Human
gaccauacuaauuauacccc

SEQ ID NO: 548106 - RNA, 12 nt, Human
cagaacagugau

SEQ ID NO: 548107 - RNA, 14 nt, Human
ucaaugcagccccc

SEQ ID NO: 548108 - RNA, 14 nt, Human
aaaagaaagaaaau

SEQ ID NO: 548109 - RNA, 17 nt, Human
gccugagcgacagugag

SEQ ID NO: 548110 - RNA, 23 nt, Human
cacuggacucaccucccccaucu

SEQ ID NO: 548111 - RNA, 18 nt, Human
ugugaccacugcagaaga

SEQ ID NO: 548112 - RNA, 18 nt, Human
gagucccaggcugagccu

SEQ ID NO: 548113 - RNA, 22 nt, Human
aagacccaaaaggcagaagcaa

SEQ ID NO: 548114 - RNA, 18 nt, Human
gccugagcgacagugaga

SEQ ID NO: 548115 - RNA, 16 nt, Human
uugccauaauuacuau

SEQ ID NO: 548116 - RNA, 18 nt, Human
cucuauguucuaagaagu

SEQ ID NO: 548117 - RNA, 18 nt, Human
agguccacaacacacaga

SEQ ID NO: 548118 - RNA, 14 nt, Human
acuacuauccaacu

SEQ ID NO: 548119 - RNA, 18 nt, Human
cugagucccaggcugagc

SEQ ID NO: 548120 - RNA, 23 nt, Human
cucagucucccucccuuggggcc

SEQ ID NO: 548121 - RNA, 18 nt, Human
aaaaguucugcagauaaa

SEQ ID NO: 548122 - RNA, 12 nt, Human
aaauauaaagca

SEQ ID NO: 548123 - RNA, 17 nt, Human
cucagucucccucccuu

SEQ ID NO: 548124 - RNA, 14 nt, Human
ggacucaccucccc

SEQ ID NO: 548125 - RNA, 15 nt, Human
aaauauaaagcaaga

SEQ ID NO: 548126 - RNA, 13 nt, Human
uuccucugagccu

SEQ ID NO: 548127 - RNA, 18 nt, Human
agugucaaugcagccccc

SEQ ID NO: 548128 - RNA, 14 nt, Human
agacaucaacagau

SEQ ID NO: 548129 - RNA, 15 nt, Human
gaaaugaaagcaggg

SEQ ID NO: 548130 - RNA, 21 nt, Human
caauuuuguuauguauauuuu

SEQ ID NO: 548131 - RNA, 16 nt, Human
uaaaugaaauugaaaa

SEQ ID NO: 548132 - RNA, 18 nt, Human
auaacaacaacaacaaaa

SEQ ID NO: 548133 - RNA, 16 nt, Human
aaaaugugauauguac

SEQ ID NO: 548134 - RNA, 15 nt, Human
cuaagcaaaauguga

SEQ ID NO: 548135 - RNA, 16 nt, Human
gagaaacuggaacucu

SEQ ID NO: 548136 - RNA, 19 nt, Human
agauuugagcucagcccug

SEQ ID NO: 548137 - RNA, 20 nt, Human
ccugccuaagugcagccccg

SEQ ID NO: 548138 - RNA, 21 nt, Human
cuccagcuggccgggagccug

SEQ ID NO: 548139 - RNA, 14 nt, Human
ccacuggacucacc

SEQ ID NO: 548140 - RNA, 19 nt, Human
cagcuacuugggaggcuga

SEQ ID NO: 548141 - RNA, 20 nt, Human
cuggccuucggccuccaucc

SEQ ID NO: 548142 - RNA, 23 nt, Human
ucaauaucuuuuuuuuaauaaac

SEQ ID NO: 548143 - RNA, 15 nt, Human
gaagauguagaggag

SEQ ID NO: 548144 - RNA, 22 nt, Human
agccaaacauccuacaagacac

SEQ ID NO: 548145 - RNA, 17 nt, Human
ccacugcagaagacagu

SEQ ID NO: 548146 - RNA, 18 nt, Human
gaugccccgucccccucu

SEQ ID NO: 548147 - RNA, 20 nt, Human
aaucuuuauaguucuacucc

SEQ ID NO: 548148 - RNA, 16 nt, Human
augcuaagugaaauaa

SEQ ID NO: 548149 - RNA, 19 nt, Human
ggacucaccucccccaucu

SEQ ID NO: 548150 - RNA, 17 nt, Human
auggcuaguaucaaaag

SEQ ID NO: 548151 - RNA, 21 nt, Human
ccauccugccccugagcccau

SEQ ID NO: 548152 - RNA, 21 nt, Human
gcccugcugagucccaggcug

SEQ ID NO: 548153 - RNA, 13 nt, Human
ccucuggcuccag

SEQ ID NO: 548154 - RNA, 17 nt, Human
agaaaugaaagcaggga

SEQ ID NO: 548155 - RNA, 16 nt, Human
agagguccacaacaca

SEQ ID NO: 548156 - RNA, 23 nt, Human
cccagcccuccuuaucaaaggac

SEQ ID NO: 548157 - RNA, 15 nt, Human
aauugacccacaaga

SEQ ID NO: 548158 - RNA, 22 nt, Human
caccucccccaucucuucuggg

SEQ ID NO: 548159 - RNA, 21 nt, Human
aagacucgggauuaguacaca

SEQ ID NO: 548160 - RNA, 15 nt, Human
ugcaauuccacuuau

SEQ ID NO: 548161 - RNA, 16 nt, Human
aagcaagauaauaaaa

SEQ ID NO: 548162 - RNA, 14 nt, Human
ugagcucagcccug

SEQ ID NO: 548163 - RNA, 19 nt, Human
cucuguucugcacacagca

SEQ ID NO: 548164 - RNA, 16 nt, Human
gccuaagugcagcccc

SEQ ID NO: 548165 - RNA, 19 nt, Human
cuuccuaauuccacagcug

SEQ ID NO: 548166 - RNA, 17 nt, Human
ccuauccuacuuccccu

SEQ ID NO: 548167 - RNA, 19 nt, Human
cagauccccaagccuggca

SEQ ID NO: 548168 - RNA, 22 nt, Human
gugugaccacugcagaagacag

SEQ ID NO: 548169 - RNA, 19 nt, Human
uugugccccugcacuccag

SEQ ID NO: 548170 - RNA, 13 nt, Human
gcagaacagugau

SEQ ID NO: 548171 - RNA, 22 nt, Human
ugagacucugucucaguccaug

SEQ ID NO: 548172 - RNA, 15 nt, Human
ggacucaccuccccc

SEQ ID NO: 548173 - RNA, 19 nt, Human
ucaccaaggcugauuaaac

SEQ ID NO: 548174 - RNA, 19 nt, Human
uuccucccuucucuucaca

SEQ ID NO: 548175 - RNA, 18 nt, Human
ucuucuggguuccuuccu

SEQ ID NO: 548176 - RNA, 18 nt, Human
gagcgacagugagacucu

SEQ ID NO: 548177 - RNA, 20 nt, Human
gcagagaugaggccgccaug

SEQ ID NO: 548178 - RNA, 20 nt, Human
cucuguucugcacacagcac

SEQ ID NO: 548179 - RNA, 16 nt, Human
cucagcccuggugggc

SEQ ID NO: 548180 - RNA, 17 nt, Human
augcagagguccacaac

SEQ ID NO: 548181 - RNA, 20 nt, Human
ccagugagacagcucugcau

SEQ ID NO: 548182 - RNA, 21 nt, Human
cccacuggacucaccuccccc

SEQ ID NO: 548183 - RNA, 14 nt, Human
ugagaugcuagaac

SEQ ID NO: 548184 - RNA, 12 nt, Human
ccccuugccaua

SEQ ID NO: 548185 - RNA, 17 nt, Human
agagacagaaagcagaa

SEQ ID NO: 548186 - RNA, 18 nt, Human
agauccccaagccuggca

SEQ ID NO: 548187 - RNA, 14 nt, Human
auacaaaaaaaaaa

SEQ ID NO: 548188 - RNA, 21 nt, Human
auccccaagccuggcaaggga

SEQ ID NO: 548189 - RNA, 13 nt, Human
cccuccuuaucaa

SEQ ID NO: 548190 - RNA, 14 nt, Human
agucucccucccuu

SEQ ID NO: 548191 - RNA, 15 nt, Human
cauuccaagccucau

SEQ ID NO: 548192 - RNA, 16 nt, Human
cuccaccuuacuucuu

SEQ ID NO: 548193 - RNA, 23 nt, Human
gcuuuggucuaucuuugagcgcc

SEQ ID NO: 548194 - RNA, 14 nt, Human
uauguauauuuuau

SEQ ID NO: 548195 - RNA, 17 nt, Human
ucagacauagaauuaac

SEQ ID NO: 548196 - RNA, 21 nt, Human
aaugugacuuaaugccacuaa

SEQ ID NO: 548197 - RNA, 13 nt, Human
ggaaguagaggag

SEQ ID NO: 548198 - RNA, 20 nt, Human
uccaagccucauguccacug

SEQ ID NO: 548199 - RNA, 17 nt, Human
uaauuccacagcugcuc

SEQ ID NO: 548200 - RNA, 20 nt, Human
ugagagugaacaaauuuaca

SEQ ID NO: 548201 - RNA, 11 nt, Human
aaccugagccc

SEQ ID NO: 548202 - RNA, 19 nt, Human
augaaagcagggacuugaa

SEQ ID NO: 548203 - RNA, 21 nt, Human
ccucuguucugcacacagcac

SEQ ID NO: 548204 - RNA, 21 nt, Human
cccccucuggcuccagcuggc

SEQ ID NO: 548205 - RNA, 19 nt, Human
ccccugagcuugcagagau

SEQ ID NO: 548206 - RNA, 15 nt, Human
cccugcaaagcccag

SEQ ID NO: 548207 - RNA, 20 nt, Human
uuaacacaugauccugcaau

SEQ ID NO: 548208 - RNA, 22 nt, Human
aucaccaaggcugauuaaacca

SEQ ID NO: 548209 - RNA, 15 nt, Human
uccuacaagacacag

SEQ ID NO: 548210 - RNA, 18 nt, Human
acauguuacaacacggac

SEQ ID NO: 548211 - RNA, 10 nt, Human
accugagccc

SEQ ID NO: 548212 - RNA, 21 nt, Human
auguuuacagauccccaagcc

SEQ ID NO: 548213 - RNA, 21 nt, Human
ugaccauacuaauuauacccc

SEQ ID NO: 548214 - RNA, 18 nt, Human
ccacuuggucugugagau

SEQ ID NO: 548215 - RNA, 14 nt, Human
ccugccccccagcc

SEQ ID NO: 548216 - RNA, 22 nt, Human
aucucuucuggguuccuuccuc

SEQ ID NO: 548217 - RNA, 17 nt, Human
agugauuaccagggacu

SEQ ID NO: 548218 - RNA, 16 nt, Human
agggaggacgcucucu

SEQ ID NO: 548219 - RNA, 14 nt, Human
gaaagcagaacagu

SEQ ID NO: 548220 - RNA, 11 nt, Human
accauuuuuac

SEQ ID NO: 548221 - RNA, 12 nt, Human
gccccugagccc

SEQ ID NO: 548222 - RNA, 17 nt, Human
gccccccagcccuccuu

SEQ ID NO: 548223 - RNA, 21 nt, Human
ugaacaaauuuacagagacag

SEQ ID NO: 548224 - RNA, 13 nt, Human
aucaggcuggcca

SEQ ID NO: 548225 - RNA, 15 nt, Human
aucaaaggacaccau

SEQ ID NO: 548226 - RNA, 19 nt, Human
gagccucagucucccuccc

SEQ ID NO: 548227 - RNA, 21 nt, Human
ugagcucagcccuggugggca

SEQ ID NO: 548228 - RNA, 15 nt, Human
cugcacuccagccug

SEQ ID NO: 548229 - RNA, 16 nt, Human
ugacacuuaaaaaugg

SEQ ID NO: 548230 - RNA, 13 nt, Human
aucaaugaaugaa

SEQ ID NO: 548231 - RNA, 12 nt, Human
cacaacacacag

SEQ ID NO: 548232 - RNA, 16 nt, Human
accuuacuucuucuca

SEQ ID NO: 548233 - RNA, 16 nt, Human
gaagauguagaggaga

SEQ ID NO: 548234 - RNA, 18 nt, Human
cccaagccuggcaaggga

SEQ ID NO: 548235 - RNA, 22 nt, Human
cccagcccuccuuaucaaagga

SEQ ID NO: 548236 - RNA, 17 nt, Human
ugaccacugcagaagac

SEQ ID NO: 548237 - RNA, 12 nt, Human
aaugcagccccc

SEQ ID NO: 548238 - RNA, 16 nt, Human
ggcugagccucagucu

SEQ ID NO: 548239 - RNA, 19 nt, Human
caaggaugccccguccccc

SEQ ID NO: 548240 - RNA, 14 nt, Human
cucuggcuccagcu

SEQ ID NO: 548241 - RNA, 18 nt, Human
cuuugagcgcccacuaga

SEQ ID NO: 548242 - RNA, 19 nt, Human
uggaaauguuuacagaucc

SEQ ID NO: 548243 - RNA, 15 nt, Human
ccucagucucccucc

SEQ ID NO: 548244 - RNA, 14 nt, Human
aucaccaaggcuga

SEQ ID NO: 548245 - RNA, 14 nt, Human
ugcuagaacucccu

SEQ ID NO: 548246 - RNA, 20 nt, Human
auaagccagacaucaacaga

SEQ ID NO: 548247 - RNA, 20 nt, Human
uacuucuucucauacuauuu

SEQ ID NO: 548248 - RNA, 20 nt, Human
ccauacuaauuauacccccu

SEQ ID NO: 548249 - RNA, 22 nt, Human
uggguuccuuccucugagccuu

SEQ ID NO: 548250 - RNA, 14 nt, Human
acuggacucaccuc

SEQ ID NO: 548251 - RNA, 22 nt, Human
uauuuaagagaacaagcaaaua

SEQ ID NO: 548252 - RNA, 16 nt, Human
ggcagagagguaggga

SEQ ID NO: 548253 - RNA, 23 nt, Human
cuagacccacuggacucaccucc

SEQ ID NO: 548254 - RNA, 14 nt, Human
uaguuucccuugca

SEQ ID NO: 548255 - RNA, 15 nt, Human
cuggacucaccuccc

SEQ ID NO: 548256 - RNA, 15 nt, Human
ugccccgucccccuc

SEQ ID NO: 548257 - RNA, 14 nt, Human
aauggcuaagcaaa

SEQ ID NO: 548258 - RNA, 21 nt, Human
aauauaaagcaagauaauaaa

SEQ ID NO: 548259 - RNA, 22 nt, Human
uacaugagguacugagagugaa

SEQ ID NO: 548260 - RNA, 13 nt, Human
gagacagcucugc

SEQ ID NO: 548261 - RNA, 22 nt, Human
ucuacuccauuaaauauaaagc

SEQ ID NO: 548262 - RNA, 18 nt, Human
cacuccagugagacagcu

SEQ ID NO: 548263 - RNA, 14 nt, Human
cugcugagucccag

SEQ ID NO: 548264 - RNA, 16 nt, Human
cugcacuccagccuga

SEQ ID NO: 548265 - RNA, 16 nt, Human
ccacuuggucugugag

SEQ ID NO: 548266 - RNA, 20 nt, Human
cccugccccccagcccuccu

SEQ ID NO: 548267 - RNA, 18 nt, Human
aaaaugguauuaaagauc

SEQ ID NO: 548268 - RNA, 14 nt, Human
gauuaguacacacu

SEQ ID NO: 548269 - RNA, 23 nt, Human
gucucccucccuuggggccuaug

SEQ ID NO: 548270 - RNA, 13 nt, Human
ccucccccaucuc

SEQ ID NO: 548271 - RNA, 22 nt, Human
cucugagccuugggaccccuga

SEQ ID NO: 548272 - RNA, 21 nt, Human
cuggccuucggccuccauccu

SEQ ID NO: 548273 - RNA, 13 nt, Human
uuauucacaagac

SEQ ID NO: 548274 - RNA, 18 nt, Human
gaggcuccacuuggucug

SEQ ID NO: 548275 - RNA, 22 nt, Human
aggacaccauuuuggcaagcuc

SEQ ID NO: 548276 - RNA, 23 nt, Human
ucggccuccauccugaggcucca

SEQ ID NO: 548277 - RNA, 16 nt, Human
ccuaagugcagccccg

SEQ ID NO: 548278 - RNA, 23 nt, Human
cacaagaaaugaaagcagggacu

SEQ ID NO: 548279 - RNA, 14 nt, Human
ccucagucucccuc

SEQ ID NO: 548280 - RNA, 19 nt, Human
caacucccugccccccagc

SEQ ID NO: 548281 - RNA, 15 nt, Human
ccugcaaagcccagc

SEQ ID NO: 548282 - RNA, 22 nt, Human
ugaauggcuaagcaaaauguga

SEQ ID NO: 548283 - RNA, 13 nt, Human
cucugagccuugg

SEQ ID NO: 548284 - RNA, 23 nt, Human
cucauguccacugguucuucuug

SEQ ID NO: 548285 - RNA, 11 nt, Human
auaacaacaac

SEQ ID NO: 548286 - RNA, 17 nt, Human
uccugccccugagccca

SEQ ID NO: 548287 - RNA, 19 nt, Human
uuuauaucaauuuaaaaaa

SEQ ID NO: 548288 - RNA, 20 nt, Human
acggacgaaccuugaaaacu

SEQ ID NO: 548289 - RNA, 22 nt, Human
cagcacgggggccaaggaugcc

SEQ ID NO: 548290 - RNA, 15 nt, Human
gugaccacugcagaa

SEQ ID NO: 548291 - RNA, 14 nt, Human
gagcucagcccugg

SEQ ID NO: 548292 - RNA, 16 nt, Human
uggggauagugaggca

SEQ ID NO: 548293 - RNA, 16 nt, Human
cugcugagucccaggc

SEQ ID NO: 548294 - RNA, 15 nt, Human
gacaguauggcagcu

SEQ ID NO: 548295 - RNA, 20 nt, Human
ggccaugggacagggaggac

SEQ ID NO: 548296 - RNA, 14 nt, Human
aagcaacccaaaug

SEQ ID NO: 548297 - RNA, 13 nt, Human
gguccacaacaca

SEQ ID NO: 548298 - RNA, 12 nt, Human
cuggcuccagcu

SEQ ID NO: 548299 - RNA, 16 nt, Human
auacauguuacaacac

SEQ ID NO: 548300 - RNA, 22 nt, Human
ugaccauacuaauuauaccccc

SEQ ID NO: 548301 - RNA, 14 nt, Human
aaaacuucagacau

SEQ ID NO: 548302 - RNA, 20 nt, Human
uauaaagcaagauaauaaaa

SEQ ID NO: 548303 - RNA, 18 nt, Human
caugaagauguagaggag

SEQ ID NO: 548304 - RNA, 15 nt, Human
cgggagccugaucac

SEQ ID NO: 548305 - RNA, 23 nt, Human
aguucuacuccauuaaauauaaa

SEQ ID NO: 548306 - RNA, 15 nt, Human
cccugccccccagcc

SEQ ID NO: 548307 - RNA, 19 nt, Human
gccugaucaccugcccugc

SEQ ID NO: 548308 - RNA, 22 nt, Human
gucacaggaaguagaggaggcc

SEQ ID NO: 548309 - RNA, 21 nt, Human
cugcccugcugagucccaggc

SEQ ID NO: 548310 - RNA, 12 nt, Human
uauucacaagac

SEQ ID NO: 548311 - RNA, 13 nt, Human
ccaccugccuaua

SEQ ID NO: 548312 - RNA, 21 nt, Human
aaaagguauuuuaaucaccaa

SEQ ID NO: 548313 - RNA, 14 nt, Human
cugucucaguccau

SEQ ID NO: 548314 - RNA, 17 nt, Human
uaaaugaaauugaaaau

SEQ ID NO: 548315 - RNA, 17 nt, Human
cccaggcugagccucag

SEQ ID NO: 548316 - RNA, 16 nt, Human
agguugcagugagccg

SEQ ID NO: 548317 - RNA, 14 nt, Human
ccugccccugagcc

SEQ ID NO: 548318 - RNA, 18 nt, Human
agccugaucaccugcccu

SEQ ID NO: 548319 - RNA, 16 nt, Human
gccaaggaugccccgu

SEQ ID NO: 548320 - RNA, 12 nt, Human
gcaaagcccagc

SEQ ID NO: 548321 - RNA, 13 nt, Human
ucuacuaaaaaua

SEQ ID NO: 548322 - RNA, 16 nt, Human
aggccaugggacaggg

SEQ ID NO: 548323 - RNA, 15 nt, Human
ucuggcuccagcugg

SEQ ID NO: 548324 - RNA, 21 nt, Human
acagugauuaccagggacuga

SEQ ID NO: 548325 - RNA, 16 nt, Human
aauuccacagcugcuc

SEQ ID NO: 548326 - RNA, 17 nt, Human
ccacuggacucaccucc

SEQ ID NO: 548327 - RNA, 12 nt, Human
aaggaugccccg

SEQ ID NO: 548328 - RNA, 19 nt, Human
ccccucuggcuccagcugg

SEQ ID NO: 548329 - RNA, 16 nt, Human
auacuauuuaagagaa

SEQ ID NO: 548330 - RNA, 21 nt, Human
gaaagcagggacuugaaccca

SEQ ID NO: 548331 - RNA, 14 nt, Human
acuuggucugugag

SEQ ID NO: 548332 - RNA, 16 nt, Human
gaauggcuaagcaaaa

SEQ ID NO: 548333 - RNA, 23 nt, Human
ggucuaucuuugagcgcccacua

SEQ ID NO: 548334 - RNA, 22 nt, Human
aaacauccuacaagacacagug

SEQ ID NO: 548335 - RNA, 21 nt, Human
cagcaacuuguguuccuaaca

SEQ ID NO: 548336 - RNA, 20 nt, Human
uuucuucaacucccugcccc

SEQ ID NO: 548337 - RNA, 14 nt, Human
agagguccacaaca

SEQ ID NO: 548338 - RNA, 17 nt, Human
uuccaagccucaugucc

SEQ ID NO: 548339 - RNA, 18 nt, Human
accaccugccuauauuuu

SEQ ID NO: 548340 - RNA, 21 nt, Human
cuaaauugacacuuaaaaaug

SEQ ID NO: 548341 - RNA, 14 nt, Human
cagauuugagcuca

SEQ ID NO: 548342 - RNA, 20 nt, Human
ccaaauguucaucaaugaau

SEQ ID NO: 548343 - RNA, 16 nt, Human
ccacuuauaggaauug

SEQ ID NO: 548344 - RNA, 19 nt, Human
agcagcuuauucacaagac

SEQ ID NO: 548345 - RNA, 17 nt, Human
ugaaauaagccagacau

SEQ ID NO: 548346 - RNA, 15 nt, Human
agcucuaucaccaag

SEQ ID NO: 548347 - RNA, 21 nt, Human
acaugagguacugagagugaa

SEQ ID NO: 548348 - RNA, 12 nt, Human
accccugagcuu

SEQ ID NO: 548349 - RNA, 19 nt, Human
aaucuacacuccagugaga

SEQ ID NO: 548350 - RNA, 16 nt, Human
cacuuaaaaaugguuu

SEQ ID NO: 548351 - RNA, 22 nt, Human
acuccauuaaauauaaagcaag

SEQ ID NO: 548352 - RNA, 18 nt, Human
ccuuccuaauuccacagc

SEQ ID NO: 548353 - RNA, 20 nt, Human
aggcugagaugggagaauca

SEQ ID NO: 548354 - RNA, 20 nt, Human
uaagaaucuuuauaguucua

SEQ ID NO: 548355 - RNA, 14 nt, Human
gcaaauauaaacag

SEQ ID NO: 548356 - RNA, 20 nt, Human
auauuuuauaucaauuuaaa

SEQ ID NO: 548357 - RNA, 15 nt, Human
uggacucaccucccc

SEQ ID NO: 548358 - RNA, 12 nt, Human
acaagaaaugaa

SEQ ID NO: 548359 - RNA, 16 nt, Human
ccaggcugagccucag

SEQ ID NO: 548360 - RNA, 13 nt, Human
aacaacaacaaca

SEQ ID NO: 548361 - RNA, 22 nt, Human
acagauuugagcucagcccugg

SEQ ID NO: 548362 - RNA, 19 nt, Human
auuuaagagaacaagcaaa

SEQ ID NO: 548363 - RNA, 17 nt, Human
agugagacagcucugca

SEQ ID NO: 548364 - RNA, 17 nt, Human
gacucaccucccccauc

SEQ ID NO: 548365 - RNA, 22 nt, Human
uauccuacuuccccuuccuaau

SEQ ID NO: 548366 - RNA, 15 nt, Human
gcaacccaaauguuc

SEQ ID NO: 548367 - RNA, 14 nt, Human
gcaaagcccagcuu

SEQ ID NO: 548368 - RNA, 20 nt, Human
aauaagccagacaucaacag

SEQ ID NO: 548369 - RNA, 17 nt, Human
cuggacucaccuccccc

SEQ ID NO: 548370 - RNA, 18 nt, Human
agcugcucaauaaaguac

SEQ ID NO: 548371 - RNA, 18 nt, Human
caaggcugauuaaaccaa

SEQ ID NO: 548372 - RNA, 22 nt, Human
caucgcaauguaagacucggga

SEQ ID NO: 548373 - RNA, 16 nt, Human
agugucaaugcagccc

SEQ ID NO: 548374 - RNA, 16 nt, Human
augccccgucccccuc

SEQ ID NO: 548375 - RNA, 14 nt, Human
uccacaacacacag

SEQ ID NO: 548376 - RNA, 19 nt, Human
cccauggcacucuauguuc

SEQ ID NO: 548377 - RNA, 19 nt, Human
uacuauccaacuuauauuu

SEQ ID NO: 548378 - RNA, 17 nt, Human
uguucuaagaagugaaa

SEQ ID NO: 548379 - RNA, 15 nt, Human
acaggguuuauguuu

SEQ ID NO: 548380 - RNA, 20 nt, Human
agcaacuuguguuccuaaca

SEQ ID NO: 548381 - RNA, 21 nt, Human
cagugagacagcucugcauac

SEQ ID NO: 548382 - RNA, 18 nt, Human
caaggcuagaaccaccug

SEQ ID NO: 548383 - RNA, 15 nt, Human
ccauuaaauauaaag

SEQ ID NO: 548384 - RNA, 17 nt, Human
uaugcuaagugaaauaa

SEQ ID NO: 548385 - RNA, 21 nt, Human
ugcucaauaaaguacaagagc

SEQ ID NO: 548386 - RNA, 22 nt, Human
gugccucaccccuugccauaau

SEQ ID NO: 548387 - RNA, 14 nt, Human
cagagguugcagug

SEQ ID NO: 548388 - RNA, 17 nt, Human
aaaaugguauuaaagau

SEQ ID NO: 548389 - RNA, 22 nt, Human
ugaaaaaguucugcagauaaac

SEQ ID NO: 548390 - RNA, 19 nt, Human
auguuuacagauccccaag

SEQ ID NO: 548391 - RNA, 22 nt, Human
uuccccuuccuaauuccacagc

SEQ ID NO: 548392 - RNA, 13 nt, Human
uguauauuuuaua

SEQ ID NO: 548393 - RNA, 16 nt, Human
cagggacuugaaccca

SEQ ID NO: 548394 - RNA, 20 nt, Human
cuuauucacaagacccaaaa

SEQ ID NO: 548395 - RNA, 17 nt, Human
agcgacagugagacucu

SEQ ID NO: 548396 - RNA, 19 nt, Human
gccccccagcccuccuuau

SEQ ID NO: 548397 - RNA, 16 nt, Human
aauuucuucaacuccc

SEQ ID NO: 548398 - RNA, 19 nt, Human
cucaccucccccaucucuu

SEQ ID NO: 548399 - RNA, 17 nt, Human
agaaucacuugaacccg

SEQ ID NO: 548400 - RNA, 21 nt, Human
auucauagcagcuuauucaca

SEQ ID NO: 548401 - RNA, 15 nt, Human
uucaaaguuaagaau

SEQ ID NO: 548402 - RNA, 19 nt, Human
cccugcaaagcccagcuug

SEQ ID NO: 548403 - RNA, 19 nt, Human
ucagugucaaugcagcccc

SEQ ID NO: 548404 - RNA, 14 nt, Human
accauuuuuacuug

SEQ ID NO: 548405 - RNA, 16 nt, Human
uggcaagcucuaucac

SEQ ID NO: 548406 - RNA, 14 nt, Human
ugaucaccugcccu

SEQ ID NO: 548407 - RNA, 15 nt, Human
ccacaagaaaugaaa

SEQ ID NO: 548408 - RNA, 16 nt, Human
caugguuuagaaagcu

SEQ ID NO: 548409 - RNA, 14 nt, Human
cugccccccagccc

SEQ ID NO: 548410 - RNA, 18 nt, Human
gaccccugagcuugcaga

SEQ ID NO: 548411 - RNA, 23 nt, Human
uaggauggcuaguaucaaaagaa

SEQ ID NO: 548412 - RNA, 14 nt, Human
cuuggucugugaga

SEQ ID NO: 548413 - RNA, 21 nt, Human
uacaugagguacugagaguga

SEQ ID NO: 548414 - RNA, 13 nt, Human
augcuagaacucc

SEQ ID NO: 548415 - RNA, 15 nt, Human
uuaagagaacaagca

SEQ ID NO: 548416 - RNA, 23 nt, Human
caacggggugaaacccugucucu

SEQ ID NO: 548417 - RNA, 14 nt, Human
agauguagaggaga

SEQ ID NO: 548418 - RNA, 16 nt, Human
ucugcagauaaacagu

SEQ ID NO: 548419 - RNA, 17 nt, Human
ggccaugggacagggag

SEQ ID NO: 548420 - RNA, 13 nt, Human
caacucccugccc

SEQ ID NO: 548421 - RNA, 16 nt, Human
cugaucaccugcccug

SEQ ID NO: 548422 - RNA, 20 nt, Human
uugaaaaugguauuaaagau

SEQ ID NO: 548423 - RNA, 16 nt, Human
uaucaaaagaaagaaa

SEQ ID NO: 548424 - RNA, 21 nt, Human
guccccuauccuacuuccccu

SEQ ID NO: 548425 - RNA, 16 nt, Human
uggucugugagaugcu

SEQ ID NO: 548426 - RNA, 15 nt, Human
ggcaagcucuaucac

SEQ ID NO: 548427 - RNA, 13 nt, Human
cccugcacuccag

SEQ ID NO: 548428 - RNA, 22 nt, Human
gaggggagcaugggaagugacg

SEQ ID NO: 548429 - RNA, 14 nt, Human
aaagaggaaugaag

SEQ ID NO: 548430 - RNA, 16 nt, Human
acauccuacaagacac

SEQ ID NO: 548431 - RNA, 14 nt, Human
caagcaaauauaaa

SEQ ID NO: 548432 - RNA, 23 nt, Human
aucacagcuacuugggaggcuga

SEQ ID NO: 548433 - RNA, 19 nt, Human
ugcacacagcacgggggcc

SEQ ID NO: 548434 - RNA, 23 nt, Human
caucucuucuggguuccuuccuc

SEQ ID NO: 548435 - RNA, 14 nt, Human
ugcuggagcucugc

SEQ ID NO: 548436 - RNA, 13 nt, Human
gcuggagcucugc

SEQ ID NO: 548437 - RNA, 17 nt, Human
cccacuggacucaccuc

SEQ ID NO: 548438 - RNA, 19 nt, Human
agccugaucaccugcccug

SEQ ID NO: 548439 - RNA, 17 nt, Human
uaucuuuuuuuuaauaa

SEQ ID NO: 548440 - RNA, 19 nt, Human
gcacacagcacgggggcca

SEQ ID NO: 548441 - RNA, 13 nt, Human
gcucucuggccuu

SEQ ID NO: 548442 - RNA, 23 nt, Human
uggaaauguuuacagauccccaa

SEQ ID NO: 548443 - RNA, 18 nt, Human
cagauuugagcucagccc

SEQ ID NO: 548444 - RNA, 22 nt, Human
accuaacgaaguauccuucagc

SEQ ID NO: 548445 - RNA, 18 nt, Human
uccagcuggccgggagcc

SEQ ID NO: 548446 - RNA, 21 nt, Human
uuucauuguucuauaacaaca

SEQ ID NO: 548447 - RNA, 21 nt, Human
caacacacagauuugagcuca

SEQ ID NO: 548448 - RNA, 20 nt, Human
acaagcaaauauaaacagca

SEQ ID NO: 548449 - RNA, 16 nt, Human
acuaguuucccuugca

SEQ ID NO: 548450 - RNA, 13 nt, Human
uggcuccagcugg

SEQ ID NO: 548451 - RNA, 13 nt, Human
ugagcgacaguga

SEQ ID NO: 548452 - RNA, 15 nt, Human
aaaguuaagaaucuu

SEQ ID NO: 548453 - RNA, 13 nt, Human
aaacauccuacaa

SEQ ID NO: 548454 - RNA, 21 nt, Human
aaaaaguucugcagauaaaca

SEQ ID NO: 548455 - RNA, 20 nt, Human
uuaaugccacuaaauugaca

SEQ ID NO: 548456 - RNA, 11 nt, Human
ggucacaggaa

SEQ ID NO: 548457 - RNA, 16 nt, Human
aagagaacaagcaaau

SEQ ID NO: 548458 - RNA, 16 nt, Human
uaggauguugaaaaag

SEQ ID NO: 548459 - RNA, 13 nt, Human
cacaacacacaga

SEQ ID NO: 548460 - RNA, 20 nt, Human
cagccugagcgacagugaga

SEQ ID NO: 548461 - RNA, 22 nt, Human
aggauggcuaguaucaaaagaa

SEQ ID NO: 548462 - RNA, 19 nt, Human
uauauuuuuuguuaaauga

SEQ ID NO: 548463 - RNA, 19 nt, Human
uggcaagcucuaucaccaa

SEQ ID NO: 548464 - RNA, 15 nt, Human
gacagggaggacgcu

SEQ ID NO: 548465 - RNA, 18 nt, Human
ccuucggccuccauccug

SEQ ID NO: 548466 - RNA, 17 nt, Human
cccacuagacccacugg

SEQ ID NO: 548467 - RNA, 16 nt, Human
cccccagcccuccuua

SEQ ID NO: 548468 - RNA, 23 nt, Human
aucaccaaggcugauuaaaccaa

SEQ ID NO: 548469 - RNA, 20 nt, Human
aaacuuuaugcuaagugaaa

SEQ ID NO: 548470 - RNA, 14 nt, Human
cugcaaagcccagc

SEQ ID NO: 548471 - RNA, 16 nt, Human
ccugagcuugcagaga

SEQ ID NO: 548472 - RNA, 13 nt, Human
agcucugcccauc

SEQ ID NO: 548473 - RNA, 19 nt, Human
acaaauuuacagagacaga

SEQ ID NO: 548474 - RNA, 14 nt, Human
aagaagugaaaauc

SEQ ID NO: 548475 - RNA, 12 nt, Human
agugcagccccg

SEQ ID NO: 548476 - RNA, 14 nt, Human
cagauccccaagcc

SEQ ID NO: 548477 - RNA, 17 nt, Human
aggcuagaaccaccugc

SEQ ID NO: 548478 - RNA, 17 nt, Human
ccucagucucccucccu

SEQ ID NO: 548479 - RNA, 14 nt, Human
cucccugcccccca

SEQ ID NO: 548480 - RNA, 17 nt, Human
auguuuacagaucccca

SEQ ID NO: 548481 - RNA, 21 nt, Human
acuauuuaagagaacaagcaa

SEQ ID NO: 548482 - RNA, 18 nt, Human
uugaaaaugguauuaaag

SEQ ID NO: 548483 - RNA, 14 nt, Human
agcucuaucaccaa

SEQ ID NO: 548484 - RNA, 12 nt, Human
caugggaaguga

SEQ ID NO: 548485 - RNA, 18 nt, Human
gcccuggugggcagagag

SEQ ID NO: 548486 - RNA, 14 nt, Human
cccugccccccagc

SEQ ID NO: 548487 - RNA, 19 nt, Human
uccccuauccuacuucccc

SEQ ID NO: 548488 - RNA, 17 nt, Human
cugagaugggagaauca

SEQ ID NO: 548489 - RNA, 22 nt, Human
cuucaacucccugccccccagc

SEQ ID NO: 548490 - RNA, 22 nt, Human
aaugggcacaggguuuauguuu

SEQ ID NO: 548491 - RNA, 23 nt, Human
cucagcccuggugggcagagagg

SEQ ID NO: 548492 - RNA, 16 nt, Human
guuccuuccucugagc

SEQ ID NO: 548493 - RNA, 19 nt, Human
uuggcaagcucuaucacca

SEQ ID NO: 548494 - RNA, 15 nt, Human
agacagcucugcaua

SEQ ID NO: 548495 - RNA, 15 nt, Human
ccuggugggcagaga

SEQ ID NO: 548496 - RNA, 12 nt, Human
ccuucagccuga

SEQ ID NO: 548497 - RNA, 21 nt, Human
gacagaaagcagaacagugau

SEQ ID NO: 548498 - RNA, 17 nt, Human
uccacaacacacagauu

SEQ ID NO: 548499 - RNA, 18 nt, Human
auccuucagccugaaaga

SEQ ID NO: 548500 - RNA, 17 nt, Human
acaagaaaugaaagcag

SEQ ID NO: 548501 - RNA, 18 nt, Human
uguggucacaggaaguag

SEQ ID NO: 548502 - RNA, 22 nt, Human
gugaacaaauuuacagagacag

SEQ ID NO: 548503 - RNA, 23 nt, Human
aaagcccagcuugaaaccuucac

SEQ ID NO: 548504 - RNA, 14 nt, Human
cacuuauaggaauu

SEQ ID NO: 548505 - RNA, 13 nt, Human
ccaaaagguauuu

SEQ ID NO: 548506 - RNA, 19 nt, Human
cccccucuggcuccagcug

SEQ ID NO: 548507 - RNA, 17 nt, Human
cuauccuacuuccccuu

SEQ ID NO: 548508 - RNA, 18 nt, Human
agaagcaacccaaauguu

SEQ ID NO: 548509 - RNA, 12 nt, Human
ucuacacuccag

SEQ ID NO: 548510 - RNA, 23 nt, Human
gaaauugaaaaugguauuaaaga

SEQ ID NO: 548511 - RNA, 22 nt, Human
cccccugcaaagcccagcuuga

SEQ ID NO: 548512 - RNA, 14 nt, Human
agaaaugaaagcag

SEQ ID NO: 548513 - RNA, 16 nt, Human
cagucucccucccuug

SEQ ID NO: 548514 - RNA, 13 nt, Human
cacgaugggcuuu

SEQ ID NO: 548515 - RNA, 16 nt, Human
caggcugagccucagu

SEQ ID NO: 548516 - RNA, 15 nt, Human
uucggccuccauccu

SEQ ID NO: 548517 - RNA, 18 nt, Human
cccaggcugagccucagu

SEQ ID NO: 548518 - RNA, 19 nt, Human
cagcacgggggccaaggau

SEQ ID NO: 548519 - RNA, 21 nt, Human
auaguuguaccgcaaugugac

SEQ ID NO: 548520 - RNA, 13 nt, Human
ccaacuuauauuu

SEQ ID NO: 548521 - RNA, 22 nt, Human
gcuugcagagaugaggccgcca

SEQ ID NO: 548522 - RNA, 18 nt, Human
uuggggccuaugcagagg

SEQ ID NO: 548523 - RNA, 14 nt, Human
acccaaaaggcaga

SEQ ID NO: 548524 - RNA, 15 nt, Human
ccccugagcuugcag

SEQ ID NO: 548525 - RNA, 12 nt, Human
gcucagcccugg

SEQ ID NO: 548526 - RNA, 14 nt, Human
uucagccugaaaga

SEQ ID NO: 548527 - RNA, 21 nt, Human
cucaguccaugaagauguaga

SEQ ID NO: 548528 - RNA, 17 nt, Human
agaacucccuuucaaca

SEQ ID NO: 548529 - RNA, 14 nt, Human
ccuuaucaaaggac

SEQ ID NO: 548530 - RNA, 16 nt, Human
agaugcuagaacuccc

SEQ ID NO: 548531 - RNA, 16 nt, Human
aucaauuuaaaaaaaa

SEQ ID NO: 548532 - RNA, 12 nt, Human
aaaagaaagaaa

SEQ ID NO: 548533 - RNA, 13 nt, Human
aacucccugcccc

SEQ ID NO: 548534 - RNA, 14 nt, Human
ucuuuuuuuuaaua

SEQ ID NO: 548535 - RNA, 23 nt, Human
uuuaagagaacaagcaaauauaa

SEQ ID NO: 548536 - RNA, 18 nt, Human
gcaaagcccagcuugaaa

SEQ ID NO: 548537 - RNA, 15 nt, Human
uucugcacacagcac

SEQ ID NO: 548538 - RNA, 14 nt, Human
uaguaucaaaagaa

SEQ ID NO: 548539 - RNA, 24 nt, Human
ccccugagcuugcagagaugaggc

SEQ ID NO: 548540 - RNA, 16 nt, Human
auuauacccccugcaa

SEQ ID NO: 548541 - RNA, 20 nt, Human
ggccuaugcagagguccaca

SEQ ID NO: 548542 - RNA, 22 nt, Human
aaaaaaccugagccccaaaagg

SEQ ID NO: 548543 - RNA, 16 nt, Human
ccuggugggcagagag

SEQ ID NO: 548544 - RNA, 17 nt, Human
uccuacaagacacagug

SEQ ID NO: 548545 - RNA, 18 nt, Human
ccugaaagaggaaugaag

SEQ ID NO: 548546 - RNA, 15 nt, Human
uauaaagcaagauaa

SEQ ID NO: 548547 - RNA, 22 nt, Human
ccgggagccugaucaccugccc

SEQ ID NO: 548548 - RNA, 19 nt, Human
ucaguccaugaagauguag

SEQ ID NO: 548549 - RNA, 21 nt, Human
caagacccaaaaggcagaagc

SEQ ID NO: 548550 - RNA, 19 nt, Human
cuggccuucggccuccauc

SEQ ID NO: 548551 - RNA, 16 nt, Human
aucaaaagaaagaaaa

SEQ ID NO: 548552 - RNA, 17 nt, Human
uccagcuggccgggagc

SEQ ID NO: 548553 - RNA, 13 nt, Human
aaauauaaacagc

SEQ ID NO: 548554 - RNA, 18 nt, Human
cuccagccugagcgacag

SEQ ID NO: 548555 - RNA, 22 nt, Human
gaagugaaaaucuacacuccag

SEQ ID NO: 548556 - RNA, 13 nt, Human
aaaaaugguuuaa

SEQ ID NO: 548557 - RNA, 15 nt, Human
gucaaugcagccccc

SEQ ID NO: 548558 - RNA, 13 nt, Human
caccaaggagcca

SEQ ID NO: 548559 - RNA, 22 nt, Human
aggcuccacuuggucugugaga

SEQ ID NO: 548560 - RNA, 14 nt, Human
cgucccccucuggc

SEQ ID NO: 548561 - RNA, 18 nt, Human
cuuccucugagccuuggg

SEQ ID NO: 548562 - RNA, 23 nt, Human
gggagccugaucaccugcccugc

SEQ ID NO: 548563 - RNA, 19 nt, Human
cagagaugaggccgccaug

SEQ ID NO: 548564 - RNA, 15 nt, Human
gccuugggaccccug

SEQ ID NO: 548565 - RNA, 14 nt, Human
agguugcagugagc

SEQ ID NO: 548566 - RNA, 16 nt, Human
cuuuauaguucuacuc

SEQ ID NO: 548567 - RNA, 17 nt, Human
guguccccuauccuacu

SEQ ID NO: 548568 - RNA, 23 nt, Human
ggaggcagagguugcagugagcc

SEQ ID NO: 548569 - RNA, 23 nt, Human
acucuauguucuaagaagugaaa

SEQ ID NO: 548570 - RNA, 15 nt, Human
ucugcagauaaacag

SEQ ID NO: 548571 - RNA, 21 nt, Human
cucagugucaaugcagccccc

SEQ ID NO: 548572 - RNA, 16 nt, Human
ccccaucucuucuggg

SEQ ID NO: 548573 - RNA, 17 nt, Human
cagacaucaacagauaa

SEQ ID NO: 548574 - RNA, 15 nt, Human
uuacagagacagaaa

SEQ ID NO: 548575 - RNA, 16 nt, Human
cagauccccaagccug

SEQ ID NO: 548576 - RNA, 13 nt, Human
ccugagcuugcag

SEQ ID NO: 548577 - RNA, 23 nt, Human
auucaauaucuuuuuuuuaauaa

SEQ ID NO: 548578 - RNA, 22 nt, Human
ucuacuaaaaauacaaaaaaaa

SEQ ID NO: 548579 - RNA, 18 nt, Human
uaaauauaaagcaagaua

SEQ ID NO: 548580 - RNA, 14 nt, Human
cucagucucccucc

SEQ ID NO: 548581 - RNA, 15 nt, Human
ugaaacccugucucu

SEQ ID NO: 548582 - RNA, 14 nt, Human
agcucauaaaugaa

SEQ ID NO: 548583 - RNA, 15 nt, Human
agccucagucucccu

SEQ ID NO: 548584 - RNA, 19 nt, Human
uagcagcucauaaaugaaa

SEQ ID NO: 548585 - RNA, 19 nt, Human
uaguuuaugauuccaccua

SEQ ID NO: 548586 - RNA, 22 nt, Human
cuggguuccuuccucugagccu

SEQ ID NO: 548587 - RNA, 21 nt, Human
ccaaggaugccccgucccccu

SEQ ID NO: 548588 - RNA, 14 nt, Human
caaggcuagaacca

SEQ ID NO: 548589 - RNA, 19 nt, Human
uggugagugccuguaauca

SEQ ID NO: 548590 - RNA, 21 nt, Human
cagagguccacaacacacaga

SEQ ID NO: 548591 - RNA, 20 nt, Human
cugagccucagucucccucc

SEQ ID NO: 548592 - RNA, 19 nt, Human
ggaauuucuucaacucccu

SEQ ID NO: 548593 - RNA, 20 nt, Human
gcuugcagagaugaggccgc

SEQ ID NO: 548594 - RNA, 14 nt, Human
aagcucuaucacca

SEQ ID NO: 548595 - RNA, 13 nt, Human
ccaggcugagccu

SEQ ID NO: 548596 - RNA, 22 nt, Human
auaucuuuuuuuuaauaaacca

SEQ ID NO: 548597 - RNA, 20 nt, Human
uuaaauggucaauuuuguua

SEQ ID NO: 548598 - RNA, 12 nt, Human
cuuccucugagc

SEQ ID NO: 548599 - RNA, 22 nt, Human
ucuggguuccuuccucugagcc

SEQ ID NO: 548600 - RNA, 16 nt, Human
ucccugccccccagcc

SEQ ID NO: 548601 - RNA, 16 nt, Human
agccucagucucccuc

SEQ ID NO: 548602 - RNA, 21 nt, Human
cugagccucagucucccuccc

SEQ ID NO: 548603 - RNA, 20 nt, Human
gaugggcuuucccaacagcu

SEQ ID NO: 548604 - RNA, 22 nt, Human
uacugagagugaacaaauuuac

SEQ ID NO: 548605 - RNA, 14 nt, Human
auaaagcaagauaa

SEQ ID NO: 548606 - RNA, 18 nt, Human
ccaagccuggcaagggaa

SEQ ID NO: 548607 - RNA, 20 nt, Human
augguuuagaaagcuugccc

SEQ ID NO: 548608 - RNA, 12 nt, Human
ucccccucuggc

SEQ ID NO: 548609 - RNA, 15 nt, Human
agaacaagcaaauau

SEQ ID NO: 548610 - RNA, 13 nt, Human
cugcacuccagcc

SEQ ID NO: 548611 - RNA, 18 nt, Human
caacuuguguuccuaaca

SEQ ID NO: 548612 - RNA, 19 nt, Human
ccuccauccugaggcucca

SEQ ID NO: 548613 - RNA, 12 nt, Human
uuaauaaaccau

SEQ ID NO: 548614 - RNA, 17 nt, Human
caagacccaaaaggcag

SEQ ID NO: 548615 - RNA, 15 nt, Human
gucccaggcugagcc

SEQ ID NO: 548616 - RNA, 14 nt, Human
ugagacucugucuc

SEQ ID NO: 548617 - RNA, 16 nt, Human
ccuccuuaucaaagga

SEQ ID NO: 548618 - RNA, 22 nt, Human
gacucaccucccccaucucuuc

SEQ ID NO: 548619 - RNA, 14 nt, Human
acaagcaaauauaa

SEQ ID NO: 548620 - RNA, 16 nt, Human
gacauagaauuaacac

SEQ ID NO: 548621 - RNA, 19 nt, Human
uccauccugaggcuccacu

SEQ ID NO: 548622 - RNA, 16 nt, Human
uauaucaauuuaaaaa

SEQ ID NO: 548623 - RNA, 18 nt, Human
aaggaugccccguccccc

SEQ ID NO: 548624 - RNA, 16 nt, Human
auccuacaagacacag

SEQ ID NO: 548625 - RNA, 14 nt, Human
aagaaucuuuauag

SEQ ID NO: 548626 - RNA, 22 nt, Human
cucuggccuucggccuccaucc

SEQ ID NO: 548627 - RNA, 19 nt, Human
agcaucucauuuauaaugu

SEQ ID NO: 548628 - RNA, 14 nt, Human
aauauaaagcaaga

SEQ ID NO: 548629 - RNA, 15 nt, Human
gccccugcacuccag

SEQ ID NO: 548630 - RNA, 22 nt, Human
cuucagccugaaagaggaauga

SEQ ID NO: 548631 - RNA, 21 nt, Human
ccugaucaccugcccugcuga

SEQ ID NO: 548632 - RNA, 13 nt, Human
ugggaggcugaga

SEQ ID NO: 548633 - RNA, 16 nt, Human
aaugaaagcagggacu

SEQ ID NO: 548634 - RNA, 16 nt, Human
ccuaugcagaggucca

SEQ ID NO: 548635 - RNA, 20 nt, Human
agcccuggugggcagagagg

SEQ ID NO: 548636 - RNA, 17 nt, Human
cccccugcaaagcccag

SEQ ID NO: 548637 - RNA, 22 nt, Human
guguccccuauccuacuucccc

SEQ ID NO: 548638 - RNA, 18 nt, Human
uaguaucaaaagaaagaa

SEQ ID NO: 548639 - RNA, 14 nt, Human
aauaguuuaugauu

SEQ ID NO: 548640 - RNA, 17 nt, Human
gaaaaucaggcuggcca

SEQ ID NO: 548641 - RNA, 15 nt, Human
gccuaagugcagccc

SEQ ID NO: 548642 - RNA, 18 nt, Human
ugggcacaggguuuaugu

SEQ ID NO: 548643 - RNA, 23 nt, Human
cccacuggacucaccucccccau

SEQ ID NO: 548644 - RNA, 19 nt, Human
ccauccugccccugagccc

SEQ ID NO: 548645 - RNA, 19 nt, Human
augaaguacucauacaugu

SEQ ID NO: 548646 - RNA, 14 nt, Human
ggcuccagcuggcc

SEQ ID NO: 548647 - RNA, 17 nt, Human
gcaagcucuaucaccaa

SEQ ID NO: 548648 - RNA, 17 nt, Human
gccaugggacagggagg

SEQ ID NO: 548649 - RNA, 15 nt, Human
acaucaacagauaaa

SEQ ID NO: 548650 - RNA, 16 nt, Human
ccugccccccagcccu

SEQ ID NO: 548651 - RNA, 15 nt, Human
uuaaauauaaagcaa

SEQ ID NO: 548652 - RNA, 23 nt, Human
aauguagcagcucauaaaugaaa

SEQ ID NO: 548653 - RNA, 22 nt, Human
agacccacuggacucaccuccc

SEQ ID NO: 548654 - RNA, 15 nt, Human
gcaagcucuaucacc

SEQ ID NO: 548655 - RNA, 17 nt, Human
cuacacuccagugagac

SEQ ID NO: 548656 - RNA, 23 nt, Human
caucaacagauaaauaguuuaug

SEQ ID NO: 548657 - RNA, 23 nt, Human
ggccuccauccugaggcuccacu

SEQ ID NO: 548658 - RNA, 18 nt, Human
gaaaugaaagcagggacu

SEQ ID NO: 548659 - RNA, 17 nt, Human
uccucugagccuuggga

SEQ ID NO: 548660 - RNA, 13 nt, Human
cuuacuucuucuc

SEQ ID NO: 548661 - RNA, 17 nt, Human
aaacauccuacaagaca

SEQ ID NO: 548662 - RNA, 16 nt, Human
uguccccuauccuacu

SEQ ID NO: 548663 - RNA, 14 nt, Human
uauaauguagcagc

SEQ ID NO: 548664 - RNA, 15 nt, Human
cagucucccucccuu

SEQ ID NO: 548665 - RNA, 20 nt, Human
gggaggcagagguugcagug

SEQ ID NO: 548666 - RNA, 14 nt, Human
uuagagcaucucau

SEQ ID NO: 548667 - RNA, 16 nt, Human
aaagaucugcaacuac

SEQ ID NO: 548668 - RNA, 16 nt, Human
uauccuacuuccccuu

SEQ ID NO: 548669 - RNA, 19 nt, Human
ugagucccaggcugagccu

SEQ ID NO: 548670 - RNA, 22 nt, Human
ggcauuuaggccaugggacagg

SEQ ID NO: 548671 - RNA, 14 nt, Human
cagucucccucccu

SEQ ID NO: 548672 - RNA, 19 nt, Human
auuuacagagacagaaagc

SEQ ID NO: 548673 - RNA, 16 nt, Human
cccuauccuacuuccc

SEQ ID NO: 548674 - RNA, 20 nt, Human
cuuauauuucugcuuucaaa

SEQ ID NO: 548675 - RNA, 14 nt, Human
aacaacaacaacaa

SEQ ID NO: 548676 - RNA, 20 nt, Human
agaggagaaacuggaacucu

SEQ ID NO: 548677 - RNA, 17 nt, Human
accugagccccaaaagg

SEQ ID NO: 548678 - RNA, 15 nt, Human
agagacagaaagcag

SEQ ID NO: 548679 - RNA, 19 nt, Human
ugaacaaauuuacagagac

SEQ ID NO: 548680 - RNA, 13 nt, Human
uuuaaaaaaaaac

SEQ ID NO: 548681 - RNA, 20 nt, Human
ggguuccuuccucugagccu

SEQ ID NO: 548682 - RNA, 14 nt, Human
ugacacuuaaaaau

SEQ ID NO: 548683 - RNA, 17 nt, Human
ccugagcuugcagagau

SEQ ID NO: 548684 - RNA, 22 nt, Human
cuccagccugagcgacagugag

SEQ ID NO: 548685 - RNA, 21 nt, Human
gccugaucaccugcccugcug

SEQ ID NO: 548686 - RNA, 15 nt, Human
guucugcagauaaac

SEQ ID NO: 548687 - RNA, 18 nt, Human
gccuucggccuccauccu

SEQ ID NO: 548688 - RNA, 22 nt, Human
caagcucuaucaccaaggagcc

SEQ ID NO: 548689 - RNA, 19 nt, Human
cuuggggccuaugcagagg

SEQ ID NO: 548690 - RNA, 14 nt, Human
ggccgggagccuga

SEQ ID NO: 548691 - RNA, 23 nt, Human
gcaacuuguguuccuaacaggaa

SEQ ID NO: 548692 - RNA, 16 nt, Human
ugacuuaaugccacua

SEQ ID NO: 548693 - RNA, 20 nt, Human
cucccugccccccagcccuc

SEQ ID NO: 548694 - RNA, 12 nt, Human
aagagcuuaaca

SEQ ID NO: 548695 - RNA, 16 nt, Human
ugagaugcuagaacuc

SEQ ID NO: 548696 - RNA, 12 nt, Human
cuucaacucccu

SEQ ID NO: 548697 - RNA, 23 nt, Human
cuggccgggagccugaucaccug

SEQ ID NO: 548698 - RNA, 22 nt, Human
accccugagcuugcagagauga

SEQ ID NO: 548699 - RNA, 14 nt, Human
cguguccccuaucc

SEQ ID NO: 548700 - RNA, 21 nt, Human
ccccugcaaagcccagcuuga

SEQ ID NO: 548701 - RNA, 22 nt, Human
caaggaugccccgucccccucu

SEQ ID NO: 548702 - RNA, 17 nt, Human
cauuaaauauaaagcaa

SEQ ID NO: 548703 - RNA, 20 nt, Human
ccuccugccuaagugcagcc

SEQ ID NO: 548704 - RNA, 17 nt, Human
aaagcagggacuugaac

SEQ ID NO: 548705 - RNA, 22 nt, Human
caguauggcagcuuuccucaaa

SEQ ID NO: 548706 - RNA, 20 nt, Human
cuacuuccccuuccuaauuc

SEQ ID NO: 548707 - RNA, 23 nt, Human
aucucuucuggguuccuuccucu

SEQ ID NO: 548708 - RNA, 16 nt, Human
ugcaugguuuagaaag

SEQ ID NO: 548709 - RNA, 20 nt, Human
caggcugagccucagucucc

SEQ ID NO: 548710 - RNA, 23 nt, Human
cucuacuaaaaauacaaaaaaaa

SEQ ID NO: 548711 - RNA, 11 nt, Human
caacucccugc

SEQ ID NO: 548712 - RNA, 15 nt, Human
aaagaaagaaaauca

SEQ ID NO: 548713 - RNA, 23 nt, Human
caaaagcgauuauuauuuuagag

SEQ ID NO: 548714 - RNA, 14 nt, Human
aaccugagccccaa

SEQ ID NO: 548715 - RNA, 20 nt, Human
aaaaaccugagccccaaaag

SEQ ID NO: 548716 - RNA, 20 nt, Human
acaugagguacugagaguga

SEQ ID NO: 548717 - RNA, 15 nt, Human
auccaacuuauauuu

SEQ ID NO: 548718 - RNA, 20 nt, Human
uaagugaaauaagccagaca

SEQ ID NO: 548719 - RNA, 14 nt, Human
cucaccccuugcca

SEQ ID NO: 548720 - RNA, 23 nt, Human
aguacucauacauguuacaacac

SEQ ID NO: 548721 - RNA, 21 nt, Human
cccuauccuacuuccccuucc

SEQ ID NO: 548722 - RNA, 15 nt, Human
uccaccuuacuucuu

SEQ ID NO: 548723 - RNA, 22 nt, Human
aauguagcagcucauaaaugaa

SEQ ID NO: 548724 - RNA, 16 nt, Human
gaaaaugguauuaaag

SEQ ID NO: 548725 - RNA, 15 nt, Human
ccaccuuacuucuuc

SEQ ID NO: 548726 - RNA, 21 nt, Human
ugccuguaaucacagcuacuu

SEQ ID NO: 548727 - RNA, 12 nt, Human
cuaagaagugaa

SEQ ID NO: 548728 - RNA, 20 nt, Human
caaacauccuacaagacaca

SEQ ID NO: 548729 - RNA, 22 nt, Human
gaaauaagccagacaucaacag

SEQ ID NO: 548730 - RNA, 18 nt, Human
ccugccuaagugcagccc

SEQ ID NO: 548731 - RNA, 14 nt, Human
cuggccgggagccu

SEQ ID NO: 548732 - RNA, 16 nt, Human
ugugagaugcuagaac

SEQ ID NO: 548733 - RNA, 18 nt, Human
cugcucaauaaaguacaa

SEQ ID NO: 548734 - RNA, 12 nt, Human
ucaccccuugcc

SEQ ID NO: 548735 - RNA, 14 nt, Human
aucaaaagaaagaa

SEQ ID NO: 548736 - RNA, 15 nt, Human
aaugaauggcuaagc

SEQ ID NO: 548737 - RNA, 15 nt, Human
gaccacugcagaaga

SEQ ID NO: 548738 - RNA, 15 nt, Human
acaagacccaaaagg

SEQ ID NO: 548739 - RNA, 18 nt, Human
cagaaagcagaacaguga

SEQ ID NO: 548740 - RNA, 14 nt, Human
acccgggaggcaga

SEQ ID NO: 548741 - RNA, 20 nt, Human
gccgggcgugguggugagug

SEQ ID NO: 548742 - RNA, 22 nt, Human
ccccuuccuaauuccacagcug

SEQ ID NO: 548743 - RNA, 20 nt, Human
ugagucccaggcugagccuc

SEQ ID NO: 548744 - RNA, 17 nt, Human
auaaaguacaagagcuu

SEQ ID NO: 548745 - RNA, 13 nt, Human
gauuguaaaaugg

SEQ ID NO: 548746 - RNA, 15 nt, Human
acucaccucccccau

SEQ ID NO: 548747 - RNA, 16 nt, Human
ucaaaagaaagaaaau

SEQ ID NO: 548748 - RNA, 18 nt, Human
uggucaauuuuguuaugu

SEQ ID NO: 548749 - RNA, 23 nt, Human
ccccucuggcuccagcuggccgg

SEQ ID NO: 548750 - RNA, 15 nt, Human
uaucaauuuaaaaaa

SEQ ID NO: 548751 - RNA, 20 nt, Human
cccugcacuccagccugagc

SEQ ID NO: 548752 - RNA, 21 nt, Human
ccaagaagauaaucuccaaag

SEQ ID NO: 548753 - RNA, 17 nt, Human
ccuacuuccccuuccua

SEQ ID NO: 548754 - RNA, 18 nt, Human
ucuucaacucccugcccc

SEQ ID NO: 548755 - RNA, 22 nt, Human
gagccucagucucccucccuug

SEQ ID NO: 548756 - RNA, 15 nt, Human
uugacccacaagaaa

SEQ ID NO: 548757 - RNA, 19 nt, Human
cgcccacuagacccacugg

SEQ ID NO: 548758 - RNA, 19 nt, Human
cggccuccauccugaggcu

SEQ ID NO: 548759 - RNA, 23 nt, Human
cucauacuauuuaagagaacaag

SEQ ID NO: 548760 - RNA, 13 nt, Human
aagugcagccccg

SEQ ID NO: 548761 - RNA, 23 nt, Human
aaauuuacagagacagaaagcag

SEQ ID NO: 548762 - RNA, 19 nt, Human
agcucugcccauccugccc

SEQ ID NO: 548763 - RNA, 15 nt, Human
gccucagucucccuc

SEQ ID NO: 548764 - RNA, 18 nt, Human
acagagacagaaagcaga

SEQ ID NO: 548765 - RNA, 20 nt, Human
aaggaugccccgucccccuc

SEQ ID NO: 548766 - RNA, 16 nt, Human
caaauauaaacagcaa

SEQ ID NO: 548767 - RNA, 15 nt, Human
aagaagugaaaaucu

SEQ ID NO: 548768 - RNA, 15 nt, Human
ucaaaggacaccauu

SEQ ID NO: 548769 - RNA, 12 nt, Human
aucguguccccu

SEQ ID NO: 548770 - RNA, 15 nt, Human
uaaaugaaauugaaa

SEQ ID NO: 548771 - RNA, 15 nt, Human
aucaauuuaaaaaaa

SEQ ID NO: 548772 - RNA, 17 nt, Human
cuccuuaucaaaggaca

SEQ ID NO: 548773 - RNA, 18 nt, Human
cccacuggacucaccucc

SEQ ID NO: 548774 - RNA, 16 nt, Human
caugggacagggagga

SEQ ID NO: 548775 - RNA, 23 nt, Human
gccccugcacuccagccugagcg

SEQ ID NO: 548776 - RNA, 21 nt, Human
gcugagucccaggcugagccu

SEQ ID NO: 548777 - RNA, 15 nt, Human
aauauaaacagcaac

SEQ ID NO: 548778 - RNA, 15 nt, Human
cuuacuucuucucau

SEQ ID NO: 548779 - RNA, 22 nt, Human
gagucccaggcugagccucagu

SEQ ID NO: 548780 - RNA, 14 nt, Human
cuucucuucacagu

SEQ ID NO: 548781 - RNA, 15 nt, Human
cccccagcccuccuu

SEQ ID NO: 548782 - RNA, 13 nt, Human
ucuauaacaacaa

SEQ ID NO: 548783 - RNA, 20 nt, Human
auuuaagagaacaagcaaau

SEQ ID NO: 548784 - RNA, 18 nt, Human
gcacuccagccugagcga

SEQ ID NO: 548785 - RNA, 18 nt, Human
ccugcaaagcccagcuug

SEQ ID NO: 548786 - RNA, 20 nt, Human
ugaggcuccacuuggucugu

SEQ ID NO: 548787 - RNA, 12 nt, Human
acaugagguacu

SEQ ID NO: 548788 - RNA, 21 nt, Human
gaagugaaaaucuacacucca

SEQ ID NO: 548789 - RNA, 19 nt, Human
gguuccuuccucugagccu

SEQ ID NO: 548790 - RNA, 22 nt, Human
gucucuacuaaaaauacaaaaa

SEQ ID NO: 548791 - RNA, 19 nt, Human
acuggacucaccuccccca

SEQ ID NO: 548792 - RNA, 15 nt, Human
auuucauucaauauc

SEQ ID NO: 548793 - RNA, 16 nt, Human
cacuggacucaccucc

SEQ ID NO: 548794 - RNA, 23 nt, Human
agcccuccuuaucaaaggacacc

SEQ ID NO: 548795 - RNA, 22 nt, Human
cauacuauuuaagagaacaagc

SEQ ID NO: 548796 - RNA, 16 nt, Human
uguucuauaacaacaa

SEQ ID NO: 548797 - RNA, 16 nt, Human
agugagacagcucugc

SEQ ID NO: 548798 - RNA, 21 nt, Human
gaaauguuuacagauccccaa

SEQ ID NO: 548799 - RNA, 16 nt, Human
cagcuuuccucaaaac

SEQ ID NO: 548800 - RNA, 13 nt, Human
agaaaugaaagca

SEQ ID NO: 548801 - RNA, 17 nt, Human
agcagcucauaaaugaa

SEQ ID NO: 548802 - RNA, 21 nt, Human
caacaacaaaagcgauuauua

SEQ ID NO: 548803 - RNA, 19 nt, Human
cucugcauacucauuagga

SEQ ID NO: 548804 - RNA, 17 nt, Human
ccaaggaugccccgucc

SEQ ID NO: 548805 - RNA, 19 nt, Human
guacaagagcuuaacagug

SEQ ID NO: 548806 - RNA, 21 nt, Human
gucucagugucaaugcagccc

SEQ ID NO: 548807 - RNA, 17 nt, Human
cguaaucguguccccua

SEQ ID NO: 548808 - RNA, 15 nt, Human
ucccccaucucuucu

SEQ ID NO: 548809 - RNA, 16 nt, Human
ccccugcacuccagcc

SEQ ID NO: 548810 - RNA, 16 nt, Human
cugagccucagucucc

SEQ ID NO: 548811 - RNA, 12 nt, Human
aauaaaguacaa

SEQ ID NO: 548812 - RNA, 15 nt, Human
ugguuuagaaagcuu

SEQ ID NO: 548813 - RNA, 22 nt, Human
caucucuucuggguuccuuccu

SEQ ID NO: 548814 - RNA, 16 nt, Human
agcuugaaaccuucac

SEQ ID NO: 548815 - RNA, 17 nt, Human
aggccaugggacaggga

SEQ ID NO: 548816 - RNA, 13 nt, Human
auauaaagcaaga

SEQ ID NO: 548817 - RNA, 20 nt, Human
uaggaauugacccacaagaa

SEQ ID NO: 548818 - RNA, 12 nt, Human
uauaacaacaac

SEQ ID NO: 548819 - RNA, 22 nt, Human
agacucugucucaguccaugaa

SEQ ID NO: 548820 - RNA, 16 nt, Human
cugagcuugcagagau

SEQ ID NO: 548821 - RNA, 16 nt, Human
cuucggccuccauccu

SEQ ID NO: 548822 - RNA, 11 nt, Human
gccaugggaca

SEQ ID NO: 548823 - RNA, 22 nt, Human
cugcucaauaaaguacaagagc

SEQ ID NO: 548824 - RNA, 16 nt, Human
ugaaguacucauacau

SEQ ID NO: 548825 - RNA, 19 nt, Human
cuggacucaccucccccau

SEQ ID NO: 548826 - RNA, 23 nt, Human
ggucucagugucaaugcagcccc

SEQ ID NO: 548827 - RNA, 18 nt, Human
auuugcuggagcucugcc

SEQ ID NO: 548828 - RNA, 22 nt, Human
uaagagaacaagcaaauauaaa

SEQ ID NO: 548829 - RNA, 19 nt, Human
ggagccugaucaccugccc

SEQ ID NO: 548830 - RNA, 18 nt, Human
cagggaggacgcucucug

SEQ ID NO: 548831 - RNA, 22 nt, Human
ggguuccuuccucugagccuug

SEQ ID NO: 548832 - RNA, 18 nt, Human
cagagacagaaagcagaa

SEQ ID NO: 548833 - RNA, 18 nt, Human
cugagccuugggaccccu

SEQ ID NO: 548834 - RNA, 11 nt, Human
cccaacagcuc

SEQ ID NO: 548835 - RNA, 18 nt, Human
cucccuuggggccuaugc

SEQ ID NO: 548836 - RNA, 14 nt, Human
gucccaggcugagc

SEQ ID NO: 548837 - RNA, 22 nt, Human
agcccuccuuaucaaaggacac

SEQ ID NO: 548838 - RNA, 16 nt, Human
cuuuaugcuaagugaa

SEQ ID NO: 548839 - RNA, 24 nt, Human
uggccgggagccugaucaccugcc

SEQ ID NO: 548840 - RNA, 16 nt, Human
ucuuggucucaguguc

SEQ ID NO: 548841 - RNA, 18 nt, Human
caagccucauguccacug

SEQ ID NO: 548842 - RNA, 19 nt, Human
agacucgggauuaguacac

SEQ ID NO: 548843 - RNA, 21 nt, Human
aagagaacaagcaaauauaaa

SEQ ID NO: 548844 - RNA, 20 nt, Human
agcaucucauuuauaaugua

SEQ ID NO: 548845 - RNA, 16 nt, Human
auaucaauuuaaaaaa

SEQ ID NO: 548846 - RNA, 22 nt, Human
aggaugccccgucccccucugg

SEQ ID NO: 548847 - RNA, 23 nt, Human
aaguauccuucagccugaaagag

SEQ ID NO: 548848 - RNA, 20 nt, Human
ucugcaacuacuauccaacu

SEQ ID NO: 548849 - RNA, 14 nt, Human
aauauaaacagcaa

SEQ ID NO: 548850 - RNA, 14 nt, Human
aaaauacaaaaaaa

SEQ ID NO: 548851 - RNA, 15 nt, Human
agccugaaagaggaa

SEQ ID NO: 548852 - RNA, 17 nt, Human
uaucaauuuaaaaaaaa

SEQ ID NO: 548853 - RNA, 20 nt, Human
guaucaaaagaaagaaaauc

SEQ ID NO: 548854 - RNA, 20 nt, Human
cuugccauaauuacuauguc

SEQ ID NO: 548855 - RNA, 18 nt, Human
cagucucccucccuuggg

SEQ ID NO: 548856 - RNA, 22 nt, Human
acaugagguacugagagugaac

SEQ ID NO: 548857 - RNA, 13 nt, Human
acggggugaaacc

SEQ ID NO: 548858 - RNA, 14 nt, Human
uaaauaguuuauga

SEQ ID NO: 548859 - RNA, 19 nt, Human
agaacaagcaaauauaaac

SEQ ID NO: 548860 - RNA, 19 nt, Human
auacuaauuauacccccug

SEQ ID NO: 548861 - RNA, 16 nt, Human
auuccaccuacaugag

SEQ ID NO: 548862 - RNA, 15 nt, Human
cuacaagacacagug

SEQ ID NO: 548863 - RNA, 18 nt, Human
auagaauuaacacaugau

SEQ ID NO: 548864 - RNA, 18 nt, Human
cuacuccauuaaauauaa

SEQ ID NO: 548865 - RNA, 13 nt, Human
acaagaaaugaaa

SEQ ID NO: 548866 - RNA, 22 nt, Human
cacagauuugagcucagcccug

SEQ ID NO: 548867 - RNA, 20 nt, Human
gcccauccugccccugagcc

SEQ ID NO: 548868 - RNA, 21 nt, Human
accaccugccuauauuuuuug

SEQ ID NO: 548869 - RNA, 19 nt, Human
cccacuggacucaccuccc

SEQ ID NO: 548870 - RNA, 19 nt, Human
acuccauuaaauauaaagc

SEQ ID NO: 548871 - RNA, 18 nt, Human
cuccauccugaggcucca

SEQ ID NO: 548872 - RNA, 14 nt, Human
ugagcuugcagaga

SEQ ID NO: 548873 - RNA, 22 nt, Human
ugauaguuguaccgcaauguga

SEQ ID NO: 548874 - RNA, 21 nt, Human
uccauccugaggcuccacuug

SEQ ID NO: 548875 - RNA, 21 nt, Human
cucaaaacuucagacauagaa

SEQ ID NO: 548876 - RNA, 22 nt, Human
cccuauccuacuuccccuuccu

SEQ ID NO: 548877 - RNA, 19 nt, Human
cuucuggguuccuuccucu

SEQ ID NO: 548878 - RNA, 20 nt, Human
acaagacacagugaccauac

SEQ ID NO: 548879 - RNA, 17 nt, Human
ucugugagaugcuagaa

SEQ ID NO: 548880 - RNA, 21 nt, Human
aauuuucauuguucuauaaca

SEQ ID NO: 548881 - RNA, 17 nt, Human
uuacagagacagaaagc

SEQ ID NO: 548882 - RNA, 12 nt, Human
uucagccugaaa

SEQ ID NO: 548883 - RNA, 19 nt, Human
auccuacaagacacaguga

SEQ ID NO: 548884 - RNA, 13 nt, Human
uuaugcuaaguga

SEQ ID NO: 548885 - RNA, 13 nt, Human
aaaugaaagcagg

SEQ ID NO: 548886 - RNA, 17 nt, Human
ugaucaccugcccugcu

SEQ ID NO: 548887 - RNA, 15 nt, Human
uugacacuuaaaaau

SEQ ID NO: 548888 - RNA, 14 nt, Human
gcugauuaaaccaa

SEQ ID NO: 548889 - RNA, 18 nt, Human
auccccaagccuggcaag

SEQ ID NO: 548890 - RNA, 13 nt, Human
agacagcucugca

SEQ ID NO: 548891 - RNA, 13 nt, Human
agagguccacaac

SEQ ID NO: 548892 - RNA, 20 nt, Human
ggagccugaucaccugcccu

SEQ ID NO: 548893 - RNA, 17 nt, Human
cugagcgacagugagac

SEQ ID NO: 548894 - RNA, 14 nt, Human
uugcuggagcucug

SEQ ID NO: 548895 - RNA, 18 nt, Human
gccccugcacuccagccu

SEQ ID NO: 548896 - RNA, 21 nt, Human
auggcagcuuuccucaaaacu

SEQ ID NO: 548897 - RNA, 18 nt, Human
uuuguuaaaugauuucau

SEQ ID NO: 548898 - RNA, 12 nt, Human
cucccugccccc

SEQ ID NO: 548899 - RNA, 16 nt, Human
ccugagcgacagugag

SEQ ID NO: 548900 - RNA, 22 nt, Human
ccauacuaauuauacccccugc

SEQ ID NO: 548901 - RNA, 18 nt, Human
ccucuggcuccagcuggc

SEQ ID NO: 548902 - RNA, 12 nt, Human
gguauuuuaauc

SEQ ID NO: 548903 - RNA, 22 nt, Human
aauuuaaaaaaaaaccugagcc

SEQ ID NO: 548904 - RNA, 13 nt, Human
aagcaaauauaaa

SEQ ID NO: 548905 - RNA, 14 nt, Human
cacaagaaaugaaa

SEQ ID NO: 548906 - RNA, 16 nt, Human
cacgggggccaaggau

SEQ ID NO: 548907 - RNA, 14 nt, Human
cacaacacacagau

SEQ ID NO: 548908 - RNA, 16 nt, Human
cuggccuucggccucc

SEQ ID NO: 548909 - RNA, 13 nt, Human
uacagagacagaa

SEQ ID NO: 548910 - RNA, 15 nt, Human
ccugccccccagccc

SEQ ID NO: 548911 - RNA, 18 nt, Human
cccucuggcuccagcugg

SEQ ID NO: 548912 - RNA, 15 nt, Human
gacucaccuccccca

SEQ ID NO: 548913 - RNA, 16 nt, Human
gaaucacuugaacccg

SEQ ID NO: 548914 - RNA, 20 nt, Human
ccagcuugaaaccuucacuu

SEQ ID NO: 548915 - RNA, 11 nt, Human
ucaccuccccc

SEQ ID NO: 548916 - RNA, 19 nt, Human
ugagcgcccacuagaccca

SEQ ID NO: 548917 - RNA, 18 nt, Human
gacccacuggacucaccu

SEQ ID NO: 548918 - RNA, 14 nt, Human
gcaagauaauaaaa

SEQ ID NO: 548919 - RNA, 14 nt, Human
gccucagucucccu

SEQ ID NO: 548920 - RNA, 12 nt, Human
uaguacacacuu

SEQ ID NO: 548921 - RNA, 14 nt, Human
cugaggcuccacuu

SEQ ID NO: 548922 - RNA, 16 nt, Human
ccuacaugagguacug

SEQ ID NO: 548923 - RNA, 21 nt, Human
cccccauuguggucacaggaa

SEQ ID NO: 548924 - RNA, 19 nt, Human
gagguacugagagugaaca

SEQ ID NO: 548925 - RNA, 21 nt, Human
acuccauuaaauauaaagcaa

SEQ ID NO: 548926 - RNA, 21 nt, Human
uccuucagccugaaagaggaa

SEQ ID NO: 548927 - RNA, 16 nt, Human
cuagaaccaccugccu

SEQ ID NO: 548928 - RNA, 14 nt, Human
caaaguuaagaauc

SEQ ID NO: 548929 - RNA, 17 nt, Human
agucccaggcugagccu

SEQ ID NO: 548930 - RNA, 12 nt, Human
gucccaggcuga

SEQ ID NO: 548931 - RNA, 15 nt, Human
gcccacuagacccac

SEQ ID NO: 548932 - RNA, 19 nt, Human
caagaagauaaucuccaaa

SEQ ID NO: 548933 - RNA, 21 nt, Human
caaagcccagcuugaaaccuu

SEQ ID NO: 548934 - RNA, 17 nt, Human
gugccuguaaucacagc

SEQ ID NO: 548935 - RNA, 18 nt, Human
cagcugcucaauaaagua

SEQ ID NO: 548936 - RNA, 18 nt, Human
uaucaaaagaaagaaaau

SEQ ID NO: 548937 - RNA, 15 nt, Human
aaaauacaaaaaaaa

SEQ ID NO: 548938 - RNA, 14 nt, Human
ccagcuggccggga

SEQ ID NO: 548939 - RNA, 15 nt, Human
ucugucucaguccau

SEQ ID NO: 548940 - RNA, 15 nt, Human
cauguccacugguuc

SEQ ID NO: 548941 - RNA, 21 nt, Human
aauuuacagagacagaaagca

SEQ ID NO: 548942 - RNA, 16 nt, Human
ucagucucccucccuu

SEQ ID NO: 548943 - RNA, 17 nt, Human
caccucccccaucucuu

SEQ ID NO: 548944 - RNA, 16 nt, Human
uuaagagaacaagcaa

SEQ ID NO: 548945 - RNA, 16 nt, Human
acagagacagaaagca

SEQ ID NO: 548946 - RNA, 21 nt, Human
cuaguaucaaaagaaagaaaa

SEQ ID NO: 548947 - RNA, 11 nt, Human
ccugagcccca

SEQ ID NO: 548948 - RNA, 15 nt, Human
cugcagauaaacagu

SEQ ID NO: 548949 - RNA, 19 nt, Human
cuccagcuggccgggagcc

SEQ ID NO: 548950 - RNA, 19 nt, Human
acucugucucaguccauga

SEQ ID NO: 548951 - RNA, 16 nt, Human
ugcaacuacuauccaa

SEQ ID NO: 548952 - RNA, 18 nt, Human
uuuuauaucaauuuaaaa

SEQ ID NO: 548953 - RNA, 21 nt, Human
acgcucucuggccuucggccu

SEQ ID NO: 548954 - RNA, 16 nt, Human
cccacuggacucaccu

SEQ ID NO: 548955 - RNA, 22 nt, Human
aacucccugccccccagcccuc

SEQ ID NO: 548956 - RNA, 19 nt, Human
ccccuauccuacuuccccu

SEQ ID NO: 548957 - RNA, 19 nt, Human
acagugauuaccagggacu

SEQ ID NO: 548958 - RNA, 17 nt, Human
cugcacuccagccugag

SEQ ID NO: 548959 - RNA, 22 nt, Human
gaacaagcaaauauaaacagca

SEQ ID NO: 548960 - RNA, 13 nt, Human
ccugccccccagc

SEQ ID NO: 548961 - RNA, 12 nt, Human
acaagacacagu

SEQ ID NO: 548962 - RNA, 14 nt, Human
uaacaacaacaaca

SEQ ID NO: 548963 - RNA, 18 nt, Human
agcaaauauaaacagcaa

SEQ ID NO: 548964 - RNA, 13 nt, Human
uccuacuuccccu

SEQ ID NO: 548965 - RNA, 20 nt, Human
cacagcacgggggccaagga

SEQ ID NO: 548966 - RNA, 16 nt, Human
uauguucuaagaagug

SEQ ID NO: 548967 - RNA, 18 nt, Human
uccuaauuccacagcugc

SEQ ID NO: 548968 - RNA, 15 nt, Human
ccucauguccacugg

SEQ ID NO: 548969 - RNA, 22 nt, Human
uucaauaucuuuuuuuuaauaa

SEQ ID NO: 548970 - RNA, 19 nt, Human
gugacuuaaugccacuaaa

SEQ ID NO: 548971 - RNA, 13 nt, Human
augauuccaccua

SEQ ID NO: 548972 - RNA, 16 nt, Human
ugagcucagcccuggu

SEQ ID NO: 548973 - RNA, 15 nt, Human
cucccugccccccag

SEQ ID NO: 548974 - RNA, 11 nt, Human
aauuccacagc

SEQ ID NO: 548975 - RNA, 12 nt, Human
cuauaacaacaa

SEQ ID NO: 548976 - RNA, 23 nt, Human
ugcagagguccacaacacacaga

SEQ ID NO: 548977 - RNA, 14 nt, Human
gcuggagcucugcc

SEQ ID NO: 548978 - RNA, 15 nt, Human
gauccugcaauucca

SEQ ID NO: 548979 - RNA, 20 nt, Human
uugaacccgggaggcagagg

SEQ ID NO: 548980 - RNA, 19 nt, Human
cagaaagcagaacagugau

SEQ ID NO: 548981 - RNA, 14 nt, Human
gagagugaacaaau

SEQ ID NO: 548982 - RNA, 14 nt, Human
gagcccauggcacu

SEQ ID NO: 548983 - RNA, 14 nt, Human
cuccagugagacag

SEQ ID NO: 548984 - RNA, 10 nt, Human
caacucccug

SEQ ID NO: 548985 - RNA, 12 nt, Human
ucugcacacagc

SEQ ID NO: 548986 - RNA, 12 nt, Human
uaauuccacagc

SEQ ID NO: 548987 - RNA, 19 nt, Human
auuaaauauaaagcaagau

SEQ ID NO: 548988 - RNA, 13 nt, Human
ccacaacacacag

SEQ ID NO: 548989 - RNA, 21 nt, Human
accaaggagccaaacauccua

SEQ ID NO: 548990 - RNA, 15 nt, Human
ugggacagggaggac

SEQ ID NO: 548991 - RNA, 19 nt, Human
cugcaaagcccagcuugaa

SEQ ID NO: 548992 - RNA, 20 nt, Human
ucaaaacuucagacauagaa

SEQ ID NO: 548993 - RNA, 13 nt, Human
aucuacacuccag

SEQ ID NO: 548994 - RNA, 14 nt, Human
ggccuucggccucc

SEQ ID NO: 548995 - RNA, 13 nt, Human
ucucccucccuug

SEQ ID NO: 548996 - RNA, 19 nt, Human
accccugagcuugcagaga

SEQ ID NO: 548997 - RNA, 17 nt, Human
cuuucccaacagcucca

SEQ ID NO: 548998 - RNA, 22 nt, Human
ccgggaggcagagguugcagug

SEQ ID NO: 548999 - RNA, 19 nt, Human
cugccccccagcccuccuu

SEQ ID NO: 549000 - RNA, 15 nt, Human
aagugaaaaucuaca

SEQ ID NO: 549001 - RNA, 16 nt, Human
ucaucaaugaaugaau

SEQ ID NO: 549002 - RNA, 15 nt, Human
ggccuccauccugag

SEQ ID NO: 549003 - RNA, 16 nt, Human
ccucagucucccuccc

SEQ ID NO: 549004 - RNA, 15 nt, Human
cuucucuucacaguc

SEQ ID NO: 549005 - RNA, 19 nt, Human
ccgggcgugguggugagug

SEQ ID NO: 549006 - RNA, 16 nt, Human
ccugcaaagcccagcu

SEQ ID NO: 549007 - RNA, 22 nt, Human
ccaaacauccuacaagacacag

SEQ ID NO: 549008 - RNA, 17 nt, Human
acccacuggacucaccu

SEQ ID NO: 549009 - RNA, 20 nt, Human
uccagccugagcgacaguga

SEQ ID NO: 549010 - RNA, 16 nt, Human
uguucuaagaagugaa

SEQ ID NO: 549011 - RNA, 16 nt, Human
aauugacccacaagaa

SEQ ID NO: 549012 - RNA, 14 nt, Human
agcaaauauaaaca

SEQ ID NO: 549013 - RNA, 18 nt, Human
ccauccugccccugagcc

SEQ ID NO: 549014 - RNA, 15 nt, Human
ugauuucauucaaua

SEQ ID NO: 549015 - RNA, 23 nt, Human
cgauuauuauuuuagagcaucuc

SEQ ID NO: 549016 - RNA, 21 nt, Human
gcccauccugccccugagccc

SEQ ID NO: 549017 - RNA, 17 nt, Human
cuaacaggaauuuucau

SEQ ID NO: 549018 - RNA, 19 nt, Human
acgaugggcuuucccaaca

SEQ ID NO: 549019 - RNA, 18 nt, Human
ugccauaauuacuauguc

SEQ ID NO: 549020 - RNA, 18 nt, Human
acagaaagcagaacagug

SEQ ID NO: 549021 - RNA, 10 nt, Human
ccugagcccc

SEQ ID NO: 549022 - RNA, 14 nt, Human
cucccuuggggccu

SEQ ID NO: 549023 - RNA, 19 nt, Human
ccugccuaagugcagcccc

SEQ ID NO: 549024 - RNA, 20 nt, Human
cuucaacucccugcccccca

SEQ ID NO: 549025 - RNA, 18 nt, Human
ggaggacgcucucuggcc

SEQ ID NO: 549026 - RNA, 14 nt, Human
uuaaagaucugcaa

SEQ ID NO: 549027 - RNA, 13 nt, Human
cgggaggcagagg

SEQ ID NO: 549028 - RNA, 21 nt, Human
cgacagugagacucugucuca

SEQ ID NO: 549029 - RNA, 22 nt, Human
cuacuauccaacuuauauuucu

SEQ ID NO: 549030 - RNA, 17 nt, Human
acuugaacccauauuug

SEQ ID NO: 549031 - RNA, 20 nt, Human
gauugugccccugcacucca

SEQ ID NO: 549032 - RNA, 13 nt, Human
acaagagcuuaac

SEQ ID NO: 549033 - RNA, 12 nt, Human
acagagacagaa

SEQ ID NO: 549034 - RNA, 16 nt, Human
cugagcgacagugaga

SEQ ID NO: 549035 - RNA, 14 nt, Human
cuacaagacacagu

SEQ ID NO: 549036 - RNA, 23 nt, Chlamydophila pneumoniae TW-183
uugauuaggaacaagucggcagg

SEQ ID NO: 549037 - RNA, 19 nt, Chlamydophila pneumoniae TW-183
uuuccuugguaucccaauc

SEQ ID NO: 549038 - RNA, 23 nt, Chlamydophila pneumoniae TW-183
uuguaaaaauggcacuugagcac

SEQ ID NO: 549039 - RNA, 14 nt, Chlamydophila pneumoniae TW-183
uuuucaagucugua

SEQ ID NO: 549040 - RNA, 13 nt, Chlamydophila pneumoniae TW-183
uuuuucucuugcu

SEQ ID NO: 549041 - RNA, 15 nt, Chlamydophila pneumoniae TW-183
uuagagguuuuugua

SEQ ID NO: 549042 - RNA, 18 nt, Chlamydophila pneumoniae TW-183
uguuaacaaguaccaaga

SEQ ID NO: 549043 - RNA, 20 nt, Chlamydophila pneumoniae TW-183
uggaucuagagaagaaaaga

SEQ ID NO: 549044 - RNA, 14 nt, Chlamydophila pneumoniae TW-183
ugcgcgucuccuug

SEQ ID NO: 549045 - RNA, 14 nt, Chlamydophila pneumoniae TW-183
ugcaaucucaaaau

SEQ ID NO: 549046 - RNA, 13 nt, Chlamydophila pneumoniae TW-183
ugaucugaaguug

SEQ ID NO: 549047 - RNA, 14 nt, Chlamydophila pneumoniae TW-183
ugaauaucaucacu

SEQ ID NO: 549048 - RNA, 16 nt, Chlamydophila pneumoniae TW-183
ugaaauugcucuugcu

SEQ ID NO: 549049 - RNA, 15 nt, Chlamydophila pneumoniae TW-183
ucuccccauucacaa

SEQ ID NO: 549050 - RNA, 16 nt, Chlamydophila pneumoniae TW-183
ucuuuuaacuuaaaga

SEQ ID NO: 549051 - RNA, 23 nt, Chlamydophila pneumoniae TW-183
ucuaagcugugcauuuucuucuu

SEQ ID NO: 549052 - RNA, 19 nt, Chlamydophila pneumoniae TW-183
ucuauauuuuuucccacaa

SEQ ID NO: 549053 - RNA, 20 nt, Chlamydophila pneumoniae TW-183
ucuauaagauagcucuugcg

SEQ ID NO: 549054 - RNA, 16 nt, Chlamydophila pneumoniae TW-183
ucucaucagcaaaacu

SEQ ID NO: 549055 - RNA, 13 nt, Chlamydophila pneumoniae TW-183
ucuccaacuaaac

SEQ ID NO: 549056 - RNA, 11 nt, Chlamydophila pneumoniae TW-183
uccccuaaaaa

SEQ ID NO: 549057 - RNA, 14 nt, Chlamydophila pneumoniae TW-183
uccccauucacaaa

SEQ ID NO: 549058 - RNA, 23 nt, Chlamydophila pneumoniae TW-183
uccacgaguucgcggaucuucuu

SEQ ID NO: 549059 - RNA, 14 nt, Chlamydophila pneumoniae TW-183
ucaccugagcuaua

SEQ ID NO: 549060 - RNA, 20 nt, Chlamydophila pneumoniae TW-183
ucacacuuaaagguaaaacu

SEQ ID NO: 549061 - RNA, 22 nt, Chlamydophila pneumoniae TW-183
ucaccagaagcaacuaaacucu

SEQ ID NO: 549062 - RNA, 17 nt, Chlamydophila pneumoniae TW-183
ucaaacaucacucagga

SEQ ID NO: 549063 - RNA, 23 nt, Chlamydophila pneumoniae TW-183
uaugccucaggucugcugaggag

SEQ ID NO: 549064 - RNA, 18 nt, Chlamydophila pneumoniae TW-183
uagccauuccauggauau

SEQ ID NO: 549065 - RNA, 19 nt, Chlamydophila pneumoniae TW-183
uacccuuccggggugcgac

SEQ ID NO: 549066 - RNA, 22 nt, Chlamydophila pneumoniae TW-183
uaauccuccucgaauggagugc

SEQ ID NO: 549067 - RNA, 14 nt, Chlamydophila pneumoniae TW-183
uaaucauaaaaaaa

SEQ ID NO: 549068 - RNA, 18 nt, Chlamydophila pneumoniae TW-183
uacagaugcaugauccua

SEQ ID NO: 549069 - RNA, 16 nt, Chlamydophila pneumoniae TW-183
uaaaacacaaauagca

SEQ ID NO: 549070 - RNA, 16 nt, Chlamydophila pneumoniae TW-183
uaaaacaaaaucaaaa

SEQ ID NO: 549071 - RNA, 16 nt, Chlamydophila pneumoniae TW-183
uaaaaacuauccuauu

SEQ ID NO: 549072 - RNA, 20 nt, Chlamydophila pneumoniae TW-183
uaaacuaaaaugguaaaccu

SEQ ID NO: 549073 - RNA, 15 nt, Chlamydophila pneumoniae TW-183
uaaagagaaucuccu

SEQ ID NO: 549074 - RNA, 13 nt, Chlamydophila pneumoniae TW-183
uaaaguaggaauu

SEQ ID NO: 549075 - RNA, 14 nt, Chlamydophila pneumoniae TW-183
guuccauagaguau

SEQ ID NO: 549076 - RNA, 13 nt, Chlamydophila pneumoniae TW-183
guguugaauaaga

SEQ ID NO: 549077 - RNA, 12 nt, Chlamydophila pneumoniae TW-183
guuaaagagcau

SEQ ID NO: 549078 - RNA, 15 nt, Chlamydophila pneumoniae TW-183
guaccacauacucuu

SEQ ID NO: 549079 - RNA, 20 nt, Chlamydophila pneumoniae TW-183
gggaucacagucuuaaaucc

SEQ ID NO: 549080 - RNA, 21 nt, Chlamydophila pneumoniae TW-183
ggagaccuuuauagauaugcc

SEQ ID NO: 549081 - RNA, 14 nt, Chlamydophila pneumoniae TW-183
ggauguugcguuag

SEQ ID NO: 549082 - RNA, 19 nt, Chlamydophila pneumoniae TW-183
gcuguggaauuuuccugag

SEQ ID NO: 549083 - RNA, 22 nt, Chlamydophila pneumoniae TW-183
gcuguaaucgagagaagaaauu

SEQ ID NO: 549084 - RNA, 16 nt, Chlamydophila pneumoniae TW-183
uucguggagugcucua

SEQ ID NO: 549085 - RNA, 21 nt, Chlamydophila pneumoniae TW-183
uuagucccgccguaugcauca

SEQ ID NO: 549086 - RNA, 22 nt, Chlamydophila pneumoniae TW-183
uuaaaucguacuucacuucuga

SEQ ID NO: 549087 - RNA, 23 nt, Chlamydophila pneumoniae TW-183
ugugauaccuccuccaaucugcu

SEQ ID NO: 549088 - RNA, 14 nt, Chlamydophila pneumoniae TW-183
uguggaauuuuccu

SEQ ID NO: 549089 - RNA, 17 nt, Chlamydophila pneumoniae TW-183
ugugcauuuucuucuug

SEQ ID NO: 549090 - RNA, 16 nt, Chlamydophila pneumoniae TW-183
uuuacaauuagagauu

SEQ ID NO: 549091 - RNA, 12 nt, Chlamydophila pneumoniae TW-183
uuuaccauagaa

SEQ ID NO: 549092 - RNA, 21 nt, Chlamydophila pneumoniae TW-183
uuuccggggagaacuucaaca

SEQ ID NO: 549093 - RNA, 14 nt, Chlamydophila pneumoniae TW-183
uugcaugaggagac

SEQ ID NO: 549094 - RNA, 18 nt, Chlamydophila pneumoniae TW-183
uucuucaucuucuaaauc

SEQ ID NO: 549095 - RNA, 13 nt, Chlamydophila pneumoniae TW-183
uggaauuuuccug

SEQ ID NO: 549096 - RNA, 17 nt, Chlamydophila pneumoniae TW-183
ugcggcucucuucauug

SEQ ID NO: 549097 - RNA, 19 nt, Chlamydophila pneumoniae TW-183
aauagcaagagcuauaccu

SEQ ID NO: 549098 - RNA, 11 nt, Chlamydophila pneumoniae TW-183
acgcagagaug

SEQ ID NO: 549099 - RNA, 12 nt, Chlamydophila pneumoniae TW-183
accuucaaugau

SEQ ID NO: 549100 - RNA, 14 nt, Chlamydophila pneumoniae TW-183
accucgaauuccuc

SEQ ID NO: 549101 - RNA, 22 nt, Chlamydophila pneumoniae TW-183
acaucucuuuaacuucuaaaag

SEQ ID NO: 549102 - RNA, 12 nt, Chlamydophila pneumoniae TW-183
acaucucuuuaa

SEQ ID NO: 549103 - RNA, 21 nt, Chlamydophila pneumoniae TW-183
aauguugggaugaucucguag

SEQ ID NO: 549104 - RNA, 17 nt, Chlamydophila pneumoniae TW-183
ugcacucuuucagaaag

SEQ ID NO: 549105 - RNA, 23 nt, Chlamydophila pneumoniae TW-183
ucuuugaagcucgaccucuagcu

SEQ ID NO: 549106 - RNA, 16 nt, Chlamydophila pneumoniae TW-183
ucuuucuaagaagacu

SEQ ID NO: 549107 - RNA, 16 nt, Chlamydophila pneumoniae TW-183
ucuuucugcucuucua

SEQ ID NO: 549108 - RNA, 15 nt, Chlamydophila pneumoniae TW-183
ucuuucugcucuucu

SEQ ID NO: 549109 - RNA, 18 nt, Chlamydophila pneumoniae TW-183
ucuucucugcuauagcuu

SEQ ID NO: 549110 - RNA, 17 nt, Chlamydophila pneumoniae TW-183
ucuucuaaaaucuucuc

SEQ ID NO: 549111 - RNA, 14 nt, Chlamydophila pneumoniae TW-183
ucuuagcuccugua

SEQ ID NO: 549112 - RNA, 16 nt, Chlamydophila pneumoniae TW-183
ucugauccgaaaagaa

SEQ ID NO: 549113 - RNA, 18 nt, Chlamydophila pneumoniae TW-183
ucucuucauugcaaaaau

SEQ ID NO: 549114 - RNA, 15 nt, Chlamydophila pneumoniae TW-183
ucuccaaaagcucua

SEQ ID NO: 549115 - RNA, 23 nt, Chlamydophila pneumoniae TW-183
ucucauuccagcaucuucucgaa

SEQ ID NO: 549116 - RNA, 16 nt, Chlamydophila pneumoniae TW-183
ucucaugcauaggcuu

SEQ ID NO: 549117 - RNA, 14 nt, Chlamydophila pneumoniae TW-183
ucucacauuugcag

SEQ ID NO: 549118 - RNA, 17 nt, Chlamydophila pneumoniae TW-183
ucguagcaggcaucacu

SEQ ID NO: 549119 - RNA, 11 nt, Chlamydophila pneumoniae TW-183
ucgaaccacug

SEQ ID NO: 549120 - RNA, 17 nt, Chlamydophila pneumoniae TW-183
uccggggagaacuucaa

SEQ ID NO: 549121 - RNA, 21 nt, Chlamydophila pneumoniae TW-183
uccacgaguucgcggaucuuc

SEQ ID NO: 549122 - RNA, 16 nt, Chlamydophila pneumoniae TW-183
uaucaaccauaaagaa

SEQ ID NO: 549123 - RNA, 22 nt, Chlamydophila pneumoniae TW-183
aaguugaaaugagugagaaugc

SEQ ID NO: 549124 - RNA, 16 nt, Chlamydophila pneumoniae TW-183
uaauggcuccuacucc

SEQ ID NO: 549125 - RNA, 15 nt, Chlamydophila pneumoniae TW-183
uaaggacaaaucucc

SEQ ID NO: 549126 - RNA, 20 nt, Chlamydophila pneumoniae TW-183
uaagcaagcaacugauguuu

SEQ ID NO: 549127 - RNA, 13 nt, Chlamydophila pneumoniae TW-183
uaagaauggaugu

SEQ ID NO: 549128 - RNA, 22 nt, Chlamydophila pneumoniae TW-183
uaacgaagugaggagaauagca

SEQ ID NO: 549129 - RNA, 20 nt, Chlamydophila pneumoniae TW-183
uaaaagaacauuaagaggaa

SEQ ID NO: 549130 - RNA, 13 nt, Chlamydophila pneumoniae TW-183
uaaccuccucuuc

SEQ ID NO: 549131 - RNA, 18 nt, Chlamydophila pneumoniae TW-183
guuguugauaauuacaga

SEQ ID NO: 549132 - RNA, 18 nt, Chlamydophila pneumoniae TW-183
agaccugccaagauacua

SEQ ID NO: 549133 - RNA, 21 nt, Chlamydophila pneumoniae TW-183
agaauguaugugaaagauuau

SEQ ID NO: 549134 - RNA, 19 nt, Chlamydophila pneumoniae TW-183
agaauaccuucaacaagaa

SEQ ID NO: 549135 - RNA, 18 nt, Chlamydophila pneumoniae TW-183
agcaagauucuucagaau

SEQ ID NO: 549136 - RNA, 22 nt, Chlamydophila pneumoniae TW-183
agcaaggcugccagagauucuu

SEQ ID NO: 549137 - RNA, 16 nt, Chlamydophila pneumoniae TW-183
agcaggcaucacuaau

SEQ ID NO: 549138 - RNA, 22 nt, Chlamydophila pneumoniae TW-183
auaucgaguucuuuuugcagau

SEQ ID NO: 549139 - RNA, 17 nt, Chlamydophila pneumoniae TW-183
auaggcuuuaccauaga

SEQ ID NO: 549140 - RNA, 18 nt, Chlamydophila pneumoniae TW-183
auagaaaacauagagauu

SEQ ID NO: 549141 - RNA, 20 nt, Chlamydophila pneumoniae TW-183
auaaguuuugauuuugcagu

SEQ ID NO: 549142 - RNA, 11 nt, Chlamydophila pneumoniae TW-183
auaaguucuuc

SEQ ID NO: 549143 - RNA, 19 nt, Chlamydophila pneumoniae TW-183
auaagugacuuuucuucuu

SEQ ID NO: 549144 - RNA, 15 nt, Chlamydophila pneumoniae TW-183
auaaccaaaagaauu

SEQ ID NO: 549145 - RNA, 21 nt, Chlamydophila pneumoniae TW-183
aggagauaaagauguagaaua

SEQ ID NO: 549146 - RNA, 19 nt, Chlamydophila pneumoniae TW-183
aggaaauuacaaucucuag

SEQ ID NO: 549147 - RNA, 16 nt, Chlamydophila pneumoniae TW-183
caauuccccuucauca

SEQ ID NO: 549148 - RNA, 18 nt, Chlamydophila pneumoniae TW-183
caacuucuccaacuaaac

SEQ ID NO: 549149 - RNA, 17 nt, Chlamydophila pneumoniae TW-183
caacuuuguuaauagaa

SEQ ID NO: 549150 - RNA, 22 nt, Chlamydophila pneumoniae TW-183
caacaguucgacaaccaaaaca

SEQ ID NO: 549151 - RNA, 19 nt, Chlamydophila pneumoniae TW-183
auuucuucuucuauacgaa

SEQ ID NO: 549152 - RNA, 14 nt, Chlamydophila pneumoniae TW-183
auuccagcaucuuc

SEQ ID NO: 549153 - RNA, 15 nt, Chlamydophila pneumoniae TW-183
auucacaaaucuucc

SEQ ID NO: 549154 - RNA, 19 nt, Chlamydophila pneumoniae TW-183
auguuucuaagcugaaaga

SEQ ID NO: 549155 - RNA, 16 nt, Chlamydophila pneumoniae TW-183
auuaagaggaaagcau

SEQ ID NO: 549156 - RNA, 16 nt, Chlamydophila pneumoniae TW-183
augaucuuagcuccug

SEQ ID NO: 549157 - RNA, 19 nt, Chlamydophila pneumoniae TW-183
augauuucuuuagcuuuau

SEQ ID NO: 549158 - RNA, 15 nt, Chlamydophila pneumoniae TW-183
aucucuuuaaauguu

SEQ ID NO: 549159 - RNA, 21 nt, Chlamydophila pneumoniae TW-183
aucccgccuuucuacccuucc

SEQ ID NO: 549160 - RNA, 23 nt, Chlamydophila pneumoniae TW-183
aucagcuucuugauguacaguaa

SEQ ID NO: 549161 - RNA, 16 nt, Chlamydophila pneumoniae TW-183
cauuuucuucuugcaa

SEQ ID NO: 549162 - RNA, 15 nt, Chlamydophila pneumoniae TW-183
caucacuuauauuuu

SEQ ID NO: 549163 - RNA, 16 nt, Chlamydophila pneumoniae TW-183
caucagaagccaccaa

SEQ ID NO: 549164 - RNA, 20 nt, Chlamydophila pneumoniae TW-183
caggcaucacuaaucucagg

SEQ ID NO: 549165 - RNA, 21 nt, Chlamydophila pneumoniae TW-183
cagcauuuucucugagcagcu

SEQ ID NO: 549166 - RNA, 20 nt, Chlamydophila pneumoniae TW-183
ccuaccucugggaagacucu

SEQ ID NO: 549167 - RNA, 15 nt, Chlamydophila pneumoniae TW-183
gcacaaacuaacaua

SEQ ID NO: 549168 - RNA, 16 nt, Chlamydophila pneumoniae TW-183
gauuggaucuagagaa

SEQ ID NO: 549169 - RNA, 15 nt, Chlamydophila pneumoniae TW-183
gauguugcccuacaa

SEQ ID NO: 549170 - RNA, 14 nt, Chlamydophila pneumoniae TW-183
gaugccaagaaaua

SEQ ID NO: 549171 - RNA, 23 nt, Chlamydophila pneumoniae TW-183
gaguagccccagcaacccgaauu

SEQ ID NO: 549172 - RNA, 17 nt, Chlamydophila pneumoniae TW-183
gaagcaacuaaacucuc

SEQ ID NO: 549173 - RNA, 16 nt, Chlamydophila pneumoniae TW-183
gaaaccagaacacaug

SEQ ID NO: 549174 - RNA, 18 nt, Chlamydophila pneumoniae TW-183
gaaaaauaucggaagaga

SEQ ID NO: 549175 - RNA, 21 nt, Chlamydophila pneumoniae TW-183
gaaaaagccuaugggaggaau

SEQ ID NO: 549176 - RNA, 14 nt, Chlamydophila pneumoniae TW-183
cuuugggauaaaaa

SEQ ID NO: 549177 - RNA, 23 nt, Chlamydophila pneumoniae TW-183
cuuugcgcuuguucuuuucauca

SEQ ID NO: 549178 - RNA, 23 nt, Chlamydophila pneumoniae TW-183
cuugauguacaguaaaguaugca

SEQ ID NO: 549179 - RNA, 22 nt, Chlamydophila pneumoniae TW-183
cuugauguaaucccagauuuuu

SEQ ID NO: 549180 - RNA, 23 nt, Chlamydophila pneumoniae TW-183
cuucuuuuauauuaagaauggau

SEQ ID NO: 549181 - RNA, 22 nt, Chlamydophila pneumoniae TW-183
cuuacggccccuggaauuucuc

SEQ ID NO: 549182 - RNA, 18 nt, Chlamydophila pneumoniae TW-183
cuuaagaguuuuacauca

SEQ ID NO: 549183 - RNA, 19 nt, Chlamydophila pneumoniae TW-183
cugcucuucuauguguucu

SEQ ID NO: 549184 - RNA, 13 nt, Chlamydophila pneumoniae TW-183
cugcuuuuguugu

SEQ ID NO: 549185 - RNA, 12 nt, Chlamydophila pneumoniae TW-183
cugaagauuuuu

SEQ ID NO: 549186 - RNA, 12 nt, Chlamydophila pneumoniae TW-183
cugagagaagca

SEQ ID NO: 549187 - RNA, 12 nt, Chlamydophila pneumoniae TW-183
cucgaauuccuc

SEQ ID NO: 549188 - RNA, 22 nt, Chlamydophila pneumoniae TW-183
cucauaaccuaaggcauggcac

SEQ ID NO: 549189 - RNA, 19 nt, Chlamydophila pneumoniae TW-183
cucaucaaggccuauagau

SEQ ID NO: 549190 - RNA, 17 nt, Chlamydophila pneumoniae TW-183
cuccacgcacuccugga

SEQ ID NO: 549191 - RNA, 23 nt, Chlamydophila pneumoniae TW-183
cuauuuuugaggaacgcacgcca

SEQ ID NO: 549192 - RNA, 21 nt, Chlamydophila pneumoniae TW-183
cuaagcugugcauuuucuucu

SEQ ID NO: 549193 - RNA, 21 nt, Chlamydophila pneumoniae TW-183
cuaaucucaggcauucuucau

SEQ ID NO: 549194 - RNA, 16 nt, Chlamydophila pneumoniae TW-183
cuaggagaaaucacac

SEQ ID NO: 549195 - RNA, 13 nt, Chlamydophila pneumoniae TW-183
cuaaacucuccaa

SEQ ID NO: 549196 - RNA, 17 nt, Chlamydophila pneumoniae TW-183
cuaggguuucuacagga

SEQ ID NO: 549197 - RNA, 14 nt, Chlamydophila pneumoniae TW-183
cuacgauguuuucu

SEQ ID NO: 549198 - RNA, 15 nt, Chlamydophila pneumoniae TW-183
cuaagugauaaggaa

SEQ ID NO: 549199 - RNA, 17 nt, Chlamydophila pneumoniae TW-183
cuaagucguuaacauca

SEQ ID NO: 549200 - RNA, 17 nt, Chlamydophila pneumoniae TW-183
cuaauucucgagcagcu

SEQ ID NO: 549201 - RNA, 12 nt, Chlamydophila pneumoniae TW-183
cucuucugcagc

SEQ ID NO: 549202 - RNA, 20 nt, Chlamydophila pneumoniae TW-183
cucuucuauguguucucgaa

SEQ ID NO: 549203 - RNA, 13 nt, Chlamydophila pneumoniae TW-183
cuccagcauaagg

SEQ ID NO: 549204 - RNA, 14 nt, Chlamydophila pneumoniae TW-183
aacgauuucuucuu

SEQ ID NO: 549205 - RNA, 15 nt, Chlamydophila pneumoniae TW-183
gaaugaagagaguuc

SEQ ID NO: 549206 - RNA, 13 nt, Chlamydophila pneumoniae TW-183
gaacaggaggugu

SEQ ID NO: 549207 - RNA, 19 nt, Chlamydophila pneumoniae TW-183
gaaagagugccaagagcau

SEQ ID NO: 549208 - RNA, 17 nt, Chlamydophila pneumoniae TW-183
cuugcaaaacagcauca

SEQ ID NO: 549209 - RNA, 13 nt, Chlamydophila pneumoniae TW-183
cuuaauuuuuuua

SEQ ID NO: 549210 - RNA, 16 nt, Chlamydophila pneumoniae TW-183
cuucacaaucuaaaua

SEQ ID NO: 549211 - RNA, 17 nt, Chlamydophila pneumoniae TW-183
cuguaauugauguuccu

SEQ ID NO: 549212 - RNA, 16 nt, Chlamydophila pneumoniae TW-183
cuguuccaagagucuu

SEQ ID NO: 549213 - RNA, 22 nt, Chlamydophila pneumoniae TW-183
gagguucgcagaacuucuccaa

SEQ ID NO: 549214 - RNA, 20 nt, Chlamydophila pneumoniae TW-183
gagcuuuuagguagagaauc

SEQ ID NO: 549215 - RNA, 16 nt, Chlamydophila pneumoniae TW-183
gagauucuugaggacc

SEQ ID NO: 549216 - RNA, 15 nt, Chlamydophila pneumoniae TW-183
gagaaguuaagacaa

SEQ ID NO: 549217 - RNA, 17 nt, Chlamydophila pneumoniae TW-183
gagcaugagagucgaaa

SEQ ID NO: 549218 - RNA, 19 nt, Chlamydophila pneumoniae TW-183
aagauccuaauauccauaa

SEQ ID NO: 549219 - RNA, 15 nt, Chlamydophila pneumoniae TW-183
aagcuagucuuucua

SEQ ID NO: 549220 - RNA, 20 nt, Chlamydophila pneumoniae TW-183
aagcugcaaucucaaaauca

SEQ ID NO: 549221 - RNA, 15 nt, Chlamydophila pneumoniae TW-183
gcuaauaagauccaa

SEQ ID NO: 549222 - RNA, 21 nt, Chlamydophila pneumoniae TW-183
guacgucuuucaccaacuccu

SEQ ID NO: 549223 - RNA, 19 nt, Chlamydophila pneumoniae TW-183
guaauuuccauguacaaug

SEQ ID NO: 549224 - RNA, 16 nt, Chlamydophila pneumoniae TW-183
aaguaccaagaaaaua

SEQ ID NO: 549225 - RNA, 18 nt, Chlamydophila pneumoniae TW-183
ggagucucuggaguuuga

SEQ ID NO: 549226 - RNA, 14 nt, Chlamydophila pneumoniae TW-183
aacaagucggcagg

SEQ ID NO: 549227 - RNA, 20 nt, Chlamydophila pneumoniae TW-183
cgacaugcaggccaacucuc

SEQ ID NO: 549228 - RNA, 20 nt, Chlamydophila pneumoniae TW-183
ccuaugucaagaagugcuuu

SEQ ID NO: 549229 - RNA, 15 nt, Chlamydophila pneumoniae TW-183
ccuagagaguucuug

SEQ ID NO: 549230 - RNA, 13 nt, Chlamydophila pneumoniae TW-183
ccguaacugaggc

SEQ ID NO: 549231 - RNA, 14 nt, Chlamydophila pneumoniae TW-183
ccagagauucuuca

SEQ ID NO: 549232 - RNA, 19 nt, Chlamydophila pneumoniae TW-183
ccaaaaauucccauagcau

SEQ ID NO: 549233 - RNA, 18 nt, Chlamydophila pneumoniae TW-183
cauugacuugggauucuu

SEQ ID NO: 549234 - RNA, 19 nt, Chlamydophila pneumoniae TW-183
caguuuucagugcuguuuu

SEQ ID NO: 549235 - RNA, 16 nt, Chlamydophila pneumoniae TW-183
caggagagagaaggcu

SEQ ID NO: 549236 - RNA, 17 nt, Chlamydophila pneumoniae TW-183
caggaaacguucuuuca

SEQ ID NO: 549237 - RNA, 18 nt, Chlamydophila pneumoniae TW-183
cagcaacccgaauuccuc

SEQ ID NO: 549238 - RNA, 14 nt, Chlamydophila pneumoniae TW-183
cagacuuuccucuc

SEQ ID NO: 549239 - RNA, 23 nt, Chlamydophila pneumoniae TW-183
cagaaguuccuacuucugcagga

SEQ ID NO: 549240 - RNA, 21 nt, Chlamydophila pneumoniae TW-183
caaaugccuguacuaucuuuu

SEQ ID NO: 549241 - RNA, 21 nt, Chlamydophila pneumoniae TW-183
caacacgcacaaacuaacaua

SEQ ID NO: 549242 - RNA, 13 nt, Chlamydophila pneumoniae TW-183
caacacgcacaaa

SEQ ID NO: 549243 - RNA, 15 nt, Chlamydophila pneumoniae TW-183
caacccgaauuccuc

SEQ ID NO: 549244 - RNA, 23 nt, Chlamydophila pneumoniae TW-183
cacauacucuucauccugaucuu

SEQ ID NO: 549245 - RNA, 18 nt, Chlamydophila pneumoniae TW-183
caauuuucucaauagugu

SEQ ID NO: 549246 - RNA, 17 nt, Chlamydophila pneumoniae TW-183
auucuugcauagcggca

SEQ ID NO: 549247 - RNA, 22 nt, Chlamydophila pneumoniae TW-183
auguuuguaguguugaauaaga

SEQ ID NO: 549248 - RNA, 18 nt, Chlamydophila pneumoniae TW-183
auguuaagcguauagaau

SEQ ID NO: 549249 - RNA, 14 nt, Chlamydophila pneumoniae TW-183
auuaagaagaagcu

SEQ ID NO: 549250 - RNA, 23 nt, Chlamydophila pneumoniae TW-183
aucgagaaaugcucuucugcagc

SEQ ID NO: 549251 - RNA, 13 nt, Chlamydophila pneumoniae TW-183
aucugguagagaa

SEQ ID NO: 549252 - RNA, 17 nt, Chlamydophila pneumoniae TW-183
aucuaaauaagauuuua

SEQ ID NO: 549253 - RNA, 17 nt, Chlamydophila pneumoniae TW-183
aucuacgauguuuucuu

SEQ ID NO: 549254 - RNA, 16 nt, Chlamydophila pneumoniae TW-183
aucaagagcucguaau

SEQ ID NO: 549255 - RNA, 14 nt, Chlamydophila pneumoniae TW-183
auagcuuugaagag

SEQ ID NO: 549256 - RNA, 23 nt, Chlamydophila pneumoniae TW-183
auacuuuaggaggggggauucug

SEQ ID NO: 549257 - RNA, 20 nt, Chlamydophila pneumoniae TW-183
agugucauacgcagcacgca

SEQ ID NO: 549258 - RNA, 20 nt, Chlamydophila pneumoniae TW-183
aguaaucacuucagcacgaa

SEQ ID NO: 549259 - RNA, 12 nt, Chlamydophila pneumoniae TW-183
agcuggauucug

SEQ ID NO: 549260 - RNA, 18 nt, Chlamydophila pneumoniae TW-183
agcuaucaaccauaaaga

SEQ ID NO: 549261 - RNA, 12 nt, Chlamydophila pneumoniae TW-183
agcgucuucuuu

SEQ ID NO: 549262 - RNA, 22 nt, Chlamydophila pneumoniae TW-183
agcaacuucccgaacagcggca

SEQ ID NO: 549263 - RNA, 23 nt, Chlamydophila pneumoniae TW-183
acuucugaugacguuaauaaaga

SEQ ID NO: 549264 - RNA, 14 nt, Chlamydophila pneumoniae TW-183
acccucaaagaaua

SEQ ID NO: 549265 - RNA, 23 nt, Chlamydophila pneumoniae TW-183
acccaagcuuugcgcuuguucuu

SEQ ID NO: 549266 - RNA, 19 nt, Chlamydophila pneumoniae TW-183
accacuuuagaauuuucuu

SEQ ID NO: 549267 - RNA, 19 nt, Chlamydophila pneumoniae TW-183
accacauacucuucauccu

SEQ ID NO: 549268 - RNA, 23 nt, Chlamydophila pneumoniae TW-183
aagucacggcgaaagcuacagcu

SEQ ID NO: 549269 - RNA, 17 nt, Chlamydophila pneumoniae TW-183
aaguauucgauuccuga

SEQ ID NO: 549270 - RNA, 22 nt, Chlamydophila pneumoniae TW-183
aagagcucguaauccuucuuuc

SEQ ID NO: 549271 - RNA, 13 nt, Chlamydophila pneumoniae TW-183
aagagcucaaaaa

SEQ ID NO: 549272 - RNA, 15 nt, Chlamydophila pneumoniae TW-183
aagaugaauaccaga

SEQ ID NO: 549273 - RNA, 22 nt, Chlamydophila pneumoniae TW-183
aagaucgaucucugugguuccu

SEQ ID NO: 549274 - RNA, 18 nt, Chlamydophila pneumoniae TW-183
aacagcauggacuccaag

SEQ ID NO: 549275 - RNA, 20 nt, Chlamydophila pneumoniae TW-183
aaaguuagguagauagaaau

SEQ ID NO: 549276 - RNA, 23 nt, Chlamydophila pneumoniae TW-183
aaauacguccagccugcaccaga

SEQ ID NO: 549277 - RNA, 22 nt, Chlamydophila pneumoniae TW-183
aaaaauucuagaccugccaaga

SEQ ID NO: 549278 - RNA, 22 nt, Chlamydophila pneumoniae TW-183
aaaaauggcacuugagcacauu

SEQ ID NO: 549279 - RNA, 13 nt, Chlamydophila pneumoniae TW-183
uuuugcugaagau

SEQ ID NO: 549280 - RNA, 21 nt, Chlamydophila pneumoniae TW-183
uuucucggauccuccaagauc

SEQ ID NO: 549281 - RNA, 15 nt, Chlamydophila pneumoniae TW-183
uucuuuucugaagau

SEQ ID NO: 549282 - RNA, 18 nt, Chlamydophila pneumoniae TW-183
uucuuucggugucucuag

SEQ ID NO: 549283 - RNA, 13 nt, Chlamydophila pneumoniae TW-183
uuguuguaacggg

SEQ ID NO: 549284 - RNA, 22 nt, Chlamydophila pneumoniae TW-183
uuuaucuccccauucacaaauc

SEQ ID NO: 549285 - RNA, 13 nt, Chlamydophila pneumoniae TW-183
uuuagcaauugag

SEQ ID NO: 549286 - RNA, 18 nt, Chlamydophila pneumoniae TW-183
uucuucuucggaucugua

SEQ ID NO: 549287 - RNA, 17 nt, Chlamydophila pneumoniae TW-183
uucuauguguucucgaa

SEQ ID NO: 549288 - RNA, 16 nt, Chlamydophila pneumoniae TW-183
uucguagcuucccgua

SEQ ID NO: 549289 - RNA, 19 nt, Chlamydophila pneumoniae TW-183
uucuaaacaauuucaauuc

SEQ ID NO: 549290 - RNA, 18 nt, Chlamydophila pneumoniae TW-183
uucgcugucuagaacacu

SEQ ID NO: 549291 - RNA, 21 nt, Chlamydophila pneumoniae TW-183
uucccagccuugauugaacag

SEQ ID NO: 549292 - RNA, 14 nt, Chlamydophila pneumoniae TW-183
uguagguuuuucca

SEQ ID NO: 549293 - RNA, 22 nt, Chlamydophila pneumoniae TW-183
uguauaugcuuggcaauagcuu

SEQ ID NO: 549294 - RNA, 20 nt, Chlamydophila pneumoniae TW-183
ugcuauuuuccucuauauuu

SEQ ID NO: 549295 - RNA, 15 nt, Chlamydophila pneumoniae TW-183
ugccuuugaucagga

SEQ ID NO: 549296 - RNA, 14 nt, Chlamydophila pneumoniae TW-183
ugauagagaaaaua

SEQ ID NO: 549297 - RNA, 19 nt, Chlamydophila pneumoniae TW-183
ucuucauugcaaaaaugaa

SEQ ID NO: 549298 - RNA, 22 nt, Chlamydophila pneumoniae TW-183
ucuucauugcaaaaaugaaaga

SEQ ID NO: 549299 - RNA, 16 nt, Chlamydophila pneumoniae TW-183
ucuuccaucucuuuaa

SEQ ID NO: 549300 - RNA, 19 nt, Chlamydophila pneumoniae TW-183
ucuuccaucucuuuaaaug

SEQ ID NO: 549301 - RNA, 23 nt, Chlamydophila pneumoniae TW-183
ucuuaugaaguccagacuuuccu

SEQ ID NO: 549302 - RNA, 23 nt, Chlamydophila pneumoniae TW-183
ucuguagguuuuuccaacuucaa

SEQ ID NO: 549303 - RNA, 22 nt, Chlamydophila pneumoniae TW-183
ucucaaggucacagcauuuucu

SEQ ID NO: 549304 - RNA, 23 nt, Chlamydophila pneumoniae TW-183
ucuacgauguuuucuuauccuug

SEQ ID NO: 549305 - RNA, 14 nt, Chlamydophila pneumoniae TW-183
ucuauuuucaggag

SEQ ID NO: 549306 - RNA, 15 nt, Chlamydophila pneumoniae TW-183
ucgcggaucuucuuc

SEQ ID NO: 549307 - RNA, 16 nt, Chlamydophila pneumoniae TW-183
uccuagggagugagga

SEQ ID NO: 549308 - RNA, 18 nt, Chlamydophila pneumoniae TW-183
ucauuccagcaucuucuc

SEQ ID NO: 549309 - RNA, 13 nt, Chlamydophila pneumoniae TW-183
uccaaauucuugc

SEQ ID NO: 549310 - RNA, 15 nt, Chlamydophila pneumoniae TW-183
ucaguuaaagagcau

SEQ ID NO: 549311 - RNA, 13 nt, Chlamydophila pneumoniae TW-183
uauaggauuugca

SEQ ID NO: 549312 - RNA, 22 nt, Chlamydophila pneumoniae TW-183
uauaaagaucgggucuacaaca

SEQ ID NO: 549313 - RNA, 19 nt, Chlamydophila pneumoniae TW-183
uagucaugauuuuucaauc

SEQ ID NO: 549314 - RNA, 19 nt, Chlamydophila pneumoniae TW-183
uaucauggacaagcaaaag

SEQ ID NO: 549315 - RNA, 20 nt, Chlamydophila pneumoniae TW-183
uagaaauucuguagauacua

SEQ ID NO: 549316 - RNA, 12 nt, Chlamydophila pneumoniae TW-183
uacuuccccaaa

SEQ ID NO: 549317 - RNA, 23 nt, Chlamydophila pneumoniae TW-183
uagaaacucgggauucguagcuu

SEQ ID NO: 549318 - RNA, 14 nt, Chlamydophila pneumoniae TW-183
uacuuacaagaaca

SEQ ID NO: 549319 - RNA, 15 nt, Chlamydophila pneumoniae TW-183
uaccuuguuuuccug

SEQ ID NO: 549320 - RNA, 16 nt, Chlamydophila pneumoniae TW-183
uaagacuucuggaagc

SEQ ID NO: 549321 - RNA, 17 nt, Chlamydophila pneumoniae TW-183
uaaggaaauuacaaucu

SEQ ID NO: 549322 - RNA, 14 nt, Chlamydophila pneumoniae TW-183
guuucuaaaacaga

SEQ ID NO: 549323 - RNA, 22 nt, Chlamydophila pneumoniae TW-183
guuuacagaugcaugauccuau

SEQ ID NO: 549324 - RNA, 13 nt, Chlamydophila pneumoniae TW-183
ggagaugccauaa

SEQ ID NO: 549325 - RNA, 18 nt, Chlamydophila pneumoniae TW-183
ggacaacagcaacacucg

SEQ ID NO: 549326 - RNA, 16 nt, Chlamydophila pneumoniae TW-183
gcucuucaauagguaa

SEQ ID NO: 549327 - RNA, 13 nt, Chlamydophila pneumoniae TW-183
gcugaagauuuuu

SEQ ID NO: 549328 - RNA, 21 nt, Chlamydophila pneumoniae TW-183
ucgcaaaaauccgauaagaua

SEQ ID NO: 549329 - RNA, 15 nt, Chlamydophila pneumoniae TW-183
ugaugccaagaaaua

SEQ ID NO: 549330 - RNA, 17 nt, Chlamydophila pneumoniae TW-183
ugauccuugcaaaacag

SEQ ID NO: 549331 - RNA, 16 nt, Chlamydophila pneumoniae TW-183
ugauguugcccuacaa

SEQ ID NO: 549332 - RNA, 17 nt, Chlamydophila pneumoniae TW-183
ugacucuuauugcagaa

SEQ ID NO: 549333 - RNA, 18 nt, Chlamydophila pneumoniae TW-183
ugacacagcuaaucaauc

SEQ ID NO: 549334 - RNA, 17 nt, Chlamydophila pneumoniae TW-183
ugaagggacagucuccu

SEQ ID NO: 549335 - RNA, 15 nt, Chlamydophila pneumoniae TW-183
ucuugauucucuucc

SEQ ID NO: 549336 - RNA, 16 nt, Chlamydophila pneumoniae TW-183
ucuuuagauagcucuu

SEQ ID NO: 549337 - RNA, 12 nt, Chlamydophila pneumoniae TW-183
aauacuuuuccu

SEQ ID NO: 549338 - RNA, 14 nt, Chlamydophila pneumoniae TW-183
ucugggaagacucu

SEQ ID NO: 549339 - RNA, 13 nt, Chlamydophila pneumoniae TW-183
ucuccuggaacag

SEQ ID NO: 549340 - RNA, 18 nt, Chlamydophila pneumoniae TW-183
ucuaaggacaaaucuccc

SEQ ID NO: 549341 - RNA, 16 nt, Chlamydophila pneumoniae TW-183
ucuacgcgcucuucuu

SEQ ID NO: 549342 - RNA, 16 nt, Chlamydophila pneumoniae TW-183
ucguuuccgaucauuu

SEQ ID NO: 549343 - RNA, 17 nt, Chlamydophila pneumoniae TW-183
uccauucugagaaagaa

SEQ ID NO: 549344 - RNA, 16 nt, Chlamydophila pneumoniae TW-183
uccauuggcauagagc

SEQ ID NO: 549345 - RNA, 13 nt, Chlamydophila pneumoniae TW-183
uccauggaaagaa

SEQ ID NO: 549346 - RNA, 15 nt, Chlamydophila pneumoniae TW-183
ucauaaccaaaagaa

SEQ ID NO: 549347 - RNA, 20 nt, Chlamydophila pneumoniae TW-183
ucaagagcucguaauccuuc

SEQ ID NO: 549348 - RNA, 15 nt, Chlamydophila pneumoniae TW-183
ucaaccauaaagaau

SEQ ID NO: 549349 - RNA, 20 nt, Chlamydophila pneumoniae TW-183
ucaaagaccagaauaccuuc

SEQ ID NO: 549350 - RNA, 15 nt, Chlamydophila pneumoniae TW-183
uauacgguaaugcca

SEQ ID NO: 549351 - RNA, 14 nt, Chlamydophila pneumoniae TW-183
aauaaaagaacauu

SEQ ID NO: 549352 - RNA, 17 nt, Chlamydophila pneumoniae TW-183
uaggcacuuaucucuuu

SEQ ID NO: 549353 - RNA, 12 nt, Chlamydophila pneumoniae TW-183
uaggaaccacuu

SEQ ID NO: 549354 - RNA, 22 nt, Chlamydophila pneumoniae TW-183
uagccuggaggcgguggcaugc

SEQ ID NO: 549355 - RNA, 16 nt, Chlamydophila pneumoniae TW-183
uaagugacuuuucuuc

SEQ ID NO: 549356 - RNA, 14 nt, Chlamydophila pneumoniae TW-183
uaacgccaacacgc

SEQ ID NO: 549357 - RNA, 17 nt, Chlamydophila pneumoniae TW-183
guuuucguaagagaauu

SEQ ID NO: 549358 - RNA, 17 nt, Chlamydophila pneumoniae TW-183
guucuuucaauaacaga

SEQ ID NO: 549359 - RNA, 22 nt, Chlamydophila pneumoniae TW-183
guggaucagaaaaaaugcguuu

SEQ ID NO: 549360 - RNA, 15 nt, Chlamydophila pneumoniae TW-183
aauaucaucacuaag

SEQ ID NO: 549361 - RNA, 12 nt, Chlamydophila pneumoniae TW-183
uggaucagaaaa

SEQ ID NO: 549362 - RNA, 13 nt, Chlamydophila pneumoniae TW-183
uggcguucaggau

SEQ ID NO: 549363 - RNA, 18 nt, Chlamydophila pneumoniae TW-183
ugggaggaauuccucuca

SEQ ID NO: 549364 - RNA, 15 nt, Chlamydophila pneumoniae TW-183
aaugcuaagcuccau

SEQ ID NO: 549365 - RNA, 20 nt, Chlamydophila pneumoniae TW-183
uuucuaaauagaaaacauag

SEQ ID NO: 549366 - RNA, 12 nt, Chlamydophila pneumoniae TW-183
uuuucugaagau

SEQ ID NO: 549367 - RNA, 20 nt, Chlamydophila pneumoniae TW-183
uuuucucaauaguguaacau

SEQ ID NO: 549368 - RNA, 23 nt, Chlamydophila pneumoniae TW-183
uuuccguaaguaaccaauacagc

SEQ ID NO: 549369 - RNA, 16 nt, Chlamydophila pneumoniae TW-183
uuuccaacuucaacuu

SEQ ID NO: 549370 - RNA, 21 nt, Chlamydophila pneumoniae TW-183
uuucaaagaccagaauaccuu

SEQ ID NO: 549371 - RNA, 12 nt, Chlamydophila pneumoniae TW-183
uuguuagcaucg

SEQ ID NO: 549372 - RNA, 22 nt, Chlamydophila pneumoniae TW-183
uugcuucuccccgagauacggg

SEQ ID NO: 549373 - RNA, 11 nt, Chlamydophila pneumoniae TW-183
uugcugaagau

SEQ ID NO: 549374 - RNA, 10 nt, Chlamydophila pneumoniae TW-183
uugagcucuc

SEQ ID NO: 549375 - RNA, 14 nt, Chlamydophila pneumoniae TW-183
uugaaaauuuuccc

SEQ ID NO: 549376 - RNA, 13 nt, Chlamydophila pneumoniae TW-183
uucuuucaaacca

SEQ ID NO: 549377 - RNA, 23 nt, Chlamydophila pneumoniae TW-183
uuccgugcgauuuccccuucaga

SEQ ID NO: 549378 - RNA, 23 nt, Chlamydophila pneumoniae TW-183
uuaucaaaagguuuuauaaagau

SEQ ID NO: 549379 - RNA, 23 nt, Chlamydophila pneumoniae TW-183
uguuaacaaguaccaagaaaaua

SEQ ID NO: 549380 - RNA, 18 nt, Chlamydophila pneumoniae TW-183
uuaaguugaccuuuuuca

SEQ ID NO: 549381 - RNA, 12 nt, Chlamydophila pneumoniae TW-183
acguucuuucaa

SEQ ID NO: 549382 - RNA, 23 nt, Chlamydophila pneumoniae TW-183
acuucugcaggacugucuagcag

SEQ ID NO: 549383 - RNA, 23 nt, Chlamydophila pneumoniae TW-183
acuucuccacagcuucuucguaa

SEQ ID NO: 549384 - RNA, 15 nt, Chlamydophila pneumoniae TW-183
acuugcccaaaaguu

SEQ ID NO: 549385 - RNA, 21 nt, Chlamydophila pneumoniae TW-183
acgcaaaguacuaauuacaga

SEQ ID NO: 549386 - RNA, 16 nt, Chlamydophila pneumoniae TW-183
acgauuucuucuucua

SEQ ID NO: 549387 - RNA, 15 nt, Chlamydophila pneumoniae TW-183
acgagacaugaugca

SEQ ID NO: 549388 - RNA, 17 nt, Chlamydophila pneumoniae TW-183
acccguagccccuuaaa

SEQ ID NO: 549389 - RNA, 18 nt, Chlamydophila pneumoniae TW-183
acccgagacuucucucuu

SEQ ID NO: 549390 - RNA, 21 nt, Chlamydophila pneumoniae TW-183
accguaacugaggcaaagauu

SEQ ID NO: 549391 - RNA, 18 nt, Chlamydophila pneumoniae TW-183
acagcuaaucaauccaag

SEQ ID NO: 549392 - RNA, 14 nt, Chlamydophila pneumoniae TW-183
acaucacuaucaug

SEQ ID NO: 549393 - RNA, 14 nt, Chlamydophila pneumoniae TW-183
acagcauaaaaauu

SEQ ID NO: 549394 - RNA, 23 nt, Chlamydophila pneumoniae TW-183
aucuucaucacaaaauucaugca

SEQ ID NO: 549395 - RNA, 13 nt, Chlamydophila pneumoniae TW-183
aucuuagcuccug

SEQ ID NO: 549396 - RNA, 18 nt, Chlamydophila pneumoniae TW-183
auuccugaggcuauagaa

SEQ ID NO: 549397 - RNA, 16 nt, Chlamydophila pneumoniae TW-183
auucgcugucuagaac

SEQ ID NO: 549398 - RNA, 14 nt, Chlamydophila pneumoniae TW-183
auucuaaguucuua

SEQ ID NO: 549399 - RNA, 21 nt, Chlamydophila pneumoniae TW-183
auucuggagucgagcagaaau

SEQ ID NO: 549400 - RNA, 15 nt, Chlamydophila pneumoniae TW-183
auucugagaaagaag

SEQ ID NO: 549401 - RNA, 19 nt, Chlamydophila pneumoniae TW-183
augcugaggacgcagagau

SEQ ID NO: 549402 - RNA, 13 nt, Chlamydophila pneumoniae TW-183
caauaggcaccca

SEQ ID NO: 549403 - RNA, 14 nt, Chlamydophila pneumoniae TW-183
caauaaaaugucca

SEQ ID NO: 549404 - RNA, 12 nt, Chlamydophila pneumoniae TW-183
caaguaaagaaa

SEQ ID NO: 549405 - RNA, 16 nt, Chlamydophila pneumoniae TW-183
caaacuaaaucaacua

SEQ ID NO: 549406 - RNA, 23 nt, Chlamydophila pneumoniae TW-183
auagaguaucuaaaacuucuugu

SEQ ID NO: 549407 - RNA, 19 nt, Chlamydophila pneumoniae TW-183
auagacucuggcauagcua

SEQ ID NO: 549408 - RNA, 14 nt, Chlamydophila pneumoniae TW-183
auaaucuauaggau

SEQ ID NO: 549409 - RNA, 12 nt, Chlamydophila pneumoniae TW-183
auaaaauagccc

SEQ ID NO: 549410 - RNA, 14 nt, Chlamydophila pneumoniae TW-183
aguugaccauauaa

SEQ ID NO: 549411 - RNA, 16 nt, Chlamydophila pneumoniae TW-183
aguaucuaaaacuucu

SEQ ID NO: 549412 - RNA, 19 nt, Chlamydophila pneumoniae TW-183
aguaccgaccgaaucucuc

SEQ ID NO: 549413 - RNA, 19 nt, Chlamydophila pneumoniae TW-183
aggucuuccaucucuuuaa

SEQ ID NO: 549414 - RNA, 18 nt, Chlamydophila pneumoniae TW-183
agggcaaccauucaucua

SEQ ID NO: 549415 - RNA, 14 nt, Chlamydophila pneumoniae TW-183
agggaugguuuccu

SEQ ID NO: 549416 - RNA, 18 nt, Chlamydophila pneumoniae TW-183
agcguuuuuugaaaauuu

SEQ ID NO: 549417 - RNA, 12 nt, Chlamydophila pneumoniae TW-183
cccuaagauucg

SEQ ID NO: 549418 - RNA, 20 nt, Chlamydophila pneumoniae TW-183
cauguacaaugauaucagca

SEQ ID NO: 549419 - RNA, 16 nt, Chlamydophila pneumoniae TW-183
ccagaagcauugagga

SEQ ID NO: 549420 - RNA, 18 nt, Chlamydophila pneumoniae TW-183
caucaaugagaaauaggg

SEQ ID NO: 549421 - RNA, 13 nt, Chlamydophila pneumoniae TW-183
caucaggauucuc

SEQ ID NO: 549422 - RNA, 14 nt, Chlamydophila pneumoniae TW-183
caguaggagcagcg

SEQ ID NO: 549423 - RNA, 22 nt, Chlamydophila pneumoniae TW-183
cauaaucucaccagaagcaacu

SEQ ID NO: 549424 - RNA, 16 nt, Chlamydophila pneumoniae TW-183
caggaguucuugauuc

SEQ ID NO: 549425 - RNA, 23 nt, Chlamydophila pneumoniae TW-183
cagcgaggaguuuuccaaaguca

SEQ ID NO: 549426 - RNA, 20 nt, Chlamydophila pneumoniae TW-183
cagagauugccaggagagcu

SEQ ID NO: 549427 - RNA, 20 nt, Chlamydophila pneumoniae TW-183
cucuaagcugugcauuuucu

SEQ ID NO: 549428 - RNA, 18 nt, Chlamydophila pneumoniae TW-183
cucgaagcuugcugauuu

SEQ ID NO: 549429 - RNA, 12 nt, Chlamydophila pneumoniae TW-183
cuccgcucuaag

SEQ ID NO: 549430 - RNA, 20 nt, Chlamydophila pneumoniae TW-183
cucaggucugcugaggagag

SEQ ID NO: 549431 - RNA, 15 nt, Chlamydophila pneumoniae TW-183
cucccaauauccaga

SEQ ID NO: 549432 - RNA, 17 nt, Chlamydophila pneumoniae TW-183
cuacaggauauugcgga

SEQ ID NO: 549433 - RNA, 14 nt, Chlamydophila pneumoniae TW-183
cuauagcauagccu

SEQ ID NO: 549434 - RNA, 13 nt, Chlamydophila pneumoniae TW-183
cucaagaucuuca

SEQ ID NO: 549435 - RNA, 23 nt, Chlamydophila pneumoniae TW-183
cuaugagguaguccgcagauuuu

SEQ ID NO: 549436 - RNA, 22 nt, Chlamydophila pneumoniae TW-183
cguauggauuucuccagcagcu

SEQ ID NO: 549437 - RNA, 12 nt, Chlamydophila pneumoniae TW-183
gagcagaaacuc

SEQ ID NO: 549438 - RNA, 15 nt, Chlamydophila pneumoniae TW-183
gaacaggggauguga

SEQ ID NO: 549439 - RNA, 20 nt, Chlamydophila pneumoniae TW-183
gaacaucucgaaccauacgg

SEQ ID NO: 549440 - RNA, 22 nt, Chlamydophila pneumoniae TW-183
gaacaagucggcaggagaggua

SEQ ID NO: 549441 - RNA, 23 nt, Chlamydophila pneumoniae TW-183
gaaauuagagggauuuguaggaa

SEQ ID NO: 549442 - RNA, 22 nt, Chlamydophila pneumoniae TW-183
cuuuugugauaccuccuccaau

SEQ ID NO: 549443 - RNA, 20 nt, Chlamydophila pneumoniae TW-183
cuuggucggaguuuuuuucu

SEQ ID NO: 549444 - RNA, 20 nt, Chlamydophila pneumoniae TW-183
cuuauagggaauuuuuucug

SEQ ID NO: 549445 - RNA, 14 nt, Chlamydophila pneumoniae TW-183
cuuccauaucuaga

SEQ ID NO: 549446 - RNA, 14 nt, Chlamydophila pneumoniae TW-183
cuucaucacaaaau

SEQ ID NO: 549447 - RNA, 16 nt, Chlamydophila pneumoniae TW-183
cuucaucaauaaagau

SEQ ID NO: 549448 - RNA, 16 nt, Chlamydophila pneumoniae TW-183
cuguacuaucuuuuuu

SEQ ID NO: 549449 - RNA, 17 nt, Chlamydophila pneumoniae TW-183
gaucuguaauagcagga

SEQ ID NO: 549450 - RNA, 15 nt, Chlamydophila pneumoniae TW-183
gcaaguaaagaaauu

SEQ ID NO: 549451 - RNA, 15 nt, Chlamydophila pneumoniae TW-183
gcaaacuccccaguu

SEQ ID NO: 549452 - RNA, 16 nt, Chlamydophila pneumoniae TW-183
cgcuuguucuuuucau

SEQ ID NO: 549453 - RNA, 19 nt, Chlamydophila pneumoniae TW-183
cgcguucuugaaucuucaa

SEQ ID NO: 549454 - RNA, 17 nt, Chlamydophila pneumoniae TW-183
ccuaagucguuaacauc

SEQ ID NO: 549455 - RNA, 23 nt, Chlamydophila pneumoniae TW-183
aaaauuuaagauaucgaccuuaa

SEQ ID NO: 549456 - RNA, 16 nt, Chlamydophila pneumoniae TW-183
aaacauagagauucua

SEQ ID NO: 549457 - RNA, 19 nt, Chlamydophila pneumoniae TW-183
aaaccucuuagcuaucaac

SEQ ID NO: 549458 - RNA, 23 nt, Chlamydophila pneumoniae TW-183
aaaaaccccuagaacuuuacaau

SEQ ID NO: 549459 - RNA, 20 nt, Chlamydophila pneumoniae TW-183
aaaacuuagaaaagugaaga

SEQ ID NO: 549460 - RNA, 13 nt, Chlamydophila pneumoniae TW-183
aaaagagcucaaa

SEQ ID NO: 549461 - RNA, 20 nt, Chlamydophila pneumoniae TW-183
aaaagagcucaaaaaguucc

SEQ ID NO: 549462 - RNA, 14 nt, Chlamydophila pneumoniae TW-183
acagcaucaggauu

SEQ ID NO: 549463 - RNA, 13 nt, Chlamydophila pneumoniae TW-183
acacucagagaug

SEQ ID NO: 549464 - RNA, 13 nt, Chlamydophila pneumoniae TW-183
acaccuucuucua

SEQ ID NO: 549465 - RNA, 14 nt, Chlamydophila pneumoniae TW-183
aaugcuaagcucca

SEQ ID NO: 549466 - RNA, 14 nt, Chlamydophila pneumoniae TW-183
aaggcugcuugaga

SEQ ID NO: 549467 - RNA, 17 nt, Chlamydophila pneumoniae TW-183
aaggucacagcauuuuc

SEQ ID NO: 549468 - RNA, 16 nt, Chlamydophila pneumoniae TW-183
aagaccuaagcucaua

SEQ ID NO: 549469 - RNA, 12 nt, Chlamydophila pneumoniae TW-183
aacuccucuaag

SEQ ID NO: 549470 - RNA, 12 nt, Chlamydophila pneumoniae TW-183
aacucagagauu

SEQ ID NO: 549471 - RNA, 22 nt, Chlamydophila pneumoniae TW-183
agaguugccaggaaacguucuu

SEQ ID NO: 549472 - RNA, 21 nt, Chlamydophila pneumoniae TW-183
agaauaacgcaagggcggaga

SEQ ID NO: 549473 - RNA, 21 nt, Chlamydophila pneumoniae TW-183
agaaacuccaaaauauucuuu

SEQ ID NO: 549474 - RNA, 22 nt, Chlamydophila pneumoniae TW-183
agaacaaggcuccguugaauua

SEQ ID NO: 549475 - RNA, 21 nt, Chlamydophila pneumoniae TW-183
agaaauuagaguaugaggaga

SEQ ID NO: 549476 - RNA, 14 nt, Chlamydophila pneumoniae TW-183
acuuauauuuucua

SEQ ID NO: 549477 - RNA, 14 nt, Chlamydophila pneumoniae TW-183
acugaggcaaagau

SEQ ID NO: 549478 - RNA, 20 nt, Chlamydophila pneumoniae TW-183
acuuaaguugaccuuuuuca

SEQ ID NO: 549479 - RNA, 15 nt, Chlamydophila pneumoniae TW-183
acuaaaaguuuuuua

SEQ ID NO: 549480 - RNA, 18 nt, Chlamydophila pneumoniae TW-183
acuaaacaccuucuucua

SEQ ID NO: 549481 - RNA, 22 nt, Chlamydophila pneumoniae TW-183
acgauauaaucacguccuucua

SEQ ID NO: 549482 - RNA, 21 nt, Chlamydophila pneumoniae TW-183
cuauagcuugaaauaauugag

SEQ ID NO: 549483 - RNA, 18 nt, Chlamydophila pneumoniae TW-183
cuauucgcugucuagaac

SEQ ID NO: 549484 - RNA, 19 nt, Chlamydophila pneumoniae TW-183
cuauuuuccucuauauuuu

SEQ ID NO: 549485 - RNA, 18 nt, Chlamydophila pneumoniae TW-183
cuaugggaggaauuccuc

SEQ ID NO: 549486 - RNA, 18 nt, Chlamydophila pneumoniae TW-183
cugcauaaucucaccaga

SEQ ID NO: 549487 - RNA, 22 nt, Chlamydophila pneumoniae TW-183
cugacguuguguagcugaaauc

SEQ ID NO: 549488 - RNA, 18 nt, Chlamydophila pneumoniae TW-183
cucuugcgaacuauccua

SEQ ID NO: 549489 - RNA, 14 nt, Chlamydophila pneumoniae TW-183
cucuaucucucgga

SEQ ID NO: 549490 - RNA, 13 nt, Chlamydophila pneumoniae TW-183
cguaguauccuuu

SEQ ID NO: 549491 - RNA, 21 nt, Chlamydophila pneumoniae TW-183
cguaguauccuuucaucagca

SEQ ID NO: 549492 - RNA, 20 nt, Chlamydophila pneumoniae TW-183
gaaaaagccuaugggaggaa

SEQ ID NO: 549493 - RNA, 23 nt, Chlamydophila pneumoniae TW-183
cuuuuuaauaaagggaaaucgga

SEQ ID NO: 549494 - RNA, 18 nt, Chlamydophila pneumoniae TW-183
cuuuagauagcucuuuga

SEQ ID NO: 549495 - RNA, 15 nt, Chlamydophila pneumoniae TW-183
cuucauugcaaaaau

SEQ ID NO: 549496 - RNA, 12 nt, Chlamydophila pneumoniae TW-183
cuuaucucuuuc

SEQ ID NO: 549497 - RNA, 17 nt, Chlamydophila pneumoniae TW-183
cuuaagaguuuuacauc

SEQ ID NO: 549498 - RNA, 20 nt, Chlamydophila pneumoniae TW-183
aagcaaggcugccagagauu

SEQ ID NO: 549499 - RNA, 13 nt, Chlamydophila pneumoniae TW-183
aagauuuuuucuu

SEQ ID NO: 549500 - RNA, 19 nt, Chlamydophila pneumoniae TW-183
aagauacuacuuacaagaa

SEQ ID NO: 549501 - RNA, 20 nt, Chlamydophila pneumoniae TW-183
gccauuccauggauauggaa

SEQ ID NO: 549502 - RNA, 19 nt, Chlamydophila pneumoniae TW-183
gccccuggaauuucuccag

SEQ ID NO: 549503 - RNA, 15 nt, Chlamydophila pneumoniae TW-183
aagaaaucaguccua

SEQ ID NO: 549504 - RNA, 20 nt, Chlamydophila pneumoniae TW-183
gcaggugugugguaaaaaua

SEQ ID NO: 549505 - RNA, 14 nt, Chlamydophila pneumoniae TW-183
gauuuuucaagacc

SEQ ID NO: 549506 - RNA, 16 nt, Chlamydophila pneumoniae TW-183
gauugauccacagauc

SEQ ID NO: 549507 - RNA, 17 nt, Chlamydophila pneumoniae TW-183
gauuaccuaaaacaaaa

SEQ ID NO: 549508 - RNA, 19 nt, Chlamydophila pneumoniae TW-183
gaugauccacugcuuuagg

SEQ ID NO: 549509 - RNA, 19 nt, Chlamydophila pneumoniae TW-183
gcucucuagcaccuaauaa

SEQ ID NO: 549510 - RNA, 22 nt, Chlamydophila pneumoniae TW-183
gucucuggaguuugauagagaa

SEQ ID NO: 549511 - RNA, 15 nt, Chlamydophila pneumoniae TW-183
guacgcaaaguacua

SEQ ID NO: 549512 - RNA, 22 nt, Chlamydophila pneumoniae TW-183
ggcacccaaacugaugccaaga

SEQ ID NO: 549513 - RNA, 16 nt, Chlamydophila pneumoniae TW-183
cggaaauugaauaucg

SEQ ID NO: 549514 - RNA, 18 nt, Chlamydophila pneumoniae TW-183
cgaagcuugcugauuucu

SEQ ID NO: 549515 - RNA, 15 nt, Chlamydophila pneumoniae TW-183
ccgaaucucuccagc

SEQ ID NO: 549516 - RNA, 22 nt, Chlamydophila pneumoniae TW-183
ccccaaacauggacaauauaga

SEQ ID NO: 549517 - RNA, 20 nt, Chlamydophila pneumoniae TW-183
aaaucccgagauaugaagag

SEQ ID NO: 549518 - RNA, 20 nt, Chlamydophila pneumoniae TW-183
aaaguuugagcuaagcugaa

SEQ ID NO: 549519 - RNA, 22 nt, Chlamydophila pneumoniae TW-183
aaauaagaaaucaguccuaaag

SEQ ID NO: 549520 - RNA, 17 nt, Chlamydophila pneumoniae TW-183
cauaaccuccucuucuu

SEQ ID NO: 549521 - RNA, 18 nt, Chlamydophila pneumoniae TW-183
caucaggcggaugaccuu

SEQ ID NO: 549522 - RNA, 17 nt, Chlamydophila pneumoniae TW-183
aaagauuauucuagagu

SEQ ID NO: 549523 - RNA, 22 nt, Chlamydophila pneumoniae TW-183
cagaucguaaucuguauaugcu

SEQ ID NO: 549524 - RNA, 21 nt, Chlamydophila pneumoniae TW-183
cagauaaagacaucucuuuaa

SEQ ID NO: 549525 - RNA, 22 nt, Chlamydophila pneumoniae TW-183
aaagacaucucuuuaacuucua

SEQ ID NO: 549526 - RNA, 23 nt, Chlamydophila pneumoniae TW-183
cagacacaaaaagcuuuuuucuc

SEQ ID NO: 549527 - RNA, 23 nt, Chlamydophila pneumoniae TW-183
caccuuaauggcuccuacuccua

SEQ ID NO: 549528 - RNA, 17 nt, Chlamydophila pneumoniae TW-183
caagcacuuucgcaaaa

SEQ ID NO: 549529 - RNA, 19 nt, Chlamydophila pneumoniae TW-183
caauaaacaacgaucguca

SEQ ID NO: 549530 - RNA, 13 nt, Chlamydophila pneumoniae TW-183
caauaaacaacga

SEQ ID NO: 549531 - RNA, 19 nt, Chlamydophila pneumoniae TW-183
caaagaacugcauaaucuc

SEQ ID NO: 549532 - RNA, 16 nt, Chlamydophila pneumoniae TW-183
auuucauguaagaaug

SEQ ID NO: 549533 - RNA, 19 nt, Chlamydophila pneumoniae TW-183
auuccagcaucuucucgaa

SEQ ID NO: 549534 - RNA, 22 nt, Chlamydophila pneumoniae TW-183
augagggagcgaaguuuuucug

SEQ ID NO: 549535 - RNA, 13 nt, Chlamydophila pneumoniae TW-183
aucugccauagga

SEQ ID NO: 549536 - RNA, 15 nt, Chlamydophila pneumoniae TW-183
auccugaucuucuug

SEQ ID NO: 549537 - RNA, 17 nt, Chlamydophila pneumoniae TW-183
aucccugcacucuuuca

SEQ ID NO: 549538 - RNA, 18 nt, Chlamydophila pneumoniae TW-183
aucccgugcuaggaagau

SEQ ID NO: 549539 - RNA, 17 nt, Chlamydophila pneumoniae TW-183
aucacuuauauuuucua

SEQ ID NO: 549540 - RNA, 15 nt, Chlamydophila pneumoniae TW-183
aucaacauucuucug

SEQ ID NO: 549541 - RNA, 14 nt, Chlamydophila pneumoniae TW-183
aucaacauucuucu

SEQ ID NO: 549542 - RNA, 19 nt, Chlamydophila pneumoniae TW-183
auaucagcuucuugaugua

SEQ ID NO: 549543 - RNA, 22 nt, Chlamydophila pneumoniae TW-183
auaaugguacaauacuggagag

SEQ ID NO: 549544 - RNA, 20 nt, Chlamydophila pneumoniae TW-183
agguaguccgcagauuuuaa

SEQ ID NO: 549545 - RNA, 17 nt, Chlamydophila pneumoniae TW-183
agggcgcuucccuauaa

SEQ ID NO: 549546 - RNA, 17 nt, Chlamydophila pneumoniae TW-183
aggagcgggauaggcaa

SEQ ID NO: 549547 - RNA, 19 nt, Chlamydophila pneumoniae TW-183
aggaguuuucaagucugua

SEQ ID NO: 549548 - RNA, 20 nt, Chlamydophila pneumoniae TW-183
agcuucuuuagauagcucuu

SEQ ID NO: 549549 - RNA, 23 nt, Chlamydophila pneumoniae TW-183
aggaagucaccuuacauccaauu

SEQ ID NO: 549550 - RNA, 21 nt, Chlamydophila pneumoniae TW-183
aggaaucccugcacucuuuca

SEQ ID NO: 549551 - RNA, 13 nt, Chlamydophila pneumoniae TW-183
aggaauuccucuc

SEQ ID NO: 549552 - RNA, 11 nt, Chlamydophila pneumoniae TW-183
uuuuuucuauu

SEQ ID NO: 549553 - RNA, 23 nt, Chlamydophila pneumoniae TW-183
uuuuucaaucaauaaaaugucca

SEQ ID NO: 549554 - RNA, 19 nt, Chlamydophila pneumoniae TW-183
uuuuuagcaauugagcuuc

SEQ ID NO: 549555 - RNA, 22 nt, Chlamydophila pneumoniae TW-183
uuuucagccugucuauaaaaua

SEQ ID NO: 549556 - RNA, 19 nt, Chlamydophila pneumoniae TW-183
uuuucagcaacgaguccuu

SEQ ID NO: 549557 - RNA, 13 nt, Chlamydophila pneumoniae TW-183
uuuuccucuauau

SEQ ID NO: 549558 - RNA, 16 nt, Chlamydophila pneumoniae TW-183
uuuaccuuguuuuccu

SEQ ID NO: 549559 - RNA, 13 nt, Chlamydophila pneumoniae TW-183
uuuucuucuugca

SEQ ID NO: 549560 - RNA, 20 nt, Chlamydophila pneumoniae TW-183
uuuucuucuucggaucugua

SEQ ID NO: 549561 - RNA, 22 nt, Chlamydophila pneumoniae TW-183
uuuucuuuugcagcaacuuccc

SEQ ID NO: 549562 - RNA, 22 nt, Chlamydophila pneumoniae TW-183
uuuucuuuucugaagauuuuuu

SEQ ID NO: 549563 - RNA, 14 nt, Chlamydophila pneumoniae TW-183
ugaaaauuuuccca

SEQ ID NO: 549564 - RNA, 17 nt, Chlamydophila pneumoniae TW-183
ugaaaccguaacugagg

SEQ ID NO: 549565 - RNA, 20 nt, Chlamydophila pneumoniae TW-183
ugaaaccguaacugaggcaa

SEQ ID NO: 549566 - RNA, 21 nt, Chlamydophila pneumoniae TW-183
ugaaagauuauucuagaguug

SEQ ID NO: 549567 - RNA, 16 nt, Chlamydophila pneumoniae TW-183
ucuuuuucagcuucua

SEQ ID NO: 549568 - RNA, 14 nt, Chlamydophila pneumoniae TW-183
ucuuuucugaagau

SEQ ID NO: 549569 - RNA, 17 nt, Chlamydophila pneumoniae TW-183
ucuuuucugaagauuuu

SEQ ID NO: 549570 - RNA, 17 nt, Chlamydophila pneumoniae TW-183
ucuuuuguuuuagcucu

SEQ ID NO: 549571 - RNA, 14 nt, Chlamydophila pneumoniae TW-183
ugaaaaaagaagcu

SEQ ID NO: 549572 - RNA, 13 nt, Chlamydophila pneumoniae TW-183
ucuuuucaucaag

SEQ ID NO: 549573 - RNA, 18 nt, Chlamydophila pneumoniae TW-183
ucuuuucaucaagaaccc

SEQ ID NO: 549574 - RNA, 16 nt, Chlamydophila pneumoniae TW-183
ucuuuuaacuuaaaga

SEQ ID NO: 549575 - RNA, 13 nt, Chlamydophila pneumoniae TW-183
ucuuugauuuucu

SEQ ID NO: 549576 - RNA, 19 nt, Chlamydophila pneumoniae TW-183
ucuuugggauaaaaaguuu

SEQ ID NO: 549577 - RNA, 18 nt, Chlamydophila pneumoniae TW-183
ucuuugaggauacgaaua

SEQ ID NO: 549578 - RNA, 22 nt, Chlamydophila pneumoniae TW-183
ucuugcucuagucuuucaaccu

SEQ ID NO: 549579 - RNA, 16 nt, Chlamydophila pneumoniae TW-183
ucuuccccccucacaa

SEQ ID NO: 549580 - RNA, 20 nt, Chlamydophila pneumoniae TW-183
ucuuucaccaacuccucuaa

SEQ ID NO: 549581 - RNA, 22 nt, Chlamydophila pneumoniae TW-183
ucuuucaccaacuccucuaagg

SEQ ID NO: 549582 - RNA, 14 nt, Chlamydophila pneumoniae TW-183
ucuuucagaaagaa

SEQ ID NO: 549583 - RNA, 18 nt, Chlamydophila pneumoniae TW-183
ucuuucggugucucuaga

SEQ ID NO: 549584 - RNA, 13 nt, Chlamydophila pneumoniae TW-183
ucuuagcuccugu

SEQ ID NO: 549585 - RNA, 16 nt, Chlamydophila pneumoniae TW-183
ucuuagcuuccauauu

SEQ ID NO: 549586 - RNA, 18 nt, Chlamydophila pneumoniae TW-183
ucuuaugaaguccagacu

SEQ ID NO: 549587 - RNA, 13 nt, Chlamydophila pneumoniae TW-183
ucuucauccgaag

SEQ ID NO: 549588 - RNA, 15 nt, Chlamydophila pneumoniae TW-183
ucuucaucacaaaau

SEQ ID NO: 549589 - RNA, 13 nt, Chlamydophila pneumoniae TW-183
ucuucagcccacu

SEQ ID NO: 549590 - RNA, 19 nt, Chlamydophila pneumoniae TW-183
ucuguaaagugaaauugaa

SEQ ID NO: 549591 - RNA, 21 nt, Chlamydophila pneumoniae TW-183
ucuggaguuugauagagaaaa

SEQ ID NO: 549592 - RNA, 18 nt, Chlamydophila pneumoniae TW-183
ucuggcugagagaagcag

SEQ ID NO: 549593 - RNA, 16 nt, Chlamydophila pneumoniae TW-183
ucugcuauagcuugaa

SEQ ID NO: 549594 - RNA, 15 nt, Chlamydophila pneumoniae TW-183
ucugcugaagggaca

SEQ ID NO: 549595 - RNA, 13 nt, Chlamydophila pneumoniae TW-183
ucugcugaggaga

SEQ ID NO: 549596 - RNA, 21 nt, Chlamydophila pneumoniae TW-183
ucucgggagaacaugccccca

SEQ ID NO: 549597 - RNA, 21 nt, Chlamydophila pneumoniae TW-183
ucucuagcuguuaauucccgu

SEQ ID NO: 549598 - RNA, 15 nt, Chlamydophila pneumoniae TW-183
ucucuaggaacucuu

SEQ ID NO: 549599 - RNA, 13 nt, Chlamydophila pneumoniae TW-183
ucucuaaaugauu

SEQ ID NO: 549600 - RNA, 22 nt, Chlamydophila pneumoniae TW-183
ucucuaaguucuugauuuucaa

SEQ ID NO: 549601 - RNA, 17 nt, Chlamydophila pneumoniae TW-183
ucucgggagaacaugcc

SEQ ID NO: 549602 - RNA, 22 nt, Chlamydophila pneumoniae TW-183
ucucaugcggacuuuauucucu

SEQ ID NO: 549603 - RNA, 18 nt, Chlamydophila pneumoniae TW-183
ucuccaguaucuucucuu

SEQ ID NO: 549604 - RNA, 14 nt, Chlamydophila pneumoniae TW-183
ucuccucaucagaa

SEQ ID NO: 549605 - RNA, 13 nt, Chlamydophila pneumoniae TW-183
ucuccucaucaga

SEQ ID NO: 549606 - RNA, 17 nt, Chlamydophila pneumoniae TW-183
ucucuuuaacuucuaaa

SEQ ID NO: 549607 - RNA, 19 nt, Chlamydophila pneumoniae TW-183
ucucuuuaacuucuaaaag

SEQ ID NO: 549608 - RNA, 20 nt, Chlamydophila pneumoniae TW-183
ucucuugaagcacuuugacu

SEQ ID NO: 549609 - RNA, 22 nt, Chlamydophila pneumoniae TW-183
ucucuucgcuggcauguuuaau

SEQ ID NO: 549610 - RNA, 17 nt, Chlamydophila pneumoniae TW-183
ucucuucacucuuuuau

SEQ ID NO: 549611 - RNA, 17 nt, Chlamydophila pneumoniae TW-183
ucucucugccuaccaaa

SEQ ID NO: 549612 - RNA, 18 nt, Chlamydophila pneumoniae TW-183
ucugaugacguuaauaaa

SEQ ID NO: 549613 - RNA, 17 nt, Chlamydophila pneumoniae TW-183
ucuaagcgcucuucaau

SEQ ID NO: 549614 - RNA, 16 nt, Chlamydophila pneumoniae TW-183
ucuaagacuucuggaa

SEQ ID NO: 549615 - RNA, 18 nt, Chlamydophila pneumoniae TW-183
ucuaaaugauuuuuaauu

SEQ ID NO: 549616 - RNA, 16 nt, Chlamydophila pneumoniae TW-183
ucuaaauagaaaacau

SEQ ID NO: 549617 - RNA, 20 nt, Chlamydophila pneumoniae TW-183
ucuacaggauauugcggaaa

SEQ ID NO: 549618 - RNA, 20 nt, Chlamydophila pneumoniae TW-183
ucuaagcugugcauuuucuu

SEQ ID NO: 549619 - RNA, 20 nt, Chlamydophila pneumoniae TW-183
ucuaaggacaaaucucccaa

SEQ ID NO: 549620 - RNA, 19 nt, Chlamydophila pneumoniae TW-183
ucuaaggcauuggaaaucu

SEQ ID NO: 549621 - RNA, 15 nt, Chlamydophila pneumoniae TW-183
ucuaaguucuuaaga

SEQ ID NO: 549622 - RNA, 21 nt, Chlamydophila pneumoniae TW-183
ucgguaauuuccauguacaau

SEQ ID NO: 549623 - RNA, 22 nt, Chlamydophila pneumoniae TW-183
ucguaauccuucuuucugcucu

SEQ ID NO: 549624 - RNA, 16 nt, Chlamydophila pneumoniae TW-183
ucggcucuauaaauuu

SEQ ID NO: 549625 - RNA, 17 nt, Chlamydophila pneumoniae TW-183
ucggcucuauaaauuuc

SEQ ID NO: 549626 - RNA, 13 nt, Chlamydophila pneumoniae TW-183
ucggaucuguaau

SEQ ID NO: 549627 - RNA, 20 nt, Chlamydophila pneumoniae TW-183
ucgcuugugcaugcaucuua

SEQ ID NO: 549628 - RNA, 14 nt, Chlamydophila pneumoniae TW-183
ucgcuugugcaugc

SEQ ID NO: 549629 - RNA, 22 nt, Chlamydophila pneumoniae TW-183
ucgaucucugugguuccuggau

SEQ ID NO: 549630 - RNA, 23 nt, Chlamydophila pneumoniae TW-183
ucgcaacuuaagauacuucucca

SEQ ID NO: 549631 - RNA, 16 nt, Chlamydophila pneumoniae TW-183
ucgaguucuuuuugca

SEQ ID NO: 549632 - RNA, 19 nt, Chlamydophila pneumoniae TW-183
ucgaaacucuuugaggaua

SEQ ID NO: 549633 - RNA, 16 nt, Chlamydophila pneumoniae TW-183
ucgaaacacucaugaa

SEQ ID NO: 549634 - RNA, 15 nt, Chlamydophila pneumoniae TW-183
uccuucuuucugcuc

SEQ ID NO: 549635 - RNA, 21 nt, Chlamydophila pneumoniae TW-183
uccuucuuucugcucuucuau

SEQ ID NO: 549636 - RNA, 14 nt, Chlamydophila pneumoniae TW-183
uccuugauuuggga

SEQ ID NO: 549637 - RNA, 14 nt, Chlamydophila pneumoniae TW-183
uccuucaacacacc

SEQ ID NO: 549638 - RNA, 17 nt, Chlamydophila pneumoniae TW-183
uccuuacuugcauagau

SEQ ID NO: 549639 - RNA, 14 nt, Chlamydophila pneumoniae TW-183
uccuuacucccaug

SEQ ID NO: 549640 - RNA, 13 nt, Chlamydophila pneumoniae TW-183
uccuguagccacu

SEQ ID NO: 549641 - RNA, 17 nt, Chlamydophila pneumoniae TW-183
uccuggaacaguauaau

SEQ ID NO: 549642 - RNA, 22 nt, Chlamydophila pneumoniae TW-183
uccuggaagaauuucauaagag

SEQ ID NO: 549643 - RNA, 16 nt, Chlamydophila pneumoniae TW-183
uccuggagcaugagag

SEQ ID NO: 549644 - RNA, 15 nt, Chlamydophila pneumoniae TW-183
ugaauaagauuuuga

SEQ ID NO: 549645 - RNA, 17 nt, Chlamydophila pneumoniae TW-183
ugaauaguagaguugac

SEQ ID NO: 549646 - RNA, 19 nt, Chlamydophila pneumoniae TW-183
ugaauaguagaguugacaa

SEQ ID NO: 549647 - RNA, 19 nt, Chlamydophila pneumoniae TW-183
ugaauuaauaaaagagcuc

SEQ ID NO: 549648 - RNA, 21 nt, Chlamydophila pneumoniae TW-183
ugaacguagcuacaaaauuau

SEQ ID NO: 549649 - RNA, 15 nt, Chlamydophila pneumoniae TW-183
ugaagagcauuuaaa

SEQ ID NO: 549650 - RNA, 16 nt, Chlamydophila pneumoniae TW-183
ugaagaaaccagaaca

SEQ ID NO: 549651 - RNA, 18 nt, Chlamydophila pneumoniae TW-183
ugaacuuuuguacacaga

SEQ ID NO: 549652 - RNA, 12 nt, Chlamydophila pneumoniae TW-183
ugacugaaacuc

SEQ ID NO: 549653 - RNA, 18 nt, Chlamydophila pneumoniae TW-183
ugacgucuccaacagucu

SEQ ID NO: 549654 - RNA, 22 nt, Chlamydophila pneumoniae TW-183
ugacguugcgaacagcuccugg

SEQ ID NO: 549655 - RNA, 17 nt, Chlamydophila pneumoniae TW-183
ugauugaacagucuugc

SEQ ID NO: 549656 - RNA, 21 nt, Chlamydophila pneumoniae TW-183
ugauucauaaagaggaaugaa

SEQ ID NO: 549657 - RNA, 12 nt, Chlamydophila pneumoniae TW-183
ugcaaaauuuaa

SEQ ID NO: 549658 - RNA, 22 nt, Chlamydophila pneumoniae TW-183
ugauuggaucuagagaagaaaa

SEQ ID NO: 549659 - RNA, 17 nt, Chlamydophila pneumoniae TW-183
ugauuuucuuagcuucc

SEQ ID NO: 549660 - RNA, 18 nt, Chlamydophila pneumoniae TW-183
ugauuuucuuagcuucca

SEQ ID NO: 549661 - RNA, 21 nt, Chlamydophila pneumoniae TW-183
ugaucugaaguugaaaugagu

SEQ ID NO: 549662 - RNA, 18 nt, Chlamydophila pneumoniae TW-183
ugaugcccugacguuuug

SEQ ID NO: 549663 - RNA, 13 nt, Chlamydophila pneumoniae TW-183
ugauagagaaaau

SEQ ID NO: 549664 - RNA, 16 nt, Chlamydophila pneumoniae TW-183
ugauagagaaaauaag

SEQ ID NO: 549665 - RNA, 16 nt, Chlamydophila pneumoniae TW-183
ugauaauuucauuaua

SEQ ID NO: 549666 - RNA, 13 nt, Chlamydophila pneumoniae TW-183
ugauaaggaagaa

SEQ ID NO: 549667 - RNA, 20 nt, Chlamydophila pneumoniae TW-183
ugaguuagcuuuugugauac

SEQ ID NO: 549668 - RNA, 10 nt, Chlamydophila pneumoniae TW-183
ugagucgaca

SEQ ID NO: 549669 - RNA, 23 nt, Chlamydophila pneumoniae TW-183
ugagccaacagguucacuucauc

SEQ ID NO: 549670 - RNA, 21 nt, Chlamydophila pneumoniae TW-183
ugcugcuuccccuaauagggg

SEQ ID NO: 549671 - RNA, 15 nt, Chlamydophila pneumoniae TW-183
ugcugauuucuuuuu

SEQ ID NO: 549672 - RNA, 18 nt, Chlamydophila pneumoniae TW-183
ugcugauuucuuuuucag

SEQ ID NO: 549673 - RNA, 23 nt, Chlamydophila pneumoniae TW-183
ugcggaugugccgugacuccaga

SEQ ID NO: 549674 - RNA, 20 nt, Chlamydophila pneumoniae TW-183
ugccucauugccguggugag

SEQ ID NO: 549675 - RNA, 18 nt, Chlamydophila pneumoniae TW-183
ugcccuacaauuuccuug

SEQ ID NO: 549676 - RNA, 18 nt, Chlamydophila pneumoniae TW-183
ugccagagauucuucaca

SEQ ID NO: 549677 - RNA, 13 nt, Chlamydophila pneumoniae TW-183
ugccagcccaugu

SEQ ID NO: 549678 - RNA, 16 nt, Chlamydophila pneumoniae TW-183
ugccagagauucuuca

SEQ ID NO: 549679 - RNA, 16 nt, Chlamydophila pneumoniae TW-183
ugcauuuucuucuugc

SEQ ID NO: 549680 - RNA, 15 nt, Chlamydophila pneumoniae TW-183
ugcauuuucuucuug

SEQ ID NO: 549681 - RNA, 13 nt, Chlamydophila pneumoniae TW-183
ugcaugaggagac

SEQ ID NO: 549682 - RNA, 12 nt, Chlamydophila pneumoniae TW-183
ugcaucuuauca

SEQ ID NO: 549683 - RNA, 19 nt, Chlamydophila pneumoniae TW-183
ugcaucuuaucaagagcuc

SEQ ID NO: 549684 - RNA, 13 nt, Chlamydophila pneumoniae TW-183
ugcauaaucucac

SEQ ID NO: 549685 - RNA, 16 nt, Chlamydophila pneumoniae TW-183
uucaaagaccagaaua

SEQ ID NO: 549686 - RNA, 15 nt, Chlamydophila pneumoniae TW-183
uucaacaagaauaac

SEQ ID NO: 549687 - RNA, 21 nt, Chlamydophila pneumoniae TW-183
uucaacuuuguuaauagaaga

SEQ ID NO: 549688 - RNA, 23 nt, Chlamydophila pneumoniae TW-183
uucaacuuuguuaauagaagauc

SEQ ID NO: 549689 - RNA, 11 nt, Chlamydophila pneumoniae TW-183
uucaagaaaaa

SEQ ID NO: 549690 - RNA, 18 nt, Chlamydophila pneumoniae TW-183
uuaucccagauaaagaca

SEQ ID NO: 549691 - RNA, 15 nt, Chlamydophila pneumoniae TW-183
uuauagauaugccuc

SEQ ID NO: 549692 - RNA, 22 nt, Chlamydophila pneumoniae TW-183
uuauagauagggccgugaagca

SEQ ID NO: 549693 - RNA, 18 nt, Chlamydophila pneumoniae TW-183
uuagaguugaccauauaa

SEQ ID NO: 549694 - RNA, 22 nt, Chlamydophila pneumoniae TW-183
uuauaaagaucgggucuacaac

SEQ ID NO: 549695 - RNA, 23 nt, Chlamydophila pneumoniae TW-183
uuaucgauaauaaaagcacccuc

SEQ ID NO: 549696 - RNA, 14 nt, Chlamydophila pneumoniae TW-183
uuaagaggaaagca

SEQ ID NO: 549697 - RNA, 16 nt, Chlamydophila pneumoniae TW-183
uuaacuucuaaaagca

SEQ ID NO: 549698 - RNA, 19 nt, Chlamydophila pneumoniae TW-183
uuaagauaucgaccuuaaa

SEQ ID NO: 549699 - RNA, 19 nt, Chlamydophila pneumoniae TW-183
uuaaccgagcuuuuugcuu

SEQ ID NO: 549700 - RNA, 19 nt, Chlamydophila pneumoniae TW-183
uuaacaaguaccaagaaaa

SEQ ID NO: 549701 - RNA, 13 nt, Chlamydophila pneumoniae TW-183
uuaacaacaugcg

SEQ ID NO: 549702 - RNA, 17 nt, Chlamydophila pneumoniae TW-183
uuaacaaguaccaagaa

SEQ ID NO: 549703 - RNA, 15 nt, Chlamydophila pneumoniae TW-183
uuaaagagaaucucc

SEQ ID NO: 549704 - RNA, 20 nt, Chlamydophila pneumoniae TW-183
uguugcccuacaauuuccuu

SEQ ID NO: 549705 - RNA, 18 nt, Chlamydophila pneumoniae TW-183
uuacagccuauugcaggg

SEQ ID NO: 549706 - RNA, 20 nt, Chlamydophila pneumoniae TW-183
uuacagaugcaugauccuau

SEQ ID NO: 549707 - RNA, 13 nt, Chlamydophila pneumoniae TW-183
uuacaucaaugau

SEQ ID NO: 549708 - RNA, 21 nt, Chlamydophila pneumoniae TW-183
uuacagauaaggaagagaguu

SEQ ID NO: 549709 - RNA, 22 nt, Chlamydophila pneumoniae TW-183
uuagaaucaaaagucaugagga

SEQ ID NO: 549710 - RNA, 17 nt, Chlamydophila pneumoniae TW-183
uuacugucugcaaagag

SEQ ID NO: 549711 - RNA, 15 nt, Chlamydophila pneumoniae TW-183
uguucuuuucaucaa

SEQ ID NO: 549712 - RNA, 16 nt, Chlamydophila pneumoniae TW-183
uguugauaauuacaga

SEQ ID NO: 549713 - RNA, 22 nt, Chlamydophila pneumoniae TW-183
uguuagcaucgcuuaacaaacu

SEQ ID NO: 549714 - RNA, 13 nt, Chlamydophila pneumoniae TW-183
uguguaaaaguua

SEQ ID NO: 549715 - RNA, 20 nt, Chlamydophila pneumoniae TW-183
ugugauccuugcaaaacagc

SEQ ID NO: 549716 - RNA, 14 nt, Chlamydophila pneumoniae TW-183
ugugauauucuugg

SEQ ID NO: 549717 - RNA, 14 nt, Chlamydophila pneumoniae TW-183
ugucucuuaaaaaa

SEQ ID NO: 549718 - RNA, 21 nt, Chlamydophila pneumoniae TW-183
uguccuccauggaaagaaaca

SEQ ID NO: 549719 - RNA, 23 nt, Chlamydophila pneumoniae TW-183
uguccaugcacgagauucuugag

SEQ ID NO: 549720 - RNA, 21 nt, Chlamydophila pneumoniae TW-183
ugucaagaggcuguccuugca

SEQ ID NO: 549721 - RNA, 15 nt, Chlamydophila pneumoniae TW-183
ugucaagaagugcuu

SEQ ID NO: 549722 - RNA, 14 nt, Chlamydophila pneumoniae TW-183
uguaucuuuuuaau

SEQ ID NO: 549723 - RNA, 16 nt, Chlamydophila pneumoniae TW-183
uguacacagagaugcu

SEQ ID NO: 549724 - RNA, 15 nt, Chlamydophila pneumoniae TW-183
uguaaauuuuuccuu

SEQ ID NO: 549725 - RNA, 16 nt, Chlamydophila pneumoniae TW-183
uguaagcgugcaaguu

SEQ ID NO: 549726 - RNA, 18 nt, Chlamydophila pneumoniae TW-183
ugguuuaccuuguuuucc

SEQ ID NO: 549727 - RNA, 15 nt, Chlamydophila pneumoniae TW-183
ugguuucuucaucug

SEQ ID NO: 549728 - RNA, 20 nt, Chlamydophila pneumoniae TW-183
ugguccaucgagaaaugcuc

SEQ ID NO: 549729 - RNA, 17 nt, Chlamydophila pneumoniae TW-183
uggucggaguuuuuuuc

SEQ ID NO: 549730 - RNA, 17 nt, Chlamydophila pneumoniae TW-183
uggucuuggguuuuaaa

SEQ ID NO: 549731 - RNA, 15 nt, Chlamydophila pneumoniae TW-183
ugggcgucuucuucg

SEQ ID NO: 549732 - RNA, 18 nt, Chlamydophila pneumoniae TW-183
uggggaucuuaggaaauu

SEQ ID NO: 549733 - RNA, 18 nt, Chlamydophila pneumoniae TW-183
ugggagauccugaaaaaa

SEQ ID NO: 549734 - RNA, 15 nt, Chlamydophila pneumoniae TW-183
uggcugagagaagca

SEQ ID NO: 549735 - RNA, 12 nt, Chlamydophila pneumoniae TW-183
ugggaagacucu

SEQ ID NO: 549736 - RNA, 19 nt, Chlamydophila pneumoniae TW-183
ugggaagacucucaucagc

SEQ ID NO: 549737 - RNA, 20 nt, Chlamydophila pneumoniae TW-183
uggcuauagauacuuugcaa

SEQ ID NO: 549738 - RNA, 14 nt, Chlamydophila pneumoniae TW-183
uggcucuauagggg

SEQ ID NO: 549739 - RNA, 17 nt, Chlamydophila pneumoniae TW-183
uucagaggcuagaaaau

SEQ ID NO: 549740 - RNA, 19 nt, Chlamydophila pneumoniae TW-183
uucacuauuaggcuuuuuu

SEQ ID NO: 549741 - RNA, 11 nt, Chlamydophila pneumoniae TW-183
uucacuucauc

SEQ ID NO: 549742 - RNA, 15 nt, Chlamydophila pneumoniae TW-183
uucacuuacagauaa

SEQ ID NO: 549743 - RNA, 23 nt, Chlamydophila pneumoniae TW-183
uucacaaaucuuccccuaaaaau

SEQ ID NO: 549744 - RNA, 16 nt, Chlamydophila pneumoniae TW-183
uucacaaucuaaauaa

SEQ ID NO: 549745 - RNA, 20 nt, Chlamydophila pneumoniae TW-183
uucaccagaagcauugagga

SEQ ID NO: 549746 - RNA, 19 nt, Chlamydophila pneumoniae TW-183
uucacaucgugaucuaugu

SEQ ID NO: 549747 - RNA, 20 nt, Chlamydophila pneumoniae TW-183
uucaucuaggggagcuauua

SEQ ID NO: 549748 - RNA, 17 nt, Chlamydophila pneumoniae TW-183
uucaucaggagaacggu

SEQ ID NO: 549749 - RNA, 21 nt, Chlamydophila pneumoniae TW-183
uucaucacaaaauucaugcaa

SEQ ID NO: 549750 - RNA, 12 nt, Chlamydophila pneumoniae TW-183
uucaugcaaaac

SEQ ID NO: 549751 - RNA, 21 nt, Chlamydophila pneumoniae TW-183
uucauuguagaggucacuaua

SEQ ID NO: 549752 - RNA, 14 nt, Chlamydophila pneumoniae TW-183
uucaggauuuagag

SEQ ID NO: 549753 - RNA, 14 nt, Chlamydophila pneumoniae TW-183
uucagccugucuau

SEQ ID NO: 549754 - RNA, 17 nt, Chlamydophila pneumoniae TW-183
uuccaauccauucugag

SEQ ID NO: 549755 - RNA, 22 nt, Chlamydophila pneumoniae TW-183
uuccauagaguaucuaaaacuu

SEQ ID NO: 549756 - RNA, 15 nt, Chlamydophila pneumoniae TW-183
uuccaggcucuagga

SEQ ID NO: 549757 - RNA, 22 nt, Chlamydophila pneumoniae TW-183
uuccagggcauucucuaaauga

SEQ ID NO: 549758 - RNA, 15 nt, Chlamydophila pneumoniae TW-183
uuccauguacaauga

SEQ ID NO: 549759 - RNA, 19 nt, Chlamydophila pneumoniae TW-183
uuccauggauauggaaugg

SEQ ID NO: 549760 - RNA, 19 nt, Chlamydophila pneumoniae TW-183
uuccuuaaugguagcuuaa

SEQ ID NO: 549761 - RNA, 12 nt, Chlamydophila pneumoniae TW-183
uuccuagagucg

SEQ ID NO: 549762 - RNA, 20 nt, Chlamydophila pneumoniae TW-183
uuccucuaucagggagcgga

SEQ ID NO: 549763 - RNA, 17 nt, Chlamydophila pneumoniae TW-183
uuccggguucauuucca

SEQ ID NO: 549764 - RNA, 17 nt, Chlamydophila pneumoniae TW-183
uuguucuuuucaucaag

SEQ ID NO: 549765 - RNA, 21 nt, Chlamydophila pneumoniae TW-183
uugugaaaaucgcaccuugac

SEQ ID NO: 549766 - RNA, 18 nt, Chlamydophila pneumoniae TW-183
uuggaucuagagaagaaa

SEQ ID NO: 549767 - RNA, 18 nt, Chlamydophila pneumoniae TW-183
uugcuagaucuggagagg

SEQ ID NO: 549768 - RNA, 16 nt, Chlamydophila pneumoniae TW-183
uugcggaaauugaaua

SEQ ID NO: 549769 - RNA, 19 nt, Chlamydophila pneumoniae TW-183
uugccuggggaucuuagga

SEQ ID NO: 549770 - RNA, 16 nt, Chlamydophila pneumoniae TW-183
uugcagcucggaaugc

SEQ ID NO: 549771 - RNA, 22 nt, Chlamydophila pneumoniae TW-183
uugccaggaaacguucuuucaa

SEQ ID NO: 549772 - RNA, 18 nt, Chlamydophila pneumoniae TW-183
uugcauagcggcaacaag

SEQ ID NO: 549773 - RNA, 14 nt, Chlamydophila pneumoniae TW-183
uugcaauugccaua

SEQ ID NO: 549774 - RNA, 14 nt, Chlamydophila pneumoniae TW-183
uugcaaucuuugaa

SEQ ID NO: 549775 - RNA, 16 nt, Chlamydophila pneumoniae TW-183
uugauugaacagucuu

SEQ ID NO: 549776 - RNA, 13 nt, Chlamydophila pneumoniae TW-183
uugagcucucuag

SEQ ID NO: 549777 - RNA, 13 nt, Chlamydophila pneumoniae TW-183
uugagcuucuuua

SEQ ID NO: 549778 - RNA, 13 nt, Chlamydophila pneumoniae TW-183
uugauaaaacgcu

SEQ ID NO: 549779 - RNA, 23 nt, Chlamydophila pneumoniae TW-183
uugauaacuuugcaugaggagac

SEQ ID NO: 549780 - RNA, 14 nt, Chlamydophila pneumoniae TW-183
uucuuucugcucuu

SEQ ID NO: 549781 - RNA, 18 nt, Chlamydophila pneumoniae TW-183
uucuuguaauaaaagaac

SEQ ID NO: 549782 - RNA, 20 nt, Chlamydophila pneumoniae TW-183
uucuuguaauaaaagaacau

SEQ ID NO: 549783 - RNA, 21 nt, Chlamydophila pneumoniae TW-183
uucuuggaauauagguuuaga

SEQ ID NO: 549784 - RNA, 22 nt, Chlamydophila pneumoniae TW-183
uucuugcgacauaaccaucgau

SEQ ID NO: 549785 - RNA, 14 nt, Chlamydophila pneumoniae TW-183
uugaccuuuuucau

SEQ ID NO: 549786 - RNA, 19 nt, Chlamydophila pneumoniae TW-183
uugaacguagcuacaaaau

SEQ ID NO: 549787 - RNA, 13 nt, Chlamydophila pneumoniae TW-183
uucuucacaaucu

SEQ ID NO: 549788 - RNA, 16 nt, Chlamydophila pneumoniae TW-183
uucuucauugcagaua

SEQ ID NO: 549789 - RNA, 19 nt, Chlamydophila pneumoniae TW-183
uucugauccgaaaagaacc

SEQ ID NO: 549790 - RNA, 22 nt, Chlamydophila pneumoniae TW-183
uucugaugacguuaauaaagag

SEQ ID NO: 549791 - RNA, 15 nt, Chlamydophila pneumoniae TW-183
uucuggaagauguug

SEQ ID NO: 549792 - RNA, 22 nt, Chlamydophila pneumoniae TW-183
uucuguaaagugaaauugaacu

SEQ ID NO: 549793 - RNA, 14 nt, Chlamydophila pneumoniae TW-183
uucugaagauuuuu

SEQ ID NO: 549794 - RNA, 17 nt, Chlamydophila pneumoniae TW-183
uucuaaauagaaaacau

SEQ ID NO: 549795 - RNA, 21 nt, Chlamydophila pneumoniae TW-183
uucuaaaucccgccuuucuac

SEQ ID NO: 549796 - RNA, 12 nt, Chlamydophila pneumoniae TW-183
uucuaaguucuu

SEQ ID NO: 549797 - RNA, 16 nt, Chlamydophila pneumoniae TW-183
uucucgaagcuugcug

SEQ ID NO: 549798 - RNA, 20 nt, Chlamydophila pneumoniae TW-183
uucuccaaccucgagauccu

SEQ ID NO: 549799 - RNA, 22 nt, Chlamydophila pneumoniae TW-183
gcaaucuuugaucgcuugugca

SEQ ID NO: 549800 - RNA, 13 nt, Chlamydophila pneumoniae TW-183
gcaaguaaagaaa

SEQ ID NO: 549801 - RNA, 18 nt, Chlamydophila pneumoniae TW-183
gcaaauuucauuuagaca

SEQ ID NO: 549802 - RNA, 15 nt, Chlamydophila pneumoniae TW-183
gcaagggcggagaau

SEQ ID NO: 549803 - RNA, 15 nt, Chlamydophila pneumoniae TW-183
gcaauuuucucaaua

SEQ ID NO: 549804 - RNA, 22 nt, Chlamydophila pneumoniae TW-183
gcauccuguagagcaagauucu

SEQ ID NO: 549805 - RNA, 21 nt, Chlamydophila pneumoniae TW-183
gcauaaggauucugagaaguu

SEQ ID NO: 549806 - RNA, 17 nt, Chlamydophila pneumoniae TW-183
gcauaaucucaccagaa

SEQ ID NO: 549807 - RNA, 16 nt, Chlamydophila pneumoniae TW-183
gcauaaucuuuaacaa

SEQ ID NO: 549808 - RNA, 19 nt, Chlamydophila pneumoniae TW-183
gcaguccacgcuaucuccu

SEQ ID NO: 549809 - RNA, 20 nt, Chlamydophila pneumoniae TW-183
gcaggcaucacuaaucucag

SEQ ID NO: 549810 - RNA, 22 nt, Chlamydophila pneumoniae TW-183
gcagcgugaauaucaucacuaa

SEQ ID NO: 549811 - RNA, 13 nt, Chlamydophila pneumoniae TW-183
gcaaagauuucca

SEQ ID NO: 549812 - RNA, 14 nt, Chlamydophila pneumoniae TW-183
gcaaacuccccagu

SEQ ID NO: 549813 - RNA, 11 nt, Chlamydophila pneumoniae TW-183
gauuuugugag

SEQ ID NO: 549814 - RNA, 19 nt, Chlamydophila pneumoniae TW-183
gauuuucaaagaccagaau

SEQ ID NO: 549815 - RNA, 21 nt, Chlamydophila pneumoniae TW-183
gauucucucugccuaccaaag

SEQ ID NO: 549816 - RNA, 20 nt, Chlamydophila pneumoniae TW-183
gauucucccaauauccagaa

SEQ ID NO: 549817 - RNA, 13 nt, Chlamydophila pneumoniae TW-183
gauucuucagaau

SEQ ID NO: 549818 - RNA, 15 nt, Chlamydophila pneumoniae TW-183
gauuaugaugccuca

SEQ ID NO: 549819 - RNA, 17 nt, Chlamydophila pneumoniae TW-183
gauggucauaccaaccu

SEQ ID NO: 549820 - RNA, 16 nt, Chlamydophila pneumoniae TW-183
gaugacuuucagagca

SEQ ID NO: 549821 - RNA, 17 nt, Chlamydophila pneumoniae TW-183
gaucgucaguaaaacac

SEQ ID NO: 549822 - RNA, 15 nt, Chlamydophila pneumoniae TW-183
gaugccaagaaauau

SEQ ID NO: 549823 - RNA, 13 nt, Chlamydophila pneumoniae TW-183
gaugccaagaaau

SEQ ID NO: 549824 - RNA, 21 nt, Chlamydophila pneumoniae TW-183
gaugauccacugcuuuaggcc

SEQ ID NO: 549825 - RNA, 23 nt, Chlamydophila pneumoniae TW-183
gaucccuguaguuucuaaaacag

SEQ ID NO: 549826 - RNA, 23 nt, Chlamydophila pneumoniae TW-183
gauccugaaaaaagaagcuuucc

SEQ ID NO: 549827 - RNA, 13 nt, Chlamydophila pneumoniae TW-183
gauauugucaaga

SEQ ID NO: 549828 - RNA, 16 nt, Chlamydophila pneumoniae TW-183
gauauugcggaaauug

SEQ ID NO: 549829 - RNA, 19 nt, Chlamydophila pneumoniae TW-183
gauagaucguuucuaucuc

SEQ ID NO: 549830 - RNA, 19 nt, Chlamydophila pneumoniae TW-183
gauaaaacgcuauuguuug

SEQ ID NO: 549831 - RNA, 12 nt, Chlamydophila pneumoniae TW-183
gaguguuuucug

SEQ ID NO: 549832 - RNA, 18 nt, Chlamydophila pneumoniae TW-183
gaguucuuguaauaaaag

SEQ ID NO: 549833 - RNA, 17 nt, Chlamydophila pneumoniae TW-183
gaguucucucuucacuc

SEQ ID NO: 549834 - RNA, 21 nt, Chlamydophila pneumoniae TW-183
gagugccaagagcaucacaaa

SEQ ID NO: 549835 - RNA, 21 nt, Chlamydophila pneumoniae TW-183
gaauuucuccaguaucuucuc

SEQ ID NO: 549836 - RNA, 14 nt, Chlamydophila pneumoniae TW-183
gccgugaagcagag

SEQ ID NO: 549837 - RNA, 14 nt, Chlamydophila pneumoniae TW-183
gcccuauaguauaa

SEQ ID NO: 549838 - RNA, 16 nt, Chlamydophila pneumoniae TW-183
gccagcccaugucuuu

SEQ ID NO: 549839 - RNA, 12 nt, Chlamydophila pneumoniae TW-183
gccaaggucuuc

SEQ ID NO: 549840 - RNA, 16 nt, Chlamydophila pneumoniae TW-183
gccaaggucuucccga

SEQ ID NO: 549841 - RNA, 19 nt, Chlamydophila pneumoniae TW-183
gcauuuucucugagcagcu

SEQ ID NO: 549842 - RNA, 12 nt, Chlamydophila pneumoniae TW-183
gccaacucucua

SEQ ID NO: 549843 - RNA, 23 nt, Chlamydophila pneumoniae TW-183
gcauuuaaaacggcuguacuucc

SEQ ID NO: 549844 - RNA, 16 nt, Chlamydophila pneumoniae TW-183
gcauggacuccaagaa

SEQ ID NO: 549845 - RNA, 13 nt, Chlamydophila pneumoniae TW-183
gcaucuucucgaa

SEQ ID NO: 549846 - RNA, 22 nt, Chlamydophila pneumoniae TW-183
gcucuacaagcucgguacgucu

SEQ ID NO: 549847 - RNA, 17 nt, Chlamydophila pneumoniae TW-183
gcucuagcuaacauaaa

SEQ ID NO: 549848 - RNA, 23 nt, Chlamydophila pneumoniae TW-183
gcucuaccccacgcuaaacuaaa

SEQ ID NO: 549849 - RNA, 23 nt, Chlamydophila pneumoniae TW-183
gcucuuugggauaaaaaguuuuu

SEQ ID NO: 549850 - RNA, 16 nt, Chlamydophila pneumoniae TW-183
gcucuuugauuuucuu

SEQ ID NO: 549851 - RNA, 18 nt, Chlamydophila pneumoniae TW-183
gcucuuugauuuucuuag

SEQ ID NO: 549852 - RNA, 12 nt, Chlamydophila pneumoniae TW-183
gcucuucuuucu

SEQ ID NO: 549853 - RNA, 13 nt, Chlamydophila pneumoniae TW-183
gcucuucuuucuc

SEQ ID NO: 549854 - RNA, 19 nt, Chlamydophila pneumoniae TW-183
gcucuucuuucucuaucuc

SEQ ID NO: 549855 - RNA, 13 nt, Chlamydophila pneumoniae TW-183
gcugagagaagca

SEQ ID NO: 549856 - RNA, 17 nt, Chlamydophila pneumoniae TW-183
gcugaagauuuuuucuu

SEQ ID NO: 549857 - RNA, 20 nt, Chlamydophila pneumoniae TW-183
gcucaaaucucauuccagca

SEQ ID NO: 549858 - RNA, 21 nt, Chlamydophila pneumoniae TW-183
gcucaaaaaguuccauagagu

SEQ ID NO: 549859 - RNA, 13 nt, Chlamydophila pneumoniae TW-183
gcuaugaugagaa

SEQ ID NO: 549860 - RNA, 14 nt, Chlamydophila pneumoniae TW-183
gcuaugaugagaac

SEQ ID NO: 549861 - RNA, 17 nt, Chlamydophila pneumoniae TW-183
gcuauaccuauauagag

SEQ ID NO: 549862 - RNA, 21 nt, Chlamydophila pneumoniae TW-183
gcuauagauacuuugcaauac

SEQ ID NO: 549863 - RNA, 19 nt, Chlamydophila pneumoniae TW-183
gcuaucaaccauaaagaau

SEQ ID NO: 549864 - RNA, 19 nt, Chlamydophila pneumoniae TW-183
gcgucuccuugauuuggga

SEQ ID NO: 549865 - RNA, 14 nt, Chlamydophila pneumoniae TW-183
gcggcuuuuugcaa

SEQ ID NO: 549866 - RNA, 22 nt, Chlamydophila pneumoniae TW-183
gcggcaacaagagcgcauuuua

SEQ ID NO: 549867 - RNA, 15 nt, Chlamydophila pneumoniae TW-183
ggcauguuuaauauc

SEQ ID NO: 549868 - RNA, 11 nt, Chlamydophila pneumoniae TW-183
ggaugugaugu

SEQ ID NO: 549869 - RNA, 18 nt, Chlamydophila pneumoniae TW-183
ggaucuucagagagaaca

SEQ ID NO: 549870 - RNA, 13 nt, Chlamydophila pneumoniae TW-183
ggauaauuaaacu

SEQ ID NO: 549871 - RNA, 19 nt, Chlamydophila pneumoniae TW-183
ggagagguaaccagagagc

SEQ ID NO: 549872 - RNA, 13 nt, Chlamydophila pneumoniae TW-183
ggacuacugaaac

SEQ ID NO: 549873 - RNA, 14 nt, Chlamydophila pneumoniae TW-183
ggacaaucaacauu

SEQ ID NO: 549874 - RNA, 14 nt, Chlamydophila pneumoniae TW-183
ggacacuagaauac

SEQ ID NO: 549875 - RNA, 19 nt, Chlamydophila pneumoniae TW-183
ggaauggcuuuuguuuugu

SEQ ID NO: 549876 - RNA, 16 nt, Chlamydophila pneumoniae TW-183
ggaagcuuaucaagaa

SEQ ID NO: 549877 - RNA, 13 nt, Chlamydophila pneumoniae TW-183
ggaagacucucau

SEQ ID NO: 549878 - RNA, 20 nt, Chlamydophila pneumoniae TW-183
ggaagacucucaucagcaaa

SEQ ID NO: 549879 - RNA, 21 nt, Chlamydophila pneumoniae TW-183
ggaagaauuucauaagagaac

SEQ ID NO: 549880 - RNA, 20 nt, Chlamydophila pneumoniae TW-183
ggaagaugaauaccagaagc

SEQ ID NO: 549881 - RNA, 21 nt, Chlamydophila pneumoniae TW-183
ggaacuaaaaguuuuuuauuu

SEQ ID NO: 549882 - RNA, 20 nt, Chlamydophila pneumoniae TW-183
ggaacauaucgauaggauuc

SEQ ID NO: 549883 - RNA, 16 nt, Chlamydophila pneumoniae TW-183
ggaaacguucuuucaa

SEQ ID NO: 549884 - RNA, 14 nt, Chlamydophila pneumoniae TW-183
gcuuuuguuguuuu

SEQ ID NO: 549885 - RNA, 18 nt, Chlamydophila pneumoniae TW-183
gcuuuuguuuuguauuua

SEQ ID NO: 549886 - RNA, 16 nt, Chlamydophila pneumoniae TW-183
gcuuugcgcuuguucu

SEQ ID NO: 549887 - RNA, 21 nt, Chlamydophila pneumoniae TW-183
gcuugugcaugcaucuuauca

SEQ ID NO: 549888 - RNA, 12 nt, Chlamydophila pneumoniae TW-183
gcuugaaauaau

SEQ ID NO: 549889 - RNA, 19 nt, Chlamydophila pneumoniae TW-183
gcuuccgugcgauuucccc

SEQ ID NO: 549890 - RNA, 19 nt, Chlamydophila pneumoniae TW-183
gcuuccccuaauaggggac

SEQ ID NO: 549891 - RNA, 11 nt, Chlamydophila pneumoniae TW-183
gcuuagcaacc

SEQ ID NO: 549892 - RNA, 13 nt, Chlamydophila pneumoniae TW-183
gcuguuuuuucac

SEQ ID NO: 549893 - RNA, 19 nt, Chlamydophila pneumoniae TW-183
gcugugcauuuucuucuug

SEQ ID NO: 549894 - RNA, 13 nt, Chlamydophila pneumoniae TW-183
gcugugcauuuuc

SEQ ID NO: 549895 - RNA, 14 nt, Chlamydophila pneumoniae TW-183
gcuguguaaaaguu

SEQ ID NO: 549896 - RNA, 13 nt, Chlamydophila pneumoniae TW-183
gcugcuucagaaa

SEQ ID NO: 549897 - RNA, 22 nt, Chlamydophila pneumoniae TW-183
gcugcaaucucaaaaucaaaua

SEQ ID NO: 549898 - RNA, 14 nt, Chlamydophila pneumoniae TW-183
gcugauuucuuuuu

SEQ ID NO: 549899 - RNA, 16 nt, Chlamydophila pneumoniae TW-183
gcugauuucuuuuuca

SEQ ID NO: 549900 - RNA, 22 nt, Chlamydophila pneumoniae TW-183
gcugauuucuuuuucagcuucu

SEQ ID NO: 549901 - RNA, 14 nt, Chlamydophila pneumoniae TW-183
gcugauucucccaa

SEQ ID NO: 549902 - RNA, 22 nt, Chlamydophila pneumoniae TW-183
uacagcauaaaaauucucauaa

SEQ ID NO: 549903 - RNA, 18 nt, Chlamydophila pneumoniae TW-183
uacagcaucggcaaccag

SEQ ID NO: 549904 - RNA, 22 nt, Chlamydophila pneumoniae TW-183
uacaauuagagauucauaaaac

SEQ ID NO: 549905 - RNA, 21 nt, Chlamydophila pneumoniae TW-183
uacaauuuccuugguauccca

SEQ ID NO: 549906 - RNA, 12 nt, Chlamydophila pneumoniae TW-183
uacaaguugaga

SEQ ID NO: 549907 - RNA, 15 nt, Chlamydophila pneumoniae TW-183
uacaaaauuauuaaa

SEQ ID NO: 549908 - RNA, 20 nt, Chlamydophila pneumoniae TW-183
uaauuucuaaauagaaaaca

SEQ ID NO: 549909 - RNA, 18 nt, Chlamydophila pneumoniae TW-183
uaaucgagagaagaaauu

SEQ ID NO: 549910 - RNA, 23 nt, Chlamydophila pneumoniae TW-183
uaaugccgagaauacagagucug

SEQ ID NO: 549911 - RNA, 21 nt, Chlamydophila pneumoniae TW-183
uaauccuucuuucugcucuuc

SEQ ID NO: 549912 - RNA, 14 nt, Chlamydophila pneumoniae TW-183
uaauccuucuuucu

SEQ ID NO: 549913 - RNA, 12 nt, Chlamydophila pneumoniae TW-183
uaaucaccuuag

SEQ ID NO: 549914 - RNA, 21 nt, Chlamydophila pneumoniae TW-183
uaaucagaagugaucuugaga

SEQ ID NO: 549915 - RNA, 14 nt, Chlamydophila pneumoniae TW-183
uaacguugccuguu

SEQ ID NO: 549916 - RNA, 23 nt, Chlamydophila pneumoniae TW-183
uacuggagagguaaccagagagc

SEQ ID NO: 549917 - RNA, 20 nt, Chlamydophila pneumoniae TW-183
uacuuacaagaacaaggcuc

SEQ ID NO: 549918 - RNA, 15 nt, Chlamydophila pneumoniae TW-183
uacuuacaagaacaa

SEQ ID NO: 549919 - RNA, 24 nt, Chlamydophila pneumoniae TW-183
uacuucuccacagcuucuucguaa

SEQ ID NO: 549920 - RNA, 23 nt, Chlamydophila pneumoniae TW-183
uacguuuugucgguaauuuccau

SEQ ID NO: 549921 - RNA, 15 nt, Chlamydophila pneumoniae TW-183
uacuccauuggcaua

SEQ ID NO: 549922 - RNA, 22 nt, Chlamydophila pneumoniae TW-183
uaccuucaacaagaauaacuuu

SEQ ID NO: 549923 - RNA, 14 nt, Chlamydophila pneumoniae TW-183
uaccuuguuuuccu

SEQ ID NO: 549924 - RNA, 13 nt, Chlamydophila pneumoniae TW-183
uacgauguuuucu

SEQ ID NO: 549925 - RNA, 15 nt, Chlamydophila pneumoniae TW-183
uacgcgcucuucuuu

SEQ ID NO: 549926 - RNA, 23 nt, Chlamydophila pneumoniae TW-183
uagucaugauuuuucaaucaaua

SEQ ID NO: 549927 - RNA, 20 nt, Chlamydophila pneumoniae TW-183
uaguucaucauauuuuucuu

SEQ ID NO: 549928 - RNA, 16 nt, Chlamydophila pneumoniae TW-183
uauaaagcaaaugccu

SEQ ID NO: 549929 - RNA, 19 nt, Chlamydophila pneumoniae TW-183
uauaagugacuuuucuucu

SEQ ID NO: 549930 - RNA, 17 nt, Chlamydophila pneumoniae TW-183
uauaagugacuuuucuu

SEQ ID NO: 549931 - RNA, 17 nt, Chlamydophila pneumoniae TW-183
uauaagggggaucuuca

SEQ ID NO: 549932 - RNA, 16 nt, Chlamydophila pneumoniae TW-183
uagcuauuuuugagga

SEQ ID NO: 549933 - RNA, 21 nt, Chlamydophila pneumoniae TW-183
uaggagaaaucacacuuaaag

SEQ ID NO: 549934 - RNA, 12 nt, Chlamydophila pneumoniae TW-183
uaggcccaagaa

SEQ ID NO: 549935 - RNA, 18 nt, Chlamydophila pneumoniae TW-183
uaggauuugcauagaggg

SEQ ID NO: 549936 - RNA, 12 nt, Chlamydophila pneumoniae TW-183
uaggauuugcau

SEQ ID NO: 549937 - RNA, 14 nt, Chlamydophila pneumoniae TW-183
uagccgaguccuau

SEQ ID NO: 549938 - RNA, 22 nt, Chlamydophila pneumoniae TW-183
uagcgguacuugcgaaagaucc

SEQ ID NO: 549939 - RNA, 23 nt, Chlamydophila pneumoniae TW-183
uagcaaagcgauggcuauagaua

SEQ ID NO: 549940 - RNA, 19 nt, Chlamydophila pneumoniae TW-183
uagauuuuuacuugcccaa

SEQ ID NO: 549941 - RNA, 17 nt, Chlamydophila pneumoniae TW-183
uagaaaagugaagaaac

SEQ ID NO: 549942 - RNA, 17 nt, Chlamydophila pneumoniae TW-183
uaugaggagauaaagau

SEQ ID NO: 549943 - RNA, 21 nt, Chlamydophila pneumoniae TW-183
uaugacacagcuaaucaaucc

SEQ ID NO: 549944 - RNA, 21 nt, Chlamydophila pneumoniae TW-183
uaugaugccucauugccgugg

SEQ ID NO: 549945 - RNA, 17 nt, Chlamydophila pneumoniae TW-183
uaugaugccucauugcc

SEQ ID NO: 549946 - RNA, 22 nt, Chlamydophila pneumoniae TW-183
uauggaaggcggcuuuuugcaa

SEQ ID NO: 549947 - RNA, 13 nt, Chlamydophila pneumoniae TW-183
uaugggaggaauu

SEQ ID NO: 549948 - RNA, 14 nt, Chlamydophila pneumoniae TW-183
uaugucaagaagug

SEQ ID NO: 549949 - RNA, 24 nt, Chlamydophila pneumoniae TW-183
uaugugaaagauuauucuagaguu

SEQ ID NO: 549950 - RNA, 23 nt, Chlamydophila pneumoniae TW-183
uaucgccuuccuuaacaacauca

SEQ ID NO: 549951 - RNA, 22 nt, Chlamydophila pneumoniae TW-183
uauccagaaauacguccagccu

SEQ ID NO: 549952 - RNA, 17 nt, Chlamydophila pneumoniae TW-183
uaucccagauaaagaca

SEQ ID NO: 549953 - RNA, 20 nt, Chlamydophila pneumoniae TW-183
uauaguauaauagugagcuc

SEQ ID NO: 549954 - RNA, 22 nt, Chlamydophila pneumoniae TW-183
uauauguaauuucccuaauucu

SEQ ID NO: 549955 - RNA, 14 nt, Chlamydophila pneumoniae TW-183
uauauuuuuuccca

SEQ ID NO: 549956 - RNA, 15 nt, Chlamydophila pneumoniae TW-183
uaucaaaagguuuua

SEQ ID NO: 549957 - RNA, 17 nt, Chlamydophila pneumoniae TW-183
uaucaaccauaaagaau

SEQ ID NO: 549958 - RNA, 17 nt, Chlamydophila pneumoniae TW-183
ucagcaacgaguccuua

SEQ ID NO: 549959 - RNA, 16 nt, Chlamydophila pneumoniae TW-183
ucagcccacuguuuug

SEQ ID NO: 549960 - RNA, 13 nt, Chlamydophila pneumoniae TW-183
ucagccugucuau

SEQ ID NO: 549961 - RNA, 19 nt, Chlamydophila pneumoniae TW-183
ucagccugucuauaaaaua

SEQ ID NO: 549962 - RNA, 13 nt, Chlamydophila pneumoniae TW-183
ucagagagaacag

SEQ ID NO: 549963 - RNA, 18 nt, Chlamydophila pneumoniae TW-183
ucagagauugccaggaga

SEQ ID NO: 549964 - RNA, 15 nt, Chlamydophila pneumoniae TW-183
ucagaggcuagaaaa

SEQ ID NO: 549965 - RNA, 16 nt, Chlamydophila pneumoniae TW-183
ucagagauugccagga

SEQ ID NO: 549966 - RNA, 16 nt, Chlamydophila pneumoniae TW-183
ucagaagugaucuuga

SEQ ID NO: 549967 - RNA, 21 nt, Chlamydophila pneumoniae TW-183
ucagaagugaucuugagaaaa

SEQ ID NO: 549968 - RNA, 15 nt, Chlamydophila pneumoniae TW-183
ucacuuacagauaag

SEQ ID NO: 549969 - RNA, 21 nt, Chlamydophila pneumoniae TW-183
ucacggcuggcuucaaaacac

SEQ ID NO: 549970 - RNA, 13 nt, Chlamydophila pneumoniae TW-183
ucaccuugugaga

SEQ ID NO: 549971 - RNA, 13 nt, Chlamydophila pneumoniae TW-183
ucaccuuacaucc

SEQ ID NO: 549972 - RNA, 14 nt, Chlamydophila pneumoniae TW-183
ucacagucuuaaau

SEQ ID NO: 549973 - RNA, 13 nt, Chlamydophila pneumoniae TW-183
ucaccaacuccuc

SEQ ID NO: 549974 - RNA, 18 nt, Chlamydophila pneumoniae TW-183
ucacacuacauucaggau

SEQ ID NO: 549975 - RNA, 16 nt, Chlamydophila pneumoniae TW-183
ucacagcauuuucucu

SEQ ID NO: 549976 - RNA, 19 nt, Chlamydophila pneumoniae TW-183
ucaauccaagaauagccau

SEQ ID NO: 549977 - RNA, 23 nt, Chlamydophila pneumoniae TW-183
ucacaaaucuuccccuaaaaauu

SEQ ID NO: 549978 - RNA, 18 nt, Chlamydophila pneumoniae TW-183
ucaauagguaaggaaacg

SEQ ID NO: 549979 - RNA, 23 nt, Chlamydophila pneumoniae TW-183
ucaacauucuucugucuguauuu

SEQ ID NO: 549980 - RNA, 13 nt, Chlamydophila pneumoniae TW-183
ucaacauucuucu

SEQ ID NO: 549981 - RNA, 17 nt, Chlamydophila pneumoniae TW-183
ucaaauaguucaucaua

SEQ ID NO: 549982 - RNA, 23 nt, Chlamydophila pneumoniae TW-183
ucaaauaguucaucauauuuuuc

SEQ ID NO: 549983 - RNA, 13 nt, Chlamydophila pneumoniae TW-183
ucaaauaguucau

SEQ ID NO: 549984 - RNA, 16 nt, Chlamydophila pneumoniae TW-183
ucaacuacaucuccaa

SEQ ID NO: 549985 - RNA, 14 nt, Chlamydophila pneumoniae TW-183
ucaagaagugcuuu

SEQ ID NO: 549986 - RNA, 14 nt, Chlamydophila pneumoniae TW-183
ucaacuuuguuaau

SEQ ID NO: 549987 - RNA, 15 nt, Chlamydophila pneumoniae TW-183
ucaagaaaaaccccu

SEQ ID NO: 549988 - RNA, 20 nt, Chlamydophila pneumoniae TW-183
ucaaaccacggauuuucucu

SEQ ID NO: 549989 - RNA, 23 nt, Chlamydophila pneumoniae TW-183
ucaaaccacggauuuucucuaca

SEQ ID NO: 549990 - RNA, 20 nt, Chlamydophila pneumoniae TW-183
ucaaagaacugcauaaucuc

SEQ ID NO: 549991 - RNA, 20 nt, Chlamydophila pneumoniae TW-183
uauuuuuuaagcuaauaaga

SEQ ID NO: 549992 - RNA, 11 nt, Chlamydophila pneumoniae TW-183
ucaaaaaguuc

SEQ ID NO: 549993 - RNA, 17 nt, Chlamydophila pneumoniae TW-183
ucaaaagguuuuauaaa

SEQ ID NO: 549994 - RNA, 23 nt, Chlamydophila pneumoniae TW-183
uauugggaagaaacuucucuagg

SEQ ID NO: 549995 - RNA, 13 nt, Chlamydophila pneumoniae TW-183
uauugcagaaucu

SEQ ID NO: 549996 - RNA, 13 nt, Chlamydophila pneumoniae TW-183
uauugauagcuga

SEQ ID NO: 549997 - RNA, 22 nt, Chlamydophila pneumoniae TW-183
uauuacgcacuguaaaaaagaa

SEQ ID NO: 549998 - RNA, 18 nt, Chlamydophila pneumoniae TW-183
uaaagagaaucuccucau

SEQ ID NO: 549999 - RNA, 17 nt, Chlamydophila pneumoniae TW-183
uaaagacaucucuuuaa

SEQ ID NO: 550000 - RNA, 15 nt, Chlamydophila pneumoniae TW-183
uaaagagcauccugu

SEQ ID NO: 550001 - RNA, 17 nt, Chlamydophila pneumoniae TW-183
uaaaaucuucucugcua

SEQ ID NO: 550002 - RNA, 21 nt, Chlamydophila pneumoniae TW-183
uaaauguugggaugaucucgu

SEQ ID NO: 550003 - RNA, 20 nt, Chlamydophila pneumoniae TW-183
uaaaucaacuacaucuccaa

SEQ ID NO: 550004 - RNA, 18 nt, Chlamydophila pneumoniae TW-183
uaaauagaaaacauagag

SEQ ID NO: 550005 - RNA, 19 nt, Chlamydophila pneumoniae TW-183
uaaaguuugagcuaagcug

SEQ ID NO: 550006 - RNA, 21 nt, Chlamydophila pneumoniae TW-183
uaaccuuugacaacaccacag

SEQ ID NO: 550007 - RNA, 21 nt, Chlamydophila pneumoniae TW-183
uaaccguggcuuuguaaaaau

SEQ ID NO: 550008 - RNA, 17 nt, Chlamydophila pneumoniae TW-183
uaaccuaaggcauggca

SEQ ID NO: 550009 - RNA, 17 nt, Chlamydophila pneumoniae TW-183
uaaaaguagcauccugu

SEQ ID NO: 550010 - RNA, 16 nt, Chlamydophila pneumoniae TW-183
uaaaaguuagguagau

SEQ ID NO: 550011 - RNA, 23 nt, Chlamydophila pneumoniae TW-183
uaaaaguuuuuuauuuucuggug

SEQ ID NO: 550012 - RNA, 16 nt, Chlamydophila pneumoniae TW-183
uaaaaguuuuuuauuu

SEQ ID NO: 550013 - RNA, 20 nt, Chlamydophila pneumoniae TW-183
uaaaacacaaauagcaagag

SEQ ID NO: 550014 - RNA, 13 nt, Chlamydophila pneumoniae TW-183
uaaaacagaaauu

SEQ ID NO: 550015 - RNA, 19 nt, Chlamydophila pneumoniae TW-183
uaaaacacaaauagcaaga

SEQ ID NO: 550016 - RNA, 23 nt, Chlamydophila pneumoniae TW-183
uaaaaauaggaggcucuacagca

SEQ ID NO: 550017 - RNA, 18 nt, Chlamydophila pneumoniae TW-183
uaaaaaaagcuagucuuu

SEQ ID NO: 550018 - RNA, 15 nt, Chlamydophila pneumoniae TW-183
guuuuuaucccagau

SEQ ID NO: 550019 - RNA, 22 nt, Chlamydophila pneumoniae TW-183
guuuugauuuugcagugauaaa

SEQ ID NO: 550020 - RNA, 17 nt, Chlamydophila pneumoniae TW-183
guuuucuuuucugaaga

SEQ ID NO: 550021 - RNA, 20 nt, Chlamydophila pneumoniae TW-183
guuuucuuuucugaagauuu

SEQ ID NO: 550022 - RNA, 21 nt, Chlamydophila pneumoniae TW-183
guuuucuguugcacuuuccgu

SEQ ID NO: 550023 - RNA, 18 nt, Chlamydophila pneumoniae TW-183
guuuguaguguugaauaa

SEQ ID NO: 550024 - RNA, 21 nt, Chlamydophila pneumoniae TW-183
guuuguaguguugaauaagau

SEQ ID NO: 550025 - RNA, 18 nt, Chlamydophila pneumoniae TW-183
guuuaaguccuucuuccc

SEQ ID NO: 550026 - RNA, 21 nt, Chlamydophila pneumoniae TW-183
guuucuaaaacagaaauugcu

SEQ ID NO: 550027 - RNA, 19 nt, Chlamydophila pneumoniae TW-183
guucucaaagaucaucuac

SEQ ID NO: 550028 - RNA, 23 nt, Chlamydophila pneumoniae TW-183
guucaccagaagcauugaggaca

SEQ ID NO: 550029 - RNA, 15 nt, Chlamydophila pneumoniae TW-183
guuaggucuuaaagu

SEQ ID NO: 550030 - RNA, 13 nt, Chlamydophila pneumoniae TW-183
guuauaagugacu

SEQ ID NO: 550031 - RNA, 21 nt, Chlamydophila pneumoniae TW-183
guuaucaaaagguuuuauaaa

SEQ ID NO: 550032 - RNA, 11 nt, Chlamydophila pneumoniae TW-183
guuaacaucaa

SEQ ID NO: 550033 - RNA, 21 nt, Chlamydophila pneumoniae TW-183
guuaacaaguaccaagaaaau

SEQ ID NO: 550034 - RNA, 16 nt, Chlamydophila pneumoniae TW-183
gugucauacgcagcac

SEQ ID NO: 550035 - RNA, 21 nt, Chlamydophila pneumoniae TW-183
gugccuguaauugauguuccu

SEQ ID NO: 550036 - RNA, 20 nt, Chlamydophila pneumoniae TW-183
gugacuaaacaccuucuucu

SEQ ID NO: 550037 - RNA, 14 nt, Chlamydophila pneumoniae TW-183
gugacuuuucuucu

SEQ ID NO: 550038 - RNA, 15 nt, Chlamydophila pneumoniae TW-183
gugaagaaaccagaa

SEQ ID NO: 550039 - RNA, 21 nt, Chlamydophila pneumoniae TW-183
gugaacuuuuguacacagaga

SEQ ID NO: 550040 - RNA, 22 nt, Chlamydophila pneumoniae TW-183
gucuuccccccucacaauauaa

SEQ ID NO: 550041 - RNA, 13 nt, Chlamydophila pneumoniae TW-183
gucuccuugauuu

SEQ ID NO: 550042 - RNA, 20 nt, Chlamydophila pneumoniae TW-183
gucucuuaaaaaaaauuacu

SEQ ID NO: 550043 - RNA, 23 nt, Chlamydophila pneumoniae TW-183
gucugcaaagagcaaaggagcgg

SEQ ID NO: 550044 - RNA, 13 nt, Chlamydophila pneumoniae TW-183
gucuguaaggaca

SEQ ID NO: 550045 - RNA, 13 nt, Chlamydophila pneumoniae TW-183
gucuuccaucucu

SEQ ID NO: 550046 - RNA, 17 nt, Chlamydophila pneumoniae TW-183
gucuguuaacucagaga

SEQ ID NO: 550047 - RNA, 17 nt, Chlamydophila pneumoniae TW-183
gucuccaaaaauuccca

SEQ ID NO: 550048 - RNA, 16 nt, Chlamydophila pneumoniae TW-183
gucuagaacacucaga

SEQ ID NO: 550049 - RNA, 21 nt, Chlamydophila pneumoniae TW-183
gucggcucuauaaauuucuca

SEQ ID NO: 550050 - RNA, 22 nt, Chlamydophila pneumoniae TW-183
gucggcucuauaaauuucucau

SEQ ID NO: 550051 - RNA, 16 nt, Chlamydophila pneumoniae TW-183
gucggagauuguuuca

SEQ ID NO: 550052 - RNA, 13 nt, Chlamydophila pneumoniae TW-183
gucggaguuuuuu

SEQ ID NO: 550053 - RNA, 19 nt, Chlamydophila pneumoniae TW-183
guccuccauggaaagaaac

SEQ ID NO: 550054 - RNA, 20 nt, Chlamydophila pneumoniae TW-183
guccuccauggaaagaaaca

SEQ ID NO: 550055 - RNA, 21 nt, Chlamydophila pneumoniae TW-183
guccauuucauguaagaaugu

SEQ ID NO: 550056 - RNA, 15 nt, Chlamydophila pneumoniae TW-183
gucccacaaaugaua

SEQ ID NO: 550057 - RNA, 16 nt, Chlamydophila pneumoniae TW-183
guccagccugcaccag

SEQ ID NO: 550058 - RNA, 17 nt, Chlamydophila pneumoniae TW-183
guaugaggagauaaaga

SEQ ID NO: 550059 - RNA, 21 nt, Chlamydophila pneumoniae TW-183
guauggauuucuccagcagcu

SEQ ID NO: 550060 - RNA, 16 nt, Chlamydophila pneumoniae TW-183
guauacgguaaugcca

SEQ ID NO: 550061 - RNA, 12 nt, Chlamydophila pneumoniae TW-183
guaggagcagcg

SEQ ID NO: 550062 - RNA, 11 nt, Chlamydophila pneumoniae TW-183
guagccccagc

SEQ ID NO: 550063 - RNA, 19 nt, Chlamydophila pneumoniae TW-183
guacgcaaguaaagaaauu

SEQ ID NO: 550064 - RNA, 16 nt, Chlamydophila pneumoniae TW-183
guaccacauacucuuc

SEQ ID NO: 550065 - RNA, 17 nt, Chlamydophila pneumoniae TW-183
guaccacauacucuuca

SEQ ID NO: 550066 - RNA, 19 nt, Chlamydophila pneumoniae TW-183
guacaaugauaucagcaua

SEQ ID NO: 550067 - RNA, 14 nt, Chlamydophila pneumoniae TW-183
guaaugccagcagc

SEQ ID NO: 550068 - RNA, 19 nt, Chlamydophila pneumoniae TW-183
gguuugcaugccuauuaag

SEQ ID NO: 550069 - RNA, 21 nt, Chlamydophila pneumoniae TW-183
guaaaacacaaauagcaagag

SEQ ID NO: 550070 - RNA, 11 nt, Chlamydophila pneumoniae TW-183
guaaaacacaa

SEQ ID NO: 550071 - RNA, 13 nt, Chlamydophila pneumoniae TW-183
gguuuuuccaacu

SEQ ID NO: 550072 - RNA, 22 nt, Chlamydophila pneumoniae TW-183
gguucauuuccaaauucuugca

SEQ ID NO: 550073 - RNA, 17 nt, Chlamydophila pneumoniae TW-183
gguggguagccaggaug

SEQ ID NO: 550074 - RNA, 15 nt, Chlamydophila pneumoniae TW-183
ggucacagcauuuuc

SEQ ID NO: 550075 - RNA, 18 nt, Chlamydophila pneumoniae TW-183
gggccuaucucuaugagg

SEQ ID NO: 550076 - RNA, 21 nt, Chlamydophila pneumoniae TW-183
ggggaucuucagagagaacag

SEQ ID NO: 550077 - RNA, 19 nt, Chlamydophila pneumoniae TW-183
gggaagaaacuucucuagg

SEQ ID NO: 550078 - RNA, 17 nt, Chlamydophila pneumoniae TW-183
gggaagacucucaucag

SEQ ID NO: 550079 - RNA, 18 nt, Chlamydophila pneumoniae TW-183
cuacagagggaauuucau

SEQ ID NO: 550080 - RNA, 23 nt, Chlamydophila pneumoniae TW-183
cuacacagacuugaggaaucuga

SEQ ID NO: 550081 - RNA, 14 nt, Chlamydophila pneumoniae TW-183
cuacaauuuccuug

SEQ ID NO: 550082 - RNA, 19 nt, Chlamydophila pneumoniae TW-183
cuacauaguuguucggaca

SEQ ID NO: 550083 - RNA, 22 nt, Chlamydophila pneumoniae TW-183
cuacauaguuguucggacaaaa

SEQ ID NO: 550084 - RNA, 20 nt, Chlamydophila pneumoniae TW-183
cuaccccacgcuaaacuaaa

SEQ ID NO: 550085 - RNA, 14 nt, Chlamydophila pneumoniae TW-183
cuaccauaucuuga

SEQ ID NO: 550086 - RNA, 18 nt, Chlamydophila pneumoniae TW-183
cuagaacacucagagaug

SEQ ID NO: 550087 - RNA, 17 nt, Chlamydophila pneumoniae TW-183
cuagaccugccaagaua

SEQ ID NO: 550088 - RNA, 20 nt, Chlamydophila pneumoniae TW-183
cuagaauaccguuuuaggaa

SEQ ID NO: 550089 - RNA, 22 nt, Chlamydophila pneumoniae TW-183
cuagagaguucuuguaauaaaa

SEQ ID NO: 550090 - RNA, 21 nt, Chlamydophila pneumoniae TW-183
cuaggaacucuuuaaaagggc

SEQ ID NO: 550091 - RNA, 21 nt, Chlamydophila pneumoniae TW-183
cuagucuuucaaccuccgcuc

SEQ ID NO: 550092 - RNA, 13 nt, Chlamydophila pneumoniae TW-183
cuagucuuucaac

SEQ ID NO: 550093 - RNA, 12 nt, Chlamydophila pneumoniae TW-183
cuauaaaauaaa

SEQ ID NO: 550094 - RNA, 17 nt, Chlamydophila pneumoniae TW-183
cuauaaagcaaaugccu

SEQ ID NO: 550095 - RNA, 18 nt, Chlamydophila pneumoniae TW-183
cuauaaauuucucaugca

SEQ ID NO: 550096 - RNA, 13 nt, Chlamydophila pneumoniae TW-183
cucaaagaauacu

SEQ ID NO: 550097 - RNA, 16 nt, Chlamydophila pneumoniae TW-183
cucaccagaagcaacu

SEQ ID NO: 550098 - RNA, 19 nt, Chlamydophila pneumoniae TW-183
cucaccagaagcaacuaaa

SEQ ID NO: 550099 - RNA, 14 nt, Chlamydophila pneumoniae TW-183
cuauuguuuguccu

SEQ ID NO: 550100 - RNA, 23 nt, Chlamydophila pneumoniae TW-183
cuaucugccauaggauccaggag

SEQ ID NO: 550101 - RNA, 15 nt, Chlamydophila pneumoniae TW-183
cuaugguaaucaccu

SEQ ID NO: 550102 - RNA, 14 nt, Chlamydophila pneumoniae TW-183
cuaugggaggaauu

SEQ ID NO: 550103 - RNA, 21 nt, Chlamydophila pneumoniae TW-183
cuaugggaggaauuccucuca

SEQ ID NO: 550104 - RNA, 21 nt, Chlamydophila pneumoniae TW-183
cucuaagcugugcauuuucuu

SEQ ID NO: 550105 - RNA, 18 nt, Chlamydophila pneumoniae TW-183
cucgaaccacuguccaug

SEQ ID NO: 550106 - RNA, 22 nt, Chlamydophila pneumoniae TW-183
cuccucaucagaagccaccaaa

SEQ ID NO: 550107 - RNA, 17 nt, Chlamydophila pneumoniae TW-183
cuccuccaaucugcuga

SEQ ID NO: 550108 - RNA, 20 nt, Chlamydophila pneumoniae TW-183
cuccgaauggagaaggacac

SEQ ID NO: 550109 - RNA, 21 nt, Chlamydophila pneumoniae TW-183
cuccgcucuaagcugugcauu

SEQ ID NO: 550110 - RNA, 21 nt, Chlamydophila pneumoniae TW-183
cuccuaagucguuaacaucaa

SEQ ID NO: 550111 - RNA, 22 nt, Chlamydophila pneumoniae TW-183
cuccauuggcauagagccuaga

SEQ ID NO: 550112 - RNA, 23 nt, Chlamydophila pneumoniae TW-183
cuccagcauaaggauucugagaa

SEQ ID NO: 550113 - RNA, 17 nt, Chlamydophila pneumoniae TW-183
cuccacgcacuccugga

SEQ ID NO: 550114 - RNA, 14 nt, Chlamydophila pneumoniae TW-183
cuccacaugccugc

SEQ ID NO: 550115 - RNA, 18 nt, Chlamydophila pneumoniae TW-183
cuccaaaagcucuacaag

SEQ ID NO: 550116 - RNA, 15 nt, Chlamydophila pneumoniae TW-183
cuccaaaauauucuu

SEQ ID NO: 550117 - RNA, 19 nt, Chlamydophila pneumoniae TW-183
cuccaacuaaaccuucaau

SEQ ID NO: 550118 - RNA, 13 nt, Chlamydophila pneumoniae TW-183
cuccaacagucug

SEQ ID NO: 550119 - RNA, 14 nt, Chlamydophila pneumoniae TW-183
cuccaagaauagca

SEQ ID NO: 550120 - RNA, 17 nt, Chlamydophila pneumoniae TW-183
cucauuccagcaucuuc

SEQ ID NO: 550121 - RNA, 18 nt, Chlamydophila pneumoniae TW-183
cucauuccagcaucuucu

SEQ ID NO: 550122 - RNA, 19 nt, Chlamydophila pneumoniae TW-183
cucauuccagcaucuucuc

SEQ ID NO: 550123 - RNA, 15 nt, Chlamydophila pneumoniae TW-183
cucaggauauauaga

SEQ ID NO: 550124 - RNA, 22 nt, Chlamydophila pneumoniae TW-183
cuaaacaccuucuucuaaaauc

SEQ ID NO: 550125 - RNA, 14 nt, Chlamydophila pneumoniae TW-183
cuaaaacuucuugu

SEQ ID NO: 550126 - RNA, 18 nt, Chlamydophila pneumoniae TW-183
cguuuugcuguggaauuu

SEQ ID NO: 550127 - RNA, 22 nt, Chlamydophila pneumoniae TW-183
cguucaacuuuguuaauagaag

SEQ ID NO: 550128 - RNA, 12 nt, Chlamydophila pneumoniae TW-183
cuaacaacuccu

SEQ ID NO: 550129 - RNA, 23 nt, Chlamydophila pneumoniae TW-183
cuaaaccuucaaugauuucuuua

SEQ ID NO: 550130 - RNA, 23 nt, Chlamydophila pneumoniae TW-183
cuaacgaagugaggagaauagca

SEQ ID NO: 550131 - RNA, 17 nt, Chlamydophila pneumoniae TW-183
cuaagugauaaggaaga

SEQ ID NO: 550132 - RNA, 18 nt, Chlamydophila pneumoniae TW-183
cuaagucguuaacaucaa

SEQ ID NO: 550133 - RNA, 19 nt, Chlamydophila pneumoniae TW-183
cuaaggacaaaucucccaa

SEQ ID NO: 550134 - RNA, 15 nt, Chlamydophila pneumoniae TW-183
cuaaucucaggcauu

SEQ ID NO: 550135 - RNA, 17 nt, Chlamydophila pneumoniae TW-183
cuaaucucaggcauucu

SEQ ID NO: 550136 - RNA, 19 nt, Chlamydophila pneumoniae TW-183
cuaaucuaugaaguccuga

SEQ ID NO: 550137 - RNA, 12 nt, Chlamydophila pneumoniae TW-183
cuaauauugauu

SEQ ID NO: 550138 - RNA, 20 nt, Chlamydophila pneumoniae TW-183
cuaauaggggaccuaucggg

SEQ ID NO: 550139 - RNA, 16 nt, Chlamydophila pneumoniae TW-183
cuaauaagauccaaaa

SEQ ID NO: 550140 - RNA, 17 nt, Chlamydophila pneumoniae TW-183
cuaauaagauccaaaaa

SEQ ID NO: 550141 - RNA, 11 nt, Chlamydophila pneumoniae TW-183
cuacaacaguu

SEQ ID NO: 550142 - RNA, 15 nt, Chlamydophila pneumoniae TW-183
cuacaagcuuagcaa

SEQ ID NO: 550143 - RNA, 16 nt, Chlamydophila pneumoniae TW-183
cgugaagcagaggguu

SEQ ID NO: 550144 - RNA, 14 nt, Chlamydophila pneumoniae TW-183
cgucuccaacaguc

SEQ ID NO: 550145 - RNA, 18 nt, Chlamydophila pneumoniae TW-183
cguacgcaaguaaagaaa

SEQ ID NO: 550146 - RNA, 19 nt, Chlamydophila pneumoniae TW-183
cuucgauguuauaagugac

SEQ ID NO: 550147 - RNA, 20 nt, Chlamydophila pneumoniae TW-183
cuucccaagcagaagacccu

SEQ ID NO: 550148 - RNA, 16 nt, Chlamydophila pneumoniae TW-183
cuuccccaaacaugga

SEQ ID NO: 550149 - RNA, 20 nt, Chlamydophila pneumoniae TW-183
cuuccaucucuuuaaauguu

SEQ ID NO: 550150 - RNA, 15 nt, Chlamydophila pneumoniae TW-183
cuucaacaagaauaa

SEQ ID NO: 550151 - RNA, 16 nt, Chlamydophila pneumoniae TW-183
cuucagaaucuuugug

SEQ ID NO: 550152 - RNA, 11 nt, Chlamydophila pneumoniae TW-183
cuucagagaga

SEQ ID NO: 550153 - RNA, 16 nt, Chlamydophila pneumoniae TW-183
cuucagagagaacagg

SEQ ID NO: 550154 - RNA, 22 nt, Chlamydophila pneumoniae TW-183
cuucagcccacuguuuugcuuc

SEQ ID NO: 550155 - RNA, 22 nt, Chlamydophila pneumoniae TW-183
cuuaagaguuuuacaucaauga

SEQ ID NO: 550156 - RNA, 17 nt, Chlamydophila pneumoniae TW-183
cuuacagauaaggaaga

SEQ ID NO: 550157 - RNA, 19 nt, Chlamydophila pneumoniae TW-183
cuuacggccccuggaauuu

SEQ ID NO: 550158 - RNA, 19 nt, Chlamydophila pneumoniae TW-183
cuuauagggaauuuuuucu

SEQ ID NO: 550159 - RNA, 14 nt, Chlamydophila pneumoniae TW-183
cugugguuccugga

SEQ ID NO: 550160 - RNA, 16 nt, Chlamydophila pneumoniae TW-183
cugugguuccuggauu

SEQ ID NO: 550161 - RNA, 14 nt, Chlamydophila pneumoniae TW-183
cuguggaauuuucc

SEQ ID NO: 550162 - RNA, 12 nt, Chlamydophila pneumoniae TW-183
cugugcauuuuc

SEQ ID NO: 550163 - RNA, 13 nt, Chlamydophila pneumoniae TW-183
cugugcauuuucu

SEQ ID NO: 550164 - RNA, 20 nt, Chlamydophila pneumoniae TW-183
cugugcauuuucuucuugca

SEQ ID NO: 550165 - RNA, 21 nt, Chlamydophila pneumoniae TW-183
cugugauagguagcagcccgc

SEQ ID NO: 550166 - RNA, 16 nt, Chlamydophila pneumoniae TW-183
cugugaaaauuuucuu

SEQ ID NO: 550167 - RNA, 17 nt, Chlamydophila pneumoniae TW-183
cuguccuugcagcccug

SEQ ID NO: 550168 - RNA, 21 nt, Chlamydophila pneumoniae TW-183
cuguagguuuuuccaacuuca

SEQ ID NO: 550169 - RNA, 18 nt, Chlamydophila pneumoniae TW-183
cuguaguaaaauaagaaa

SEQ ID NO: 550170 - RNA, 13 nt, Chlamydophila pneumoniae TW-183
aaacugaugccaa

SEQ ID NO: 550171 - RNA, 19 nt, Chlamydophila pneumoniae TW-183
aaacugaugccaagaaaua

SEQ ID NO: 550172 - RNA, 15 nt, Chlamydophila pneumoniae TW-183
aaacucuuugaggau

SEQ ID NO: 550173 - RNA, 21 nt, Chlamydophila pneumoniae TW-183
cuguaccacauacucuucauc

SEQ ID NO: 550174 - RNA, 16 nt, Chlamydophila pneumoniae TW-183
cuguaccacauacucu

SEQ ID NO: 550175 - RNA, 18 nt, Chlamydophila pneumoniae TW-183
cuguaacuugcauuuuuu

SEQ ID NO: 550176 - RNA, 14 nt, Chlamydophila pneumoniae TW-183
cugguuucuucauc

SEQ ID NO: 550177 - RNA, 15 nt, Chlamydophila pneumoniae TW-183
cugggcgucuucuuc

SEQ ID NO: 550178 - RNA, 15 nt, Chlamydophila pneumoniae TW-183
cugggaagacucuca

SEQ ID NO: 550179 - RNA, 18 nt, Chlamydophila pneumoniae TW-183
aaacuccccaguuuucca

SEQ ID NO: 550180 - RNA, 20 nt, Chlamydophila pneumoniae TW-183
aaacuccaaaauauucuuuc

SEQ ID NO: 550181 - RNA, 12 nt, Chlamydophila pneumoniae TW-183
aaacuccaaaau

SEQ ID NO: 550182 - RNA, 20 nt, Chlamydophila pneumoniae TW-183
aaacuccaaguguugccagc

SEQ ID NO: 550183 - RNA, 14 nt, Chlamydophila pneumoniae TW-183
cuggcugagagaag

SEQ ID NO: 550184 - RNA, 24 nt, Chlamydophila pneumoniae TW-183
cuggaggcgguggcaugccauaau

SEQ ID NO: 550185 - RNA, 17 nt, Chlamydophila pneumoniae TW-183
cuggagagguaaccaga

SEQ ID NO: 550186 - RNA, 20 nt, Chlamydophila pneumoniae TW-183
cuggaagauguuguuuuuug

SEQ ID NO: 550187 - RNA, 18 nt, Chlamydophila pneumoniae TW-183
cuggaagaauuucauaag

SEQ ID NO: 550188 - RNA, 23 nt, Chlamydophila pneumoniae TW-183
cugcugaggagaguaaggucauu

SEQ ID NO: 550189 - RNA, 16 nt, Chlamydophila pneumoniae TW-183
cugcgguagccuggag

SEQ ID NO: 550190 - RNA, 18 nt, Chlamydophila pneumoniae TW-183
cugcauaaucucaccaga

SEQ ID NO: 550191 - RNA, 20 nt, Chlamydophila pneumoniae TW-183
cugcauaaucucaccagaag

SEQ ID NO: 550192 - RNA, 16 nt, Chlamydophila pneumoniae TW-183
cugcauaaucucacca

SEQ ID NO: 550193 - RNA, 20 nt, Chlamydophila pneumoniae TW-183
cugauuuuucaagaccuaag

SEQ ID NO: 550194 - RNA, 17 nt, Chlamydophila pneumoniae TW-183
cugauguuuuauagaua

SEQ ID NO: 550195 - RNA, 16 nt, Chlamydophila pneumoniae TW-183
cugauuucuuuuucag

SEQ ID NO: 550196 - RNA, 22 nt, Chlamydophila pneumoniae TW-183
cugaugcugaggacgcagagau

SEQ ID NO: 550197 - RNA, 17 nt, Chlamydophila pneumoniae TW-183
cugaggacgcagagaug

SEQ ID NO: 550198 - RNA, 21 nt, Chlamydophila pneumoniae TW-183
gacacaaaaagcuuuuuucuc

SEQ ID NO: 550199 - RNA, 12 nt, Chlamydophila pneumoniae TW-183
gacacaacucuu

SEQ ID NO: 550200 - RNA, 19 nt, Chlamydophila pneumoniae TW-183
gaauguaugugaaagauua

SEQ ID NO: 550201 - RNA, 20 nt, Chlamydophila pneumoniae TW-183
gaaucgaguucuucauugca

SEQ ID NO: 550202 - RNA, 21 nt, Chlamydophila pneumoniae TW-183
gaaucgaguucuucauugcag

SEQ ID NO: 550203 - RNA, 17 nt, Chlamydophila pneumoniae TW-183
gaaucuuuuguuuuagc

SEQ ID NO: 550204 - RNA, 18 nt, Chlamydophila pneumoniae TW-183
gaauagcaagcacuuucg

SEQ ID NO: 550205 - RNA, 17 nt, Chlamydophila pneumoniae TW-183
gaauaccucaagaugca

SEQ ID NO: 550206 - RNA, 23 nt, Chlamydophila pneumoniae TW-183
gaauaccuucaacaagaauaacu

SEQ ID NO: 550207 - RNA, 13 nt, Chlamydophila pneumoniae TW-183
gaauaacuuuaga

SEQ ID NO: 550208 - RNA, 21 nt, Chlamydophila pneumoniae TW-183
gaaguuccuacuucugcagga

SEQ ID NO: 550209 - RNA, 21 nt, Chlamydophila pneumoniae TW-183
gaaggcggcuuuuugcaagcu

SEQ ID NO: 550210 - RNA, 15 nt, Chlamydophila pneumoniae TW-183
gaagcuugcugauuu

SEQ ID NO: 550211 - RNA, 20 nt, Chlamydophila pneumoniae TW-183
gaagcaacuaaacucuccaa

SEQ ID NO: 550212 - RNA, 23 nt, Chlamydophila pneumoniae TW-183
aaagagugccaagagcaucacaa

SEQ ID NO: 550213 - RNA, 14 nt, Chlamydophila pneumoniae TW-183
aaagagugccaaga

SEQ ID NO: 550214 - RNA, 19 nt, Chlamydophila pneumoniae TW-183
gaagaaacuucucuaggaa

SEQ ID NO: 550215 - RNA, 14 nt, Chlamydophila pneumoniae TW-183
gaagacucucauca

SEQ ID NO: 550216 - RNA, 22 nt, Chlamydophila pneumoniae TW-183
gaagacucucaucagcaaaacu

SEQ ID NO: 550217 - RNA, 18 nt, Chlamydophila pneumoniae TW-183
gaagaaaagagcucauca

SEQ ID NO: 550218 - RNA, 22 nt, Chlamydophila pneumoniae TW-183
gaacuguaacuugcauuuuuug

SEQ ID NO: 550219 - RNA, 21 nt, Chlamydophila pneumoniae TW-183
gacuauagggagacucuugag

SEQ ID NO: 550220 - RNA, 15 nt, Chlamydophila pneumoniae TW-183
gacuagcuuuucaug

SEQ ID NO: 550221 - RNA, 19 nt, Chlamydophila pneumoniae TW-183
gacuaaacaccuucuucua

SEQ ID NO: 550222 - RNA, 20 nt, Chlamydophila pneumoniae TW-183
gacuaaacaccuucuucuaa

SEQ ID NO: 550223 - RNA, 23 nt, Chlamydophila pneumoniae TW-183
gacgacguuuugcuguggaauuu

SEQ ID NO: 550224 - RNA, 18 nt, Chlamydophila pneumoniae TW-183
gaccaugaucuuagcucc

SEQ ID NO: 550225 - RNA, 13 nt, Chlamydophila pneumoniae TW-183
gaccgaaucucuc

SEQ ID NO: 550226 - RNA, 16 nt, Chlamydophila pneumoniae TW-183
gaacguacuuagguaa

SEQ ID NO: 550227 - RNA, 19 nt, Chlamydophila pneumoniae TW-183
gaacuaaaaguuuuuuauu

SEQ ID NO: 550228 - RNA, 23 nt, Chlamydophila pneumoniae TW-183
gaacagcauggacuccaagaaua

SEQ ID NO: 550229 - RNA, 20 nt, Chlamydophila pneumoniae TW-183
gaacaggagagagaaggcuc

SEQ ID NO: 550230 - RNA, 18 nt, Chlamydophila pneumoniae TW-183
gaacaggagagagaaggc

SEQ ID NO: 550231 - RNA, 21 nt, Chlamydophila pneumoniae TW-183
gaacaggagguguauccguag

SEQ ID NO: 550232 - RNA, 22 nt, Chlamydophila pneumoniae TW-183
gaacaagucggcaggagaggua

SEQ ID NO: 550233 - RNA, 17 nt, Chlamydophila pneumoniae TW-183
gaaaucggagggcuaca

SEQ ID NO: 550234 - RNA, 15 nt, Chlamydophila pneumoniae TW-183
gaaauacuuuuccua

SEQ ID NO: 550235 - RNA, 12 nt, Chlamydophila pneumoniae TW-183
gaaauccuccua

SEQ ID NO: 550236 - RNA, 14 nt, Chlamydophila pneumoniae TW-183
gaaaacauagagau

SEQ ID NO: 550237 - RNA, 14 nt, Chlamydophila pneumoniae TW-183
gaaaagaaccuagg

SEQ ID NO: 550238 - RNA, 12 nt, Chlamydophila pneumoniae TW-183
gaaaagagcuca

SEQ ID NO: 550239 - RNA, 19 nt, Chlamydophila pneumoniae TW-183
gaaaagagcucaucaauga

SEQ ID NO: 550240 - RNA, 20 nt, Chlamydophila pneumoniae TW-183
gaaaagagcucaucaaugag

SEQ ID NO: 550241 - RNA, 18 nt, Chlamydophila pneumoniae TW-183
cuuuuguuguuuuugcug

SEQ ID NO: 550242 - RNA, 18 nt, Chlamydophila pneumoniae TW-183
cuuuuguuuuagcucuuu

SEQ ID NO: 550243 - RNA, 14 nt, Chlamydophila pneumoniae TW-183
cuuuucugaagauu

SEQ ID NO: 550244 - RNA, 19 nt, Chlamydophila pneumoniae TW-183
cuuuucugaagauuuuuua

SEQ ID NO: 550245 - RNA, 14 nt, Chlamydophila pneumoniae TW-183
cuuuucuucuucgg

SEQ ID NO: 550246 - RNA, 17 nt, Chlamydophila pneumoniae TW-183
cuuugaucgcuugugca

SEQ ID NO: 550247 - RNA, 14 nt, Chlamydophila pneumoniae TW-183
cuuugcaugaggag

SEQ ID NO: 550248 - RNA, 21 nt, Chlamydophila pneumoniae TW-183
cuuugcaugaggagaccuuua

SEQ ID NO: 550249 - RNA, 15 nt, Chlamydophila pneumoniae TW-183
cuuugcgcuuguucu

SEQ ID NO: 550250 - RNA, 21 nt, Chlamydophila pneumoniae TW-183
cuuucaucagcaucggugucu

SEQ ID NO: 550251 - RNA, 23 nt, Chlamydophila pneumoniae TW-183
gagcagcuuuaucaggaucuuga

SEQ ID NO: 550252 - RNA, 11 nt, Chlamydophila pneumoniae TW-183
aaagcacauac

SEQ ID NO: 550253 - RNA, 19 nt, Chlamydophila pneumoniae TW-183
gagcauugacuugggauuc

SEQ ID NO: 550254 - RNA, 22 nt, Chlamydophila pneumoniae TW-183
gagagguaaccagagagcuuuu

SEQ ID NO: 550255 - RNA, 22 nt, Chlamydophila pneumoniae TW-183
gagaggaaaucccgagauauga

SEQ ID NO: 550256 - RNA, 17 nt, Chlamydophila pneumoniae TW-183
gagauuaccgaagagcc

SEQ ID NO: 550257 - RNA, 15 nt, Chlamydophila pneumoniae TW-183
gagauucauaaaacu

SEQ ID NO: 550258 - RNA, 23 nt, Chlamydophila pneumoniae TW-183
gagcuaugaugagaacguccuca

SEQ ID NO: 550259 - RNA, 18 nt, Chlamydophila pneumoniae TW-183
gagccuagagaguucuug

SEQ ID NO: 550260 - RNA, 23 nt, Chlamydophila pneumoniae TW-183
gaguuucuacgcgcucuucuuuc

SEQ ID NO: 550261 - RNA, 19 nt, Chlamydophila pneumoniae TW-183
gaguucgcggaucuucuuc

SEQ ID NO: 550262 - RNA, 16 nt, Chlamydophila pneumoniae TW-183
gauaacguugccuguu

SEQ ID NO: 550263 - RNA, 16 nt, Chlamydophila pneumoniae TW-183
gauaacgagacaugau

SEQ ID NO: 550264 - RNA, 14 nt, Chlamydophila pneumoniae TW-183
gaguaugaggagau

SEQ ID NO: 550265 - RNA, 19 nt, Chlamydophila pneumoniae TW-183
gaguaugaggagauaaaga

SEQ ID NO: 550266 - RNA, 22 nt, Chlamydophila pneumoniae TW-183
gagucgaaacacucaugaaagu

SEQ ID NO: 550267 - RNA, 16 nt, Chlamydophila pneumoniae TW-183
gaggguuccaagagcu

SEQ ID NO: 550268 - RNA, 14 nt, Chlamydophila pneumoniae TW-183
gagguaaccagaga

SEQ ID NO: 550269 - RNA, 17 nt, Chlamydophila pneumoniae TW-183
gagguaaccagagagcu

SEQ ID NO: 550270 - RNA, 13 nt, Chlamydophila pneumoniae TW-183
gaggagauaaaga

SEQ ID NO: 550271 - RNA, 20 nt, Chlamydophila pneumoniae TW-183
gaggagaauagcaagcacuu

SEQ ID NO: 550272 - RNA, 19 nt, Chlamydophila pneumoniae TW-183
gaucugaaguugaaaugag

SEQ ID NO: 550273 - RNA, 19 nt, Chlamydophila pneumoniae TW-183
gaucuggagagggaaggaa

SEQ ID NO: 550274 - RNA, 22 nt, Chlamydophila pneumoniae TW-183
gaucuagagaagaaaagagcuc

SEQ ID NO: 550275 - RNA, 18 nt, Chlamydophila pneumoniae TW-183
gaucgggucuacaacagu

SEQ ID NO: 550276 - RNA, 22 nt, Chlamydophila pneumoniae TW-183
gaucgauuaccuaaaacaaaau

SEQ ID NO: 550277 - RNA, 15 nt, Chlamydophila pneumoniae TW-183
gauccgaaaagaacc

SEQ ID NO: 550278 - RNA, 22 nt, Chlamydophila pneumoniae TW-183
gaucccgggccuaucucuauga

SEQ ID NO: 550279 - RNA, 19 nt, Chlamydophila pneumoniae TW-183
gauccaucggcauuucucc

SEQ ID NO: 550280 - RNA, 16 nt, Chlamydophila pneumoniae TW-183
gaucauuuuugcuaga

SEQ ID NO: 550281 - RNA, 21 nt, Chlamydophila pneumoniae TW-183
gaucaucuacgauguuuucuu

SEQ ID NO: 550282 - RNA, 15 nt, Chlamydophila pneumoniae TW-183
gauaugaagagacgu

SEQ ID NO: 550283 - RNA, 16 nt, Chlamydophila pneumoniae TW-183
gauauauagagcagac

SEQ ID NO: 550284 - RNA, 23 nt, Chlamydophila pneumoniae TW-183
gauaggugagguuugugcugcuu

SEQ ID NO: 550285 - RNA, 13 nt, Chlamydophila pneumoniae TW-183
gauaggaaccacu

SEQ ID NO: 550286 - RNA, 18 nt, Chlamydophila pneumoniae TW-183
gauacucugaacaggaau

SEQ ID NO: 550287 - RNA, 13 nt, Chlamydophila pneumoniae TW-183
gauagagaaaaua

SEQ ID NO: 550288 - RNA, 15 nt, Chlamydophila pneumoniae TW-183
gauaagauaaagaau

SEQ ID NO: 550289 - RNA, 17 nt, Chlamydophila pneumoniae TW-183
gaugcugaggacgcaga

SEQ ID NO: 550290 - RNA, 14 nt, Chlamydophila pneumoniae TW-183
gaugccaagaaaua

SEQ ID NO: 550291 - RNA, 20 nt, Chlamydophila pneumoniae TW-183
gaugcaguccacgcuaucuc

SEQ ID NO: 550292 - RNA, 22 nt, Chlamydophila pneumoniae TW-183
gaugaugcccugacguuuugau

SEQ ID NO: 550293 - RNA, 15 nt, Chlamydophila pneumoniae TW-183
aaagccuaugggagg

SEQ ID NO: 550294 - RNA, 15 nt, Chlamydophila pneumoniae TW-183
gaugacuuucagagc

SEQ ID NO: 550295 - RNA, 14 nt, Chlamydophila pneumoniae TW-183
gaugaauaccagaa

SEQ ID NO: 550296 - RNA, 23 nt, Chlamydophila pneumoniae TW-183
gaugaauccaaaauaaauagaag

SEQ ID NO: 550297 - RNA, 20 nt, Chlamydophila pneumoniae TW-183
gaugugauguucugcugcuu

SEQ ID NO: 550298 - RNA, 20 nt, Chlamydophila pneumoniae TW-183
gaugugccgugacuccagaa

SEQ ID NO: 550299 - RNA, 19 nt, Chlamydophila pneumoniae TW-183
gauuaggaacaagucggca

SEQ ID NO: 550300 - RNA, 14 nt, Chlamydophila pneumoniae TW-183
gauuauucuagagu

SEQ ID NO: 550301 - RNA, 14 nt, Chlamydophila pneumoniae TW-183
gauuaccuaaaaca

SEQ ID NO: 550302 - RNA, 18 nt, Chlamydophila pneumoniae TW-183
gauuaccuaaaacaaaau

SEQ ID NO: 550303 - RNA, 19 nt, Chlamydophila pneumoniae TW-183
gaugcuuagcaaaggcaac

SEQ ID NO: 550304 - RNA, 11 nt, Chlamydophila pneumoniae TW-183
gauuuucucua

SEQ ID NO: 550305 - RNA, 15 nt, Chlamydophila pneumoniae TW-183
gauuuccuuuuggga

SEQ ID NO: 550306 - RNA, 16 nt, Chlamydophila pneumoniae TW-183
gauuucuccagcagcu

SEQ ID NO: 550307 - RNA, 14 nt, Chlamydophila pneumoniae TW-183
gauuucuuuuucag

SEQ ID NO: 550308 - RNA, 20 nt, Chlamydophila pneumoniae TW-183
gauuucuuuuucagcuucua

SEQ ID NO: 550309 - RNA, 15 nt, Chlamydophila pneumoniae TW-183
gauuguaaaaguagc

SEQ ID NO: 550310 - RNA, 19 nt, Chlamydophila pneumoniae TW-183
gauuuaaaugcaagugcuu

SEQ ID NO: 550311 - RNA, 13 nt, Chlamydophila pneumoniae TW-183
gauugccaggaga

SEQ ID NO: 550312 - RNA, 20 nt, Chlamydophila pneumoniae TW-183
gauucucucugccuaccaaa

SEQ ID NO: 550313 - RNA, 18 nt, Chlamydophila pneumoniae TW-183
gauugaggauaaguucuu

SEQ ID NO: 550314 - RNA, 21 nt, Chlamydophila pneumoniae TW-183
gauugaggauaaguucuucca

SEQ ID NO: 550315 - RNA, 21 nt, Chlamydophila pneumoniae TW-183
gcaaacuccccaguuuuccau

SEQ ID NO: 550316 - RNA, 17 nt, Chlamydophila pneumoniae TW-183
gcaaaagcaaggcugcc

SEQ ID NO: 550317 - RNA, 17 nt, Chlamydophila pneumoniae TW-183
gcaaaaaugaaagaaac

SEQ ID NO: 550318 - RNA, 19 nt, Chlamydophila pneumoniae TW-183
gauuuuuuugguugcuucu

SEQ ID NO: 550319 - RNA, 12 nt, Chlamydophila pneumoniae TW-183
gcauuuucucug

SEQ ID NO: 550320 - RNA, 17 nt, Chlamydophila pneumoniae TW-183
gcauuuucuucuugcaa

SEQ ID NO: 550321 - RNA, 15 nt, Chlamydophila pneumoniae TW-183
gcauuucuuucucuu

SEQ ID NO: 550322 - RNA, 18 nt, Chlamydophila pneumoniae TW-183
gcauuggaaaucuuauaa

SEQ ID NO: 550323 - RNA, 22 nt, Chlamydophila pneumoniae TW-183
gcaugcaucuuaucaagagcuc

SEQ ID NO: 550324 - RNA, 22 nt, Chlamydophila pneumoniae TW-183
gcaugccauaaucuauaggauu

SEQ ID NO: 550325 - RNA, 19 nt, Chlamydophila pneumoniae TW-183
gcauaaccuuugacaacac

SEQ ID NO: 550326 - RNA, 20 nt, Chlamydophila pneumoniae TW-183
gccaggagagcuaacagcac

SEQ ID NO: 550327 - RNA, 23 nt, Chlamydophila pneumoniae TW-183
gccagcagcgaggaguuuuccaa

SEQ ID NO: 550328 - RNA, 17 nt, Chlamydophila pneumoniae TW-183
gccagagauucuucaca

SEQ ID NO: 550329 - RNA, 19 nt, Chlamydophila pneumoniae TW-183
gcccuugcagcgacaacac

SEQ ID NO: 550330 - RNA, 22 nt, Chlamydophila pneumoniae TW-183
gccccuuaaagagaaucuccuc

SEQ ID NO: 550331 - RNA, 13 nt, Chlamydophila pneumoniae TW-183
gcgcucuucuuuc

SEQ ID NO: 550332 - RNA, 11 nt, Chlamydophila pneumoniae TW-183
gccuuucucuu

SEQ ID NO: 550333 - RNA, 22 nt, Chlamydophila pneumoniae TW-183
gccugucuauaaaauaaauuuu

SEQ ID NO: 550334 - RNA, 18 nt, Chlamydophila pneumoniae TW-183
gccuauagaaauuagagu

SEQ ID NO: 550335 - RNA, 12 nt, Chlamydophila pneumoniae TW-183
gccucauugccg

SEQ ID NO: 550336 - RNA, 16 nt, Chlamydophila pneumoniae TW-183
gccucgagcagaaacu

SEQ ID NO: 550337 - RNA, 22 nt, Chlamydophila pneumoniae TW-183
ggucacuauagaucucuugaag

SEQ ID NO: 550338 - RNA, 22 nt, Chlamydophila pneumoniae TW-183
ggucgauugagauugaggauaa

SEQ ID NO: 550339 - RNA, 20 nt, Chlamydophila pneumoniae TW-183
gguaucuccuugauaaaacg

SEQ ID NO: 550340 - RNA, 12 nt, Chlamydophila pneumoniae TW-183
ggguuucccugu

SEQ ID NO: 550341 - RNA, 15 nt, Chlamydophila pneumoniae TW-183
gggucuacaacaguu

SEQ ID NO: 550342 - RNA, 22 nt, Chlamydophila pneumoniae TW-183
ggggaucuuaggaaauuuggau

SEQ ID NO: 550343 - RNA, 14 nt, Chlamydophila pneumoniae TW-183
gggcauucucuaaa

SEQ ID NO: 550344 - RNA, 15 nt, Chlamydophila pneumoniae TW-183
gggcaggggauaggc

SEQ ID NO: 550345 - RNA, 17 nt, Chlamydophila pneumoniae TW-183
gggaucuucagagagaa

SEQ ID NO: 550346 - RNA, 14 nt, Chlamydophila pneumoniae TW-183
gggaucacagucuu

SEQ ID NO: 550347 - RNA, 16 nt, Chlamydophila pneumoniae TW-183
gggaggaauuccucuc

SEQ ID NO: 550348 - RNA, 22 nt, Chlamydophila pneumoniae TW-183
gggagcgaaguuuuucuggaag

SEQ ID NO: 550349 - RNA, 21 nt, Chlamydophila pneumoniae TW-183
ggcuuuaccauagaaagauaa

SEQ ID NO: 550350 - RNA, 22 nt, Chlamydophila pneumoniae TW-183
ggcugcuuuuguuguuuuugcu

SEQ ID NO: 550351 - RNA, 14 nt, Chlamydophila pneumoniae TW-183
ggcugagagaagca

SEQ ID NO: 550352 - RNA, 24 nt, Chlamydophila pneumoniae TW-183
ggcugauucucccaauauccagaa

SEQ ID NO: 550353 - RNA, 14 nt, Chlamydophila pneumoniae TW-183
aaauagaaaacaua

SEQ ID NO: 550354 - RNA, 14 nt, Chlamydophila pneumoniae TW-183
ggccccuggaauuu

SEQ ID NO: 550355 - RNA, 18 nt, Chlamydophila pneumoniae TW-183
aaagucacggcgaaagcu

SEQ ID NO: 550356 - RNA, 19 nt, Chlamydophila pneumoniae TW-183
aaaguagccauuccaugga

SEQ ID NO: 550357 - RNA, 16 nt, Chlamydophila pneumoniae TW-183
ggauucugucuauaag

SEQ ID NO: 550358 - RNA, 14 nt, Chlamydophila pneumoniae TW-183
aaaguaaucacuuc

SEQ ID NO: 550359 - RNA, 23 nt, Chlamydophila pneumoniae TW-183
ggaucuucuucuggcugagagaa

SEQ ID NO: 550360 - RNA, 12 nt, Chlamydophila pneumoniae TW-183
ggauccaggagu

SEQ ID NO: 550361 - RNA, 20 nt, Chlamydophila pneumoniae TW-183
ggaucgcucucuccaugagc

SEQ ID NO: 550362 - RNA, 15 nt, Chlamydophila pneumoniae TW-183
ggauccaucggcauu

SEQ ID NO: 550363 - RNA, 15 nt, Chlamydophila pneumoniae TW-183
ggauaaguucuucca

SEQ ID NO: 550364 - RNA, 20 nt, Chlamydophila pneumoniae TW-183
ggauauugucaagaggcugu

SEQ ID NO: 550365 - RNA, 20 nt, Chlamydophila pneumoniae TW-183
ggauacucugaacaggaaua

SEQ ID NO: 550366 - RNA, 17 nt, Chlamydophila pneumoniae TW-183
ggauaaaaaguuuuugu

SEQ ID NO: 550367 - RNA, 14 nt, Chlamydophila pneumoniae TW-183
ggaguuuuccuaaa

SEQ ID NO: 550368 - RNA, 13 nt, Chlamydophila pneumoniae TW-183
ggagagggaagga

SEQ ID NO: 550369 - RNA, 19 nt, Chlamydophila pneumoniae TW-183
ggagaccuuuauagauaug

SEQ ID NO: 550370 - RNA, 17 nt, Chlamydophila pneumoniae TW-183
ggaccuguuuucuuuuc

SEQ ID NO: 550371 - RNA, 18 nt, Chlamydophila pneumoniae TW-183
ggacgcuaauccuccucg

SEQ ID NO: 550372 - RNA, 14 nt, Chlamydophila pneumoniae TW-183
ggacaauauagaga

SEQ ID NO: 550373 - RNA, 14 nt, Chlamydophila pneumoniae TW-183
ggacaaaucuccca

SEQ ID NO: 550374 - RNA, 18 nt, Chlamydophila pneumoniae TW-183
gcuuuccuccuuguuucc

SEQ ID NO: 550375 - RNA, 14 nt, Chlamydophila pneumoniae TW-183
ggaacaguauaauc

SEQ ID NO: 550376 - RNA, 20 nt, Chlamydophila pneumoniae TW-183
gcuuuccagggcauucucua

SEQ ID NO: 550377 - RNA, 23 nt, Chlamydophila pneumoniae TW-183
gcuugcugauuucuuuuucagcu

SEQ ID NO: 550378 - RNA, 19 nt, Chlamydophila pneumoniae TW-183
aaaggcaacaacgccuaca

SEQ ID NO: 550379 - RNA, 18 nt, Chlamydophila pneumoniae TW-183
gcuucuuguuuuugugga

SEQ ID NO: 550380 - RNA, 17 nt, Chlamydophila pneumoniae TW-183
gcuucgcaaucuuugau

SEQ ID NO: 550381 - RNA, 13 nt, Chlamydophila pneumoniae TW-183
gcuucgcaaucuu

SEQ ID NO: 550382 - RNA, 16 nt, Chlamydophila pneumoniae TW-183
gcuucgcaaucuuuga

SEQ ID NO: 550383 - RNA, 16 nt, Chlamydophila pneumoniae TW-183
gcuucuauuuuagaau

SEQ ID NO: 550384 - RNA, 16 nt, Chlamydophila pneumoniae TW-183
gcuucuacagcaucgg

SEQ ID NO: 550385 - RNA, 13 nt, Chlamydophila pneumoniae TW-183
gcuguuccaagag

SEQ ID NO: 550386 - RNA, 17 nt, Chlamydophila pneumoniae TW-183
aaaggaccuguuuucuu

SEQ ID NO: 550387 - RNA, 19 nt, Chlamydophila pneumoniae TW-183
gcugcuuuuguuguuuuug

SEQ ID NO: 550388 - RNA, 15 nt, Chlamydophila pneumoniae TW-183
gcucucuccaugagc

SEQ ID NO: 550389 - RNA, 16 nt, Chlamydophila pneumoniae TW-183
gcugaagauuuuuucu

SEQ ID NO: 550390 - RNA, 11 nt, Chlamydophila pneumoniae TW-183
gcugaagauuu

SEQ ID NO: 550391 - RNA, 21 nt, Chlamydophila pneumoniae TW-183
gcucgguacgucuuucaccaa

SEQ ID NO: 550392 - RNA, 15 nt, Chlamydophila pneumoniae TW-183
gcucuagucuuucaa

SEQ ID NO: 550393 - RNA, 17 nt, Chlamydophila pneumoniae TW-183
gcucuauaaauuucuca

SEQ ID NO: 550394 - RNA, 14 nt, Chlamydophila pneumoniae TW-183
gcuccuugacuaaa

SEQ ID NO: 550395 - RNA, 14 nt, Chlamydophila pneumoniae TW-183
gcucauaagaaauu

SEQ ID NO: 550396 - RNA, 12 nt, Chlamydophila pneumoniae TW-183
guuuucuuuucu

SEQ ID NO: 550397 - RNA, 13 nt, Chlamydophila pneumoniae TW-183
guuucuucaucug

SEQ ID NO: 550398 - RNA, 19 nt, Chlamydophila pneumoniae TW-183
aaauauucuuucaaaccac

SEQ ID NO: 550399 - RNA, 14 nt, Chlamydophila pneumoniae TW-183
aaauaucggaagag

SEQ ID NO: 550400 - RNA, 13 nt, Chlamydophila pneumoniae TW-183
guugcacuuuccg

SEQ ID NO: 550401 - RNA, 18 nt, Chlamydophila pneumoniae TW-183
guucgcggaucuucuucu

SEQ ID NO: 550402 - RNA, 22 nt, Chlamydophila pneumoniae TW-183
guuccauagaguaucuaaaacu

SEQ ID NO: 550403 - RNA, 15 nt, Chlamydophila pneumoniae TW-183
guuaggauauggugu

SEQ ID NO: 550404 - RNA, 19 nt, Chlamydophila pneumoniae TW-183
guuaacaaguaccaagaaa

SEQ ID NO: 550405 - RNA, 13 nt, Chlamydophila pneumoniae TW-183
guguugaauaaga

SEQ ID NO: 550406 - RNA, 16 nt, Chlamydophila pneumoniae TW-183
gugugugguaaaaaua

SEQ ID NO: 550407 - RNA, 18 nt, Chlamydophila pneumoniae TW-183
gugugguaaaaauauagg

SEQ ID NO: 550408 - RNA, 16 nt, Chlamydophila pneumoniae TW-183
gugguuggauccaucg

SEQ ID NO: 550409 - RNA, 13 nt, Chlamydophila pneumoniae TW-183
gugucuacaaaga

SEQ ID NO: 550410 - RNA, 15 nt, Chlamydophila pneumoniae TW-183
aaauauacugccagc

SEQ ID NO: 550411 - RNA, 16 nt, Chlamydophila pneumoniae TW-183
aaauaguucaucauau

SEQ ID NO: 550412 - RNA, 19 nt, Chlamydophila pneumoniae TW-183
aaauagggugggagucucu

SEQ ID NO: 550413 - RNA, 19 nt, Chlamydophila pneumoniae TW-183
gucuugacguugcgaacag

SEQ ID NO: 550414 - RNA, 14 nt, Chlamydophila pneumoniae TW-183
gucugcugaggaga

SEQ ID NO: 550415 - RNA, 19 nt, Chlamydophila pneumoniae TW-183
gucuccuggaacaguauaa

SEQ ID NO: 550416 - RNA, 21 nt, Chlamydophila pneumoniae TW-183
gucucgaaacucuuugaggau

SEQ ID NO: 550417 - RNA, 19 nt, Chlamydophila pneumoniae TW-183
guccuugcagcccugcaua

SEQ ID NO: 550418 - RNA, 23 nt, Chlamydophila pneumoniae TW-183
gucaucaguggcgacugcaacag

SEQ ID NO: 550419 - RNA, 15 nt, Chlamydophila pneumoniae TW-183
uacgcaaaguacuaa

SEQ ID NO: 550420 - RNA, 18 nt, Chlamydophila pneumoniae TW-183
uacgcaaguaaagaaauu

SEQ ID NO: 550421 - RNA, 16 nt, Chlamydophila pneumoniae TW-183
uacgcaaguaaagaaa

SEQ ID NO: 550422 - RNA, 15 nt, Chlamydophila pneumoniae TW-183
uacgcaaguaaagaa

SEQ ID NO: 550423 - RNA, 13 nt, Chlamydophila pneumoniae TW-183
uacuacucucauc

SEQ ID NO: 550424 - RNA, 14 nt, Chlamydophila pneumoniae TW-183
uacgcgcucuucuu

SEQ ID NO: 550425 - RNA, 17 nt, Chlamydophila pneumoniae TW-183
uacugccagcgaucaca

SEQ ID NO: 550426 - RNA, 20 nt, Chlamydophila pneumoniae TW-183
uacucugaacaggaauagaa

SEQ ID NO: 550427 - RNA, 15 nt, Chlamydophila pneumoniae TW-183
uacuacucucaucaa

SEQ ID NO: 550428 - RNA, 17 nt, Chlamydophila pneumoniae TW-183
uacuacuuacaagaaca

SEQ ID NO: 550429 - RNA, 15 nt, Chlamydophila pneumoniae TW-183
uacuacuuacaagaa

SEQ ID NO: 550430 - RNA, 18 nt, Chlamydophila pneumoniae TW-183
uacuacuuacaagaacaa

SEQ ID NO: 550431 - RNA, 23 nt, Chlamydophila pneumoniae TW-183
uacuuuaggaggggggauucugu

SEQ ID NO: 550432 - RNA, 19 nt, Chlamydophila pneumoniae TW-183
uacuucaagaaaaaccccu

SEQ ID NO: 550433 - RNA, 21 nt, Chlamydophila pneumoniae TW-183
uacuggagagguaaccagaga

SEQ ID NO: 550434 - RNA, 17 nt, Chlamydophila pneumoniae TW-183
uaccaucgucuccaaaa

SEQ ID NO: 550435 - RNA, 17 nt, Chlamydophila pneumoniae TW-183
uacaucuccaagccaug

SEQ ID NO: 550436 - RNA, 20 nt, Chlamydophila pneumoniae TW-183
uacaucaaugauaucgccuu

SEQ ID NO: 550437 - RNA, 17 nt, Chlamydophila pneumoniae TW-183
uacagugacauccggau

SEQ ID NO: 550438 - RNA, 14 nt, Chlamydophila pneumoniae TW-183
uacaagcuuagcaa

SEQ ID NO: 550439 - RNA, 22 nt, Chlamydophila pneumoniae TW-183
uacaagugucugaguuagcuuu

SEQ ID NO: 550440 - RNA, 14 nt, Chlamydophila pneumoniae TW-183
uaauagcaggaguu

SEQ ID NO: 550441 - RNA, 17 nt, Chlamydophila pneumoniae TW-183
uaauacgucucaucgcu

SEQ ID NO: 550442 - RNA, 19 nt, Chlamydophila pneumoniae TW-183
uaauauccauaagaucucu

SEQ ID NO: 550443 - RNA, 24 nt, Chlamydophila pneumoniae TW-183
uacaaauuaccuugagacaaagaa

SEQ ID NO: 550444 - RNA, 16 nt, Chlamydophila pneumoniae TW-183
uacaaagauccuaaua

SEQ ID NO: 550445 - RNA, 13 nt, Chlamydophila pneumoniae TW-183
uacaaaauuauua

SEQ ID NO: 550446 - RNA, 20 nt, Chlamydophila pneumoniae TW-183
uaaucgagagaagaaauucu

SEQ ID NO: 550447 - RNA, 14 nt, Chlamydophila pneumoniae TW-183
uaauuacagaaucc

SEQ ID NO: 550448 - RNA, 20 nt, Chlamydophila pneumoniae TW-183
uaacuuaaagacuugcuucc

SEQ ID NO: 550449 - RNA, 13 nt, Chlamydophila pneumoniae TW-183
aaauccgauaaga

SEQ ID NO: 550450 - RNA, 16 nt, Chlamydophila pneumoniae TW-183
aaaucccgccuuucua

SEQ ID NO: 550451 - RNA, 22 nt, Chlamydophila pneumoniae TW-183
uaacugaggcaaagauuuccaa

SEQ ID NO: 550452 - RNA, 16 nt, Chlamydophila pneumoniae TW-183
uaacugaggcaaagau

SEQ ID NO: 550453 - RNA, 18 nt, Chlamydophila pneumoniae TW-183
uaacucagagauugccag

SEQ ID NO: 550454 - RNA, 20 nt, Chlamydophila pneumoniae TW-183
uaagaaucgaguucuucauu

SEQ ID NO: 550455 - RNA, 20 nt, Chlamydophila pneumoniae TW-183
uaagaauguagcuguuccaa

SEQ ID NO: 550456 - RNA, 19 nt, Chlamydophila pneumoniae TW-183
uaagaagacuagcuuuuca

SEQ ID NO: 550457 - RNA, 18 nt, Chlamydophila pneumoniae TW-183
uaacuuggugagcagcuu

SEQ ID NO: 550458 - RNA, 21 nt, Chlamydophila pneumoniae TW-183
uaacuuggugagcagcuuuau

SEQ ID NO: 550459 - RNA, 22 nt, Chlamydophila pneumoniae TW-183
uaacuuggugagcagcuuuauc

SEQ ID NO: 550460 - RNA, 21 nt, Chlamydophila pneumoniae TW-183
uaacuugcauuuuuuggaaua

SEQ ID NO: 550461 - RNA, 14 nt, Chlamydophila pneumoniae TW-183
uaagauccaaaaau

SEQ ID NO: 550462 - RNA, 20 nt, Chlamydophila pneumoniae TW-183
uaagauacuucuccacagcu

SEQ ID NO: 550463 - RNA, 15 nt, Chlamydophila pneumoniae TW-183
uaagauacuucucca

SEQ ID NO: 550464 - RNA, 19 nt, Chlamydophila pneumoniae TW-183
uaagacaauaaaauagccc

SEQ ID NO: 550465 - RNA, 16 nt, Chlamydophila pneumoniae TW-183
uaagacgugcaucgcu

SEQ ID NO: 550466 - RNA, 23 nt, Chlamydophila pneumoniae TW-183
uaaguccuucuucccagccuuga

SEQ ID NO: 550467 - RNA, 19 nt, Chlamydophila pneumoniae TW-183
uaaguccuucuucccagcc

SEQ ID NO: 550468 - RNA, 16 nt, Chlamydophila pneumoniae TW-183
uaaguccuucuuccca

SEQ ID NO: 550469 - RNA, 17 nt, Chlamydophila pneumoniae TW-183
uaaguaaccaauacagc

SEQ ID NO: 550470 - RNA, 22 nt, Chlamydophila pneumoniae TW-183
uaagggggaucuucagagagaa

SEQ ID NO: 550471 - RNA, 16 nt, Chlamydophila pneumoniae TW-183
uaaguucuugauuuuc

SEQ ID NO: 550472 - RNA, 14 nt, Chlamydophila pneumoniae TW-183
uaauaaaagcaccc

SEQ ID NO: 550473 - RNA, 15 nt, Chlamydophila pneumoniae TW-183
uaauaaaagaacauu

SEQ ID NO: 550474 - RNA, 13 nt, Chlamydophila pneumoniae TW-183
uaaggcuccagca

SEQ ID NO: 550475 - RNA, 16 nt, Chlamydophila pneumoniae TW-183
uaaggauguuguggau

SEQ ID NO: 550476 - RNA, 14 nt, Chlamydophila pneumoniae TW-183
uaaggacaaaucuc

SEQ ID NO: 550477 - RNA, 21 nt, Chlamydophila pneumoniae TW-183
uaagcuaauaagauccaaaaa

SEQ ID NO: 550478 - RNA, 20 nt, Chlamydophila pneumoniae TW-183
uaagcuaauaagauccaaaa

SEQ ID NO: 550479 - RNA, 20 nt, Chlamydophila pneumoniae TW-183
uaagcuggauucugucuaua

SEQ ID NO: 550480 - RNA, 19 nt, Chlamydophila pneumoniae TW-183
uaagcuggauucugucuau

SEQ ID NO: 550481 - RNA, 17 nt, Chlamydophila pneumoniae TW-183
uaagcucauaagaaauu

SEQ ID NO: 550482 - RNA, 19 nt, Chlamydophila pneumoniae TW-183
uaagcuccauaaaaauagg

SEQ ID NO: 550483 - RNA, 12 nt, Chlamydophila pneumoniae TW-183
uaagauuuugaa

SEQ ID NO: 550484 - RNA, 12 nt, Chlamydophila pneumoniae TW-183
uaaccagagagc

SEQ ID NO: 550485 - RNA, 19 nt, Chlamydophila pneumoniae TW-183
uaacaaguaccaagaaaau

SEQ ID NO: 550486 - RNA, 22 nt, Chlamydophila pneumoniae TW-183
uaacaaguaccaagaaaauagu

SEQ ID NO: 550487 - RNA, 14 nt, Chlamydophila pneumoniae TW-183
uaaauuuuuccuuc

SEQ ID NO: 550488 - RNA, 19 nt, Chlamydophila pneumoniae TW-183
uaaaugcuauuuuccucua

SEQ ID NO: 550489 - RNA, 23 nt, Chlamydophila pneumoniae TW-183
uaaacagcgguugccuuucucuu

SEQ ID NO: 550490 - RNA, 18 nt, Chlamydophila pneumoniae TW-183
guuuugcuguggaauuuu

SEQ ID NO: 550491 - RNA, 15 nt, Chlamydophila pneumoniae TW-183
uaaagacaucucuuu

SEQ ID NO: 550492 - RNA, 13 nt, Chlamydophila pneumoniae TW-183
uaaagaauucucc

SEQ ID NO: 550493 - RNA, 19 nt, Chlamydophila pneumoniae TW-183
uaaacucuccaaaagcucu

SEQ ID NO: 550494 - RNA, 12 nt, Chlamydophila pneumoniae TW-183
uaaacucuccaa

SEQ ID NO: 550495 - RNA, 14 nt, Chlamydophila pneumoniae TW-183
uaaacucuccaaaa

SEQ ID NO: 550496 - RNA, 23 nt, Chlamydophila pneumoniae TW-183
uaaaccuaccucugggaagacuc

SEQ ID NO: 550497 - RNA, 13 nt, Chlamydophila pneumoniae TW-183
uaaagcuuuuccg

SEQ ID NO: 550498 - RNA, 19 nt, Chlamydophila pneumoniae TW-183
uaaagauguagaauaacgc

SEQ ID NO: 550499 - RNA, 22 nt, Chlamydophila pneumoniae TW-183
ucacagcauuuucucugagcag

SEQ ID NO: 550500 - RNA, 12 nt, Chlamydophila pneumoniae TW-183
ucaaugagaaau

SEQ ID NO: 550501 - RNA, 13 nt, Chlamydophila pneumoniae TW-183
ucaauccaagaau

SEQ ID NO: 550502 - RNA, 14 nt, Chlamydophila pneumoniae TW-183
ucaauugaaucaga

SEQ ID NO: 550503 - RNA, 19 nt, Chlamydophila pneumoniae TW-183
ucaacuacaucuccaagcc

SEQ ID NO: 550504 - RNA, 13 nt, Chlamydophila pneumoniae TW-183
ucaacuacaucuc

SEQ ID NO: 550505 - RNA, 15 nt, Chlamydophila pneumoniae TW-183
ucaacuacaucucca

SEQ ID NO: 550506 - RNA, 14 nt, Chlamydophila pneumoniae TW-183
ucaacaagaauaac

SEQ ID NO: 550507 - RNA, 21 nt, Chlamydophila pneumoniae TW-183
ucaacauucuucugucuguau

SEQ ID NO: 550508 - RNA, 21 nt, Chlamydophila pneumoniae TW-183
ucaaaccacggauuuucucua

SEQ ID NO: 550509 - RNA, 18 nt, Chlamydophila pneumoniae TW-183
ucaaauagauuuuuacuu

SEQ ID NO: 550510 - RNA, 16 nt, Chlamydophila pneumoniae TW-183
ucacuucugaugacgu

SEQ ID NO: 550511 - RNA, 16 nt, Chlamydophila pneumoniae TW-183
ucacuucaucgacagu

SEQ ID NO: 550512 - RNA, 13 nt, Chlamydophila pneumoniae TW-183
ucacuaucaugga

SEQ ID NO: 550513 - RNA, 14 nt, Chlamydophila pneumoniae TW-183
ucagauuagaguua

SEQ ID NO: 550514 - RNA, 16 nt, Chlamydophila pneumoniae TW-183
ucagaaucuuugugau

SEQ ID NO: 550515 - RNA, 19 nt, Chlamydophila pneumoniae TW-183
ucagagauugccaggagag

SEQ ID NO: 550516 - RNA, 18 nt, Chlamydophila pneumoniae TW-183
ucaggugacuaaacaccu

SEQ ID NO: 550517 - RNA, 23 nt, Chlamydophila pneumoniae TW-183
ucaggauacucugaacaggaaua

SEQ ID NO: 550518 - RNA, 20 nt, Chlamydophila pneumoniae TW-183
ucagcccacuguuuugcuuc

SEQ ID NO: 550519 - RNA, 20 nt, Chlamydophila pneumoniae TW-183
ucagcaucggugucuacaaa

SEQ ID NO: 550520 - RNA, 19 nt, Chlamydophila pneumoniae TW-183
uauuaggcuuuuuucuauu

SEQ ID NO: 550521 - RNA, 17 nt, Chlamydophila pneumoniae TW-183
uauuaggcuuuuuucua

SEQ ID NO: 550522 - RNA, 15 nt, Chlamydophila pneumoniae TW-183
uauucuagaguugcu

SEQ ID NO: 550523 - RNA, 13 nt, Chlamydophila pneumoniae TW-183
uauucuuggaaua

SEQ ID NO: 550524 - RNA, 20 nt, Chlamydophila pneumoniae TW-183
uaugggaggaauuccucuca

SEQ ID NO: 550525 - RNA, 19 nt, Chlamydophila pneumoniae TW-183
uaugacacagcuaaucaau

SEQ ID NO: 550526 - RNA, 15 nt, Chlamydophila pneumoniae TW-183
uaugaugccucauug

SEQ ID NO: 550527 - RNA, 12 nt, Chlamydophila pneumoniae TW-183
uaugcaucaaug

SEQ ID NO: 550528 - RNA, 13 nt, Chlamydophila pneumoniae TW-183
uaucuaaaacuuc

SEQ ID NO: 550529 - RNA, 17 nt, Chlamydophila pneumoniae TW-183
uaucuucaaaaguaauc

SEQ ID NO: 550530 - RNA, 15 nt, Chlamydophila pneumoniae TW-183
uaugaaacccauaau

SEQ ID NO: 550531 - RNA, 22 nt, Chlamydophila pneumoniae TW-183
uauccuugaaauugcucuugcu

SEQ ID NO: 550532 - RNA, 14 nt, Chlamydophila pneumoniae TW-183
uaucgaguucuuuu

SEQ ID NO: 550533 - RNA, 18 nt, Chlamydophila pneumoniae TW-183
uauccagaaauacgucca

SEQ ID NO: 550534 - RNA, 14 nt, Chlamydophila pneumoniae TW-183
uauauaaaacauag

SEQ ID NO: 550535 - RNA, 23 nt, Chlamydophila pneumoniae TW-183
uauaagggggaucuucagagaga

SEQ ID NO: 550536 - RNA, 16 nt, Chlamydophila pneumoniae TW-183
uagucuuucuaagaag

SEQ ID NO: 550537 - RNA, 20 nt, Chlamydophila pneumoniae TW-183
uccuaagucguuaacaucaa

SEQ ID NO: 550538 - RNA, 19 nt, Chlamydophila pneumoniae TW-183
uccuaagucguuaacauca

SEQ ID NO: 550539 - RNA, 21 nt, Chlamydophila pneumoniae TW-183
uccuagagucgaguuucuagu

SEQ ID NO: 550540 - RNA, 16 nt, Chlamydophila pneumoniae TW-183
uccuacuccuaaagua

SEQ ID NO: 550541 - RNA, 20 nt, Chlamydophila pneumoniae TW-183
uccuaugucaagaagugcuu

SEQ ID NO: 550542 - RNA, 19 nt, Chlamydophila pneumoniae TW-183
uccuauuuuagcauaaucu

SEQ ID NO: 550543 - RNA, 15 nt, Chlamydophila pneumoniae TW-183
uccuguagagcaaga

SEQ ID NO: 550544 - RNA, 22 nt, Chlamydophila pneumoniae TW-183
uccuuaaugguagcuuaagaau

SEQ ID NO: 550545 - RNA, 22 nt, Chlamydophila pneumoniae TW-183
uccuuaacaacaucacuuauau

SEQ ID NO: 550546 - RNA, 17 nt, Chlamydophila pneumoniae TW-183
uccugaaaaaagaagcu

SEQ ID NO: 550547 - RNA, 16 nt, Chlamydophila pneumoniae TW-183
uccugacacaacucuu

SEQ ID NO: 550548 - RNA, 18 nt, Chlamydophila pneumoniae TW-183
uccuccuagguucuuuuu

SEQ ID NO: 550549 - RNA, 13 nt, Chlamydophila pneumoniae TW-183
uccucaucagaag

SEQ ID NO: 550550 - RNA, 21 nt, Chlamydophila pneumoniae TW-183
uccucuaaggacaaaucuccc

SEQ ID NO: 550551 - RNA, 23 nt, Chlamydophila pneumoniae TW-183
uccucuaaggacaaaucucccaa

SEQ ID NO: 550552 - RNA, 18 nt, Chlamydophila pneumoniae TW-183
ucgauugagauugaggau

SEQ ID NO: 550553 - RNA, 16 nt, Chlamydophila pneumoniae TW-183
ucgauacgguuuuuau

SEQ ID NO: 550554 - RNA, 20 nt, Chlamydophila pneumoniae TW-183
ucgaguaccgaccgaaucuc

SEQ ID NO: 550555 - RNA, 21 nt, Chlamydophila pneumoniae TW-183
ucgagcagaaacuccaaaaua

SEQ ID NO: 550556 - RNA, 19 nt, Chlamydophila pneumoniae TW-183
ucgagcagaaacuccaaaa

SEQ ID NO: 550557 - RNA, 15 nt, Chlamydophila pneumoniae TW-183
ucgagcagaaaugau

SEQ ID NO: 550558 - RNA, 17 nt, Chlamydophila pneumoniae TW-183
ucgagagaagaaauucu

SEQ ID NO: 550559 - RNA, 19 nt, Chlamydophila pneumoniae TW-183
ucgagagaagaaauucuga

SEQ ID NO: 550560 - RNA, 16 nt, Chlamydophila pneumoniae TW-183
ucgacaaccaaaacag

SEQ ID NO: 550561 - RNA, 16 nt, Chlamydophila pneumoniae TW-183
ucgaagcuugcugauu

SEQ ID NO: 550562 - RNA, 22 nt, Chlamydophila pneumoniae TW-183
ucgaaacacucaugaaagugcu

SEQ ID NO: 550563 - RNA, 17 nt, Chlamydophila pneumoniae TW-183
ucgaaacucuuugagga

SEQ ID NO: 550564 - RNA, 17 nt, Chlamydophila pneumoniae TW-183
uccuugcagcccugcau

SEQ ID NO: 550565 - RNA, 16 nt, Chlamydophila pneumoniae TW-183
uccuuguucuugaaca

SEQ ID NO: 550566 - RNA, 15 nt, Chlamydophila pneumoniae TW-183
uccuuucaucagcau

SEQ ID NO: 550567 - RNA, 19 nt, Chlamydophila pneumoniae TW-183
uccuugcaaaacagcauca

SEQ ID NO: 550568 - RNA, 18 nt, Chlamydophila pneumoniae TW-183
uccuugauaaaacgcuau

SEQ ID NO: 550569 - RNA, 18 nt, Chlamydophila pneumoniae TW-183
uccuugaaauugcucuug

SEQ ID NO: 550570 - RNA, 17 nt, Chlamydophila pneumoniae TW-183
uccgauuaacuuuauac

SEQ ID NO: 550571 - RNA, 23 nt, Chlamydophila pneumoniae TW-183
uccgaucauuuuugcuagaucug

SEQ ID NO: 550572 - RNA, 23 nt, Chlamydophila pneumoniae TW-183
uccgaagacucaaagaacugcau

SEQ ID NO: 550573 - RNA, 13 nt, Chlamydophila pneumoniae TW-183
ucccuuuuuaagu

SEQ ID NO: 550574 - RNA, 20 nt, Chlamydophila pneumoniae TW-183
ucccuauaaagcaaaugccu

SEQ ID NO: 550575 - RNA, 18 nt, Chlamydophila pneumoniae TW-183
ucccuguaguuucuaaaa

SEQ ID NO: 550576 - RNA, 18 nt, Chlamydophila pneumoniae TW-183
ucccagaagaaauuagag

SEQ ID NO: 550577 - RNA, 20 nt, Chlamydophila pneumoniae TW-183
ucccacggugccuaggcuaa

SEQ ID NO: 550578 - RNA, 18 nt, Chlamydophila pneumoniae TW-183
ucccagauuuuuuugguu

SEQ ID NO: 550579 - RNA, 20 nt, Chlamydophila pneumoniae TW-183
ucccagauuuuuuugguugc

SEQ ID NO: 550580 - RNA, 16 nt, Chlamydophila pneumoniae TW-183
ucccaucgucccuaaa

SEQ ID NO: 550581 - RNA, 18 nt, Chlamydophila pneumoniae TW-183
uccccauucacaaaucuu

SEQ ID NO: 550582 - RNA, 12 nt, Chlamydophila pneumoniae TW-183
ucccaugggaua

SEQ ID NO: 550583 - RNA, 22 nt, Chlamydophila pneumoniae TW-183
uccauggauauggaauggcuuu

SEQ ID NO: 550584 - RNA, 23 nt, Chlamydophila pneumoniae TW-183
uccauguacaaugauaucagcau

SEQ ID NO: 550585 - RNA, 19 nt, Chlamydophila pneumoniae TW-183
uccagaaauacguccagcc

SEQ ID NO: 550586 - RNA, 22 nt, Chlamydophila pneumoniae TW-183
uccacgaccugcaaacucccca

SEQ ID NO: 550587 - RNA, 12 nt, Chlamydophila pneumoniae TW-183
uccaacuucaac

SEQ ID NO: 550588 - RNA, 18 nt, Chlamydophila pneumoniae TW-183
uccaagaauagccauaau

SEQ ID NO: 550589 - RNA, 16 nt, Chlamydophila pneumoniae TW-183
uccaagaauagccaua

SEQ ID NO: 550590 - RNA, 21 nt, Chlamydophila pneumoniae TW-183
uccaacuaaaccuucaaugau

SEQ ID NO: 550591 - RNA, 13 nt, Chlamydophila pneumoniae TW-183
uccaaucugcuga

SEQ ID NO: 550592 - RNA, 15 nt, Chlamydophila pneumoniae TW-183
ucauuccagcaucuu

SEQ ID NO: 550593 - RNA, 14 nt, Chlamydophila pneumoniae TW-183
ucauuccagcaucu

SEQ ID NO: 550594 - RNA, 21 nt, Chlamydophila pneumoniae TW-183
ugaaaaucgcaccuugaccuc

SEQ ID NO: 550595 - RNA, 12 nt, Chlamydophila pneumoniae TW-183
ugaaaucaugga

SEQ ID NO: 550596 - RNA, 18 nt, Chlamydophila pneumoniae TW-183
ugaaguccagacuuuccu

SEQ ID NO: 550597 - RNA, 15 nt, Chlamydophila pneumoniae TW-183
ugaagauuuuuucuu

SEQ ID NO: 550598 - RNA, 20 nt, Chlamydophila pneumoniae TW-183
ugaagcagaggguuccaaga

SEQ ID NO: 550599 - RNA, 19 nt, Chlamydophila pneumoniae TW-183
ucuuugggagauccugaaa

SEQ ID NO: 550600 - RNA, 14 nt, Chlamydophila pneumoniae TW-183
ucuuugauuuucuu

SEQ ID NO: 550601 - RNA, 14 nt, Chlamydophila pneumoniae TW-183
ucuuucugcucuuc

SEQ ID NO: 550602 - RNA, 20 nt, Chlamydophila pneumoniae TW-183
ucuuugaggauacgaauaag

SEQ ID NO: 550603 - RNA, 14 nt, Chlamydophila pneumoniae TW-183
ucuuucuaagaaga

SEQ ID NO: 550604 - RNA, 16 nt, Chlamydophila pneumoniae TW-183
ucuuuugauaacuuug

SEQ ID NO: 550605 - RNA, 17 nt, Chlamydophila pneumoniae TW-183
ucuuuuauauuaagaau

SEQ ID NO: 550606 - RNA, 22 nt, Chlamydophila pneumoniae TW-183
ucuuucaaccuccgcucuaagc

SEQ ID NO: 550607 - RNA, 16 nt, Chlamydophila pneumoniae TW-183
ucuuucaauaacagag

SEQ ID NO: 550608 - RNA, 15 nt, Chlamydophila pneumoniae TW-183
ucuuuagauagcucu

SEQ ID NO: 550609 - RNA, 18 nt, Chlamydophila pneumoniae TW-183
ucuuggucggaguuuuuu

SEQ ID NO: 550610 - RNA, 19 nt, Chlamydophila pneumoniae TW-183
ucuugauuuucaaagacca

SEQ ID NO: 550611 - RNA, 17 nt, Chlamydophila pneumoniae TW-183
ucuugauguacaguaaa

SEQ ID NO: 550612 - RNA, 13 nt, Chlamydophila pneumoniae TW-183
ucuucuuucucua

SEQ ID NO: 550613 - RNA, 14 nt, Chlamydophila pneumoniae TW-183
ucuucuuucucuau

SEQ ID NO: 550614 - RNA, 18 nt, Chlamydophila pneumoniae TW-183
ucuucuaaaaucuucucu

SEQ ID NO: 550615 - RNA, 21 nt, Chlamydophila pneumoniae TW-183
ucuucucgaacaggagagaga

SEQ ID NO: 550616 - RNA, 22 nt, Chlamydophila pneumoniae TW-183
ucuucucgaacaggagagagaa

SEQ ID NO: 550617 - RNA, 15 nt, Chlamydophila pneumoniae TW-183
ucuucuugcaaucuu

SEQ ID NO: 550618 - RNA, 22 nt, Chlamydophila pneumoniae TW-183
ucuucuucgguguagaucuuuu

SEQ ID NO: 550619 - RNA, 11 nt, Chlamydophila pneumoniae TW-183
ucuuagcuccu

SEQ ID NO: 550620 - RNA, 22 nt, Chlamydophila pneumoniae TW-183
ucuucagcccacuguuuugcuu

SEQ ID NO: 550621 - RNA, 14 nt, Chlamydophila pneumoniae TW-183
ucuuccgauuaacu

SEQ ID NO: 550622 - RNA, 16 nt, Chlamydophila pneumoniae TW-183
ucuucauccgaagacu

SEQ ID NO: 550623 - RNA, 18 nt, Chlamydophila pneumoniae TW-183
ucuggaagauguuguuuu

SEQ ID NO: 550624 - RNA, 16 nt, Chlamydophila pneumoniae TW-183
ucugcugaggagagua

SEQ ID NO: 550625 - RNA, 13 nt, Chlamydophila pneumoniae TW-183
ucugagaaguuaa

SEQ ID NO: 550626 - RNA, 19 nt, Chlamydophila pneumoniae TW-183
ucugaaucucauaaguaua

SEQ ID NO: 550627 - RNA, 23 nt, Chlamydophila pneumoniae TW-183
ucugaaucucauaaguauagaga

SEQ ID NO: 550628 - RNA, 19 nt, Chlamydophila pneumoniae TW-183
ucugacgucuccaacaguc

SEQ ID NO: 550629 - RNA, 18 nt, Chlamydophila pneumoniae TW-183
aaaugcuauuuuccucua

SEQ ID NO: 550630 - RNA, 18 nt, Chlamydophila pneumoniae TW-183
ucugaacaggaauagaaa

SEQ ID NO: 550631 - RNA, 15 nt, Chlamydophila pneumoniae TW-183
ucugaagauuuuuua

SEQ ID NO: 550632 - RNA, 13 nt, Chlamydophila pneumoniae TW-183
ucucuuaaaaaaa

SEQ ID NO: 550633 - RNA, 15 nt, Chlamydophila pneumoniae TW-183
ucucuuaaaaaaaau

SEQ ID NO: 550634 - RNA, 16 nt, Chlamydophila pneumoniae TW-183
ucucuuaaaaaaaauu

SEQ ID NO: 550635 - RNA, 23 nt, Chlamydophila pneumoniae TW-183
ucucuaaguucuugauuuucaaa

SEQ ID NO: 550636 - RNA, 18 nt, Chlamydophila pneumoniae TW-183
ugagaaccuucacaagaa

SEQ ID NO: 550637 - RNA, 13 nt, Chlamydophila pneumoniae TW-183
ugagaaauauaaa

SEQ ID NO: 550638 - RNA, 17 nt, Chlamydophila pneumoniae TW-183
ugacuccagaaggugug

SEQ ID NO: 550639 - RNA, 11 nt, Chlamydophila pneumoniae TW-183
ugacugaaacu

SEQ ID NO: 550640 - RNA, 21 nt, Chlamydophila pneumoniae TW-183
ugacuauagggagacucuuga

SEQ ID NO: 550641 - RNA, 19 nt, Chlamydophila pneumoniae TW-183
ugacuaaacaccuucuucu

SEQ ID NO: 550642 - RNA, 22 nt, Chlamydophila pneumoniae TW-183
ugacuaaacaccuucuucuaaa

SEQ ID NO: 550643 - RNA, 22 nt, Chlamydophila pneumoniae TW-183
ugacguuaauaaagaggcuccc

SEQ ID NO: 550644 - RNA, 20 nt, Chlamydophila pneumoniae TW-183
ugacguuaauaaagaggcuc

SEQ ID NO: 550645 - RNA, 13 nt, Chlamydophila pneumoniae TW-183
ugaucaggagucu

SEQ ID NO: 550646 - RNA, 16 nt, Chlamydophila pneumoniae TW-183
ugauccuugcaaaaca

SEQ ID NO: 550647 - RNA, 22 nt, Chlamydophila pneumoniae TW-183
ugauaaggaagaauuucgucuu

SEQ ID NO: 550648 - RNA, 14 nt, Chlamydophila pneumoniae TW-183
ugauaacuuugcau

SEQ ID NO: 550649 - RNA, 19 nt, Chlamydophila pneumoniae TW-183
ugaggauaaguucuuccaa

SEQ ID NO: 550650 - RNA, 20 nt, Chlamydophila pneumoniae TW-183
ugaggaacgcacgccaagag

SEQ ID NO: 550651 - RNA, 22 nt, Chlamydophila pneumoniae TW-183
ugaggaacgcacgccaagagag

SEQ ID NO: 550652 - RNA, 22 nt, Chlamydophila pneumoniae TW-183
ugaggaaucauaaccaaaagaa

SEQ ID NO: 550653 - RNA, 18 nt, Chlamydophila pneumoniae TW-183
ugaggauaaguucuucca

SEQ ID NO: 550654 - RNA, 20 nt, Chlamydophila pneumoniae TW-183
ugcaguccacgcuaucuccu

SEQ ID NO: 550655 - RNA, 21 nt, Chlamydophila pneumoniae TW-183
ugcauagauaucuuugggaga

SEQ ID NO: 550656 - RNA, 19 nt, Chlamydophila pneumoniae TW-183
ugcagauauacuuuuucag

SEQ ID NO: 550657 - RNA, 15 nt, Chlamydophila pneumoniae TW-183
ugcacacauccugga

SEQ ID NO: 550658 - RNA, 17 nt, Chlamydophila pneumoniae TW-183
ugcaauugccauaucau

SEQ ID NO: 550659 - RNA, 14 nt, Chlamydophila pneumoniae TW-183
ugcaaucucaaaau

SEQ ID NO: 550660 - RNA, 17 nt, Chlamydophila pneumoniae TW-183
ugcaagugcuuucagga

SEQ ID NO: 550661 - RNA, 16 nt, Chlamydophila pneumoniae TW-183
ugcaagugcuuucagg

SEQ ID NO: 550662 - RNA, 18 nt, Chlamydophila pneumoniae TW-183
ugcaagcuucaucaggag

SEQ ID NO: 550663 - RNA, 12 nt, Chlamydophila pneumoniae TW-183
ugcaaauuucau

SEQ ID NO: 550664 - RNA, 16 nt, Chlamydophila pneumoniae TW-183
ugcaaaaaugaaagaa

SEQ ID NO: 550665 - RNA, 19 nt, Chlamydophila pneumoniae TW-183
ugauuuuucaaucaauaaa

SEQ ID NO: 550666 - RNA, 17 nt, Chlamydophila pneumoniae TW-183
ugcaaaaaugaaagaaa

SEQ ID NO: 550667 - RNA, 14 nt, Chlamydophila pneumoniae TW-183
ugccuguuuuauug

SEQ ID NO: 550668 - RNA, 19 nt, Chlamydophila pneumoniae TW-183
ugcgaaugucguuaaaaac

SEQ ID NO: 550669 - RNA, 12 nt, Chlamydophila pneumoniae TW-183
ugccuuucucuu

SEQ ID NO: 550670 - RNA, 23 nt, Chlamydophila pneumoniae TW-183
ugcuccuaagugauaaggaagaa

SEQ ID NO: 550671 - RNA, 13 nt, Chlamydophila pneumoniae TW-183
ugcuaagcuccau

SEQ ID NO: 550672 - RNA, 19 nt, Chlamydophila pneumoniae TW-183
ugcuaagcuccauaaaaau

SEQ ID NO: 550673 - RNA, 13 nt, Chlamydophila pneumoniae TW-183
ugcuaacaacucc

SEQ ID NO: 550674 - RNA, 21 nt, Chlamydophila pneumoniae TW-183
ugcuagaucuggagagggaag

SEQ ID NO: 550675 - RNA, 14 nt, Chlamydophila pneumoniae TW-183
ugcuaggaagauga

SEQ ID NO: 550676 - RNA, 15 nt, Chlamydophila pneumoniae TW-183
ugcuauuuuccucua

SEQ ID NO: 550677 - RNA, 16 nt, Chlamydophila pneumoniae TW-183
ugcgcuuguucuuuuc

SEQ ID NO: 550678 - RNA, 22 nt, Chlamydophila pneumoniae TW-183
uggaacaguauaaucagaagug

SEQ ID NO: 550679 - RNA, 19 nt, Chlamydophila pneumoniae TW-183
ugcuuuuguuguuuuugcu

SEQ ID NO: 550680 - RNA, 23 nt, Chlamydophila pneumoniae TW-183
ugcuuucaggaguucuugauucu

SEQ ID NO: 550681 - RNA, 20 nt, Chlamydophila pneumoniae TW-183
ugcuuuauggcucaacuuaa

SEQ ID NO: 550682 - RNA, 15 nt, Chlamydophila pneumoniae TW-183
ugcuuagcaaaggca

SEQ ID NO: 550683 - RNA, 14 nt, Chlamydophila pneumoniae TW-183
ugcuguuuuuucac

SEQ ID NO: 550684 - RNA, 14 nt, Chlamydophila pneumoniae TW-183
ugcugcuucagaaa

SEQ ID NO: 550685 - RNA, 21 nt, Chlamydophila pneumoniae TW-183
ugcugaggacgcagagaugcu

SEQ ID NO: 550686 - RNA, 14 nt, Chlamydophila pneumoniae TW-183
ugcugaagggacag

SEQ ID NO: 550687 - RNA, 21 nt, Chlamydophila pneumoniae TW-183
ugcugaagauuuuuucuuggu

SEQ ID NO: 550688 - RNA, 17 nt, Chlamydophila pneumoniae TW-183
ugcugaagauuuuuucu

SEQ ID NO: 550689 - RNA, 22 nt, Chlamydophila pneumoniae TW-183
ugcucuuuuaacuuaaagacuu

SEQ ID NO: 550690 - RNA, 16 nt, Chlamydophila pneumoniae TW-183
ugucugaguuagcuuu

SEQ ID NO: 550691 - RNA, 17 nt, Chlamydophila pneumoniae TW-183
ugucugcaaagagcaaa

SEQ ID NO: 550692 - RNA, 15 nt, Chlamydophila pneumoniae TW-183
ugugauguucugcug

SEQ ID NO: 550693 - RNA, 16 nt, Chlamydophila pneumoniae TW-183
ugugauguucugcugc

SEQ ID NO: 550694 - RNA, 19 nt, Chlamydophila pneumoniae TW-183
ugugauccuugcaaaacag

SEQ ID NO: 550695 - RNA, 13 nt, Chlamydophila pneumoniae TW-183
ugucguuaaaaac

SEQ ID NO: 550696 - RNA, 13 nt, Chlamydophila pneumoniae TW-183
uguccuugcagcc

SEQ ID NO: 550697 - RNA, 19 nt, Chlamydophila pneumoniae TW-183
ugucacacugcgagagaaa

SEQ ID NO: 550698 - RNA, 13 nt, Chlamydophila pneumoniae TW-183
ugguuccuggauu

SEQ ID NO: 550699 - RNA, 23 nt, Chlamydophila pneumoniae TW-183
uguaaagugaaauugaacucuca

SEQ ID NO: 550700 - RNA, 20 nt, Chlamydophila pneumoniae TW-183
uguacaguaaaguaugcaua

SEQ ID NO: 550701 - RNA, 17 nt, Chlamydophila pneumoniae TW-183
uguaauagcaggaguuu

SEQ ID NO: 550702 - RNA, 21 nt, Chlamydophila pneumoniae TW-183
ugggcauuuaacaacaugcgc

SEQ ID NO: 550703 - RNA, 14 nt, Chlamydophila pneumoniae TW-183
uggcauagagccua

SEQ ID NO: 550704 - RNA, 20 nt, Chlamydophila pneumoniae TW-183
uggaucagaaaaaaugcguu

SEQ ID NO: 550705 - RNA, 21 nt, Chlamydophila pneumoniae TW-183
uggauccaucggcauuucucc

SEQ ID NO: 550706 - RNA, 16 nt, Chlamydophila pneumoniae TW-183
uggaucuagagaagaa

SEQ ID NO: 550707 - RNA, 17 nt, Chlamydophila pneumoniae TW-183
uggagagggaaggaaua

SEQ ID NO: 550708 - RNA, 15 nt, Chlamydophila pneumoniae TW-183
uggagcuguuucugc

SEQ ID NO: 550709 - RNA, 21 nt, Chlamydophila pneumoniae TW-183
uggaggcgguggcaugccaua

SEQ ID NO: 550710 - RNA, 17 nt, Chlamydophila pneumoniae TW-183
uggacuacugaaacacu

SEQ ID NO: 550711 - RNA, 12 nt, Chlamydophila pneumoniae TW-183
uggacuccaaga

SEQ ID NO: 550712 - RNA, 19 nt, Chlamydophila pneumoniae TW-183
uucuaagcugaaagaacac

SEQ ID NO: 550713 - RNA, 17 nt, Chlamydophila pneumoniae TW-183
uucguggagugcucuac

SEQ ID NO: 550714 - RNA, 14 nt, Chlamydophila pneumoniae TW-183
uucucugagcagcu

SEQ ID NO: 550715 - RNA, 19 nt, Chlamydophila pneumoniae TW-183
uucugcaaugcuaagcucc

SEQ ID NO: 550716 - RNA, 22 nt, Chlamydophila pneumoniae TW-183
uucucgaacaggagagagaagg

SEQ ID NO: 550717 - RNA, 17 nt, Chlamydophila pneumoniae TW-183
uucuauacgaacacaga

SEQ ID NO: 550718 - RNA, 13 nt, Chlamydophila pneumoniae TW-183
uucuauguguucu

SEQ ID NO: 550719 - RNA, 22 nt, Chlamydophila pneumoniae TW-183
uucuauucgcugucuagaacac

SEQ ID NO: 550720 - RNA, 22 nt, Chlamydophila pneumoniae TW-183
uuccuacaacggcaaucuauuu

SEQ ID NO: 550721 - RNA, 16 nt, Chlamydophila pneumoniae TW-183
uuccuacuucugcagg

SEQ ID NO: 550722 - RNA, 17 nt, Chlamydophila pneumoniae TW-183
uugcucuagucuuucaa

SEQ ID NO: 550723 - RNA, 23 nt, Chlamydophila pneumoniae TW-183
uugcugaagauuuuuucuugguc

SEQ ID NO: 550724 - RNA, 20 nt, Chlamydophila pneumoniae TW-183
uugcugaagauuuuuucuug

SEQ ID NO: 550725 - RNA, 15 nt, Chlamydophila pneumoniae TW-183
uugcugaagauuuuu

SEQ ID NO: 550726 - RNA, 15 nt, Chlamydophila pneumoniae TW-183
uugcgccagcaaaga

SEQ ID NO: 550727 - RNA, 21 nt, Chlamydophila pneumoniae TW-183
uugcaauaccaauugggcuag

SEQ ID NO: 550728 - RNA, 21 nt, Chlamydophila pneumoniae TW-183
uugauuuugcagugauaaacc

SEQ ID NO: 550729 - RNA, 12 nt, Chlamydophila pneumoniae TW-183
uugauucauaaa

SEQ ID NO: 550730 - RNA, 14 nt, Chlamydophila pneumoniae TW-183
uugagacaaagaau

SEQ ID NO: 550731 - RNA, 15 nt, Chlamydophila pneumoniae TW-183
uugagaaaagaacag

SEQ ID NO: 550732 - RNA, 14 nt, Chlamydophila pneumoniae TW-183
uugagcacauuguu

SEQ ID NO: 550733 - RNA, 18 nt, Chlamydophila pneumoniae TW-183
uugacaauaggcacccaa

SEQ ID NO: 550734 - RNA, 14 nt, Chlamydophila pneumoniae TW-183
uugacaucuguagu

SEQ ID NO: 550735 - RNA, 19 nt, Chlamydophila pneumoniae TW-183
uugaauaagauuuugaaaa

SEQ ID NO: 550736 - RNA, 21 nt, Chlamydophila pneumoniae TW-183
uugaaaccguaacugaggcaa

SEQ ID NO: 550737 - RNA, 15 nt, Chlamydophila pneumoniae TW-183
uugaaauaauugagg

SEQ ID NO: 550738 - RNA, 14 nt, Chlamydophila pneumoniae TW-183
uugaacaugaggau

SEQ ID NO: 550739 - RNA, 23 nt, Chlamydophila pneumoniae TW-183
uucagagagaacaggagguguau

SEQ ID NO: 550740 - RNA, 22 nt, Chlamydophila pneumoniae TW-183
uucacccucauuaagaggaguc

SEQ ID NO: 550741 - RNA, 20 nt, Chlamydophila pneumoniae TW-183
uucaauagguaaggaaacga

SEQ ID NO: 550742 - RNA, 19 nt, Chlamydophila pneumoniae TW-183
uuauccuugaaauugcucu

SEQ ID NO: 550743 - RNA, 19 nt, Chlamydophila pneumoniae TW-183
uuaugagggagcgaaguuu

SEQ ID NO: 550744 - RNA, 19 nt, Chlamydophila pneumoniae TW-183
uuaucuccccauucacaaa

SEQ ID NO: 550745 - RNA, 16 nt, Chlamydophila pneumoniae TW-183
uuaucuaagacuucug

SEQ ID NO: 550746 - RNA, 22 nt, Chlamydophila pneumoniae TW-183
uuacuugcgauacaauaaacaa

SEQ ID NO: 550747 - RNA, 13 nt, Chlamydophila pneumoniae TW-183
uuaccgaagagcc

SEQ ID NO: 550748 - RNA, 13 nt, Chlamydophila pneumoniae TW-183
uuagagugacuca

SEQ ID NO: 550749 - RNA, 13 nt, Chlamydophila pneumoniae TW-183
uuagcaauugagc

SEQ ID NO: 550750 - RNA, 14 nt, Chlamydophila pneumoniae TW-183
uuaguuuuuucuaa

SEQ ID NO: 550751 - RNA, 17 nt, Chlamydophila pneumoniae TW-183
uuaaugguagcuuaaga

SEQ ID NO: 550752 - RNA, 18 nt, Chlamydophila pneumoniae TW-183
uuacagcaucuauagaau

SEQ ID NO: 550753 - RNA, 15 nt, Chlamydophila pneumoniae TW-183
uuaagaagaagcuga

SEQ ID NO: 550754 - RNA, 18 nt, Chlamydophila pneumoniae TW-183
uuucauguaagaauguag

SEQ ID NO: 550755 - RNA, 17 nt, Chlamydophila pneumoniae TW-183
uuucagugcuguuuuuu

SEQ ID NO: 550756 - RNA, 19 nt, Chlamydophila pneumoniae TW-183
uuucagugcuguuuuuuca

SEQ ID NO: 550757 - RNA, 22 nt, Chlamydophila pneumoniae TW-183
uuuauuuuaggaagcuuaucaa

SEQ ID NO: 550758 - RNA, 18 nt, Chlamydophila pneumoniae TW-183
uuuauagcggaguguuuu

SEQ ID NO: 550759 - RNA, 21 nt, Chlamydophila pneumoniae TW-183
uuucaccaacuccucuaagga

SEQ ID NO: 550760 - RNA, 21 nt, Chlamydophila pneumoniae TW-183
uuuaauuuucugugacaaaau

SEQ ID NO: 550761 - RNA, 16 nt, Chlamydophila pneumoniae TW-183
uuuagcgcuacaguga

SEQ ID NO: 550762 - RNA, 14 nt, Chlamydophila pneumoniae TW-183
uuguuguuuuugcu

SEQ ID NO: 550763 - RNA, 13 nt, Chlamydophila pneumoniae TW-183
uuguuaucaggaa

SEQ ID NO: 550764 - RNA, 23 nt, Chlamydophila pneumoniae TW-183
uugcugcgaaugucguuaaaaac

SEQ ID NO: 550765 - RNA, 19 nt, Chlamydophila pneumoniae TW-183
uugcugauuucuuuuucag

SEQ ID NO: 550766 - RNA, 17 nt, Chlamydophila pneumoniae TW-183
uuugcuagaucuggaga

SEQ ID NO: 550767 - RNA, 12 nt, Chlamydophila pneumoniae TW-183
uuugcugaagau

SEQ ID NO: 550768 - RNA, 18 nt, Chlamydophila pneumoniae TW-183
uuugcugaagauuuuuuc

SEQ ID NO: 550769 - RNA, 14 nt, Chlamydophila pneumoniae TW-183
uuugaucgcuugug

SEQ ID NO: 550770 - RNA, 16 nt, Chlamydophila pneumoniae TW-183
uuugauucauaaagag

SEQ ID NO: 550771 - RNA, 13 nt, Chlamydophila pneumoniae TW-183
uuugauucauaaa

SEQ ID NO: 550772 - RNA, 20 nt, Chlamydophila pneumoniae TW-183
uuucuuauagcuuuggaacg

SEQ ID NO: 550773 - RNA, 17 nt, Chlamydophila pneumoniae TW-183
uuucuguugcacuuucc

SEQ ID NO: 550774 - RNA, 13 nt, Chlamydophila pneumoniae TW-183
uuugacaacacca

SEQ ID NO: 550775 - RNA, 14 nt, Chlamydophila pneumoniae TW-183
uuucuuuuucagcu

SEQ ID NO: 550776 - RNA, 12 nt, Chlamydophila pneumoniae TW-183
uuucuauuuuca

SEQ ID NO: 550777 - RNA, 17 nt, Chlamydophila pneumoniae TW-183
uuucucaauaguguaac

SEQ ID NO: 550778 - RNA, 16 nt, Chlamydophila pneumoniae TW-183
uuucucauagguaaua

SEQ ID NO: 550779 - RNA, 18 nt, Chlamydophila pneumoniae TW-183
uuucugaaucuuuuguuu

SEQ ID NO: 550780 - RNA, 13 nt, Chlamydophila pneumoniae TW-183
uuucugaagauuu

SEQ ID NO: 550781 - RNA, 22 nt, Chlamydophila pneumoniae TW-183
uuucuggaagauguuguuuuuu

SEQ ID NO: 550782 - RNA, 17 nt, Chlamydophila pneumoniae TW-183
uuucuacgcgcucuucu

SEQ ID NO: 550783 - RNA, 19 nt, Chlamydophila pneumoniae TW-183
uuucuaaauagaaaacaua

SEQ ID NO: 550784 - RNA, 22 nt, Chlamydophila pneumoniae TW-183
uuuccucuaucagggagcggaa

SEQ ID NO: 550785 - RNA, 17 nt, Chlamydophila pneumoniae TW-183
uuuccuugguaucccaa

SEQ ID NO: 550786 - RNA, 15 nt, Chlamydophila pneumoniae TW-183
uuucccuucuaagga

SEQ ID NO: 550787 - RNA, 19 nt, Chlamydophila pneumoniae TW-183
uuuccggggagaacuucaa

SEQ ID NO: 550788 - RNA, 11 nt, Chlamydophila pneumoniae TW-183
uuuccauccac

SEQ ID NO: 550789 - RNA, 19 nt, Chlamydophila pneumoniae TW-183
uuuccagggcauucucuaa

SEQ ID NO: 550790 - RNA, 13 nt, Chlamydophila pneumoniae TW-183
uuuuugaaaauuu

SEQ ID NO: 550791 - RNA, 17 nt, Chlamydophila pneumoniae TW-183
uuuuugcugaagauuuu

SEQ ID NO: 550792 - RNA, 13 nt, Chlamydophila pneumoniae TW-183
aaauucuaagcgc

SEQ ID NO: 550793 - RNA, 22 nt, Chlamydophila pneumoniae TW-183
aaauucuggagucgagcagaaa

SEQ ID NO: 550794 - RNA, 18 nt, Chlamydophila pneumoniae TW-183
aaauucuguaaagugaaa

SEQ ID NO: 550795 - RNA, 11 nt, Chlamydophila pneumoniae TW-183
aaauucccaua

SEQ ID NO: 550796 - RNA, 18 nt, Chlamydophila pneumoniae TW-183
uuuugcugaagauuuuuu

SEQ ID NO: 550797 - RNA, 16 nt, Chlamydophila pneumoniae TW-183
uuuugcugaagauuuu

SEQ ID NO: 550798 - RNA, 15 nt, Chlamydophila pneumoniae TW-183
uuuugcuuuucccuu

SEQ ID NO: 550799 - RNA, 17 nt, Chlamydophila pneumoniae TW-183
uuuugcugaagauuuuu

SEQ ID NO: 550800 - RNA, 20 nt, Chlamydophila pneumoniae TW-183
uuuugcagugauaaaccaag

SEQ ID NO: 550801 - RNA, 21 nt, Chlamydophila pneumoniae TW-183
uuuucuuauagggaauuuuuu

SEQ ID NO: 550802 - RNA, 22 nt, Chlamydophila pneumoniae TW-183
uuuucuuauagggaauuuuuuc

SEQ ID NO: 550803 - RNA, 18 nt, Chlamydophila pneumoniae TW-183
uuuucuuagcuuccauau

SEQ ID NO: 550804 - RNA, 13 nt, Chlamydophila pneumoniae TW-183
uuuucucugagca

SEQ ID NO: 550805 - RNA, 13 nt, Chlamydophila pneumoniae TW-183
uuuuguacacaga

SEQ ID NO: 550806 - RNA, 21 nt, Chlamydophila pneumoniae TW-183
uuuuuaaccgagcuuuuugcu

SEQ ID NO: 550807 - RNA, 13 nt, Chlamydophila pneumoniae TW-183
uuuuuaauuuucu

SEQ ID NO: 550808 - RNA, 22 nt, Chlamydophila pneumoniae TW-183
uuuuuagcaauugagcuucuuu

SEQ ID NO: 550809 - RNA, 21 nt, Chlamydophila pneumoniae TW-183
uuuuuagaagguguuuuggcu

SEQ ID NO: 550810 - RNA, 15 nt, Chlamydophila pneumoniae TW-183
uuuuuccaacuucaa

SEQ ID NO: 550811 - RNA, 17 nt, Chlamydophila pneumoniae TW-183
uuuuuccaacuucaacu

SEQ ID NO: 550812 - RNA, 22 nt, Chlamydophila pneumoniae TW-183
uuuucaggaggcgcguagaucc

SEQ ID NO: 550813 - RNA, 13 nt, Chlamydophila pneumoniae TW-183
uuuucagugcugu

SEQ ID NO: 550814 - RNA, 22 nt, Chlamydophila pneumoniae TW-183
uuuucagugcuguuuuuucacu

SEQ ID NO: 550815 - RNA, 17 nt, Chlamydophila pneumoniae TW-183
uuuucacuuacagauaa

SEQ ID NO: 550816 - RNA, 21 nt, Chlamydophila pneumoniae TW-183
uuuuccugugugguuggaucc

SEQ ID NO: 550817 - RNA, 20 nt, Chlamydophila pneumoniae TW-183
uuuuacuugcccaaaaguuu

SEQ ID NO: 550818 - RNA, 18 nt, Chlamydophila pneumoniae TW-183
uuuguuaauagaagauca

SEQ ID NO: 550819 - RNA, 17 nt, Chlamydophila pneumoniae TW-183
uuugggauaaaaaguuu

SEQ ID NO: 550820 - RNA, 18 nt, Chlamydophila pneumoniae TW-183
uuugucgguaauuuccau

SEQ ID NO: 550821 - RNA, 22 nt, Chlamydophila pneumoniae TW-183
uuugugauauucuuggaauaua

SEQ ID NO: 550822 - RNA, 14 nt, Chlamydophila pneumoniae TW-183
uuuguagcauuucu

SEQ ID NO: 550823 - RNA, 14 nt, Chlamydophila pneumoniae TW-183
uuuguaguguugaa

SEQ ID NO: 550824 - RNA, 19 nt, Chlamydophila pneumoniae TW-183
aagauagggaccaugaucu

SEQ ID NO: 550825 - RNA, 23 nt, Chlamydophila pneumoniae TW-183
aagaucgcucgaucgugcucugc

SEQ ID NO: 550826 - RNA, 20 nt, Chlamydophila pneumoniae TW-183
aagauguuguuuuuugauug

SEQ ID NO: 550827 - RNA, 14 nt, Chlamydophila pneumoniae TW-183
aagauuuugaaaau

SEQ ID NO: 550828 - RNA, 22 nt, Chlamydophila pneumoniae TW-183
aagcaggugugugguaaaaaua

SEQ ID NO: 550829 - RNA, 14 nt, Chlamydophila pneumoniae TW-183
aagcacccucuuca

SEQ ID NO: 550830 - RNA, 20 nt, Chlamydophila pneumoniae TW-183
aagcacccucuucauccgaa

SEQ ID NO: 550831 - RNA, 22 nt, Chlamydophila pneumoniae TW-183
aagcacauacaguacgcaaagu

SEQ ID NO: 550832 - RNA, 18 nt, Chlamydophila pneumoniae TW-183
aagcaaaugccuguacua

SEQ ID NO: 550833 - RNA, 17 nt, Chlamydophila pneumoniae TW-183
aagcaacuaaacucucc

SEQ ID NO: 550834 - RNA, 18 nt, Chlamydophila pneumoniae TW-183
aagcaacuaaacucucca

SEQ ID NO: 550835 - RNA, 13 nt, Chlamydophila pneumoniae TW-183
aagagugccaaga

SEQ ID NO: 550836 - RNA, 22 nt, Chlamydophila pneumoniae TW-183
aagagucuuugaugcuaaacga

SEQ ID NO: 550837 - RNA, 18 nt, Chlamydophila pneumoniae TW-183
aagaguagccccagcaac

SEQ ID NO: 550838 - RNA, 17 nt, Chlamydophila pneumoniae TW-183
aagagcccccauaggaa

SEQ ID NO: 550839 - RNA, 14 nt, Chlamydophila pneumoniae TW-183
aagagcgcauuuua

SEQ ID NO: 550840 - RNA, 23 nt, Chlamydophila pneumoniae TW-183
aagagcucguaauccuucuuucu

SEQ ID NO: 550841 - RNA, 16 nt, Chlamydophila pneumoniae TW-183
aagagcuaugaugaga

SEQ ID NO: 550842 - RNA, 17 nt, Chlamydophila pneumoniae TW-183
aagagcucguaauccuu

SEQ ID NO: 550843 - RNA, 15 nt, Chlamydophila pneumoniae TW-183
aagagaaucuccuca

SEQ ID NO: 550844 - RNA, 16 nt, Chlamydophila pneumoniae TW-183
aagacucucaucagca

SEQ ID NO: 550845 - RNA, 14 nt, Chlamydophila pneumoniae TW-183
aagacucucaucag

SEQ ID NO: 550846 - RNA, 19 nt, Chlamydophila pneumoniae TW-183
aagacucucaucagcaaaa

SEQ ID NO: 550847 - RNA, 16 nt, Chlamydophila pneumoniae TW-183
aagacugaaaagaucg

SEQ ID NO: 550848 - RNA, 17 nt, Chlamydophila pneumoniae TW-183
aagaauuucauaagaga

SEQ ID NO: 550849 - RNA, 18 nt, Chlamydophila pneumoniae TW-183
aagaauagcguagaggac

SEQ ID NO: 550850 - RNA, 20 nt, Chlamydophila pneumoniae TW-183
aagaaucgaguucuucauug

SEQ ID NO: 550851 - RNA, 16 nt, Chlamydophila pneumoniae TW-183
aagaauuaagaagaag

SEQ ID NO: 550852 - RNA, 17 nt, Chlamydophila pneumoniae TW-183
aagaauguagcuguucc

SEQ ID NO: 550853 - RNA, 20 nt, Chlamydophila pneumoniae TW-183
aagaauguagcuguuccaag

SEQ ID NO: 550854 - RNA, 17 nt, Chlamydophila pneumoniae TW-183
aagucaccuuacaucca

SEQ ID NO: 550855 - RNA, 18 nt, Chlamydophila pneumoniae TW-183
aagguuuuauaaagaucg

SEQ ID NO: 550856 - RNA, 16 nt, Chlamydophila pneumoniae TW-183
aaguccagacuuuccu

SEQ ID NO: 550857 - RNA, 17 nt, Chlamydophila pneumoniae TW-183
aagucacggcgaaagcu

SEQ ID NO: 550858 - RNA, 20 nt, Chlamydophila pneumoniae TW-183
aagugcuuucaggaguucuu

SEQ ID NO: 550859 - RNA, 13 nt, Chlamydophila pneumoniae TW-183
aauaaaagcaccc

SEQ ID NO: 550860 - RNA, 14 nt, Chlamydophila pneumoniae TW-183
aaguuuaggcagga

SEQ ID NO: 550861 - RNA, 17 nt, Chlamydophila pneumoniae TW-183
aaguuuucgauacacaa

SEQ ID NO: 550862 - RNA, 22 nt, Chlamydophila pneumoniae TW-183
aagguugagacguaaccacagg

SEQ ID NO: 550863 - RNA, 16 nt, Chlamydophila pneumoniae TW-183
aagguaaaacuacagg

SEQ ID NO: 550864 - RNA, 20 nt, Chlamydophila pneumoniae TW-183
aagguaaaacuacaggaaaa

SEQ ID NO: 550865 - RNA, 23 nt, Chlamydophila pneumoniae TW-183
aaggcugccagagauucuucaca

SEQ ID NO: 550866 - RNA, 18 nt, Chlamydophila pneumoniae TW-183
aaggcugcuugagacuug

SEQ ID NO: 550867 - RNA, 21 nt, Chlamydophila pneumoniae TW-183
aaggcucucaaggucacagca

SEQ ID NO: 550868 - RNA, 15 nt, Chlamydophila pneumoniae TW-183
aaggacaaaucuccc

SEQ ID NO: 550869 - RNA, 16 nt, Chlamydophila pneumoniae TW-183
aaggacaaaucuccca

SEQ ID NO: 550870 - RNA, 14 nt, Chlamydophila pneumoniae TW-183
aaggaagagaguuu

SEQ ID NO: 550871 - RNA, 17 nt, Chlamydophila pneumoniae TW-183
aagcuuugcgcuuguuc

SEQ ID NO: 550872 - RNA, 20 nt, Chlamydophila pneumoniae TW-183
aagcuuugcgcuuguucuuu

SEQ ID NO: 550873 - RNA, 11 nt, Chlamydophila pneumoniae TW-183
aagcugugcau

SEQ ID NO: 550874 - RNA, 12 nt, Chlamydophila pneumoniae TW-183
aagcugugcauu

SEQ ID NO: 550875 - RNA, 20 nt, Chlamydophila pneumoniae TW-183
aagcuaauaagauccaaaaa

SEQ ID NO: 550876 - RNA, 22 nt, Chlamydophila pneumoniae TW-183
aagcguauagaauagaauguau

SEQ ID NO: 550877 - RNA, 14 nt, Chlamydophila pneumoniae TW-183
aauuaauaaaagag

SEQ ID NO: 550878 - RNA, 21 nt, Chlamydophila pneumoniae TW-183
aauuaccuugagacaaagaau

SEQ ID NO: 550879 - RNA, 18 nt, Chlamydophila pneumoniae TW-183
aauuaccuugagacaaag

SEQ ID NO: 550880 - RNA, 15 nt, Chlamydophila pneumoniae TW-183
aauuagaaucagagg

SEQ ID NO: 550881 - RNA, 18 nt, Chlamydophila pneumoniae TW-183
aauguccaacucagcuuu

SEQ ID NO: 550882 - RNA, 22 nt, Chlamydophila pneumoniae TW-183
aauguagucaugauuuuucaau

SEQ ID NO: 550883 - RNA, 16 nt, Chlamydophila pneumoniae TW-183
aauguagucaugauuu

SEQ ID NO: 550884 - RNA, 15 nt, Chlamydophila pneumoniae TW-183
aaugcucuucugcag

SEQ ID NO: 550885 - RNA, 17 nt, Chlamydophila pneumoniae TW-183
aaucgauaacguugccu

SEQ ID NO: 550886 - RNA, 20 nt, Chlamydophila pneumoniae TW-183
aaucguuucuauagacucua

SEQ ID NO: 550887 - RNA, 19 nt, Chlamydophila pneumoniae TW-183
aaucucaaaaucaaauaga

SEQ ID NO: 550888 - RNA, 18 nt, Chlamydophila pneumoniae TW-183
aaucucauuccagcaucu

SEQ ID NO: 550889 - RNA, 22 nt, Chlamydophila pneumoniae TW-183
aaucucauuccagcaucuucuc

SEQ ID NO: 550890 - RNA, 13 nt, Chlamydophila pneumoniae TW-183
aaucugaaucuca

SEQ ID NO: 550891 - RNA, 16 nt, Chlamydophila pneumoniae TW-183
aaucugaaucucauaa

SEQ ID NO: 550892 - RNA, 16 nt, Chlamydophila pneumoniae TW-183
aaucuccucaucagaa

SEQ ID NO: 550893 - RNA, 13 nt, Chlamydophila pneumoniae TW-183
aaucuuccccuaa

SEQ ID NO: 550894 - RNA, 14 nt, Chlamydophila pneumoniae TW-183
aaucuuugaagcuc

SEQ ID NO: 550895 - RNA, 20 nt, Chlamydophila pneumoniae TW-183
aaucuuugaagcucgaccuc

SEQ ID NO: 550896 - RNA, 15 nt, Chlamydophila pneumoniae TW-183
aauacguccagccug

SEQ ID NO: 550897 - RNA, 13 nt, Chlamydophila pneumoniae TW-183
aauaccagaagca

SEQ ID NO: 550898 - RNA, 19 nt, Chlamydophila pneumoniae TW-183
aauaccagaagcaaaggua

SEQ ID NO: 550899 - RNA, 18 nt, Chlamydophila pneumoniae TW-183
aauaucgaguucuuuuug

SEQ ID NO: 550900 - RNA, 22 nt, Chlamydophila pneumoniae TW-183
aauaucgaguucuuuuugcaga

SEQ ID NO: 550901 - RNA, 14 nt, Chlamydophila pneumoniae TW-183
aaucagaagugauc

SEQ ID NO: 550902 - RNA, 13 nt, Chlamydophila pneumoniae TW-183
aaucaguccuaaa

SEQ ID NO: 550903 - RNA, 15 nt, Chlamydophila pneumoniae TW-183
aaucauaaaaaaagc

SEQ ID NO: 550904 - RNA, 12 nt, Chlamydophila pneumoniae TW-183
aaucauaaccaa

SEQ ID NO: 550905 - RNA, 14 nt, Chlamydophila pneumoniae TW-183
accgaaucucucca

SEQ ID NO: 550906 - RNA, 18 nt, Chlamydophila pneumoniae TW-183
acccauaaugguacaaua

SEQ ID NO: 550907 - RNA, 19 nt, Chlamydophila pneumoniae TW-183
accaucgucuccaaaaauu

SEQ ID NO: 550908 - RNA, 22 nt, Chlamydophila pneumoniae TW-183
accacuguccaugcacgagauu

SEQ ID NO: 550909 - RNA, 19 nt, Chlamydophila pneumoniae TW-183
accacuuaggguucucaaa

SEQ ID NO: 550910 - RNA, 14 nt, Chlamydophila pneumoniae TW-183
accaauacagcaua

SEQ ID NO: 550911 - RNA, 19 nt, Chlamydophila pneumoniae TW-183
accaaugaucguagcuaaa

SEQ ID NO: 550912 - RNA, 18 nt, Chlamydophila pneumoniae TW-183
acauuugcagacacaaaa

SEQ ID NO: 550913 - RNA, 23 nt, Chlamydophila pneumoniae TW-183
acauuguuuaaguccuucuuccc

SEQ ID NO: 550914 - RNA, 16 nt, Chlamydophila pneumoniae TW-183
acaugcgcguauaagg

SEQ ID NO: 550915 - RNA, 13 nt, Chlamydophila pneumoniae TW-183
acauuaagaggaa

SEQ ID NO: 550916 - RNA, 19 nt, Chlamydophila pneumoniae TW-183
acauucacccucauuaaga

SEQ ID NO: 550917 - RNA, 19 nt, Chlamydophila pneumoniae TW-183
acauucaggauacucugaa

SEQ ID NO: 550918 - RNA, 18 nt, Chlamydophila pneumoniae TW-183
acauugaccuaaaggaau

SEQ ID NO: 550919 - RNA, 11 nt, Chlamydophila pneumoniae TW-183
acaucaaugau

SEQ ID NO: 550920 - RNA, 18 nt, Chlamydophila pneumoniae TW-183
acauccuggagcaugaga

SEQ ID NO: 550921 - RNA, 22 nt, Chlamydophila pneumoniae TW-183
acauagaaaacauaucccauag

SEQ ID NO: 550922 - RNA, 24 nt, Chlamydophila pneumoniae TW-183
acauagagauucuacaaauuaccu

SEQ ID NO: 550923 - RNA, 13 nt, Chlamydophila pneumoniae TW-183
acagcaucggcaa

SEQ ID NO: 550924 - RNA, 16 nt, Chlamydophila pneumoniae TW-183
acagcaucggcaacca

SEQ ID NO: 550925 - RNA, 14 nt, Chlamydophila pneumoniae TW-183
acagcauaaaaauu

SEQ ID NO: 550926 - RNA, 17 nt, Chlamydophila pneumoniae TW-183
acagauaagacaauaaa

SEQ ID NO: 550927 - RNA, 14 nt, Chlamydophila pneumoniae TW-183
acagacuugaggaa

SEQ ID NO: 550928 - RNA, 20 nt, Chlamydophila pneumoniae TW-183
acacaugucucuuaaaaaaa

SEQ ID NO: 550929 - RNA, 15 nt, Chlamydophila pneumoniae TW-183
acaccauuuuugaau

SEQ ID NO: 550930 - RNA, 12 nt, Chlamydophila pneumoniae TW-183
acaccuucuucu

SEQ ID NO: 550931 - RNA, 22 nt, Chlamydophila pneumoniae TW-183
acaccuucuucuaaaaucuucu

SEQ ID NO: 550932 - RNA, 15 nt, Chlamydophila pneumoniae TW-183
acacgaggagccucu

SEQ ID NO: 550933 - RNA, 23 nt, Chlamydophila pneumoniae TW-183
acaagcuucguccugacacaacu

SEQ ID NO: 550934 - RNA, 16 nt, Chlamydophila pneumoniae TW-183
acaaguaccaagaaaa

SEQ ID NO: 550935 - RNA, 15 nt, Chlamydophila pneumoniae TW-183
acaaguaccaagaaa

SEQ ID NO: 550936 - RNA, 21 nt, Chlamydophila pneumoniae TW-183
acaauaggcacccaaacugau

SEQ ID NO: 550937 - RNA, 14 nt, Chlamydophila pneumoniae TW-183
acaauauaaaugcu

SEQ ID NO: 550938 - RNA, 22 nt, Chlamydophila pneumoniae TW-183
acaaucucuagggauaauuaaa

SEQ ID NO: 550939 - RNA, 17 nt, Chlamydophila pneumoniae TW-183
acacaaaaagcuuuuuu

SEQ ID NO: 550940 - RNA, 19 nt, Chlamydophila pneumoniae TW-183
acacaaauagcaagagcua

SEQ ID NO: 550941 - RNA, 12 nt, Chlamydophila pneumoniae TW-183
acacaaauagca

SEQ ID NO: 550942 - RNA, 15 nt, Chlamydophila pneumoniae TW-183
acaacaucacuauca

SEQ ID NO: 550943 - RNA, 22 nt, Chlamydophila pneumoniae TW-183
acaacaguugcggagaugccau

SEQ ID NO: 550944 - RNA, 15 nt, Chlamydophila pneumoniae TW-183
acaacaguugcggag

SEQ ID NO: 550945 - RNA, 15 nt, Chlamydophila pneumoniae TW-183
acaacauaacagggu

SEQ ID NO: 550946 - RNA, 19 nt, Chlamydophila pneumoniae TW-183
acaagagcgcauuuuacag

SEQ ID NO: 550947 - RNA, 15 nt, Chlamydophila pneumoniae TW-183
acaaacuaaaucaac

SEQ ID NO: 550948 - RNA, 20 nt, Chlamydophila pneumoniae TW-183
acaaaauucaugcaaaacaa

SEQ ID NO: 550949 - RNA, 23 nt, Chlamydophila pneumoniae TW-183
acaaaagguauugcaaauuucau

SEQ ID NO: 550950 - RNA, 23 nt, Chlamydophila pneumoniae TW-183
aauuuucuugcgacauaaccauc

SEQ ID NO: 550951 - RNA, 15 nt, Chlamydophila pneumoniae TW-183
aauuuucccauuaca

SEQ ID NO: 550952 - RNA, 12 nt, Chlamydophila pneumoniae TW-183
aauuuucccauu

SEQ ID NO: 550953 - RNA, 20 nt, Chlamydophila pneumoniae TW-183
aauuucuccaguaucuucuc

SEQ ID NO: 550954 - RNA, 14 nt, Chlamydophila pneumoniae TW-183
aauuucgucuucau

SEQ ID NO: 550955 - RNA, 17 nt, Chlamydophila pneumoniae TW-183
aauuucauguccuccau

SEQ ID NO: 550956 - RNA, 17 nt, Chlamydophila pneumoniae TW-183
aauuagagggauuugua

SEQ ID NO: 550957 - RNA, 15 nt, Chlamydophila pneumoniae TW-183
aauuagaguaugagg

SEQ ID NO: 550958 - RNA, 16 nt, Chlamydophila pneumoniae TW-183
acucuuauugcagaau

SEQ ID NO: 550959 - RNA, 15 nt, Chlamydophila pneumoniae TW-183
acucuuucagaaaga

SEQ ID NO: 550960 - RNA, 15 nt, Chlamydophila pneumoniae TW-183
acugaauaguagagu

SEQ ID NO: 550961 - RNA, 21 nt, Chlamydophila pneumoniae TW-183
acugaauaguagaguugacaa

SEQ ID NO: 550962 - RNA, 22 nt, Chlamydophila pneumoniae TW-183
acucucaguuaaagagcauccu

SEQ ID NO: 550963 - RNA, 17 nt, Chlamydophila pneumoniae TW-183
acucuccaaaagcucua

SEQ ID NO: 550964 - RNA, 12 nt, Chlamydophila pneumoniae TW-183
acucagagauug

SEQ ID NO: 550965 - RNA, 13 nt, Chlamydophila pneumoniae TW-183
acuccaagaauag

SEQ ID NO: 550966 - RNA, 15 nt, Chlamydophila pneumoniae TW-183
acucaugaaagugcu

SEQ ID NO: 550967 - RNA, 14 nt, Chlamydophila pneumoniae TW-183
acuagcuuuucaug

SEQ ID NO: 550968 - RNA, 17 nt, Chlamydophila pneumoniae TW-183
acuauagggagacucuu

SEQ ID NO: 550969 - RNA, 16 nt, Chlamydophila pneumoniae TW-183
acuacugaaacacuuu

SEQ ID NO: 550970 - RNA, 16 nt, Chlamydophila pneumoniae TW-183
acuacucucaucaagg

SEQ ID NO: 550971 - RNA, 19 nt, Chlamydophila pneumoniae TW-183
acuaaguuuaggcaggaag

SEQ ID NO: 550972 - RNA, 12 nt, Chlamydophila pneumoniae TW-183
acuaacauagau

SEQ ID NO: 550973 - RNA, 16 nt, Chlamydophila pneumoniae TW-183
acgucuuucaccaacu

SEQ ID NO: 550974 - RNA, 13 nt, Chlamydophila pneumoniae TW-183
acgucuuaugaaa

SEQ ID NO: 550975 - RNA, 17 nt, Chlamydophila pneumoniae TW-183
acgucuuucaccaacuc

SEQ ID NO: 550976 - RNA, 17 nt, Chlamydophila pneumoniae TW-183
acggcugauucucccaa

SEQ ID NO: 550977 - RNA, 13 nt, Chlamydophila pneumoniae TW-183
acgcacgccaaga

SEQ ID NO: 550978 - RNA, 20 nt, Chlamydophila pneumoniae TW-183
acgcagagaugcuaacaacu

SEQ ID NO: 550979 - RNA, 21 nt, Chlamydophila pneumoniae TW-183
acuucaacaaaggcuccaaac

SEQ ID NO: 550980 - RNA, 17 nt, Chlamydophila pneumoniae TW-183
acuugcgauacaauaaa

SEQ ID NO: 550981 - RNA, 18 nt, Chlamydophila pneumoniae TW-183
acuugcaagcuucuuguu

SEQ ID NO: 550982 - RNA, 14 nt, Chlamydophila pneumoniae TW-183
acuucucucuuaau

SEQ ID NO: 550983 - RNA, 18 nt, Chlamydophila pneumoniae TW-183
acuucuugugauccuugc

SEQ ID NO: 550984 - RNA, 15 nt, Chlamydophila pneumoniae TW-183
acuucuaaaagcaag

SEQ ID NO: 550985 - RNA, 17 nt, Chlamydophila pneumoniae TW-183
acuucaucgacaguauu

SEQ ID NO: 550986 - RNA, 15 nt, Chlamydophila pneumoniae TW-183
acuuugugauuacag

SEQ ID NO: 550987 - RNA, 22 nt, Chlamydophila pneumoniae TW-183
acuuugaggcaagucucaaagg

SEQ ID NO: 550988 - RNA, 18 nt, Chlamydophila pneumoniae TW-183
acuuucccuucuaaggaa

SEQ ID NO: 550989 - RNA, 17 nt, Chlamydophila pneumoniae TW-183
acuuuccucucuuuaua

SEQ ID NO: 550990 - RNA, 14 nt, Chlamydophila pneumoniae TW-183
acuuuauucucuuc

SEQ ID NO: 550991 - RNA, 14 nt, Chlamydophila pneumoniae TW-183
acuuuaacgaagaa

SEQ ID NO: 550992 - RNA, 12 nt, Chlamydophila pneumoniae TW-183
agaaagauaacg

SEQ ID NO: 550993 - RNA, 12 nt, Chlamydophila pneumoniae TW-183
agaaaccagaac

SEQ ID NO: 550994 - RNA, 16 nt, Chlamydophila pneumoniae TW-183
agaaauauacugccag

SEQ ID NO: 550995 - RNA, 15 nt, Chlamydophila pneumoniae TW-183
agaaaucaguccuaa

SEQ ID NO: 550996 - RNA, 21 nt, Chlamydophila pneumoniae TW-183
agaaaacauagagauucuaca

SEQ ID NO: 550997 - RNA, 13 nt, Chlamydophila pneumoniae TW-183
agaaaacauagag

SEQ ID NO: 550998 - RNA, 15 nt, Chlamydophila pneumoniae TW-183
agaaaagaacagggg

SEQ ID NO: 550999 - RNA, 16 nt, Chlamydophila pneumoniae TW-183
agaaaagaacagggga

SEQ ID NO: 551000 - RNA, 19 nt, Chlamydophila pneumoniae TW-183
agauaaagacaucucuuua

SEQ ID NO: 551001 - RNA, 16 nt, Chlamydophila pneumoniae TW-183
agagggauuuguagga

SEQ ID NO: 551002 - RNA, 14 nt, Chlamydophila pneumoniae TW-183
agagcucaucaaug

SEQ ID NO: 551003 - RNA, 15 nt, Chlamydophila pneumoniae TW-183
agagcuaugaugaga

SEQ ID NO: 551004 - RNA, 13 nt, Chlamydophila pneumoniae TW-183
agaggaaugaaga

SEQ ID NO: 551005 - RNA, 18 nt, Chlamydophila pneumoniae TW-183
agaggaaugaagagaguu

SEQ ID NO: 551006 - RNA, 13 nt, Chlamydophila pneumoniae TW-183
agagcagaccucu

SEQ ID NO: 551007 - RNA, 18 nt, Chlamydophila pneumoniae TW-183
agagaaucuccucaucag

SEQ ID NO: 551008 - RNA, 19 nt, Chlamydophila pneumoniae TW-183
agagaaucuccucaucaga

SEQ ID NO: 551009 - RNA, 14 nt, Chlamydophila pneumoniae TW-183
agagaacaggaggu

SEQ ID NO: 551010 - RNA, 12 nt, Chlamydophila pneumoniae TW-183
agagaagaaaag

SEQ ID NO: 551011 - RNA, 13 nt, Chlamydophila pneumoniae TW-183
agacugaaaagau

SEQ ID NO: 551012 - RNA, 13 nt, Chlamydophila pneumoniae TW-183
agacucucaucag

SEQ ID NO: 551013 - RNA, 14 nt, Chlamydophila pneumoniae TW-183
agacucucaucagc

SEQ ID NO: 551014 - RNA, 22 nt, Chlamydophila pneumoniae TW-183
agacaaagaauccccccuucua

SEQ ID NO: 551015 - RNA, 20 nt, Chlamydophila pneumoniae TW-183
agaauuuucuuuugcagcaa

SEQ ID NO: 551016 - RNA, 20 nt, Chlamydophila pneumoniae TW-183
agaauuaagaagaagcugac

SEQ ID NO: 551017 - RNA, 19 nt, Chlamydophila pneumoniae TW-183
agacacaaaaagcuuuuuu

SEQ ID NO: 551018 - RNA, 22 nt, Chlamydophila pneumoniae TW-183
agacacaggggaacgcucucua

SEQ ID NO: 551019 - RNA, 16 nt, Chlamydophila pneumoniae TW-183
agaagugcuuuuagag

SEQ ID NO: 551020 - RNA, 17 nt, Chlamydophila pneumoniae TW-183
agaagugcuuuuagagg

SEQ ID NO: 551021 - RNA, 19 nt, Chlamydophila pneumoniae TW-183
agaagugaucuugagaaaa

SEQ ID NO: 551022 - RNA, 16 nt, Chlamydophila pneumoniae TW-183
agaaggccaguuacug

SEQ ID NO: 551023 - RNA, 18 nt, Chlamydophila pneumoniae TW-183
agaaggcuuguuucuguu

SEQ ID NO: 551024 - RNA, 13 nt, Chlamydophila pneumoniae TW-183
agaagggacuugu

SEQ ID NO: 551025 - RNA, 19 nt, Chlamydophila pneumoniae TW-183
agaaggcucucaaggucac

SEQ ID NO: 551026 - RNA, 16 nt, Chlamydophila pneumoniae TW-183
agcaacccgaauuccu

SEQ ID NO: 551027 - RNA, 15 nt, Chlamydophila pneumoniae TW-183
agcaacccaagcuuu

SEQ ID NO: 551028 - RNA, 15 nt, Chlamydophila pneumoniae TW-183
agcaacgcaugacgc

SEQ ID NO: 551029 - RNA, 14 nt, Chlamydophila pneumoniae TW-183
agcaacuaaacucu

SEQ ID NO: 551030 - RNA, 18 nt, Chlamydophila pneumoniae TW-183
agcaagagcuauaccuau

SEQ ID NO: 551031 - RNA, 14 nt, Chlamydophila pneumoniae TW-183
agauuuuuucuugg

SEQ ID NO: 551032 - RNA, 15 nt, Chlamydophila pneumoniae TW-183
agauaaggaagagag

SEQ ID NO: 551033 - RNA, 16 nt, Chlamydophila pneumoniae TW-183
agauaaggaagagagu

SEQ ID NO: 551034 - RNA, 18 nt, Chlamydophila pneumoniae TW-183
agcagaaacuccaaaaua

SEQ ID NO: 551035 - RNA, 13 nt, Chlamydophila pneumoniae TW-183
agcagaaacucca

SEQ ID NO: 551036 - RNA, 15 nt, Chlamydophila pneumoniae TW-183
agcagaaacuccaaa

SEQ ID NO: 551037 - RNA, 18 nt, Chlamydophila pneumoniae TW-183
agcagaccucucccuugg

SEQ ID NO: 551038 - RNA, 14 nt, Chlamydophila pneumoniae TW-183
agcacgcacuaauc

SEQ ID NO: 551039 - RNA, 22 nt, Chlamydophila pneumoniae TW-183
agcacauacaguacgcaaagua

SEQ ID NO: 551040 - RNA, 21 nt, Chlamydophila pneumoniae TW-183
agcaccuaauaaagaagguug

SEQ ID NO: 551041 - RNA, 19 nt, Chlamydophila pneumoniae TW-183
agcauaaggauucugagaa

SEQ ID NO: 551042 - RNA, 12 nt, Chlamydophila pneumoniae TW-183
agcauaaaaauu

SEQ ID NO: 551043 - RNA, 17 nt, Chlamydophila pneumoniae TW-183
agcaguugcaauaccaa

SEQ ID NO: 551044 - RNA, 21 nt, Chlamydophila pneumoniae TW-183
agcauccuguagagcaagauu

SEQ ID NO: 551045 - RNA, 19 nt, Chlamydophila pneumoniae TW-183
agcaucgcuuaacaaacuu

SEQ ID NO: 551046 - RNA, 21 nt, Chlamydophila pneumoniae TW-183
agcaggaaggaauagagaaag

SEQ ID NO: 551047 - RNA, 21 nt, Chlamydophila pneumoniae TW-183
agcaggaguuuucaagucugu

SEQ ID NO: 551048 - RNA, 20 nt, Chlamydophila pneumoniae TW-183
agccauaauuagaacagcau

SEQ ID NO: 551049 - RNA, 15 nt, Chlamydophila pneumoniae TW-183
agccacuaaguuuag

SEQ ID NO: 551050 - RNA, 16 nt, Chlamydophila pneumoniae TW-183
agcauuucuuucucuu

SEQ ID NO: 551051 - RNA, 16 nt, Chlamydophila pneumoniae TW-183
agcauuuucucugagc

SEQ ID NO: 551052 - RNA, 15 nt, Chlamydophila pneumoniae TW-183
agcauggacuccaag

SEQ ID NO: 551053 - RNA, 15 nt, Chlamydophila pneumoniae TW-183
agcugcaaucucaaa

SEQ ID NO: 551054 - RNA, 19 nt, Chlamydophila pneumoniae TW-183
agcugcaaucucaaaauca

SEQ ID NO: 551055 - RNA, 13 nt, Chlamydophila pneumoniae TW-183
agcgaaguuuuuc

SEQ ID NO: 551056 - RNA, 12 nt, Chlamydophila pneumoniae TW-183
agccugucuaua

SEQ ID NO: 551057 - RNA, 16 nt, Chlamydophila pneumoniae TW-183
agccucuacccucuga

SEQ ID NO: 551058 - RNA, 17 nt, Chlamydophila pneumoniae TW-183
agccugcaccagacccu

SEQ ID NO: 551059 - RNA, 23 nt, Chlamydophila pneumoniae TW-183
agccucgagcagaaacuccaaaa

SEQ ID NO: 551060 - RNA, 21 nt, Chlamydophila pneumoniae TW-183
agccguaggguagccauccac

SEQ ID NO: 551061 - RNA, 13 nt, Chlamydophila pneumoniae TW-183
agccccagcaacc

SEQ ID NO: 551062 - RNA, 24 nt, Chlamydophila pneumoniae TW-183
auaaacagcgguugccuuucucuu

SEQ ID NO: 551063 - RNA, 17 nt, Chlamydophila pneumoniae TW-183
auaaaagagcucaaaaa

SEQ ID NO: 551064 - RNA, 22 nt, Chlamydophila pneumoniae TW-183
auaaaacgcuauuguuuguccu

SEQ ID NO: 551065 - RNA, 16 nt, Chlamydophila pneumoniae TW-183
auaaaaauucucauaa

SEQ ID NO: 551066 - RNA, 14 nt, Chlamydophila pneumoniae TW-183
auaaaacauaggcu

SEQ ID NO: 551067 - RNA, 24 nt, Chlamydophila pneumoniae TW-183
auaaauuucucaugcauaggcuuu

SEQ ID NO: 551068 - RNA, 21 nt, Chlamydophila pneumoniae TW-183
auaaccuuugacaacaccaca

SEQ ID NO: 551069 - RNA, 16 nt, Chlamydophila pneumoniae TW-183
aguugaccuuuuucau

SEQ ID NO: 551070 - RNA, 20 nt, Chlamydophila pneumoniae TW-183
aguucgcggaucuucuucug

SEQ ID NO: 551071 - RNA, 18 nt, Chlamydophila pneumoniae TW-183
aguucuugauucucuucc

SEQ ID NO: 551072 - RNA, 22 nt, Chlamydophila pneumoniae TW-183
aguucuuguaauaaaagaacau

SEQ ID NO: 551073 - RNA, 15 nt, Chlamydophila pneumoniae TW-183
aguucucucuucacu

SEQ ID NO: 551074 - RNA, 22 nt, Chlamydophila pneumoniae TW-183
aguucaucauauuuuucuugaa

SEQ ID NO: 551075 - RNA, 18 nt, Chlamydophila pneumoniae TW-183
aguggccgcuauuuauga

SEQ ID NO: 551076 - RNA, 20 nt, Chlamydophila pneumoniae TW-183
aguggccgcuauuuaugagg

SEQ ID NO: 551077 - RNA, 18 nt, Chlamydophila pneumoniae TW-183
agugccaagagcaucaca

SEQ ID NO: 551078 - RNA, 18 nt, Chlamydophila pneumoniae TW-183
agucuccuggaacaguau

SEQ ID NO: 551079 - RNA, 19 nt, Chlamydophila pneumoniae TW-183
agugaucuugagaaaagaa

SEQ ID NO: 551080 - RNA, 15 nt, Chlamydophila pneumoniae TW-183
agugauaaggaagaa

SEQ ID NO: 551081 - RNA, 22 nt, Chlamydophila pneumoniae TW-183
agugagcucccugauguugccc

SEQ ID NO: 551082 - RNA, 22 nt, Chlamydophila pneumoniae TW-183
agugaacuuuuguacacagaga

SEQ ID NO: 551083 - RNA, 15 nt, Chlamydophila pneumoniae TW-183
aguccagacuuuccu

SEQ ID NO: 551084 - RNA, 22 nt, Chlamydophila pneumoniae TW-183
agucaugauuuuucaaucaaua

SEQ ID NO: 551085 - RNA, 24 nt, Chlamydophila pneumoniae TW-183
agucacggcgaaagcuacagcuaa

SEQ ID NO: 551086 - RNA, 15 nt, Chlamydophila pneumoniae TW-183
aguauccuuucauca

SEQ ID NO: 551087 - RNA, 17 nt, Chlamydophila pneumoniae TW-183
aguaucuaaaacuucuu

SEQ ID NO: 551088 - RNA, 19 nt, Chlamydophila pneumoniae TW-183
aguauucgauuccugaggc

SEQ ID NO: 551089 - RNA, 13 nt, Chlamydophila pneumoniae TW-183
aguaggagcagcg

SEQ ID NO: 551090 - RNA, 12 nt, Chlamydophila pneumoniae TW-183
aguaggaauuuu

SEQ ID NO: 551091 - RNA, 13 nt, Chlamydophila pneumoniae TW-183
aguauaaucagaa

SEQ ID NO: 551092 - RNA, 22 nt, Chlamydophila pneumoniae TW-183
aguauaauagugagcucccuga

SEQ ID NO: 551093 - RNA, 20 nt, Chlamydophila pneumoniae TW-183
aguauagcuuuuaguuuccc

SEQ ID NO: 551094 - RNA, 17 nt, Chlamydophila pneumoniae TW-183
aguacgcaaaguacuaa

SEQ ID NO: 551095 - RNA, 18 nt, Chlamydophila pneumoniae TW-183
aucaacuacaucuccaag

SEQ ID NO: 551096 - RNA, 21 nt, Chlamydophila pneumoniae TW-183
aucaaaggcugcuugagacuu

SEQ ID NO: 551097 - RNA, 17 nt, Chlamydophila pneumoniae TW-183
auauucuuucaaaccac

SEQ ID NO: 551098 - RNA, 23 nt, Chlamydophila pneumoniae TW-183
auauggguguaaauuuuuccuuc

SEQ ID NO: 551099 - RNA, 13 nt, Chlamydophila pneumoniae TW-183
auaugaagagacg

SEQ ID NO: 551100 - RNA, 19 nt, Chlamydophila pneumoniae TW-183
auaugcuuggcaauagcuu

SEQ ID NO: 551101 - RNA, 21 nt, Chlamydophila pneumoniae TW-183
auauggaaggcggcuuuuugc

SEQ ID NO: 551102 - RNA, 14 nt, Chlamydophila pneumoniae TW-183
auauggaauggcuu

SEQ ID NO: 551103 - RNA, 22 nt, Chlamydophila pneumoniae TW-183
auaucgccuuccuuaacaacau

SEQ ID NO: 551104 - RNA, 14 nt, Chlamydophila pneumoniae TW-183
auaucaucacuaag

SEQ ID NO: 551105 - RNA, 19 nt, Chlamydophila pneumoniae TW-183
auauaaaugcuauuuuccu

SEQ ID NO: 551106 - RNA, 22 nt, Chlamydophila pneumoniae TW-183
auauacugccagcgaucacaua

SEQ ID NO: 551107 - RNA, 13 nt, Chlamydophila pneumoniae TW-183
auauauagagcag

SEQ ID NO: 551108 - RNA, 23 nt, Chlamydophila pneumoniae TW-183
auagccuuccauaucuagaaguu

SEQ ID NO: 551109 - RNA, 16 nt, Chlamydophila pneumoniae TW-183
auaguuaaauuuccaa

SEQ ID NO: 551110 - RNA, 19 nt, Chlamydophila pneumoniae TW-183
auaguuaaauuuccaaaga

SEQ ID NO: 551111 - RNA, 15 nt, Chlamydophila pneumoniae TW-183
auagaauacacagcu

SEQ ID NO: 551112 - RNA, 15 nt, Chlamydophila pneumoniae TW-183
auagaagaucauuaa

SEQ ID NO: 551113 - RNA, 20 nt, Chlamydophila pneumoniae TW-183
auacuacuuacaagaacaag

SEQ ID NO: 551114 - RNA, 22 nt, Chlamydophila pneumoniae TW-183
auagauagggccgugaagcaga

SEQ ID NO: 551115 - RNA, 18 nt, Chlamydophila pneumoniae TW-183
auagauaucuuugggaga

SEQ ID NO: 551116 - RNA, 13 nt, Chlamydophila pneumoniae TW-183
auagauaugccuc

SEQ ID NO: 551117 - RNA, 16 nt, Chlamydophila pneumoniae TW-183
auacagcauaaaaauu

SEQ ID NO: 551118 - RNA, 15 nt, Chlamydophila pneumoniae TW-183
auacagcauaaaaau

SEQ ID NO: 551119 - RNA, 19 nt, Chlamydophila pneumoniae TW-183
auacaacgguauguauggu

SEQ ID NO: 551120 - RNA, 15 nt, Chlamydophila pneumoniae TW-183
auaaugguacaauac

SEQ ID NO: 551121 - RNA, 15 nt, Chlamydophila pneumoniae TW-183
auaaucucaccagaa

SEQ ID NO: 551122 - RNA, 15 nt, Chlamydophila pneumoniae TW-183
aucgaccuuaaaauu

SEQ ID NO: 551123 - RNA, 16 nt, Chlamydophila pneumoniae TW-183
auccuugcaaaacagc

SEQ ID NO: 551124 - RNA, 14 nt, Chlamydophila pneumoniae TW-183
auccuugcaaaaca

SEQ ID NO: 551125 - RNA, 14 nt, Chlamydophila pneumoniae TW-183
aucgaucucugugg

SEQ ID NO: 551126 - RNA, 16 nt, Chlamydophila pneumoniae TW-183
aucguacuucacuucu

SEQ ID NO: 551127 - RNA, 16 nt, Chlamydophila pneumoniae TW-183
auccugaaaaaagaag

SEQ ID NO: 551128 - RNA, 22 nt, Chlamydophila pneumoniae TW-183
auccuagagaaugugcucggca

SEQ ID NO: 551129 - RNA, 16 nt, Chlamydophila pneumoniae TW-183
auccuauuuuagcaua

SEQ ID NO: 551130 - RNA, 18 nt, Chlamydophila pneumoniae TW-183
auccgaagacucaaagaa

SEQ ID NO: 551131 - RNA, 23 nt, Chlamydophila pneumoniae TW-183
aucccugcacucuuucagaaaga

SEQ ID NO: 551132 - RNA, 18 nt, Chlamydophila pneumoniae TW-183
aucccuguaguuucuaaa

SEQ ID NO: 551133 - RNA, 21 nt, Chlamydophila pneumoniae TW-183
aucccuguaguuucuaaaaca

SEQ ID NO: 551134 - RNA, 23 nt, Chlamydophila pneumoniae TW-183
aucccagauaaagacaucucuuu

SEQ ID NO: 551135 - RNA, 22 nt, Chlamydophila pneumoniae TW-183
aucccagauuuuuuugguugcu

SEQ ID NO: 551136 - RNA, 21 nt, Chlamydophila pneumoniae TW-183
auccaucggcauuucuccaca

SEQ ID NO: 551137 - RNA, 17 nt, Chlamydophila pneumoniae TW-183
auccaucggcauuucuc

SEQ ID NO: 551138 - RNA, 16 nt, Chlamydophila pneumoniae TW-183
auccacugcuuuaggc

SEQ ID NO: 551139 - RNA, 13 nt, Chlamydophila pneumoniae TW-183
aucauuuuugcua

SEQ ID NO: 551140 - RNA, 12 nt, Chlamydophila pneumoniae TW-183
aucauauuuuuc

SEQ ID NO: 551141 - RNA, 18 nt, Chlamydophila pneumoniae TW-183
aucaggauggucauacca

SEQ ID NO: 551142 - RNA, 18 nt, Chlamydophila pneumoniae TW-183
aucaggagucucuggaag

SEQ ID NO: 551143 - RNA, 13 nt, Chlamydophila pneumoniae TW-183
aucauaucuucaa

SEQ ID NO: 551144 - RNA, 17 nt, Chlamydophila pneumoniae TW-183
aucauaaccaaaagaau

SEQ ID NO: 551145 - RNA, 15 nt, Chlamydophila pneumoniae TW-183
auggaucccuguagu

SEQ ID NO: 551146 - RNA, 14 nt, Chlamydophila pneumoniae TW-183
auggacaagcaaaa

SEQ ID NO: 551147 - RNA, 16 nt, Chlamydophila pneumoniae TW-183
auguacaguaaaguau

SEQ ID NO: 551148 - RNA, 22 nt, Chlamydophila pneumoniae TW-183
augucucuuaaaaaaaauuacu

SEQ ID NO: 551149 - RNA, 23 nt, Chlamydophila pneumoniae TW-183
augcaaaacaacaucacuaucau

SEQ ID NO: 551150 - RNA, 18 nt, Chlamydophila pneumoniae TW-183
augagcucaggcaacaac

SEQ ID NO: 551151 - RNA, 17 nt, Chlamydophila pneumoniae TW-183
aucuuccccuaaaaauu

SEQ ID NO: 551152 - RNA, 15 nt, Chlamydophila pneumoniae TW-183
aucuuccccuaaaaa

SEQ ID NO: 551153 - RNA, 15 nt, Chlamydophila pneumoniae TW-183
aucuucagagagaac

SEQ ID NO: 551154 - RNA, 13 nt, Chlamydophila pneumoniae TW-183
aucuucagagaga

SEQ ID NO: 551155 - RNA, 15 nt, Chlamydophila pneumoniae TW-183
aucuucaagaccacu

SEQ ID NO: 551156 - RNA, 23 nt, Chlamydophila pneumoniae TW-183
aucuguaauagcaggaguuuuca

SEQ ID NO: 551157 - RNA, 18 nt, Chlamydophila pneumoniae TW-183
aucuguaguaggcacuua

SEQ ID NO: 551158 - RNA, 16 nt, Chlamydophila pneumoniae TW-183
auucgagauauggaag

SEQ ID NO: 551159 - RNA, 19 nt, Chlamydophila pneumoniae TW-183
auucgauuccugaggcuau

SEQ ID NO: 551160 - RNA, 20 nt, Chlamydophila pneumoniae TW-183
auuccugaggcuauagaaua

SEQ ID NO: 551161 - RNA, 17 nt, Chlamydophila pneumoniae TW-183
auuccuuaaugguagcu

SEQ ID NO: 551162 - RNA, 22 nt, Chlamydophila pneumoniae TW-183
auucggcagaaggcuuguuucu

SEQ ID NO: 551163 - RNA, 12 nt, Chlamydophila pneumoniae TW-183
auuccauggaua

SEQ ID NO: 551164 - RNA, 19 nt, Chlamydophila pneumoniae TW-183
auuccagcaucuucucgaa

SEQ ID NO: 551165 - RNA, 14 nt, Chlamydophila pneumoniae TW-183
auuccaggcucuag

SEQ ID NO: 551166 - RNA, 23 nt, Chlamydophila pneumoniae TW-183
auucauaaagaggaaugaagaga

SEQ ID NO: 551167 - RNA, 17 nt, Chlamydophila pneumoniae TW-183
auucauaaagaggaaug

SEQ ID NO: 551168 - RNA, 23 nt, Chlamydophila pneumoniae TW-183
auucaucuaggggagcuauuacu

SEQ ID NO: 551169 - RNA, 14 nt, Chlamydophila pneumoniae TW-183
auuggcauagagcc

SEQ ID NO: 551170 - RNA, 20 nt, Chlamydophila pneumoniae TW-183
auuggcauagagccuagaga

SEQ ID NO: 551171 - RNA, 22 nt, Chlamydophila pneumoniae TW-183
auugcauuuaaacuaagaauac

SEQ ID NO: 551172 - RNA, 15 nt, Chlamydophila pneumoniae TW-183
auugcauuuaaacua

SEQ ID NO: 551173 - RNA, 16 nt, Chlamydophila pneumoniae TW-183
auugaugcuuaagagu

SEQ ID NO: 551174 - RNA, 12 nt, Chlamydophila pneumoniae TW-183
auucucuucacu

SEQ ID NO: 551175 - RNA, 20 nt, Chlamydophila pneumoniae TW-183
auucuagaguugcuuuaugg

SEQ ID NO: 551176 - RNA, 21 nt, Chlamydophila pneumoniae TW-183
auucugagaaagaaguccuag

SEQ ID NO: 551177 - RNA, 15 nt, Chlamydophila pneumoniae TW-183
auucugagaaagaag

SEQ ID NO: 551178 - RNA, 17 nt, Chlamydophila pneumoniae TW-183
auucuucugucuguauu

SEQ ID NO: 551179 - RNA, 14 nt, Chlamydophila pneumoniae TW-183
auuucuuucucuuc

SEQ ID NO: 551180 - RNA, 14 nt, Chlamydophila pneumoniae TW-183
auuuuuaauuuucu

SEQ ID NO: 551181 - RNA, 15 nt, Chlamydophila pneumoniae TW-183
auuuucucaauagug

SEQ ID NO: 551182 - RNA, 21 nt, Chlamydophila pneumoniae TW-183
auuuucuauucgcugucuaga

SEQ ID NO: 551183 - RNA, 14 nt, Chlamydophila pneumoniae TW-183
auuuuagcauaauc

SEQ ID NO: 551184 - RNA, 22 nt, Chlamydophila pneumoniae TW-183
auuuuaggaagcuuaucaagaa

SEQ ID NO: 551185 - RNA, 21 nt, Chlamydophila pneumoniae TW-183
auuuuagggaugguuuccucu

SEQ ID NO: 551186 - RNA, 19 nt, Chlamydophila pneumoniae TW-183
auuuccggguucauuucca

SEQ ID NO: 551187 - RNA, 18 nt, Chlamydophila pneumoniae TW-183
auuucauaagagaacuuu

SEQ ID NO: 551188 - RNA, 19 nt, Chlamydophila pneumoniae TW-183
auuuccaauccauucugag

SEQ ID NO: 551189 - RNA, 23 nt, Chlamydophila pneumoniae TW-183
auuuaagauaucgaccuuaaaau

SEQ ID NO: 551190 - RNA, 20 nt, Chlamydophila pneumoniae TW-183
auuuacaauuguguuugcag

SEQ ID NO: 551191 - RNA, 23 nt, Chlamydophila pneumoniae TW-183
auuuaggaugaauccaaaauaaa

SEQ ID NO: 551192 - RNA, 13 nt, Chlamydophila pneumoniae TW-183
caaagauauaagg

SEQ ID NO: 551193 - RNA, 13 nt, Chlamydophila pneumoniae TW-183
caaagaccagaau

SEQ ID NO: 551194 - RNA, 15 nt, Chlamydophila pneumoniae TW-183
caaagagcaaaggag

SEQ ID NO: 551195 - RNA, 15 nt, Chlamydophila pneumoniae TW-183
caacagcaacacucg

SEQ ID NO: 551196 - RNA, 19 nt, Chlamydophila pneumoniae TW-183
caaacuaacauagauaagg

SEQ ID NO: 551197 - RNA, 22 nt, Chlamydophila pneumoniae TW-183
caaacuccccaguuuuccaucc

SEQ ID NO: 551198 - RNA, 20 nt, Chlamydophila pneumoniae TW-183
caaacugaugccaagaaaua

SEQ ID NO: 551199 - RNA, 17 nt, Chlamydophila pneumoniae TW-183
caaacaucacucaggau

SEQ ID NO: 551200 - RNA, 21 nt, Chlamydophila pneumoniae TW-183
caaaccacggauuuucucuac

SEQ ID NO: 551201 - RNA, 15 nt, Chlamydophila pneumoniae TW-183
caaaauauucuuuca

SEQ ID NO: 551202 - RNA, 15 nt, Chlamydophila pneumoniae TW-183
caaaagguuuuauaa

SEQ ID NO: 551203 - RNA, 21 nt, Chlamydophila pneumoniae TW-183
caagcaacugauguuuuauag

SEQ ID NO: 551204 - RNA, 17 nt, Chlamydophila pneumoniae TW-183
caagauuaugaugccuc

SEQ ID NO: 551205 - RNA, 18 nt, Chlamydophila pneumoniae TW-183
caauacagcauaaaaauu

SEQ ID NO: 551206 - RNA, 17 nt, Chlamydophila pneumoniae TW-183
caagauacuacuuacaa

SEQ ID NO: 551207 - RNA, 16 nt, Chlamydophila pneumoniae TW-183
caagaaaacaaaguca

SEQ ID NO: 551208 - RNA, 19 nt, Chlamydophila pneumoniae TW-183
caacuuuguuaauagaaga

SEQ ID NO: 551209 - RNA, 20 nt, Chlamydophila pneumoniae TW-183
caacucuacaagugucugag

SEQ ID NO: 551210 - RNA, 18 nt, Chlamydophila pneumoniae TW-183
caagaauagcaggaagga

SEQ ID NO: 551211 - RNA, 21 nt, Chlamydophila pneumoniae TW-183
caagaauagccauaauuagaa

SEQ ID NO: 551212 - RNA, 16 nt, Chlamydophila pneumoniae TW-183
caacuaaacucuccaa

SEQ ID NO: 551213 - RNA, 12 nt, Chlamydophila pneumoniae TW-183
caacuaaacucu

SEQ ID NO: 551214 - RNA, 19 nt, Chlamydophila pneumoniae TW-183
caacgcaugacgcuuuucc

SEQ ID NO: 551215 - RNA, 16 nt, Chlamydophila pneumoniae TW-183
caacgaucgucaguaa

SEQ ID NO: 551216 - RNA, 18 nt, Chlamydophila pneumoniae TW-183
caacgaguccuuacuugc

SEQ ID NO: 551217 - RNA, 22 nt, Chlamydophila pneumoniae TW-183
caaccuucgauuccaggcucua

SEQ ID NO: 551218 - RNA, 20 nt, Chlamydophila pneumoniae TW-183
cacucuaucauaucuucaaa

SEQ ID NO: 551219 - RNA, 18 nt, Chlamydophila pneumoniae TW-183
cacuaaguuuaggcagga

SEQ ID NO: 551220 - RNA, 17 nt, Chlamydophila pneumoniae TW-183
cacggauuuucucuaca

SEQ ID NO: 551221 - RNA, 21 nt, Chlamydophila pneumoniae TW-183
cacgcacaaacuaacauagau

SEQ ID NO: 551222 - RNA, 23 nt, Chlamydophila pneumoniae TW-183
cacgaguucgcggaucuucuucu

SEQ ID NO: 551223 - RNA, 20 nt, Chlamydophila pneumoniae TW-183
cacgaccucgaauuccuccc

SEQ ID NO: 551224 - RNA, 16 nt, Chlamydophila pneumoniae TW-183
caccuaaaguuugagc

SEQ ID NO: 551225 - RNA, 22 nt, Chlamydophila pneumoniae TW-183
caccuaauaaagaagguugaga

SEQ ID NO: 551226 - RNA, 22 nt, Chlamydophila pneumoniae TW-183
cacccaaacugaugccaagaaa

SEQ ID NO: 551227 - RNA, 19 nt, Chlamydophila pneumoniae TW-183
caccagaagcaacuaaacu

SEQ ID NO: 551228 - RNA, 14 nt, Chlamydophila pneumoniae TW-183
caccagaagcaacu

SEQ ID NO: 551229 - RNA, 22 nt, Chlamydophila pneumoniae TW-183
caccagacccucgaguaccgac

SEQ ID NO: 551230 - RNA, 17 nt, Chlamydophila pneumoniae TW-183
caccaaugauaauuuca

SEQ ID NO: 551231 - RNA, 15 nt, Chlamydophila pneumoniae TW-183
caccaaaaauuccgu

SEQ ID NO: 551232 - RNA, 14 nt, Chlamydophila pneumoniae TW-183
cacaugucucuuaa

SEQ ID NO: 551233 - RNA, 16 nt, Chlamydophila pneumoniae TW-183
cacaugucucuuaaaa

SEQ ID NO: 551234 - RNA, 19 nt, Chlamydophila pneumoniae TW-183
cacaggggaacgcucucua

SEQ ID NO: 551235 - RNA, 17 nt, Chlamydophila pneumoniae TW-183
cacauacaguacgcaaa

SEQ ID NO: 551236 - RNA, 23 nt, Chlamydophila pneumoniae TW-183
cacagcauuuucucugagcagcu

SEQ ID NO: 551237 - RNA, 18 nt, Chlamydophila pneumoniae TW-183
cacagagaugcuucuaaa

SEQ ID NO: 551238 - RNA, 22 nt, Chlamydophila pneumoniae TW-183
cacagagaugcuucuaaacaau

SEQ ID NO: 551239 - RNA, 19 nt, Chlamydophila pneumoniae TW-183
cacacuuaaagguaaaacu

SEQ ID NO: 551240 - RNA, 15 nt, Chlamydophila pneumoniae TW-183
cacaauauaaaugcu

SEQ ID NO: 551241 - RNA, 23 nt, Chlamydophila pneumoniae TW-183
cacaauauaaaugcuauuuuccu

SEQ ID NO: 551242 - RNA, 13 nt, Chlamydophila pneumoniae TW-183
cacaaaaccugga

SEQ ID NO: 551243 - RNA, 21 nt, Chlamydophila pneumoniae TW-183
cacaaaaagcuuuuuucucuu

SEQ ID NO: 551244 - RNA, 20 nt, Chlamydophila pneumoniae TW-183
caauugaaucagauuagagu

SEQ ID NO: 551245 - RNA, 15 nt, Chlamydophila pneumoniae TW-183
caauugagcuucuuu

SEQ ID NO: 551246 - RNA, 23 nt, Chlamydophila pneumoniae TW-183
caauugagcuucuuuagauagcu

SEQ ID NO: 551247 - RNA, 17 nt, Chlamydophila pneumoniae TW-183
caauucgagauauggaa

SEQ ID NO: 551248 - RNA, 18 nt, Chlamydophila pneumoniae TW-183
caauuccccuucaucaau

SEQ ID NO: 551249 - RNA, 16 nt, Chlamydophila pneumoniae TW-183
cauagaguaucuaaaa

SEQ ID NO: 551250 - RNA, 20 nt, Chlamydophila pneumoniae TW-183
cauagguaauacgagaggaa

SEQ ID NO: 551251 - RNA, 19 nt, Chlamydophila pneumoniae TW-183
cauagguaauacgagagga

SEQ ID NO: 551252 - RNA, 23 nt, Chlamydophila pneumoniae TW-183
cauaggcuuuaccauagaaagau

SEQ ID NO: 551253 - RNA, 17 nt, Chlamydophila pneumoniae TW-183
cauaggauccaggaguu

SEQ ID NO: 551254 - RNA, 21 nt, Chlamydophila pneumoniae TW-183
cauaggaaugccaaaccucuu

SEQ ID NO: 551255 - RNA, 18 nt, Chlamydophila pneumoniae TW-183
cauauacuguuaacaagu

SEQ ID NO: 551256 - RNA, 19 nt, Chlamydophila pneumoniae TW-183
cauaucaucgauaucuaag

SEQ ID NO: 551257 - RNA, 20 nt, Chlamydophila pneumoniae TW-183
caucaaauaguucaucauau

SEQ ID NO: 551258 - RNA, 19 nt, Chlamydophila pneumoniae TW-183
caucgucuccaaaaauucc

SEQ ID NO: 551259 - RNA, 22 nt, Chlamydophila pneumoniae TW-183
caucggcauuucuccacaugcc

SEQ ID NO: 551260 - RNA, 22 nt, Chlamydophila pneumoniae TW-183
cauccuguagagcaagauucuu

SEQ ID NO: 551261 - RNA, 14 nt, Chlamydophila pneumoniae TW-183
caucaggauucucu

SEQ ID NO: 551262 - RNA, 16 nt, Chlamydophila pneumoniae TW-183
caucaggauucucucu

SEQ ID NO: 551263 - RNA, 16 nt, Chlamydophila pneumoniae TW-183
cauuucauguaagaau

SEQ ID NO: 551264 - RNA, 19 nt, Chlamydophila pneumoniae TW-183
cauuggcuccuaaggaaac

SEQ ID NO: 551265 - RNA, 17 nt, Chlamydophila pneumoniae TW-183
cauuccagcaucuucuc

SEQ ID NO: 551266 - RNA, 18 nt, Chlamydophila pneumoniae TW-183
cauguuaagcguauagaa

SEQ ID NO: 551267 - RNA, 22 nt, Chlamydophila pneumoniae TW-183
caugaugcaguccacgcuaucu

SEQ ID NO: 551268 - RNA, 22 nt, Chlamydophila pneumoniae TW-183
caugcauaggcuuuaccauaga

SEQ ID NO: 551269 - RNA, 23 nt, Chlamydophila pneumoniae TW-183
caugagagucgaaacacucauga

SEQ ID NO: 551270 - RNA, 17 nt, Chlamydophila pneumoniae TW-183
caugaggagaccuuuau

SEQ ID NO: 551271 - RNA, 21 nt, Chlamydophila pneumoniae TW-183
caugagagucgaaacacucau

SEQ ID NO: 551272 - RNA, 15 nt, Chlamydophila pneumoniae TW-183
caugacgcuuuucca

SEQ ID NO: 551273 - RNA, 15 nt, Chlamydophila pneumoniae TW-183
caguuuuccauccac

SEQ ID NO: 551274 - RNA, 14 nt, Chlamydophila pneumoniae TW-183
cauaagagaacuuu

SEQ ID NO: 551275 - RNA, 13 nt, Chlamydophila pneumoniae TW-183
cauaagaucucua

SEQ ID NO: 551276 - RNA, 22 nt, Chlamydophila pneumoniae TW-183
cauaagaucucuaaguucuuga

SEQ ID NO: 551277 - RNA, 15 nt, Chlamydophila pneumoniae TW-183
caguucgacaaccaa

SEQ ID NO: 551278 - RNA, 22 nt, Chlamydophila pneumoniae TW-183
caguaggagcagcggcacccuc

SEQ ID NO: 551279 - RNA, 15 nt, Chlamydophila pneumoniae TW-183
caggucugcugagga

SEQ ID NO: 551280 - RNA, 17 nt, Chlamydophila pneumoniae TW-183
caggauauugcggaaau

SEQ ID NO: 551281 - RNA, 15 nt, Chlamydophila pneumoniae TW-183
caggcaucacuaauc

SEQ ID NO: 551282 - RNA, 13 nt, Chlamydophila pneumoniae TW-183
caggcauucuuca

SEQ ID NO: 551283 - RNA, 16 nt, Chlamydophila pneumoniae TW-183
cagcuucgcaaucuuu

SEQ ID NO: 551284 - RNA, 15 nt, Chlamydophila pneumoniae TW-183
cagcuucuacagcau

SEQ ID NO: 551285 - RNA, 22 nt, Chlamydophila pneumoniae TW-183
cagcuuuaucaggaucuugauu

SEQ ID NO: 551286 - RNA, 17 nt, Chlamydophila pneumoniae TW-183
cagcuuuaucaggaucu

SEQ ID NO: 551287 - RNA, 20 nt, Chlamydophila pneumoniae TW-183
caggaaaacgcccucuagaa

SEQ ID NO: 551288 - RNA, 15 nt, Chlamydophila pneumoniae TW-183
cagcuaacgaaguga

SEQ ID NO: 551289 - RNA, 19 nt, Chlamydophila pneumoniae TW-183
cagcuaaucaauccaagaa

SEQ ID NO: 551290 - RNA, 20 nt, Chlamydophila pneumoniae TW-183
cagcuaaucaauccaagaau

SEQ ID NO: 551291 - RNA, 17 nt, Chlamydophila pneumoniae TW-183
cccagauuuuuuugguu

SEQ ID NO: 551292 - RNA, 16 nt, Chlamydophila pneumoniae TW-183
cccaauauccagaaau

SEQ ID NO: 551293 - RNA, 15 nt, Chlamydophila pneumoniae TW-183
cccaauauccagaaa

SEQ ID NO: 551294 - RNA, 16 nt, Chlamydophila pneumoniae TW-183
ccauggauauggaaug

SEQ ID NO: 551295 - RNA, 15 nt, Chlamydophila pneumoniae TW-183
ccaugaucuuagcuc

SEQ ID NO: 551296 - RNA, 20 nt, Chlamydophila pneumoniae TW-183
ccaugaucuuagcuccugua

SEQ ID NO: 551297 - RNA, 15 nt, Chlamydophila pneumoniae TW-183
ccaugagcucaggca

SEQ ID NO: 551298 - RNA, 17 nt, Chlamydophila pneumoniae TW-183
ccauccacgaccucgaa

SEQ ID NO: 551299 - RNA, 18 nt, Chlamydophila pneumoniae TW-183
ccaguuuuccauccacga

SEQ ID NO: 551300 - RNA, 15 nt, Chlamydophila pneumoniae TW-183
ccaguuacugucugc

SEQ ID NO: 551301 - RNA, 22 nt, Chlamydophila pneumoniae TW-183
ccaggagagcuaacagcacgua

SEQ ID NO: 551302 - RNA, 22 nt, Chlamydophila pneumoniae TW-183
ccaggaaacguucuuucaauaa

SEQ ID NO: 551303 - RNA, 17 nt, Chlamydophila pneumoniae TW-183
ccaggaaacguucuuuc

SEQ ID NO: 551304 - RNA, 15 nt, Chlamydophila pneumoniae TW-183
ccagcaucuucucga

SEQ ID NO: 551305 - RNA, 19 nt, Chlamydophila pneumoniae TW-183
ccagacuuuccucucuuua

SEQ ID NO: 551306 - RNA, 23 nt, Chlamydophila pneumoniae TW-183
ccagagagcuuuuagguagagaa

SEQ ID NO: 551307 - RNA, 14 nt, Chlamydophila pneumoniae TW-183
ccagagagcuuuua

SEQ ID NO: 551308 - RNA, 23 nt, Chlamydophila pneumoniae TW-183
ccacgaguucgcggaucuucuuc

SEQ ID NO: 551309 - RNA, 15 nt, Chlamydophila pneumoniae TW-183
ccacggauuuucucu

SEQ ID NO: 551310 - RNA, 16 nt, Chlamydophila pneumoniae TW-183
ccacggauuuucucua

SEQ ID NO: 551311 - RNA, 13 nt, Chlamydophila pneumoniae TW-183
ccacagcuucuuc

SEQ ID NO: 551312 - RNA, 15 nt, Chlamydophila pneumoniae TW-183
ccacaacauaacagg

SEQ ID NO: 551313 - RNA, 18 nt, Chlamydophila pneumoniae TW-183
ccaauacagcauaaaaau

SEQ ID NO: 551314 - RNA, 19 nt, Chlamydophila pneumoniae TW-183
ccaaucgauaacguugccu

SEQ ID NO: 551315 - RNA, 22 nt, Chlamydophila pneumoniae TW-183
ccaauccauucugagaaagaag

SEQ ID NO: 551316 - RNA, 22 nt, Chlamydophila pneumoniae TW-183
ccaaguguugccagcccauguc

SEQ ID NO: 551317 - RNA, 22 nt, Chlamydophila pneumoniae TW-183
ccaagcaggugugugguaaaaa

SEQ ID NO: 551318 - RNA, 22 nt, Chlamydophila pneumoniae TW-183
ccaagagucuuugaugcuaaac

SEQ ID NO: 551319 - RNA, 16 nt, Chlamydophila pneumoniae TW-183
ccaagaaauauacugc

SEQ ID NO: 551320 - RNA, 19 nt, Chlamydophila pneumoniae TW-183
ccaaaccucuuagcuauca

SEQ ID NO: 551321 - RNA, 11 nt, Chlamydophila pneumoniae TW-183
ccaaacaugga

SEQ ID NO: 551322 - RNA, 21 nt, Chlamydophila pneumoniae TW-183
ccaaacauggacaauauagag

SEQ ID NO: 551323 - RNA, 23 nt, Chlamydophila pneumoniae TW-183
ccaaaagaauuaagaagaagcug

SEQ ID NO: 551324 - RNA, 15 nt, Chlamydophila pneumoniae TW-183
ccaaaaauucccaua

SEQ ID NO: 551325 - RNA, 20 nt, Chlamydophila pneumoniae TW-183
ccaaacggcugauucuccca

SEQ ID NO: 551326 - RNA, 16 nt, Chlamydophila pneumoniae TW-183
ccaaagcauauacugu

SEQ ID NO: 551327 - RNA, 18 nt, Chlamydophila pneumoniae TW-183
cgaaugucguuaaaaacu

SEQ ID NO: 551328 - RNA, 12 nt, Chlamydophila pneumoniae TW-183
cgaaucucucca

SEQ ID NO: 551329 - RNA, 21 nt, Chlamydophila pneumoniae TW-183
cgaauaaguuuugauuuugca

SEQ ID NO: 551330 - RNA, 23 nt, Chlamydophila pneumoniae TW-183
cgaagcuugcugauuucuuuuuc

SEQ ID NO: 551331 - RNA, 17 nt, Chlamydophila pneumoniae TW-183
cgaagacucaaagaacu

SEQ ID NO: 551332 - RNA, 17 nt, Chlamydophila pneumoniae TW-183
cgaagauccuagagaau

SEQ ID NO: 551333 - RNA, 19 nt, Chlamydophila pneumoniae TW-183
cgaccugcaaacuccccag

SEQ ID NO: 551334 - RNA, 18 nt, Chlamydophila pneumoniae TW-183
cgaccucgaauuccuccc

SEQ ID NO: 551335 - RNA, 17 nt, Chlamydophila pneumoniae TW-183
cgaccuaggagaaauca

SEQ ID NO: 551336 - RNA, 18 nt, Chlamydophila pneumoniae TW-183
cgaaagcuacagcuaacg

SEQ ID NO: 551337 - RNA, 23 nt, Chlamydophila pneumoniae TW-183
ccuuucucuuccgauuaacuuua

SEQ ID NO: 551338 - RNA, 12 nt, Chlamydophila pneumoniae TW-183
ccuuguuuuccu

SEQ ID NO: 551339 - RNA, 14 nt, Chlamydophila pneumoniae TW-183
ccuugguaucccaa

SEQ ID NO: 551340 - RNA, 15 nt, Chlamydophila pneumoniae TW-183
ccuugacuaaaucca

SEQ ID NO: 551341 - RNA, 21 nt, Chlamydophila pneumoniae TW-183
ccuugcagcgacaacacgccc

SEQ ID NO: 551342 - RNA, 13 nt, Chlamydophila pneumoniae TW-183
ccuugcagcccug

SEQ ID NO: 551343 - RNA, 14 nt, Chlamydophila pneumoniae TW-183
ccuucgauuccagg

SEQ ID NO: 551344 - RNA, 22 nt, Chlamydophila pneumoniae TW-183
cgcaacuuaagauacuucucca

SEQ ID NO: 551345 - RNA, 14 nt, Chlamydophila pneumoniae TW-183
cgauuccugaggcu

SEQ ID NO: 551346 - RNA, 15 nt, Chlamydophila pneumoniae TW-183
cgauuccugaggcua

SEQ ID NO: 551347 - RNA, 22 nt, Chlamydophila pneumoniae TW-183
cgauuguaaaaguagcauccug

SEQ ID NO: 551348 - RNA, 19 nt, Chlamydophila pneumoniae TW-183
cgaguucgcggaucuucuu

SEQ ID NO: 551349 - RNA, 22 nt, Chlamydophila pneumoniae TW-183
cgaguucgcggaucuucuucug

SEQ ID NO: 551350 - RNA, 15 nt, Chlamydophila pneumoniae TW-183
cgaguaucuacuuug

SEQ ID NO: 551351 - RNA, 16 nt, Chlamydophila pneumoniae TW-183
cgaguccuuacuugca

SEQ ID NO: 551352 - RNA, 15 nt, Chlamydophila pneumoniae TW-183
cgagauaugaagaga

SEQ ID NO: 551353 - RNA, 18 nt, Chlamydophila pneumoniae TW-183
cgagaguugccaggaaac

SEQ ID NO: 551354 - RNA, 16 nt, Chlamydophila pneumoniae TW-183
cgagcagaaacuccaa

SEQ ID NO: 551355 - RNA, 21 nt, Chlamydophila pneumoniae TW-183
cgacguuuugcuguggaauuu

SEQ ID NO: 551356 - RNA, 23 nt, Chlamydophila pneumoniae TW-183
ccuguaguuucuaaaacagaaau

SEQ ID NO: 551357 - RNA, 15 nt, Chlamydophila pneumoniae TW-183
ccuguacuaucuuuu

SEQ ID NO: 551358 - RNA, 18 nt, Chlamydophila pneumoniae TW-183
ccuggauugauccacaga

SEQ ID NO: 551359 - RNA, 17 nt, Chlamydophila pneumoniae TW-183
ccugcaccagacccucg

SEQ ID NO: 551360 - RNA, 14 nt, Chlamydophila pneumoniae TW-183
ccucucccuuggga

SEQ ID NO: 551361 - RNA, 12 nt, Chlamydophila pneumoniae TW-183
ccucuucuucau

SEQ ID NO: 551362 - RNA, 11 nt, Chlamydophila pneumoniae TW-183
ccuccucuucu

SEQ ID NO: 551363 - RNA, 23 nt, Chlamydophila pneumoniae TW-183
ccucaucagaagccaccaaaaau

SEQ ID NO: 551364 - RNA, 14 nt, Chlamydophila pneumoniae TW-183
ccucaucagaagcc

SEQ ID NO: 551365 - RNA, 20 nt, Chlamydophila pneumoniae TW-183
ccucaucagaagccaccaaa

SEQ ID NO: 551366 - RNA, 17 nt, Chlamydophila pneumoniae TW-183
ccgugacuccagaaggu

SEQ ID NO: 551367 - RNA, 18 nt, Chlamydophila pneumoniae TW-183
ccguacgaguaucuacuu

SEQ ID NO: 551368 - RNA, 23 nt, Chlamydophila pneumoniae TW-183
ccgcucuaagcugugcauuuucu

SEQ ID NO: 551369 - RNA, 16 nt, Chlamydophila pneumoniae TW-183
ccgaucauuuuugcua

SEQ ID NO: 551370 - RNA, 15 nt, Chlamydophila pneumoniae TW-183
ccgagcuuuuugcuu

SEQ ID NO: 551371 - RNA, 13 nt, Chlamydophila pneumoniae TW-183
ccgaaucucucca

SEQ ID NO: 551372 - RNA, 13 nt, Chlamydophila pneumoniae TW-183
ccgagaauacaga

SEQ ID NO: 551373 - RNA, 15 nt, Chlamydophila pneumoniae TW-183
ccgagacuucucucu

SEQ ID NO: 551374 - RNA, 17 nt, Chlamydophila pneumoniae TW-183
cccugaugcuguaucuc

SEQ ID NO: 551375 - RNA, 23 nt, Chlamydophila pneumoniae TW-183
cccucuucauccgaagacucaaa

SEQ ID NO: 551376 - RNA, 11 nt, Chlamydophila pneumoniae TW-183
cccucuucauc

SEQ ID NO: 551377 - RNA, 12 nt, Chlamydophila pneumoniae TW-183
cccucuucaucc

SEQ ID NO: 551378 - RNA, 20 nt, Chlamydophila pneumoniae TW-183
cguacgcaaguaaagaaauu

SEQ ID NO: 551379 - RNA, 18 nt, Chlamydophila pneumoniae TW-183
cguaauccuucuuucugc

SEQ ID NO: 551380 - RNA, 17 nt, Chlamydophila pneumoniae TW-183
cguaauccuucuuucug

SEQ ID NO: 551381 - RNA, 13 nt, Chlamydophila pneumoniae TW-183
cguaacugaggca

SEQ ID NO: 551382 - RNA, 18 nt, Chlamydophila pneumoniae TW-183
cguaacugaggcaaagau

SEQ ID NO: 551383 - RNA, 23 nt, Chlamydophila pneumoniae TW-183
cggguucauuuccaaauucuugc

SEQ ID NO: 551384 - RNA, 21 nt, Chlamydophila pneumoniae TW-183
cggcugcgguagccuggaggc

SEQ ID NO: 551385 - RNA, 19 nt, Chlamydophila pneumoniae TW-183
cgggaucguagcaggcauc

SEQ ID NO: 551386 - RNA, 18 nt, Chlamydophila pneumoniae TW-183
cgggauucguagcuuccc

SEQ ID NO: 551387 - RNA, 17 nt, Chlamydophila pneumoniae TW-183
cggaacaacuuugaggc

SEQ ID NO: 551388 - RNA, 19 nt, Chlamydophila pneumoniae TW-183
cgcguuggugaugauuuga

SEQ ID NO: 551389 - RNA, 18 nt, Chlamydophila pneumoniae TW-183
cgugaauaucaucacuaa

SEQ ID NO: 551390 - RNA, 14 nt, Chlamydophila pneumoniae TW-183
cgucuuucaccaac

SEQ ID NO: 551391 - RNA, 14 nt, Chlamydophila pneumoniae TW-183
cguacuucacuucu

SEQ ID NO: 551392 - RNA, 19 nt, Chlamydophila pneumoniae TW-183
cguccagccugcaccagac

SEQ ID NO: 551393 - RNA, 19 nt, Chlamydophila pneumoniae TW-183
cguuuccgaucauuuuugc

SEQ ID NO: 551394 - RNA, 18 nt, Chlamydophila pneumoniae TW-183
cuaaguuuaggcaggaag

SEQ ID NO: 551395 - RNA, 16 nt, Chlamydophila pneumoniae TW-183
cuaaguucuuaagaau

SEQ ID NO: 551396 - RNA, 20 nt, Chlamydophila pneumoniae TW-183
cuaagcugugcauuuucuuc

SEQ ID NO: 551397 - RNA, 20 nt, Chlamydophila pneumoniae TW-183
cuaagcugaaagaacacucc

SEQ ID NO: 551398 - RNA, 18 nt, Chlamydophila pneumoniae TW-183
cuaagcuccauaaaaaua

SEQ ID NO: 551399 - RNA, 16 nt, Chlamydophila pneumoniae TW-183
cuaagcgcucuucaau

SEQ ID NO: 551400 - RNA, 15 nt, Chlamydophila pneumoniae TW-183
cuaaaccuucaauga

SEQ ID NO: 551401 - RNA, 19 nt, Chlamydophila pneumoniae TW-183
cguggagugcucuacccca

SEQ ID NO: 551402 - RNA, 14 nt, Chlamydophila pneumoniae TW-183
cgugcucugcaauc

SEQ ID NO: 551403 - RNA, 17 nt, Chlamydophila pneumoniae TW-183
cguggcuuuguaaaaau

SEQ ID NO: 551404 - RNA, 19 nt, Chlamydophila pneumoniae TW-183
cucauuaagaggagucccc

SEQ ID NO: 551405 - RNA, 21 nt, Chlamydophila pneumoniae TW-183
cucaucagaagccaccaaaaa

SEQ ID NO: 551406 - RNA, 16 nt, Chlamydophila pneumoniae TW-183
cucaguaggagcagcg

SEQ ID NO: 551407 - RNA, 12 nt, Chlamydophila pneumoniae TW-183
cuauuuuuuaag

SEQ ID NO: 551408 - RNA, 14 nt, Chlamydophila pneumoniae TW-183
cuauuuuugaggaa

SEQ ID NO: 551409 - RNA, 20 nt, Chlamydophila pneumoniae TW-183
cucaaggucacagcauuuuc

SEQ ID NO: 551410 - RNA, 22 nt, Chlamydophila pneumoniae TW-183
cuauagaauacacagcuaugau

SEQ ID NO: 551411 - RNA, 19 nt, Chlamydophila pneumoniae TW-183
cuauaaauuucucaugcau

SEQ ID NO: 551412 - RNA, 20 nt, Chlamydophila pneumoniae TW-183
cuaugggaggaauuccucuc

SEQ ID NO: 551413 - RNA, 19 nt, Chlamydophila pneumoniae TW-183
cuaugggaggaauuccucu

SEQ ID NO: 551414 - RNA, 16 nt, Chlamydophila pneumoniae TW-183
cuaucuccuuguucuu

SEQ ID NO: 551415 - RNA, 13 nt, Chlamydophila pneumoniae TW-183
cuauccuauuuua

SEQ ID NO: 551416 - RNA, 16 nt, Chlamydophila pneumoniae TW-183
cuagcaguugcaauac

SEQ ID NO: 551417 - RNA, 21 nt, Chlamydophila pneumoniae TW-183
cuagaguugcuuuauggcuca

SEQ ID NO: 551418 - RNA, 16 nt, Chlamydophila pneumoniae TW-183
cuagaacacucagaga

SEQ ID NO: 551419 - RNA, 15 nt, Chlamydophila pneumoniae TW-183
cuacgcgcucuucuu

SEQ ID NO: 551420 - RNA, 17 nt, Chlamydophila pneumoniae TW-183
cuacgcgcucuucuuuc

SEQ ID NO: 551421 - RNA, 15 nt, Chlamydophila pneumoniae TW-183
cuaauacuuuaggag

SEQ ID NO: 551422 - RNA, 24 nt, Chlamydophila pneumoniae TW-183
cuaccucugggaagacucucauca

SEQ ID NO: 551423 - RNA, 19 nt, Chlamydophila pneumoniae TW-183
cucuaccccacgcuaaacu

SEQ ID NO: 551424 - RNA, 16 nt, Chlamydophila pneumoniae TW-183
cucuaccccacgcuaa

SEQ ID NO: 551425 - RNA, 17 nt, Chlamydophila pneumoniae TW-183
cucguaauccuucuuuc

SEQ ID NO: 551426 - RNA, 13 nt, Chlamydophila pneumoniae TW-183
cucgggagaacau

SEQ ID NO: 551427 - RNA, 20 nt, Chlamydophila pneumoniae TW-183
cucgggauucguagcuuccc

SEQ ID NO: 551428 - RNA, 22 nt, Chlamydophila pneumoniae TW-183
cucggauggacuacugaaacac

SEQ ID NO: 551429 - RNA, 21 nt, Chlamydophila pneumoniae TW-183
cucgagcagaaacuccaaaau

SEQ ID NO: 551430 - RNA, 23 nt, Chlamydophila pneumoniae TW-183
cuccuaaggaaaccacguccauu

SEQ ID NO: 551431 - RNA, 20 nt, Chlamydophila pneumoniae TW-183
cuccugacucuuauugcaga

SEQ ID NO: 551432 - RNA, 18 nt, Chlamydophila pneumoniae TW-183
cuccugacucuuauugca

SEQ ID NO: 551433 - RNA, 17 nt, Chlamydophila pneumoniae TW-183
cucccaauauccagaaa

SEQ ID NO: 551434 - RNA, 17 nt, Chlamydophila pneumoniae TW-183
cuccauuggcauagagc

SEQ ID NO: 551435 - RNA, 13 nt, Chlamydophila pneumoniae TW-183
cuccagcauaagg

SEQ ID NO: 551436 - RNA, 14 nt, Chlamydophila pneumoniae TW-183
cuccagcagcuucc

SEQ ID NO: 551437 - RNA, 16 nt, Chlamydophila pneumoniae TW-183
cuccaaaaauucccau

SEQ ID NO: 551438 - RNA, 17 nt, Chlamydophila pneumoniae TW-183
cucuauauuuuuuccca

SEQ ID NO: 551439 - RNA, 12 nt, Chlamydophila pneumoniae TW-183
cucuaucucucg

SEQ ID NO: 551440 - RNA, 15 nt, Chlamydophila pneumoniae TW-183
cugaggacgcagaga

SEQ ID NO: 551441 - RNA, 22 nt, Chlamydophila pneumoniae TW-183
cugaggcuauagaauacacagc

SEQ ID NO: 551442 - RNA, 22 nt, Chlamydophila pneumoniae TW-183
cugcaaacuccccaguuuucca

SEQ ID NO: 551443 - RNA, 21 nt, Chlamydophila pneumoniae TW-183
cugauuucuuuuucagcuucu

SEQ ID NO: 551444 - RNA, 22 nt, Chlamydophila pneumoniae TW-183
cugauguugcccuacaauuucc

SEQ ID NO: 551445 - RNA, 21 nt, Chlamydophila pneumoniae TW-183
cugccagagauucuucacaau

SEQ ID NO: 551446 - RNA, 21 nt, Chlamydophila pneumoniae TW-183
cuguaaaaaagaaauacuuuu

SEQ ID NO: 551447 - RNA, 22 nt, Chlamydophila pneumoniae TW-183
cuguagguuuuuccaacuucaa

SEQ ID NO: 551448 - RNA, 17 nt, Chlamydophila pneumoniae TW-183
cuggaggcuguguaaaa

SEQ ID NO: 551449 - RNA, 22 nt, Chlamydophila pneumoniae TW-183
cugcuugugaggcuauagcaua

SEQ ID NO: 551450 - RNA, 15 nt, Chlamydophila pneumoniae TW-183
cugcuugugaggcua

SEQ ID NO: 551451 - RNA, 14 nt, Chlamydophila pneumoniae TW-183
cugcuuuuguuguu

SEQ ID NO: 551452 - RNA, 21 nt, Chlamydophila pneumoniae TW-183
cugcuuuuguuguuuuugcug

SEQ ID NO: 551453 - RNA, 19 nt, Chlamydophila pneumoniae TW-183
cugcuuuuuugaucugaag

SEQ ID NO: 551454 - RNA, 21 nt, Chlamydophila pneumoniae TW-183
cuguuuuuucacuuacagaua

SEQ ID NO: 551455 - RNA, 19 nt, Chlamydophila pneumoniae TW-183
cuuaaaagagaacauguuu

SEQ ID NO: 551456 - RNA, 20 nt, Chlamydophila pneumoniae TW-183
cuuaaaauucuguaaaguga

SEQ ID NO: 551457 - RNA, 15 nt, Chlamydophila pneumoniae TW-183
cuuaaaauucuguaa

SEQ ID NO: 551458 - RNA, 15 nt, Chlamydophila pneumoniae TW-183
cuguuuucuuuucug

SEQ ID NO: 551459 - RNA, 18 nt, Chlamydophila pneumoniae TW-183
cugucuagaacacucaga

SEQ ID NO: 551460 - RNA, 15 nt, Chlamydophila pneumoniae TW-183
cuguugcacuuuccg

SEQ ID NO: 551461 - RNA, 23 nt, Chlamydophila pneumoniae TW-183
cuuacggccccuggaauuucucc

SEQ ID NO: 551462 - RNA, 20 nt, Chlamydophila pneumoniae TW-183
cuuaaagagaaucuccucau

SEQ ID NO: 551463 - RNA, 20 nt, Chlamydophila pneumoniae TW-183
cuuagaguugaccauauaau

SEQ ID NO: 551464 - RNA, 18 nt, Chlamydophila pneumoniae TW-183
cuucagagagaacaggag

SEQ ID NO: 551465 - RNA, 14 nt, Chlamydophila pneumoniae TW-183
cuucacaagaaaac

SEQ ID NO: 551466 - RNA, 21 nt, Chlamydophila pneumoniae TW-183
cuucauccgaagacucaaaga

SEQ ID NO: 551467 - RNA, 14 nt, Chlamydophila pneumoniae TW-183
cuucccagccuuga

SEQ ID NO: 551468 - RNA, 14 nt, Chlamydophila pneumoniae TW-183
cuucauugcaaaaa

SEQ ID NO: 551469 - RNA, 11 nt, Chlamydophila pneumoniae TW-183
cuuuccucucu

SEQ ID NO: 551470 - RNA, 22 nt, Chlamydophila pneumoniae TW-183
cuuuauagauaugccucagguc

SEQ ID NO: 551471 - RNA, 13 nt, Chlamydophila pneumoniae TW-183
cuuuauagauaug

SEQ ID NO: 551472 - RNA, 17 nt, Chlamydophila pneumoniae TW-183
cuuuaccauagaaagau

SEQ ID NO: 551473 - RNA, 19 nt, Chlamydophila pneumoniae TW-183
cuuuaccauagaaagauaa

SEQ ID NO: 551474 - RNA, 15 nt, Chlamydophila pneumoniae TW-183
cuuguucuuuucauc

SEQ ID NO: 551475 - RNA, 18 nt, Chlamydophila pneumoniae TW-183
cuuguuuuccuguguggu

SEQ ID NO: 551476 - RNA, 15 nt, Chlamydophila pneumoniae TW-183
cuugauucucuucca

SEQ ID NO: 551477 - RNA, 20 nt, Chlamydophila pneumoniae TW-183
cuugauaaaacgcuauuguu

SEQ ID NO: 551478 - RNA, 17 nt, Chlamydophila pneumoniae TW-183
cuucuuguuuuugugga

SEQ ID NO: 551479 - RNA, 23 nt, Chlamydophila pneumoniae TW-183
cuugagccaacagguucacuuca

SEQ ID NO: 551480 - RNA, 19 nt, Chlamydophila pneumoniae TW-183
cuugaaauugcucuugcuc

SEQ ID NO: 551481 - RNA, 15 nt, Chlamydophila pneumoniae TW-183
cuucuugugauccuu

SEQ ID NO: 551482 - RNA, 14 nt, Chlamydophila pneumoniae TW-183
cuucuuguuuuugu

SEQ ID NO: 551483 - RNA, 19 nt, Chlamydophila pneumoniae TW-183
cuucuucuaaaaucuucuc

SEQ ID NO: 551484 - RNA, 18 nt, Chlamydophila pneumoniae TW-183
cuucuucccagccuugau

SEQ ID NO: 551485 - RNA, 19 nt, Chlamydophila pneumoniae TW-183
gaagacucucaucagcaaa

SEQ ID NO: 551486 - RNA, 20 nt, Chlamydophila pneumoniae TW-183
gaagacucucaucagcaaaa

SEQ ID NO: 551487 - RNA, 18 nt, Chlamydophila pneumoniae TW-183
gaagaauuucgucuucau

SEQ ID NO: 551488 - RNA, 18 nt, Chlamydophila pneumoniae TW-183
gaagcaacuaaacucucc

SEQ ID NO: 551489 - RNA, 20 nt, Chlamydophila pneumoniae TW-183
gaagagcauuuaaaacggcu

SEQ ID NO: 551490 - RNA, 18 nt, Chlamydophila pneumoniae TW-183
gaagagcauuuaaaacgg

SEQ ID NO: 551491 - RNA, 16 nt, Chlamydophila pneumoniae TW-183
gaagauccuagagaau

SEQ ID NO: 551492 - RNA, 15 nt, Chlamydophila pneumoniae TW-183
gaagcugacaaauag

SEQ ID NO: 551493 - RNA, 15 nt, Chlamydophila pneumoniae TW-183
gaacucuuuaaaagg

SEQ ID NO: 551494 - RNA, 13 nt, Chlamydophila pneumoniae TW-183
gaacgugcugcga

SEQ ID NO: 551495 - RNA, 15 nt, Chlamydophila pneumoniae TW-183
gaacuaaaaguuuuu

SEQ ID NO: 551496 - RNA, 18 nt, Chlamydophila pneumoniae TW-183
gaacccgagacuucucuc

SEQ ID NO: 551497 - RNA, 20 nt, Chlamydophila pneumoniae TW-183
gaauuccucccagcccuaua

SEQ ID NO: 551498 - RNA, 14 nt, Chlamydophila pneumoniae TW-183
gaauggauguugcg

SEQ ID NO: 551499 - RNA, 21 nt, Chlamydophila pneumoniae TW-183
gaaucucauaaguauagagag

SEQ ID NO: 551500 - RNA, 15 nt, Chlamydophila pneumoniae TW-183
gaaucuccucaucag

SEQ ID NO: 551501 - RNA, 17 nt, Chlamydophila pneumoniae TW-183
gaaucuccucaucagaa

SEQ ID NO: 551502 - RNA, 21 nt, Chlamydophila pneumoniae TW-183
gaauccccccuucuaauacuu

SEQ ID NO: 551503 - RNA, 19 nt, Chlamydophila pneumoniae TW-183
gaauaaagcccuuuugaau

SEQ ID NO: 551504 - RNA, 21 nt, Chlamydophila pneumoniae TW-183
gaaguugaaaugagugagaau

SEQ ID NO: 551505 - RNA, 23 nt, Chlamydophila pneumoniae TW-183
gaaguugaaaugagugagaaugc

SEQ ID NO: 551506 - RNA, 17 nt, Chlamydophila pneumoniae TW-183
gaagucccacaaaugau

SEQ ID NO: 551507 - RNA, 17 nt, Chlamydophila pneumoniae TW-183
gaaguccagacuuuccu

SEQ ID NO: 551508 - RNA, 18 nt, Chlamydophila pneumoniae TW-183
gaagugaggagaauagca

SEQ ID NO: 551509 - RNA, 18 nt, Chlamydophila pneumoniae TW-183
gaagguguggguacaggg

SEQ ID NO: 551510 - RNA, 17 nt, Chlamydophila pneumoniae TW-183
gaauaccguuuuaggaa

SEQ ID NO: 551511 - RNA, 21 nt, Chlamydophila pneumoniae TW-183
gaauaaguuuugauuuugcag

SEQ ID NO: 551512 - RNA, 20 nt, Chlamydophila pneumoniae TW-183
gaauaaguuuugauuuugca

SEQ ID NO: 551513 - RNA, 20 nt, Chlamydophila pneumoniae TW-183
gaauaagauuuugaaaauug

SEQ ID NO: 551514 - RNA, 14 nt, Chlamydophila pneumoniae TW-183
gaauaagauuuuga

SEQ ID NO: 551515 - RNA, 22 nt, Chlamydophila pneumoniae TW-183
gaauaagauuuugaaaauugca

SEQ ID NO: 551516 - RNA, 12 nt, Chlamydophila pneumoniae TW-183
gaauagcaggaa

SEQ ID NO: 551517 - RNA, 18 nt, Chlamydophila pneumoniae TW-183
gaauagaauguaugugaa

SEQ ID NO: 551518 - RNA, 22 nt, Chlamydophila pneumoniae TW-183
gaauaucgaguucuuuuugcag

SEQ ID NO: 551519 - RNA, 19 nt, Chlamydophila pneumoniae TW-183
gaacagucuugcgccagca

SEQ ID NO: 551520 - RNA, 21 nt, Chlamydophila pneumoniae TW-183
gaacaguauaaucagaaguga

SEQ ID NO: 551521 - RNA, 12 nt, Chlamydophila pneumoniae TW-183
gaacaggagaga

SEQ ID NO: 551522 - RNA, 22 nt, Chlamydophila pneumoniae TW-183
gaacagcauggacuccaagaau

SEQ ID NO: 551523 - RNA, 13 nt, Chlamydophila pneumoniae TW-183
gaacaaggcuccg

SEQ ID NO: 551524 - RNA, 21 nt, Chlamydophila pneumoniae TW-183
gaaauugaacucucaguuaaa

SEQ ID NO: 551525 - RNA, 14 nt, Chlamydophila pneumoniae TW-183
gaaauugcucuugc

SEQ ID NO: 551526 - RNA, 22 nt, Chlamydophila pneumoniae TW-183
gaaauugaauaucgaguucuuu

SEQ ID NO: 551527 - RNA, 15 nt, Chlamydophila pneumoniae TW-183
gaaaucacacuuaaa

SEQ ID NO: 551528 - RNA, 13 nt, Chlamydophila pneumoniae TW-183
gaaaugagugaga

SEQ ID NO: 551529 - RNA, 22 nt, Chlamydophila pneumoniae TW-183
gaaauaauugaggaguuucuac

SEQ ID NO: 551530 - RNA, 22 nt, Chlamydophila pneumoniae TW-183
gaaauacguccagccugcacca

SEQ ID NO: 551531 - RNA, 22 nt, Chlamydophila pneumoniae TW-183
gaaacccauaaugguacaauac

SEQ ID NO: 551532 - RNA, 24 nt, Chlamydophila pneumoniae TW-183
gaaacacuuuggauaggauaggag

SEQ ID NO: 551533 - RNA, 13 nt, Chlamydophila pneumoniae TW-183
gaaacacucauga

SEQ ID NO: 551534 - RNA, 15 nt, Chlamydophila pneumoniae TW-183
gaaaagaacagggga

SEQ ID NO: 551535 - RNA, 15 nt, Chlamydophila pneumoniae TW-183
gaaaauaagcaguuu

SEQ ID NO: 551536 - RNA, 13 nt, Chlamydophila pneumoniae TW-183
gaaaacauagaga

SEQ ID NO: 551537 - RNA, 17 nt, Chlamydophila pneumoniae TW-183
gaaaacgcccucuagaa

SEQ ID NO: 551538 - RNA, 23 nt, Chlamydophila pneumoniae TW-183
gaaaaaccccuagaacuuuacaa

SEQ ID NO: 551539 - RNA, 14 nt, Chlamydophila pneumoniae TW-183
cuuuuugcagaucu

SEQ ID NO: 551540 - RNA, 20 nt, Chlamydophila pneumoniae TW-183
cuuuuugauuagaguuuuug

SEQ ID NO: 551541 - RNA, 15 nt, Chlamydophila pneumoniae TW-183
cuuuugugauaccuc

SEQ ID NO: 551542 - RNA, 21 nt, Chlamydophila pneumoniae TW-183
cuuuucugaaucuuuuguuuu

SEQ ID NO: 551543 - RNA, 17 nt, Chlamydophila pneumoniae TW-183
cuuuucugaagauuuuu

SEQ ID NO: 551544 - RNA, 18 nt, Chlamydophila pneumoniae TW-183
cuuuucugaagauuuuuu

SEQ ID NO: 551545 - RNA, 16 nt, Chlamydophila pneumoniae TW-183
cuuuuagguagagaau

SEQ ID NO: 551546 - RNA, 13 nt, Chlamydophila pneumoniae TW-183
cuuuucaucaaga

SEQ ID NO: 551547 - RNA, 20 nt, Chlamydophila pneumoniae TW-183
cuuuuccggggagaacuuca

SEQ ID NO: 551548 - RNA, 21 nt, Chlamydophila pneumoniae TW-183
cuuuuccggggagaacuucaa

SEQ ID NO: 551549 - RNA, 16 nt, Chlamydophila pneumoniae TW-183
cuuugugauuacagca

SEQ ID NO: 551550 - RNA, 18 nt, Chlamydophila pneumoniae TW-183
cuuuguuaauagaagauc

SEQ ID NO: 551551 - RNA, 15 nt, Chlamydophila pneumoniae TW-183
aaaaaagaaauacuu

SEQ ID NO: 551552 - RNA, 13 nt, Chlamydophila pneumoniae TW-183
aaaaaaaauuacu

SEQ ID NO: 551553 - RNA, 16 nt, Chlamydophila pneumoniae TW-183
aaaaacccucaaagaa

SEQ ID NO: 551554 - RNA, 15 nt, Chlamydophila pneumoniae TW-183
aaaacauaucccaua

SEQ ID NO: 551555 - RNA, 19 nt, Chlamydophila pneumoniae TW-183
aaaccacggauuuucucua

SEQ ID NO: 551556 - RNA, 12 nt, Chlamydophila pneumoniae TW-183
aaaccagaacac

SEQ ID NO: 551557 - RNA, 17 nt, Chlamydophila pneumoniae TW-183
aaacccucaaagaauac

SEQ ID NO: 551558 - RNA, 23 nt, Chlamydophila pneumoniae TW-183
aaaccguaacugaggcaaagauu

SEQ ID NO: 551559 - RNA, 22 nt, Chlamydophila pneumoniae TW-183
aaacacuuuggauaggauagga

SEQ ID NO: 551560 - RNA, 15 nt, Chlamydophila pneumoniae TW-183
aaacagcaucaggau

SEQ ID NO: 551561 - RNA, 21 nt, Chlamydophila pneumoniae TW-183
aaaauugcauuuaaacuaaga

SEQ ID NO: 551562 - RNA, 16 nt, Chlamydophila pneumoniae TW-183
aaacacucaugaaagu

SEQ ID NO: 551563 - RNA, 15 nt, Chlamydophila pneumoniae TW-183
aaacaccuucuucua

SEQ ID NO: 551564 - RNA, 20 nt, Chlamydophila pneumoniae TW-183
aaacacaaauagcaagagcu

SEQ ID NO: 551565 - RNA, 17 nt, Chlamydophila pneumoniae TW-183
aaacacaaauagcaaga

SEQ ID NO: 551566 - RNA, 19 nt, Chlamydophila pneumoniae TW-183
aaacacaaauagcaagagc

SEQ ID NO: 551567 - RNA, 13 nt, Chlamydophila pneumoniae TW-183
aaaaagaaauacu

SEQ ID NO: 551568 - RNA, 17 nt, Chlamydophila pneumoniae TW-183
aaaagcuuuuuucucuu

SEQ ID NO: 551569 - RNA, 13 nt, Chlamydophila pneumoniae TW-183
aaaacgcuauugu

SEQ ID NO: 551570 - RNA, 15 nt, Chlamydophila pneumoniae TW-183
aaaagucaugaggac

SEQ ID NO: 551571 - RNA, 18 nt, Chlamydophila pneumoniae TW-183
aaaagucaugaggacugu

SEQ ID NO: 551572 - RNA, 20 nt, Chlamydophila pneumoniae TW-183
aaaauaagcaguuuucagug

SEQ ID NO: 551573 - RNA, 19 nt, Chlamydophila pneumoniae TW-183
aaaagugaagaaaccagaa

SEQ ID NO: 551574 - RNA, 14 nt, Chlamydophila pneumoniae TW-183
aaaaucuucucugc

SEQ ID NO: 551575 - RNA, 13 nt, Chlamydophila pneumoniae TW-183
aaaaucaaaaacu

SEQ ID NO: 551576 - RNA, 17 nt, Chlamydophila pneumoniae TW-183
aaaauucuguaaaguga

SEQ ID NO: 551577 - RNA, 14 nt, Chlamydophila pneumoniae TW-183
aaaaugaaagaaac

SEQ ID NO: 551578 - RNA, 13 nt, Chlamydophila pneumoniae TW-183
aaaaugaaagaaa

SEQ ID NO: 551579 - RNA, 22 nt, Chlamydophila pneumoniae TW-183
aaagaucgggucuacaacaguu

SEQ ID NO: 551580 - RNA, 15 nt, Chlamydophila pneumoniae TW-183
aaagacaucucuuua

SEQ ID NO: 551581 - RNA, 14 nt, Chlamydophila pneumoniae TW-183
aaagaggaaugaag

SEQ ID NO: 551582 - RNA, 11 nt, Chlamydophila pneumoniae TW-183
aaagauuaagg

SEQ ID NO: 551583 - RNA, 17 nt, Chlamydophila pneumoniae TW-183
aaagauuauucuagagu

SEQ ID NO: 551584 - RNA, 12 nt, Chlamydophila pneumoniae TW-183
aaagaacacucc

SEQ ID NO: 551585 - RNA, 21 nt, Chlamydophila pneumoniae TW-183
aaagaaauucuggagucgagc

SEQ ID NO: 551586 - RNA, 17 nt, Chlamydophila pneumoniae TW-183
aaagcuuuuuucucuug

SEQ ID NO: 551587 - RNA, 16 nt, Chlamydophila pneumoniae TW-183
aaagcuuuuuucucuu

SEQ ID NO: 551588 - RNA, 13 nt, Chlamydophila pneumoniae TW-183
aaagguaaaacua

SEQ ID NO: 551589 - RNA, 21 nt, Chlamydophila pneumoniae TW-183
aaauaaaaaaacccucaaaga

SEQ ID NO: 551590 - RNA, 15 nt, Chlamydophila pneumoniae TW-183
aaaguuuaugacaca

SEQ ID NO: 551591 - RNA, 20 nt, Chlamydophila pneumoniae TW-183
aaaguuagguagauagaaau

SEQ ID NO: 551592 - RNA, 23 nt, Chlamydophila pneumoniae TW-183
aaagugaaauugaacucucaguu

SEQ ID NO: 551593 - RNA, 18 nt, Chlamydophila pneumoniae TW-183
aaauagaaaggaaucccu

SEQ ID NO: 551594 - RNA, 13 nt, Chlamydophila pneumoniae TW-183
aaauacuuuuccu

SEQ ID NO: 551595 - RNA, 22 nt, Chlamydophila pneumoniae TW-183
aaauuuaagauaucgaccuuaa

SEQ ID NO: 551596 - RNA, 17 nt, Chlamydophila pneumoniae TW-183
aaauugcauuuaaacua

SEQ ID NO: 551597 - RNA, 12 nt, Chlamydophila pneumoniae TW-183
aaauugcucuug

SEQ ID NO: 551598 - RNA, 17 nt, Chlamydophila pneumoniae TW-183
aaauugaauaucgaguu

SEQ ID NO: 551599 - RNA, 12 nt, Chlamydophila pneumoniae TW-183
aaauuuuuccuu

SEQ ID NO: 551600 - RNA, 19 nt, Chlamydophila pneumoniae TW-183
aaauuuucuugcgacauaa

SEQ ID NO: 551601 - RNA, 17 nt, Chlamydophila pneumoniae TW-183
aaauuuucccauuacag

SEQ ID NO: 551602 - RNA, 17 nt, Chlamydophila pneumoniae TW-183
aaaucguacuucacuuc

SEQ ID NO: 551603 - RNA, 23 nt, Chlamydophila pneumoniae TW-183
aaaucgguaaccugugaaaauuu

SEQ ID NO: 551604 - RNA, 12 nt, Chlamydophila pneumoniae TW-183
aaaucuucucug

SEQ ID NO: 551605 - RNA, 19 nt, Chlamydophila pneumoniae TW-183
aaaucggagggcuacaguu

SEQ ID NO: 551606 - RNA, 16 nt, Chlamydophila pneumoniae TW-183
aaauccgauaagauaa

SEQ ID NO: 551607 - RNA, 16 nt, Chlamydophila pneumoniae TW-183
aaauccaccaaugaua

SEQ ID NO: 551608 - RNA, 17 nt, Chlamydophila pneumoniae TW-183
aagagugccaagagcau

SEQ ID NO: 551609 - RNA, 15 nt, Chlamydophila pneumoniae TW-183
aagauaaagaauucu

SEQ ID NO: 551610 - RNA, 21 nt, Chlamydophila pneumoniae TW-183
aagauagggaccaugaucuua

SEQ ID NO: 551611 - RNA, 18 nt, Chlamydophila pneumoniae TW-183
aagauagccgaguccuau

SEQ ID NO: 551612 - RNA, 16 nt, Chlamydophila pneumoniae TW-183
aagauacgaaguccca

SEQ ID NO: 551613 - RNA, 22 nt, Chlamydophila pneumoniae TW-183
aagagagcuugucacacugcga

SEQ ID NO: 551614 - RNA, 20 nt, Chlamydophila pneumoniae TW-183
aagagagcuugucacacugc

SEQ ID NO: 551615 - RNA, 21 nt, Chlamydophila pneumoniae TW-183
aagagaaucuccucaucagaa

SEQ ID NO: 551616 - RNA, 20 nt, Chlamydophila pneumoniae TW-183
aagaggcucccaucgucccu

SEQ ID NO: 551617 - RNA, 19 nt, Chlamydophila pneumoniae TW-183
aagagcucaucaaugagaa

SEQ ID NO: 551618 - RNA, 15 nt, Chlamydophila pneumoniae TW-183
aagacucaaagaacu

SEQ ID NO: 551619 - RNA, 13 nt, Chlamydophila pneumoniae TW-183
aagaccagaauac

SEQ ID NO: 551620 - RNA, 21 nt, Chlamydophila pneumoniae TW-183
aagaccagaauaccuucaaca

SEQ ID NO: 551621 - RNA, 14 nt, Chlamydophila pneumoniae TW-183
aacucucaguuaaa

SEQ ID NO: 551622 - RNA, 21 nt, Chlamydophila pneumoniae TW-183
aacuccuaagucguuaacauc

SEQ ID NO: 551623 - RNA, 19 nt, Chlamydophila pneumoniae TW-183
aacgggagcguuuuuugaa

SEQ ID NO: 551624 - RNA, 13 nt, Chlamydophila pneumoniae TW-183
aacuccaaaauau

SEQ ID NO: 551625 - RNA, 12 nt, Chlamydophila pneumoniae TW-183
aacuccaaaaua

SEQ ID NO: 551626 - RNA, 16 nt, Chlamydophila pneumoniae TW-183
aacuuugaggcaaguc

SEQ ID NO: 551627 - RNA, 12 nt, Chlamydophila pneumoniae TW-183
aacuucucuagg

SEQ ID NO: 551628 - RNA, 21 nt, Chlamydophila pneumoniae TW-183
aacuuguuuucguaagagaau

SEQ ID NO: 551629 - RNA, 18 nt, Chlamydophila pneumoniae TW-183
aacuuugaggcaagucuc

SEQ ID NO: 551630 - RNA, 22 nt, Chlamydophila pneumoniae TW-183
aacgcucucuagcaccuaauaa

SEQ ID NO: 551631 - RNA, 22 nt, Chlamydophila pneumoniae TW-183
aacgaagugaggagaauagcaa

SEQ ID NO: 551632 - RNA, 23 nt, Chlamydophila pneumoniae TW-183
aacgcaugacgcuuuuccaaagc

SEQ ID NO: 551633 - RNA, 13 nt, Chlamydophila pneumoniae TW-183
aaccuucaaugau

SEQ ID NO: 551634 - RNA, 16 nt, Chlamydophila pneumoniae TW-183
aaccuccgcucuaagc

SEQ ID NO: 551635 - RNA, 19 nt, Chlamydophila pneumoniae TW-183
aacccgagacuucucucuu

SEQ ID NO: 551636 - RNA, 13 nt, Chlamydophila pneumoniae TW-183
aaccagaacacau

SEQ ID NO: 551637 - RNA, 14 nt, Chlamydophila pneumoniae TW-183
aacauggacaauau

SEQ ID NO: 551638 - RNA, 15 nt, Chlamydophila pneumoniae TW-183
aacaucucgaaccau

SEQ ID NO: 551639 - RNA, 14 nt, Chlamydophila pneumoniae TW-183
aacagguucacuuc

SEQ ID NO: 551640 - RNA, 17 nt, Chlamydophila pneumoniae TW-183
aacaggaauagaaaauc

SEQ ID NO: 551641 - RNA, 22 nt, Chlamydophila pneumoniae TW-183
aagauccuaauauccauaagau

SEQ ID NO: 551642 - RNA, 14 nt, Chlamydophila pneumoniae TW-183
aagcucauaagaaa

SEQ ID NO: 551643 - RNA, 19 nt, Chlamydophila pneumoniae TW-183
aaggcuuguuucuguuuuc

SEQ ID NO: 551644 - RNA, 14 nt, Chlamydophila pneumoniae TW-183
aaggccuauagauu

SEQ ID NO: 551645 - RNA, 21 nt, Chlamydophila pneumoniae TW-183
aagcuucguccugacacaacu

SEQ ID NO: 551646 - RNA, 18 nt, Chlamydophila pneumoniae TW-183
aagcuggauucugucuau

SEQ ID NO: 551647 - RNA, 17 nt, Chlamydophila pneumoniae TW-183
aaguugaccuuuuucau

SEQ ID NO: 551648 - RNA, 15 nt, Chlamydophila pneumoniae TW-183
aaguugaccuuuuuc

SEQ ID NO: 551649 - RNA, 23 nt, Chlamydophila pneumoniae TW-183
aaguccagacuuuccucucuuua

SEQ ID NO: 551650 - RNA, 17 nt, Chlamydophila pneumoniae TW-183
aaguccagacuuuccuc

SEQ ID NO: 551651 - RNA, 18 nt, Chlamydophila pneumoniae TW-183
aagucacggcgaaagcua

SEQ ID NO: 551652 - RNA, 20 nt, Chlamydophila pneumoniae TW-183
aagggggaucuucagagaga

SEQ ID NO: 551653 - RNA, 14 nt, Chlamydophila pneumoniae TW-183
aauaccagaagcaa

SEQ ID NO: 551654 - RNA, 17 nt, Chlamydophila pneumoniae TW-183
aaaaauccgauaagaua

SEQ ID NO: 551655 - RNA, 16 nt, Chlamydophila pneumoniae TW-183
aaaaauccgauaagau

SEQ ID NO: 551656 - RNA, 13 nt, Chlamydophila pneumoniae TW-183
aauaagauccaaa

SEQ ID NO: 551657 - RNA, 17 nt, Chlamydophila pneumoniae TW-183
aauaagauccaaaaauu

SEQ ID NO: 551658 - RNA, 15 nt, Chlamydophila pneumoniae TW-183
aauaagauccaaaaa

SEQ ID NO: 551659 - RNA, 17 nt, Chlamydophila pneumoniae TW-183
aaguuguugauaauuac

SEQ ID NO: 551660 - RNA, 21 nt, Chlamydophila pneumoniae TW-183
aaaaaguuccauagaguaucu

SEQ ID NO: 551661 - RNA, 14 nt, Chlamydophila pneumoniae TW-183
aauaagauuuugaa

SEQ ID NO: 551662 - RNA, 15 nt, Chlamydophila pneumoniae TW-183
aauaagauuuugaaa

SEQ ID NO: 551663 - RNA, 12 nt, Chlamydophila pneumoniae TW-183
aauaucaucacu

SEQ ID NO: 551664 - RNA, 17 nt, Chlamydophila pneumoniae TW-183
aauauagagaucuagau

SEQ ID NO: 551665 - RNA, 20 nt, Chlamydophila pneumoniae TW-183
aauaccuucaacaagaauaa

SEQ ID NO: 551666 - RNA, 14 nt, Chlamydophila pneumoniae TW-183
aauagcaagcacuu

SEQ ID NO: 551667 - RNA, 21 nt, Chlamydophila pneumoniae TW-183
aauagauuuuuacuugcccaa

SEQ ID NO: 551668 - RNA, 14 nt, Chlamydophila pneumoniae TW-183
aauaguacgcuuuu

SEQ ID NO: 551669 - RNA, 14 nt, Chlamydophila pneumoniae TW-183
aauaggcacccaaa

SEQ ID NO: 551670 - RNA, 15 nt, Chlamydophila pneumoniae TW-183
accacguccauuuca

SEQ ID NO: 551671 - RNA, 20 nt, Chlamydophila pneumoniae TW-183
accacuuuagaauuuucuuu

SEQ ID NO: 551672 - RNA, 20 nt, Chlamydophila pneumoniae TW-183
accaaugauaauuucauuau

SEQ ID NO: 551673 - RNA, 18 nt, Chlamydophila pneumoniae TW-183
accaauugagcucucuag

SEQ ID NO: 551674 - RNA, 20 nt, Chlamydophila pneumoniae TW-183
accacagaggucgauuugaa

SEQ ID NO: 551675 - RNA, 20 nt, Chlamydophila pneumoniae TW-183
acauaucgauaggauucgga

SEQ ID NO: 551676 - RNA, 19 nt, Chlamydophila pneumoniae TW-183
acaucacuuauauuuucua

SEQ ID NO: 551677 - RNA, 17 nt, Chlamydophila pneumoniae TW-183
acagcguguauccaucu

SEQ ID NO: 551678 - RNA, 17 nt, Chlamydophila pneumoniae TW-183
acaggagagagaaggcu

SEQ ID NO: 551679 - RNA, 21 nt, Chlamydophila pneumoniae TW-183
acagcauggacuccaagaaua

SEQ ID NO: 551680 - RNA, 18 nt, Chlamydophila pneumoniae TW-183
acagcauggacuccaaga

SEQ ID NO: 551681 - RNA, 16 nt, Chlamydophila pneumoniae TW-183
acagcauaaaaauucu

SEQ ID NO: 551682 - RNA, 22 nt, Chlamydophila pneumoniae TW-183
acagcaucaggauucucucugc

SEQ ID NO: 551683 - RNA, 19 nt, Chlamydophila pneumoniae TW-183
acagcaucggcaaccaguu

SEQ ID NO: 551684 - RNA, 16 nt, Chlamydophila pneumoniae TW-183
acagauaggaaccacu

SEQ ID NO: 551685 - RNA, 20 nt, Chlamydophila pneumoniae TW-183
acagaaauugcuucuuccaa

SEQ ID NO: 551686 - RNA, 20 nt, Chlamydophila pneumoniae TW-183
acagaaguuccuacuucugc

SEQ ID NO: 551687 - RNA, 18 nt, Chlamydophila pneumoniae TW-183
acacugcgagagaaaguc

SEQ ID NO: 551688 - RNA, 12 nt, Chlamydophila pneumoniae TW-183
acacucuaucau

SEQ ID NO: 551689 - RNA, 21 nt, Chlamydophila pneumoniae TW-183
acacaggggaacgcucucuag

SEQ ID NO: 551690 - RNA, 23 nt, Chlamydophila pneumoniae TW-183
acacagacuugaggaaucugaau

SEQ ID NO: 551691 - RNA, 20 nt, Chlamydophila pneumoniae TW-183
acacagagaugcuucuaaac

SEQ ID NO: 551692 - RNA, 17 nt, Chlamydophila pneumoniae TW-183
acaauauagagaucuag

SEQ ID NO: 551693 - RNA, 21 nt, Chlamydophila pneumoniae TW-183
acaaucuacggcauaaccuuu

SEQ ID NO: 551694 - RNA, 23 nt, Chlamydophila pneumoniae TW-183
acaauuuccuugguaucccaauc

SEQ ID NO: 551695 - RNA, 23 nt, Chlamydophila pneumoniae TW-183
acaauuagagauucauaaaacug

SEQ ID NO: 551696 - RNA, 14 nt, Chlamydophila pneumoniae TW-183
acaagaaaacaaag

SEQ ID NO: 551697 - RNA, 13 nt, Chlamydophila pneumoniae TW-183
acaagaaaacaaa

SEQ ID NO: 551698 - RNA, 15 nt, Chlamydophila pneumoniae TW-183
acaacuuugaggcaa

SEQ ID NO: 551699 - RNA, 13 nt, Chlamydophila pneumoniae TW-183
acaacuccuaagu

SEQ ID NO: 551700 - RNA, 21 nt, Chlamydophila pneumoniae TW-183
acaacgccuacauggaucccu

SEQ ID NO: 551701 - RNA, 17 nt, Chlamydophila pneumoniae TW-183
acaacggcaaucuauuu

SEQ ID NO: 551702 - RNA, 13 nt, Chlamydophila pneumoniae TW-183
acaagaauaacuu

SEQ ID NO: 551703 - RNA, 16 nt, Chlamydophila pneumoniae TW-183
aauucggcagaaggcu

SEQ ID NO: 551704 - RNA, 19 nt, Chlamydophila pneumoniae TW-183
aauucggcagaaggcuugu

SEQ ID NO: 551705 - RNA, 15 nt, Chlamydophila pneumoniae TW-183
aauucggcagaaggc

SEQ ID NO: 551706 - RNA, 20 nt, Chlamydophila pneumoniae TW-183
aauucccguagguagagcug

SEQ ID NO: 551707 - RNA, 20 nt, Chlamydophila pneumoniae TW-183
aauugagcucucuagcuguu

SEQ ID NO: 551708 - RNA, 14 nt, Chlamydophila pneumoniae TW-183
aauugacuggaggc

SEQ ID NO: 551709 - RNA, 13 nt, Chlamydophila pneumoniae TW-183
aauuauuaaacuc

SEQ ID NO: 551710 - RNA, 15 nt, Chlamydophila pneumoniae TW-183
aauuagaacagcaug

SEQ ID NO: 551711 - RNA, 21 nt, Chlamydophila pneumoniae TW-183
aauuacuuagaguugaccaua

SEQ ID NO: 551712 - RNA, 21 nt, Chlamydophila pneumoniae TW-183
aauguaucggggauugcaaaa

SEQ ID NO: 551713 - RNA, 22 nt, Chlamydophila pneumoniae TW-183
aauguagcuguuccaagagucu

SEQ ID NO: 551714 - RNA, 22 nt, Chlamydophila pneumoniae TW-183
aauuucuccaguaucuucucuu

SEQ ID NO: 551715 - RNA, 19 nt, Chlamydophila pneumoniae TW-183
aauuuccaaucacacuaca

SEQ ID NO: 551716 - RNA, 19 nt, Chlamydophila pneumoniae TW-183
aauuuuuccuucaacacac

SEQ ID NO: 551717 - RNA, 16 nt, Chlamydophila pneumoniae TW-183
aauuuucugugacaaa

SEQ ID NO: 551718 - RNA, 22 nt, Chlamydophila pneumoniae TW-183
aauuuucagccugucuauaaaa

SEQ ID NO: 551719 - RNA, 23 nt, Chlamydophila pneumoniae TW-183
aauuuucagccugucuauaaaau

SEQ ID NO: 551720 - RNA, 13 nt, Chlamydophila pneumoniae TW-183
aaugcuauuuucc

SEQ ID NO: 551721 - RNA, 21 nt, Chlamydophila pneumoniae TW-183
aaugcuaagcuccauaaaaau

SEQ ID NO: 551722 - RNA, 19 nt, Chlamydophila pneumoniae TW-183
aaucuuugaucgcuugugc

SEQ ID NO: 551723 - RNA, 23 nt, Chlamydophila pneumoniae TW-183
aaucucuagggauaauuaaacuc

SEQ ID NO: 551724 - RNA, 16 nt, Chlamydophila pneumoniae TW-183
aaucucgggagaacau

SEQ ID NO: 551725 - RNA, 11 nt, Chlamydophila pneumoniae TW-183
aaucuaugaga

SEQ ID NO: 551726 - RNA, 16 nt, Chlamydophila pneumoniae TW-183
aaucuauaggauuugc

SEQ ID NO: 551727 - RNA, 21 nt, Chlamydophila pneumoniae TW-183
aauccaccaaugauaauuuca

SEQ ID NO: 551728 - RNA, 13 nt, Chlamydophila pneumoniae TW-183
aauccaagaauag

SEQ ID NO: 551729 - RNA, 13 nt, Chlamydophila pneumoniae TW-183
aaaaauucucaua

SEQ ID NO: 551730 - RNA, 21 nt, Chlamydophila pneumoniae TW-183
aaaaauucucauaaccuaagg

SEQ ID NO: 551731 - RNA, 13 nt, Chlamydophila pneumoniae TW-183
aaaaauucccaua

SEQ ID NO: 551732 - RNA, 18 nt, Chlamydophila pneumoniae TW-183
aaucauaaccaaaagaau

SEQ ID NO: 551733 - RNA, 20 nt, Chlamydophila pneumoniae TW-183
aaucauaaccaaaagaauua

SEQ ID NO: 551734 - RNA, 12 nt, Chlamydophila pneumoniae TW-183
acucuacaagug

SEQ ID NO: 551735 - RNA, 16 nt, Chlamydophila pneumoniae TW-183
acucucaucagcaaaa

SEQ ID NO: 551736 - RNA, 14 nt, Chlamydophila pneumoniae TW-183
acucuacaaguguc

SEQ ID NO: 551737 - RNA, 20 nt, Chlamydophila pneumoniae TW-183
acucgggauucguagcuucc

SEQ ID NO: 551738 - RNA, 15 nt, Chlamydophila pneumoniae TW-183
acuggagagguaacc

SEQ ID NO: 551739 - RNA, 19 nt, Chlamydophila pneumoniae TW-183
acucuuuuauuuuaggaag

SEQ ID NO: 551740 - RNA, 23 nt, Chlamydophila pneumoniae TW-183
acucuuuaaaagggcgcuucccu

SEQ ID NO: 551741 - RNA, 17 nt, Chlamydophila pneumoniae TW-183
acuucucucuuaauuuu

SEQ ID NO: 551742 - RNA, 21 nt, Chlamydophila pneumoniae TW-183
acuucuugugauccuugcaaa

SEQ ID NO: 551743 - RNA, 16 nt, Chlamydophila pneumoniae TW-183
acuucaacuucuccaa

SEQ ID NO: 551744 - RNA, 17 nt, Chlamydophila pneumoniae TW-183
acuucaacuucuccaac

SEQ ID NO: 551745 - RNA, 18 nt, Chlamydophila pneumoniae TW-183
acuucaacuucuccaacu

SEQ ID NO: 551746 - RNA, 22 nt, Chlamydophila pneumoniae TW-183
acuucaacaaaggcuccaaacg

SEQ ID NO: 551747 - RNA, 16 nt, Chlamydophila pneumoniae TW-183
acuuaaagacuugcuu

SEQ ID NO: 551748 - RNA, 22 nt, Chlamydophila pneumoniae TW-183
acuaaacaccuucuucuaaaau

SEQ ID NO: 551749 - RNA, 19 nt, Chlamydophila pneumoniae TW-183
acguugcgaacagcuccug

SEQ ID NO: 551750 - RNA, 17 nt, Chlamydophila pneumoniae TW-183
acguagcuacaaaauua

SEQ ID NO: 551751 - RNA, 18 nt, Chlamydophila pneumoniae TW-183
acguagcuacaaaauuau

SEQ ID NO: 551752 - RNA, 20 nt, Chlamydophila pneumoniae TW-183
acguuaucuaagacuucugg

SEQ ID NO: 551753 - RNA, 12 nt, Chlamydophila pneumoniae TW-183
acuacagaggga

SEQ ID NO: 551754 - RNA, 13 nt, Chlamydophila pneumoniae TW-183
acuacauucagga

SEQ ID NO: 551755 - RNA, 21 nt, Chlamydophila pneumoniae TW-183
acuauugggagguucgcagaa

SEQ ID NO: 551756 - RNA, 17 nt, Chlamydophila pneumoniae TW-183
acuauagaucucuugaa

SEQ ID NO: 551757 - RNA, 15 nt, Chlamydophila pneumoniae TW-183
acggaaagcacauac

SEQ ID NO: 551758 - RNA, 15 nt, Chlamydophila pneumoniae TW-183
acgcaugacgcuuuu

SEQ ID NO: 551759 - RNA, 16 nt, Chlamydophila pneumoniae TW-183
acgcaaguaaagaaau

SEQ ID NO: 551760 - RNA, 20 nt, Chlamydophila pneumoniae TW-183
acgaucgucaguaaaacaca

SEQ ID NO: 551761 - RNA, 19 nt, Chlamydophila pneumoniae TW-183
accuucaacaagaauaacu

SEQ ID NO: 551762 - RNA, 20 nt, Chlamydophila pneumoniae TW-183
accuuacauccaauuuuguu

SEQ ID NO: 551763 - RNA, 19 nt, Chlamydophila pneumoniae TW-183
accuuaguuuuuucuaagg

SEQ ID NO: 551764 - RNA, 16 nt, Chlamydophila pneumoniae TW-183
accuuagagugacuca

SEQ ID NO: 551765 - RNA, 18 nt, Chlamydophila pneumoniae TW-183
accuuuuucauugaugcu

SEQ ID NO: 551766 - RNA, 22 nt, Chlamydophila pneumoniae TW-183
accucucccuugggauuccuua

SEQ ID NO: 551767 - RNA, 17 nt, Chlamydophila pneumoniae TW-183
accuaggagaaaucaca

SEQ ID NO: 551768 - RNA, 21 nt, Chlamydophila pneumoniae TW-183
accuaggagaaaucacacuua

SEQ ID NO: 551769 - RNA, 21 nt, Chlamydophila pneumoniae TW-183
accuccucuucuucaucuucu

SEQ ID NO: 551770 - RNA, 21 nt, Chlamydophila pneumoniae TW-183
accucgaauuccucccagccc

SEQ ID NO: 551771 - RNA, 15 nt, Chlamydophila pneumoniae TW-183
acccucgaaccacug

SEQ ID NO: 551772 - RNA, 22 nt, Chlamydophila pneumoniae TW-183
accccacgcuaaacuaaaaugg

SEQ ID NO: 551773 - RNA, 19 nt, Chlamydophila pneumoniae TW-183
acccaaacugaugccaaga

SEQ ID NO: 551774 - RNA, 16 nt, Chlamydophila pneumoniae TW-183
accaugaucuuagcuc

SEQ ID NO: 551775 - RNA, 15 nt, Chlamydophila pneumoniae TW-183
agcauaaucuuuaac

SEQ ID NO: 551776 - RNA, 23 nt, Chlamydophila pneumoniae TW-183
agcaucggugucuacaaagaucc

SEQ ID NO: 551777 - RNA, 18 nt, Chlamydophila pneumoniae TW-183
agcagcccgcacaucaug

SEQ ID NO: 551778 - RNA, 18 nt, Chlamydophila pneumoniae TW-183
agcaccuaauaaagaagg

SEQ ID NO: 551779 - RNA, 21 nt, Chlamydophila pneumoniae TW-183
agccauaauuagaacagcaug

SEQ ID NO: 551780 - RNA, 19 nt, Chlamydophila pneumoniae TW-183
agcauggacuccaagaaua

SEQ ID NO: 551781 - RNA, 17 nt, Chlamydophila pneumoniae TW-183
agcauggacuccaagaa

SEQ ID NO: 551782 - RNA, 12 nt, Chlamydophila pneumoniae TW-183
agcucauaagaa

SEQ ID NO: 551783 - RNA, 12 nt, Chlamydophila pneumoniae TW-183
agcucaaaaagu

SEQ ID NO: 551784 - RNA, 15 nt, Chlamydophila pneumoniae TW-183
agcuaugaugagaac

SEQ ID NO: 551785 - RNA, 17 nt, Chlamydophila pneumoniae TW-183
agcuaugaugagaacgu

SEQ ID NO: 551786 - RNA, 18 nt, Chlamydophila pneumoniae TW-183
agcuagucuuucuaagaa

SEQ ID NO: 551787 - RNA, 17 nt, Chlamydophila pneumoniae TW-183
agcuagucuuucuaaga

SEQ ID NO: 551788 - RNA, 17 nt, Chlamydophila pneumoniae TW-183
agcuaauaagauccaaa

SEQ ID NO: 551789 - RNA, 15 nt, Chlamydophila pneumoniae TW-183
agcguguauccaucu

SEQ ID NO: 551790 - RNA, 15 nt, Chlamydophila pneumoniae TW-183
agcgugaauaucauc

SEQ ID NO: 551791 - RNA, 19 nt, Chlamydophila pneumoniae TW-183
agcgaucacauagaaaaca

SEQ ID NO: 551792 - RNA, 15 nt, Chlamydophila pneumoniae TW-183
agcgaucacauagaa

SEQ ID NO: 551793 - RNA, 14 nt, Chlamydophila pneumoniae TW-183
agccugcaccagac

SEQ ID NO: 551794 - RNA, 17 nt, Chlamydophila pneumoniae TW-183
agcaaagguaaauugac

SEQ ID NO: 551795 - RNA, 18 nt, Chlamydophila pneumoniae TW-183
agauuguuucaggccugg

SEQ ID NO: 551796 - RNA, 17 nt, Chlamydophila pneumoniae TW-183
agauugaggauaaguuc

SEQ ID NO: 551797 - RNA, 12 nt, Chlamydophila pneumoniae TW-183
agauucuacaaa

SEQ ID NO: 551798 - RNA, 15 nt, Chlamydophila pneumoniae TW-183
agauucauaaaacug

SEQ ID NO: 551799 - RNA, 20 nt, Chlamydophila pneumoniae TW-183
agauuaccgaagagccccca

SEQ ID NO: 551800 - RNA, 22 nt, Chlamydophila pneumoniae TW-183
agauguggcagaguccuucuuu

SEQ ID NO: 551801 - RNA, 16 nt, Chlamydophila pneumoniae TW-183
aaaacccucaaagaau

SEQ ID NO: 551802 - RNA, 17 nt, Chlamydophila pneumoniae TW-183
aaaacccucaaagaaua

SEQ ID NO: 551803 - RNA, 22 nt, Chlamydophila pneumoniae TW-183
agaucaucuacgauguuuucuu

SEQ ID NO: 551804 - RNA, 23 nt, Chlamydophila pneumoniae TW-183
agauaugccucaggucugcugag

SEQ ID NO: 551805 - RNA, 19 nt, Chlamydophila pneumoniae TW-183
agauaugccucaggucugc

SEQ ID NO: 551806 - RNA, 13 nt, Chlamydophila pneumoniae TW-183
agauaugaagaga

SEQ ID NO: 551807 - RNA, 22 nt, Chlamydophila pneumoniae TW-183
agauaucgaccuuaaaauugaa

SEQ ID NO: 551808 - RNA, 14 nt, Chlamydophila pneumoniae TW-183
agaguuagauguaa

SEQ ID NO: 551809 - RNA, 13 nt, Chlamydophila pneumoniae TW-183
agauaaagaauuc

SEQ ID NO: 551810 - RNA, 23 nt, Chlamydophila pneumoniae TW-183
agaguugcuuuauggcucaacuu

SEQ ID NO: 551811 - RNA, 17 nt, Chlamydophila pneumoniae TW-183
agauacggguucguuuc

SEQ ID NO: 551812 - RNA, 21 nt, Chlamydophila pneumoniae TW-183
agauacuaucugccauaggau

SEQ ID NO: 551813 - RNA, 22 nt, Chlamydophila pneumoniae TW-183
agauacuaucugccauaggauc

SEQ ID NO: 551814 - RNA, 15 nt, Chlamydophila pneumoniae TW-183
agauacgaaguccca

SEQ ID NO: 551815 - RNA, 13 nt, Chlamydophila pneumoniae TW-183
agaguaaagagua

SEQ ID NO: 551816 - RNA, 23 nt, Chlamydophila pneumoniae TW-183
agaggguuuuuuugcugcgaaug

SEQ ID NO: 551817 - RNA, 14 nt, Chlamydophila pneumoniae TW-183
agagggaaggaaua

SEQ ID NO: 551818 - RNA, 16 nt, Chlamydophila pneumoniae TW-183
agaggcuguccuugca

SEQ ID NO: 551819 - RNA, 19 nt, Chlamydophila pneumoniae TW-183
agagcuuuuagguagagaa

SEQ ID NO: 551820 - RNA, 20 nt, Chlamydophila pneumoniae TW-183
agagcuugucacacugcgag

SEQ ID NO: 551821 - RNA, 20 nt, Chlamydophila pneumoniae TW-183
agagcaagauucuucagaau

SEQ ID NO: 551822 - RNA, 19 nt, Chlamydophila pneumoniae TW-183
agagauuaccgaagagccc

SEQ ID NO: 551823 - RNA, 22 nt, Chlamydophila pneumoniae TW-183
agacguuaucuaagacuucugg

SEQ ID NO: 551824 - RNA, 13 nt, Chlamydophila pneumoniae TW-183
aaaacauauccca

SEQ ID NO: 551825 - RNA, 17 nt, Chlamydophila pneumoniae TW-183
agacaauaaaauagccc

SEQ ID NO: 551826 - RNA, 14 nt, Chlamydophila pneumoniae TW-183
agaauguaugugaa

SEQ ID NO: 551827 - RNA, 17 nt, Chlamydophila pneumoniae TW-183
agaauguaugugaaaga

SEQ ID NO: 551828 - RNA, 18 nt, Chlamydophila pneumoniae TW-183
agaaucgaguucuucauu

SEQ ID NO: 551829 - RNA, 20 nt, Chlamydophila pneumoniae TW-183
agaaguauucgauuccugag

SEQ ID NO: 551830 - RNA, 22 nt, Chlamydophila pneumoniae TW-183
agaaguauucgauuccugaggc

SEQ ID NO: 551831 - RNA, 23 nt, Chlamydophila pneumoniae TW-183
agaagguguuuuggcugcuuuug

SEQ ID NO: 551832 - RNA, 17 nt, Chlamydophila pneumoniae TW-183
agaagcaacuaaacucu

SEQ ID NO: 551833 - RNA, 13 nt, Chlamydophila pneumoniae TW-183
agaagcaaaggua

SEQ ID NO: 551834 - RNA, 12 nt, Chlamydophila pneumoniae TW-183
agaacuucaaca

SEQ ID NO: 551835 - RNA, 17 nt, Chlamydophila pneumoniae TW-183
agaacacucagagaugu

SEQ ID NO: 551836 - RNA, 16 nt, Chlamydophila pneumoniae TW-183
agaacacucagagaug

SEQ ID NO: 551837 - RNA, 19 nt, Chlamydophila pneumoniae TW-183
agaaauucuguagauacua

SEQ ID NO: 551838 - RNA, 21 nt, Chlamydophila pneumoniae TW-183
agaaauucuaagcgcucuuca

SEQ ID NO: 551839 - RNA, 20 nt, Chlamydophila pneumoniae TW-183
agaaagaaguccuagggagu

SEQ ID NO: 551840 - RNA, 13 nt, Chlamydophila pneumoniae TW-183
agaaacuucucua

SEQ ID NO: 551841 - RNA, 14 nt, Chlamydophila pneumoniae TW-183
agaaacuccaaaau

SEQ ID NO: 551842 - RNA, 15 nt, Chlamydophila pneumoniae TW-183
agaaacuccaaaaua

SEQ ID NO: 551843 - RNA, 16 nt, Chlamydophila pneumoniae TW-183
agaaaccagaacacau

SEQ ID NO: 551844 - RNA, 14 nt, Chlamydophila pneumoniae TW-183
agaaaacaaaguca

SEQ ID NO: 551845 - RNA, 19 nt, Chlamydophila pneumoniae TW-183
agaaaaaccccuagaacuu

SEQ ID NO: 551846 - RNA, 14 nt, Chlamydophila pneumoniae TW-183
agaaaacauagaga

SEQ ID NO: 551847 - RNA, 19 nt, Chlamydophila pneumoniae TW-183
agaaaagagcucaucaaug

SEQ ID NO: 551848 - RNA, 22 nt, Chlamydophila pneumoniae TW-183
aggaagaugaauaccagaagca

SEQ ID NO: 551849 - RNA, 19 nt, Chlamydophila pneumoniae TW-183
aggaacucuuuaaaagggc

SEQ ID NO: 551850 - RNA, 17 nt, Chlamydophila pneumoniae TW-183
aggaacgcacgccaaga

SEQ ID NO: 551851 - RNA, 21 nt, Chlamydophila pneumoniae TW-183
aggaaaucccgagauaugaag

SEQ ID NO: 551852 - RNA, 23 nt, Chlamydophila pneumoniae TW-183
agcuuuuccguaaguaaccaaua

SEQ ID NO: 551853 - RNA, 16 nt, Chlamydophila pneumoniae TW-183
aggaauuccucucaca

SEQ ID NO: 551854 - RNA, 21 nt, Chlamydophila pneumoniae TW-183
aggacaaucaacauucuucug

SEQ ID NO: 551855 - RNA, 13 nt, Chlamydophila pneumoniae TW-183
aggacaaaucucc

SEQ ID NO: 551856 - RNA, 23 nt, Chlamydophila pneumoniae TW-183
agcuugucacacugcgagagaaa

SEQ ID NO: 551857 - RNA, 13 nt, Chlamydophila pneumoniae TW-183
agcuugucacacu

SEQ ID NO: 551858 - RNA, 21 nt, Chlamydophila pneumoniae TW-183
agcuuagcaacccaagcuuug

SEQ ID NO: 551859 - RNA, 18 nt, Chlamydophila pneumoniae TW-183
agcuguggcgauuuuacu

SEQ ID NO: 551860 - RNA, 12 nt, Chlamydophila pneumoniae TW-183
agcugugcauuu

SEQ ID NO: 551861 - RNA, 17 nt, Chlamydophila pneumoniae TW-183
aggagcucccuaagauu

SEQ ID NO: 551862 - RNA, 23 nt, Chlamydophila pneumoniae TW-183
aggauucugagaaguuaagacaa

SEQ ID NO: 551863 - RNA, 21 nt, Chlamydophila pneumoniae TW-183
agguaaccagagagcuuuuag

SEQ ID NO: 551864 - RNA, 23 nt, Chlamydophila pneumoniae TW-183
aggguagccauccacgaccugca

SEQ ID NO: 551865 - RNA, 15 nt, Chlamydophila pneumoniae TW-183
agguagauagaaauu

SEQ ID NO: 551866 - RNA, 17 nt, Chlamydophila pneumoniae TW-183
agggagacucuugaggc

SEQ ID NO: 551867 - RNA, 22 nt, Chlamydophila pneumoniae TW-183
agggaauuucauguccuccaug

SEQ ID NO: 551868 - RNA, 14 nt, Chlamydophila pneumoniae TW-183
aggcuuuuuucuau

SEQ ID NO: 551869 - RNA, 15 nt, Chlamydophila pneumoniae TW-183
aggcuuguuucuguu

SEQ ID NO: 551870 - RNA, 17 nt, Chlamydophila pneumoniae TW-183
aguaugaggagauaaag

SEQ ID NO: 551871 - RNA, 19 nt, Chlamydophila pneumoniae TW-183
aguaugaggagauaaagau

SEQ ID NO: 551872 - RNA, 12 nt, Chlamydophila pneumoniae TW-183
aguaucuacuuu

SEQ ID NO: 551873 - RNA, 17 nt, Chlamydophila pneumoniae TW-183
aguaucgggauuuuguc

SEQ ID NO: 551874 - RNA, 23 nt, Chlamydophila pneumoniae TW-183
aguaucgggauuuugucgagaac

SEQ ID NO: 551875 - RNA, 15 nt, Chlamydophila pneumoniae TW-183
aguacccagucaucg

SEQ ID NO: 551876 - RNA, 17 nt, Chlamydophila pneumoniae TW-183
aguagcauccuguagag

SEQ ID NO: 551877 - RNA, 15 nt, Chlamydophila pneumoniae TW-183
aguaaaacacaaaua

SEQ ID NO: 551878 - RNA, 23 nt, Chlamydophila pneumoniae TW-183
agguuugcaauuuucucaauagu

SEQ ID NO: 551879 - RNA, 18 nt, Chlamydophila pneumoniae TW-183
aguaccaagaaaauagua

SEQ ID NO: 551880 - RNA, 14 nt, Chlamydophila pneumoniae TW-183
aguaccaagaaaau

SEQ ID NO: 551881 - RNA, 23 nt, Chlamydophila pneumoniae TW-183
aguaaccaauacagcauaaaaau

SEQ ID NO: 551882 - RNA, 16 nt, Chlamydophila pneumoniae TW-183
aguccuaugucaagaa

SEQ ID NO: 551883 - RNA, 21 nt, Chlamydophila pneumoniae TW-183
aguccuaugucaagaagugcu

SEQ ID NO: 551884 - RNA, 15 nt, Chlamydophila pneumoniae TW-183
aguccugauuuuuca

SEQ ID NO: 551885 - RNA, 12 nt, Chlamydophila pneumoniae TW-183
agucaaacauca

SEQ ID NO: 551886 - RNA, 17 nt, Chlamydophila pneumoniae TW-183
agucuuucuaagaagac

SEQ ID NO: 551887 - RNA, 15 nt, Chlamydophila pneumoniae TW-183
agugaacuuuuguac

SEQ ID NO: 551888 - RNA, 18 nt, Chlamydophila pneumoniae TW-183
agugcuguuuuuucacuu

SEQ ID NO: 551889 - RNA, 20 nt, Chlamydophila pneumoniae TW-183
aguuugauagagaaaauaag

SEQ ID NO: 551890 - RNA, 21 nt, Chlamydophila pneumoniae TW-183
aguuuguagcauuucuuucuc

SEQ ID NO: 551891 - RNA, 14 nt, Chlamydophila pneumoniae TW-183
aguuucaaucggag

SEQ ID NO: 551892 - RNA, 18 nt, Chlamydophila pneumoniae TW-183
aguuuaugacacagcuaa

SEQ ID NO: 551893 - RNA, 18 nt, Chlamydophila pneumoniae TW-183
aguuccauagaguaucua

SEQ ID NO: 551894 - RNA, 15 nt, Chlamydophila pneumoniae TW-183
aguucuuccaaagcu

SEQ ID NO: 551895 - RNA, 20 nt, Chlamydophila pneumoniae TW-183
aguuagauguaaucauaaaa

SEQ ID NO: 551896 - RNA, 17 nt, Chlamydophila pneumoniae TW-183
agugucauacgcagcac

SEQ ID NO: 551897 - RNA, 19 nt, Chlamydophila pneumoniae TW-183
aguuacgcgaccucuguag

SEQ ID NO: 551898 - RNA, 15 nt, Chlamydophila pneumoniae TW-183
auaauaaaagcaccc

SEQ ID NO: 551899 - RNA, 18 nt, Chlamydophila pneumoniae TW-183
auaagaaaucaguccuaa

SEQ ID NO: 551900 - RNA, 14 nt, Chlamydophila pneumoniae TW-183
auaauagugagcuc

SEQ ID NO: 551901 - RNA, 22 nt, Chlamydophila pneumoniae TW-183
auaauagugagcucccugaugu

SEQ ID NO: 551902 - RNA, 21 nt, Chlamydophila pneumoniae TW-183
auaaccaaaagaauuaagaag

SEQ ID NO: 551903 - RNA, 14 nt, Chlamydophila pneumoniae TW-183
aguuuuccauccac

SEQ ID NO: 551904 - RNA, 16 nt, Chlamydophila pneumoniae TW-183
aguuuucaagucugua

SEQ ID NO: 551905 - RNA, 15 nt, Chlamydophila pneumoniae TW-183
aucagcaaaacuccc

SEQ ID NO: 551906 - RNA, 17 nt, Chlamydophila pneumoniae TW-183
aucauauuuuucuugaa

SEQ ID NO: 551907 - RNA, 15 nt, Chlamydophila pneumoniae TW-183
aucaagagcucguaa

SEQ ID NO: 551908 - RNA, 21 nt, Chlamydophila pneumoniae TW-183
aucaagagcucguaauccuuc

SEQ ID NO: 551909 - RNA, 15 nt, Chlamydophila pneumoniae TW-183
auaugauuuccacuu

SEQ ID NO: 551910 - RNA, 17 nt, Chlamydophila pneumoniae TW-183
auauugucaagaggcug

SEQ ID NO: 551911 - RNA, 18 nt, Chlamydophila pneumoniae TW-183
auauugucaagaggcugu

SEQ ID NO: 551912 - RNA, 15 nt, Chlamydophila pneumoniae TW-183
auaucuuugggagau

SEQ ID NO: 551913 - RNA, 18 nt, Chlamydophila pneumoniae TW-183
auaucgaguucuuuuugc

SEQ ID NO: 551914 - RNA, 17 nt, Chlamydophila pneumoniae TW-183
auaucgaccuuaaaauu

SEQ ID NO: 551915 - RNA, 19 nt, Chlamydophila pneumoniae TW-183
auauccauaagaucucuaa

SEQ ID NO: 551916 - RNA, 21 nt, Chlamydophila pneumoniae TW-183
auauaagggggaucuucagag

SEQ ID NO: 551917 - RNA, 15 nt, Chlamydophila pneumoniae TW-183
auauaauacgucuca

SEQ ID NO: 551918 - RNA, 22 nt, Chlamydophila pneumoniae TW-183
auauaauacgucucaucgcuuu

SEQ ID NO: 551919 - RNA, 20 nt, Chlamydophila pneumoniae TW-183
auauagagagcgcagagucu

SEQ ID NO: 551920 - RNA, 19 nt, Chlamydophila pneumoniae TW-183
auagcucuuugauuuucuu

SEQ ID NO: 551921 - RNA, 21 nt, Chlamydophila pneumoniae TW-183
auagccucgagcagaaacucc

SEQ ID NO: 551922 - RNA, 17 nt, Chlamydophila pneumoniae TW-183
auagcaagcacuuucgc

SEQ ID NO: 551923 - RNA, 23 nt, Chlamydophila pneumoniae TW-183
auagcaggaaggaauagagaaag

SEQ ID NO: 551924 - RNA, 13 nt, Chlamydophila pneumoniae TW-183
auagcagucuugc

SEQ ID NO: 551925 - RNA, 14 nt, Chlamydophila pneumoniae TW-183
auagauaugccuca

SEQ ID NO: 551926 - RNA, 16 nt, Chlamydophila pneumoniae TW-183
auagaaaacauauccc

SEQ ID NO: 551927 - RNA, 15 nt, Chlamydophila pneumoniae TW-183
auagaaaaucuuguu

SEQ ID NO: 551928 - RNA, 17 nt, Chlamydophila pneumoniae TW-183
auacuuuuccuacaacg

SEQ ID NO: 551929 - RNA, 20 nt, Chlamydophila pneumoniae TW-183
auagaguaucuaaaacuucu

SEQ ID NO: 551930 - RNA, 19 nt, Chlamydophila pneumoniae TW-183
auaccuccuccaaucugcu

SEQ ID NO: 551931 - RNA, 15 nt, Chlamydophila pneumoniae TW-183
auacuucuccacagc

SEQ ID NO: 551932 - RNA, 15 nt, Chlamydophila pneumoniae TW-183
auccuguagagcaag

SEQ ID NO: 551933 - RNA, 22 nt, Chlamydophila pneumoniae TW-183
auccuguagagcaagauucuuc

SEQ ID NO: 551934 - RNA, 15 nt, Chlamydophila pneumoniae TW-183
auccuugcaaaacag

SEQ ID NO: 551935 - RNA, 19 nt, Chlamydophila pneumoniae TW-183
auccuugcaaaacagcauc

SEQ ID NO: 551936 - RNA, 15 nt, Chlamydophila pneumoniae TW-183
auccuggagcaugag

SEQ ID NO: 551937 - RNA, 19 nt, Chlamydophila pneumoniae TW-183
aucgcucucuccaugagcu

SEQ ID NO: 551938 - RNA, 17 nt, Chlamydophila pneumoniae TW-183
auccccguccuguacca

SEQ ID NO: 551939 - RNA, 17 nt, Chlamydophila pneumoniae TW-183
auccaagaauagccaua

SEQ ID NO: 551940 - RNA, 14 nt, Chlamydophila pneumoniae TW-183
auccaagaauagcc

SEQ ID NO: 551941 - RNA, 19 nt, Chlamydophila pneumoniae TW-183
aucauuaaggugugcuccu

SEQ ID NO: 551942 - RNA, 14 nt, Chlamydophila pneumoniae TW-183
aucuguaguaggca

SEQ ID NO: 551943 - RNA, 17 nt, Chlamydophila pneumoniae TW-183
aucuguaguaggcacuu

SEQ ID NO: 551944 - RNA, 20 nt, Chlamydophila pneumoniae TW-183
aucuguauaugcuuggcaau

SEQ ID NO: 551945 - RNA, 22 nt, Chlamydophila pneumoniae TW-183
aucuucagagagaacaggaggu

SEQ ID NO: 551946 - RNA, 16 nt, Chlamydophila pneumoniae TW-183
aucuucagagagaaca

SEQ ID NO: 551947 - RNA, 15 nt, Chlamydophila pneumoniae TW-183
aucuuaucaagagcu

SEQ ID NO: 551948 - RNA, 14 nt, Chlamydophila pneumoniae TW-183
aucuccucaucaga

SEQ ID NO: 551949 - RNA, 21 nt, Chlamydophila pneumoniae TW-183
aucuccaagccaugcaaugaa

SEQ ID NO: 551950 - RNA, 19 nt, Chlamydophila pneumoniae TW-183
aucuccaagccaugcaaug

SEQ ID NO: 551951 - RNA, 22 nt, Chlamydophila pneumoniae TW-183
aucucugacuugcaagcuucuu

SEQ ID NO: 551952 - RNA, 18 nt, Chlamydophila pneumoniae TW-183
aucucugacuugcaagcu

SEQ ID NO: 551953 - RNA, 13 nt, Chlamydophila pneumoniae TW-183
aucucuccucccc

SEQ ID NO: 551954 - RNA, 22 nt, Chlamydophila pneumoniae TW-183
aucucaguaggagcagcggcac

SEQ ID NO: 551955 - RNA, 13 nt, Chlamydophila pneumoniae TW-183
augauaauuucau

SEQ ID NO: 551956 - RNA, 13 nt, Chlamydophila pneumoniae TW-183
augauaucagcau

SEQ ID NO: 551957 - RNA, 20 nt, Chlamydophila pneumoniae TW-183
augacguuaauaaagaggcu

SEQ ID NO: 551958 - RNA, 21 nt, Chlamydophila pneumoniae TW-183
augaaagugcucuuuuaacuu

SEQ ID NO: 551959 - RNA, 22 nt, Chlamydophila pneumoniae TW-183
auuacagcaucuauagaauuuc

SEQ ID NO: 551960 - RNA, 13 nt, Chlamydophila pneumoniae TW-183
auuaagucaccuu

SEQ ID NO: 551961 - RNA, 15 nt, Chlamydophila pneumoniae TW-183
auuaagucaccuuaa

SEQ ID NO: 551962 - RNA, 15 nt, Chlamydophila pneumoniae TW-183
auuaaggcuccagca

SEQ ID NO: 551963 - RNA, 18 nt, Chlamydophila pneumoniae TW-183
auucacaaaucuuccccu

SEQ ID NO: 551964 - RNA, 12 nt, Chlamydophila pneumoniae TW-183
auuauucuagag

SEQ ID NO: 551965 - RNA, 15 nt, Chlamydophila pneumoniae TW-183
auuauucuagaguug

SEQ ID NO: 551966 - RNA, 18 nt, Chlamydophila pneumoniae TW-183
auucaggauacucugaac

SEQ ID NO: 551967 - RNA, 22 nt, Chlamydophila pneumoniae TW-183
aaaagcuagucuuucuaagaag

SEQ ID NO: 551968 - RNA, 23 nt, Chlamydophila pneumoniae TW-183
auguaucggggauugcaaaauuu

SEQ ID NO: 551969 - RNA, 22 nt, Chlamydophila pneumoniae TW-183
auguauggugcgcgucuccuug

SEQ ID NO: 551970 - RNA, 16 nt, Chlamydophila pneumoniae TW-183
auguagcuguuccaag

SEQ ID NO: 551971 - RNA, 14 nt, Chlamydophila pneumoniae TW-183
auguaagaauguag

SEQ ID NO: 551972 - RNA, 13 nt, Chlamydophila pneumoniae TW-183
auggucuuccccc

SEQ ID NO: 551973 - RNA, 19 nt, Chlamydophila pneumoniae TW-183
auggucuuggguuuuaaau

SEQ ID NO: 551974 - RNA, 20 nt, Chlamydophila pneumoniae TW-183
auggauuucuccagcagcuu

SEQ ID NO: 551975 - RNA, 15 nt, Chlamydophila pneumoniae TW-183
aaaagagcucaaaaa

SEQ ID NO: 551976 - RNA, 20 nt, Chlamydophila pneumoniae TW-183
aaaagagcucaaaaaguucc

SEQ ID NO: 551977 - RNA, 13 nt, Chlamydophila pneumoniae TW-183
augcuaagcucca

SEQ ID NO: 551978 - RNA, 17 nt, Chlamydophila pneumoniae TW-183
augcuauuuuccucuau

SEQ ID NO: 551979 - RNA, 18 nt, Chlamydophila pneumoniae TW-183
augcgcagcucggaugga

SEQ ID NO: 551980 - RNA, 22 nt, Chlamydophila pneumoniae TW-183
augcauucugauccgaaaagaa

SEQ ID NO: 551981 - RNA, 15 nt, Chlamydophila pneumoniae TW-183
augcaucaaugaagu

SEQ ID NO: 551982 - RNA, 19 nt, Chlamydophila pneumoniae TW-183
auucucccaauauccagaa

SEQ ID NO: 551983 - RNA, 23 nt, Chlamydophila pneumoniae TW-183
auugaacagucuugcgccagcaa

SEQ ID NO: 551984 - RNA, 20 nt, Chlamydophila pneumoniae TW-183
auugaacguagcuacaaaau

SEQ ID NO: 551985 - RNA, 23 nt, Chlamydophila pneumoniae TW-183
auugaggacaacagcaacacucg

SEQ ID NO: 551986 - RNA, 20 nt, Chlamydophila pneumoniae TW-183
auugaggauaaguucuucca

SEQ ID NO: 551987 - RNA, 15 nt, Chlamydophila pneumoniae TW-183
auucggaccaaugau

SEQ ID NO: 551988 - RNA, 17 nt, Chlamydophila pneumoniae TW-183
auucuagaccugccaag

SEQ ID NO: 551989 - RNA, 17 nt, Chlamydophila pneumoniae TW-183
auuccucucacauuugc

SEQ ID NO: 551990 - RNA, 16 nt, Chlamydophila pneumoniae TW-183
auuggaucuagagaag

SEQ ID NO: 551991 - RNA, 20 nt, Chlamydophila pneumoniae TW-183
auuuaggagggguaaaccaa

SEQ ID NO: 551992 - RNA, 17 nt, Chlamydophila pneumoniae TW-183
auuuucccauuacagcc

SEQ ID NO: 551993 - RNA, 21 nt, Chlamydophila pneumoniae TW-183
auuuucagccugucuauaaaa

SEQ ID NO: 551994 - RNA, 20 nt, Chlamydophila pneumoniae TW-183
auuuucuggugccuguaauu

SEQ ID NO: 551995 - RNA, 15 nt, Chlamydophila pneumoniae TW-183
auuuuuugagaaaua

SEQ ID NO: 551996 - RNA, 21 nt, Chlamydophila pneumoniae TW-183
auuuuuugagaaauauaaaca

SEQ ID NO: 551997 - RNA, 18 nt, Chlamydophila pneumoniae TW-183
caaaaaguuccauagagu

SEQ ID NO: 551998 - RNA, 10 nt, Chlamydophila pneumoniae TW-183
caaaaauucc

SEQ ID NO: 551999 - RNA, 16 nt, Chlamydophila pneumoniae TW-183
caaaacauaaccuccu

SEQ ID NO: 552000 - RNA, 19 nt, Chlamydophila pneumoniae TW-183
caaaacauaaccuccucuu

SEQ ID NO: 552001 - RNA, 16 nt, Chlamydophila pneumoniae TW-183
auuucuccaguaucuu

SEQ ID NO: 552002 - RNA, 17 nt, Chlamydophila pneumoniae TW-183
auuugugcgucaucaac

SEQ ID NO: 552003 - RNA, 22 nt, Chlamydophila pneumoniae TW-183
auuuguguauggucucaggauc

SEQ ID NO: 552004 - RNA, 16 nt, Chlamydophila pneumoniae TW-183
auuuccaaauucuugc

SEQ ID NO: 552005 - RNA, 23 nt, Chlamydophila pneumoniae TW-183
cacgcacuccuggagcuguuucu

SEQ ID NO: 552006 - RNA, 22 nt, Chlamydophila pneumoniae TW-183
caccuucuucuaaaaucuucuc

SEQ ID NO: 552007 - RNA, 23 nt, Chlamydophila pneumoniae TW-183
caccuucuucuaaaaucuucucu

SEQ ID NO: 552008 - RNA, 18 nt, Chlamydophila pneumoniae TW-183
aaaauaagcaguuuucag

SEQ ID NO: 552009 - RNA, 17 nt, Chlamydophila pneumoniae TW-183
caccauuuuugaauaug

SEQ ID NO: 552010 - RNA, 18 nt, Chlamydophila pneumoniae TW-183
caccagaagcauugagga

SEQ ID NO: 552011 - RNA, 22 nt, Chlamydophila pneumoniae TW-183
aaaaguuuuuguucauccagaa

SEQ ID NO: 552012 - RNA, 19 nt, Chlamydophila pneumoniae TW-183
caccaaugauaauuucauu

SEQ ID NO: 552013 - RNA, 17 nt, Chlamydophila pneumoniae TW-183
cacauuguuuaaguccu

SEQ ID NO: 552014 - RNA, 23 nt, Chlamydophila pneumoniae TW-183
cacauuguuuaaguccuucuucc

SEQ ID NO: 552015 - RNA, 13 nt, Chlamydophila pneumoniae TW-183
caccaagggaugc

SEQ ID NO: 552016 - RNA, 21 nt, Chlamydophila pneumoniae TW-183
cacagacuugaggaaucugaa

SEQ ID NO: 552017 - RNA, 15 nt, Chlamydophila pneumoniae TW-183
cacagacuugaggaa

SEQ ID NO: 552018 - RNA, 20 nt, Chlamydophila pneumoniae TW-183
cacaggggaacgcucucuag

SEQ ID NO: 552019 - RNA, 22 nt, Chlamydophila pneumoniae TW-183
caauugaaucagauuagaguua

SEQ ID NO: 552020 - RNA, 15 nt, Chlamydophila pneumoniae TW-183
caauugaaucagauu

SEQ ID NO: 552021 - RNA, 12 nt, Chlamydophila pneumoniae TW-183
caauugagcucu

SEQ ID NO: 552022 - RNA, 18 nt, Chlamydophila pneumoniae TW-183
caauuagagauucauaaa

SEQ ID NO: 552023 - RNA, 16 nt, Chlamydophila pneumoniae TW-183
caauugagcucucuag

SEQ ID NO: 552024 - RNA, 14 nt, Chlamydophila pneumoniae TW-183
caaguugagagaga

SEQ ID NO: 552025 - RNA, 21 nt, Chlamydophila pneumoniae TW-183
caaguuguugauaauuacaga

SEQ ID NO: 552026 - RNA, 17 nt, Chlamydophila pneumoniae TW-183
caauauaaaugcuauuu

SEQ ID NO: 552027 - RNA, 23 nt, Chlamydophila pneumoniae TW-183
caaucuuugaucgcuugugcaug

SEQ ID NO: 552028 - RNA, 20 nt, Chlamydophila pneumoniae TW-183
caaugauaauuucauuauag

SEQ ID NO: 552029 - RNA, 14 nt, Chlamydophila pneumoniae TW-183
caaugauaauuuca

SEQ ID NO: 552030 - RNA, 19 nt, Chlamydophila pneumoniae TW-183
caaucucuagggauaauua

SEQ ID NO: 552031 - RNA, 23 nt, Chlamydophila pneumoniae TW-183
caaggucacagcauuuucucuga

SEQ ID NO: 552032 - RNA, 20 nt, Chlamydophila pneumoniae TW-183
caagcuuugcgcuuguucuu

SEQ ID NO: 552033 - RNA, 23 nt, Chlamydophila pneumoniae TW-183
caagagcucguaauccuucuuuc

SEQ ID NO: 552034 - RNA, 22 nt, Chlamydophila pneumoniae TW-183
caagaggcuguccuugcagccc

SEQ ID NO: 552035 - RNA, 20 nt, Chlamydophila pneumoniae TW-183
caagagcaucacaaacuaaa

SEQ ID NO: 552036 - RNA, 18 nt, Chlamydophila pneumoniae TW-183
caagaaauauacugccag

SEQ ID NO: 552037 - RNA, 14 nt, Chlamydophila pneumoniae TW-183
caagaaaaaccccu

SEQ ID NO: 552038 - RNA, 23 nt, Chlamydophila pneumoniae TW-183
caacuuuguuaauagaagaucau

SEQ ID NO: 552039 - RNA, 14 nt, Chlamydophila pneumoniae TW-183
caacuucuccaacu

SEQ ID NO: 552040 - RNA, 19 nt, Chlamydophila pneumoniae TW-183
caacugauguuuuauagau

SEQ ID NO: 552041 - RNA, 20 nt, Chlamydophila pneumoniae TW-183
caacuaaaccuucaaugauu

SEQ ID NO: 552042 - RNA, 19 nt, Chlamydophila pneumoniae TW-183
caacgaucgucaguaaaac

SEQ ID NO: 552043 - RNA, 18 nt, Chlamydophila pneumoniae TW-183
caacccgaauuccucucc

SEQ ID NO: 552044 - RNA, 16 nt, Chlamydophila pneumoniae TW-183
caacccgaauuccucu

SEQ ID NO: 552045 - RNA, 15 nt, Chlamydophila pneumoniae TW-183
caacccgaauuccuc

SEQ ID NO: 552046 - RNA, 22 nt, Chlamydophila pneumoniae TW-183
caacauaaucauuauccauauc

SEQ ID NO: 552047 - RNA, 19 nt, Chlamydophila pneumoniae TW-183
caaauagauuuuuacuugc

SEQ ID NO: 552048 - RNA, 14 nt, Chlamydophila pneumoniae TW-183
caaauagauuuuua

SEQ ID NO: 552049 - RNA, 22 nt, Chlamydophila pneumoniae TW-183
caaacauggacaauauagagau

SEQ ID NO: 552050 - RNA, 12 nt, Chlamydophila pneumoniae TW-183
caaaauaaaaaa

SEQ ID NO: 552051 - RNA, 24 nt, Chlamydophila pneumoniae TW-183
caaaauaaaaaaacccucaaagaa

SEQ ID NO: 552052 - RNA, 17 nt, Chlamydophila pneumoniae TW-183
caaaauaaaaaaacccu

SEQ ID NO: 552053 - RNA, 17 nt, Chlamydophila pneumoniae TW-183
caaaauauuuguuacua

SEQ ID NO: 552054 - RNA, 17 nt, Chlamydophila pneumoniae TW-183
caaacugaugccaagaa

SEQ ID NO: 552055 - RNA, 22 nt, Chlamydophila pneumoniae TW-183
cagcaacgaguccuuacuugca

SEQ ID NO: 552056 - RNA, 14 nt, Chlamydophila pneumoniae TW-183
cagagagaacagga

SEQ ID NO: 552057 - RNA, 18 nt, Chlamydophila pneumoniae TW-183
cagaguccuucuuuuccg

SEQ ID NO: 552058 - RNA, 15 nt, Chlamydophila pneumoniae TW-183
cagacacaaaaagcu

SEQ ID NO: 552059 - RNA, 20 nt, Chlamydophila pneumoniae TW-183
cagaagcauugaggacaaca

SEQ ID NO: 552060 - RNA, 21 nt, Chlamydophila pneumoniae TW-183
cagaagcaacuaaacucucca

SEQ ID NO: 552061 - RNA, 21 nt, Chlamydophila pneumoniae TW-183
cagaacacaugucucuuaaaa

SEQ ID NO: 552062 - RNA, 15 nt, Chlamydophila pneumoniae TW-183
cacuuucugauguga

SEQ ID NO: 552063 - RNA, 24 nt, Chlamydophila pneumoniae TW-183
cagcgacaacacgcccacggaaag

SEQ ID NO: 552064 - RNA, 15 nt, Chlamydophila pneumoniae TW-183
cagccugcaccagac

SEQ ID NO: 552065 - RNA, 17 nt, Chlamydophila pneumoniae TW-183
cagcauugccuggggau

SEQ ID NO: 552066 - RNA, 15 nt, Chlamydophila pneumoniae TW-183
cagcauggacuccaa

SEQ ID NO: 552067 - RNA, 18 nt, Chlamydophila pneumoniae TW-183
cagcaucaggauucucuc

SEQ ID NO: 552068 - RNA, 18 nt, Chlamydophila pneumoniae TW-183
cagcauaaaaauucucau

SEQ ID NO: 552069 - RNA, 15 nt, Chlamydophila pneumoniae TW-183
cagcauaaaaauucu

SEQ ID NO: 552070 - RNA, 14 nt, Chlamydophila pneumoniae TW-183
cagucuccuggaac

SEQ ID NO: 552071 - RNA, 22 nt, Chlamydophila pneumoniae TW-183
cagucuccuggaacaguauaau

SEQ ID NO: 552072 - RNA, 23 nt, Chlamydophila pneumoniae TW-183
cagucuugcgccagcaaagauua

SEQ ID NO: 552073 - RNA, 16 nt, Chlamydophila pneumoniae TW-183
caguaaaacacaaaua

SEQ ID NO: 552074 - RNA, 20 nt, Chlamydophila pneumoniae TW-183
caguaaaacacaaauagcaa

SEQ ID NO: 552075 - RNA, 22 nt, Chlamydophila pneumoniae TW-183
caguaaaagacugaaaagaucg

SEQ ID NO: 552076 - RNA, 23 nt, Chlamydophila pneumoniae TW-183
aaacaacgaucgucaguaaaaca

SEQ ID NO: 552077 - RNA, 18 nt, Chlamydophila pneumoniae TW-183
caggucugcugaggagag

SEQ ID NO: 552078 - RNA, 20 nt, Chlamydophila pneumoniae TW-183
caggugacuaaacaccuucu

SEQ ID NO: 552079 - RNA, 18 nt, Chlamydophila pneumoniae TW-183
cagguucacuucaucgac

SEQ ID NO: 552080 - RNA, 18 nt, Chlamydophila pneumoniae TW-183
caggccuggugcuuaaaa

SEQ ID NO: 552081 - RNA, 16 nt, Chlamydophila pneumoniae TW-183
caggagagagaaggcu

SEQ ID NO: 552082 - RNA, 22 nt, Chlamydophila pneumoniae TW-183
caggauacucugaacaggaaua

SEQ ID NO: 552083 - RNA, 12 nt, Chlamydophila pneumoniae TW-183
aaaauuuuccca

SEQ ID NO: 552084 - RNA, 23 nt, Chlamydophila pneumoniae TW-183
cagcuucccaagcagaagacccu

SEQ ID NO: 552085 - RNA, 20 nt, Chlamydophila pneumoniae TW-183
cagcuucuugauguacagua

SEQ ID NO: 552086 - RNA, 13 nt, Chlamydophila pneumoniae TW-183
cagcuaaucaauc

SEQ ID NO: 552087 - RNA, 18 nt, Chlamydophila pneumoniae TW-183
aaaauugcauuuaaacua

SEQ ID NO: 552088 - RNA, 13 nt, Chlamydophila pneumoniae TW-183
cagcuccuggaua

SEQ ID NO: 552089 - RNA, 14 nt, Chlamydophila pneumoniae TW-183
ccagcaucuucucg

SEQ ID NO: 552090 - RNA, 22 nt, Chlamydophila pneumoniae TW-183
ccagauuuuuuugguugcuucu

SEQ ID NO: 552091 - RNA, 16 nt, Chlamydophila pneumoniae TW-183
ccagacuuuccucucu

SEQ ID NO: 552092 - RNA, 22 nt, Chlamydophila pneumoniae TW-183
ccagaagcaacuaaacucucca

SEQ ID NO: 552093 - RNA, 20 nt, Chlamydophila pneumoniae TW-183
ccagaauaccuucaacaaga

SEQ ID NO: 552094 - RNA, 22 nt, Chlamydophila pneumoniae TW-183
ccagaauaccuucaacaagaau

SEQ ID NO: 552095 - RNA, 12 nt, Chlamydophila pneumoniae TW-183
ccacugcuuuag

SEQ ID NO: 552096 - RNA, 16 nt, Chlamydophila pneumoniae TW-183
ccaauuccccuucauc

SEQ ID NO: 552097 - RNA, 18 nt, Chlamydophila pneumoniae TW-183
ccaauuccccuucaucaa

SEQ ID NO: 552098 - RNA, 14 nt, Chlamydophila pneumoniae TW-183
ccaaaguuuguagc

SEQ ID NO: 552099 - RNA, 17 nt, Chlamydophila pneumoniae TW-183
ccaaaguuuguagcauu

SEQ ID NO: 552100 - RNA, 23 nt, Chlamydophila pneumoniae TW-183
ccaacacgcacaaacuaacauag

SEQ ID NO: 552101 - RNA, 13 nt, Chlamydophila pneumoniae TW-183
ccaacuccucuaa

SEQ ID NO: 552102 - RNA, 20 nt, Chlamydophila pneumoniae TW-183
ccaaaagaauuaagaagaag

SEQ ID NO: 552103 - RNA, 21 nt, Chlamydophila pneumoniae TW-183
cauuuucuucuugcaaucuuu

SEQ ID NO: 552104 - RNA, 15 nt, Chlamydophila pneumoniae TW-183
cauuccagcaucuuc

SEQ ID NO: 552105 - RNA, 20 nt, Chlamydophila pneumoniae TW-183
cauguuuaauaucagcuucu

SEQ ID NO: 552106 - RNA, 16 nt, Chlamydophila pneumoniae TW-183
caugcggacuuuauuc

SEQ ID NO: 552107 - RNA, 22 nt, Chlamydophila pneumoniae TW-183
caugcccccacaaaaccuggau

SEQ ID NO: 552108 - RNA, 20 nt, Chlamydophila pneumoniae TW-183
caugcauaggcuuuaccaua

SEQ ID NO: 552109 - RNA, 18 nt, Chlamydophila pneumoniae TW-183
caugcacgagagccucgg

SEQ ID NO: 552110 - RNA, 13 nt, Chlamydophila pneumoniae TW-183
caugauuuuucaa

SEQ ID NO: 552111 - RNA, 17 nt, Chlamydophila pneumoniae TW-183
caugagcucaggcaaca

SEQ ID NO: 552112 - RNA, 19 nt, Chlamydophila pneumoniae TW-183
caugacgcuuuuccaaagc

SEQ ID NO: 552113 - RNA, 19 nt, Chlamydophila pneumoniae TW-183
caucggugucuacaaagau

SEQ ID NO: 552114 - RNA, 22 nt, Chlamydophila pneumoniae TW-183
cauccacgaccucgaauuccuc

SEQ ID NO: 552115 - RNA, 12 nt, Chlamydophila pneumoniae TW-183
cauccagaagua

SEQ ID NO: 552116 - RNA, 19 nt, Chlamydophila pneumoniae TW-183
caucacaaacuaaaucaac

SEQ ID NO: 552117 - RNA, 14 nt, Chlamydophila pneumoniae TW-183
caucacuaaucuca

SEQ ID NO: 552118 - RNA, 19 nt, Chlamydophila pneumoniae TW-183
caucagcaaaacucccgac

SEQ ID NO: 552119 - RNA, 23 nt, Chlamydophila pneumoniae TW-183
caucacuaagauacgaaguccca

SEQ ID NO: 552120 - RNA, 16 nt, Chlamydophila pneumoniae TW-183
cauauuuuucuugaag

SEQ ID NO: 552121 - RNA, 20 nt, Chlamydophila pneumoniae TW-183
cauauuuuucuugaagguuc

SEQ ID NO: 552122 - RNA, 20 nt, Chlamydophila pneumoniae TW-183
cauaggcuuuaccauagaaa

SEQ ID NO: 552123 - RNA, 15 nt, Chlamydophila pneumoniae TW-183
cauagagauucuaca

SEQ ID NO: 552124 - RNA, 18 nt, Chlamydophila pneumoniae TW-183
cauacucuucauccugau

SEQ ID NO: 552125 - RNA, 14 nt, Chlamydophila pneumoniae TW-183
cauacucuucaucc

SEQ ID NO: 552126 - RNA, 20 nt, Chlamydophila pneumoniae TW-183
cgaaugucguuaaaaacuau

SEQ ID NO: 552127 - RNA, 13 nt, Chlamydophila pneumoniae TW-183
cgaaucucuccag

SEQ ID NO: 552128 - RNA, 18 nt, Chlamydophila pneumoniae TW-183
cgaagcuugcugauuucu

SEQ ID NO: 552129 - RNA, 22 nt, Chlamydophila pneumoniae TW-183
cgaccuaggagaaaucacacuu

SEQ ID NO: 552130 - RNA, 17 nt, Chlamydophila pneumoniae TW-183
cgaccucgaauuccucc

SEQ ID NO: 552131 - RNA, 20 nt, Chlamydophila pneumoniae TW-183
cgaccucgaauuccucccag

SEQ ID NO: 552132 - RNA, 13 nt, Chlamydophila pneumoniae TW-183
ccuuguuuuccug

SEQ ID NO: 552133 - RNA, 15 nt, Chlamydophila pneumoniae TW-183
ccuugugagaggguc

SEQ ID NO: 552134 - RNA, 12 nt, Chlamydophila pneumoniae TW-183
ccuuguucuuga

SEQ ID NO: 552135 - RNA, 16 nt, Chlamydophila pneumoniae TW-183
ccuugagacaaagaau

SEQ ID NO: 552136 - RNA, 19 nt, Chlamydophila pneumoniae TW-183
ccuugaaauugcucuugcu

SEQ ID NO: 552137 - RNA, 19 nt, Chlamydophila pneumoniae TW-183
ccuucacaagaaaacaaag

SEQ ID NO: 552138 - RNA, 20 nt, Chlamydophila pneumoniae TW-183
ccuguaauugauguuccuug

SEQ ID NO: 552139 - RNA, 22 nt, Chlamydophila pneumoniae TW-183
ccuguaccacauacucuucauc

SEQ ID NO: 552140 - RNA, 14 nt, Chlamydophila pneumoniae TW-183
ccuggauuuaggau

SEQ ID NO: 552141 - RNA, 21 nt, Chlamydophila pneumoniae TW-183
ccuggaggcgguggcaugcca

SEQ ID NO: 552142 - RNA, 18 nt, Chlamydophila pneumoniae TW-183
ccuggacgauauaaucac

SEQ ID NO: 552143 - RNA, 12 nt, Chlamydophila pneumoniae TW-183
ccugcugcuuca

SEQ ID NO: 552144 - RNA, 21 nt, Chlamydophila pneumoniae TW-183
ccucgagcagaaacuccaaaa

SEQ ID NO: 552145 - RNA, 17 nt, Chlamydophila pneumoniae TW-183
ccucgaauuccucccag

SEQ ID NO: 552146 - RNA, 16 nt, Chlamydophila pneumoniae TW-183
ccucgccgcugcccua

SEQ ID NO: 552147 - RNA, 16 nt, Chlamydophila pneumoniae TW-183
ccuccauggaaagaaa

SEQ ID NO: 552148 - RNA, 21 nt, Chlamydophila pneumoniae TW-183
ccucaucagaagccaccaaaa

SEQ ID NO: 552149 - RNA, 21 nt, Chlamydophila pneumoniae TW-183
ccuauaaagcaaaugccugua

SEQ ID NO: 552150 - RNA, 21 nt, Chlamydophila pneumoniae TW-183
ccuauaguauaauagugagcu

SEQ ID NO: 552151 - RNA, 20 nt, Chlamydophila pneumoniae TW-183
ccuacaacggcaaucuauuu

SEQ ID NO: 552152 - RNA, 20 nt, Chlamydophila pneumoniae TW-183
ccuaccaaaguuuguagcau

SEQ ID NO: 552153 - RNA, 17 nt, Chlamydophila pneumoniae TW-183
ccuacauggaucccugu

SEQ ID NO: 552154 - RNA, 18 nt, Chlamydophila pneumoniae TW-183
ccuaccucugggaagacu

SEQ ID NO: 552155 - RNA, 16 nt, Chlamydophila pneumoniae TW-183
ccuaagugauaaggaa

SEQ ID NO: 552156 - RNA, 12 nt, Chlamydophila pneumoniae TW-183
ccuaauauccau

SEQ ID NO: 552157 - RNA, 19 nt, Chlamydophila pneumoniae TW-183
ccuaauauccauaagaucu

SEQ ID NO: 552158 - RNA, 23 nt, Chlamydophila pneumoniae TW-183
ccuaaaguuugagcuaagcugaa

SEQ ID NO: 552159 - RNA, 15 nt, Chlamydophila pneumoniae TW-183
ccgaaucucuccagc

SEQ ID NO: 552160 - RNA, 15 nt, Chlamydophila pneumoniae TW-183
aaacaucacucagga

SEQ ID NO: 552161 - RNA, 23 nt, Chlamydophila pneumoniae TW-183
cccuuaaagagaaucuccucauc

SEQ ID NO: 552162 - RNA, 12 nt, Chlamydophila pneumoniae TW-183
cccuucaucaau

SEQ ID NO: 552163 - RNA, 22 nt, Chlamydophila pneumoniae TW-183
aaacagcgguugccuuucucuu

SEQ ID NO: 552164 - RNA, 23 nt, Chlamydophila pneumoniae TW-183
aaacagcaucaggauucucucug

SEQ ID NO: 552165 - RNA, 19 nt, Chlamydophila pneumoniae TW-183
cccucacaauauaaaugcu

SEQ ID NO: 552166 - RNA, 19 nt, Chlamydophila pneumoniae TW-183
cccucaagcgauuucgaaa

SEQ ID NO: 552167 - RNA, 12 nt, Chlamydophila pneumoniae TW-183
aaacaauuucaa

SEQ ID NO: 552168 - RNA, 19 nt, Chlamydophila pneumoniae TW-183
cccaguuuuccauccacga

SEQ ID NO: 552169 - RNA, 11 nt, Chlamydophila pneumoniae TW-183
aaacacaaaua

SEQ ID NO: 552170 - RNA, 13 nt, Chlamydophila pneumoniae TW-183
cccauagcaugag

SEQ ID NO: 552171 - RNA, 13 nt, Chlamydophila pneumoniae TW-183
cccagauuuuuuu

SEQ ID NO: 552172 - RNA, 13 nt, Chlamydophila pneumoniae TW-183
ccauccacgaccu

SEQ ID NO: 552173 - RNA, 17 nt, Chlamydophila pneumoniae TW-183
ccauccacgaccugcaa

SEQ ID NO: 552174 - RNA, 18 nt, Chlamydophila pneumoniae TW-183
ccauccacgaccugcaaa

SEQ ID NO: 552175 - RNA, 17 nt, Chlamydophila pneumoniae TW-183
ccauaauuagaacagca

SEQ ID NO: 552176 - RNA, 20 nt, Chlamydophila pneumoniae TW-183
cgcaaguaaagaaauucugg

SEQ ID NO: 552177 - RNA, 14 nt, Chlamydophila pneumoniae TW-183
cgauuaccuaaaac

SEQ ID NO: 552178 - RNA, 15 nt, Chlamydophila pneumoniae TW-183
cgauuaccuaaaaca

SEQ ID NO: 552179 - RNA, 14 nt, Chlamydophila pneumoniae TW-183
cgaucgucaguaaa

SEQ ID NO: 552180 - RNA, 21 nt, Chlamydophila pneumoniae TW-183
cgauaacguugccuguuuuau

SEQ ID NO: 552181 - RNA, 14 nt, Chlamydophila pneumoniae TW-183
cgccagcaaagauu

SEQ ID NO: 552182 - RNA, 14 nt, Chlamydophila pneumoniae TW-183
cgcucguauugaua

SEQ ID NO: 552183 - RNA, 12 nt, Chlamydophila pneumoniae TW-183
cgcggaucuucu

SEQ ID NO: 552184 - RNA, 20 nt, Chlamydophila pneumoniae TW-183
cggcacuuacuucaagaaaa

SEQ ID NO: 552185 - RNA, 18 nt, Chlamydophila pneumoniae TW-183
uuuuuguucauccagaag

SEQ ID NO: 552186 - RNA, 10 nt, Chlamydophila pneumoniae TW-183
uuuuucucuu

SEQ ID NO: 552187 - RNA, 15 nt, Chlamydophila pneumoniae TW-183
uuuugauuuugcagu

SEQ ID NO: 552188 - RNA, 22 nt, Chlamydophila pneumoniae TW-183
uuuuucuguuccugaguacuuu

SEQ ID NO: 552189 - RNA, 20 nt, Chlamydophila pneumoniae TW-183
uuuuugaauaugauuuccac

SEQ ID NO: 552190 - RNA, 22 nt, Chlamydophila pneumoniae TW-183
uuuuagcauaaucuuuaacaaa

SEQ ID NO: 552191 - RNA, 18 nt, Chlamydophila pneumoniae TW-183
uuuucaagucuguaagga

SEQ ID NO: 552192 - RNA, 16 nt, Chlamydophila pneumoniae TW-183
uuuucccuuuuuagaa

SEQ ID NO: 552193 - RNA, 13 nt, Chlamydophila pneumoniae TW-183
uuuugaaaauuuu

SEQ ID NO: 552194 - RNA, 20 nt, Chlamydophila pneumoniae TW-183
uuuugaaaauugcauuuaaa

SEQ ID NO: 552195 - RNA, 15 nt, Chlamydophila pneumoniae TW-183
uuuguacacagagau

SEQ ID NO: 552196 - RNA, 23 nt, Chlamydophila pneumoniae TW-183
uuugggauaaaaaguuuuuguuc

SEQ ID NO: 552197 - RNA, 19 nt, Chlamydophila pneumoniae TW-183
uuugggagauccugaaaaa

SEQ ID NO: 552198 - RNA, 14 nt, Chlamydophila pneumoniae TW-183
uuugcugaagauuu

SEQ ID NO: 552199 - RNA, 16 nt, Chlamydophila pneumoniae TW-183
uuugcugcgaaugucg

SEQ ID NO: 552200 - RNA, 19 nt, Chlamydophila pneumoniae TW-183
uuuguguauggucucagga

SEQ ID NO: 552201 - RNA, 22 nt, Chlamydophila pneumoniae TW-183
uuuuaaguugguccaucgagaa

SEQ ID NO: 552202 - RNA, 14 nt, Chlamydophila pneumoniae TW-183
uucucaaagaucau

SEQ ID NO: 552203 - RNA, 17 nt, Chlamydophila pneumoniae TW-183
uucuauguguucucgaa

SEQ ID NO: 552204 - RNA, 20 nt, Chlamydophila pneumoniae TW-183
uuaucaggaacuaaaaguuu

SEQ ID NO: 552205 - RNA, 21 nt, Chlamydophila pneumoniae TW-183
uucucugagcagcuucgcaau

SEQ ID NO: 552206 - RNA, 19 nt, Chlamydophila pneumoniae TW-183
uucucuaggaacucuuuaa

SEQ ID NO: 552207 - RNA, 18 nt, Chlamydophila pneumoniae TW-183
uucucaagaucuucauca

SEQ ID NO: 552208 - RNA, 23 nt, Chlamydophila pneumoniae TW-183
uucugucuauaagauagcucuug

SEQ ID NO: 552209 - RNA, 12 nt, Chlamydophila pneumoniae TW-183
uucuucuaaaau

SEQ ID NO: 552210 - RNA, 13 nt, Chlamydophila pneumoniae TW-183
uugauguuccuug

SEQ ID NO: 552211 - RNA, 17 nt, Chlamydophila pneumoniae TW-183
uugcaaaaaugaaagaa

SEQ ID NO: 552212 - RNA, 13 nt, Chlamydophila pneumoniae TW-183
uugauagagaaaa

SEQ ID NO: 552213 - RNA, 16 nt, Chlamydophila pneumoniae TW-183
uugauaauuacagaag

SEQ ID NO: 552214 - RNA, 19 nt, Chlamydophila pneumoniae TW-183
uugaggcaagucucaaagg

SEQ ID NO: 552215 - RNA, 17 nt, Chlamydophila pneumoniae TW-183
uugaggcaagucucaaa

SEQ ID NO: 552216 - RNA, 20 nt, Chlamydophila pneumoniae TW-183
uugaggaaucugaaucucau

SEQ ID NO: 552217 - RNA, 18 nt, Chlamydophila pneumoniae TW-183
uugaggaacgcacgccaa

SEQ ID NO: 552218 - RNA, 15 nt, Chlamydophila pneumoniae TW-183
uugacuauugggagg

SEQ ID NO: 552219 - RNA, 23 nt, Chlamydophila pneumoniae TW-183
uugacuaaauccaccaaugauaa

SEQ ID NO: 552220 - RNA, 12 nt, Chlamydophila pneumoniae TW-183
uugacugaaacu

SEQ ID NO: 552221 - RNA, 14 nt, Chlamydophila pneumoniae TW-183
uugaaauugcucuu

SEQ ID NO: 552222 - RNA, 13 nt, Chlamydophila pneumoniae TW-183
uugaaauugcucu

SEQ ID NO: 552223 - RNA, 20 nt, Chlamydophila pneumoniae TW-183
uucuucuggcugagagaagc

SEQ ID NO: 552224 - RNA, 19 nt, Chlamydophila pneumoniae TW-183
uugucucaauugaaucaga

SEQ ID NO: 552225 - RNA, 19 nt, Chlamydophila pneumoniae TW-183
uugugcuagguaguguggu

SEQ ID NO: 552226 - RNA, 15 nt, Chlamydophila pneumoniae TW-183
uugugcgucaucaac

SEQ ID NO: 552227 - RNA, 22 nt, Chlamydophila pneumoniae TW-183
uuguaagcgugcaaguucacac

SEQ ID NO: 552228 - RNA, 20 nt, Chlamydophila pneumoniae TW-183
uuguaauuucuaaauagaaa

SEQ ID NO: 552229 - RNA, 21 nt, Chlamydophila pneumoniae TW-183
uugucacacugcgagagaaag

SEQ ID NO: 552230 - RNA, 11 nt, Chlamydophila pneumoniae TW-183
uuguaucuuuu

SEQ ID NO: 552231 - RNA, 18 nt, Chlamydophila pneumoniae TW-183
uuuaaaugagcaauguuu

SEQ ID NO: 552232 - RNA, 20 nt, Chlamydophila pneumoniae TW-183
uuuaauuuucugugacaaaa

SEQ ID NO: 552233 - RNA, 16 nt, Chlamydophila pneumoniae TW-183
uuuaaguccuucuucc

SEQ ID NO: 552234 - RNA, 21 nt, Chlamydophila pneumoniae TW-183
uuuaaccgagcuuuuugcuuu

SEQ ID NO: 552235 - RNA, 15 nt, Chlamydophila pneumoniae TW-183
uuuaacuuaaagacu

SEQ ID NO: 552236 - RNA, 14 nt, Chlamydophila pneumoniae TW-183
uugcugaagauuuu

SEQ ID NO: 552237 - RNA, 12 nt, Chlamydophila pneumoniae TW-183
uugcugaagauu

SEQ ID NO: 552238 - RNA, 13 nt, Chlamydophila pneumoniae TW-183
uugcugauuucuu

SEQ ID NO: 552239 - RNA, 14 nt, Chlamydophila pneumoniae TW-183
uugcuguggaauuu

SEQ ID NO: 552240 - RNA, 19 nt, Chlamydophila pneumoniae TW-183
uugcuguggaauuuuccug

SEQ ID NO: 552241 - RNA, 19 nt, Chlamydophila pneumoniae TW-183
uugcgaacagcuccuggau

SEQ ID NO: 552242 - RNA, 13 nt, Chlamydophila pneumoniae TW-183
uugcaugaggaga

SEQ ID NO: 552243 - RNA, 16 nt, Chlamydophila pneumoniae TW-183
uuuaucccagauaaag

SEQ ID NO: 552244 - RNA, 22 nt, Chlamydophila pneumoniae TW-183
uuuaugacacagcuaaucaauc

SEQ ID NO: 552245 - RNA, 21 nt, Chlamydophila pneumoniae TW-183
uuuauaaagaucgggucuaca

SEQ ID NO: 552246 - RNA, 23 nt, Chlamydophila pneumoniae TW-183
uuuauauuuuuugagaaauauaa

SEQ ID NO: 552247 - RNA, 15 nt, Chlamydophila pneumoniae TW-183
uuuaguuucccacua

SEQ ID NO: 552248 - RNA, 21 nt, Chlamydophila pneumoniae TW-183
uuuagaagguguuuuggcugc

SEQ ID NO: 552249 - RNA, 17 nt, Chlamydophila pneumoniae TW-183
uuuccaaagaucgaucu

SEQ ID NO: 552250 - RNA, 13 nt, Chlamydophila pneumoniae TW-183
uuuccaacuucaa

SEQ ID NO: 552251 - RNA, 13 nt, Chlamydophila pneumoniae TW-183
uuucauaagagaa

SEQ ID NO: 552252 - RNA, 18 nt, Chlamydophila pneumoniae TW-183
uuucagugcuguuuuuuc

SEQ ID NO: 552253 - RNA, 17 nt, Chlamydophila pneumoniae TW-183
uuucaccaacuccucua

SEQ ID NO: 552254 - RNA, 13 nt, Chlamydophila pneumoniae TW-183
uuugcaugaggag

SEQ ID NO: 552255 - RNA, 19 nt, Chlamydophila pneumoniae TW-183
uuugauuuucuuagcuucc

SEQ ID NO: 552256 - RNA, 14 nt, Chlamydophila pneumoniae TW-183
uuugauagagaaaa

SEQ ID NO: 552257 - RNA, 17 nt, Chlamydophila pneumoniae TW-183
uuugauagagaaaauaa

SEQ ID NO: 552258 - RNA, 13 nt, Chlamydophila pneumoniae TW-183
uuucuguuccuga

SEQ ID NO: 552259 - RNA, 16 nt, Chlamydophila pneumoniae TW-183
uuucugugacaaaaua

SEQ ID NO: 552260 - RNA, 19 nt, Chlamydophila pneumoniae TW-183
uuucuuuucugaagauuuu

SEQ ID NO: 552261 - RNA, 13 nt, Chlamydophila pneumoniae TW-183
uuucugcucuucu

SEQ ID NO: 552262 - RNA, 15 nt, Chlamydophila pneumoniae TW-183
ucauugcagauauac

SEQ ID NO: 552263 - RNA, 23 nt, Chlamydophila pneumoniae TW-183
ucauugcagauauacuuuuucag

SEQ ID NO: 552264 - RNA, 18 nt, Chlamydophila pneumoniae TW-183
uccaaccucgagauccuc

SEQ ID NO: 552265 - RNA, 22 nt, Chlamydophila pneumoniae TW-183
uccaacagucugcuuuuuugau

SEQ ID NO: 552266 - RNA, 20 nt, Chlamydophila pneumoniae TW-183
ucaugaaagugcucuuuuaa

SEQ ID NO: 552267 - RNA, 11 nt, Chlamydophila pneumoniae TW-183
ucaugaaagug

SEQ ID NO: 552268 - RNA, 18 nt, Chlamydophila pneumoniae TW-183
ucaucuacgauguuuucu

SEQ ID NO: 552269 - RNA, 22 nt, Chlamydophila pneumoniae TW-183
ucaucugggaguuguaaaacuu

SEQ ID NO: 552270 - RNA, 15 nt, Chlamydophila pneumoniae TW-183
ucauccgaagacuca

SEQ ID NO: 552271 - RNA, 16 nt, Chlamydophila pneumoniae TW-183
ucaucaguaaaagacu

SEQ ID NO: 552272 - RNA, 18 nt, Chlamydophila pneumoniae TW-183
ucaucagcaaaacucccg

SEQ ID NO: 552273 - RNA, 16 nt, Chlamydophila pneumoniae TW-183
ucaucagaagccacca

SEQ ID NO: 552274 - RNA, 14 nt, Chlamydophila pneumoniae TW-183
ucaucaaugagaaa

SEQ ID NO: 552275 - RNA, 17 nt, Chlamydophila pneumoniae TW-183
ucaucaauaaagauagg

SEQ ID NO: 552276 - RNA, 13 nt, Chlamydophila pneumoniae TW-183
ucauaagaaauuc

SEQ ID NO: 552277 - RNA, 23 nt, Chlamydophila pneumoniae TW-183
ucauacgccgugccuauagaaau

SEQ ID NO: 552278 - RNA, 13 nt, Chlamydophila pneumoniae TW-183
ucauaaagaggaa

SEQ ID NO: 552279 - RNA, 15 nt, Chlamydophila pneumoniae TW-183
ucauaaccaaaagaa

SEQ ID NO: 552280 - RNA, 18 nt, Chlamydophila pneumoniae TW-183
ucaggucugcugaggaga

SEQ ID NO: 552281 - RNA, 21 nt, Chlamydophila pneumoniae TW-183
ucagggagcggaauuucucau

SEQ ID NO: 552282 - RNA, 15 nt, Chlamydophila pneumoniae TW-183
ucaggcauucuucau

SEQ ID NO: 552283 - RNA, 23 nt, Chlamydophila pneumoniae TW-183
ucaggcauucuucauuguagagg

SEQ ID NO: 552284 - RNA, 18 nt, Chlamydophila pneumoniae TW-183
ucagcuucuacagcaucg

SEQ ID NO: 552285 - RNA, 15 nt, Chlamydophila pneumoniae TW-183
ucagcuucuacagca

SEQ ID NO: 552286 - RNA, 20 nt, Chlamydophila pneumoniae TW-183
uaucuucaaaaguaaucacu

SEQ ID NO: 552287 - RNA, 16 nt, Chlamydophila pneumoniae TW-183
uccaaucugcugaagg

SEQ ID NO: 552288 - RNA, 18 nt, Chlamydophila pneumoniae TW-183
uccaaucugcugaaggga

SEQ ID NO: 552289 - RNA, 19 nt, Chlamydophila pneumoniae TW-183
uccaauccauucugagaaa

SEQ ID NO: 552290 - RNA, 13 nt, Chlamydophila pneumoniae TW-183
uccaacuucaacu

SEQ ID NO: 552291 - RNA, 20 nt, Chlamydophila pneumoniae TW-183
uccaccaaugauaauuucau

SEQ ID NO: 552292 - RNA, 21 nt, Chlamydophila pneumoniae TW-183
uccacagaucguaaucuguau

SEQ ID NO: 552293 - RNA, 21 nt, Chlamydophila pneumoniae TW-183
uccacgcuaucuccuuguucu

SEQ ID NO: 552294 - RNA, 21 nt, Chlamydophila pneumoniae TW-183
uccauagaguaucuaaaacuu

SEQ ID NO: 552295 - RNA, 15 nt, Chlamydophila pneumoniae TW-183
uccauagaguaucua

SEQ ID NO: 552296 - RNA, 17 nt, Chlamydophila pneumoniae TW-183
uccauaucuagaaguuu

SEQ ID NO: 552297 - RNA, 14 nt, Chlamydophila pneumoniae TW-183
uccauauuacgcac

SEQ ID NO: 552298 - RNA, 16 nt, Chlamydophila pneumoniae TW-183
uccaucggcauuucuc

SEQ ID NO: 552299 - RNA, 16 nt, Chlamydophila pneumoniae TW-183
ucccaauauccagaaa

SEQ ID NO: 552300 - RNA, 18 nt, Chlamydophila pneumoniae TW-183
ucccaauauccagaaaua

SEQ ID NO: 552301 - RNA, 21 nt, Chlamydophila pneumoniae TW-183
uccauuggcauagagccuaga

SEQ ID NO: 552302 - RNA, 18 nt, Chlamydophila pneumoniae TW-183
uccauucugagaaagaag

SEQ ID NO: 552303 - RNA, 13 nt, Chlamydophila pneumoniae TW-183
uccaucucuuuaa

SEQ ID NO: 552304 - RNA, 24 nt, Chlamydophila pneumoniae TW-183
uccccccucacaauauaaaugcua

SEQ ID NO: 552305 - RNA, 16 nt, Chlamydophila pneumoniae TW-183
uccgaauggagaagga

SEQ ID NO: 552306 - RNA, 20 nt, Chlamydophila pneumoniae TW-183
ucccugauguugcccuacaa

SEQ ID NO: 552307 - RNA, 23 nt, Chlamydophila pneumoniae TW-183
ucccuauaaagcaaaugccugua

SEQ ID NO: 552308 - RNA, 22 nt, Chlamydophila pneumoniae TW-183
ucccuauaaagcaaaugccugu

SEQ ID NO: 552309 - RNA, 21 nt, Chlamydophila pneumoniae TW-183
ucccgagggaugaugcccuga

SEQ ID NO: 552310 - RNA, 17 nt, Chlamydophila pneumoniae TW-183
ucccgagauaugaagag

SEQ ID NO: 552311 - RNA, 19 nt, Chlamydophila pneumoniae TW-183
uccccuucaucaauaaaga

SEQ ID NO: 552312 - RNA, 13 nt, Chlamydophila pneumoniae TW-183
ucccgacaagcuu

SEQ ID NO: 552313 - RNA, 16 nt, Chlamydophila pneumoniae TW-183
uccuacuucugcagga

SEQ ID NO: 552314 - RNA, 18 nt, Chlamydophila pneumoniae TW-183
uccuaagucguuaacauc

SEQ ID NO: 552315 - RNA, 17 nt, Chlamydophila pneumoniae TW-183
uccguugaauuaauaaa

SEQ ID NO: 552316 - RNA, 22 nt, Chlamydophila pneumoniae TW-183
uccuccauggaaagaaacaaau

SEQ ID NO: 552317 - RNA, 14 nt, Chlamydophila pneumoniae TW-183
uccucaucagaagc

SEQ ID NO: 552318 - RNA, 18 nt, Chlamydophila pneumoniae TW-183
uccuagggagugaggaau

SEQ ID NO: 552319 - RNA, 15 nt, Chlamydophila pneumoniae TW-183
uccuaugucaagaag

SEQ ID NO: 552320 - RNA, 19 nt, Chlamydophila pneumoniae TW-183
uccuaugucaagaagugcu

SEQ ID NO: 552321 - RNA, 15 nt, Chlamydophila pneumoniae TW-183
uccucaccgaucuca

SEQ ID NO: 552322 - RNA, 14 nt, Chlamydophila pneumoniae TW-183
uccuauuuuuuaag

SEQ ID NO: 552323 - RNA, 19 nt, Chlamydophila pneumoniae TW-183
uccugaggcuauagaauac

SEQ ID NO: 552324 - RNA, 14 nt, Chlamydophila pneumoniae TW-183
uccucucuuuauau

SEQ ID NO: 552325 - RNA, 20 nt, Chlamydophila pneumoniae TW-183
uccucuucuucaucuucuaa

SEQ ID NO: 552326 - RNA, 16 nt, Chlamydophila pneumoniae TW-183
uccucgaauggagugc

SEQ ID NO: 552327 - RNA, 22 nt, Chlamydophila pneumoniae TW-183
uccucuauauuuuuucccacaa

SEQ ID NO: 552328 - RNA, 12 nt, Chlamydophila pneumoniae TW-183
uccguaaguaac

SEQ ID NO: 552329 - RNA, 21 nt, Chlamydophila pneumoniae TW-183
ucgagaaaugcucuucugcag

SEQ ID NO: 552330 - RNA, 15 nt, Chlamydophila pneumoniae TW-183
ucgagagaagaaauu

SEQ ID NO: 552331 - RNA, 20 nt, Chlamydophila pneumoniae TW-183
ucgacaugcaggccaacucu

SEQ ID NO: 552332 - RNA, 12 nt, Chlamydophila pneumoniae TW-183
ucgaauuccucc

SEQ ID NO: 552333 - RNA, 16 nt, Chlamydophila pneumoniae TW-183
uccuuaacaacaucac

SEQ ID NO: 552334 - RNA, 12 nt, Chlamydophila pneumoniae TW-183
ucgcuaccauau

SEQ ID NO: 552335 - RNA, 18 nt, Chlamydophila pneumoniae TW-183
ucucaccagaagcaacua

SEQ ID NO: 552336 - RNA, 13 nt, Chlamydophila pneumoniae TW-183
ucuauuuucagga

SEQ ID NO: 552337 - RNA, 14 nt, Chlamydophila pneumoniae TW-183
ucuauuuucaggag

SEQ ID NO: 552338 - RNA, 17 nt, Chlamydophila pneumoniae TW-183
ucuccacagcuucuucg

SEQ ID NO: 552339 - RNA, 15 nt, Chlamydophila pneumoniae TW-183
ucuccaaaagcucua

SEQ ID NO: 552340 - RNA, 15 nt, Chlamydophila pneumoniae TW-183
ucucaguuaaagagc

SEQ ID NO: 552341 - RNA, 15 nt, Chlamydophila pneumoniae TW-183
ucuccguuuuagauc

SEQ ID NO: 552342 - RNA, 14 nt, Chlamydophila pneumoniae TW-183
ucuagagaagaaaa

SEQ ID NO: 552343 - RNA, 17 nt, Chlamydophila pneumoniae TW-183
ucuagaguugcuuuaug

SEQ ID NO: 552344 - RNA, 13 nt, Chlamydophila pneumoniae TW-183
ucuagaacacuca

SEQ ID NO: 552345 - RNA, 17 nt, Chlamydophila pneumoniae TW-183
ucuagaacacucagaga

SEQ ID NO: 552346 - RNA, 21 nt, Chlamydophila pneumoniae TW-183
ucuagaaaaauucuuuaggga

SEQ ID NO: 552347 - RNA, 13 nt, Chlamydophila pneumoniae TW-183
ucuauaaauuucu

SEQ ID NO: 552348 - RNA, 19 nt, Chlamydophila pneumoniae TW-183
ucuaugagaguaaguuuuu

SEQ ID NO: 552349 - RNA, 23 nt, Chlamydophila pneumoniae TW-183
ucuaugagaguaaguuuuuaauc

SEQ ID NO: 552350 - RNA, 14 nt, Chlamydophila pneumoniae TW-183
ucuauguguucucg

SEQ ID NO: 552351 - RNA, 18 nt, Chlamydophila pneumoniae TW-183
ucuauucgcugucuagaa

SEQ ID NO: 552352 - RNA, 16 nt, Chlamydophila pneumoniae TW-183
ucuacgauguuuucuu

SEQ ID NO: 552353 - RNA, 18 nt, Chlamydophila pneumoniae TW-183
ucuacgcgcucuucuuuc

SEQ ID NO: 552354 - RNA, 23 nt, Chlamydophila pneumoniae TW-183
ucuacgcgcucuucuuucucuau

SEQ ID NO: 552355 - RNA, 16 nt, Chlamydophila pneumoniae TW-183
ucuaaaaucuucucug

SEQ ID NO: 552356 - RNA, 20 nt, Chlamydophila pneumoniae TW-183
ucuaaaagcaaguuguugau

SEQ ID NO: 552357 - RNA, 18 nt, Chlamydophila pneumoniae TW-183
ucuaaaacagaaauugcu

SEQ ID NO: 552358 - RNA, 21 nt, Chlamydophila pneumoniae TW-183
ucguccugacacaacucuuaa

SEQ ID NO: 552359 - RNA, 12 nt, Chlamydophila pneumoniae TW-183
ucguagcuuccc

SEQ ID NO: 552360 - RNA, 20 nt, Chlamydophila pneumoniae TW-183
ucguagcaggcaucacuaau

SEQ ID NO: 552361 - RNA, 19 nt, Chlamydophila pneumoniae TW-183
ucugccauaggauccagga

SEQ ID NO: 552362 - RNA, 17 nt, Chlamydophila pneumoniae TW-183
ucugccuaccaaaguuu

SEQ ID NO: 552363 - RNA, 15 nt, Chlamydophila pneumoniae TW-183
ucuccuugauuuggg

SEQ ID NO: 552364 - RNA, 13 nt, Chlamydophila pneumoniae TW-183
ucugaaacauaag

SEQ ID NO: 552365 - RNA, 16 nt, Chlamydophila pneumoniae TW-183
ucuguagguuuuucca

SEQ ID NO: 552366 - RNA, 15 nt, Chlamydophila pneumoniae TW-183
ucuguagguuuuucc

SEQ ID NO: 552367 - RNA, 17 nt, Chlamydophila pneumoniae TW-183
ucugugacaaaauauuu

SEQ ID NO: 552368 - RNA, 18 nt, Chlamydophila pneumoniae TW-183
ucugggaguuguaaaacu

SEQ ID NO: 552369 - RNA, 16 nt, Chlamydophila pneumoniae TW-183
ucuggcauagcuacaa

SEQ ID NO: 552370 - RNA, 17 nt, Chlamydophila pneumoniae TW-183
ucuucuggcugagagaa

SEQ ID NO: 552371 - RNA, 22 nt, Chlamydophila pneumoniae TW-183
ucuucuugcaaucuuugaagcu

SEQ ID NO: 552372 - RNA, 14 nt, Chlamydophila pneumoniae TW-183
ucuucuucuggcug

SEQ ID NO: 552373 - RNA, 17 nt, Chlamydophila pneumoniae TW-183
ucuucuucaucuucuaa

SEQ ID NO: 552374 - RNA, 16 nt, Chlamydophila pneumoniae TW-183
ucuucuaaaaucuucu

SEQ ID NO: 552375 - RNA, 19 nt, Chlamydophila pneumoniae TW-183
ucuucuaaaaucuucucug

SEQ ID NO: 552376 - RNA, 16 nt, Chlamydophila pneumoniae TW-183
ucuucggaucuguaau

SEQ ID NO: 552377 - RNA, 17 nt, Chlamydophila pneumoniae TW-183
ucuucggaucuguaaua

SEQ ID NO: 552378 - RNA, 20 nt, Chlamydophila pneumoniae TW-183
ucuucauugcaaaaaugaaa

SEQ ID NO: 552379 - RNA, 16 nt, Chlamydophila pneumoniae TW-183
ucuucauugcagauau

SEQ ID NO: 552380 - RNA, 21 nt, Chlamydophila pneumoniae TW-183
uguaacauugaccuaaaggaa

SEQ ID NO: 552381 - RNA, 18 nt, Chlamydophila pneumoniae TW-183
uguaauaaaagaacauua

SEQ ID NO: 552382 - RNA, 14 nt, Chlamydophila pneumoniae TW-183
uguaaaaguagcau

SEQ ID NO: 552383 - RNA, 11 nt, Chlamydophila pneumoniae TW-183
uguaaaaguua

SEQ ID NO: 552384 - RNA, 20 nt, Chlamydophila pneumoniae TW-183
uguaaaacuuagaaaaguga

SEQ ID NO: 552385 - RNA, 22 nt, Chlamydophila pneumoniae TW-183
uguacuuccccaaacauggaca

SEQ ID NO: 552386 - RNA, 22 nt, Chlamydophila pneumoniae TW-183
uguauggugcgcgucuccuuga

SEQ ID NO: 552387 - RNA, 13 nt, Chlamydophila pneumoniae TW-183
uguaugugaaaga

SEQ ID NO: 552388 - RNA, 23 nt, Chlamydophila pneumoniae TW-183
uguauccguagugagguuugcaa

SEQ ID NO: 552389 - RNA, 18 nt, Chlamydophila pneumoniae TW-183
uguauccguagugagguu

SEQ ID NO: 552390 - RNA, 19 nt, Chlamydophila pneumoniae TW-183
uguagucaugauuuuucaa

SEQ ID NO: 552391 - RNA, 19 nt, Chlamydophila pneumoniae TW-183
uguagcauuucuuucucuu

SEQ ID NO: 552392 - RNA, 15 nt, Chlamydophila pneumoniae TW-183
ugguaucccaaucga

SEQ ID NO: 552393 - RNA, 22 nt, Chlamydophila pneumoniae TW-183
ugguguucuucagcccacuguu

SEQ ID NO: 552394 - RNA, 19 nt, Chlamydophila pneumoniae TW-183
ugggcuaggguuucuacag

SEQ ID NO: 552395 - RNA, 15 nt, Chlamydophila pneumoniae TW-183
ugggaugaucucuga

SEQ ID NO: 552396 - RNA, 20 nt, Chlamydophila pneumoniae TW-183
uggccgauaggaagauagcc

SEQ ID NO: 552397 - RNA, 13 nt, Chlamydophila pneumoniae TW-183
uggauuucuccag

SEQ ID NO: 552398 - RNA, 22 nt, Chlamydophila pneumoniae TW-183
uggauuucuccagcagcuuccc

SEQ ID NO: 552399 - RNA, 22 nt, Chlamydophila pneumoniae TW-183
uggauccaucggcauuucucca

SEQ ID NO: 552400 - RNA, 17 nt, Chlamydophila pneumoniae TW-183
uggauauugucaagagg

SEQ ID NO: 552401 - RNA, 14 nt, Chlamydophila pneumoniae TW-183
uggacuccaagaau

SEQ ID NO: 552402 - RNA, 19 nt, Chlamydophila pneumoniae TW-183
uguuuaaguccuucuuccc

SEQ ID NO: 552403 - RNA, 14 nt, Chlamydophila pneumoniae TW-183
uguuguuuuuugau

SEQ ID NO: 552404 - RNA, 15 nt, Chlamydophila pneumoniae TW-183
uguuucgaaaguugg

SEQ ID NO: 552405 - RNA, 21 nt, Chlamydophila pneumoniae TW-183
uguuuugcuucuauuuuagaa

SEQ ID NO: 552406 - RNA, 16 nt, Chlamydophila pneumoniae TW-183
uguuuuugcugaagau

SEQ ID NO: 552407 - RNA, 20 nt, Chlamydophila pneumoniae TW-183
uguuaauagaagaucauuaa

SEQ ID NO: 552408 - RNA, 21 nt, Chlamydophila pneumoniae TW-183
uguuaacaaguaccaagaaaa

SEQ ID NO: 552409 - RNA, 22 nt, Chlamydophila pneumoniae TW-183
ugugguaaaaauauaggcugca

SEQ ID NO: 552410 - RNA, 13 nt, Chlamydophila pneumoniae TW-183
ugugcaugcaucu

SEQ ID NO: 552411 - RNA, 15 nt, Chlamydophila pneumoniae TW-183
ugugcaugcaucuua

SEQ ID NO: 552412 - RNA, 13 nt, Chlamydophila pneumoniae TW-183
uuaccuaaaacaa

SEQ ID NO: 552413 - RNA, 16 nt, Chlamydophila pneumoniae TW-183
uuacuucaagaaaaac

SEQ ID NO: 552414 - RNA, 16 nt, Chlamydophila pneumoniae TW-183
uuacuugcauagauau

SEQ ID NO: 552415 - RNA, 20 nt, Chlamydophila pneumoniae TW-183
uuaucaaaagguuuuauaaa

SEQ ID NO: 552416 - RNA, 11 nt, Chlamydophila pneumoniae TW-183
uuauauuaaga

SEQ ID NO: 552417 - RNA, 12 nt, Chlamydophila pneumoniae TW-183
uuaggucuuaaa

SEQ ID NO: 552418 - RNA, 23 nt, Chlamydophila pneumoniae TW-183
uuagguagauagaaauucuguag

SEQ ID NO: 552419 - RNA, 15 nt, Chlamydophila pneumoniae TW-183
uggacaauauagaga

SEQ ID NO: 552420 - RNA, 19 nt, Chlamydophila pneumoniae TW-183
uggaauauagguuuagauu

SEQ ID NO: 552421 - RNA, 23 nt, Chlamydophila pneumoniae TW-183
uggaauggcuuuuguuuuguauu

SEQ ID NO: 552422 - RNA, 13 nt, Chlamydophila pneumoniae TW-183
uggaauuuuccug

SEQ ID NO: 552423 - RNA, 17 nt, Chlamydophila pneumoniae TW-183
uggaagaauuucauaag

SEQ ID NO: 552424 - RNA, 17 nt, Chlamydophila pneumoniae TW-183
ugcuuggcaauagcuuu

SEQ ID NO: 552425 - RNA, 17 nt, Chlamydophila pneumoniae TW-183
ugcuucuauuuuagaau

SEQ ID NO: 552426 - RNA, 16 nt, Chlamydophila pneumoniae TW-183
ugcuuaaaauucugua

SEQ ID NO: 552427 - RNA, 19 nt, Chlamydophila pneumoniae TW-183
ugcuuaagaguuuuacauc

SEQ ID NO: 552428 - RNA, 16 nt, Chlamydophila pneumoniae TW-183
ugcucuagucuuucaa

SEQ ID NO: 552429 - RNA, 21 nt, Chlamydophila pneumoniae TW-183
ugcuaagcuccauaaaaauag

SEQ ID NO: 552430 - RNA, 22 nt, Chlamydophila pneumoniae TW-183
ugcuauagcuugaaauaauuga

SEQ ID NO: 552431 - RNA, 18 nt, Chlamydophila pneumoniae TW-183
ugcgcagcucggauggac

SEQ ID NO: 552432 - RNA, 18 nt, Chlamydophila pneumoniae TW-183
ugccucaggucugcugag

SEQ ID NO: 552433 - RNA, 19 nt, Chlamydophila pneumoniae TW-183
ugccaggagagcuaacagc

SEQ ID NO: 552434 - RNA, 19 nt, Chlamydophila pneumoniae TW-183
ugcaguccacgcuaucucc

SEQ ID NO: 552435 - RNA, 13 nt, Chlamydophila pneumoniae TW-183
ugccaagagcauc

SEQ ID NO: 552436 - RNA, 13 nt, Chlamydophila pneumoniae TW-183
ugcagaucuuuua

SEQ ID NO: 552437 - RNA, 14 nt, Chlamydophila pneumoniae TW-183
ugcacgagagccuc

SEQ ID NO: 552438 - RNA, 20 nt, Chlamydophila pneumoniae TW-183
ugcaaugcuaagcuccauaa

SEQ ID NO: 552439 - RNA, 16 nt, Chlamydophila pneumoniae TW-183
ugcaaguucacacgua

SEQ ID NO: 552440 - RNA, 22 nt, Chlamydophila pneumoniae TW-183
ugauucucccaauauccagaaa

SEQ ID NO: 552441 - RNA, 15 nt, Chlamydophila pneumoniae TW-183
ugaugccaagaaaua

SEQ ID NO: 552442 - RNA, 13 nt, Chlamydophila pneumoniae TW-183
ugauauuccuuga

SEQ ID NO: 552443 - RNA, 19 nt, Chlamydophila pneumoniae TW-183
ugauaucagcauauuuccg

SEQ ID NO: 552444 - RNA, 21 nt, Chlamydophila pneumoniae TW-183
ugaggcaaagauuuccaaucc

SEQ ID NO: 552445 - RNA, 14 nt, Chlamydophila pneumoniae TW-183
ugaggcuauagaau

SEQ ID NO: 552446 - RNA, 18 nt, Chlamydophila pneumoniae TW-183
ugaggaaucauaaccaaa

SEQ ID NO: 552447 - RNA, 19 nt, Chlamydophila pneumoniae TW-183
ugaggacgcagagaugcua

SEQ ID NO: 552448 - RNA, 18 nt, Chlamydophila pneumoniae TW-183
ugaggauacgaauaaguu

SEQ ID NO: 552449 - RNA, 12 nt, Chlamydophila pneumoniae TW-183
ugagcuucuuua

SEQ ID NO: 552450 - RNA, 13 nt, Chlamydophila pneumoniae TW-183
ugagcucucuagc

SEQ ID NO: 552451 - RNA, 17 nt, Chlamydophila pneumoniae TW-183
ugagcagcuuuaucagg

SEQ ID NO: 552452 - RNA, 17 nt, Chlamydophila pneumoniae TW-183
ugacgcuuuuccaaagc

SEQ ID NO: 552453 - RNA, 18 nt, Chlamydophila pneumoniae TW-183
ugacgcuuuuccaaagca

SEQ ID NO: 552454 - RNA, 23 nt, Chlamydophila pneumoniae TW-183
ugacacucuaucauaucuucaaa

SEQ ID NO: 552455 - RNA, 17 nt, Chlamydophila pneumoniae TW-183
ugacaaauagaaaggaa

SEQ ID NO: 552456 - RNA, 13 nt, Chlamydophila pneumoniae TW-183
ugacaaaauauuu

SEQ ID NO: 552457 - RNA, 19 nt, Chlamydophila pneumoniae TW-183
gaauuuucagccugucuau

SEQ ID NO: 552458 - RNA, 18 nt, Chlamydophila pneumoniae TW-183
gacaaucaacauucuucu

SEQ ID NO: 552459 - RNA, 20 nt, Chlamydophila pneumoniae TW-183
gacaagguggguagccagga

SEQ ID NO: 552460 - RNA, 16 nt, Chlamydophila pneumoniae TW-183
gacaauaaaauagccc

SEQ ID NO: 552461 - RNA, 23 nt, Chlamydophila pneumoniae TW-183
gacacaaaaagcuuuuuucucuu

SEQ ID NO: 552462 - RNA, 19 nt, Chlamydophila pneumoniae TW-183
gaccuucucaagaucuuca

SEQ ID NO: 552463 - RNA, 19 nt, Chlamydophila pneumoniae TW-183
gaccucuagcucaaaucuc

SEQ ID NO: 552464 - RNA, 23 nt, Chlamydophila pneumoniae TW-183
gaccuguaguaaaauaagaaauc

SEQ ID NO: 552465 - RNA, 15 nt, Chlamydophila pneumoniae TW-183
gaccuguaguaaaau

SEQ ID NO: 552466 - RNA, 21 nt, Chlamydophila pneumoniae TW-183
gaccuguuuucuuuucugaag

SEQ ID NO: 552467 - RNA, 19 nt, Chlamydophila pneumoniae TW-183
gaccugcaaacuccccagu

SEQ ID NO: 552468 - RNA, 21 nt, Chlamydophila pneumoniae TW-183
gaccucuguagguuuuuccaa

SEQ ID NO: 552469 - RNA, 21 nt, Chlamydophila pneumoniae TW-183
gagaggaaaucccgagauaug

SEQ ID NO: 552470 - RNA, 20 nt, Chlamydophila pneumoniae TW-183
gagagcuuuuagguagagaa

SEQ ID NO: 552471 - RNA, 15 nt, Chlamydophila pneumoniae TW-183
gagagguaggcagug

SEQ ID NO: 552472 - RNA, 13 nt, Chlamydophila pneumoniae TW-183
gagagaagaaauu

SEQ ID NO: 552473 - RNA, 16 nt, Chlamydophila pneumoniae TW-183
gagaaucuccucauca

SEQ ID NO: 552474 - RNA, 18 nt, Chlamydophila pneumoniae TW-183
gagaauacagagucugug

SEQ ID NO: 552475 - RNA, 12 nt, Chlamydophila pneumoniae TW-183
gagaacuucaac

SEQ ID NO: 552476 - RNA, 17 nt, Chlamydophila pneumoniae TW-183
gagaacuucaacaaagg

SEQ ID NO: 552477 - RNA, 16 nt, Chlamydophila pneumoniae TW-183
gagaaagagugccaag

SEQ ID NO: 552478 - RNA, 18 nt, Chlamydophila pneumoniae TW-183
gagaaaugcucuucugca

SEQ ID NO: 552479 - RNA, 19 nt, Chlamydophila pneumoniae TW-183
gagaaagucgauuuccuuu

SEQ ID NO: 552480 - RNA, 21 nt, Chlamydophila pneumoniae TW-183
gagaacaugcccccacaaaac

SEQ ID NO: 552481 - RNA, 18 nt, Chlamydophila pneumoniae TW-183
gacuucuggaagcuguug

SEQ ID NO: 552482 - RNA, 22 nt, Chlamydophila pneumoniae TW-183
gacuucuggaagcuguuguucu

SEQ ID NO: 552483 - RNA, 14 nt, Chlamydophila pneumoniae TW-183
gacuucucucuuaa

SEQ ID NO: 552484 - RNA, 16 nt, Chlamydophila pneumoniae TW-183
gacuugcaagcuucuu

SEQ ID NO: 552485 - RNA, 20 nt, Chlamydophila pneumoniae TW-183
gacuugcaagcuucuuguuu

SEQ ID NO: 552486 - RNA, 23 nt, Chlamydophila pneumoniae TW-183
gacucucaucagcaaaacucccg

SEQ ID NO: 552487 - RNA, 14 nt, Chlamydophila pneumoniae TW-183
gacucucaucagca

SEQ ID NO: 552488 - RNA, 23 nt, Chlamydophila pneumoniae TW-183
gacugaaaagaucguuaucaaaa

SEQ ID NO: 552489 - RNA, 10 nt, Chlamydophila pneumoniae TW-183
gacugaaacu

SEQ ID NO: 552490 - RNA, 15 nt, Chlamydophila pneumoniae TW-183
gacuccaagaauagc

SEQ ID NO: 552491 - RNA, 19 nt, Chlamydophila pneumoniae TW-183
gacuccaagaauagcagga

SEQ ID NO: 552492 - RNA, 22 nt, Chlamydophila pneumoniae TW-183
gacguuaauaaagaggcuccca

SEQ ID NO: 552493 - RNA, 20 nt, Chlamydophila pneumoniae TW-183
gacguugcgaacagcuccug

SEQ ID NO: 552494 - RNA, 16 nt, Chlamydophila pneumoniae TW-183
gacgucuccaacaguc

SEQ ID NO: 552495 - RNA, 16 nt, Chlamydophila pneumoniae TW-183
gaggauucuuuuugau

SEQ ID NO: 552496 - RNA, 14 nt, Chlamydophila pneumoniae TW-183
gaggaguuuuccaa

SEQ ID NO: 552497 - RNA, 15 nt, Chlamydophila pneumoniae TW-183
gaggaacgcacgcca

SEQ ID NO: 552498 - RNA, 12 nt, Chlamydophila pneumoniae TW-183
gaggaaugaaga

SEQ ID NO: 552499 - RNA, 21 nt, Chlamydophila pneumoniae TW-183
gaggaaucugaaucucauaag

SEQ ID NO: 552500 - RNA, 14 nt, Chlamydophila pneumoniae TW-183
gaggacgaaucaau

SEQ ID NO: 552501 - RNA, 15 nt, Chlamydophila pneumoniae TW-183
gagcuguuucugcaa

SEQ ID NO: 552502 - RNA, 21 nt, Chlamydophila pneumoniae TW-183
gagcuucuuuagauagcucuu

SEQ ID NO: 552503 - RNA, 22 nt, Chlamydophila pneumoniae TW-183
gagcuucuuuagauagcucuuu

SEQ ID NO: 552504 - RNA, 20 nt, Chlamydophila pneumoniae TW-183
gagcucguaauccuucuuuc

SEQ ID NO: 552505 - RNA, 17 nt, Chlamydophila pneumoniae TW-183
gagcucaucaaugagaa

SEQ ID NO: 552506 - RNA, 12 nt, Chlamydophila pneumoniae TW-183
gagcggaauuuc

SEQ ID NO: 552507 - RNA, 21 nt, Chlamydophila pneumoniae TW-183
gagccaacagguucacuucau

SEQ ID NO: 552508 - RNA, 18 nt, Chlamydophila pneumoniae TW-183
gagcagaaacuccaaaau

SEQ ID NO: 552509 - RNA, 21 nt, Chlamydophila pneumoniae TW-183
gagaugccauaagcaagcaac

SEQ ID NO: 552510 - RNA, 15 nt, Chlamydophila pneumoniae TW-183
gagauugccaggaga

SEQ ID NO: 552511 - RNA, 17 nt, Chlamydophila pneumoniae TW-183
gagauccuccuggaaga

SEQ ID NO: 552512 - RNA, 13 nt, Chlamydophila pneumoniae TW-183
gagugacucauca

SEQ ID NO: 552513 - RNA, 14 nt, Chlamydophila pneumoniae TW-183
gaguccuucuuuuc

SEQ ID NO: 552514 - RNA, 13 nt, Chlamydophila pneumoniae TW-183
gaguagccccagc

SEQ ID NO: 552515 - RNA, 22 nt, Chlamydophila pneumoniae TW-183
gaguugccaggaaacguucuuu

SEQ ID NO: 552516 - RNA, 15 nt, Chlamydophila pneumoniae TW-183
gaguuugauagagaa

SEQ ID NO: 552517 - RNA, 13 nt, Chlamydophila pneumoniae TW-183
gauaagauaaaga

SEQ ID NO: 552518 - RNA, 19 nt, Chlamydophila pneumoniae TW-183
gauaaagacaucucuuuaa

SEQ ID NO: 552519 - RNA, 13 nt, Chlamydophila pneumoniae TW-183
gaguuuuacauca

SEQ ID NO: 552520 - RNA, 23 nt, Chlamydophila pneumoniae TW-183
gaguuuuuguguuugacugaaac

SEQ ID NO: 552521 - RNA, 13 nt, Chlamydophila pneumoniae TW-183
gaguuuuuuucuu

SEQ ID NO: 552522 - RNA, 22 nt, Chlamydophila pneumoniae TW-183
gaguuuuuuucuuauagggaau

SEQ ID NO: 552523 - RNA, 13 nt, Chlamydophila pneumoniae TW-183
gagggucucagca

SEQ ID NO: 552524 - RNA, 23 nt, Chlamydophila pneumoniae TW-183
gagggguaaaccaauugagcucu

SEQ ID NO: 552525 - RNA, 21 nt, Chlamydophila pneumoniae TW-183
gaggcuagaaaaucauacgcc

SEQ ID NO: 552526 - RNA, 21 nt, Chlamydophila pneumoniae TW-183
gaggcggagguacguaucuuc

SEQ ID NO: 552527 - RNA, 16 nt, Chlamydophila pneumoniae TW-183
gauagggaccaugauc

SEQ ID NO: 552528 - RNA, 18 nt, Chlamydophila pneumoniae TW-183
gauagggaccaugaucuu

SEQ ID NO: 552529 - RNA, 21 nt, Chlamydophila pneumoniae TW-183
gauaggaaccacuuuagaauu

SEQ ID NO: 552530 - RNA, 17 nt, Chlamydophila pneumoniae TW-183
gauagcucuuugauuuu

SEQ ID NO: 552531 - RNA, 15 nt, Chlamydophila pneumoniae TW-183
gauagcugaugcuga

SEQ ID NO: 552532 - RNA, 17 nt, Chlamydophila pneumoniae TW-183
gaucagaaaaaaugcgu

SEQ ID NO: 552533 - RNA, 11 nt, Chlamydophila pneumoniae TW-183
gauauauagag

SEQ ID NO: 552534 - RNA, 16 nt, Chlamydophila pneumoniae TW-183
gaucacauagaaaaca

SEQ ID NO: 552535 - RNA, 17 nt, Chlamydophila pneumoniae TW-183
gaucacauagaaaacau

SEQ ID NO: 552536 - RNA, 18 nt, Chlamydophila pneumoniae TW-183
gaugccauuguagagauu

SEQ ID NO: 552537 - RNA, 17 nt, Chlamydophila pneumoniae TW-183
gaucuucagagagaaca

SEQ ID NO: 552538 - RNA, 14 nt, Chlamydophila pneumoniae TW-183
gaucuuagcuccug

SEQ ID NO: 552539 - RNA, 23 nt, Chlamydophila pneumoniae TW-183
gaucuuuugauaacuuugcauga

SEQ ID NO: 552540 - RNA, 18 nt, Chlamydophila pneumoniae TW-183
gaucuugagaaaagaaca

SEQ ID NO: 552541 - RNA, 13 nt, Chlamydophila pneumoniae TW-183
gaucuauguagau

SEQ ID NO: 552542 - RNA, 18 nt, Chlamydophila pneumoniae TW-183
gaucucaguaggagcagc

SEQ ID NO: 552543 - RNA, 22 nt, Chlamydophila pneumoniae TW-183
gaucucaguaggagcagcggca

SEQ ID NO: 552544 - RNA, 20 nt, Chlamydophila pneumoniae TW-183
gauuuccccuucagaggcua

SEQ ID NO: 552545 - RNA, 17 nt, Chlamydophila pneumoniae TW-183
gauuuccccuucagagg

SEQ ID NO: 552546 - RNA, 23 nt, Chlamydophila pneumoniae TW-183
gauuuccaauccauucugagaaa

SEQ ID NO: 552547 - RNA, 21 nt, Chlamydophila pneumoniae TW-183
gauuuugcagugauaaaccaa

SEQ ID NO: 552548 - RNA, 17 nt, Chlamydophila pneumoniae TW-183
gauuuucuuagcuucca

SEQ ID NO: 552549 - RNA, 14 nt, Chlamydophila pneumoniae TW-183
gauucguagcuucc

SEQ ID NO: 552550 - RNA, 13 nt, Chlamydophila pneumoniae TW-183
gauucuacaaauu

SEQ ID NO: 552551 - RNA, 13 nt, Chlamydophila pneumoniae TW-183
gauuccugaggcu

SEQ ID NO: 552552 - RNA, 22 nt, Chlamydophila pneumoniae TW-183
gauuacagcaucuauagaauuu

SEQ ID NO: 552553 - RNA, 22 nt, Chlamydophila pneumoniae TW-183
gauguuauaagugacuuuucuu

SEQ ID NO: 552554 - RNA, 17 nt, Chlamydophila pneumoniae TW-183
gauguuguggaucagaa

SEQ ID NO: 552555 - RNA, 16 nt, Chlamydophila pneumoniae TW-183
gcaguugcaauaccaa

SEQ ID NO: 552556 - RNA, 15 nt, Chlamydophila pneumoniae TW-183
gcaggaguuuucaag

SEQ ID NO: 552557 - RNA, 17 nt, Chlamydophila pneumoniae TW-183
gcagcucggauggacua

SEQ ID NO: 552558 - RNA, 18 nt, Chlamydophila pneumoniae TW-183
gcagcuucccaagcagaa

SEQ ID NO: 552559 - RNA, 22 nt, Chlamydophila pneumoniae TW-183
gcaggaagucaccuuacaucca

SEQ ID NO: 552560 - RNA, 13 nt, Chlamydophila pneumoniae TW-183
gcagaucuuuuau

SEQ ID NO: 552561 - RNA, 23 nt, Chlamydophila pneumoniae TW-183
gcagagucucaguugagaaccuu

SEQ ID NO: 552562 - RNA, 18 nt, Chlamydophila pneumoniae TW-183
gcagaguccuucuuuucc

SEQ ID NO: 552563 - RNA, 10 nt, Chlamydophila pneumoniae TW-183
gcacuuuccg

SEQ ID NO: 552564 - RNA, 23 nt, Chlamydophila pneumoniae TW-183
gcacccaaacugaugccaagaaa

SEQ ID NO: 552565 - RNA, 21 nt, Chlamydophila pneumoniae TW-183
gcaauacaccaagggaugcca

SEQ ID NO: 552566 - RNA, 22 nt, Chlamydophila pneumoniae TW-183
gcaaguuguugauaauuacaga

SEQ ID NO: 552567 - RNA, 19 nt, Chlamydophila pneumoniae TW-183
gcaagcuguggcgauuuua

SEQ ID NO: 552568 - RNA, 14 nt, Chlamydophila pneumoniae TW-183
gcaaggagcucccu

SEQ ID NO: 552569 - RNA, 19 nt, Chlamydophila pneumoniae TW-183
gcaacaacgccuacaugga

SEQ ID NO: 552570 - RNA, 18 nt, Chlamydophila pneumoniae TW-183
gcuaaucaauccaagaau

SEQ ID NO: 552571 - RNA, 16 nt, Chlamydophila pneumoniae TW-183
gcuacaaaauuauuaa

SEQ ID NO: 552572 - RNA, 17 nt, Chlamydophila pneumoniae TW-183
gcuacaaaauuauuaaa

SEQ ID NO: 552573 - RNA, 20 nt, Chlamydophila pneumoniae TW-183
gcuaccuuaguuuuuucuaa

SEQ ID NO: 552574 - RNA, 18 nt, Chlamydophila pneumoniae TW-183
gcguucuugaaucuucaa

SEQ ID NO: 552575 - RNA, 18 nt, Chlamydophila pneumoniae TW-183
gcguuuuuugaaaauuuu

SEQ ID NO: 552576 - RNA, 13 nt, Chlamydophila pneumoniae TW-183
gcgcuacagugac

SEQ ID NO: 552577 - RNA, 15 nt, Chlamydophila pneumoniae TW-183
gcgaccuaggagaaa

SEQ ID NO: 552578 - RNA, 17 nt, Chlamydophila pneumoniae TW-183
gccuugauugaacaguc

SEQ ID NO: 552579 - RNA, 17 nt, Chlamydophila pneumoniae TW-183
gccuuccauaucuagaa

SEQ ID NO: 552580 - RNA, 23 nt, Chlamydophila pneumoniae TW-183
gccuggggaucuuaggaaauuug

SEQ ID NO: 552581 - RNA, 20 nt, Chlamydophila pneumoniae TW-183
gccuguaauugauguuccuu

SEQ ID NO: 552582 - RNA, 16 nt, Chlamydophila pneumoniae TW-183
gccucuacccucugag

SEQ ID NO: 552583 - RNA, 15 nt, Chlamydophila pneumoniae TW-183
gccugcacgucugca

SEQ ID NO: 552584 - RNA, 13 nt, Chlamydophila pneumoniae TW-183
gccuaccaaaguu

SEQ ID NO: 552585 - RNA, 21 nt, Chlamydophila pneumoniae TW-183
gccagcgaucacauagaaaac

SEQ ID NO: 552586 - RNA, 21 nt, Chlamydophila pneumoniae TW-183
gccacuaaguuuaggcaggaa

SEQ ID NO: 552587 - RNA, 20 nt, Chlamydophila pneumoniae TW-183
gcauagauaucuuugggaga

SEQ ID NO: 552588 - RNA, 22 nt, Chlamydophila pneumoniae TW-183
gcauagccuuccauaucuagaa

SEQ ID NO: 552589 - RNA, 21 nt, Chlamydophila pneumoniae TW-183
uagaagguguuuuggcugcuu

SEQ ID NO: 552590 - RNA, 16 nt, Chlamydophila pneumoniae TW-183
uagaauacacagcuau

SEQ ID NO: 552591 - RNA, 23 nt, Chlamydophila pneumoniae TW-183
uagaaucagagggacuccuguga

SEQ ID NO: 552592 - RNA, 20 nt, Chlamydophila pneumoniae TW-183
uagaacagcauggacuccaa

SEQ ID NO: 552593 - RNA, 22 nt, Chlamydophila pneumoniae TW-183
uagaacagcauggacuccaaga

SEQ ID NO: 552594 - RNA, 16 nt, Chlamydophila pneumoniae TW-183
uagaacacucagagau

SEQ ID NO: 552595 - RNA, 13 nt, Chlamydophila pneumoniae TW-183
uagaaaggaaucc

SEQ ID NO: 552596 - RNA, 17 nt, Chlamydophila pneumoniae TW-183
uagaggguccagggucu

SEQ ID NO: 552597 - RNA, 20 nt, Chlamydophila pneumoniae TW-183
uagagauuaccgaagagccc

SEQ ID NO: 552598 - RNA, 22 nt, Chlamydophila pneumoniae TW-183
uagagauucauaaaacuguaau

SEQ ID NO: 552599 - RNA, 17 nt, Chlamydophila pneumoniae TW-183
uagagagcgcagagucu

SEQ ID NO: 552600 - RNA, 19 nt, Chlamydophila pneumoniae TW-183
uagagcaagauucuucaga

SEQ ID NO: 552601 - RNA, 23 nt, Chlamydophila pneumoniae TW-183
uagagcaagauucuucagaaucu

SEQ ID NO: 552602 - RNA, 16 nt, Chlamydophila pneumoniae TW-183
uagaguugacaauagg

SEQ ID NO: 552603 - RNA, 16 nt, Chlamydophila pneumoniae TW-183
uagagggauuuguagg

SEQ ID NO: 552604 - RNA, 15 nt, Chlamydophila pneumoniae TW-183
uagagaagaaaagag

SEQ ID NO: 552605 - RNA, 23 nt, Chlamydophila pneumoniae TW-183
uagagaagaaaagagcucaucaa

SEQ ID NO: 552606 - RNA, 12 nt, Chlamydophila pneumoniae TW-183
uagagaaaauaa

SEQ ID NO: 552607 - RNA, 18 nt, Chlamydophila pneumoniae TW-183
uaggguuugcaugccuau

SEQ ID NO: 552608 - RNA, 13 nt, Chlamydophila pneumoniae TW-183
uaggguucucaaa

SEQ ID NO: 552609 - RNA, 21 nt, Chlamydophila pneumoniae TW-183
uaggguuugcaugccuauuaa

SEQ ID NO: 552610 - RNA, 23 nt, Chlamydophila pneumoniae TW-183
uagggagugaggaaucauaacca

SEQ ID NO: 552611 - RNA, 21 nt, Chlamydophila pneumoniae TW-183
uagggaauuuuuucuguuccu

SEQ ID NO: 552612 - RNA, 14 nt, Chlamydophila pneumoniae TW-183
uaggaagaugaaua

SEQ ID NO: 552613 - RNA, 21 nt, Chlamydophila pneumoniae TW-183
uaggagggguaaaccaauuga

SEQ ID NO: 552614 - RNA, 18 nt, Chlamydophila pneumoniae TW-183
uagcucaaaucucauucc

SEQ ID NO: 552615 - RNA, 22 nt, Chlamydophila pneumoniae TW-183
uagcucuugcgaacuauccuaa

SEQ ID NO: 552616 - RNA, 18 nt, Chlamydophila pneumoniae TW-183
uagaucguuucuaucucc

SEQ ID NO: 552617 - RNA, 18 nt, Chlamydophila pneumoniae TW-183
uagauaugccucaggucu

SEQ ID NO: 552618 - RNA, 22 nt, Chlamydophila pneumoniae TW-183
uagauagcucuuugauuuucuu

SEQ ID NO: 552619 - RNA, 16 nt, Chlamydophila pneumoniae TW-183
uagcauuucuuucucu

SEQ ID NO: 552620 - RNA, 17 nt, Chlamydophila pneumoniae TW-183
uagcauuucuuucucuu

SEQ ID NO: 552621 - RNA, 20 nt, Chlamydophila pneumoniae TW-183
uagcauagccuuccauaucu

SEQ ID NO: 552622 - RNA, 23 nt, Chlamydophila pneumoniae TW-183
uagccuuacggccccuggaauuu

SEQ ID NO: 552623 - RNA, 22 nt, Chlamydophila pneumoniae TW-183
uagccguaggguagccauccac

SEQ ID NO: 552624 - RNA, 21 nt, Chlamydophila pneumoniae TW-183
uaucuagaaguuuaaacgucu

SEQ ID NO: 552625 - RNA, 16 nt, Chlamydophila pneumoniae TW-183
uaucauggacaagcaa

SEQ ID NO: 552626 - RNA, 18 nt, Chlamydophila pneumoniae TW-183
uauccuugaaauugcucu

SEQ ID NO: 552627 - RNA, 16 nt, Chlamydophila pneumoniae TW-183
uauccuuucaucagca

SEQ ID NO: 552628 - RNA, 16 nt, Chlamydophila pneumoniae TW-183
uaucgaccuuaaaauu

SEQ ID NO: 552629 - RNA, 17 nt, Chlamydophila pneumoniae TW-183
uauaggcugcacacauc

SEQ ID NO: 552630 - RNA, 15 nt, Chlamydophila pneumoniae TW-183
uaucauaucuucaaa

SEQ ID NO: 552631 - RNA, 16 nt, Chlamydophila pneumoniae TW-183
uauagauuuugugagg

SEQ ID NO: 552632 - RNA, 17 nt, Chlamydophila pneumoniae TW-183
uauagauaugccucagg

SEQ ID NO: 552633 - RNA, 14 nt, Chlamydophila pneumoniae TW-183
uagucuuucuaaga

SEQ ID NO: 552634 - RNA, 15 nt, Chlamydophila pneumoniae TW-183
uagucuuucuaagaa

SEQ ID NO: 552635 - RNA, 15 nt, Chlamydophila pneumoniae TW-183
uagucuuucaaccuc

SEQ ID NO: 552636 - RNA, 21 nt, Chlamydophila pneumoniae TW-183
uagugaacuuuuguacacaga

SEQ ID NO: 552637 - RNA, 17 nt, Chlamydophila pneumoniae TW-183
uagguagauagaaauuc

SEQ ID NO: 552638 - RNA, 18 nt, Chlamydophila pneumoniae TW-183
uaguuucccacuagcccu

SEQ ID NO: 552639 - RNA, 19 nt, Chlamydophila pneumoniae TW-183
uacgccgugccuauagaaa

SEQ ID NO: 552640 - RNA, 20 nt, Chlamydophila pneumoniae TW-183
uacgcaaguaaagaaauucu

SEQ ID NO: 552641 - RNA, 14 nt, Chlamydophila pneumoniae TW-183
uacgcuuuuuacug

SEQ ID NO: 552642 - RNA, 15 nt, Chlamydophila pneumoniae TW-183
uaccauagaaagaua

SEQ ID NO: 552643 - RNA, 16 nt, Chlamydophila pneumoniae TW-183
uaccgaccgaaucucu

SEQ ID NO: 552644 - RNA, 19 nt, Chlamydophila pneumoniae TW-183
uaccgaccgaaucucucca

SEQ ID NO: 552645 - RNA, 21 nt, Chlamydophila pneumoniae TW-183
uaccaaccuucgauuccaggc

SEQ ID NO: 552646 - RNA, 20 nt, Chlamydophila pneumoniae TW-183
uaccaaggcagguaucuccu

SEQ ID NO: 552647 - RNA, 22 nt, Chlamydophila pneumoniae TW-183
uacauuugauucauaaagagga

SEQ ID NO: 552648 - RNA, 14 nt, Chlamydophila pneumoniae TW-183
uacagcaaccacau

SEQ ID NO: 552649 - RNA, 22 nt, Chlamydophila pneumoniae TW-183
uacaaucucuagggauaauuaa

SEQ ID NO: 552650 - RNA, 16 nt, Chlamydophila pneumoniae TW-183
uacaauacuggagagg

SEQ ID NO: 552651 - RNA, 13 nt, Chlamydophila pneumoniae TW-183
uacaauacuggag

SEQ ID NO: 552652 - RNA, 14 nt, Chlamydophila pneumoniae TW-183
uaauaaaagaacau

SEQ ID NO: 552653 - RNA, 17 nt, Chlamydophila pneumoniae TW-183
uaaguugguccaucgag

SEQ ID NO: 552654 - RNA, 13 nt, Chlamydophila pneumoniae TW-183
uaaguucuuccaa

SEQ ID NO: 552655 - RNA, 15 nt, Chlamydophila pneumoniae TW-183
uaaguucuuaagaau

SEQ ID NO: 552656 - RNA, 18 nt, Chlamydophila pneumoniae TW-183
uaagugacuuuucuucuu

SEQ ID NO: 552657 - RNA, 17 nt, Chlamydophila pneumoniae TW-183
uaagugauaaggaagaa

SEQ ID NO: 552658 - RNA, 18 nt, Chlamydophila pneumoniae TW-183
uaaggacaaaucucccaa

SEQ ID NO: 552659 - RNA, 19 nt, Chlamydophila pneumoniae TW-183
uaaggacaaaucucccaaa

SEQ ID NO: 552660 - RNA, 14 nt, Chlamydophila pneumoniae TW-183
uaauagaagaucau

SEQ ID NO: 552661 - RNA, 12 nt, Chlamydophila pneumoniae TW-183
uaaucuguauau

SEQ ID NO: 552662 - RNA, 15 nt, Chlamydophila pneumoniae TW-183
uaagcgcucuucaau

SEQ ID NO: 552663 - RNA, 15 nt, Chlamydophila pneumoniae TW-183
uaaggacaaaucucc

SEQ ID NO: 552664 - RNA, 23 nt, Chlamydophila pneumoniae TW-183
uaaggaagaauuucgucuucaua

SEQ ID NO: 552665 - RNA, 16 nt, Chlamydophila pneumoniae TW-183
uaaggaagagaguuuu

SEQ ID NO: 552666 - RNA, 17 nt, Chlamydophila pneumoniae TW-183
uaagcugugcauuuucu

SEQ ID NO: 552667 - RNA, 15 nt, Chlamydophila pneumoniae TW-183
uaagcugcaaucuca

SEQ ID NO: 552668 - RNA, 17 nt, Chlamydophila pneumoniae TW-183
uaagcugcaaucucaaa

SEQ ID NO: 552669 - RNA, 15 nt, Chlamydophila pneumoniae TW-183
uaagcugaaagaaca

SEQ ID NO: 552670 - RNA, 22 nt, Chlamydophila pneumoniae TW-183
uaagcaagcaacugauguuuua

SEQ ID NO: 552671 - RNA, 20 nt, Chlamydophila pneumoniae TW-183
uaagauaucgaccuuaaaau

SEQ ID NO: 552672 - RNA, 21 nt, Chlamydophila pneumoniae TW-183
uaagaguuuuacaucaaugau

SEQ ID NO: 552673 - RNA, 12 nt, Chlamydophila pneumoniae TW-183
uaagaggaaagc

SEQ ID NO: 552674 - RNA, 15 nt, Chlamydophila pneumoniae TW-183
uaagagaacuuuaac

SEQ ID NO: 552675 - RNA, 22 nt, Chlamydophila pneumoniae TW-183
uaagacaagguggguagccagg

SEQ ID NO: 552676 - RNA, 22 nt, Chlamydophila pneumoniae TW-183
uaacuucuaaaagcaaguuguu

SEQ ID NO: 552677 - RNA, 23 nt, Chlamydophila pneumoniae TW-183
uaacguacgcaaguaaagaaauu

SEQ ID NO: 552678 - RNA, 17 nt, Chlamydophila pneumoniae TW-183
uaacaaguaccaagaaa

SEQ ID NO: 552679 - RNA, 14 nt, Chlamydophila pneumoniae TW-183
uaacaacuucacau

SEQ ID NO: 552680 - RNA, 20 nt, Chlamydophila pneumoniae TW-183
uaaauuuuuccuucaacaca

SEQ ID NO: 552681 - RNA, 20 nt, Chlamydophila pneumoniae TW-183
uaaccaaaagaauuaagaag

SEQ ID NO: 552682 - RNA, 13 nt, Chlamydophila pneumoniae TW-183
uaacauagauaag

SEQ ID NO: 552683 - RNA, 13 nt, Chlamydophila pneumoniae TW-183
uaacauaaaguca

SEQ ID NO: 552684 - RNA, 19 nt, Chlamydophila pneumoniae TW-183
uaaagugucauacgcagca

SEQ ID NO: 552685 - RNA, 18 nt, Chlamydophila pneumoniae TW-183
uaaagugucauacgcagc

SEQ ID NO: 552686 - RNA, 19 nt, Chlamydophila pneumoniae TW-183
uaaauccaccaaugauaau

SEQ ID NO: 552687 - RNA, 14 nt, Chlamydophila pneumoniae TW-183
uaaagaaauucugg

SEQ ID NO: 552688 - RNA, 23 nt, Chlamydophila pneumoniae TW-183
uaaagaucgggucuacaacaguu

SEQ ID NO: 552689 - RNA, 14 nt, Chlamydophila pneumoniae TW-183
uaaagcaaaugccu

SEQ ID NO: 552690 - RNA, 19 nt, Chlamydophila pneumoniae TW-183
uaaaggaaucucgggagaa

SEQ ID NO: 552691 - RNA, 18 nt, Chlamydophila pneumoniae TW-183
uaaaggaccuguuuucuu

SEQ ID NO: 552692 - RNA, 18 nt, Chlamydophila pneumoniae TW-183
uaaacucuccaaaagcuc

SEQ ID NO: 552693 - RNA, 17 nt, Chlamydophila pneumoniae TW-183
uaaaacuacaggaaaac

SEQ ID NO: 552694 - RNA, 12 nt, Chlamydophila pneumoniae TW-183
uaaaauaagaaa

SEQ ID NO: 552695 - RNA, 14 nt, Chlamydophila pneumoniae TW-183
uaaaauaagaaauc

SEQ ID NO: 552696 - RNA, 12 nt, Chlamydophila pneumoniae TW-183
guuuagguaggc

SEQ ID NO: 552697 - RNA, 22 nt, Chlamydophila pneumoniae TW-183
guuucuacgcgcucuucuuucu

SEQ ID NO: 552698 - RNA, 19 nt, Chlamydophila pneumoniae TW-183
guuuccgaucauuuuugcu

SEQ ID NO: 552699 - RNA, 23 nt, Chlamydophila pneumoniae TW-183
guuggauccaucggcauuucucc

SEQ ID NO: 552700 - RNA, 20 nt, Chlamydophila pneumoniae TW-183
guuggauccaucggcauuuc

SEQ ID NO: 552701 - RNA, 23 nt, Chlamydophila pneumoniae TW-183
guugcgaacagcuccuggauauu

SEQ ID NO: 552702 - RNA, 12 nt, Chlamydophila pneumoniae TW-183
guucuuuuugca

SEQ ID NO: 552703 - RNA, 15 nt, Chlamydophila pneumoniae TW-183
guucuugauuuucaa

SEQ ID NO: 552704 - RNA, 20 nt, Chlamydophila pneumoniae TW-183
guuccuacuucugcaggacu

SEQ ID NO: 552705 - RNA, 16 nt, Chlamydophila pneumoniae TW-183
guguggguacaggggg

SEQ ID NO: 552706 - RNA, 14 nt, Chlamydophila pneumoniae TW-183
guguaaaaguuagg

SEQ ID NO: 552707 - RNA, 16 nt, Chlamydophila pneumoniae TW-183
guggguagccaggaug

SEQ ID NO: 552708 - RNA, 20 nt, Chlamydophila pneumoniae TW-183
gugcuguuuuuucacuuaca

SEQ ID NO: 552709 - RNA, 15 nt, Chlamydophila pneumoniae TW-183
gugcucggcacuuac

SEQ ID NO: 552710 - RNA, 14 nt, Chlamydophila pneumoniae TW-183
gugaucuugagaaa

SEQ ID NO: 552711 - RNA, 17 nt, Chlamydophila pneumoniae TW-183
gugcaaguucacacgua

SEQ ID NO: 552712 - RNA, 14 nt, Chlamydophila pneumoniae TW-183
gugcauuuucuucu

SEQ ID NO: 552713 - RNA, 12 nt, Chlamydophila pneumoniae TW-183
guccuucuuccc

SEQ ID NO: 552714 - RNA, 14 nt, Chlamydophila pneumoniae TW-183
guccgcagauuuua

SEQ ID NO: 552715 - RNA, 13 nt, Chlamydophila pneumoniae TW-183
gucaguaaaacac

SEQ ID NO: 552716 - RNA, 17 nt, Chlamydophila pneumoniae TW-183
gucaagaagugcuuuua

SEQ ID NO: 552717 - RNA, 14 nt, Chlamydophila pneumoniae TW-183
guagguuuuuccaa

SEQ ID NO: 552718 - RNA, 16 nt, Chlamydophila pneumoniae TW-183
guaguaggcacuuauc

SEQ ID NO: 552719 - RNA, 22 nt, Chlamydophila pneumoniae TW-183
guagucaugauuuuucaaucaa

SEQ ID NO: 552720 - RNA, 15 nt, Chlamydophila pneumoniae TW-183
guagucaugauuuuu

SEQ ID NO: 552721 - RNA, 17 nt, Chlamydophila pneumoniae TW-183
guaguuucuaaaacaga

SEQ ID NO: 552722 - RNA, 19 nt, Chlamydophila pneumoniae TW-183
guaguuucuaaaacagaaa

SEQ ID NO: 552723 - RNA, 22 nt, Chlamydophila pneumoniae TW-183
guagcuacaaaauuauuaaacu

SEQ ID NO: 552724 - RNA, 17 nt, Chlamydophila pneumoniae TW-183
guagcuauuuuugagga

SEQ ID NO: 552725 - RNA, 21 nt, Chlamydophila pneumoniae TW-183
guagccguaggguagccaucc

SEQ ID NO: 552726 - RNA, 16 nt, Chlamydophila pneumoniae TW-183
guagagcaagauucuu

SEQ ID NO: 552727 - RNA, 14 nt, Chlamydophila pneumoniae TW-183
guaccaagaaaaua

SEQ ID NO: 552728 - RNA, 20 nt, Chlamydophila pneumoniae TW-183
guaaaguaugcauagccucg

SEQ ID NO: 552729 - RNA, 19 nt, Chlamydophila pneumoniae TW-183
guaaauuuuuccuucaaca

SEQ ID NO: 552730 - RNA, 20 nt, Chlamydophila pneumoniae TW-183
guaaauuuuuccuucaacac

SEQ ID NO: 552731 - RNA, 20 nt, Chlamydophila pneumoniae TW-183
guaaaccaauugagcucucu

SEQ ID NO: 552732 - RNA, 13 nt, Chlamydophila pneumoniae TW-183
guaaccagagagc

SEQ ID NO: 552733 - RNA, 19 nt, Chlamydophila pneumoniae TW-183
guaacauugaccuaaagga

SEQ ID NO: 552734 - RNA, 22 nt, Chlamydophila pneumoniae TW-183
guaaguaaccaauacagcauaa

SEQ ID NO: 552735 - RNA, 18 nt, Chlamydophila pneumoniae TW-183
guaagcugcaaucucaaa

SEQ ID NO: 552736 - RNA, 18 nt, Chlamydophila pneumoniae TW-183
guaauccuucuuucugcu

SEQ ID NO: 552737 - RNA, 23 nt, Chlamydophila pneumoniae TW-183
guaauccuucuuucugcucuucu

SEQ ID NO: 552738 - RNA, 12 nt, Chlamydophila pneumoniae TW-183
ggugacuaaaca

SEQ ID NO: 552739 - RNA, 24 nt, Chlamydophila pneumoniae TW-183
ggugacuaaacaccuucuucuaaa

SEQ ID NO: 552740 - RNA, 14 nt, Chlamydophila pneumoniae TW-183
gguagcuuaagaau

SEQ ID NO: 552741 - RNA, 14 nt, Chlamydophila pneumoniae TW-183
gguaaaacuacagg

SEQ ID NO: 552742 - RNA, 19 nt, Chlamydophila pneumoniae TW-183
gggauaggcaagauuauga

SEQ ID NO: 552743 - RNA, 16 nt, Chlamydophila pneumoniae TW-183
gggaucuucagagaga

SEQ ID NO: 552744 - RNA, 14 nt, Chlamydophila pneumoniae TW-183
gggagucucuggag

SEQ ID NO: 552745 - RNA, 21 nt, Chlamydophila pneumoniae TW-183
ggcucucaaggucacagcauu

SEQ ID NO: 552746 - RNA, 22 nt, Chlamydophila pneumoniae TW-183
ggcucuaggacccguagccccu

SEQ ID NO: 552747 - RNA, 16 nt, Chlamydophila pneumoniae TW-183
ggcucuauaaauuucu

SEQ ID NO: 552748 - RNA, 15 nt, Chlamydophila pneumoniae TW-183
ggcucuauaggggau

SEQ ID NO: 552749 - RNA, 12 nt, Chlamydophila pneumoniae TW-183
ggcuccagcaua

SEQ ID NO: 552750 - RNA, 18 nt, Chlamydophila pneumoniae TW-183
ggcuauagaauacacagc

SEQ ID NO: 552751 - RNA, 13 nt, Chlamydophila pneumoniae TW-183
ggcuauagauacu

SEQ ID NO: 552752 - RNA, 16 nt, Chlamydophila pneumoniae TW-183
ggcauuucuccacaug

SEQ ID NO: 552753 - RNA, 15 nt, Chlamydophila pneumoniae TW-183
ggcaauagcuuugaa

SEQ ID NO: 552754 - RNA, 15 nt, Chlamydophila pneumoniae TW-183
ggcaacaagagcgca

SEQ ID NO: 552755 - RNA, 20 nt, Chlamydophila pneumoniae TW-183
ggcaacaacgccuacaugga

SEQ ID NO: 552756 - RNA, 18 nt, Chlamydophila pneumoniae TW-183
ggauggacuacugaaaca

SEQ ID NO: 552757 - RNA, 20 nt, Chlamydophila pneumoniae TW-183
ggagugaggaaucauaacca

SEQ ID NO: 552758 - RNA, 18 nt, Chlamydophila pneumoniae TW-183
ggaguucuugauucucuu

SEQ ID NO: 552759 - RNA, 22 nt, Chlamydophila pneumoniae TW-183
ggagcgaaguuuuucuggaaga

SEQ ID NO: 552760 - RNA, 17 nt, Chlamydophila pneumoniae TW-183
ggagauccugaaaaaag

SEQ ID NO: 552761 - RNA, 22 nt, Chlamydophila pneumoniae TW-183
ggagauaaagauguagaauaac

SEQ ID NO: 552762 - RNA, 13 nt, Chlamydophila pneumoniae TW-183
ggaccuguuuucu

SEQ ID NO: 552763 - RNA, 21 nt, Chlamydophila pneumoniae TW-183
ggaccuguuuucuuuucugaa

SEQ ID NO: 552764 - RNA, 15 nt, Chlamydophila pneumoniae TW-183
ggaaucccuuuuuaa

SEQ ID NO: 552765 - RNA, 13 nt, Chlamydophila pneumoniae TW-183
ggacaacagcaac

SEQ ID NO: 552766 - RNA, 17 nt, Chlamydophila pneumoniae TW-183
ggaaucucgggagaaca

SEQ ID NO: 552767 - RNA, 22 nt, Chlamydophila pneumoniae TW-183
cugcuucaaaacauaaccuccu

SEQ ID NO: 552768 - RNA, 18 nt, Chlamydophila pneumoniae TW-183
cugcuuuuguuguuuuug

SEQ ID NO: 552769 - RNA, 22 nt, Chlamydophila pneumoniae TW-183
cugaugccaagaaauauacugc

SEQ ID NO: 552770 - RNA, 22 nt, Chlamydophila pneumoniae TW-183
cugauucucccaauauccagaa

SEQ ID NO: 552771 - RNA, 15 nt, Chlamydophila pneumoniae TW-183
cugagaaguuaagac

SEQ ID NO: 552772 - RNA, 22 nt, Chlamydophila pneumoniae TW-183
cugacuauagggagacucuuga

SEQ ID NO: 552773 - RNA, 16 nt, Chlamydophila pneumoniae TW-183
cugaagggacagucuc

SEQ ID NO: 552774 - RNA, 13 nt, Chlamydophila pneumoniae TW-183
cugaagauuuuuu

SEQ ID NO: 552775 - RNA, 10 nt, Chlamydophila pneumoniae TW-183
cugaagauuu

SEQ ID NO: 552776 - RNA, 15 nt, Chlamydophila pneumoniae TW-183
cugaagaggccugca

SEQ ID NO: 552777 - RNA, 20 nt, Chlamydophila pneumoniae TW-183
cucuuugauuuucuuagcuu

SEQ ID NO: 552778 - RNA, 20 nt, Chlamydophila pneumoniae TW-183
cucuuuauauuuuuugagaa

SEQ ID NO: 552779 - RNA, 23 nt, Chlamydophila pneumoniae TW-183
cucuuuauauuuuuugagaaaua

SEQ ID NO: 552780 - RNA, 18 nt, Chlamydophila pneumoniae TW-183
cucuuuaaauguugggau

SEQ ID NO: 552781 - RNA, 22 nt, Chlamydophila pneumoniae TW-183
cucuuuaaaagggcgcuucccu

SEQ ID NO: 552782 - RNA, 16 nt, Chlamydophila pneumoniae TW-183
cucuugcucuagucuu

SEQ ID NO: 552783 - RNA, 23 nt, Chlamydophila pneumoniae TW-183
cucuucuuucucuaucucucgga

SEQ ID NO: 552784 - RNA, 21 nt, Chlamydophila pneumoniae TW-183
cucuucgcuggcauguuuaau

SEQ ID NO: 552785 - RNA, 21 nt, Chlamydophila pneumoniae TW-183
cucugggaagacucucaucag

SEQ ID NO: 552786 - RNA, 16 nt, Chlamydophila pneumoniae TW-183
cucugugguuccugga

SEQ ID NO: 552787 - RNA, 16 nt, Chlamydophila pneumoniae TW-183
cucuuauugcagaauc

SEQ ID NO: 552788 - RNA, 20 nt, Chlamydophila pneumoniae TW-183
cucuuaauuuuuuuagcaau

SEQ ID NO: 552789 - RNA, 21 nt, Chlamydophila pneumoniae TW-183
cucugacuugcaagcuucuug

SEQ ID NO: 552790 - RNA, 15 nt, Chlamydophila pneumoniae TW-183
cucugagcagcuucg

SEQ ID NO: 552791 - RNA, 18 nt, Chlamydophila pneumoniae TW-183
cucugagucgacaugcag

SEQ ID NO: 552792 - RNA, 18 nt, Chlamydophila pneumoniae TW-183
cucucuuuauauuuuuug

SEQ ID NO: 552793 - RNA, 16 nt, Chlamydophila pneumoniae TW-183
cucucugccuaccaaa

SEQ ID NO: 552794 - RNA, 15 nt, Chlamydophila pneumoniae TW-183
cucucugccuaccaa

SEQ ID NO: 552795 - RNA, 16 nt, Chlamydophila pneumoniae TW-183
cucucuccaugagcuc

SEQ ID NO: 552796 - RNA, 23 nt, Chlamydophila pneumoniae TW-183
cucuccuaaugccgagaauacag

SEQ ID NO: 552797 - RNA, 14 nt, Chlamydophila pneumoniae TW-183
cucuccuccccacu

SEQ ID NO: 552798 - RNA, 13 nt, Chlamydophila pneumoniae TW-183
cucuccaaaagcu

SEQ ID NO: 552799 - RNA, 16 nt, Chlamydophila pneumoniae TW-183
cucuccagcuugauca

SEQ ID NO: 552800 - RNA, 12 nt, Chlamydophila pneumoniae TW-183
cucuauauuuuu

SEQ ID NO: 552801 - RNA, 19 nt, Chlamydophila pneumoniae TW-183
cucuauauuuuuucccaca

SEQ ID NO: 552802 - RNA, 17 nt, Chlamydophila pneumoniae TW-183
cucuagcucaaaucuca

SEQ ID NO: 552803 - RNA, 16 nt, Chlamydophila pneumoniae TW-183
cucuauaaauuucuca

SEQ ID NO: 552804 - RNA, 20 nt, Chlamydophila pneumoniae TW-183
cucguagcuauuuuugagga

SEQ ID NO: 552805 - RNA, 16 nt, Chlamydophila pneumoniae TW-183
cuccuugauaaaacgc

SEQ ID NO: 552806 - RNA, 22 nt, Chlamydophila pneumoniae TW-183
cuccuggaagaauuucauaaga

SEQ ID NO: 552807 - RNA, 17 nt, Chlamydophila pneumoniae TW-183
cuccaguaucuucucuu

SEQ ID NO: 552808 - RNA, 20 nt, Chlamydophila pneumoniae TW-183
cucaugcggacuuuauucuc

SEQ ID NO: 552809 - RNA, 19 nt, Chlamydophila pneumoniae TW-183
cucaugcggacuuuauucu

SEQ ID NO: 552810 - RNA, 20 nt, Chlamydophila pneumoniae TW-183
cucaucagcaaaacucccga

SEQ ID NO: 552811 - RNA, 17 nt, Chlamydophila pneumoniae TW-183
cucaucagcaaaacucc

SEQ ID NO: 552812 - RNA, 15 nt, Chlamydophila pneumoniae TW-183
cuauuacuagauccc

SEQ ID NO: 552813 - RNA, 13 nt, Chlamydophila pneumoniae TW-183
cuauuaagucacc

SEQ ID NO: 552814 - RNA, 22 nt, Chlamydophila pneumoniae TW-183
cucaagcgauuucgaaaaagcc

SEQ ID NO: 552815 - RNA, 15 nt, Chlamydophila pneumoniae TW-183
cucaaggucacagca

SEQ ID NO: 552816 - RNA, 22 nt, Chlamydophila pneumoniae TW-183
cucaaggucacagcauuuucuc

SEQ ID NO: 552817 - RNA, 17 nt, Chlamydophila pneumoniae TW-183
cucaaggucacagcauu

SEQ ID NO: 552818 - RNA, 19 nt, Chlamydophila pneumoniae TW-183
cucaauaguguaacauuga

SEQ ID NO: 552819 - RNA, 13 nt, Chlamydophila pneumoniae TW-183
cuauauuuuuucc

SEQ ID NO: 552820 - RNA, 14 nt, Chlamydophila pneumoniae TW-183
cuagguucuuuuuu

SEQ ID NO: 552821 - RNA, 22 nt, Chlamydophila pneumoniae TW-183
cuauaguauaauagugagcucc

SEQ ID NO: 552822 - RNA, 14 nt, Chlamydophila pneumoniae TW-183
cuaugucaagaagu

SEQ ID NO: 552823 - RNA, 23 nt, Chlamydophila pneumoniae TW-183
cuaugaugagaacguccucaccu

SEQ ID NO: 552824 - RNA, 16 nt, Chlamydophila pneumoniae TW-183
cuaucauaucuucaaa

SEQ ID NO: 552825 - RNA, 15 nt, Chlamydophila pneumoniae TW-183
cuagcaccuaauaaa

SEQ ID NO: 552826 - RNA, 13 nt, Chlamydophila pneumoniae TW-183
cuacuuacaagaa

SEQ ID NO: 552827 - RNA, 20 nt, Chlamydophila pneumoniae TW-183
cuaaacucuccaaaagcucu

SEQ ID NO: 552828 - RNA, 14 nt, Chlamydophila pneumoniae TW-183
cuaaaacaaaauca

SEQ ID NO: 552829 - RNA, 16 nt, Chlamydophila pneumoniae TW-183
cuaaauagaaaacaua

SEQ ID NO: 552830 - RNA, 23 nt, Chlamydophila pneumoniae TW-183
cuaaaucaacuacaucuccaagc

SEQ ID NO: 552831 - RNA, 13 nt, Chlamydophila pneumoniae TW-183
cguuaauaaagag

SEQ ID NO: 552832 - RNA, 14 nt, Chlamydophila pneumoniae TW-183
cguuaaaaacuauc

SEQ ID NO: 552833 - RNA, 18 nt, Chlamydophila pneumoniae TW-183
cguucuuucaauaacaga

SEQ ID NO: 552834 - RNA, 15 nt, Chlamydophila pneumoniae TW-183
cgugcaaguucacac

SEQ ID NO: 552835 - RNA, 16 nt, Chlamydophila pneumoniae TW-183
cgucaguaaaacacaa

SEQ ID NO: 552836 - RNA, 19 nt, Chlamydophila pneumoniae TW-183
cguaagcugcaaucucaaa

SEQ ID NO: 552837 - RNA, 17 nt, Chlamydophila pneumoniae TW-183
cguaagcugcaaucuca

SEQ ID NO: 552838 - RNA, 22 nt, Chlamydophila pneumoniae TW-183
cguaguauccuuucaucagcau

SEQ ID NO: 552839 - RNA, 20 nt, Chlamydophila pneumoniae TW-183
cguauggauuucuccagcag

SEQ ID NO: 552840 - RNA, 16 nt, Chlamydophila pneumoniae TW-183
cguauaaggauguugu

SEQ ID NO: 552841 - RNA, 16 nt, Chlamydophila pneumoniae TW-183
cguaugcaucaaugaa

SEQ ID NO: 552842 - RNA, 18 nt, Chlamydophila pneumoniae TW-183
cguccagccugcaccaga

SEQ ID NO: 552843 - RNA, 15 nt, Chlamydophila pneumoniae TW-183
aaacuaagaauaccu

SEQ ID NO: 552844 - RNA, 17 nt, Chlamydophila pneumoniae TW-183
aaacuaaaucaacuaca

SEQ ID NO: 552845 - RNA, 16 nt, Chlamydophila pneumoniae TW-183
cgguaaugccagcagc

SEQ ID NO: 552846 - RNA, 16 nt, Chlamydophila pneumoniae TW-183
cgguaaccugugaaaa

SEQ ID NO: 552847 - RNA, 14 nt, Chlamydophila pneumoniae TW-183
cggcucucuucauu

SEQ ID NO: 552848 - RNA, 16 nt, Chlamydophila pneumoniae TW-183
cuucaagaaaaacccc

SEQ ID NO: 552849 - RNA, 21 nt, Chlamydophila pneumoniae TW-183
cuucacuauuaggcuuuuuuc

SEQ ID NO: 552850 - RNA, 21 nt, Chlamydophila pneumoniae TW-183
cuucagcacgaauaaagcccu

SEQ ID NO: 552851 - RNA, 20 nt, Chlamydophila pneumoniae TW-183
cuuccgugcgauuuccccuu

SEQ ID NO: 552852 - RNA, 12 nt, Chlamydophila pneumoniae TW-183
aaacuucucuag

SEQ ID NO: 552853 - RNA, 16 nt, Chlamydophila pneumoniae TW-183
cuuaggguucucaaag

SEQ ID NO: 552854 - RNA, 15 nt, Chlamydophila pneumoniae TW-183
cuuaggguucucaaa

SEQ ID NO: 552855 - RNA, 17 nt, Chlamydophila pneumoniae TW-183
cuuaucaagagcucgua

SEQ ID NO: 552856 - RNA, 13 nt, Chlamydophila pneumoniae TW-183
cuguuuacagaug

SEQ ID NO: 552857 - RNA, 23 nt, Chlamydophila pneumoniae TW-183
cuguuucugcaaugcuaagcucc

SEQ ID NO: 552858 - RNA, 23 nt, Chlamydophila pneumoniae TW-183
cuuaaagguaaaacuacaggaaa

SEQ ID NO: 552859 - RNA, 14 nt, Chlamydophila pneumoniae TW-183
cuuaaaaaaaauua

SEQ ID NO: 552860 - RNA, 16 nt, Chlamydophila pneumoniae TW-183
cuuaaaaaaaauuacu

SEQ ID NO: 552861 - RNA, 17 nt, Chlamydophila pneumoniae TW-183
cuugcugauuucuuuuu

SEQ ID NO: 552862 - RNA, 20 nt, Chlamydophila pneumoniae TW-183
cuugcugauuucuuuuucag

SEQ ID NO: 552863 - RNA, 12 nt, Chlamydophila pneumoniae TW-183
aaacuucuugug

SEQ ID NO: 552864 - RNA, 22 nt, Chlamydophila pneumoniae TW-183
aaacuuguuuucguaagagaau

SEQ ID NO: 552865 - RNA, 15 nt, Chlamydophila pneumoniae TW-183
cuugcgacauaacca

SEQ ID NO: 552866 - RNA, 18 nt, Chlamydophila pneumoniae TW-183
cuugcagcgacaacacgc

SEQ ID NO: 552867 - RNA, 18 nt, Chlamydophila pneumoniae TW-183
cuugcagcccugcauagu

SEQ ID NO: 552868 - RNA, 21 nt, Chlamydophila pneumoniae TW-183
cuugcaaaacagcaucaggau

SEQ ID NO: 552869 - RNA, 24 nt, Chlamydophila pneumoniae TW-183
cuugcaaaacagcaucaggauucu

SEQ ID NO: 552870 - RNA, 16 nt, Chlamydophila pneumoniae TW-183
cuugcaaucuuugaag

SEQ ID NO: 552871 - RNA, 12 nt, Chlamydophila pneumoniae TW-183
cuugaucaggau

SEQ ID NO: 552872 - RNA, 17 nt, Chlamydophila pneumoniae TW-183
cuugagaaaagaacagg

SEQ ID NO: 552873 - RNA, 18 nt, Chlamydophila pneumoniae TW-183
cuugagaaaagaacaggg

SEQ ID NO: 552874 - RNA, 22 nt, Chlamydophila pneumoniae TW-183
cuugacuaaauccaccaaugau

SEQ ID NO: 552875 - RNA, 20 nt, Chlamydophila pneumoniae TW-183
cuucuuuagauagcucuuug

SEQ ID NO: 552876 - RNA, 12 nt, Chlamydophila pneumoniae TW-183
cuugaacaucuc

SEQ ID NO: 552877 - RNA, 15 nt, Chlamydophila pneumoniae TW-183
cuugaacaucucgaa

SEQ ID NO: 552878 - RNA, 15 nt, Chlamydophila pneumoniae TW-183
cuugaaauugcucuu

SEQ ID NO: 552879 - RNA, 15 nt, Chlamydophila pneumoniae TW-183
cuucuucggaucugu

SEQ ID NO: 552880 - RNA, 20 nt, Chlamydophila pneumoniae TW-183
cuucuucguaagcugcaauc

SEQ ID NO: 552881 - RNA, 17 nt, Chlamydophila pneumoniae TW-183
cuucuucgccuacaagu

SEQ ID NO: 552882 - RNA, 22 nt, Chlamydophila pneumoniae TW-183
cuucuucuggcugagagaagca

SEQ ID NO: 552883 - RNA, 20 nt, Chlamydophila pneumoniae TW-183
cuucuucuggcugagagaag

SEQ ID NO: 552884 - RNA, 17 nt, Chlamydophila pneumoniae TW-183
cuucuugcaaucuuuga

SEQ ID NO: 552885 - RNA, 16 nt, Chlamydophila pneumoniae TW-183
cuucuggcugagagaa

SEQ ID NO: 552886 - RNA, 14 nt, Chlamydophila pneumoniae TW-183
cuucugucuguauu

SEQ ID NO: 552887 - RNA, 17 nt, Chlamydophila pneumoniae TW-183
cuucuaaaaucuucucu

SEQ ID NO: 552888 - RNA, 18 nt, Chlamydophila pneumoniae TW-183
cuucucaagaucuucauc

SEQ ID NO: 552889 - RNA, 21 nt, Chlamydophila pneumoniae TW-183
cuucucuuaugaaguccagac

SEQ ID NO: 552890 - RNA, 13 nt, Chlamydophila pneumoniae TW-183
cuuucagaaagaa

SEQ ID NO: 552891 - RNA, 17 nt, Chlamydophila pneumoniae TW-183
cuuucaaccuccgcucu

SEQ ID NO: 552892 - RNA, 18 nt, Chlamydophila pneumoniae TW-183
cuuuauggcucaacuuaa

SEQ ID NO: 552893 - RNA, 20 nt, Chlamydophila pneumoniae TW-183
cuuuauggcucaacuuaagu

SEQ ID NO: 552894 - RNA, 22 nt, Chlamydophila pneumoniae TW-183
aaagaagguugagacguaacca

SEQ ID NO: 552895 - RNA, 17 nt, Chlamydophila pneumoniae TW-183
aaagaauuaagaagaag

SEQ ID NO: 552896 - RNA, 19 nt, Chlamydophila pneumoniae TW-183
cuuugaggcaagucucaaa

SEQ ID NO: 552897 - RNA, 16 nt, Chlamydophila pneumoniae TW-183
cuuucugcucuucuau

SEQ ID NO: 552898 - RNA, 18 nt, Chlamydophila pneumoniae TW-183
cuuuccagggcauucucu

SEQ ID NO: 552899 - RNA, 21 nt, Chlamydophila pneumoniae TW-183
cuuuccucucuuuauauuuuu

SEQ ID NO: 552900 - RNA, 22 nt, Chlamydophila pneumoniae TW-183
cuuguuaugaugauccacugcu

SEQ ID NO: 552901 - RNA, 15 nt, Chlamydophila pneumoniae TW-183
cuuguuucuguuuuc

SEQ ID NO: 552902 - RNA, 15 nt, Chlamydophila pneumoniae TW-183
cuuguugcaauugcc

SEQ ID NO: 552903 - RNA, 16 nt, Chlamydophila pneumoniae TW-183
cuuguucuuuucauca

SEQ ID NO: 552904 - RNA, 17 nt, Chlamydophila pneumoniae TW-183
cuuguucuuuucaucaa

SEQ ID NO: 552905 - RNA, 17 nt, Chlamydophila pneumoniae TW-183
cuuguucuugaacaucu

SEQ ID NO: 552906 - RNA, 17 nt, Chlamydophila pneumoniae TW-183
cuuuuagagguuuuugu

SEQ ID NO: 552907 - RNA, 16 nt, Chlamydophila pneumoniae TW-183
cuuuuauauuaagaau

SEQ ID NO: 552908 - RNA, 19 nt, Chlamydophila pneumoniae TW-183
cuuuuucagcuucuacagc

SEQ ID NO: 552909 - RNA, 14 nt, Chlamydophila pneumoniae TW-183
cuuuuucagcuucu

SEQ ID NO: 552910 - RNA, 15 nt, Chlamydophila pneumoniae TW-183
gaaaccagaacacau

SEQ ID NO: 552911 - RNA, 20 nt, Chlamydophila pneumoniae TW-183
gaaacacucaugaaagugcu

SEQ ID NO: 552912 - RNA, 23 nt, Chlamydophila pneumoniae TW-183
gaaaauaguacgcuuuuuacuga

SEQ ID NO: 552913 - RNA, 18 nt, Chlamydophila pneumoniae TW-183
gaaagagugccaagagca

SEQ ID NO: 552914 - RNA, 23 nt, Chlamydophila pneumoniae TW-183
gaaagaaguccuagggagugagg

SEQ ID NO: 552915 - RNA, 12 nt, Chlamydophila pneumoniae TW-183
gaaagaaacaaa

SEQ ID NO: 552916 - RNA, 14 nt, Chlamydophila pneumoniae TW-183
gaaauauacugcca

SEQ ID NO: 552917 - RNA, 18 nt, Chlamydophila pneumoniae TW-183
gaacaguauaaucagaag

SEQ ID NO: 552918 - RNA, 17 nt, Chlamydophila pneumoniae TW-183
gaaaugcucuucugcag

SEQ ID NO: 552919 - RNA, 16 nt, Chlamydophila pneumoniae TW-183
aaagagcucaaaaagu

SEQ ID NO: 552920 - RNA, 14 nt, Chlamydophila pneumoniae TW-183
aaagagcucaaaaa

SEQ ID NO: 552921 - RNA, 20 nt, Chlamydophila pneumoniae TW-183
aaagagcucaaaaaguucca

SEQ ID NO: 552922 - RNA, 15 nt, Chlamydophila pneumoniae TW-183
gauaucgaccuuaaa

SEQ ID NO: 552923 - RNA, 14 nt, Chlamydophila pneumoniae TW-183
gauauugcggaaau

SEQ ID NO: 552924 - RNA, 23 nt, Chlamydophila pneumoniae TW-183
gauagcgucuguuaacucagaga

SEQ ID NO: 552925 - RNA, 17 nt, Chlamydophila pneumoniae TW-183
gauaaggaagagaguuu

SEQ ID NO: 552926 - RNA, 14 nt, Chlamydophila pneumoniae TW-183
gauaaguucuucca

SEQ ID NO: 552927 - RNA, 15 nt, Chlamydophila pneumoniae TW-183
gauaaguucuuccaa

SEQ ID NO: 552928 - RNA, 22 nt, Chlamydophila pneumoniae TW-183
gagugcucuaccccacgcuaaa

SEQ ID NO: 552929 - RNA, 13 nt, Chlamydophila pneumoniae TW-183
gaguuagcuuuug

SEQ ID NO: 552930 - RNA, 17 nt, Chlamydophila pneumoniae TW-183
gaguucuuguaauaaaa

SEQ ID NO: 552931 - RNA, 14 nt, Chlamydophila pneumoniae TW-183
gaguucuugauucu

SEQ ID NO: 552932 - RNA, 12 nt, Chlamydophila pneumoniae TW-183
gaguuuuccuaa

SEQ ID NO: 552933 - RNA, 15 nt, Chlamydophila pneumoniae TW-183
gaguugccaggaaac

SEQ ID NO: 552934 - RNA, 17 nt, Chlamydophila pneumoniae TW-183
gagucucuggaguuuga

SEQ ID NO: 552935 - RNA, 16 nt, Chlamydophila pneumoniae TW-183
gagguucgcagaacuu

SEQ ID NO: 552936 - RNA, 20 nt, Chlamydophila pneumoniae TW-183
gagguucgcagaacuucucc

SEQ ID NO: 552937 - RNA, 22 nt, Chlamydophila pneumoniae TW-183
gagguucgcagaacuucuccaa

SEQ ID NO: 552938 - RNA, 14 nt, Chlamydophila pneumoniae TW-183
gaggcuagaaaauc

SEQ ID NO: 552939 - RNA, 15 nt, Chlamydophila pneumoniae TW-183
gaggcaagucucaaa

SEQ ID NO: 552940 - RNA, 11 nt, Chlamydophila pneumoniae TW-183
gagggauuugu

SEQ ID NO: 552941 - RNA, 11 nt, Chlamydophila pneumoniae TW-183
gaggcaaagau

SEQ ID NO: 552942 - RNA, 22 nt, Chlamydophila pneumoniae TW-183
gaggaaucauaaccaaaagaau

SEQ ID NO: 552943 - RNA, 13 nt, Chlamydophila pneumoniae TW-183
gaggaaugaagag

SEQ ID NO: 552944 - RNA, 15 nt, Chlamydophila pneumoniae TW-183
gaggacgcagagaug

SEQ ID NO: 552945 - RNA, 21 nt, Chlamydophila pneumoniae TW-183
gagcauccuguagccacuaag

SEQ ID NO: 552946 - RNA, 17 nt, Chlamydophila pneumoniae TW-183
gagaugcuucuaaacaa

SEQ ID NO: 552947 - RNA, 14 nt, Chlamydophila pneumoniae TW-183
gagaugcuaacaac

SEQ ID NO: 552948 - RNA, 22 nt, Chlamydophila pneumoniae TW-183
gagaguucuuguaauaaaagaa

SEQ ID NO: 552949 - RNA, 21 nt, Chlamydophila pneumoniae TW-183
gagagaagcagaaucugugag

SEQ ID NO: 552950 - RNA, 13 nt, Chlamydophila pneumoniae TW-183
gagacuucucucu

SEQ ID NO: 552951 - RNA, 16 nt, Chlamydophila pneumoniae TW-183
gagacuucucucuuaa

SEQ ID NO: 552952 - RNA, 12 nt, Chlamydophila pneumoniae TW-183
gagaaugcugua

SEQ ID NO: 552953 - RNA, 22 nt, Chlamydophila pneumoniae TW-183
gagaacuuuaacgaagaaggga

SEQ ID NO: 552954 - RNA, 14 nt, Chlamydophila pneumoniae TW-183
gagaacauguuucu

SEQ ID NO: 552955 - RNA, 22 nt, Chlamydophila pneumoniae TW-183
gagaaccuucacaagaaaacaa

SEQ ID NO: 552956 - RNA, 13 nt, Chlamydophila pneumoniae TW-183
gagaaaucacacu

SEQ ID NO: 552957 - RNA, 13 nt, Chlamydophila pneumoniae TW-183
gagaaaauaagca

SEQ ID NO: 552958 - RNA, 12 nt, Chlamydophila pneumoniae TW-183
gacuuuccucuc

SEQ ID NO: 552959 - RNA, 11 nt, Chlamydophila pneumoniae TW-183
gacugaaacuc

SEQ ID NO: 552960 - RNA, 20 nt, Chlamydophila pneumoniae TW-183
gaccuucucaagaucuucau

SEQ ID NO: 552961 - RNA, 13 nt, Chlamydophila pneumoniae TW-183
gaccuguuuucuu

SEQ ID NO: 552962 - RNA, 19 nt, Chlamydophila pneumoniae TW-183
gacacagcuaaucaaucca

SEQ ID NO: 552963 - RNA, 10 nt, Chlamydophila pneumoniae TW-183
gaauuccucu

SEQ ID NO: 552964 - RNA, 12 nt, Chlamydophila pneumoniae TW-183
gaauuuuccuga

SEQ ID NO: 552965 - RNA, 16 nt, Chlamydophila pneumoniae TW-183
gaauuuucuuuugcag

SEQ ID NO: 552966 - RNA, 15 nt, Chlamydophila pneumoniae TW-183
gacaaauagaaagga

SEQ ID NO: 552967 - RNA, 14 nt, Chlamydophila pneumoniae TW-183
gacaauauagagau

SEQ ID NO: 552968 - RNA, 14 nt, Chlamydophila pneumoniae TW-183
gaaucagauuagag

SEQ ID NO: 552969 - RNA, 15 nt, Chlamydophila pneumoniae TW-183
gaaucagauuagagu

SEQ ID NO: 552970 - RNA, 19 nt, Chlamydophila pneumoniae TW-183
gaaugccaaaccucuuagc

SEQ ID NO: 552971 - RNA, 18 nt, Chlamydophila pneumoniae TW-183
gaaucucauaaguauaga

SEQ ID NO: 552972 - RNA, 17 nt, Chlamydophila pneumoniae TW-183
gaaucucgggagaacau

SEQ ID NO: 552973 - RNA, 18 nt, Chlamydophila pneumoniae TW-183
gaauaucaucacuaagau

SEQ ID NO: 552974 - RNA, 22 nt, Chlamydophila pneumoniae TW-183
gaaguccuagggagugaggaau

SEQ ID NO: 552975 - RNA, 18 nt, Chlamydophila pneumoniae TW-183
gaagucccacaaaugaua

SEQ ID NO: 552976 - RNA, 23 nt, Chlamydophila pneumoniae TW-183
gaagugaucuugagaaaagaaca

SEQ ID NO: 552977 - RNA, 23 nt, Chlamydophila pneumoniae TW-183
gaagugcuuuuagagguuuuugu

SEQ ID NO: 552978 - RNA, 21 nt, Chlamydophila pneumoniae TW-183
gaagguguuuuggcugcuuuu

SEQ ID NO: 552979 - RNA, 19 nt, Chlamydophila pneumoniae TW-183
gaaguauucgauuccugag

SEQ ID NO: 552980 - RNA, 16 nt, Chlamydophila pneumoniae TW-183
gaaggcuuguuucugu

SEQ ID NO: 552981 - RNA, 19 nt, Chlamydophila pneumoniae TW-183
gaaguugaaaugagugaga

SEQ ID NO: 552982 - RNA, 15 nt, Chlamydophila pneumoniae TW-183
gaaguuuaaacgucu

SEQ ID NO: 552983 - RNA, 15 nt, Chlamydophila pneumoniae TW-183
gaagcaguuuaggua

SEQ ID NO: 552984 - RNA, 15 nt, Chlamydophila pneumoniae TW-183
gaagagaguuuuugg

SEQ ID NO: 552985 - RNA, 18 nt, Chlamydophila pneumoniae TW-183
gaagacccucgaaccacu

SEQ ID NO: 552986 - RNA, 23 nt, Chlamydophila pneumoniae TW-183
gaacaugcccccacaaaaccugg

SEQ ID NO: 552987 - RNA, 14 nt, Chlamydophila pneumoniae TW-183
gaagacacagggga

SEQ ID NO: 552988 - RNA, 17 nt, Chlamydophila pneumoniae TW-183
gaagaauuucauaagag

SEQ ID NO: 552989 - RNA, 20 nt, Chlamydophila pneumoniae TW-183
gaagaauuucauaagagaac

SEQ ID NO: 552990 - RNA, 13 nt, Chlamydophila pneumoniae TW-183
gaagaagggacuu

SEQ ID NO: 552991 - RNA, 14 nt, Chlamydophila pneumoniae TW-183
ggcuauagaauaca

SEQ ID NO: 552992 - RNA, 12 nt, Chlamydophila pneumoniae TW-183
ggcguuuuugca

SEQ ID NO: 552993 - RNA, 23 nt, Chlamydophila pneumoniae TW-183
aaauacguccagccugcaccaga

SEQ ID NO: 552994 - RNA, 22 nt, Chlamydophila pneumoniae TW-183
aaauaaaaaaacccucaaagaa

SEQ ID NO: 552995 - RNA, 20 nt, Chlamydophila pneumoniae TW-183
aaaguuuguagcauuucuuu

SEQ ID NO: 552996 - RNA, 23 nt, Chlamydophila pneumoniae TW-183
aaaguuagguagauagaaauucu

SEQ ID NO: 552997 - RNA, 23 nt, Chlamydophila pneumoniae TW-183
ggccaguuacugucugcaaagag

SEQ ID NO: 552998 - RNA, 20 nt, Chlamydophila pneumoniae TW-183
ggcaauagcuuugaagagca

SEQ ID NO: 552999 - RNA, 13 nt, Chlamydophila pneumoniae TW-183
ggcaauagcuuug

SEQ ID NO: 553000 - RNA, 22 nt, Chlamydophila pneumoniae TW-183
ggcaacaagagcgcauuuuaca

SEQ ID NO: 553001 - RNA, 17 nt, Chlamydophila pneumoniae TW-183
ggaucacagucuuaaau

SEQ ID NO: 553002 - RNA, 17 nt, Chlamydophila pneumoniae TW-183
ggauaggcaagauuaug

SEQ ID NO: 553003 - RNA, 20 nt, Chlamydophila pneumoniae TW-183
ggagauccugaaaaaagaag

SEQ ID NO: 553004 - RNA, 14 nt, Chlamydophila pneumoniae TW-183
aaagguuuuauaaa

SEQ ID NO: 553005 - RNA, 22 nt, Chlamydophila pneumoniae TW-183
ggacuccaagaauagcaggaag

SEQ ID NO: 553006 - RNA, 14 nt, Chlamydophila pneumoniae TW-183
ggacuacugaaaca

SEQ ID NO: 553007 - RNA, 15 nt, Chlamydophila pneumoniae TW-183
ggagaauagcaagca

SEQ ID NO: 553008 - RNA, 14 nt, Chlamydophila pneumoniae TW-183
ggagaauagcaagc

SEQ ID NO: 553009 - RNA, 20 nt, Chlamydophila pneumoniae TW-183
ggaaucucgggagaacaugc

SEQ ID NO: 553010 - RNA, 22 nt, Chlamydophila pneumoniae TW-183
ggaaucccugcacucuuucaga

SEQ ID NO: 553011 - RNA, 21 nt, Chlamydophila pneumoniae TW-183
ggaagcuuaucaagaagcuga

SEQ ID NO: 553012 - RNA, 21 nt, Chlamydophila pneumoniae TW-183
ggaagaugaauaccagaagca

SEQ ID NO: 553013 - RNA, 14 nt, Chlamydophila pneumoniae TW-183
ggaacgcucucuag

SEQ ID NO: 553014 - RNA, 14 nt, Chlamydophila pneumoniae TW-183
ggaaagcacauaca

SEQ ID NO: 553015 - RNA, 10 nt, Chlamydophila pneumoniae TW-183
gcuuuuugcu

SEQ ID NO: 553016 - RNA, 22 nt, Chlamydophila pneumoniae TW-183
gcuuuuagagguuuuuguaucu

SEQ ID NO: 553017 - RNA, 17 nt, Chlamydophila pneumoniae TW-183
gcuuuugugauaccucc

SEQ ID NO: 553018 - RNA, 20 nt, Chlamydophila pneumoniae TW-183
gcugucuagaacacucagag

SEQ ID NO: 553019 - RNA, 23 nt, Chlamydophila pneumoniae TW-183
aaagcuuuuccguaaguaaccaa

SEQ ID NO: 553020 - RNA, 19 nt, Chlamydophila pneumoniae TW-183
aaagcuuuuuucucuugcu

SEQ ID NO: 553021 - RNA, 15 nt, Chlamydophila pneumoniae TW-183
gcugaggacgcagag

SEQ ID NO: 553022 - RNA, 16 nt, Chlamydophila pneumoniae TW-183
gcucuuuuaacuuaaa

SEQ ID NO: 553023 - RNA, 20 nt, Chlamydophila pneumoniae TW-183
gcucuuugggauaaaaaguu

SEQ ID NO: 553024 - RNA, 20 nt, Chlamydophila pneumoniae TW-183
gcucuuugauuuucuuagcu

SEQ ID NO: 553025 - RNA, 15 nt, Chlamydophila pneumoniae TW-183
gcucuucuuucucua

SEQ ID NO: 553026 - RNA, 16 nt, Chlamydophila pneumoniae TW-183
gcucuucuuucucuau

SEQ ID NO: 553027 - RNA, 19 nt, Chlamydophila pneumoniae TW-183
gcucuucuauguguucucg

SEQ ID NO: 553028 - RNA, 19 nt, Chlamydophila pneumoniae TW-183
gcucucaaggucacagcau

SEQ ID NO: 553029 - RNA, 22 nt, Chlamydophila pneumoniae TW-183
gcucucaaggucacagcauuuu

SEQ ID NO: 553030 - RNA, 18 nt, Chlamydophila pneumoniae TW-183
gcucuaagcugugcauuu

SEQ ID NO: 553031 - RNA, 22 nt, Chlamydophila pneumoniae TW-183
gcucuaagcugugcauuuucuu

SEQ ID NO: 553032 - RNA, 16 nt, Chlamydophila pneumoniae TW-183
gcucguaauccuucuu

SEQ ID NO: 553033 - RNA, 15 nt, Chlamydophila pneumoniae TW-183
gcucguauugauauu

SEQ ID NO: 553034 - RNA, 22 nt, Chlamydophila pneumoniae TW-183
gcuauuuuccucuauauuuuuu

SEQ ID NO: 553035 - RNA, 15 nt, Chlamydophila pneumoniae TW-183
gcuagaaaaucauac

SEQ ID NO: 553036 - RNA, 12 nt, Chlamydophila pneumoniae TW-183
gcuagucuuucu

SEQ ID NO: 553037 - RNA, 15 nt, Chlamydophila pneumoniae TW-183
gcuaggaagaugaau

SEQ ID NO: 553038 - RNA, 12 nt, Chlamydophila pneumoniae TW-183
gcuagguagugu

SEQ ID NO: 553039 - RNA, 18 nt, Chlamydophila pneumoniae TW-183
gcuauaccuauauagaga

SEQ ID NO: 553040 - RNA, 18 nt, Chlamydophila pneumoniae TW-183
gcuauagauacuuugcaa

SEQ ID NO: 553041 - RNA, 17 nt, Chlamydophila pneumoniae TW-183
gcuaaucaauccaagaa

SEQ ID NO: 553042 - RNA, 15 nt, Chlamydophila pneumoniae TW-183
gcggaucuucuucug

SEQ ID NO: 553043 - RNA, 15 nt, Chlamydophila pneumoniae TW-183
gcggacuuuagcgcu

SEQ ID NO: 553044 - RNA, 20 nt, Chlamydophila pneumoniae TW-183
gcgcuuguucuuuucaucaa

SEQ ID NO: 553045 - RNA, 17 nt, Chlamydophila pneumoniae TW-183
gcgcucuucuuucucua

SEQ ID NO: 553046 - RNA, 21 nt, Chlamydophila pneumoniae TW-183
gcgcuaccuuaguuuuuucua

SEQ ID NO: 553047 - RNA, 23 nt, Chlamydophila pneumoniae TW-183
gccuuccauaucuagaaguuuaa

SEQ ID NO: 553048 - RNA, 20 nt, Chlamydophila pneumoniae TW-183
gccuuccuuaacaacaucac

SEQ ID NO: 553049 - RNA, 15 nt, Chlamydophila pneumoniae TW-183
gccuuacggccccug

SEQ ID NO: 553050 - RNA, 22 nt, Chlamydophila pneumoniae TW-183
gccuggaggcgguggcaugcca

SEQ ID NO: 553051 - RNA, 23 nt, Chlamydophila pneumoniae TW-183
gccuaugggaggaauuccucuca

SEQ ID NO: 553052 - RNA, 15 nt, Chlamydophila pneumoniae TW-183
gcgaaugucguuaaa

SEQ ID NO: 553053 - RNA, 17 nt, Chlamydophila pneumoniae TW-183
gcgaaugucguuaaaaa

SEQ ID NO: 553054 - RNA, 16 nt, Chlamydophila pneumoniae TW-183
gcgauacaauaaacaa

SEQ ID NO: 553055 - RNA, 17 nt, Chlamydophila pneumoniae TW-183
gcgauacaauaaacaac

SEQ ID NO: 553056 - RNA, 21 nt, Chlamydophila pneumoniae TW-183
gccgugccuauagaaauuaga

SEQ ID NO: 553057 - RNA, 21 nt, Chlamydophila pneumoniae TW-183
gcccugaugcuguaucuccac

SEQ ID NO: 553058 - RNA, 21 nt, Chlamydophila pneumoniae TW-183
gcccuauaguauaauagugag

SEQ ID NO: 553059 - RNA, 18 nt, Chlamydophila pneumoniae TW-183
gccccuggaauuucucca

SEQ ID NO: 553060 - RNA, 20 nt, Chlamydophila pneumoniae TW-183
gccauuccauggauauggaa

SEQ ID NO: 553061 - RNA, 22 nt, Chlamydophila pneumoniae TW-183
gccaguuacugucugcaaagag

SEQ ID NO: 553062 - RNA, 22 nt, Chlamydophila pneumoniae TW-183
gccacuaaguuuaggcaggaag

SEQ ID NO: 553063 - RNA, 20 nt, Chlamydophila pneumoniae TW-183
gccaagauacuacuuacaag

SEQ ID NO: 553064 - RNA, 15 nt, Chlamydophila pneumoniae TW-183
gccaagagagcuugu

SEQ ID NO: 553065 - RNA, 13 nt, Chlamydophila pneumoniae TW-183
gccaagaaauaua

SEQ ID NO: 553066 - RNA, 16 nt, Chlamydophila pneumoniae TW-183
gcauuuaaacuaagaa

SEQ ID NO: 553067 - RNA, 13 nt, Chlamydophila pneumoniae TW-183
gcauuuaaaacgg

SEQ ID NO: 553068 - RNA, 22 nt, Chlamydophila pneumoniae TW-183
gcauuuaaacuaagaauaccua

SEQ ID NO: 553069 - RNA, 20 nt, Chlamydophila pneumoniae TW-183
gcauucucuaaaugauuuuu

SEQ ID NO: 553070 - RNA, 21 nt, Chlamydophila pneumoniae TW-183
gcaugacgcuuuuccaaagca

SEQ ID NO: 553071 - RNA, 12 nt, Chlamydophila pneumoniae TW-183
gcaugaggagac

SEQ ID NO: 553072 - RNA, 14 nt, Chlamydophila pneumoniae TW-183
gcaggccaacucuc

SEQ ID NO: 553073 - RNA, 18 nt, Chlamydophila pneumoniae TW-183
gcagagaugcuaacaacu

SEQ ID NO: 553074 - RNA, 19 nt, Chlamydophila pneumoniae TW-183
gcagaguccuucuuuuccg

SEQ ID NO: 553075 - RNA, 18 nt, Chlamydophila pneumoniae TW-183
gcagauauacuuuuucag

SEQ ID NO: 553076 - RNA, 14 nt, Chlamydophila pneumoniae TW-183
gcagaguccuucuu

SEQ ID NO: 553077 - RNA, 13 nt, Chlamydophila pneumoniae TW-183
gcacuuacuucaa

SEQ ID NO: 553078 - RNA, 20 nt, Chlamydophila pneumoniae TW-183
gcacuuaucucuuucuugaa

SEQ ID NO: 553079 - RNA, 18 nt, Chlamydophila pneumoniae TW-183
gcacuguaaaaaagaaau

SEQ ID NO: 553080 - RNA, 14 nt, Chlamydophila pneumoniae TW-183
gcacgucugcaccu

SEQ ID NO: 553081 - RNA, 15 nt, Chlamydophila pneumoniae TW-183
gcacgagagccucgg

SEQ ID NO: 553082 - RNA, 16 nt, Chlamydophila pneumoniae TW-183
gcaccuaauaaagaag

SEQ ID NO: 553083 - RNA, 18 nt, Chlamydophila pneumoniae TW-183
gcaauugagcuucuuuag

SEQ ID NO: 553084 - RNA, 18 nt, Chlamydophila pneumoniae TW-183
gcaaucuuugaagcucga

SEQ ID NO: 553085 - RNA, 19 nt, Chlamydophila pneumoniae TW-183
gcaaucguuucuauagacu

SEQ ID NO: 553086 - RNA, 14 nt, Chlamydophila pneumoniae TW-183
gcaaguaaagaaau

SEQ ID NO: 553087 - RNA, 19 nt, Chlamydophila pneumoniae TW-183
gcaagcuucuuguuuuugu

SEQ ID NO: 553088 - RNA, 16 nt, Chlamydophila pneumoniae TW-183
gcaacuaaacucucca

SEQ ID NO: 553089 - RNA, 14 nt, Chlamydophila pneumoniae TW-183
guaaccacaggauc

SEQ ID NO: 553090 - RNA, 19 nt, Chlamydophila pneumoniae TW-183
guaaccaauacagcauaaa

SEQ ID NO: 553091 - RNA, 20 nt, Chlamydophila pneumoniae TW-183
guaacauugaccuaaaggaa

SEQ ID NO: 553092 - RNA, 14 nt, Chlamydophila pneumoniae TW-183
guaaaguaugcaua

SEQ ID NO: 553093 - RNA, 20 nt, Chlamydophila pneumoniae TW-183
guaaagaguagccccagcaa

SEQ ID NO: 553094 - RNA, 16 nt, Chlamydophila pneumoniae TW-183
guaaaacuacaggaaa

SEQ ID NO: 553095 - RNA, 19 nt, Chlamydophila pneumoniae TW-183
guaauagcaggaguuuuca

SEQ ID NO: 553096 - RNA, 22 nt, Chlamydophila pneumoniae TW-183
guaauuucuaaauagaaaacau

SEQ ID NO: 553097 - RNA, 14 nt, Chlamydophila pneumoniae TW-183
guaaucuguauaug

SEQ ID NO: 553098 - RNA, 15 nt, Chlamydophila pneumoniae TW-183
aaauagaaggccagu

SEQ ID NO: 553099 - RNA, 14 nt, Chlamydophila pneumoniae TW-183
guaauccuucuuuc

SEQ ID NO: 553100 - RNA, 18 nt, Chlamydophila pneumoniae TW-183
guaaucgagagaagaaau

SEQ ID NO: 553101 - RNA, 19 nt, Chlamydophila pneumoniae TW-183
guaauccuucuuucugcuc

SEQ ID NO: 553102 - RNA, 12 nt, Chlamydophila pneumoniae TW-183
guaccaagaaaa

SEQ ID NO: 553103 - RNA, 13 nt, Chlamydophila pneumoniae TW-183
guaccaagaaaau

SEQ ID NO: 553104 - RNA, 18 nt, Chlamydophila pneumoniae TW-183
guacgcaaguaaagaaau

SEQ ID NO: 553105 - RNA, 12 nt, Chlamydophila pneumoniae TW-183
guaaaaauauag

SEQ ID NO: 553106 - RNA, 14 nt, Chlamydophila pneumoniae TW-183
guaaaaauggcacu

SEQ ID NO: 553107 - RNA, 15 nt, Chlamydophila pneumoniae TW-183
guaaaacacaaauag

SEQ ID NO: 553108 - RNA, 19 nt, Chlamydophila pneumoniae TW-183
gguuccuggauuuaggaug

SEQ ID NO: 553109 - RNA, 17 nt, Chlamydophila pneumoniae TW-183
ggugccuaggcuaagag

SEQ ID NO: 553110 - RNA, 13 nt, Chlamydophila pneumoniae TW-183
guccuuacuugca

SEQ ID NO: 553111 - RNA, 16 nt, Chlamydophila pneumoniae TW-183
guccagacuuuccucu

SEQ ID NO: 553112 - RNA, 16 nt, Chlamydophila pneumoniae TW-183
gucaugauuuuucaau

SEQ ID NO: 553113 - RNA, 15 nt, Chlamydophila pneumoniae TW-183
gucaugauuuuucaa

SEQ ID NO: 553114 - RNA, 17 nt, Chlamydophila pneumoniae TW-183
gucauacuacucucauc

SEQ ID NO: 553115 - RNA, 17 nt, Chlamydophila pneumoniae TW-183
gucacagcauuuucucu

SEQ ID NO: 553116 - RNA, 16 nt, Chlamydophila pneumoniae TW-183
gucacagcauuuucuc

SEQ ID NO: 553117 - RNA, 19 nt, Chlamydophila pneumoniae TW-183
gucacacugcgagagaaag

SEQ ID NO: 553118 - RNA, 21 nt, Chlamydophila pneumoniae TW-183
gucaccuuaauggcuccuacu

SEQ ID NO: 553119 - RNA, 19 nt, Chlamydophila pneumoniae TW-183
gucaccuuaauggcuccua

SEQ ID NO: 553120 - RNA, 17 nt, Chlamydophila pneumoniae TW-183
guauugcaaauuucauu

SEQ ID NO: 553121 - RNA, 19 nt, Chlamydophila pneumoniae TW-183
guaucaagaauaugggugu

SEQ ID NO: 553122 - RNA, 22 nt, Chlamydophila pneumoniae TW-183
guaucuucuucgguguagaucu

SEQ ID NO: 553123 - RNA, 19 nt, Chlamydophila pneumoniae TW-183
guauccuuucaucagcauc

SEQ ID NO: 553124 - RNA, 19 nt, Chlamydophila pneumoniae TW-183
guauaauagugagcucccu

SEQ ID NO: 553125 - RNA, 17 nt, Chlamydophila pneumoniae TW-183
guaguccgcagauuuua

SEQ ID NO: 553126 - RNA, 18 nt, Chlamydophila pneumoniae TW-183
guaguauccuuucaucag

SEQ ID NO: 553127 - RNA, 24 nt, Chlamydophila pneumoniae TW-183
guagccuggaggcgguggcaugcc

SEQ ID NO: 553128 - RNA, 15 nt, Chlamydophila pneumoniae TW-183
guagccccagcaacc

SEQ ID NO: 553129 - RNA, 18 nt, Chlamydophila pneumoniae TW-183
guagcauuucuuucucuu

SEQ ID NO: 553130 - RNA, 20 nt, Chlamydophila pneumoniae TW-183
guagauagaaauucuguaga

SEQ ID NO: 553131 - RNA, 12 nt, Chlamydophila pneumoniae TW-183
guagagcaagau

SEQ ID NO: 553132 - RNA, 19 nt, Chlamydophila pneumoniae TW-183
guacuaauuacagaauccc

SEQ ID NO: 553133 - RNA, 19 nt, Chlamydophila pneumoniae TW-183
guacuuccccaaacaugga

SEQ ID NO: 553134 - RNA, 16 nt, Chlamydophila pneumoniae TW-183
guagaauaacgcaagg

SEQ ID NO: 553135 - RNA, 14 nt, Chlamydophila pneumoniae TW-183
uaaaaucuucucug

SEQ ID NO: 553136 - RNA, 15 nt, Chlamydophila pneumoniae TW-183
uaaaauagcccuaga

SEQ ID NO: 553137 - RNA, 13 nt, Chlamydophila pneumoniae TW-183
uaaaauagcccua

SEQ ID NO: 553138 - RNA, 23 nt, Chlamydophila pneumoniae TW-183
uaaaaguuagguagauagaaauu

SEQ ID NO: 553139 - RNA, 21 nt, Chlamydophila pneumoniae TW-183
uaaaaguuagguagauagaaa

SEQ ID NO: 553140 - RNA, 22 nt, Chlamydophila pneumoniae TW-183
uaaaaauggcacuugagcacau

SEQ ID NO: 553141 - RNA, 23 nt, Chlamydophila pneumoniae TW-183
uaaaaauggcacuugagcacauu

SEQ ID NO: 553142 - RNA, 21 nt, Chlamydophila pneumoniae TW-183
uaaaacaaaaucaaaaacugg

SEQ ID NO: 553143 - RNA, 16 nt, Chlamydophila pneumoniae TW-183
uaaaagagcucaaaaa

SEQ ID NO: 553144 - RNA, 21 nt, Chlamydophila pneumoniae TW-183
uaaaagaacauuaagaggaaa

SEQ ID NO: 553145 - RNA, 13 nt, Chlamydophila pneumoniae TW-183
uaaaagacugaaa

SEQ ID NO: 553146 - RNA, 13 nt, Chlamydophila pneumoniae TW-183
uaaaacuuagaaa

SEQ ID NO: 553147 - RNA, 12 nt, Chlamydophila pneumoniae TW-183
guuuucuuaucc

SEQ ID NO: 553148 - RNA, 21 nt, Chlamydophila pneumoniae TW-183
guuuucggggucggagauugu

SEQ ID NO: 553149 - RNA, 17 nt, Chlamydophila pneumoniae TW-183
guuuucguaagagaauu

SEQ ID NO: 553150 - RNA, 16 nt, Chlamydophila pneumoniae TW-183
uaaaaaaacccucaaa

SEQ ID NO: 553151 - RNA, 19 nt, Chlamydophila pneumoniae TW-183
uaaaaaaacccucaaagaa

SEQ ID NO: 553152 - RNA, 20 nt, Chlamydophila pneumoniae TW-183
uaaaaaguuuuuguucaucc

SEQ ID NO: 553153 - RNA, 20 nt, Chlamydophila pneumoniae TW-183
uaacgaagugaggagaauag

SEQ ID NO: 553154 - RNA, 19 nt, Chlamydophila pneumoniae TW-183
uaacgaagugaggagaaua

SEQ ID NO: 553155 - RNA, 20 nt, Chlamydophila pneumoniae TW-183
uaaccuuugacaacaccaca

SEQ ID NO: 553156 - RNA, 14 nt, Chlamydophila pneumoniae TW-183
uaaccaaaagaauu

SEQ ID NO: 553157 - RNA, 23 nt, Chlamydophila pneumoniae TW-183
uaaccaaaagaauuaagaagaag

SEQ ID NO: 553158 - RNA, 20 nt, Chlamydophila pneumoniae TW-183
uaacauaaagucaaacauca

SEQ ID NO: 553159 - RNA, 14 nt, Chlamydophila pneumoniae TW-183
uaacaaaguuuaug

SEQ ID NO: 553160 - RNA, 23 nt, Chlamydophila pneumoniae TW-183
uaaauagaaaacauagagauucu

SEQ ID NO: 553161 - RNA, 22 nt, Chlamydophila pneumoniae TW-183
uaaaggaccuguuuucuuuucu

SEQ ID NO: 553162 - RNA, 13 nt, Chlamydophila pneumoniae TW-183
uaaagagcauccu

SEQ ID NO: 553163 - RNA, 15 nt, Chlamydophila pneumoniae TW-183
uaaagaguagcccca

SEQ ID NO: 553164 - RNA, 14 nt, Chlamydophila pneumoniae TW-183
uaaacaauuucaau

SEQ ID NO: 553165 - RNA, 15 nt, Chlamydophila pneumoniae TW-183
uaaaccuucaaugau

SEQ ID NO: 553166 - RNA, 21 nt, Chlamydophila pneumoniae TW-183
guuuacagaugcaugauccua

SEQ ID NO: 553167 - RNA, 15 nt, Chlamydophila pneumoniae TW-183
guuguuuuugcugaa

SEQ ID NO: 553168 - RNA, 15 nt, Chlamydophila pneumoniae TW-183
guugaccuuuuucau

SEQ ID NO: 553169 - RNA, 19 nt, Chlamydophila pneumoniae TW-183
guugagaaccuucacaaga

SEQ ID NO: 553170 - RNA, 13 nt, Chlamydophila pneumoniae TW-183
guucuugauuuuc

SEQ ID NO: 553171 - RNA, 17 nt, Chlamydophila pneumoniae TW-183
guucuuguaauaaaaga

SEQ ID NO: 553172 - RNA, 14 nt, Chlamydophila pneumoniae TW-183
guucuuguaauaaa

SEQ ID NO: 553173 - RNA, 15 nt, Chlamydophila pneumoniae TW-183
guucuuucaauaaca

SEQ ID NO: 553174 - RNA, 17 nt, Chlamydophila pneumoniae TW-183
guugaaaugagugagaa

SEQ ID NO: 553175 - RNA, 19 nt, Chlamydophila pneumoniae TW-183
guucacuucaucgacagua

SEQ ID NO: 553176 - RNA, 15 nt, Chlamydophila pneumoniae TW-183
guucacuucaucgac

SEQ ID NO: 553177 - RNA, 22 nt, Chlamydophila pneumoniae TW-183
guucaacuuuguuaauagaaga

SEQ ID NO: 553178 - RNA, 20 nt, Chlamydophila pneumoniae TW-183
guuauaagugacuuuucuuc

SEQ ID NO: 553179 - RNA, 13 nt, Chlamydophila pneumoniae TW-183
guuaucaggaacu

SEQ ID NO: 553180 - RNA, 23 nt, Chlamydophila pneumoniae TW-183
gugguaaaaauauaggcugcaca

SEQ ID NO: 553181 - RNA, 13 nt, Chlamydophila pneumoniae TW-183
gugcucuacccca

SEQ ID NO: 553182 - RNA, 20 nt, Chlamydophila pneumoniae TW-183
gugcgcgucuccuugauuug

SEQ ID NO: 553183 - RNA, 20 nt, Chlamydophila pneumoniae TW-183
gucuagcaguugcaauacca

SEQ ID NO: 553184 - RNA, 14 nt, Chlamydophila pneumoniae TW-183
gugcaugcaucuua

SEQ ID NO: 553185 - RNA, 13 nt, Chlamydophila pneumoniae TW-183
gugcaugcaucuu

SEQ ID NO: 553186 - RNA, 13 nt, Chlamydophila pneumoniae TW-183
gugccuguaauug

SEQ ID NO: 553187 - RNA, 15 nt, Chlamydophila pneumoniae TW-183
uacagauaaggaaga

SEQ ID NO: 553188 - RNA, 22 nt, Chlamydophila pneumoniae TW-183
uacagagggaauuucauguccu

SEQ ID NO: 553189 - RNA, 17 nt, Chlamydophila pneumoniae TW-183
uacagagggaauuucau

SEQ ID NO: 553190 - RNA, 21 nt, Chlamydophila pneumoniae TW-183
uacagagucuguguagccgua

SEQ ID NO: 553191 - RNA, 13 nt, Chlamydophila pneumoniae TW-183
uacaauaaacaac

SEQ ID NO: 553192 - RNA, 17 nt, Chlamydophila pneumoniae TW-183
uacaaguugagagagag

SEQ ID NO: 553193 - RNA, 17 nt, Chlamydophila pneumoniae TW-183
uacaaucucuagggaua

SEQ ID NO: 553194 - RNA, 23 nt, Chlamydophila pneumoniae TW-183
uacaauuagagauucauaaaacu

SEQ ID NO: 553195 - RNA, 20 nt, Chlamydophila pneumoniae TW-183
uacaauuagagauucauaaa

SEQ ID NO: 553196 - RNA, 14 nt, Chlamydophila pneumoniae TW-183
uacagcauaaaaau

SEQ ID NO: 553197 - RNA, 15 nt, Chlamydophila pneumoniae TW-183
uacagcauaaaaauu

SEQ ID NO: 553198 - RNA, 16 nt, Chlamydophila pneumoniae TW-183
uacaggaaaacgcccu

SEQ ID NO: 553199 - RNA, 22 nt, Chlamydophila pneumoniae TW-183
uaauuucuaaauagaaaacaua

SEQ ID NO: 553200 - RNA, 14 nt, Chlamydophila pneumoniae TW-183
uaaucucaccagaa

SEQ ID NO: 553201 - RNA, 12 nt, Chlamydophila pneumoniae TW-183
uaaucucaccag

SEQ ID NO: 553202 - RNA, 19 nt, Chlamydophila pneumoniae TW-183
uaaucuauaggauuugcau

SEQ ID NO: 553203 - RNA, 11 nt, Chlamydophila pneumoniae TW-183
uacuuuuccua

SEQ ID NO: 553204 - RNA, 12 nt, Chlamydophila pneumoniae TW-183
uagaauuuucuu

SEQ ID NO: 553205 - RNA, 12 nt, Chlamydophila pneumoniae TW-183
uagagaagaaaa

SEQ ID NO: 553206 - RNA, 23 nt, Chlamydophila pneumoniae TW-183
uagagaaagagugccaagagcau

SEQ ID NO: 553207 - RNA, 18 nt, Chlamydophila pneumoniae TW-183
uagaagguguuuuggcug

SEQ ID NO: 553208 - RNA, 22 nt, Chlamydophila pneumoniae TW-183
uagaaucagagggacuccugug

SEQ ID NO: 553209 - RNA, 15 nt, Chlamydophila pneumoniae TW-183
uagaacacucagaga

SEQ ID NO: 553210 - RNA, 14 nt, Chlamydophila pneumoniae TW-183
uacgaauaaguuuu

SEQ ID NO: 553211 - RNA, 14 nt, Chlamydophila pneumoniae TW-183
uacgauguuuucuu

SEQ ID NO: 553212 - RNA, 19 nt, Chlamydophila pneumoniae TW-183
uaccuuaguuuuuucuaag

SEQ ID NO: 553213 - RNA, 20 nt, Chlamydophila pneumoniae TW-183
uaccuuaguuuuuucuaagg

SEQ ID NO: 553214 - RNA, 14 nt, Chlamydophila pneumoniae TW-183
uaccuugagacaaa

SEQ ID NO: 553215 - RNA, 24 nt, Chlamydophila pneumoniae TW-183
uagauugccuuugaucaggagucu

SEQ ID NO: 553216 - RNA, 19 nt, Chlamydophila pneumoniae TW-183
uagauguaaucauaaaaaa

SEQ ID NO: 553217 - RNA, 19 nt, Chlamydophila pneumoniae TW-183
uagaucguuucuaucuccg

SEQ ID NO: 553218 - RNA, 21 nt, Chlamydophila pneumoniae TW-183
uagaucgauuaccuaaaacaa

SEQ ID NO: 553219 - RNA, 15 nt, Chlamydophila pneumoniae TW-183
uagaucccagaagaa

SEQ ID NO: 553220 - RNA, 18 nt, Chlamydophila pneumoniae TW-183
uagaucccucaagcgauu

SEQ ID NO: 553221 - RNA, 13 nt, Chlamydophila pneumoniae TW-183
uagauaugccuca

SEQ ID NO: 553222 - RNA, 18 nt, Chlamydophila pneumoniae TW-183
uagagauucuacaaauua

SEQ ID NO: 553223 - RNA, 11 nt, Chlamydophila pneumoniae TW-183
uagagccuaga

SEQ ID NO: 553224 - RNA, 21 nt, Chlamydophila pneumoniae TW-183
uagauacuuugcaauacacca

SEQ ID NO: 553225 - RNA, 16 nt, Chlamydophila pneumoniae TW-183
uagaguugcuuuaugg

SEQ ID NO: 553226 - RNA, 16 nt, Chlamydophila pneumoniae TW-183
uagagugacucaucag

SEQ ID NO: 553227 - RNA, 15 nt, Chlamydophila pneumoniae TW-183
uagcauuucuuucuc

SEQ ID NO: 553228 - RNA, 16 nt, Chlamydophila pneumoniae TW-183
uagcaggaguuuucaa

SEQ ID NO: 553229 - RNA, 21 nt, Chlamydophila pneumoniae TW-183
uagcagcccgcacaucaugcu

SEQ ID NO: 553230 - RNA, 20 nt, Chlamydophila pneumoniae TW-183
uagcauaaucuuuaacaaag

SEQ ID NO: 553231 - RNA, 15 nt, Chlamydophila pneumoniae TW-183
uagcaccuaauaaag

SEQ ID NO: 553232 - RNA, 20 nt, Chlamydophila pneumoniae TW-183
uagcaauugagcuucuuuag

SEQ ID NO: 553233 - RNA, 11 nt, Chlamydophila pneumoniae TW-183
uagcaaaggca

SEQ ID NO: 553234 - RNA, 13 nt, Chlamydophila pneumoniae TW-183
uagauuuuuacuu

SEQ ID NO: 553235 - RNA, 14 nt, Chlamydophila pneumoniae TW-183
uagauuuaaaugca

SEQ ID NO: 553236 - RNA, 23 nt, Chlamydophila pneumoniae TW-183
uaggaagaugaauaccagaagca

SEQ ID NO: 553237 - RNA, 17 nt, Chlamydophila pneumoniae TW-183
uaggaaggucagaguau

SEQ ID NO: 553238 - RNA, 17 nt, Chlamydophila pneumoniae TW-183
uaggaagcuuaucaaga

SEQ ID NO: 553239 - RNA, 18 nt, Chlamydophila pneumoniae TW-183
uagcuuuuaguuucccac

SEQ ID NO: 553240 - RNA, 18 nt, Chlamydophila pneumoniae TW-183
uaggacccguagccccuu

SEQ ID NO: 553241 - RNA, 12 nt, Chlamydophila pneumoniae TW-183
uaggauucggac

SEQ ID NO: 553242 - RNA, 22 nt, Chlamydophila pneumoniae TW-183
uaggcaagauuaugaugccuca

SEQ ID NO: 553243 - RNA, 14 nt, Chlamydophila pneumoniae TW-183
uaggauccaggagu

SEQ ID NO: 553244 - RNA, 20 nt, Chlamydophila pneumoniae TW-183
uagcucuuugggauaaaaag

SEQ ID NO: 553245 - RNA, 11 nt, Chlamydophila pneumoniae TW-183
uagcccuugca

SEQ ID NO: 553246 - RNA, 23 nt, Chlamydophila pneumoniae TW-183
uagcccuagaguaaagaguagcc

SEQ ID NO: 553247 - RNA, 22 nt, Chlamydophila pneumoniae TW-183
uaucagggagcggaauuucuca

SEQ ID NO: 553248 - RNA, 19 nt, Chlamydophila pneumoniae TW-183
uaucaaaagguuuuauaaa

SEQ ID NO: 553249 - RNA, 12 nt, Chlamydophila pneumoniae TW-183
uauacuuuuuca

SEQ ID NO: 553250 - RNA, 14 nt, Chlamydophila pneumoniae TW-183
uauauagagcagac

SEQ ID NO: 553251 - RNA, 13 nt, Chlamydophila pneumoniae TW-183
uaguguugaauaa

SEQ ID NO: 553252 - RNA, 17 nt, Chlamydophila pneumoniae TW-183
uaguaaaauaagaaauc

SEQ ID NO: 553253 - RNA, 16 nt, Chlamydophila pneumoniae TW-183
uaguauccuuucauca

SEQ ID NO: 553254 - RNA, 19 nt, Chlamydophila pneumoniae TW-183
uaggucuuaaaguagccau

SEQ ID NO: 553255 - RNA, 16 nt, Chlamydophila pneumoniae TW-183
uagggugggagucucu

SEQ ID NO: 553256 - RNA, 24 nt, Chlamydophila pneumoniae TW-183
uagguaaggaaacgauuucuucuu

SEQ ID NO: 553257 - RNA, 14 nt, Chlamydophila pneumoniae TW-183
uagggguuucccug

SEQ ID NO: 553258 - RNA, 16 nt, Chlamydophila pneumoniae TW-183
uaggguagccauccac

SEQ ID NO: 553259 - RNA, 23 nt, Chlamydophila pneumoniae TW-183
uaggcuuuuuucuauuuucagga

SEQ ID NO: 553260 - RNA, 16 nt, Chlamydophila pneumoniae TW-183
uagggagugaggaauc

SEQ ID NO: 553261 - RNA, 22 nt, Chlamydophila pneumoniae TW-183
uaggcaguggcucuauagggga

SEQ ID NO: 553262 - RNA, 13 nt, Chlamydophila pneumoniae TW-183
ucacucuuuuauu

SEQ ID NO: 553263 - RNA, 12 nt, Chlamydophila pneumoniae TW-183
ucacucuuuuau

SEQ ID NO: 553264 - RNA, 14 nt, Chlamydophila pneumoniae TW-183
ucagcuucuugaug

SEQ ID NO: 553265 - RNA, 19 nt, Chlamydophila pneumoniae TW-183
ucagcuucuugauguacag

SEQ ID NO: 553266 - RNA, 18 nt, Chlamydophila pneumoniae TW-183
ucauaaagaggaaugaag

SEQ ID NO: 553267 - RNA, 19 nt, Chlamydophila pneumoniae TW-183
ucauaaagaggaaugaaga

SEQ ID NO: 553268 - RNA, 14 nt, Chlamydophila pneumoniae TW-183
ucauaaagaggaau

SEQ ID NO: 553269 - RNA, 12 nt, Chlamydophila pneumoniae TW-183
ucauaagaaauu

SEQ ID NO: 553270 - RNA, 15 nt, Chlamydophila pneumoniae TW-183
ucauaaccuaaggca

SEQ ID NO: 553271 - RNA, 15 nt, Chlamydophila pneumoniae TW-183
ucaucagcaaaacuc

SEQ ID NO: 553272 - RNA, 19 nt, Chlamydophila pneumoniae TW-183
ucauauuuuucuugaaggu

SEQ ID NO: 553273 - RNA, 20 nt, Chlamydophila pneumoniae TW-183
ucauauuuuucuugaagguu

SEQ ID NO: 553274 - RNA, 15 nt, Chlamydophila pneumoniae TW-183
ucaucaauaaagaua

SEQ ID NO: 553275 - RNA, 11 nt, Chlamydophila pneumoniae TW-183
ucaucaaugag

SEQ ID NO: 553276 - RNA, 15 nt, Chlamydophila pneumoniae TW-183
ucaucaaugagaaau

SEQ ID NO: 553277 - RNA, 17 nt, Chlamydophila pneumoniae TW-183
ucaucaaugagaaauag

SEQ ID NO: 553278 - RNA, 21 nt, Chlamydophila pneumoniae TW-183
ucaugcggacuuuauucucuu

SEQ ID NO: 553279 - RNA, 17 nt, Chlamydophila pneumoniae TW-183
ucaugcgcuaccuuagu

SEQ ID NO: 553280 - RNA, 10 nt, Chlamydophila pneumoniae TW-183
ucaugaggac

SEQ ID NO: 553281 - RNA, 21 nt, Chlamydophila pneumoniae TW-183
ucauguccuccauggaaagaa

SEQ ID NO: 553282 - RNA, 15 nt, Chlamydophila pneumoniae TW-183
uccacugcuuuaggc

SEQ ID NO: 553283 - RNA, 20 nt, Chlamydophila pneumoniae TW-183
uccagacuuuccucucuuua

SEQ ID NO: 553284 - RNA, 17 nt, Chlamydophila pneumoniae TW-183
uccaguaucuucucuua

SEQ ID NO: 553285 - RNA, 16 nt, Chlamydophila pneumoniae TW-183
uccaguaucuucucuu

SEQ ID NO: 553286 - RNA, 12 nt, Chlamydophila pneumoniae TW-183
uccauaaaaaua

SEQ ID NO: 553287 - RNA, 21 nt, Chlamydophila pneumoniae TW-183
uccagccugcaccagacccuc

SEQ ID NO: 553288 - RNA, 19 nt, Chlamydophila pneumoniae TW-183
ucaccugagcuauaaucua

SEQ ID NO: 553289 - RNA, 22 nt, Chlamydophila pneumoniae TW-183
ucaccuuacauccaauuuuguu

SEQ ID NO: 553290 - RNA, 15 nt, Chlamydophila pneumoniae TW-183
ucaccuuagagugac

SEQ ID NO: 553291 - RNA, 20 nt, Chlamydophila pneumoniae TW-183
ucaccagaagcaacuaaacu

SEQ ID NO: 553292 - RNA, 15 nt, Chlamydophila pneumoniae TW-183
ucaccagaagcauug

SEQ ID NO: 553293 - RNA, 19 nt, Chlamydophila pneumoniae TW-183
ucacacguaagaaaggaug

SEQ ID NO: 553294 - RNA, 16 nt, Chlamydophila pneumoniae TW-183
ucacacugcgagagaa

SEQ ID NO: 553295 - RNA, 15 nt, Chlamydophila pneumoniae TW-183
ucaccaacuccucua

SEQ ID NO: 553296 - RNA, 17 nt, Chlamydophila pneumoniae TW-183
ucacaaucuaaauaaga

SEQ ID NO: 553297 - RNA, 17 nt, Chlamydophila pneumoniae TW-183
ucacaauauaaaugcua

SEQ ID NO: 553298 - RNA, 16 nt, Chlamydophila pneumoniae TW-183
ucacaauauaaaugcu

SEQ ID NO: 553299 - RNA, 14 nt, Chlamydophila pneumoniae TW-183
ucaaucaauaaaau

SEQ ID NO: 553300 - RNA, 18 nt, Chlamydophila pneumoniae TW-183
ucaagaucuucaucacaa

SEQ ID NO: 553301 - RNA, 13 nt, Chlamydophila pneumoniae TW-183
ucaagaucuucau

SEQ ID NO: 553302 - RNA, 15 nt, Chlamydophila pneumoniae TW-183
ucaaggccuauagau

SEQ ID NO: 553303 - RNA, 20 nt, Chlamydophila pneumoniae TW-183
ucaaggccuauagauuuugu

SEQ ID NO: 553304 - RNA, 22 nt, Chlamydophila pneumoniae TW-183
ucaaaucucauuccagcaucuu

SEQ ID NO: 553305 - RNA, 22 nt, Chlamydophila pneumoniae TW-183
ucaagaccuaagcucauaagaa

SEQ ID NO: 553306 - RNA, 23 nt, Chlamydophila pneumoniae TW-183
ucaagaccuaagcucauaagaaa

SEQ ID NO: 553307 - RNA, 23 nt, Chlamydophila pneumoniae TW-183
ucaagaagugcuuuuagagguuu

SEQ ID NO: 553308 - RNA, 22 nt, Chlamydophila pneumoniae TW-183
ucaagaacccgagacuucucuc

SEQ ID NO: 553309 - RNA, 11 nt, Chlamydophila pneumoniae TW-183
ucaaaaacugg

SEQ ID NO: 553310 - RNA, 20 nt, Chlamydophila pneumoniae TW-183
ucaaaacacgcccugaugcu

SEQ ID NO: 553311 - RNA, 16 nt, Chlamydophila pneumoniae TW-183
ucaaagaauacucuaa

SEQ ID NO: 553312 - RNA, 22 nt, Chlamydophila pneumoniae TW-183
ucaaaagucaugaggacugugg

SEQ ID NO: 553313 - RNA, 12 nt, Chlamydophila pneumoniae TW-183
ucaaagauauaa

SEQ ID NO: 553314 - RNA, 16 nt, Chlamydophila pneumoniae TW-183
uauucugguuucuuca

SEQ ID NO: 553315 - RNA, 19 nt, Chlamydophila pneumoniae TW-183
uauugcggaaauugaauau

SEQ ID NO: 553316 - RNA, 14 nt, Chlamydophila pneumoniae TW-183
ucuacaaagauccu

SEQ ID NO: 553317 - RNA, 12 nt, Chlamydophila pneumoniae TW-183
aaaugagagacg

SEQ ID NO: 553318 - RNA, 20 nt, Chlamydophila pneumoniae TW-183
ucuacgcgcucuucuuucuc

SEQ ID NO: 553319 - RNA, 17 nt, Chlamydophila pneumoniae TW-183
ucuacgcggagaaugcu

SEQ ID NO: 553320 - RNA, 23 nt, Chlamydophila pneumoniae TW-183
ucuacgauguuuucuuauccuug

SEQ ID NO: 553321 - RNA, 17 nt, Chlamydophila pneumoniae TW-183
ucuaaaaucuucucugc

SEQ ID NO: 553322 - RNA, 16 nt, Chlamydophila pneumoniae TW-183
aaaucuuccccuaaaa

SEQ ID NO: 553323 - RNA, 21 nt, Chlamydophila pneumoniae TW-183
ucuaagcugaaagaacacucc

SEQ ID NO: 553324 - RNA, 12 nt, Chlamydophila pneumoniae TW-183
ucuaaggaaauu

SEQ ID NO: 553325 - RNA, 13 nt, Chlamydophila pneumoniae TW-183
ucucaccagaagc

SEQ ID NO: 553326 - RNA, 14 nt, Chlamydophila pneumoniae TW-183
ucucauaaguauag

SEQ ID NO: 553327 - RNA, 17 nt, Chlamydophila pneumoniae TW-183
ucucaguuaaagagcau

SEQ ID NO: 553328 - RNA, 17 nt, Chlamydophila pneumoniae TW-183
ucucaguaggagcagcg

SEQ ID NO: 553329 - RNA, 16 nt, Chlamydophila pneumoniae TW-183
ucucaaagaucaucua

SEQ ID NO: 553330 - RNA, 17 nt, Chlamydophila pneumoniae TW-183
ucucaagaucuucauca

SEQ ID NO: 553331 - RNA, 14 nt, Chlamydophila pneumoniae TW-183
ucucaagaucuuca

SEQ ID NO: 553332 - RNA, 22 nt, Chlamydophila pneumoniae TW-183
ucuaugagaguaaguuuuuaau

SEQ ID NO: 553333 - RNA, 22 nt, Chlamydophila pneumoniae TW-183
ucuagcaguugcaauaccaauu

SEQ ID NO: 553334 - RNA, 14 nt, Chlamydophila pneumoniae TW-183
ucuagaaguuuaaa

SEQ ID NO: 553335 - RNA, 19 nt, Chlamydophila pneumoniae TW-183
ucuagcuguuaauucccgu

SEQ ID NO: 553336 - RNA, 16 nt, Chlamydophila pneumoniae TW-183
ucuagcucaaaucuca

SEQ ID NO: 553337 - RNA, 11 nt, Chlamydophila pneumoniae TW-183
aaaugauuuuu

SEQ ID NO: 553338 - RNA, 23 nt, Chlamydophila pneumoniae TW-183
ucugggaagacucucaucagcaa

SEQ ID NO: 553339 - RNA, 12 nt, Chlamydophila pneumoniae TW-183
ucuguguagccg

SEQ ID NO: 553340 - RNA, 15 nt, Chlamydophila pneumoniae TW-183
ucugugaguacccag

SEQ ID NO: 553341 - RNA, 16 nt, Chlamydophila pneumoniae TW-183
ucugucuguauuuccg

SEQ ID NO: 553342 - RNA, 23 nt, Chlamydophila pneumoniae TW-183
ucuucgcuggcauguuuaauauc

SEQ ID NO: 553343 - RNA, 15 nt, Chlamydophila pneumoniae TW-183
ucuucgcuggcaugu

SEQ ID NO: 553344 - RNA, 15 nt, Chlamydophila pneumoniae TW-183
ucuuaucaagagcuc

SEQ ID NO: 553345 - RNA, 17 nt, Chlamydophila pneumoniae TW-183
ucuuauagggaauuuuu

SEQ ID NO: 553346 - RNA, 16 nt, Chlamydophila pneumoniae TW-183
ucucugccuaccaaag

SEQ ID NO: 553347 - RNA, 15 nt, Chlamydophila pneumoniae TW-183
ucucuaaaugauuuu

SEQ ID NO: 553348 - RNA, 16 nt, Chlamydophila pneumoniae TW-183
ucucuaaaugauuuuu

SEQ ID NO: 553349 - RNA, 18 nt, Chlamydophila pneumoniae TW-183
ucucuaaaugauuuuuaa

SEQ ID NO: 553350 - RNA, 16 nt, Chlamydophila pneumoniae TW-183
ucugaguuagcuuuug

SEQ ID NO: 553351 - RNA, 17 nt, Chlamydophila pneumoniae TW-183
ucugcaggacugucuag

SEQ ID NO: 553352 - RNA, 16 nt, Chlamydophila pneumoniae TW-183
ucugcaaugcuaagcu

SEQ ID NO: 553353 - RNA, 12 nt, Chlamydophila pneumoniae TW-183
ucucgaagcuug

SEQ ID NO: 553354 - RNA, 18 nt, Chlamydophila pneumoniae TW-183
ucucccaauauccagaaa

SEQ ID NO: 553355 - RNA, 16 nt, Chlamydophila pneumoniae TW-183
ucuccaaaagcucuac

SEQ ID NO: 553356 - RNA, 18 nt, Chlamydophila pneumoniae TW-183
ucuccaaaagcucuacaa

SEQ ID NO: 553357 - RNA, 19 nt, Chlamydophila pneumoniae TW-183
ucucauuccagcaucuucu

SEQ ID NO: 553358 - RNA, 17 nt, Chlamydophila pneumoniae TW-183
ucucauuccagcaucuu

SEQ ID NO: 553359 - RNA, 22 nt, Chlamydophila pneumoniae TW-183
ucguuaaaaacuauccuauuuu

SEQ ID NO: 553360 - RNA, 21 nt, Chlamydophila pneumoniae TW-183
ucguuuccgaucauuuuugcu

SEQ ID NO: 553361 - RNA, 15 nt, Chlamydophila pneumoniae TW-183
ucgucuccaaaaauu

SEQ ID NO: 553362 - RNA, 16 nt, Chlamydophila pneumoniae TW-183
ucguaccugcugcuuc

SEQ ID NO: 553363 - RNA, 14 nt, Chlamydophila pneumoniae TW-183
ucguagcuaaauug

SEQ ID NO: 553364 - RNA, 12 nt, Chlamydophila pneumoniae TW-183
ucgucaccugag

SEQ ID NO: 553365 - RNA, 22 nt, Chlamydophila pneumoniae TW-183
ucguccugacacaacucuuaaa

SEQ ID NO: 553366 - RNA, 17 nt, Chlamydophila pneumoniae TW-183
ucggugucuacaaagau

SEQ ID NO: 553367 - RNA, 21 nt, Chlamydophila pneumoniae TW-183
ucgguaaccugugaaaauuuu

SEQ ID NO: 553368 - RNA, 16 nt, Chlamydophila pneumoniae TW-183
ucggggauugcaaaau

SEQ ID NO: 553369 - RNA, 15 nt, Chlamydophila pneumoniae TW-183
ucggagauuguuuca

SEQ ID NO: 553370 - RNA, 15 nt, Chlamydophila pneumoniae TW-183
ucgcuuaacaaacuu

SEQ ID NO: 553371 - RNA, 15 nt, Chlamydophila pneumoniae TW-183
ucgcggaucuucuuc

SEQ ID NO: 553372 - RNA, 19 nt, Chlamydophila pneumoniae TW-183
ucgccuuccuuaacaacau

SEQ ID NO: 553373 - RNA, 12 nt, Chlamydophila pneumoniae TW-183
ugaauaagauuu

SEQ ID NO: 553374 - RNA, 17 nt, Chlamydophila pneumoniae TW-183
ugaauaccagaagcaaa

SEQ ID NO: 553375 - RNA, 20 nt, Chlamydophila pneumoniae TW-183
ugaauaugauuuccacuugu

SEQ ID NO: 553376 - RNA, 17 nt, Chlamydophila pneumoniae TW-183
ugaauaucaucacuaag

SEQ ID NO: 553377 - RNA, 23 nt, Chlamydophila pneumoniae TW-183
ugaagaaaccagaacacaugucu

SEQ ID NO: 553378 - RNA, 21 nt, Chlamydophila pneumoniae TW-183
ucuucguaagcugcaaucuca

SEQ ID NO: 553379 - RNA, 19 nt, Chlamydophila pneumoniae TW-183
ugaaagauuauucuagagu

SEQ ID NO: 553380 - RNA, 13 nt, Chlamydophila pneumoniae TW-183
ugacaaauagaaa

SEQ ID NO: 553381 - RNA, 21 nt, Chlamydophila pneumoniae TW-183
ugacacaacucuuaaaucgcu

SEQ ID NO: 553382 - RNA, 13 nt, Chlamydophila pneumoniae TW-183
ugaaucuucaaga

SEQ ID NO: 553383 - RNA, 16 nt, Chlamydophila pneumoniae TW-183
ugaauuaauaaaagag

SEQ ID NO: 553384 - RNA, 15 nt, Chlamydophila pneumoniae TW-183
ugaauuaauaaaaga

SEQ ID NO: 553385 - RNA, 20 nt, Chlamydophila pneumoniae TW-183
ugauuacagcaucuauagaa

SEQ ID NO: 553386 - RNA, 13 nt, Chlamydophila pneumoniae TW-183
ugauuaggaacaa

SEQ ID NO: 553387 - RNA, 17 nt, Chlamydophila pneumoniae TW-183
ugauucauaaagaggaa

SEQ ID NO: 553388 - RNA, 15 nt, Chlamydophila pneumoniae TW-183
ugauugaaaccguaa

SEQ ID NO: 553389 - RNA, 15 nt, Chlamydophila pneumoniae TW-183
ugaugcuguaucucc

SEQ ID NO: 553390 - RNA, 20 nt, Chlamydophila pneumoniae TW-183
ugaugcuguaucuccacgca

SEQ ID NO: 553391 - RNA, 18 nt, Chlamydophila pneumoniae TW-183
ugaucuauguagauuacc

SEQ ID NO: 553392 - RNA, 18 nt, Chlamydophila pneumoniae TW-183
ugauaauuacagaaguuc

SEQ ID NO: 553393 - RNA, 15 nt, Chlamydophila pneumoniae TW-183
ugagucgacaugcag

SEQ ID NO: 553394 - RNA, 14 nt, Chlamydophila pneumoniae TW-183
ugagcuucuuuaga

SEQ ID NO: 553395 - RNA, 17 nt, Chlamydophila pneumoniae TW-183
ugagguuugugcugcuu

SEQ ID NO: 553396 - RNA, 23 nt, Chlamydophila pneumoniae TW-183
ugaggcaaagauuuccaauccau

SEQ ID NO: 553397 - RNA, 14 nt, Chlamydophila pneumoniae TW-183
ugaggcaagucuca

SEQ ID NO: 553398 - RNA, 14 nt, Chlamydophila pneumoniae TW-183
ugagauugaggaua

SEQ ID NO: 553399 - RNA, 15 nt, Chlamydophila pneumoniae TW-183
ugacuuuucuucuuc

SEQ ID NO: 553400 - RNA, 12 nt, Chlamydophila pneumoniae TW-183
ugacuuuucuuc

SEQ ID NO: 553401 - RNA, 15 nt, Chlamydophila pneumoniae TW-183
ugagaaagaaguccu

SEQ ID NO: 553402 - RNA, 14 nt, Chlamydophila pneumoniae TW-183
ugaccuuuuucauu

SEQ ID NO: 553403 - RNA, 13 nt, Chlamydophila pneumoniae TW-183
ugaccuuuuucau

SEQ ID NO: 553404 - RNA, 20 nt, Chlamydophila pneumoniae TW-183
ugaccuucucaagaucuuca

SEQ ID NO: 553405 - RNA, 13 nt, Chlamydophila pneumoniae TW-183
ugaccuucucaag

SEQ ID NO: 553406 - RNA, 23 nt, Chlamydophila pneumoniae TW-183
ugcgauuuccccuucagaggcua

SEQ ID NO: 553407 - RNA, 15 nt, Chlamydophila pneumoniae TW-183
ugccgagaauacaga

SEQ ID NO: 553408 - RNA, 15 nt, Chlamydophila pneumoniae TW-183
ugccagcagcgagga

SEQ ID NO: 553409 - RNA, 18 nt, Chlamydophila pneumoniae TW-183
ugcauuuucuucuugcaa

SEQ ID NO: 553410 - RNA, 16 nt, Chlamydophila pneumoniae TW-183
ugcauaggcuuuacca

SEQ ID NO: 553411 - RNA, 17 nt, Chlamydophila pneumoniae TW-183
ugcaugauccuauuuuu

SEQ ID NO: 553412 - RNA, 17 nt, Chlamydophila pneumoniae TW-183
ugcaugcaucuuaucaa

SEQ ID NO: 553413 - RNA, 15 nt, Chlamydophila pneumoniae TW-183
ugcagaaucuaugag

SEQ ID NO: 553414 - RNA, 19 nt, Chlamydophila pneumoniae TW-183
ugcagcgaucaaaggcugc

SEQ ID NO: 553415 - RNA, 21 nt, Chlamydophila pneumoniae TW-183
ugcaggacugucuagcaguug

SEQ ID NO: 553416 - RNA, 13 nt, Chlamydophila pneumoniae TW-183
ugauuugggauga

SEQ ID NO: 553417 - RNA, 22 nt, Chlamydophila pneumoniae TW-183
uguuguaacgggagcguuuuuu

SEQ ID NO: 553418 - RNA, 15 nt, Chlamydophila pneumoniae TW-183
uguuguggaucagaa

SEQ ID NO: 553419 - RNA, 13 nt, Chlamydophila pneumoniae TW-183
uguuuacagaugc

SEQ ID NO: 553420 - RNA, 14 nt, Chlamydophila pneumoniae TW-183
uguuuaaguccuuc

SEQ ID NO: 553421 - RNA, 13 nt, Chlamydophila pneumoniae TW-183
uguuguuuuugcu

SEQ ID NO: 553422 - RNA, 14 nt, Chlamydophila pneumoniae TW-183
uguugaauaagauu

SEQ ID NO: 553423 - RNA, 11 nt, Chlamydophila pneumoniae TW-183
uguucugcugc

SEQ ID NO: 553424 - RNA, 14 nt, Chlamydophila pneumoniae TW-183
uguucuuuucauca

SEQ ID NO: 553425 - RNA, 20 nt, Chlamydophila pneumoniae TW-183
uguuauaagugacuuuucuu

SEQ ID NO: 553426 - RNA, 13 nt, Chlamydophila pneumoniae TW-183
uuaaaaaaaauua

SEQ ID NO: 553427 - RNA, 21 nt, Chlamydophila pneumoniae TW-183
uuaaacucugacgucuccaac

SEQ ID NO: 553428 - RNA, 22 nt, Chlamydophila pneumoniae TW-183
uuaaacucugacgucuccaaca

SEQ ID NO: 553429 - RNA, 15 nt, Chlamydophila pneumoniae TW-183
uuaaacuaagaauac

SEQ ID NO: 553430 - RNA, 13 nt, Chlamydophila pneumoniae TW-183
uuaaacuaagaau

SEQ ID NO: 553431 - RNA, 11 nt, Chlamydophila pneumoniae TW-183
uuaaagagcau

SEQ ID NO: 553432 - RNA, 24 nt, Chlamydophila pneumoniae TW-183
uuaaagagcauccuguagccacua

SEQ ID NO: 553433 - RNA, 12 nt, Chlamydophila pneumoniae TW-183
uguuuuauagau

SEQ ID NO: 553434 - RNA, 13 nt, Chlamydophila pneumoniae TW-183
uuaacaacaucac

SEQ ID NO: 553435 - RNA, 18 nt, Chlamydophila pneumoniae TW-183
uuaacaaguaccaagaaa

SEQ ID NO: 553436 - RNA, 13 nt, Chlamydophila pneumoniae TW-183
uuaacaaacuugu

SEQ ID NO: 553437 - RNA, 17 nt, Chlamydophila pneumoniae TW-183
uuaaauuuccaaagauc

SEQ ID NO: 553438 - RNA, 15 nt, Chlamydophila pneumoniae TW-183
uuaaagguaaaacua

SEQ ID NO: 553439 - RNA, 21 nt, Chlamydophila pneumoniae TW-183
uuacuuagaguugaccauaua

SEQ ID NO: 553440 - RNA, 18 nt, Chlamydophila pneumoniae TW-183
uuagaucgauuaccuaaa

SEQ ID NO: 553441 - RNA, 17 nt, Chlamydophila pneumoniae TW-183
uuagauggauagaucgu

SEQ ID NO: 553442 - RNA, 23 nt, Chlamydophila pneumoniae TW-183
uuagauggauagaucguuucuau

SEQ ID NO: 553443 - RNA, 21 nt, Chlamydophila pneumoniae TW-183
uuaccaucgucuccaaaaauu

SEQ ID NO: 553444 - RNA, 15 nt, Chlamydophila pneumoniae TW-183
ugugcauuuucuucu

SEQ ID NO: 553445 - RNA, 16 nt, Chlamydophila pneumoniae TW-183
ugugcauuuucuucuu

SEQ ID NO: 553446 - RNA, 23 nt, Chlamydophila pneumoniae TW-183
ugugcauuuucuucuugcaaucu

SEQ ID NO: 553447 - RNA, 15 nt, Chlamydophila pneumoniae TW-183
ugucgguaauuucca

SEQ ID NO: 553448 - RNA, 23 nt, Chlamydophila pneumoniae TW-183
uguauggucucaggaucuuagau

SEQ ID NO: 553449 - RNA, 20 nt, Chlamydophila pneumoniae TW-183
uguaguuucuaaaacagaaa

SEQ ID NO: 553450 - RNA, 16 nt, Chlamydophila pneumoniae TW-183
uguauaugcuuggcaa

SEQ ID NO: 553451 - RNA, 20 nt, Chlamydophila pneumoniae TW-183
uguaacgggagcguuuuuug

SEQ ID NO: 553452 - RNA, 22 nt, Chlamydophila pneumoniae TW-183
uguaaucccagauuuuuuuggu

SEQ ID NO: 553453 - RNA, 20 nt, Chlamydophila pneumoniae TW-183
uguaaucauaaaaaaagcua

SEQ ID NO: 553454 - RNA, 24 nt, Chlamydophila pneumoniae TW-183
uguagaggucacuauagaucucuu

SEQ ID NO: 553455 - RNA, 13 nt, Chlamydophila pneumoniae TW-183
uguacacagagau

SEQ ID NO: 553456 - RNA, 16 nt, Chlamydophila pneumoniae TW-183
uguaaaacuuagaaaa

SEQ ID NO: 553457 - RNA, 22 nt, Chlamydophila pneumoniae TW-183
ugguacaauacuggagagguaa

SEQ ID NO: 553458 - RNA, 13 nt, Chlamydophila pneumoniae TW-183
ugguaaaaauaua

SEQ ID NO: 553459 - RNA, 17 nt, Chlamydophila pneumoniae TW-183
ugggaguuguaaaacuu

SEQ ID NO: 553460 - RNA, 17 nt, Chlamydophila pneumoniae TW-183
uucacuuacagauaagg

SEQ ID NO: 553461 - RNA, 22 nt, Chlamydophila pneumoniae TW-183
uucacuuacagauaaggaagag

SEQ ID NO: 553462 - RNA, 13 nt, Chlamydophila pneumoniae TW-183
uucaccagaagca

SEQ ID NO: 553463 - RNA, 14 nt, Chlamydophila pneumoniae TW-183
uucaagucuguaag

SEQ ID NO: 553464 - RNA, 13 nt, Chlamydophila pneumoniae TW-183
uucaagucuguaa

SEQ ID NO: 553465 - RNA, 21 nt, Chlamydophila pneumoniae TW-183
uucaaugauuucuuuagcuuu

SEQ ID NO: 553466 - RNA, 15 nt, Chlamydophila pneumoniae TW-183
uucacaagaaaacaa

SEQ ID NO: 553467 - RNA, 20 nt, Chlamydophila pneumoniae TW-183
uuagggaugguuuccucuau

SEQ ID NO: 553468 - RNA, 13 nt, Chlamydophila pneumoniae TW-183
uuauuuucuggug

SEQ ID NO: 553469 - RNA, 20 nt, Chlamydophila pneumoniae TW-183
uucaacaaaggcuccaaacg

SEQ ID NO: 553470 - RNA, 14 nt, Chlamydophila pneumoniae TW-183
uucauguccuccau

SEQ ID NO: 553471 - RNA, 22 nt, Chlamydophila pneumoniae TW-183
uucauguccuccauggaaagaa

SEQ ID NO: 553472 - RNA, 13 nt, Chlamydophila pneumoniae TW-183
uucauugcaaaaa

SEQ ID NO: 553473 - RNA, 14 nt, Chlamydophila pneumoniae TW-183
uucauugcagauau

SEQ ID NO: 553474 - RNA, 17 nt, Chlamydophila pneumoniae TW-183
uucauugcagauauacu

SEQ ID NO: 553475 - RNA, 13 nt, Chlamydophila pneumoniae TW-183
uuccaacuucaac

SEQ ID NO: 553476 - RNA, 13 nt, Chlamydophila pneumoniae TW-183
uuccaagagucuu

SEQ ID NO: 553477 - RNA, 23 nt, Chlamydophila pneumoniae TW-183
uucaucaagaacccgagacuucu

SEQ ID NO: 553478 - RNA, 15 nt, Chlamydophila pneumoniae TW-183
uucaucaauaaagau

SEQ ID NO: 553479 - RNA, 14 nt, Chlamydophila pneumoniae TW-183
uucagugcuguuuu

SEQ ID NO: 553480 - RNA, 19 nt, Chlamydophila pneumoniae TW-183
uucagugcuguuuuuucac

SEQ ID NO: 553481 - RNA, 13 nt, Chlamydophila pneumoniae TW-183
uucauaaaacugu

SEQ ID NO: 553482 - RNA, 24 nt, Chlamydophila pneumoniae TW-183
uucuucuaaaaucuucucugcuau

SEQ ID NO: 553483 - RNA, 17 nt, Chlamydophila pneumoniae TW-183
uucuucgguguagaucu

SEQ ID NO: 553484 - RNA, 20 nt, Chlamydophila pneumoniae TW-183
uucuucacaaucuaaauaag

SEQ ID NO: 553485 - RNA, 18 nt, Chlamydophila pneumoniae TW-183
uucuuccaaagcuucuuu

SEQ ID NO: 553486 - RNA, 20 nt, Chlamydophila pneumoniae TW-183
uucuuaucaaaauaaaaaaa

SEQ ID NO: 553487 - RNA, 22 nt, Chlamydophila pneumoniae TW-183
uucuuauccuugaaauugcucu

SEQ ID NO: 553488 - RNA, 14 nt, Chlamydophila pneumoniae TW-183
uucucaagaucuuc

SEQ ID NO: 553489 - RNA, 17 nt, Chlamydophila pneumoniae TW-183
uucuauauguaauuucc

SEQ ID NO: 553490 - RNA, 17 nt, Chlamydophila pneumoniae TW-183
uucuauuuucaggaggc

SEQ ID NO: 553491 - RNA, 12 nt, Chlamydophila pneumoniae TW-183
uucuaaacaauu

SEQ ID NO: 553492 - RNA, 22 nt, Chlamydophila pneumoniae TW-183
uucuaaaacagaaauugcuucu

SEQ ID NO: 553493 - RNA, 20 nt, Chlamydophila pneumoniae TW-183
uucuggaagauguuguuuuu

SEQ ID NO: 553494 - RNA, 21 nt, Chlamydophila pneumoniae TW-183
uucuccaguaucuucucuuau

SEQ ID NO: 553495 - RNA, 17 nt, Chlamydophila pneumoniae TW-183
uucgcggaucuucuucu

SEQ ID NO: 553496 - RNA, 22 nt, Chlamydophila pneumoniae TW-183
uucguuuccgaucauuuuugcu

SEQ ID NO: 553497 - RNA, 13 nt, Chlamydophila pneumoniae TW-183
uucgucuucauaa

SEQ ID NO: 553498 - RNA, 13 nt, Chlamydophila pneumoniae TW-183
uucgauuccugag

SEQ ID NO: 553499 - RNA, 18 nt, Chlamydophila pneumoniae TW-183
uucgacaaccaaaacaga

SEQ ID NO: 553500 - RNA, 19 nt, Chlamydophila pneumoniae TW-183
uuccggggagaacuucaac

SEQ ID NO: 553501 - RNA, 21 nt, Chlamydophila pneumoniae TW-183
uuccccuucagaggcuagaaa

SEQ ID NO: 553502 - RNA, 13 nt, Chlamydophila pneumoniae TW-183
uuccccuucauca

SEQ ID NO: 553503 - RNA, 15 nt, Chlamydophila pneumoniae TW-183
uucccuauaaagcaa

SEQ ID NO: 553504 - RNA, 22 nt, Chlamydophila pneumoniae TW-183
uucccguacgaguaucuacuuu

SEQ ID NO: 553505 - RNA, 16 nt, Chlamydophila pneumoniae TW-183
uuccccuaauagggga

SEQ ID NO: 553506 - RNA, 23 nt, Chlamydophila pneumoniae TW-183
uuccaauccauucugagaaagaa

SEQ ID NO: 553507 - RNA, 20 nt, Chlamydophila pneumoniae TW-183
uuccaauccauucugagaaa

SEQ ID NO: 553508 - RNA, 21 nt, Chlamydophila pneumoniae TW-183
uuguguauggucucaggaucu

SEQ ID NO: 553509 - RNA, 23 nt, Chlamydophila pneumoniae TW-183
uuguggacaacgauuguaaaagu

SEQ ID NO: 553510 - RNA, 17 nt, Chlamydophila pneumoniae TW-183
uugugauccuugcaaaa

SEQ ID NO: 553511 - RNA, 20 nt, Chlamydophila pneumoniae TW-183
uugucucgaaacucuuugag

SEQ ID NO: 553512 - RNA, 22 nt, Chlamydophila pneumoniae TW-183
uuuaucccagauaaagacaucu

SEQ ID NO: 553513 - RNA, 14 nt, Chlamydophila pneumoniae TW-183
uuuauauuaagaau

SEQ ID NO: 553514 - RNA, 20 nt, Chlamydophila pneumoniae TW-183
uuuacacugcuucaaaacau

SEQ ID NO: 553515 - RNA, 17 nt, Chlamydophila pneumoniae TW-183
uuuaacuucuaaaagca

SEQ ID NO: 553516 - RNA, 21 nt, Chlamydophila pneumoniae TW-183
uuuaaucgauacgguuuuuau

SEQ ID NO: 553517 - RNA, 16 nt, Chlamydophila pneumoniae TW-183
uugggauaaaaaguuu

SEQ ID NO: 553518 - RNA, 21 nt, Chlamydophila pneumoniae TW-183
uugggagauccugaaaaaaga

SEQ ID NO: 553519 - RNA, 14 nt, Chlamydophila pneumoniae TW-183
uuggcaauagcuuu

SEQ ID NO: 553520 - RNA, 15 nt, Chlamydophila pneumoniae TW-183
uuggauaggauagga

SEQ ID NO: 553521 - RNA, 16 nt, Chlamydophila pneumoniae TW-183
uuggaucuagagaaga

SEQ ID NO: 553522 - RNA, 20 nt, Chlamydophila pneumoniae TW-183
uuggaucuagagaagaaaag

SEQ ID NO: 553523 - RNA, 14 nt, Chlamydophila pneumoniae TW-183
uugcgacauaacca

SEQ ID NO: 553524 - RNA, 12 nt, Chlamydophila pneumoniae TW-183
uugccuuucucu

SEQ ID NO: 553525 - RNA, 19 nt, Chlamydophila pneumoniae TW-183
uugcagcucggaaugcucu

SEQ ID NO: 553526 - RNA, 14 nt, Chlamydophila pneumoniae TW-183
uugcauagauaucu

SEQ ID NO: 553527 - RNA, 21 nt, Chlamydophila pneumoniae TW-183
uugcauuaaaucguacuucac

SEQ ID NO: 553528 - RNA, 19 nt, Chlamydophila pneumoniae TW-183
uugauguacaguaaaguau

SEQ ID NO: 553529 - RNA, 15 nt, Chlamydophila pneumoniae TW-183
uugaucgcuugugca

SEQ ID NO: 553530 - RNA, 22 nt, Chlamydophila pneumoniae TW-183
uugaggauacgaauaaguuuug

SEQ ID NO: 553531 - RNA, 22 nt, Chlamydophila pneumoniae TW-183
uucuuggucggaguuuuuuucu

SEQ ID NO: 553532 - RNA, 19 nt, Chlamydophila pneumoniae TW-183
uugagccaacagguucacu

SEQ ID NO: 553533 - RNA, 20 nt, Chlamydophila pneumoniae TW-183
aagcugacaaauagaaagga

SEQ ID NO: 553534 - RNA, 19 nt, Chlamydophila pneumoniae TW-183
aagcuggauucugucuaua

SEQ ID NO: 553535 - RNA, 22 nt, Chlamydophila pneumoniae TW-183
aagcuucguccugacacaacuc

SEQ ID NO: 553536 - RNA, 23 nt, Chlamydophila pneumoniae TW-183
aaggaccuguuuucuuuucugaa

SEQ ID NO: 553537 - RNA, 16 nt, Chlamydophila pneumoniae TW-183
aaggacaaucaacauu

SEQ ID NO: 553538 - RNA, 13 nt, Chlamydophila pneumoniae TW-183
aagaagguugaga

SEQ ID NO: 553539 - RNA, 15 nt, Chlamydophila pneumoniae TW-183
aagaagugcuuuuag

SEQ ID NO: 553540 - RNA, 20 nt, Chlamydophila pneumoniae TW-183
aagccaugcaaugaaggcgu

SEQ ID NO: 553541 - RNA, 18 nt, Chlamydophila pneumoniae TW-183
aaguacuaauuacagaau

SEQ ID NO: 553542 - RNA, 15 nt, Chlamydophila pneumoniae TW-183
aaguaaagaaauucu

SEQ ID NO: 553543 - RNA, 14 nt, Chlamydophila pneumoniae TW-183
aaggucacagcauu

SEQ ID NO: 553544 - RNA, 18 nt, Chlamydophila pneumoniae TW-183
aaggcggcuuuuugcaag

SEQ ID NO: 553545 - RNA, 14 nt, Chlamydophila pneumoniae TW-183
aaggauucugagaa

SEQ ID NO: 553546 - RNA, 13 nt, Chlamydophila pneumoniae TW-183
aagucaugaggac

SEQ ID NO: 553547 - RNA, 23 nt, Chlamydophila pneumoniae TW-183
aagucaaacaucacucaggauau

SEQ ID NO: 553548 - RNA, 18 nt, Chlamydophila pneumoniae TW-183
aagugauaaggaagaauu

SEQ ID NO: 553549 - RNA, 17 nt, Chlamydophila pneumoniae TW-183
aagugaucuugagaaaa

SEQ ID NO: 553550 - RNA, 20 nt, Chlamydophila pneumoniae TW-183
aagugucugaguuagcuuuu

SEQ ID NO: 553551 - RNA, 16 nt, Chlamydophila pneumoniae TW-183
aaguuagguagauaga

SEQ ID NO: 553552 - RNA, 18 nt, Chlamydophila pneumoniae TW-183
aauaggcacccaaacuga

SEQ ID NO: 553553 - RNA, 14 nt, Chlamydophila pneumoniae TW-183
aauagggugggagu

SEQ ID NO: 553554 - RNA, 14 nt, Chlamydophila pneumoniae TW-183
aauauccagaaaua

SEQ ID NO: 553555 - RNA, 20 nt, Chlamydophila pneumoniae TW-183
aauagccauaauuagaacag

SEQ ID NO: 553556 - RNA, 17 nt, Chlamydophila pneumoniae TW-183
aauaccguuuuaggaag

SEQ ID NO: 553557 - RNA, 21 nt, Chlamydophila pneumoniae TW-183
aauaccaauugggcuaggguu

SEQ ID NO: 553558 - RNA, 18 nt, Chlamydophila pneumoniae TW-183
aaguuccauagaguaucu

SEQ ID NO: 553559 - RNA, 13 nt, Chlamydophila pneumoniae TW-183
aaguugagagaga

SEQ ID NO: 553560 - RNA, 23 nt, Chlamydophila pneumoniae TW-183
aauucaugcaaaacaacaucacu

SEQ ID NO: 553561 - RNA, 15 nt, Chlamydophila pneumoniae TW-183
aauuccccuucauca

SEQ ID NO: 553562 - RNA, 16 nt, Chlamydophila pneumoniae TW-183
aauugagcucucuagc

SEQ ID NO: 553563 - RNA, 23 nt, Chlamydophila pneumoniae TW-183
aauugaacguagcuacaaaauua

SEQ ID NO: 553564 - RNA, 16 nt, Chlamydophila pneumoniae TW-183
aauugcucuugcucua

SEQ ID NO: 553565 - RNA, 21 nt, Chlamydophila pneumoniae TW-183
aaugccuguacuaucuuuuuu

SEQ ID NO: 553566 - RNA, 23 nt, Chlamydophila pneumoniae TW-183
aaucugugaguacccagucaucg

SEQ ID NO: 553567 - RNA, 21 nt, Chlamydophila pneumoniae TW-183
aaucgcuguuuuagcauagca

SEQ ID NO: 553568 - RNA, 19 nt, Chlamydophila pneumoniae TW-183
aauccuucuuucugcucuu

SEQ ID NO: 553569 - RNA, 12 nt, Chlamydophila pneumoniae TW-183
aauccuucuuuc

SEQ ID NO: 553570 - RNA, 20 nt, Chlamydophila pneumoniae TW-183
aauccuccuagguucuuuuu

SEQ ID NO: 553571 - RNA, 21 nt, Chlamydophila pneumoniae TW-183
aauccgauaagauaaagaauu

SEQ ID NO: 553572 - RNA, 16 nt, Chlamydophila pneumoniae TW-183
aaucccgugcuaggaa

SEQ ID NO: 553573 - RNA, 15 nt, Chlamydophila pneumoniae TW-183
aaucccugcacucuu

SEQ ID NO: 553574 - RNA, 21 nt, Chlamydophila pneumoniae TW-183
aauccauucugagaaagaagu

SEQ ID NO: 553575 - RNA, 20 nt, Chlamydophila pneumoniae TW-183
aauccauucugagaaagaag

SEQ ID NO: 553576 - RNA, 18 nt, Chlamydophila pneumoniae TW-183
aauccauucugagaaaga

SEQ ID NO: 553577 - RNA, 14 nt, Chlamydophila pneumoniae TW-183
aauccaccaaugau

SEQ ID NO: 553578 - RNA, 20 nt, Chlamydophila pneumoniae TW-183
aagaaauauacugccagcga

SEQ ID NO: 553579 - RNA, 18 nt, Chlamydophila pneumoniae TW-183
aagaagcuuuccuccuug

SEQ ID NO: 553580 - RNA, 22 nt, Chlamydophila pneumoniae TW-183
aagaagacuagcuuuucauguu

SEQ ID NO: 553581 - RNA, 12 nt, Chlamydophila pneumoniae TW-183
aagaaauucuga

SEQ ID NO: 553582 - RNA, 17 nt, Chlamydophila pneumoniae TW-183
aagaaauucugacuaua

SEQ ID NO: 553583 - RNA, 20 nt, Chlamydophila pneumoniae TW-183
aacuuagaaaagugaagaaa

SEQ ID NO: 553584 - RNA, 19 nt, Chlamydophila pneumoniae TW-183
aacuucaacuucuccaacu

SEQ ID NO: 553585 - RNA, 20 nt, Chlamydophila pneumoniae TW-183
aacuucuugugauccuugca

SEQ ID NO: 553586 - RNA, 14 nt, Chlamydophila pneumoniae TW-183
aacuucuaaaagca

SEQ ID NO: 553587 - RNA, 14 nt, Chlamydophila pneumoniae TW-183
aacuugagccaaca

SEQ ID NO: 553588 - RNA, 19 nt, Chlamydophila pneumoniae TW-183
aacuuguuuucguaagaga

SEQ ID NO: 553589 - RNA, 17 nt, Chlamydophila pneumoniae TW-183
aacuuggugagcagcuu

SEQ ID NO: 553590 - RNA, 15 nt, Chlamydophila pneumoniae TW-183
aacugcauaaucuca

SEQ ID NO: 553591 - RNA, 15 nt, Chlamydophila pneumoniae TW-183
aacugaugccaagaa

SEQ ID NO: 553592 - RNA, 23 nt, Chlamydophila pneumoniae TW-183
aacugaggcaaagauuuccaauc

SEQ ID NO: 553593 - RNA, 15 nt, Chlamydophila pneumoniae TW-183
aacuccaaaauauuc

SEQ ID NO: 553594 - RNA, 22 nt, Chlamydophila pneumoniae TW-183
aacuccuaagucguuaacauca

SEQ ID NO: 553595 - RNA, 16 nt, Chlamydophila pneumoniae TW-183
aacuccaaaauauucu

SEQ ID NO: 553596 - RNA, 18 nt, Chlamydophila pneumoniae TW-183
aacuccccaguuuuccau

SEQ ID NO: 553597 - RNA, 23 nt, Chlamydophila pneumoniae TW-183
aacuccucuaaggacaaaucucc

SEQ ID NO: 553598 - RNA, 13 nt, Chlamydophila pneumoniae TW-183
aacucuuugagga

SEQ ID NO: 553599 - RNA, 15 nt, Chlamydophila pneumoniae TW-183
aacgugcugcgaauu

SEQ ID NO: 553600 - RNA, 18 nt, Chlamydophila pneumoniae TW-183
aacguagcuacaaaauua

SEQ ID NO: 553601 - RNA, 19 nt, Chlamydophila pneumoniae TW-183
aacuaagaauaccuauagg

SEQ ID NO: 553602 - RNA, 14 nt, Chlamydophila pneumoniae TW-183
aacuaaacucucca

SEQ ID NO: 553603 - RNA, 17 nt, Chlamydophila pneumoniae TW-183
aacuaaaucaacuacau

SEQ ID NO: 553604 - RNA, 22 nt, Chlamydophila pneumoniae TW-183
aacuaaaaugguaaaccuaccu

SEQ ID NO: 553605 - RNA, 12 nt, Chlamydophila pneumoniae TW-183
aacguacuuagg

SEQ ID NO: 553606 - RNA, 15 nt, Chlamydophila pneumoniae TW-183
aacguacuuagguaa

SEQ ID NO: 553607 - RNA, 22 nt, Chlamydophila pneumoniae TW-183
aacgguugucucgaaacucuuu

SEQ ID NO: 553608 - RNA, 23 nt, Chlamydophila pneumoniae TW-183
aacgggagcguuuuuugaaaauu

SEQ ID NO: 553609 - RNA, 19 nt, Chlamydophila pneumoniae TW-183
aacgcucucuagcaccuaa

SEQ ID NO: 553610 - RNA, 18 nt, Chlamydophila pneumoniae TW-183
aacgccaacacgcacaaa

SEQ ID NO: 553611 - RNA, 14 nt, Chlamydophila pneumoniae TW-183
aacgcacgccaaga

SEQ ID NO: 553612 - RNA, 15 nt, Chlamydophila pneumoniae TW-183
aacgcacgccaagag

SEQ ID NO: 553613 - RNA, 16 nt, Chlamydophila pneumoniae TW-183
aacgcacgccaagaga

SEQ ID NO: 553614 - RNA, 19 nt, Chlamydophila pneumoniae TW-183
aaccuucgauuccaggcuc

SEQ ID NO: 553615 - RNA, 13 nt, Chlamydophila pneumoniae TW-183
aaccauaaagaau

SEQ ID NO: 553616 - RNA, 19 nt, Chlamydophila pneumoniae TW-183
aaccauucaucuaggggag

SEQ ID NO: 553617 - RNA, 19 nt, Chlamydophila pneumoniae TW-183
aaccagaacacaugucucu

SEQ ID NO: 553618 - RNA, 11 nt, Chlamydophila pneumoniae TW-183
aaccagagagc

SEQ ID NO: 553619 - RNA, 19 nt, Chlamydophila pneumoniae TW-183
aaccacuguccaugcacga

SEQ ID NO: 553620 - RNA, 20 nt, Chlamydophila pneumoniae TW-183
aaccaaaagaauuaagaaga

SEQ ID NO: 553621 - RNA, 19 nt, Chlamydophila pneumoniae TW-183
aacauaaccuccucuucuu

SEQ ID NO: 553622 - RNA, 17 nt, Chlamydophila pneumoniae TW-183
aacaucacucaggauau

SEQ ID NO: 553623 - RNA, 18 nt, Chlamydophila pneumoniae TW-183
aacaucacuuauauuuuc

SEQ ID NO: 553624 - RNA, 16 nt, Chlamydophila pneumoniae TW-183
aacauagauaagguaa

SEQ ID NO: 553625 - RNA, 15 nt, Chlamydophila pneumoniae TW-183
aacauagauaaggua

SEQ ID NO: 553626 - RNA, 21 nt, Chlamydophila pneumoniae TW-183
aacagcauggacuccaagaau

SEQ ID NO: 553627 - RNA, 19 nt, Chlamydophila pneumoniae TW-183
aacagcauggacuccaaga

SEQ ID NO: 553628 - RNA, 21 nt, Chlamydophila pneumoniae TW-183
aacagcgguugccuuucucuu

SEQ ID NO: 553629 - RNA, 22 nt, Chlamydophila pneumoniae TW-183
aacagcuccuggauauugucaa

SEQ ID NO: 553630 - RNA, 20 nt, Chlamydophila pneumoniae TW-183
aacagauaagacaauaaaau

SEQ ID NO: 553631 - RNA, 14 nt, Chlamydophila pneumoniae TW-183
aacagaaauugcuu

SEQ ID NO: 553632 - RNA, 16 nt, Chlamydophila pneumoniae TW-183
aacagaaauugcuucu

SEQ ID NO: 553633 - RNA, 16 nt, Chlamydophila pneumoniae TW-183
aacacgcacaaacuaa

SEQ ID NO: 553634 - RNA, 20 nt, Chlamydophila pneumoniae TW-183
aacaccuucuucuaaaaucu

SEQ ID NO: 553635 - RNA, 19 nt, Chlamydophila pneumoniae TW-183
aacacaugucucuuaaaaa

SEQ ID NO: 553636 - RNA, 23 nt, Chlamydophila pneumoniae TW-183
aacacaugucucuuaaaaaaaau

SEQ ID NO: 553637 - RNA, 20 nt, Chlamydophila pneumoniae TW-183
aacacagauaggaaccacuu

SEQ ID NO: 553638 - RNA, 14 nt, Chlamydophila pneumoniae TW-183
aacacaaauagcaa

SEQ ID NO: 553639 - RNA, 15 nt, Chlamydophila pneumoniae TW-183
aaauuucauuuagac

SEQ ID NO: 553640 - RNA, 20 nt, Chlamydophila pneumoniae TW-183
aaauuguuaucaggaacuaa

SEQ ID NO: 553641 - RNA, 22 nt, Chlamydophila pneumoniae TW-183
aacaaaguuuaugacacagcua

SEQ ID NO: 553642 - RNA, 12 nt, Chlamydophila pneumoniae TW-183
aacaaaguuuau

SEQ ID NO: 553643 - RNA, 21 nt, Chlamydophila pneumoniae TW-183
aacaaacuuguuuucguaaga

SEQ ID NO: 553644 - RNA, 16 nt, Chlamydophila pneumoniae TW-183
aacaaaaucaaaaacu

SEQ ID NO: 553645 - RNA, 11 nt, Chlamydophila pneumoniae TW-183
aacaacaucac

SEQ ID NO: 553646 - RNA, 23 nt, Chlamydophila pneumoniae TW-183
aacaacaucacuaucauggacaa

SEQ ID NO: 553647 - RNA, 22 nt, Chlamydophila pneumoniae TW-183
aacaacaucacuuauauuuucu

SEQ ID NO: 553648 - RNA, 14 nt, Chlamydophila pneumoniae TW-183
aacaaguaccaaga

SEQ ID NO: 553649 - RNA, 22 nt, Chlamydophila pneumoniae TW-183
aacaagagcgcauuuuacagcg

SEQ ID NO: 553650 - RNA, 13 nt, Chlamydophila pneumoniae TW-183
acauaaagucaaa

SEQ ID NO: 553651 - RNA, 19 nt, Chlamydophila pneumoniae TW-183
acaucaaauaguucaucau

SEQ ID NO: 553652 - RNA, 16 nt, Chlamydophila pneumoniae TW-183
acaucaaauaguucau

SEQ ID NO: 553653 - RNA, 22 nt, Chlamydophila pneumoniae TW-183
acaucacuuauauuuucuauuc

SEQ ID NO: 553654 - RNA, 22 nt, Chlamydophila pneumoniae TW-183
acagcuucuucguaagcugcaa

SEQ ID NO: 553655 - RNA, 15 nt, Chlamydophila pneumoniae TW-183
acaggagagagaagg

SEQ ID NO: 553656 - RNA, 13 nt, Chlamydophila pneumoniae TW-183
acacugcgagaga

SEQ ID NO: 553657 - RNA, 19 nt, Chlamydophila pneumoniae TW-183
acacuuaaagguaaaacua

SEQ ID NO: 553658 - RNA, 20 nt, Chlamydophila pneumoniae TW-183
accauagaaagauaacgaga

SEQ ID NO: 553659 - RNA, 17 nt, Chlamydophila pneumoniae TW-183
accacggauuuucucua

SEQ ID NO: 553660 - RNA, 21 nt, Chlamydophila pneumoniae TW-183
accaauuccccuucaucaaua

SEQ ID NO: 553661 - RNA, 20 nt, Chlamydophila pneumoniae TW-183
acaugucucuuaaaaaaaau

SEQ ID NO: 553662 - RNA, 21 nt, Chlamydophila pneumoniae TW-183
acgaucgucaguaaaacacaa

SEQ ID NO: 553663 - RNA, 21 nt, Chlamydophila pneumoniae TW-183
acgaguucgcggaucuucuuc

SEQ ID NO: 553664 - RNA, 16 nt, Chlamydophila pneumoniae TW-183
acgacguuuugcugug

SEQ ID NO: 553665 - RNA, 16 nt, Chlamydophila pneumoniae TW-183
accuugagacaaagaa

SEQ ID NO: 553666 - RNA, 21 nt, Chlamydophila pneumoniae TW-183
accuugagacaaagaaucccc

SEQ ID NO: 553667 - RNA, 16 nt, Chlamydophila pneumoniae TW-183
accuucacaagaaaac

SEQ ID NO: 553668 - RNA, 18 nt, Chlamydophila pneumoniae TW-183
accuucgauuccaggcuc

SEQ ID NO: 553669 - RNA, 21 nt, Chlamydophila pneumoniae TW-183
accuucaaugauuucuuuagc

SEQ ID NO: 553670 - RNA, 18 nt, Chlamydophila pneumoniae TW-183
accuucaaugauuucuuu

SEQ ID NO: 553671 - RNA, 13 nt, Chlamydophila pneumoniae TW-183
accuucaacaaga

SEQ ID NO: 553672 - RNA, 13 nt, Chlamydophila pneumoniae TW-183
accuguuuucuuu

SEQ ID NO: 553673 - RNA, 17 nt, Chlamydophila pneumoniae TW-183
accugugaaaauuuucu

SEQ ID NO: 553674 - RNA, 19 nt, Chlamydophila pneumoniae TW-183
accuggauugauccacaga

SEQ ID NO: 553675 - RNA, 19 nt, Chlamydophila pneumoniae TW-183
accucaagaugcauucuga

SEQ ID NO: 553676 - RNA, 22 nt, Chlamydophila pneumoniae TW-183
accuauagguucaccagaagca

SEQ ID NO: 553677 - RNA, 12 nt, Chlamydophila pneumoniae TW-183
accuaaaacaaa

SEQ ID NO: 553678 - RNA, 13 nt, Chlamydophila pneumoniae TW-183
accccuagaacuu

SEQ ID NO: 553679 - RNA, 22 nt, Chlamydophila pneumoniae TW-183
accgaucucaguaggagcagcg

SEQ ID NO: 553680 - RNA, 16 nt, Chlamydophila pneumoniae TW-183
agaaacuccaaaauau

SEQ ID NO: 553681 - RNA, 17 nt, Chlamydophila pneumoniae TW-183
agaaacuccaaaauauu

SEQ ID NO: 553682 - RNA, 21 nt, Chlamydophila pneumoniae TW-183
agaaaaauucuuuagggaggc

SEQ ID NO: 553683 - RNA, 15 nt, Chlamydophila pneumoniae TW-183
acuuuuguacacaga

SEQ ID NO: 553684 - RNA, 18 nt, Chlamydophila pneumoniae TW-183
acuuuuguacacagagau

SEQ ID NO: 553685 - RNA, 22 nt, Chlamydophila pneumoniae TW-183
acuuuuguacacagagaugcuu

SEQ ID NO: 553686 - RNA, 23 nt, Chlamydophila pneumoniae TW-183
agaacugcauaaucucaccagaa

SEQ ID NO: 553687 - RNA, 21 nt, Chlamydophila pneumoniae TW-183
agaacguccucaccuugugag

SEQ ID NO: 553688 - RNA, 20 nt, Chlamydophila pneumoniae TW-183
agaaccuucacaagaaaaca

SEQ ID NO: 553689 - RNA, 19 nt, Chlamydophila pneumoniae TW-183
agaaccuucacaagaaaac

SEQ ID NO: 553690 - RNA, 15 nt, Chlamydophila pneumoniae TW-183
agaaccuucacaaga

SEQ ID NO: 553691 - RNA, 22 nt, Chlamydophila pneumoniae TW-183
agaaccuaggaaauccuccuag

SEQ ID NO: 553692 - RNA, 21 nt, Chlamydophila pneumoniae TW-183
agaacccgagacuucucucuu

SEQ ID NO: 553693 - RNA, 21 nt, Chlamydophila pneumoniae TW-183
agaacacucagagauguggca

SEQ ID NO: 553694 - RNA, 21 nt, Chlamydophila pneumoniae TW-183
agaacagcauggacuccaaga

SEQ ID NO: 553695 - RNA, 15 nt, Chlamydophila pneumoniae TW-183
agaacaugcccccac

SEQ ID NO: 553696 - RNA, 13 nt, Chlamydophila pneumoniae TW-183
agaaauucugacu

SEQ ID NO: 553697 - RNA, 13 nt, Chlamydophila pneumoniae TW-183
agacguaaccaca

SEQ ID NO: 553698 - RNA, 15 nt, Chlamydophila pneumoniae TW-183
agaccugccaagaua

SEQ ID NO: 553699 - RNA, 16 nt, Chlamydophila pneumoniae TW-183
agaauuucgucuucau

SEQ ID NO: 553700 - RNA, 13 nt, Chlamydophila pneumoniae TW-183
agaauagcaagca

SEQ ID NO: 553701 - RNA, 12 nt, Chlamydophila pneumoniae TW-183
agaaucuuugug

SEQ ID NO: 553702 - RNA, 16 nt, Chlamydophila pneumoniae TW-183
agaaucuccucaucag

SEQ ID NO: 553703 - RNA, 22 nt, Chlamydophila pneumoniae TW-183
agaagcuuuccuccuuguuucc

SEQ ID NO: 553704 - RNA, 22 nt, Chlamydophila pneumoniae TW-183
agaagcugacaaauagaaagga

SEQ ID NO: 553705 - RNA, 23 nt, Chlamydophila pneumoniae TW-183
agaauaccguuuuaggaagguca

SEQ ID NO: 553706 - RNA, 15 nt, Chlamydophila pneumoniae TW-183
agaagcaacuaaacu

SEQ ID NO: 553707 - RNA, 21 nt, Chlamydophila pneumoniae TW-183
agaacuuuaacgaagaaggga

SEQ ID NO: 553708 - RNA, 22 nt, Chlamydophila pneumoniae TW-183
agauggucuuggguuuuaaaug

SEQ ID NO: 553709 - RNA, 23 nt, Chlamydophila pneumoniae TW-183
agaugcuucuaaacaauuucaau

SEQ ID NO: 553710 - RNA, 17 nt, Chlamydophila pneumoniae TW-183
agaugcuucuaaacaau

SEQ ID NO: 553711 - RNA, 16 nt, Chlamydophila pneumoniae TW-183
agauucuucagaaucu

SEQ ID NO: 553712 - RNA, 22 nt, Chlamydophila pneumoniae TW-183
agauugaggauaaguucuucca

SEQ ID NO: 553713 - RNA, 19 nt, Chlamydophila pneumoniae TW-183
agauugccaggagagcuaa

SEQ ID NO: 553714 - RNA, 16 nt, Chlamydophila pneumoniae TW-183
agauucauaaaacugu

SEQ ID NO: 553715 - RNA, 23 nt, Chlamydophila pneumoniae TW-183
agaugaauaccagaagcaaaggu

SEQ ID NO: 553716 - RNA, 11 nt, Chlamydophila pneumoniae TW-183
agaucucuaag

SEQ ID NO: 553717 - RNA, 23 nt, Chlamydophila pneumoniae TW-183
agaucuggagagggaaggaauaa

SEQ ID NO: 553718 - RNA, 13 nt, Chlamydophila pneumoniae TW-183
agaucuucaucac

SEQ ID NO: 553719 - RNA, 21 nt, Chlamydophila pneumoniae TW-183
agaucgauuaccuaaaacaaa

SEQ ID NO: 553720 - RNA, 16 nt, Chlamydophila pneumoniae TW-183
agauccuagagaaugu

SEQ ID NO: 553721 - RNA, 14 nt, Chlamydophila pneumoniae TW-183
agauccugaaaaaa

SEQ ID NO: 553722 - RNA, 15 nt, Chlamydophila pneumoniae TW-183
agauccugaaaaaag

SEQ ID NO: 553723 - RNA, 13 nt, Chlamydophila pneumoniae TW-183
agauccaaaaauu

SEQ ID NO: 553724 - RNA, 21 nt, Chlamydophila pneumoniae TW-183
agauauacuuuuucagcaacg

SEQ ID NO: 553725 - RNA, 15 nt, Chlamydophila pneumoniae TW-183
agauaugaagagacg

SEQ ID NO: 553726 - RNA, 18 nt, Chlamydophila pneumoniae TW-183
agauacuuugcaauacac

SEQ ID NO: 553727 - RNA, 18 nt, Chlamydophila pneumoniae TW-183
agauacuucuccacagcu

SEQ ID NO: 553728 - RNA, 20 nt, Chlamydophila pneumoniae TW-183
agaguuuuuguguuugacug

SEQ ID NO: 553729 - RNA, 15 nt, Chlamydophila pneumoniae TW-183
agaguugcuuuaugg

SEQ ID NO: 553730 - RNA, 16 nt, Chlamydophila pneumoniae TW-183
agagugacucaucagu

SEQ ID NO: 553731 - RNA, 22 nt, Chlamydophila pneumoniae TW-183
agagcuggggauggucuucccc

SEQ ID NO: 553732 - RNA, 18 nt, Chlamydophila pneumoniae TW-183
agagucuuugaugcuaaa

SEQ ID NO: 553733 - RNA, 16 nt, Chlamydophila pneumoniae TW-183
agaguccuucuuuucc

SEQ ID NO: 553734 - RNA, 12 nt, Chlamydophila pneumoniae TW-183
agaguagcccca

SEQ ID NO: 553735 - RNA, 20 nt, Chlamydophila pneumoniae TW-183
agaggguuuuuuugcugcga

SEQ ID NO: 553736 - RNA, 16 nt, Chlamydophila pneumoniae TW-183
agagguaaccagagag

SEQ ID NO: 553737 - RNA, 17 nt, Chlamydophila pneumoniae TW-183
agaggucacuauagauc

SEQ ID NO: 553738 - RNA, 15 nt, Chlamydophila pneumoniae TW-183
agagaugcuaacaac

SEQ ID NO: 553739 - RNA, 16 nt, Chlamydophila pneumoniae TW-183
agagauucauaaaacu

SEQ ID NO: 553740 - RNA, 19 nt, Chlamydophila pneumoniae TW-183
acuucccgaacagcggcaa

SEQ ID NO: 553741 - RNA, 17 nt, Chlamydophila pneumoniae TW-183
acuuccccaaacaugga

SEQ ID NO: 553742 - RNA, 20 nt, Chlamydophila pneumoniae TW-183
acugucuagcaguugcaaua

SEQ ID NO: 553743 - RNA, 22 nt, Chlamydophila pneumoniae TW-183
acuuaagauacuucuccacagc

SEQ ID NO: 553744 - RNA, 17 nt, Chlamydophila pneumoniae TW-183
acuuagguaauguaguc

SEQ ID NO: 553745 - RNA, 24 nt, Chlamydophila pneumoniae TW-183
acuuaggguucucaaagaucaucu

SEQ ID NO: 553746 - RNA, 17 nt, Chlamydophila pneumoniae TW-183
acuuaaagguaaaacua

SEQ ID NO: 553747 - RNA, 22 nt, Chlamydophila pneumoniae TW-183
acuggagagguaaccagagagc

SEQ ID NO: 553748 - RNA, 21 nt, Chlamydophila pneumoniae TW-183
acuggaggcuguguaaaaguu

SEQ ID NO: 553749 - RNA, 16 nt, Chlamydophila pneumoniae TW-183
acugcuucaaaacaua

SEQ ID NO: 553750 - RNA, 15 nt, Chlamydophila pneumoniae TW-183
acugcgagagaaagu

SEQ ID NO: 553751 - RNA, 22 nt, Chlamydophila pneumoniae TW-183
acugccagcgaucacauagaaa

SEQ ID NO: 553752 - RNA, 16 nt, Chlamydophila pneumoniae TW-183
acugcauaaucucacc

SEQ ID NO: 553753 - RNA, 14 nt, Chlamydophila pneumoniae TW-183
acugaggcaaagau

SEQ ID NO: 553754 - RNA, 22 nt, Chlamydophila pneumoniae TW-183
acuccuaagucguuaacaucaa

SEQ ID NO: 553755 - RNA, 14 nt, Chlamydophila pneumoniae TW-183
acuccugacucuua

SEQ ID NO: 553756 - RNA, 18 nt, Chlamydophila pneumoniae TW-183
acuccuggagcuguuucu

SEQ ID NO: 553757 - RNA, 23 nt, Chlamydophila pneumoniae TW-183
acuaaaucaacuacaucuccaag

SEQ ID NO: 553758 - RNA, 13 nt, Chlamydophila pneumoniae TW-183
acuagaauaccgu

SEQ ID NO: 553759 - RNA, 14 nt, Chlamydophila pneumoniae TW-183
acuacuuacaagaa

SEQ ID NO: 553760 - RNA, 17 nt, Chlamydophila pneumoniae TW-183
acuacuuacaagaacaa

SEQ ID NO: 553761 - RNA, 16 nt, Chlamydophila pneumoniae TW-183
acuauuaggcuuuuuu

SEQ ID NO: 553762 - RNA, 23 nt, Chlamydophila pneumoniae TW-183
acuauuaggcuuuuuucuauuuu

SEQ ID NO: 553763 - RNA, 20 nt, Chlamydophila pneumoniae TW-183
acuaucauggacaagcaaaa

SEQ ID NO: 553764 - RNA, 23 nt, Chlamydophila pneumoniae TW-183
acuaucauggacaagcaaaagca

SEQ ID NO: 553765 - RNA, 17 nt, Chlamydophila pneumoniae TW-183
acuaaaccuucaaugau

SEQ ID NO: 553766 - RNA, 19 nt, Chlamydophila pneumoniae TW-183
acguacgcaaguaaagaaa

SEQ ID NO: 553767 - RNA, 17 nt, Chlamydophila pneumoniae TW-183
acgguaaugccagcagc

SEQ ID NO: 553768 - RNA, 14 nt, Chlamydophila pneumoniae TW-183
acggaaagcacaua

SEQ ID NO: 553769 - RNA, 15 nt, Chlamydophila pneumoniae TW-183
acgcaaguaaagaaa

SEQ ID NO: 553770 - RNA, 15 nt, Chlamydophila pneumoniae TW-183
aggaauuuucagccu

SEQ ID NO: 553771 - RNA, 14 nt, Chlamydophila pneumoniae TW-183
aggaaugaagagag

SEQ ID NO: 553772 - RNA, 21 nt, Chlamydophila pneumoniae TW-183
aggaaucauaaccaaaagaau

SEQ ID NO: 553773 - RNA, 15 nt, Chlamydophila pneumoniae TW-183
aggaauagagaaaga

SEQ ID NO: 553774 - RNA, 17 nt, Chlamydophila pneumoniae TW-183
aggaauagagaaagagu

SEQ ID NO: 553775 - RNA, 15 nt, Chlamydophila pneumoniae TW-183
aggaaggaauagaga

SEQ ID NO: 553776 - RNA, 14 nt, Chlamydophila pneumoniae TW-183
aggaaggaauagag

SEQ ID NO: 553777 - RNA, 22 nt, Chlamydophila pneumoniae TW-183
aggaaaucccgagauaugaaga

SEQ ID NO: 553778 - RNA, 21 nt, Chlamydophila pneumoniae TW-183
aggaaacgauuucuucuucua

SEQ ID NO: 553779 - RNA, 14 nt, Chlamydophila pneumoniae TW-183
agcuuuuuucucuu

SEQ ID NO: 553780 - RNA, 12 nt, Chlamydophila pneumoniae TW-183
agcuuuuuucuc

SEQ ID NO: 553781 - RNA, 17 nt, Chlamydophila pneumoniae TW-183
aggauacgaauaaguuu

SEQ ID NO: 553782 - RNA, 16 nt, Chlamydophila pneumoniae TW-183
aggauacgaauaaguu

SEQ ID NO: 553783 - RNA, 18 nt, Chlamydophila pneumoniae TW-183
aggauaaguucuuccaaa

SEQ ID NO: 553784 - RNA, 20 nt, Chlamydophila pneumoniae TW-183
aggaguuuucaagucuguaa

SEQ ID NO: 553785 - RNA, 12 nt, Chlamydophila pneumoniae TW-183
aggaguuuucca

SEQ ID NO: 553786 - RNA, 23 nt, Chlamydophila pneumoniae TW-183
aggaguuucuacgcgcucuucuu

SEQ ID NO: 553787 - RNA, 12 nt, Chlamydophila pneumoniae TW-183
aggagagagaag

SEQ ID NO: 553788 - RNA, 20 nt, Chlamydophila pneumoniae TW-183
aggagaccuuuauagauaug

SEQ ID NO: 553789 - RNA, 18 nt, Chlamydophila pneumoniae TW-183
aggaccuguuuucuuuuc

SEQ ID NO: 553790 - RNA, 16 nt, Chlamydophila pneumoniae TW-183
aggcauuggaaaucuu

SEQ ID NO: 553791 - RNA, 17 nt, Chlamydophila pneumoniae TW-183
aggcauggcacaguccu

SEQ ID NO: 553792 - RNA, 23 nt, Chlamydophila pneumoniae TW-183
aggcacccaaacugaugccaaga

SEQ ID NO: 553793 - RNA, 16 nt, Chlamydophila pneumoniae TW-183
aggcaagauuaugaug

SEQ ID NO: 553794 - RNA, 14 nt, Chlamydophila pneumoniae TW-183
aggcaaagauuucc

SEQ ID NO: 553795 - RNA, 13 nt, Chlamydophila pneumoniae TW-183
aggauucucucug

SEQ ID NO: 553796 - RNA, 17 nt, Chlamydophila pneumoniae TW-183
aggauucucucugccua

SEQ ID NO: 553797 - RNA, 15 nt, Chlamydophila pneumoniae TW-183
aggauucuuuuugau

SEQ ID NO: 553798 - RNA, 15 nt, Chlamydophila pneumoniae TW-183
aggaucugguugagg

SEQ ID NO: 553799 - RNA, 22 nt, Chlamydophila pneumoniae TW-183
agcuuuccuccuuguuucccag

SEQ ID NO: 553800 - RNA, 18 nt, Chlamydophila pneumoniae TW-183
agcuuuauugauagcuga

SEQ ID NO: 553801 - RNA, 17 nt, Chlamydophila pneumoniae TW-183
agcuuuuaguuucccac

SEQ ID NO: 553802 - RNA, 22 nt, Chlamydophila pneumoniae TW-183
agcuucuuguuuuuguggacaa

SEQ ID NO: 553803 - RNA, 20 nt, Chlamydophila pneumoniae TW-183
agcuucuuuagauagcucuu

SEQ ID NO: 553804 - RNA, 15 nt, Chlamydophila pneumoniae TW-183
agcuucuacagcauc

SEQ ID NO: 553805 - RNA, 14 nt, Chlamydophila pneumoniae TW-183
agcugugcauuuuc

SEQ ID NO: 553806 - RNA, 20 nt, Chlamydophila pneumoniae TW-183
agcuggggauggucuucccc

SEQ ID NO: 553807 - RNA, 18 nt, Chlamydophila pneumoniae TW-183
agcucuagggguuucccu

SEQ ID NO: 553808 - RNA, 20 nt, Chlamydophila pneumoniae TW-183
agcucuuugggauaaaaagu

SEQ ID NO: 553809 - RNA, 13 nt, Chlamydophila pneumoniae TW-183
agcucuuugauuu

SEQ ID NO: 553810 - RNA, 16 nt, Chlamydophila pneumoniae TW-183
agcugaaaucauggaa

SEQ ID NO: 553811 - RNA, 12 nt, Chlamydophila pneumoniae TW-183
agcuauuuuuga

SEQ ID NO: 553812 - RNA, 23 nt, Chlamydophila pneumoniae TW-183
agcuauuuuugaggaacgcacgc

SEQ ID NO: 553813 - RNA, 14 nt, Chlamydophila pneumoniae TW-183
agcucaaaaaguuc

SEQ ID NO: 553814 - RNA, 19 nt, Chlamydophila pneumoniae TW-183
agcuaauaagauccaaaaa

SEQ ID NO: 553815 - RNA, 16 nt, Chlamydophila pneumoniae TW-183
agcuaaucaauccaag

SEQ ID NO: 553816 - RNA, 18 nt, Chlamydophila pneumoniae TW-183
agcuaaucaauccaagaa

SEQ ID NO: 553817 - RNA, 22 nt, Chlamydophila pneumoniae TW-183
agcuaaauuguuaucaggaacu

SEQ ID NO: 553818 - RNA, 17 nt, Chlamydophila pneumoniae TW-183
agcgggauaggcaagau

SEQ ID NO: 553819 - RNA, 17 nt, Chlamydophila pneumoniae TW-183
agcggacuuuagcgcua

SEQ ID NO: 553820 - RNA, 19 nt, Chlamydophila pneumoniae TW-183
agcggaacaacuuugaggc

SEQ ID NO: 553821 - RNA, 23 nt, Chlamydophila pneumoniae TW-183
agggacagucuccuggaacagua

SEQ ID NO: 553822 - RNA, 19 nt, Chlamydophila pneumoniae TW-183
aggcuuuaccauagaaaga

SEQ ID NO: 553823 - RNA, 20 nt, Chlamydophila pneumoniae TW-183
aggcuuuaccauagaaagau

SEQ ID NO: 553824 - RNA, 17 nt, Chlamydophila pneumoniae TW-183
aggcuguguaaaaguua

SEQ ID NO: 553825 - RNA, 21 nt, Chlamydophila pneumoniae TW-183
aggcugccagagauucuucac

SEQ ID NO: 553826 - RNA, 23 nt, Chlamydophila pneumoniae TW-183
agggggaucuucagagagaacag

SEQ ID NO: 553827 - RNA, 19 nt, Chlamydophila pneumoniae TW-183
agggcauucucuaaaugau

SEQ ID NO: 553828 - RNA, 16 nt, Chlamydophila pneumoniae TW-183
aggcugcacacauccu

SEQ ID NO: 553829 - RNA, 15 nt, Chlamydophila pneumoniae TW-183
aggcuacugaagagg

SEQ ID NO: 553830 - RNA, 17 nt, Chlamydophila pneumoniae TW-183
aguaaucacuucagcac

SEQ ID NO: 553831 - RNA, 15 nt, Chlamydophila pneumoniae TW-183
aguaccaagaaaaua

SEQ ID NO: 553832 - RNA, 20 nt, Chlamydophila pneumoniae TW-183
aguaaagaaauucuggaguc

SEQ ID NO: 553833 - RNA, 13 nt, Chlamydophila pneumoniae TW-183
aguaaaacacaaa

SEQ ID NO: 553834 - RNA, 14 nt, Chlamydophila pneumoniae TW-183
agguuuuuccaacu

SEQ ID NO: 553835 - RNA, 16 nt, Chlamydophila pneumoniae TW-183
agguggguagccagga

SEQ ID NO: 553836 - RNA, 17 nt, Chlamydophila pneumoniae TW-183
aggucuuccaucucuuu

SEQ ID NO: 553837 - RNA, 18 nt, Chlamydophila pneumoniae TW-183
agguaguccgcagauuuu

SEQ ID NO: 553838 - RNA, 16 nt, Chlamydophila pneumoniae TW-183
aggucacagcauuuuc

SEQ ID NO: 553839 - RNA, 20 nt, Chlamydophila pneumoniae TW-183
aggucacagcauuuucucug

SEQ ID NO: 553840 - RNA, 14 nt, Chlamydophila pneumoniae TW-183
agguaucuccuuga

SEQ ID NO: 553841 - RNA, 19 nt, Chlamydophila pneumoniae TW-183
aucagcaucggugucuaca

SEQ ID NO: 553842 - RNA, 18 nt, Chlamydophila pneumoniae TW-183
aucagaagccaccaaaaa

SEQ ID NO: 553843 - RNA, 22 nt, Chlamydophila pneumoniae TW-183
aucagaagccaccaaaaauucc

SEQ ID NO: 553844 - RNA, 20 nt, Chlamydophila pneumoniae TW-183
aucagaaaaaaugcguuuug

SEQ ID NO: 553845 - RNA, 15 nt, Chlamydophila pneumoniae TW-183
aucacguccuucuau

SEQ ID NO: 553846 - RNA, 17 nt, Chlamydophila pneumoniae TW-183
aucacauagaaaacaua

SEQ ID NO: 553847 - RNA, 15 nt, Chlamydophila pneumoniae TW-183
aucacauagaaaaca

SEQ ID NO: 553848 - RNA, 22 nt, Chlamydophila pneumoniae TW-183
aucacacuuaaagguaaaacua

SEQ ID NO: 553849 - RNA, 14 nt, Chlamydophila pneumoniae TW-183
aucaacauucuucu

SEQ ID NO: 553850 - RNA, 22 nt, Chlamydophila pneumoniae TW-183
aucaaccgaagauccuagagaa

SEQ ID NO: 553851 - RNA, 21 nt, Chlamydophila pneumoniae TW-183
auauuuuuugagaaauauaaa

SEQ ID NO: 553852 - RNA, 12 nt, Chlamydophila pneumoniae TW-183
auauccagaaau

SEQ ID NO: 553853 - RNA, 13 nt, Chlamydophila pneumoniae TW-183
auaucgauaggau

SEQ ID NO: 553854 - RNA, 18 nt, Chlamydophila pneumoniae TW-183
auaucagcauauuuccga

SEQ ID NO: 553855 - RNA, 13 nt, Chlamydophila pneumoniae TW-183
auaucagcuucuu

SEQ ID NO: 553856 - RNA, 22 nt, Chlamydophila pneumoniae TW-183
auaguauaauagugagcucccu

SEQ ID NO: 553857 - RNA, 23 nt, Chlamydophila pneumoniae TW-183
auaggcugcacacauccuggagc

SEQ ID NO: 553858 - RNA, 13 nt, Chlamydophila pneumoniae TW-183
auagcgucuguua

SEQ ID NO: 553859 - RNA, 19 nt, Chlamydophila pneumoniae TW-183
auagccauaauuagaacag

SEQ ID NO: 553860 - RNA, 12 nt, Chlamydophila pneumoniae TW-183
auagaucucuug

SEQ ID NO: 553861 - RNA, 13 nt, Chlamydophila pneumoniae TW-183
auagaucucuuga

SEQ ID NO: 553862 - RNA, 21 nt, Chlamydophila pneumoniae TW-183
auagaguaucuaaaacuucuu

SEQ ID NO: 553863 - RNA, 17 nt, Chlamydophila pneumoniae TW-183
auagaguaucuaaaacu

SEQ ID NO: 553864 - RNA, 14 nt, Chlamydophila pneumoniae TW-183
auagagauucuaca

SEQ ID NO: 553865 - RNA, 17 nt, Chlamydophila pneumoniae TW-183
auagagauucuacaaau

SEQ ID NO: 553866 - RNA, 16 nt, Chlamydophila pneumoniae TW-183
auacuguuaacaagua

SEQ ID NO: 553867 - RNA, 13 nt, Chlamydophila pneumoniae TW-183
auacgcagcacgc

SEQ ID NO: 553868 - RNA, 19 nt, Chlamydophila pneumoniae TW-183
auacgccaaggucuucccg

SEQ ID NO: 553869 - RNA, 19 nt, Chlamydophila pneumoniae TW-183
auaccuucaacaagaauaa

SEQ ID NO: 553870 - RNA, 22 nt, Chlamydophila pneumoniae TW-183
auaccuucaacaagaauaacuu

SEQ ID NO: 553871 - RNA, 15 nt, Chlamydophila pneumoniae TW-183
auacguccagccugc

SEQ ID NO: 553872 - RNA, 19 nt, Chlamydophila pneumoniae TW-183
auacggcguaguauccuuu

SEQ ID NO: 553873 - RNA, 18 nt, Chlamydophila pneumoniae TW-183
auaccuccuccaaucugc

SEQ ID NO: 553874 - RNA, 14 nt, Chlamydophila pneumoniae TW-183
auaccuccuccaau

SEQ ID NO: 553875 - RNA, 14 nt, Chlamydophila pneumoniae TW-183
auaauuagaacagc

SEQ ID NO: 553876 - RNA, 15 nt, Chlamydophila pneumoniae TW-183
auaauuagaacagca

SEQ ID NO: 553877 - RNA, 12 nt, Chlamydophila pneumoniae TW-183
aguuuuuuucuu

SEQ ID NO: 553878 - RNA, 15 nt, Chlamydophila pneumoniae TW-183
aguuugauagagaaa

SEQ ID NO: 553879 - RNA, 23 nt, Chlamydophila pneumoniae TW-183
aguuucuaaaacagaaauugcuu

SEQ ID NO: 553880 - RNA, 21 nt, Chlamydophila pneumoniae TW-183
aguuucuacgcgcucuucuuu

SEQ ID NO: 553881 - RNA, 23 nt, Chlamydophila pneumoniae TW-183
aguuucuacgcgcucuucuuucu

SEQ ID NO: 553882 - RNA, 18 nt, Chlamydophila pneumoniae TW-183
aguuuaaacgucuuauga

SEQ ID NO: 553883 - RNA, 18 nt, Chlamydophila pneumoniae TW-183
aguucuucauugcagaua

SEQ ID NO: 553884 - RNA, 22 nt, Chlamydophila pneumoniae TW-183
aguucuuuuugcagaucuuuua

SEQ ID NO: 553885 - RNA, 21 nt, Chlamydophila pneumoniae TW-183
aguugaaaugagugagaaugc

SEQ ID NO: 553886 - RNA, 14 nt, Chlamydophila pneumoniae TW-183
aguucuuaagaauc

SEQ ID NO: 553887 - RNA, 20 nt, Chlamydophila pneumoniae TW-183
aguuagguagauagaaauuc

SEQ ID NO: 553888 - RNA, 18 nt, Chlamydophila pneumoniae TW-183
aguuacugucugcaaaga

SEQ ID NO: 553889 - RNA, 18 nt, Chlamydophila pneumoniae TW-183
aguguugccagcccaugu

SEQ ID NO: 553890 - RNA, 21 nt, Chlamydophila pneumoniae TW-183
agugugguuuaccuuguuuuc

SEQ ID NO: 553891 - RNA, 23 nt, Chlamydophila pneumoniae TW-183
aguguaacauugaccuaaaggaa

SEQ ID NO: 553892 - RNA, 16 nt, Chlamydophila pneumoniae TW-183
agugucauacgcagca

SEQ ID NO: 553893 - RNA, 16 nt, Chlamydophila pneumoniae TW-183
agugacuuuucuucuu

SEQ ID NO: 553894 - RNA, 14 nt, Chlamydophila pneumoniae TW-183
agugacuuuucuuc

SEQ ID NO: 553895 - RNA, 15 nt, Chlamydophila pneumoniae TW-183
agucguuaacaucaa

SEQ ID NO: 553896 - RNA, 13 nt, Chlamydophila pneumoniae TW-183
aguccuucuuccc

SEQ ID NO: 553897 - RNA, 22 nt, Chlamydophila pneumoniae TW-183
aguccuucuucccagccuugau

SEQ ID NO: 553898 - RNA, 20 nt, Chlamydophila pneumoniae TW-183
agucuugcgccagcaaagau

SEQ ID NO: 553899 - RNA, 18 nt, Chlamydophila pneumoniae TW-183
agucuugcgccagcaaag

SEQ ID NO: 553900 - RNA, 19 nt, Chlamydophila pneumoniae TW-183
auaacuuugcaugaggaga

SEQ ID NO: 553901 - RNA, 13 nt, Chlamydophila pneumoniae TW-183
auaacuuuagaug

SEQ ID NO: 553902 - RNA, 15 nt, Chlamydophila pneumoniae TW-183
auaacuuuagaugga

SEQ ID NO: 553903 - RNA, 20 nt, Chlamydophila pneumoniae TW-183
auaacuugagccaacagguu

SEQ ID NO: 553904 - RNA, 21 nt, Chlamydophila pneumoniae TW-183
auaacuccacuaccaaggcag

SEQ ID NO: 553905 - RNA, 20 nt, Chlamydophila pneumoniae TW-183
auaaccuaaggcauggcaca

SEQ ID NO: 553906 - RNA, 15 nt, Chlamydophila pneumoniae TW-183
auaaccuaaggcaug

SEQ ID NO: 553907 - RNA, 23 nt, Chlamydophila pneumoniae TW-183
auaacagagauggucuuggguuu

SEQ ID NO: 553908 - RNA, 16 nt, Chlamydophila pneumoniae TW-183
auaaaaaguuuuuguu

SEQ ID NO: 553909 - RNA, 15 nt, Chlamydophila pneumoniae TW-183
auaaagcaaaugccu

SEQ ID NO: 553910 - RNA, 21 nt, Chlamydophila pneumoniae TW-183
auaaagcccuuuugaauaucc

SEQ ID NO: 553911 - RNA, 13 nt, Chlamydophila pneumoniae TW-183
auaauaaaagcac

SEQ ID NO: 553912 - RNA, 13 nt, Chlamydophila pneumoniae TW-183
auaaguucuucca

SEQ ID NO: 553913 - RNA, 16 nt, Chlamydophila pneumoniae TW-183
auaagugacuuuucuu

SEQ ID NO: 553914 - RNA, 23 nt, Chlamydophila pneumoniae TW-183
auaagggggaucuucagagagaa

SEQ ID NO: 553915 - RNA, 14 nt, Chlamydophila pneumoniae TW-183
auaagauccaaaaa

SEQ ID NO: 553916 - RNA, 18 nt, Chlamydophila pneumoniae TW-183
auaagauccaaaaauucu

SEQ ID NO: 553917 - RNA, 17 nt, Chlamydophila pneumoniae TW-183
auaagauaaagaauucu

SEQ ID NO: 553918 - RNA, 16 nt, Chlamydophila pneumoniae TW-183
auaagcaagcaacuga

SEQ ID NO: 553919 - RNA, 12 nt, Chlamydophila pneumoniae TW-183
auaauuaaacuc

SEQ ID NO: 553920 - RNA, 15 nt, Chlamydophila pneumoniae TW-183
aucguuaucaaaagg

SEQ ID NO: 553921 - RNA, 16 nt, Chlamydophila pneumoniae TW-183
aucgucccuaaagcuu

SEQ ID NO: 553922 - RNA, 13 nt, Chlamydophila pneumoniae TW-183
aucucuuuaacuu

SEQ ID NO: 553923 - RNA, 16 nt, Chlamydophila pneumoniae TW-183
aucucuugaagcacuu

SEQ ID NO: 553924 - RNA, 16 nt, Chlamydophila pneumoniae TW-183
aucucugugguuccug

SEQ ID NO: 553925 - RNA, 18 nt, Chlamydophila pneumoniae TW-183
aucucgggagaacaugcc

SEQ ID NO: 553926 - RNA, 21 nt, Chlamydophila pneumoniae TW-183
aucucuagggauaauuaaacu

SEQ ID NO: 553927 - RNA, 23 nt, Chlamydophila pneumoniae TW-183
aucucuagggauaauuaaacucu

SEQ ID NO: 553928 - RNA, 22 nt, Chlamydophila pneumoniae TW-183
aucucguagcuauuuuugagga

SEQ ID NO: 553929 - RNA, 22 nt, Chlamydophila pneumoniae TW-183
aucucuaaguucuugauuuuca

SEQ ID NO: 553930 - RNA, 18 nt, Chlamydophila pneumoniae TW-183
aucuccuuguucuugaac

SEQ ID NO: 553931 - RNA, 13 nt, Chlamydophila pneumoniae TW-183
aucucgaaccaua

SEQ ID NO: 553932 - RNA, 15 nt, Chlamydophila pneumoniae TW-183
aucuccucaucagaa

SEQ ID NO: 553933 - RNA, 20 nt, Chlamydophila pneumoniae TW-183
aucucaugcggacuuuauuc

SEQ ID NO: 553934 - RNA, 17 nt, Chlamydophila pneumoniae TW-183
aucucauuccagcaucu

SEQ ID NO: 553935 - RNA, 10 nt, Chlamydophila pneumoniae TW-183
aucucaguag

SEQ ID NO: 553936 - RNA, 17 nt, Chlamydophila pneumoniae TW-183
aucuaugaaguccugau

SEQ ID NO: 553937 - RNA, 15 nt, Chlamydophila pneumoniae TW-183
aucuaugagaguaag

SEQ ID NO: 553938 - RNA, 18 nt, Chlamydophila pneumoniae TW-183
aucuauaggauuugcaua

SEQ ID NO: 553939 - RNA, 16 nt, Chlamydophila pneumoniae TW-183
aucucaaaaucaaaua

SEQ ID NO: 553940 - RNA, 20 nt, Chlamydophila pneumoniae TW-183
aucuagagaagaaaagagcu

SEQ ID NO: 553941 - RNA, 19 nt, Chlamydophila pneumoniae TW-183
aucuauagaauuuccaauc

SEQ ID NO: 553942 - RNA, 21 nt, Chlamydophila pneumoniae TW-183
augccuauuaagucaccuuaa

SEQ ID NO: 553943 - RNA, 15 nt, Chlamydophila pneumoniae TW-183
augccauuguagaga

SEQ ID NO: 553944 - RNA, 22 nt, Chlamydophila pneumoniae TW-183
augauuucuuuagcuuuauuga

SEQ ID NO: 553945 - RNA, 18 nt, Chlamydophila pneumoniae TW-183
augaugagaacguccuca

SEQ ID NO: 553946 - RNA, 14 nt, Chlamydophila pneumoniae TW-183
augagaguaaguuu

SEQ ID NO: 553947 - RNA, 14 nt, Chlamydophila pneumoniae TW-183
aucuugauuaggaa

SEQ ID NO: 553948 - RNA, 15 nt, Chlamydophila pneumoniae TW-183
aucuugauuaggaac

SEQ ID NO: 553949 - RNA, 14 nt, Chlamydophila pneumoniae TW-183
aucuugagaaaaga

SEQ ID NO: 553950 - RNA, 17 nt, Chlamydophila pneumoniae TW-183
aucuucucuuaugaagu

SEQ ID NO: 553951 - RNA, 20 nt, Chlamydophila pneumoniae TW-183
auguccuccauggaaagaaa

SEQ ID NO: 553952 - RNA, 17 nt, Chlamydophila pneumoniae TW-183
auguccuccauggaaag

SEQ ID NO: 553953 - RNA, 13 nt, Chlamydophila pneumoniae TW-183
auguggcagaguc

SEQ ID NO: 553954 - RNA, 23 nt, Chlamydophila pneumoniae TW-183
auguauggugcgcgucuccuuga

SEQ ID NO: 553955 - RNA, 22 nt, Chlamydophila pneumoniae TW-183
auguaucggggauugcaaaauu

SEQ ID NO: 553956 - RNA, 17 nt, Chlamydophila pneumoniae TW-183
auguaaucauaaaaaaa

SEQ ID NO: 553957 - RNA, 19 nt, Chlamydophila pneumoniae TW-183
auguaaucccagauuuuuu

SEQ ID NO: 553958 - RNA, 18 nt, Chlamydophila pneumoniae TW-183
auguaaucccagauuuuu

SEQ ID NO: 553959 - RNA, 17 nt, Chlamydophila pneumoniae TW-183
auguaaucccagauuuu

SEQ ID NO: 553960 - RNA, 14 nt, Chlamydophila pneumoniae TW-183
augguacaauacug

SEQ ID NO: 553961 - RNA, 15 nt, Chlamydophila pneumoniae TW-183
augguacaauacugg

SEQ ID NO: 553962 - RNA, 22 nt, Chlamydophila pneumoniae TW-183
auuaaggcuccagcauaaggau

SEQ ID NO: 553963 - RNA, 14 nt, Chlamydophila pneumoniae TW-183
auuaagaagaagcu

SEQ ID NO: 553964 - RNA, 12 nt, Chlamydophila pneumoniae TW-183
auuaacuuuaua

SEQ ID NO: 553965 - RNA, 18 nt, Chlamydophila pneumoniae TW-183
auuaaaucguacuucacu

SEQ ID NO: 553966 - RNA, 20 nt, Chlamydophila pneumoniae TW-183
auguuucuaagcugaaagaa

SEQ ID NO: 553967 - RNA, 21 nt, Chlamydophila pneumoniae TW-183
auguuuguaguguugaauaag

SEQ ID NO: 553968 - RNA, 22 nt, Chlamydophila pneumoniae TW-183
auguuuguaguguugaauaaga

SEQ ID NO: 553969 - RNA, 15 nt, Chlamydophila pneumoniae TW-183
auucacaaaucuucc

SEQ ID NO: 553970 - RNA, 15 nt, Chlamydophila pneumoniae TW-183
auuaccuugagacaa

SEQ ID NO: 553971 - RNA, 15 nt, Chlamydophila pneumoniae TW-183
auuaccuaaaacaaa

SEQ ID NO: 553972 - RNA, 19 nt, Chlamydophila pneumoniae TW-183
auuaccuaaaacaaaauca

SEQ ID NO: 553973 - RNA, 17 nt, Chlamydophila pneumoniae TW-183
auuacuagaucccucaa

SEQ ID NO: 553974 - RNA, 21 nt, Chlamydophila pneumoniae TW-183
auuguuuaaguccuucuuccc

SEQ ID NO: 553975 - RNA, 15 nt, Chlamydophila pneumoniae TW-183
auuuaacaacaugcg

SEQ ID NO: 553976 - RNA, 15 nt, Chlamydophila pneumoniae TW-183
auugcuucuuccaag

SEQ ID NO: 553977 - RNA, 14 nt, Chlamydophila pneumoniae TW-183
auuggaucuagaga

SEQ ID NO: 553978 - RNA, 17 nt, Chlamydophila pneumoniae TW-183
auuggaucuagagaaga

SEQ ID NO: 553979 - RNA, 20 nt, Chlamydophila pneumoniae TW-183
auuggaucuagagaagaaaa

SEQ ID NO: 553980 - RNA, 22 nt, Chlamydophila pneumoniae TW-183
auugggagguucgcagaacuuc

SEQ ID NO: 553981 - RNA, 17 nt, Chlamydophila pneumoniae TW-183
auugcaaaaaugaaaga

SEQ ID NO: 553982 - RNA, 21 nt, Chlamydophila pneumoniae TW-183
auugcaaauuucauuuagaca

SEQ ID NO: 553983 - RNA, 16 nt, Chlamydophila pneumoniae TW-183
auugaggauaaguucu

SEQ ID NO: 553984 - RNA, 18 nt, Chlamydophila pneumoniae TW-183
auucuucagaaucuuugu

SEQ ID NO: 553985 - RNA, 22 nt, Chlamydophila pneumoniae TW-183
auucuucagaaucuuugugaua

SEQ ID NO: 553986 - RNA, 22 nt, Chlamydophila pneumoniae TW-183
auucuucacaaucuaaauaaga

SEQ ID NO: 553987 - RNA, 20 nt, Chlamydophila pneumoniae TW-183
auugaauaucgaguucuuuu

SEQ ID NO: 553988 - RNA, 13 nt, Chlamydophila pneumoniae TW-183
auugaaucagauu

SEQ ID NO: 553989 - RNA, 11 nt, Chlamydophila pneumoniae TW-183
auucugucuau

SEQ ID NO: 553990 - RNA, 17 nt, Chlamydophila pneumoniae TW-183
auucucgagcagcugca

SEQ ID NO: 553991 - RNA, 19 nt, Chlamydophila pneumoniae TW-183
auucucuaaaugauuuuua

SEQ ID NO: 553992 - RNA, 17 nt, Chlamydophila pneumoniae TW-183
auuuucagccugucuau

SEQ ID NO: 553993 - RNA, 16 nt, Chlamydophila pneumoniae TW-183
auuuucucuacacaga

SEQ ID NO: 553994 - RNA, 17 nt, Chlamydophila pneumoniae TW-183
auuuucucugagcagcu

SEQ ID NO: 553995 - RNA, 17 nt, Chlamydophila pneumoniae TW-183
auuucauguaagaaugu

SEQ ID NO: 553996 - RNA, 15 nt, Chlamydophila pneumoniae TW-183
auuucauguccucca

SEQ ID NO: 553997 - RNA, 23 nt, Chlamydophila pneumoniae TW-183
auuucuaaauagaaaacauagag

SEQ ID NO: 553998 - RNA, 15 nt, Chlamydophila pneumoniae TW-183
auuucuccagcagcu

SEQ ID NO: 553999 - RNA, 21 nt, Chlamydophila pneumoniae TW-183
caaaagaauuaagaagaagcu

SEQ ID NO: 554000 - RNA, 15 nt, Chlamydophila pneumoniae TW-183
caaaagaauuaagaa

SEQ ID NO: 554001 - RNA, 20 nt, Chlamydophila pneumoniae TW-183
caaaacagcaucaggauucu

SEQ ID NO: 554002 - RNA, 22 nt, Chlamydophila pneumoniae TW-183
caaaaccuggauugauccacag

SEQ ID NO: 554003 - RNA, 16 nt, Chlamydophila pneumoniae TW-183
auuuuuugagaaauau

SEQ ID NO: 554004 - RNA, 14 nt, Chlamydophila pneumoniae TW-183
auuuuuuuagcaau

SEQ ID NO: 554005 - RNA, 11 nt, Chlamydophila pneumoniae TW-183
auuuuuucuug

SEQ ID NO: 554006 - RNA, 16 nt, Chlamydophila pneumoniae TW-183
auuuuuucuguuccug

SEQ ID NO: 554007 - RNA, 23 nt, Chlamydophila pneumoniae TW-183
auuuuuuaaccgagcuuuuugcu

SEQ ID NO: 554008 - RNA, 23 nt, Chlamydophila pneumoniae TW-183
caagcaggugugugguaaaaaua

SEQ ID NO: 554009 - RNA, 22 nt, Chlamydophila pneumoniae TW-183
caagcaggugugugguaaaaau

SEQ ID NO: 554010 - RNA, 16 nt, Chlamydophila pneumoniae TW-183
caagcacuuucgcaaa

SEQ ID NO: 554011 - RNA, 23 nt, Chlamydophila pneumoniae TW-183
caaggcgaguguagauuauugau

SEQ ID NO: 554012 - RNA, 23 nt, Chlamydophila pneumoniae TW-183
caauacuggagagguaaccagag

SEQ ID NO: 554013 - RNA, 20 nt, Chlamydophila pneumoniae TW-183
caauauaaaugcuauuuucc

SEQ ID NO: 554014 - RNA, 21 nt, Chlamydophila pneumoniae TW-183
caauauaaaugcuauuuuccu

SEQ ID NO: 554015 - RNA, 19 nt, Chlamydophila pneumoniae TW-183
caauaguguaacauugacc

SEQ ID NO: 554016 - RNA, 10 nt, Chlamydophila pneumoniae TW-183
caaucuuuga

SEQ ID NO: 554017 - RNA, 15 nt, Chlamydophila pneumoniae TW-183
caaugauaauuucau

SEQ ID NO: 554018 - RNA, 12 nt, Chlamydophila pneumoniae TW-183
caaugagaaaua

SEQ ID NO: 554019 - RNA, 15 nt, Chlamydophila pneumoniae TW-183
caaugauaucagcau

SEQ ID NO: 554020 - RNA, 22 nt, Chlamydophila pneumoniae TW-183
caaugauuucuuuagcuuuauu

SEQ ID NO: 554021 - RNA, 22 nt, Chlamydophila pneumoniae TW-183
caaucucaaaaucaaauagauu

SEQ ID NO: 554022 - RNA, 14 nt, Chlamydophila pneumoniae TW-183
caaucuaaauaaga

SEQ ID NO: 554023 - RNA, 16 nt, Chlamydophila pneumoniae TW-183
caaucugcugaaggga

SEQ ID NO: 554024 - RNA, 15 nt, Chlamydophila pneumoniae TW-183
caaucucuagggaua

SEQ ID NO: 554025 - RNA, 20 nt, Chlamydophila pneumoniae TW-183
caacugauguuuuauagaua

SEQ ID NO: 554026 - RNA, 18 nt, Chlamydophila pneumoniae TW-183
caacaugcgcguauaagg

SEQ ID NO: 554027 - RNA, 16 nt, Chlamydophila pneumoniae TW-183
caacacgcacaaacua

SEQ ID NO: 554028 - RNA, 17 nt, Chlamydophila pneumoniae TW-183
caaauaguucaucauau

SEQ ID NO: 554029 - RNA, 22 nt, Chlamydophila pneumoniae TW-183
caaauuaccuugagacaaagaa

SEQ ID NO: 554030 - RNA, 21 nt, Chlamydophila pneumoniae TW-183
caaaucucauuccagcaucuu

SEQ ID NO: 554031 - RNA, 12 nt, Chlamydophila pneumoniae TW-183
caaaguuuauga

SEQ ID NO: 554032 - RNA, 19 nt, Chlamydophila pneumoniae TW-183
caaaguuuaugacacagcu

SEQ ID NO: 554033 - RNA, 20 nt, Chlamydophila pneumoniae TW-183
caaaguacuaauuacagaau

SEQ ID NO: 554034 - RNA, 14 nt, Chlamydophila pneumoniae TW-183
caaagauuuccaau

SEQ ID NO: 554035 - RNA, 18 nt, Chlamydophila pneumoniae TW-183
caaacuuguuuucguaag

SEQ ID NO: 554036 - RNA, 23 nt, Chlamydophila pneumoniae TW-183
caaacuuguuuucguaagagaau

SEQ ID NO: 554037 - RNA, 17 nt, Chlamydophila pneumoniae TW-183
cagaucuuuuaugcgag

SEQ ID NO: 554038 - RNA, 20 nt, Chlamydophila pneumoniae TW-183
cagauuuuaacaacuucaca

SEQ ID NO: 554039 - RNA, 13 nt, Chlamydophila pneumoniae TW-183
cagauuagaguua

SEQ ID NO: 554040 - RNA, 18 nt, Chlamydophila pneumoniae TW-183
cagauuagaguuagaugu

SEQ ID NO: 554041 - RNA, 17 nt, Chlamydophila pneumoniae TW-183
cagauauacuuuuucag

SEQ ID NO: 554042 - RNA, 17 nt, Chlamydophila pneumoniae TW-183
cagaggcuagaaaauca

SEQ ID NO: 554043 - RNA, 15 nt, Chlamydophila pneumoniae TW-183
cagaguccuucuuuu

SEQ ID NO: 554044 - RNA, 20 nt, Chlamydophila pneumoniae TW-183
cagaccucucccuugggauu

SEQ ID NO: 554045 - RNA, 16 nt, Chlamydophila pneumoniae TW-183
cagacuugaggaaucu

SEQ ID NO: 554046 - RNA, 14 nt, Chlamydophila pneumoniae TW-183
cagacuuuccucuc

SEQ ID NO: 554047 - RNA, 12 nt, Chlamydophila pneumoniae TW-183
cagagauggucu

SEQ ID NO: 554048 - RNA, 15 nt, Chlamydophila pneumoniae TW-183
cagagauguggcaga

SEQ ID NO: 554049 - RNA, 13 nt, Chlamydophila pneumoniae TW-183
cagagauucuuca

SEQ ID NO: 554050 - RNA, 17 nt, Chlamydophila pneumoniae TW-183
cagagauugccaggaga

SEQ ID NO: 554051 - RNA, 16 nt, Chlamydophila pneumoniae TW-183
cagagcauaggguuuc

SEQ ID NO: 554052 - RNA, 18 nt, Chlamydophila pneumoniae TW-183
cagagauugccaggagag

SEQ ID NO: 554053 - RNA, 15 nt, Chlamydophila pneumoniae TW-183
cagaaucuaugagag

SEQ ID NO: 554054 - RNA, 14 nt, Chlamydophila pneumoniae TW-183
cagaaucccgugcu

SEQ ID NO: 554055 - RNA, 17 nt, Chlamydophila pneumoniae TW-183
cagaauaccuucaacaa

SEQ ID NO: 554056 - RNA, 23 nt, Chlamydophila pneumoniae TW-183
cagaagugaucuugagaaaagaa

SEQ ID NO: 554057 - RNA, 17 nt, Chlamydophila pneumoniae TW-183
cagaagugaucuugaga

SEQ ID NO: 554058 - RNA, 17 nt, Chlamydophila pneumoniae TW-183
cagaagccaccaaaaau

SEQ ID NO: 554059 - RNA, 16 nt, Chlamydophila pneumoniae TW-183
cagaagcauugaggac

SEQ ID NO: 554060 - RNA, 13 nt, Chlamydophila pneumoniae TW-183
cagaagcaaaggu

SEQ ID NO: 554061 - RNA, 13 nt, Chlamydophila pneumoniae TW-183
cagaacuucucca

SEQ ID NO: 554062 - RNA, 18 nt, Chlamydophila pneumoniae TW-183
cagaaagaaggucuucca

SEQ ID NO: 554063 - RNA, 21 nt, Chlamydophila pneumoniae TW-183
cagaaagaaggucuuccaucu

SEQ ID NO: 554064 - RNA, 21 nt, Chlamydophila pneumoniae TW-183
cagaaauacguccagccugca

SEQ ID NO: 554065 - RNA, 18 nt, Chlamydophila pneumoniae TW-183
cagaaauugcuucuucca

SEQ ID NO: 554066 - RNA, 22 nt, Chlamydophila pneumoniae TW-183
cagaacacaugucucuuaaaaa

SEQ ID NO: 554067 - RNA, 16 nt, Chlamydophila pneumoniae TW-183
cacuuacuucaagaaa

SEQ ID NO: 554068 - RNA, 17 nt, Chlamydophila pneumoniae TW-183
cacuuacuucaagaaaa

SEQ ID NO: 554069 - RNA, 16 nt, Chlamydophila pneumoniae TW-183
cacuuacagauaagga

SEQ ID NO: 554070 - RNA, 14 nt, Chlamydophila pneumoniae TW-183
cacuuaaagguaaa

SEQ ID NO: 554071 - RNA, 13 nt, Chlamydophila pneumoniae TW-183
cacugcgagagaa

SEQ ID NO: 554072 - RNA, 19 nt, Chlamydophila pneumoniae TW-183
cagccugucuauaaaauaa

SEQ ID NO: 554073 - RNA, 14 nt, Chlamydophila pneumoniae TW-183
cagcauuuucucug

SEQ ID NO: 554074 - RNA, 18 nt, Chlamydophila pneumoniae TW-183
cagcauggacuccaagaa

SEQ ID NO: 554075 - RNA, 19 nt, Chlamydophila pneumoniae TW-183
cagcauggacuccaagaau

SEQ ID NO: 554076 - RNA, 20 nt, Chlamydophila pneumoniae TW-183
cagcaucaggauucucucug

SEQ ID NO: 554077 - RNA, 22 nt, Chlamydophila pneumoniae TW-183
cagcauaaggauucugagaagu

SEQ ID NO: 554078 - RNA, 22 nt, Chlamydophila pneumoniae TW-183
cagcagcuucccaagcagaaga

SEQ ID NO: 554079 - RNA, 16 nt, Chlamydophila pneumoniae TW-183
cauugcaaaaaugaaa

SEQ ID NO: 554080 - RNA, 17 nt, Chlamydophila pneumoniae TW-183
cauugaugcuuaagagu

SEQ ID NO: 554081 - RNA, 23 nt, Chlamydophila pneumoniae TW-183
cauuguuuaaguccuucuuccca

SEQ ID NO: 554082 - RNA, 16 nt, Chlamydophila pneumoniae TW-183
cauuuaaacuaagaau

SEQ ID NO: 554083 - RNA, 18 nt, Chlamydophila pneumoniae TW-183
cauuuaaacuaagaauac

SEQ ID NO: 554084 - RNA, 15 nt, Chlamydophila pneumoniae TW-183
cauuugauucauaaa

SEQ ID NO: 554085 - RNA, 16 nt, Chlamydophila pneumoniae TW-183
cauggacaauauagag

SEQ ID NO: 554086 - RNA, 15 nt, Chlamydophila pneumoniae TW-183
cauggauauggaaug

SEQ ID NO: 554087 - RNA, 19 nt, Chlamydophila pneumoniae TW-183
cauggacaagcaaaagcaa

SEQ ID NO: 554088 - RNA, 22 nt, Chlamydophila pneumoniae TW-183
caugcacgagagccucggaagu

SEQ ID NO: 554089 - RNA, 21 nt, Chlamydophila pneumoniae TW-183
caucuucucgaacaggagaga

SEQ ID NO: 554090 - RNA, 21 nt, Chlamydophila pneumoniae TW-183
caucugggaguuguaaaacuu

SEQ ID NO: 554091 - RNA, 22 nt, Chlamydophila pneumoniae TW-183
caucuacgauguuuucuuaucc

SEQ ID NO: 554092 - RNA, 19 nt, Chlamydophila pneumoniae TW-183
caucuacgauguuuucuua

SEQ ID NO: 554093 - RNA, 23 nt, Chlamydophila pneumoniae TW-183
caucgagaaaugcucuucugcag

SEQ ID NO: 554094 - RNA, 13 nt, Chlamydophila pneumoniae TW-183
caucaaggccuau

SEQ ID NO: 554095 - RNA, 20 nt, Chlamydophila pneumoniae TW-183
cauauaauacgucucaucgc

SEQ ID NO: 554096 - RNA, 16 nt, Chlamydophila pneumoniae TW-183
cauacuacucucauca

SEQ ID NO: 554097 - RNA, 16 nt, Chlamydophila pneumoniae TW-183
cauaaucucaccagaa

SEQ ID NO: 554098 - RNA, 20 nt, Chlamydophila pneumoniae TW-183
cauaaucucaccagaagcaa

SEQ ID NO: 554099 - RNA, 13 nt, Chlamydophila pneumoniae TW-183
caguuaaagagca

SEQ ID NO: 554100 - RNA, 14 nt, Chlamydophila pneumoniae TW-183
caguuaaagagcau

SEQ ID NO: 554101 - RNA, 13 nt, Chlamydophila pneumoniae TW-183
caguugcggagau

SEQ ID NO: 554102 - RNA, 16 nt, Chlamydophila pneumoniae TW-183
caguauaaucagaagu

SEQ ID NO: 554103 - RNA, 20 nt, Chlamydophila pneumoniae TW-183
cagggcauucucuaaaugau

SEQ ID NO: 554104 - RNA, 23 nt, Chlamydophila pneumoniae TW-183
caggagagagaaggcucucaagg

SEQ ID NO: 554105 - RNA, 11 nt, Chlamydophila pneumoniae TW-183
caggaggcgcg

SEQ ID NO: 554106 - RNA, 16 nt, Chlamydophila pneumoniae TW-183
caggaguucuugauuc

SEQ ID NO: 554107 - RNA, 17 nt, Chlamydophila pneumoniae TW-183
caggaaggaauagagaa

SEQ ID NO: 554108 - RNA, 11 nt, Chlamydophila pneumoniae TW-183
cagcuucuuga

SEQ ID NO: 554109 - RNA, 14 nt, Chlamydophila pneumoniae TW-183
cagcucggaaugcu

SEQ ID NO: 554110 - RNA, 22 nt, Chlamydophila pneumoniae TW-183
ccuuacucccaugggauaggaa

SEQ ID NO: 554111 - RNA, 20 nt, Chlamydophila pneumoniae TW-183
ccuucaacacaccauuuuug

SEQ ID NO: 554112 - RNA, 12 nt, Chlamydophila pneumoniae TW-183
ccuucaacacac

SEQ ID NO: 554113 - RNA, 16 nt, Chlamydophila pneumoniae TW-183
ccuguuuuauugggaa

SEQ ID NO: 554114 - RNA, 22 nt, Chlamydophila pneumoniae TW-183
ccuguuuucuuuucugaagauu

SEQ ID NO: 554115 - RNA, 18 nt, Chlamydophila pneumoniae TW-183
ccuuaaagagaaucuccu

SEQ ID NO: 554116 - RNA, 19 nt, Chlamydophila pneumoniae TW-183
ccugugauagguagcagcc

SEQ ID NO: 554117 - RNA, 20 nt, Chlamydophila pneumoniae TW-183
ccuggaacaguauaaucaga

SEQ ID NO: 554118 - RNA, 16 nt, Chlamydophila pneumoniae TW-183
ccugcaaacuccccag

SEQ ID NO: 554119 - RNA, 21 nt, Chlamydophila pneumoniae TW-183
ccugaggcuauagaauacaca

SEQ ID NO: 554120 - RNA, 20 nt, Chlamydophila pneumoniae TW-183
ccucuaaggacaaaucuccc

SEQ ID NO: 554121 - RNA, 15 nt, Chlamydophila pneumoniae TW-183
ccucuagaagacaca

SEQ ID NO: 554122 - RNA, 16 nt, Chlamydophila pneumoniae TW-183
ccucugggaagacucu

SEQ ID NO: 554123 - RNA, 20 nt, Chlamydophila pneumoniae TW-183
ccucgagcagaaacuccaaa

SEQ ID NO: 554124 - RNA, 15 nt, Chlamydophila pneumoniae TW-183
ccucgccgcugcccu

SEQ ID NO: 554125 - RNA, 19 nt, Chlamydophila pneumoniae TW-183
ccuagagaguucuuguaau

SEQ ID NO: 554126 - RNA, 21 nt, Chlamydophila pneumoniae TW-183
ccuagagaguucuuguaauaa

SEQ ID NO: 554127 - RNA, 16 nt, Chlamydophila pneumoniae TW-183
ccuaggagaaaucaca

SEQ ID NO: 554128 - RNA, 16 nt, Chlamydophila pneumoniae TW-183
ccuauaguauaauagu

SEQ ID NO: 554129 - RNA, 20 nt, Chlamydophila pneumoniae TW-183
ccuauucugguuucuucauc

SEQ ID NO: 554130 - RNA, 13 nt, Chlamydophila pneumoniae TW-183
ccuaaaacaaaau

SEQ ID NO: 554131 - RNA, 21 nt, Chlamydophila pneumoniae TW-183
ccuaaaacaaaaucaaaaacu

SEQ ID NO: 554132 - RNA, 17 nt, Chlamydophila pneumoniae TW-183
ccuaagugauaaggaag

SEQ ID NO: 554133 - RNA, 13 nt, Chlamydophila pneumoniae TW-183
ccuaauaaagaag

SEQ ID NO: 554134 - RNA, 19 nt, Chlamydophila pneumoniae TW-183
ccuaauucucgagcagcug

SEQ ID NO: 554135 - RNA, 17 nt, Chlamydophila pneumoniae TW-183
ccuaagcucauaagaaa

SEQ ID NO: 554136 - RNA, 17 nt, Chlamydophila pneumoniae TW-183
ccgacauucacccucau

SEQ ID NO: 554137 - RNA, 13 nt, Chlamydophila pneumoniae TW-183
cccucgaaccacu

SEQ ID NO: 554138 - RNA, 17 nt, Chlamydophila pneumoniae TW-183
ccccuucuaauacuuua

SEQ ID NO: 554139 - RNA, 14 nt, Chlamydophila pneumoniae TW-183
cccgagacuucucu

SEQ ID NO: 554140 - RNA, 16 nt, Chlamydophila pneumoniae TW-183
cccgagacuucucucu

SEQ ID NO: 554141 - RNA, 11 nt, Chlamydophila pneumoniae TW-183
cccauuacagc

SEQ ID NO: 554142 - RNA, 22 nt, Chlamydophila pneumoniae TW-183
ccauuuuugaauaugauuucca

SEQ ID NO: 554143 - RNA, 11 nt, Chlamydophila pneumoniae TW-183
cccagccuuga

SEQ ID NO: 554144 - RNA, 18 nt, Chlamydophila pneumoniae TW-183
cccacggcaaguuguggc

SEQ ID NO: 554145 - RNA, 20 nt, Chlamydophila pneumoniae TW-183
ccaucggcauuucuccacau

SEQ ID NO: 554146 - RNA, 22 nt, Chlamydophila pneumoniae TW-183
ccauaauuagaacagcauggac

SEQ ID NO: 554147 - RNA, 14 nt, Chlamydophila pneumoniae TW-183
ccaggauggcuccu

SEQ ID NO: 554148 - RNA, 20 nt, Chlamydophila pneumoniae TW-183
ccagaagguguggguacagg

SEQ ID NO: 554149 - RNA, 17 nt, Chlamydophila pneumoniae TW-183
ccagaacacaugucucu

SEQ ID NO: 554150 - RNA, 13 nt, Chlamydophila pneumoniae TW-183
ccacguccauuuc

SEQ ID NO: 554151 - RNA, 15 nt, Chlamydophila pneumoniae TW-183
ccacgcacuccugga

SEQ ID NO: 554152 - RNA, 22 nt, Chlamydophila pneumoniae TW-183
ccacgaccugcaaacuccccag

SEQ ID NO: 554153 - RNA, 17 nt, Chlamydophila pneumoniae TW-183
cggauuuucucuacaca

SEQ ID NO: 554154 - RNA, 22 nt, Chlamydophila pneumoniae TW-183
cggaugugccgugacuccagaa

SEQ ID NO: 554155 - RNA, 13 nt, Chlamydophila pneumoniae TW-183
cgcuuuuuacuga

SEQ ID NO: 554156 - RNA, 20 nt, Chlamydophila pneumoniae TW-183
cgcuuguucuuuucaucaag

SEQ ID NO: 554157 - RNA, 16 nt, Chlamydophila pneumoniae TW-183
cgcucuaagcugugca

SEQ ID NO: 554158 - RNA, 20 nt, Chlamydophila pneumoniae TW-183
cgcucuaagcugugcauuuu

SEQ ID NO: 554159 - RNA, 14 nt, Chlamydophila pneumoniae TW-183
cgcucucuccauga

SEQ ID NO: 554160 - RNA, 19 nt, Chlamydophila pneumoniae TW-183
cggggucggagauuguuuc

SEQ ID NO: 554161 - RNA, 22 nt, Chlamydophila pneumoniae TW-183
cgucaguaaaacacaaauagca

SEQ ID NO: 554162 - RNA, 19 nt, Chlamydophila pneumoniae TW-183
cguauggauuucuccagca

SEQ ID NO: 554163 - RNA, 14 nt, Chlamydophila pneumoniae TW-183
cguauagaauagaa

SEQ ID NO: 554164 - RNA, 18 nt, Chlamydophila pneumoniae TW-183
cguagcaggcaucacuaa

SEQ ID NO: 554165 - RNA, 23 nt, Chlamydophila pneumoniae TW-183
cguagcuacaaaauuauuaaacu

SEQ ID NO: 554166 - RNA, 20 nt, Chlamydophila pneumoniae TW-183
cguaggguagccauccacga

SEQ ID NO: 554167 - RNA, 14 nt, Chlamydophila pneumoniae TW-183
cguaaccacaggau

SEQ ID NO: 554168 - RNA, 13 nt, Chlamydophila pneumoniae TW-183
cggugucuacaaa

SEQ ID NO: 554169 - RNA, 16 nt, Chlamydophila pneumoniae TW-183
cggugucuacaaagau

SEQ ID NO: 554170 - RNA, 12 nt, Chlamydophila pneumoniae TW-183
cgccuacaaguu

SEQ ID NO: 554171 - RNA, 12 nt, Chlamydophila pneumoniae TW-183
cgauuaccuaaa

SEQ ID NO: 554172 - RNA, 17 nt, Chlamydophila pneumoniae TW-183
cuucagaaucuuuguga

SEQ ID NO: 554173 - RNA, 18 nt, Chlamydophila pneumoniae TW-183
cuucaucuucuaaauccc

SEQ ID NO: 554174 - RNA, 16 nt, Chlamydophila pneumoniae TW-183
cuucuaugguaaucac

SEQ ID NO: 554175 - RNA, 22 nt, Chlamydophila pneumoniae TW-183
cuucuaugguaaucaccuuaga

SEQ ID NO: 554176 - RNA, 18 nt, Chlamydophila pneumoniae TW-183
cuucuaaaaucuucucug

SEQ ID NO: 554177 - RNA, 12 nt, Chlamydophila pneumoniae TW-183
cuucuaaacaau

SEQ ID NO: 554178 - RNA, 16 nt, Chlamydophila pneumoniae TW-183
cuucuaaggaaauuac

SEQ ID NO: 554179 - RNA, 20 nt, Chlamydophila pneumoniae TW-183
cuucuaaggaaauuacaauc

SEQ ID NO: 554180 - RNA, 13 nt, Chlamydophila pneumoniae TW-183
cuucuacagcauc

SEQ ID NO: 554181 - RNA, 14 nt, Chlamydophila pneumoniae TW-183
cuucggaucuguaa

SEQ ID NO: 554182 - RNA, 15 nt, Chlamydophila pneumoniae TW-183
cuucggaucuguaau

SEQ ID NO: 554183 - RNA, 17 nt, Chlamydophila pneumoniae TW-183
cuucaaugauuucuuua

SEQ ID NO: 554184 - RNA, 22 nt, Chlamydophila pneumoniae TW-183
cuucacucuuuuauuuuaggaa

SEQ ID NO: 554185 - RNA, 16 nt, Chlamydophila pneumoniae TW-183
cuucaacaagaauaac

SEQ ID NO: 554186 - RNA, 15 nt, Chlamydophila pneumoniae TW-183
cuuauugcagaaucu

SEQ ID NO: 554187 - RNA, 22 nt, Chlamydophila pneumoniae TW-183
cuuacuugcauagauaucuuug

SEQ ID NO: 554188 - RNA, 20 nt, Chlamydophila pneumoniae TW-183
cuuaaugguagcuuaagaau

SEQ ID NO: 554189 - RNA, 16 nt, Chlamydophila pneumoniae TW-183
cuuacauccaauuuug

SEQ ID NO: 554190 - RNA, 22 nt, Chlamydophila pneumoniae TW-183
cuuaagaaucgaguucuucauu

SEQ ID NO: 554191 - RNA, 24 nt, Chlamydophila pneumoniae TW-183
cuuaagaaucgaguucuucauugc

SEQ ID NO: 554192 - RNA, 15 nt, Chlamydophila pneumoniae TW-183
cuuaagauacuucuc

SEQ ID NO: 554193 - RNA, 18 nt, Chlamydophila pneumoniae TW-183
cuguuccugaguacuuug

SEQ ID NO: 554194 - RNA, 20 nt, Chlamydophila pneumoniae TW-183
cuuaacaacaucacuuauau

SEQ ID NO: 554195 - RNA, 11 nt, Chlamydophila pneumoniae TW-183
cuuaacaacau

SEQ ID NO: 554196 - RNA, 16 nt, Chlamydophila pneumoniae TW-183
cuuugcgcuuguucuu

SEQ ID NO: 554197 - RNA, 13 nt, Chlamydophila pneumoniae TW-183
cuuugauuuucuu

SEQ ID NO: 554198 - RNA, 21 nt, Chlamydophila pneumoniae TW-183
cuuugauuuucuuagcuucca

SEQ ID NO: 554199 - RNA, 13 nt, Chlamydophila pneumoniae TW-183
cuuugcaugagga

SEQ ID NO: 554200 - RNA, 20 nt, Chlamydophila pneumoniae TW-183
cuuugaggauacgaauaagu

SEQ ID NO: 554201 - RNA, 19 nt, Chlamydophila pneumoniae TW-183
cuuugaagcucgaccucua

SEQ ID NO: 554202 - RNA, 23 nt, Chlamydophila pneumoniae TW-183
cuuugaagcucgaccucuagcuc

SEQ ID NO: 554203 - RNA, 16 nt, Chlamydophila pneumoniae TW-183
cuuuauugauagcuga

SEQ ID NO: 554204 - RNA, 16 nt, Chlamydophila pneumoniae TW-183
cuuucaaaccacggau

SEQ ID NO: 554205 - RNA, 16 nt, Chlamydophila pneumoniae TW-183
cuuuaacuucuaaaag

SEQ ID NO: 554206 - RNA, 13 nt, Chlamydophila pneumoniae TW-183
cuuggucgcaagg

SEQ ID NO: 554207 - RNA, 18 nt, Chlamydophila pneumoniae TW-183
cuuggucggaguuuuuuu

SEQ ID NO: 554208 - RNA, 20 nt, Chlamydophila pneumoniae TW-183
cuugucacacugcgagagaa

SEQ ID NO: 554209 - RNA, 23 nt, Chlamydophila pneumoniae TW-183
cuugcgauacaauaaacaacgau

SEQ ID NO: 554210 - RNA, 18 nt, Chlamydophila pneumoniae TW-183
cuugcugauuucuuuuuc

SEQ ID NO: 554211 - RNA, 18 nt, Chlamydophila pneumoniae TW-183
cuugcauuuuuuggaaua

SEQ ID NO: 554212 - RNA, 14 nt, Chlamydophila pneumoniae TW-183
cuugauuugggaug

SEQ ID NO: 554213 - RNA, 22 nt, Chlamydophila pneumoniae TW-183
cuugauuuucaaagaccagaau

SEQ ID NO: 554214 - RNA, 22 nt, Chlamydophila pneumoniae TW-183
cuugaucaggauggucauacca

SEQ ID NO: 554215 - RNA, 18 nt, Chlamydophila pneumoniae TW-183
cuucuuucugcucuucua

SEQ ID NO: 554216 - RNA, 19 nt, Chlamydophila pneumoniae TW-183
cuucucaagaucuucauca

SEQ ID NO: 554217 - RNA, 14 nt, Chlamydophila pneumoniae TW-183
cuucuuucugcucu

SEQ ID NO: 554218 - RNA, 21 nt, Chlamydophila pneumoniae TW-183
cuguguaaaaguuagguagau

SEQ ID NO: 554219 - RNA, 14 nt, Chlamydophila pneumoniae TW-183
cuguggcaauagcg

SEQ ID NO: 554220 - RNA, 13 nt, Chlamydophila pneumoniae TW-183
cuguuaacucaga

SEQ ID NO: 554221 - RNA, 18 nt, Chlamydophila pneumoniae TW-183
cugugcauuuucuucuug

SEQ ID NO: 554222 - RNA, 23 nt, Chlamydophila pneumoniae TW-183
cuguaucuccacgcacuccugga

SEQ ID NO: 554223 - RNA, 14 nt, Chlamydophila pneumoniae TW-183
cuguacuuccccaa

SEQ ID NO: 554224 - RNA, 17 nt, Chlamydophila pneumoniae TW-183
cugguuucuucaucugg

SEQ ID NO: 554225 - RNA, 16 nt, Chlamydophila pneumoniae TW-183
cugggcgucuucuucg

SEQ ID NO: 554226 - RNA, 23 nt, Chlamydophila pneumoniae TW-183
cugggaguuguaaaacuuagaaa

SEQ ID NO: 554227 - RNA, 18 nt, Chlamydophila pneumoniae TW-183
cuggauugauccacagau

SEQ ID NO: 554228 - RNA, 15 nt, Chlamydophila pneumoniae TW-183
cugcuucaaaacaua

SEQ ID NO: 554229 - RNA, 13 nt, Chlamydophila pneumoniae TW-183
cugcugaggagag

SEQ ID NO: 554230 - RNA, 20 nt, Chlamydophila pneumoniae TW-183
cugcugaggagaguaagguc

SEQ ID NO: 554231 - RNA, 13 nt, Chlamydophila pneumoniae TW-183
cugauucucccaa

SEQ ID NO: 554232 - RNA, 12 nt, Chlamydophila pneumoniae TW-183
cugauucuccca

SEQ ID NO: 554233 - RNA, 19 nt, Chlamydophila pneumoniae TW-183
cugauucucccaauaucca

SEQ ID NO: 554234 - RNA, 14 nt, Chlamydophila pneumoniae TW-183
cugaugccaagaaa

SEQ ID NO: 554235 - RNA, 13 nt, Chlamydophila pneumoniae TW-183
cugagcagcuucg

SEQ ID NO: 554236 - RNA, 19 nt, Chlamydophila pneumoniae TW-183
cugacuugcaagcuucuug

SEQ ID NO: 554237 - RNA, 18 nt, Chlamydophila pneumoniae TW-183
cugagagaagcagaaucu

SEQ ID NO: 554238 - RNA, 15 nt, Chlamydophila pneumoniae TW-183
cugagaaagaagucc

SEQ ID NO: 554239 - RNA, 18 nt, Chlamydophila pneumoniae TW-183
cugacgucuccaacaguc

SEQ ID NO: 554240 - RNA, 20 nt, Chlamydophila pneumoniae TW-183
cugacucuuauugcagaauc

SEQ ID NO: 554241 - RNA, 14 nt, Chlamydophila pneumoniae TW-183
cugaaucuuuuguu

SEQ ID NO: 554242 - RNA, 17 nt, Chlamydophila pneumoniae TW-183
cugaaagaacacuccug

SEQ ID NO: 554243 - RNA, 20 nt, Chlamydophila pneumoniae TW-183
cugaaagaacacuccugacu

SEQ ID NO: 554244 - RNA, 12 nt, Chlamydophila pneumoniae TW-183
cucuuugaggau

SEQ ID NO: 554245 - RNA, 22 nt, Chlamydophila pneumoniae TW-183
cucuuugauuuucuuagcuucc

SEQ ID NO: 554246 - RNA, 16 nt, Chlamydophila pneumoniae TW-183
cucuuuauauuuuuug

SEQ ID NO: 554247 - RNA, 13 nt, Chlamydophila pneumoniae TW-183
cucuuuaaaaggg

SEQ ID NO: 554248 - RNA, 21 nt, Chlamydophila pneumoniae TW-183
cucuuuaacuucuaaaagcaa

SEQ ID NO: 554249 - RNA, 23 nt, Chlamydophila pneumoniae TW-183
cucugugguuccuggauuuagga

SEQ ID NO: 554250 - RNA, 17 nt, Chlamydophila pneumoniae TW-183
cucugugguuccuggau

SEQ ID NO: 554251 - RNA, 23 nt, Chlamydophila pneumoniae TW-183
cucuguagguuuuuccaacuuca

SEQ ID NO: 554252 - RNA, 20 nt, Chlamydophila pneumoniae TW-183
cucuucauugcaaaaaugaa

SEQ ID NO: 554253 - RNA, 22 nt, Chlamydophila pneumoniae TW-183
cucuucacuauuaggcuuuuuu

SEQ ID NO: 554254 - RNA, 23 nt, Chlamydophila pneumoniae TW-183
cucuggaguuugauagagaaaau

SEQ ID NO: 554255 - RNA, 15 nt, Chlamydophila pneumoniae TW-183
cucugccuaccaaag

SEQ ID NO: 554256 - RNA, 23 nt, Chlamydophila pneumoniae TW-183
cucugccuaccaaaguuuguagc

SEQ ID NO: 554257 - RNA, 13 nt, Chlamydophila pneumoniae TW-183
cucugaacaggaa

SEQ ID NO: 554258 - RNA, 11 nt, Chlamydophila pneumoniae TW-183
cucuccaaaag

SEQ ID NO: 554259 - RNA, 19 nt, Chlamydophila pneumoniae TW-183
cucucaguuaaagagcauc

SEQ ID NO: 554260 - RNA, 19 nt, Chlamydophila pneumoniae TW-183
cucuagucuuucaaccucc

SEQ ID NO: 554261 - RNA, 15 nt, Chlamydophila pneumoniae TW-183
cucuagggguuuccc

SEQ ID NO: 554262 - RNA, 20 nt, Chlamydophila pneumoniae TW-183
cucuagcaccuaauaaagaa

SEQ ID NO: 554263 - RNA, 23 nt, Chlamydophila pneumoniae TW-183
cucuagcaccuaauaaagaaggu

SEQ ID NO: 554264 - RNA, 21 nt, Chlamydophila pneumoniae TW-183
cucuaggaacucuuuaaaagg

SEQ ID NO: 554265 - RNA, 19 nt, Chlamydophila pneumoniae TW-183
cucuagggauaauuaaacu

SEQ ID NO: 554266 - RNA, 14 nt, Chlamydophila pneumoniae TW-183
cucuaagaggguuu

SEQ ID NO: 554267 - RNA, 19 nt, Chlamydophila pneumoniae TW-183
cucuaagcugugcauuuuc

SEQ ID NO: 554268 - RNA, 21 nt, Chlamydophila pneumoniae TW-183
cucuaaggacaaaucucccaa

SEQ ID NO: 554269 - RNA, 22 nt, Chlamydophila pneumoniae TW-183
cucuaaggacaaaucucccaaa

SEQ ID NO: 554270 - RNA, 19 nt, Chlamydophila pneumoniae TW-183
cucgaacaggagagagaag

SEQ ID NO: 554271 - RNA, 20 nt, Chlamydophila pneumoniae TW-183
cuccuugacuaaauccacca

SEQ ID NO: 554272 - RNA, 13 nt, Chlamydophila pneumoniae TW-183
cucgaaacucuuu

SEQ ID NO: 554273 - RNA, 19 nt, Chlamydophila pneumoniae TW-183
cucgaaacucuuugaggau

SEQ ID NO: 554274 - RNA, 13 nt, Chlamydophila pneumoniae TW-183
cuccuggaagaau

SEQ ID NO: 554275 - RNA, 13 nt, Chlamydophila pneumoniae TW-183
cuccucaucagaa

SEQ ID NO: 554276 - RNA, 16 nt, Chlamydophila pneumoniae TW-183
cuccuccaaucugcug

SEQ ID NO: 554277 - RNA, 17 nt, Chlamydophila pneumoniae TW-183
cuccgaauggagaagga

SEQ ID NO: 554278 - RNA, 15 nt, Chlamydophila pneumoniae TW-183
cuccacagcuucuuc

SEQ ID NO: 554279 - RNA, 12 nt, Chlamydophila pneumoniae TW-183
cucaguugagaa

SEQ ID NO: 554280 - RNA, 19 nt, Chlamydophila pneumoniae TW-183
cuccaagaauagcaggaag

SEQ ID NO: 554281 - RNA, 19 nt, Chlamydophila pneumoniae TW-183
cuccaagcuuggucgcaag

SEQ ID NO: 554282 - RNA, 21 nt, Chlamydophila pneumoniae TW-183
cucaucaguaaaagacugaaa

SEQ ID NO: 554283 - RNA, 23 nt, Chlamydophila pneumoniae TW-183
cucaacuuaaguugaccuuuuuc

SEQ ID NO: 554284 - RNA, 19 nt, Chlamydophila pneumoniae TW-183
cucaaaucucauuccagca

SEQ ID NO: 554285 - RNA, 13 nt, Chlamydophila pneumoniae TW-183
cuauguguucucg

SEQ ID NO: 554286 - RNA, 15 nt, Chlamydophila pneumoniae TW-183
cuauguguucucgaa

SEQ ID NO: 554287 - RNA, 23 nt, Chlamydophila pneumoniae TW-183
cuauagauacuuugcaauacacc

SEQ ID NO: 554288 - RNA, 14 nt, Chlamydophila pneumoniae TW-183
cuauauuuuuuccc

SEQ ID NO: 554289 - RNA, 20 nt, Chlamydophila pneumoniae TW-183
cuaggguuucuacaggauau

SEQ ID NO: 554290 - RNA, 23 nt, Chlamydophila pneumoniae TW-183
cuacuuugaccaauuccccuuca

SEQ ID NO: 554291 - RNA, 18 nt, Chlamydophila pneumoniae TW-183
cuacuucugcaggacugu

SEQ ID NO: 554292 - RNA, 18 nt, Chlamydophila pneumoniae TW-183
cuaccccacgcuaaacua

SEQ ID NO: 554293 - RNA, 21 nt, Chlamydophila pneumoniae TW-183
cuaccccacgcuaaacuaaaa

SEQ ID NO: 554294 - RNA, 17 nt, Chlamydophila pneumoniae TW-183
cuaaucaauccaagaau

SEQ ID NO: 554295 - RNA, 22 nt, Chlamydophila pneumoniae TW-183
cuaauauccauaagaucucuaa

SEQ ID NO: 554296 - RNA, 18 nt, Chlamydophila pneumoniae TW-183
cuaauaagauccaaaaau

SEQ ID NO: 554297 - RNA, 19 nt, Chlamydophila pneumoniae TW-183
cuaaggaaauuacaaucuc

SEQ ID NO: 554298 - RNA, 18 nt, Chlamydophila pneumoniae TW-183
cuaagagcgucuucuuuu

SEQ ID NO: 554299 - RNA, 21 nt, Chlamydophila pneumoniae TW-183
cuaaauagaaaacauagagau

SEQ ID NO: 554300 - RNA, 14 nt, Chlamydophila pneumoniae TW-183
cuaaauagaaaaca

SEQ ID NO: 554301 - RNA, 20 nt, Chlamydophila pneumoniae TW-183
cuacaaaauuauuaaacucg

SEQ ID NO: 554302 - RNA, 16 nt, Chlamydophila pneumoniae TW-183
cuacaaauuaccuuga

SEQ ID NO: 554303 - RNA, 13 nt, Chlamydophila pneumoniae TW-183
cuacaaguugaga

SEQ ID NO: 554304 - RNA, 22 nt, Chlamydophila pneumoniae TW-183
cuacaauuuccuugguauccca

SEQ ID NO: 554305 - RNA, 17 nt, Chlamydophila pneumoniae TW-183
cuacagagggaauuuca

SEQ ID NO: 554306 - RNA, 18 nt, Chlamydophila pneumoniae TW-183
cuacagcuaacgaaguga

SEQ ID NO: 554307 - RNA, 22 nt, Chlamydophila pneumoniae TW-183
cguuuugucgguaauuuccaug

SEQ ID NO: 554308 - RNA, 14 nt, Chlamydophila pneumoniae TW-183
cuaaacaccuucuu

SEQ ID NO: 554309 - RNA, 13 nt, Chlamydophila pneumoniae TW-183
cuaaacaauuuca

SEQ ID NO: 554310 - RNA, 14 nt, Chlamydophila pneumoniae TW-183
cuaaaaguuuuuua

SEQ ID NO: 554311 - RNA, 18 nt, Chlamydophila pneumoniae TW-183
cuaaaguaggaauuuuca

SEQ ID NO: 554312 - RNA, 13 nt, Chlamydophila pneumoniae TW-183
cuaaagugucaua

SEQ ID NO: 554313 - RNA, 17 nt, Chlamydophila pneumoniae TW-183
cuaaaggaaucucggga

SEQ ID NO: 554314 - RNA, 12 nt, Chlamydophila pneumoniae TW-183
cuaaacucucca

SEQ ID NO: 554315 - RNA, 11 nt, Chlamydophila pneumoniae TW-183
cguugccuguu

SEQ ID NO: 554316 - RNA, 18 nt, Chlamydophila pneumoniae TW-183
aaaaaagcuagucuuucu

SEQ ID NO: 554317 - RNA, 20 nt, Chlamydophila pneumoniae TW-183
aaaagagaacauguuucuaa

SEQ ID NO: 554318 - RNA, 23 nt, Chlamydophila pneumoniae TW-183
aaaagaaccuaggaaauccuccu

SEQ ID NO: 554319 - RNA, 23 nt, Chlamydophila pneumoniae TW-183
aaaacuucuugugauccuugcaa

SEQ ID NO: 554320 - RNA, 15 nt, Chlamydophila pneumoniae TW-183
aaaacggauagggcu

SEQ ID NO: 554321 - RNA, 21 nt, Chlamydophila pneumoniae TW-183
aaaaucaaauagauuuuuacu

SEQ ID NO: 554322 - RNA, 14 nt, Chlamydophila pneumoniae TW-183
aaaaucaaauagau

SEQ ID NO: 554323 - RNA, 20 nt, Chlamydophila pneumoniae TW-183
aaaauaguacgcuuuuuacu

SEQ ID NO: 554324 - RNA, 19 nt, Chlamydophila pneumoniae TW-183
aaaauucccauagcaugag

SEQ ID NO: 554325 - RNA, 15 nt, Chlamydophila pneumoniae TW-183
aaaauucaugcaaaa

SEQ ID NO: 554326 - RNA, 14 nt, Chlamydophila pneumoniae TW-183
aaacaaaaucaaaa

SEQ ID NO: 554327 - RNA, 23 nt, Chlamydophila pneumoniae TW-183
aaauucuagaccugccaagauac

SEQ ID NO: 554328 - RNA, 23 nt, Chlamydophila pneumoniae TW-183
aaauucucauaaccuaaggcaug

SEQ ID NO: 554329 - RNA, 18 nt, Chlamydophila pneumoniae TW-183
aaaaagcuuuuuucucuu

SEQ ID NO: 554330 - RNA, 20 nt, Chlamydophila pneumoniae TW-183
aaaaagcuuuuuucucuugc

SEQ ID NO: 554331 - RNA, 12 nt, Chlamydophila pneumoniae TW-183
aaaugccuguac

SEQ ID NO: 554332 - RNA, 19 nt, Chlamydophila pneumoniae TW-183
aaaucuuccccuaaaaauu

SEQ ID NO: 554333 - RNA, 21 nt, Chlamydophila pneumoniae TW-183
aaaucucauuccagcaucuuc

SEQ ID NO: 554334 - RNA, 13 nt, Chlamydophila pneumoniae TW-183
aaauaagcaguuu

SEQ ID NO: 554335 - RNA, 13 nt, Chlamydophila pneumoniae TW-183
aaaucacacuuaa

SEQ ID NO: 554336 - RNA, 16 nt, Chlamydophila pneumoniae TW-183
aaagggcgcuucccua

SEQ ID NO: 554337 - RNA, 18 nt, Chlamydophila pneumoniae TW-183
aaaggaaucccuuuuuaa

SEQ ID NO: 554338 - RNA, 17 nt, Chlamydophila pneumoniae TW-183
aaaggaaucucgggaga

SEQ ID NO: 554339 - RNA, 16 nt, Chlamydophila pneumoniae TW-183
aaaggaccuguuuucu

SEQ ID NO: 554340 - RNA, 21 nt, Chlamydophila pneumoniae TW-183
aaagaaggucuuccaucucuu

SEQ ID NO: 554341 - RNA, 14 nt, Chlamydophila pneumoniae TW-183
aaagaaguccuagg

SEQ ID NO: 554342 - RNA, 14 nt, Chlamydophila pneumoniae TW-183
aaagacugaaaaga

SEQ ID NO: 554343 - RNA, 22 nt, Chlamydophila pneumoniae TW-183
aaagagaaucuccucaucagaa

SEQ ID NO: 554344 - RNA, 23 nt, Chlamydophila pneumoniae TW-183
aaagagcucaucaaugagaaaua

SEQ ID NO: 554345 - RNA, 17 nt, Chlamydophila pneumoniae TW-183
aaagagugccaagagca

SEQ ID NO: 554346 - RNA, 18 nt, Chlamydophila pneumoniae TW-183
aaagagugccaagagcau

SEQ ID NO: 554347 - RNA, 22 nt, Chlamydophila pneumoniae TW-183
aaagauaacgagacaugaugca

SEQ ID NO: 554348 - RNA, 20 nt, Chlamydophila pneumoniae TW-183
aaacucugacgucuccaaca

SEQ ID NO: 554349 - RNA, 19 nt, Chlamydophila pneumoniae TW-183
aaacggcuguacuucccca

SEQ ID NO: 554350 - RNA, 22 nt, Chlamydophila pneumoniae TW-183
aaacuaaaucaacuacaucucc

SEQ ID NO: 554351 - RNA, 19 nt, Chlamydophila pneumoniae TW-183
aagcugugcauuuucuucu

SEQ ID NO: 554352 - RNA, 19 nt, Chlamydophila pneumoniae TW-183
aagcuguggcgauuuuacu

SEQ ID NO: 554353 - RNA, 21 nt, Chlamydophila pneumoniae TW-183
aaggauucugagaaguuaaga

SEQ ID NO: 554354 - RNA, 15 nt, Chlamydophila pneumoniae TW-183
aagcucuacaagcuc

SEQ ID NO: 554355 - RNA, 16 nt, Chlamydophila pneumoniae TW-183
aagcucgaccucuagc

SEQ ID NO: 554356 - RNA, 19 nt, Chlamydophila pneumoniae TW-183
aagcucgaccucuagcuca

SEQ ID NO: 554357 - RNA, 18 nt, Chlamydophila pneumoniae TW-183
aagggacuuguuguuuca

SEQ ID NO: 554358 - RNA, 19 nt, Chlamydophila pneumoniae TW-183
aagguucccuacuccauug

SEQ ID NO: 554359 - RNA, 19 nt, Chlamydophila pneumoniae TW-183
aagguuacaccuaaaguuu

SEQ ID NO: 554360 - RNA, 21 nt, Chlamydophila pneumoniae TW-183
aagcaggugugugguaaaaau

SEQ ID NO: 554361 - RNA, 18 nt, Chlamydophila pneumoniae TW-183
aagcagaggguuccaaga

SEQ ID NO: 554362 - RNA, 18 nt, Chlamydophila pneumoniae TW-183
aagcacccucuucauccg

SEQ ID NO: 554363 - RNA, 13 nt, Chlamydophila pneumoniae TW-183
aagcaaaagcaag

SEQ ID NO: 554364 - RNA, 23 nt, Chlamydophila pneumoniae TW-183
aagauuuccaauccauucugaga

SEQ ID NO: 554365 - RNA, 14 nt, Chlamydophila pneumoniae TW-183
aagauuauucuaga

SEQ ID NO: 554366 - RNA, 22 nt, Chlamydophila pneumoniae TW-183
aagaugcauucugauccgaaaa

SEQ ID NO: 554367 - RNA, 21 nt, Chlamydophila pneumoniae TW-183
aagaauguagcuguuccaaga

SEQ ID NO: 554368 - RNA, 20 nt, Chlamydophila pneumoniae TW-183
aagaucucuaaguucuugau

SEQ ID NO: 554369 - RNA, 22 nt, Chlamydophila pneumoniae TW-183
aagaugaauaccagaagcaaag

SEQ ID NO: 554370 - RNA, 16 nt, Chlamydophila pneumoniae TW-183
aagaugaauaccagaa

SEQ ID NO: 554371 - RNA, 16 nt, Chlamydophila pneumoniae TW-183
aauacagcauaaaaau

SEQ ID NO: 554372 - RNA, 22 nt, Chlamydophila pneumoniae TW-183
aauagagaaagagugccaagag

SEQ ID NO: 554373 - RNA, 16 nt, Chlamydophila pneumoniae TW-183
aauagagaaagagugc

SEQ ID NO: 554374 - RNA, 22 nt, Chlamydophila pneumoniae TW-183
aauacuggagagguaaccagag

SEQ ID NO: 554375 - RNA, 23 nt, Chlamydophila pneumoniae TW-183
aauacguccagccugcaccagac

SEQ ID NO: 554376 - RNA, 18 nt, Chlamydophila pneumoniae TW-183
aagugaucuugagaaaag

SEQ ID NO: 554377 - RNA, 19 nt, Chlamydophila pneumoniae TW-183
aagugaggagaauagcaag

SEQ ID NO: 554378 - RNA, 18 nt, Chlamydophila pneumoniae TW-183
aaguucuuaagaaucgag

SEQ ID NO: 554379 - RNA, 15 nt, Chlamydophila pneumoniae TW-183
aaguucuugauuuuc

SEQ ID NO: 554380 - RNA, 14 nt, Chlamydophila pneumoniae TW-183
aauaaaauguccaa

SEQ ID NO: 554381 - RNA, 20 nt, Chlamydophila pneumoniae TW-183
aaguuuugauuuugcaguga

SEQ ID NO: 554382 - RNA, 16 nt, Chlamydophila pneumoniae TW-183
aaguuuuucuggaaga

SEQ ID NO: 554383 - RNA, 22 nt, Chlamydophila pneumoniae TW-183
aauaaaaaaacccucaaagaau

SEQ ID NO: 554384 - RNA, 15 nt, Chlamydophila pneumoniae TW-183
aagaauagcaggaag

SEQ ID NO: 554385 - RNA, 20 nt, Chlamydophila pneumoniae TW-183
aagaacugcauaaucucacc

SEQ ID NO: 554386 - RNA, 19 nt, Chlamydophila pneumoniae TW-183
aagaagacuagcuuuucau

SEQ ID NO: 554387 - RNA, 21 nt, Chlamydophila pneumoniae TW-183
aagaaaacaaagucacggcga

SEQ ID NO: 554388 - RNA, 20 nt, Chlamydophila pneumoniae TW-183
aagaaaaaccccuagaacuu

SEQ ID NO: 554389 - RNA, 14 nt, Chlamydophila pneumoniae TW-183
aacuucaacaaagg

SEQ ID NO: 554390 - RNA, 17 nt, Chlamydophila pneumoniae TW-183
aacuuaaagacuugcuu

SEQ ID NO: 554391 - RNA, 19 nt, Chlamydophila pneumoniae TW-183
aacuuaaagacuugcuucc

SEQ ID NO: 554392 - RNA, 14 nt, Chlamydophila pneumoniae TW-183
aacugcauaaucuc

SEQ ID NO: 554393 - RNA, 17 nt, Chlamydophila pneumoniae TW-183
aacguagcuacaaaauu

SEQ ID NO: 554394 - RNA, 18 nt, Chlamydophila pneumoniae TW-183
aacuaaacucuccaaaag

SEQ ID NO: 554395 - RNA, 15 nt, Chlamydophila pneumoniae TW-183
aacuaaaaguuuuuu

SEQ ID NO: 554396 - RNA, 20 nt, Chlamydophila pneumoniae TW-183
aacuaacauagauaagguaa

SEQ ID NO: 554397 - RNA, 23 nt, Chlamydophila pneumoniae TW-183
aacgaucgucaguaaaacacaaa

SEQ ID NO: 554398 - RNA, 15 nt, Chlamydophila pneumoniae TW-183
aacccucaaagaaua

SEQ ID NO: 554399 - RNA, 20 nt, Chlamydophila pneumoniae TW-183
aaccaauugagcucucuagc

SEQ ID NO: 554400 - RNA, 17 nt, Chlamydophila pneumoniae TW-183
aacauucuucugucugu

SEQ ID NO: 554401 - RNA, 11 nt, Chlamydophila pneumoniae TW-183
aacaugaggau

SEQ ID NO: 554402 - RNA, 14 nt, Chlamydophila pneumoniae TW-183
aacagcaacacucg

SEQ ID NO: 554403 - RNA, 20 nt, Chlamydophila pneumoniae TW-183
aacacgcccacggaaagcac

SEQ ID NO: 554404 - RNA, 19 nt, Chlamydophila pneumoniae TW-183
aacaaguaccaagaaaaua

SEQ ID NO: 554405 - RNA, 12 nt, Chlamydophila pneumoniae TW-183
aaauucuguaaa

SEQ ID NO: 554406 - RNA, 15 nt, Chlamydophila pneumoniae TW-183
aacacaaauagcaag

SEQ ID NO: 554407 - RNA, 20 nt, Chlamydophila pneumoniae TW-183
aacacaaauagcaagagcua

SEQ ID NO: 554408 - RNA, 17 nt, Chlamydophila pneumoniae TW-183
aaucccgugcuaggaag

SEQ ID NO: 554409 - RNA, 22 nt, Chlamydophila pneumoniae TW-183
aauccauucugagaaagaaguc

SEQ ID NO: 554410 - RNA, 15 nt, Chlamydophila pneumoniae TW-183
aauccauucugagaa

SEQ ID NO: 554411 - RNA, 19 nt, Chlamydophila pneumoniae TW-183
aaucgagagaagaaauucu

SEQ ID NO: 554412 - RNA, 22 nt, Chlamydophila pneumoniae TW-183
aaucgagagaagaaauucugac

SEQ ID NO: 554413 - RNA, 23 nt, Chlamydophila pneumoniae TW-183
aaucgagagaagaaauucugacu

SEQ ID NO: 554414 - RNA, 20 nt, Chlamydophila pneumoniae TW-183
aaucgauaacguugccuguu

SEQ ID NO: 554415 - RNA, 20 nt, Chlamydophila pneumoniae TW-183
aaucccugcacucuuucaga

SEQ ID NO: 554416 - RNA, 18 nt, Chlamydophila pneumoniae TW-183
aaucccgugcuaggaaga

SEQ ID NO: 554417 - RNA, 17 nt, Chlamydophila pneumoniae TW-183
aaucuuccccuaaaaau

SEQ ID NO: 554418 - RNA, 19 nt, Chlamydophila pneumoniae TW-183
aaucugugaguacccaguc

SEQ ID NO: 554419 - RNA, 20 nt, Chlamydophila pneumoniae TW-183
aaucucaccagaagcaacua

SEQ ID NO: 554420 - RNA, 16 nt, Chlamydophila pneumoniae TW-183
aaaaauucuuuaggga

SEQ ID NO: 554421 - RNA, 18 nt, Chlamydophila pneumoniae TW-183
aauauggguguaaauuuu

SEQ ID NO: 554422 - RNA, 23 nt, Chlamydophila pneumoniae TW-183
aauagcaggaaggaauagagaaa

SEQ ID NO: 554423 - RNA, 13 nt, Chlamydophila pneumoniae TW-183
aaucaauaaaaug

SEQ ID NO: 554424 - RNA, 13 nt, Chlamydophila pneumoniae TW-183
aaucaauccaaga

SEQ ID NO: 554425 - RNA, 14 nt, Chlamydophila pneumoniae TW-183
aaucaauccaagaa

SEQ ID NO: 554426 - RNA, 17 nt, Chlamydophila pneumoniae TW-183
aauucuagaccugccaa

SEQ ID NO: 554427 - RNA, 19 nt, Chlamydophila pneumoniae TW-183
aauucucgagcagcugcac

SEQ ID NO: 554428 - RNA, 17 nt, Chlamydophila pneumoniae TW-183
aauuccccuucaucaau

SEQ ID NO: 554429 - RNA, 15 nt, Chlamydophila pneumoniae TW-183
aauucaugcaaaaca

SEQ ID NO: 554430 - RNA, 15 nt, Chlamydophila pneumoniae TW-183
aauugcucuugcucu

SEQ ID NO: 554431 - RNA, 16 nt, Chlamydophila pneumoniae TW-183
aaugugcucggcacuu

SEQ ID NO: 554432 - RNA, 13 nt, Chlamydophila pneumoniae TW-183
aaugccagcagcg

SEQ ID NO: 554433 - RNA, 18 nt, Chlamydophila pneumoniae TW-183
acaaaaccuggauugauc

SEQ ID NO: 554434 - RNA, 21 nt, Chlamydophila pneumoniae TW-183
acaaacuaacauagauaaggu

SEQ ID NO: 554435 - RNA, 19 nt, Chlamydophila pneumoniae TW-183
acaaauuaccuugagacaa

SEQ ID NO: 554436 - RNA, 18 nt, Chlamydophila pneumoniae TW-183
acaacaccacagaggucg

SEQ ID NO: 554437 - RNA, 19 nt, Chlamydophila pneumoniae TW-183
acacaacucuuaaaucgcu

SEQ ID NO: 554438 - RNA, 20 nt, Chlamydophila pneumoniae TW-183
acaagcuuagcaacccaagc

SEQ ID NO: 554439 - RNA, 15 nt, Chlamydophila pneumoniae TW-183
acaaguugagagaga

SEQ ID NO: 554440 - RNA, 16 nt, Chlamydophila pneumoniae TW-183
acaaugauaucagcau

SEQ ID NO: 554441 - RNA, 22 nt, Chlamydophila pneumoniae TW-183
acagcuaaucaauccaagaaua

SEQ ID NO: 554442 - RNA, 23 nt, Chlamydophila pneumoniae TW-183
acaguccuuuaccaucgucucca

SEQ ID NO: 554443 - RNA, 21 nt, Chlamydophila pneumoniae TW-183
acaggggaugugauguucugc

SEQ ID NO: 554444 - RNA, 13 nt, Chlamydophila pneumoniae TW-183
acagguucacuuc

SEQ ID NO: 554445 - RNA, 22 nt, Chlamydophila pneumoniae TW-183
acaucuccaagccaugcaauga

SEQ ID NO: 554446 - RNA, 19 nt, Chlamydophila pneumoniae TW-183
acaucuguaguaggcacuu

SEQ ID NO: 554447 - RNA, 20 nt, Chlamydophila pneumoniae TW-183
acaugaggauucuuuuugau

SEQ ID NO: 554448 - RNA, 17 nt, Chlamydophila pneumoniae TW-183
acauccuggagcaugag

SEQ ID NO: 554449 - RNA, 21 nt, Chlamydophila pneumoniae TW-183
acauucuucugucuguauuuc

SEQ ID NO: 554450 - RNA, 14 nt, Chlamydophila pneumoniae TW-183
acauuguuuaaguc

SEQ ID NO: 554451 - RNA, 17 nt, Chlamydophila pneumoniae TW-183
acauucuucugucugua

SEQ ID NO: 554452 - RNA, 22 nt, Chlamydophila pneumoniae TW-183
accaaaaauuccguuaagaugu

SEQ ID NO: 554453 - RNA, 17 nt, Chlamydophila pneumoniae TW-183
acuugcauuuuuuggaa

SEQ ID NO: 554454 - RNA, 15 nt, Chlamydophila pneumoniae TW-183
acuugcccaaaaguu

SEQ ID NO: 554455 - RNA, 12 nt, Chlamydophila pneumoniae TW-183
acuuuauucucu

SEQ ID NO: 554456 - RNA, 20 nt, Chlamydophila pneumoniae TW-183
acuuuauucucuucacuauu

SEQ ID NO: 554457 - RNA, 22 nt, Chlamydophila pneumoniae TW-183
acuuuguuaauagaagaucauu

SEQ ID NO: 554458 - RNA, 17 nt, Chlamydophila pneumoniae TW-183
acuuugcaauacaccaa

SEQ ID NO: 554459 - RNA, 12 nt, Chlamydophila pneumoniae TW-183
acuuuccucucu

SEQ ID NO: 554460 - RNA, 17 nt, Chlamydophila pneumoniae TW-183
acuuuccguagccuuac

SEQ ID NO: 554461 - RNA, 15 nt, Chlamydophila pneumoniae TW-183
acuuuccucucuuua

SEQ ID NO: 554462 - RNA, 20 nt, Chlamydophila pneumoniae TW-183
agaaaauaguacgcuuuuua

SEQ ID NO: 554463 - RNA, 14 nt, Chlamydophila pneumoniae TW-183
agaagcauugagga

SEQ ID NO: 554464 - RNA, 13 nt, Chlamydophila pneumoniae TW-183
agaagccaccaaa

SEQ ID NO: 554465 - RNA, 15 nt, Chlamydophila pneumoniae TW-183
agaagccaccaaaaa

SEQ ID NO: 554466 - RNA, 16 nt, Chlamydophila pneumoniae TW-183
agaauaccuauagguu

SEQ ID NO: 554467 - RNA, 15 nt, Chlamydophila pneumoniae TW-183
agaauaccuucaaca

SEQ ID NO: 554468 - RNA, 19 nt, Chlamydophila pneumoniae TW-183
agaauaccuucaacaagaa

SEQ ID NO: 554469 - RNA, 24 nt, Chlamydophila pneumoniae TW-183
agaauagccauaauuagaacagca

SEQ ID NO: 554470 - RNA, 16 nt, Chlamydophila pneumoniae TW-183
agaauagcaggaagga

SEQ ID NO: 554471 - RNA, 18 nt, Chlamydophila pneumoniae TW-183
agaauagccauaauuaga

SEQ ID NO: 554472 - RNA, 21 nt, Chlamydophila pneumoniae TW-183
agaaugcuguaaucgagagaa

SEQ ID NO: 554473 - RNA, 14 nt, Chlamydophila pneumoniae TW-183
agaaucuccucauc

SEQ ID NO: 554474 - RNA, 13 nt, Chlamydophila pneumoniae TW-183
agaaaugcucuuc

SEQ ID NO: 554475 - RNA, 21 nt, Chlamydophila pneumoniae TW-183
agaaaugcucuucugcagcgu

SEQ ID NO: 554476 - RNA, 14 nt, Chlamydophila pneumoniae TW-183
agaaaucacacuua

SEQ ID NO: 554477 - RNA, 20 nt, Chlamydophila pneumoniae TW-183
aaaacagauaagacaauaaa

SEQ ID NO: 554478 - RNA, 18 nt, Chlamydophila pneumoniae TW-183
aaaacacgcccugaugcu

SEQ ID NO: 554479 - RNA, 21 nt, Chlamydophila pneumoniae TW-183
agaaccuucacaagaaaacaa

SEQ ID NO: 554480 - RNA, 24 nt, Chlamydophila pneumoniae TW-183
agaaccuucacaagaaaacaaagu

SEQ ID NO: 554481 - RNA, 20 nt, Chlamydophila pneumoniae TW-183
agaacauguuucuaagcuga

SEQ ID NO: 554482 - RNA, 18 nt, Chlamydophila pneumoniae TW-183
agaagacuagcuuuucau

SEQ ID NO: 554483 - RNA, 17 nt, Chlamydophila pneumoniae TW-183
agaagaaauuagaggga

SEQ ID NO: 554484 - RNA, 15 nt, Chlamydophila pneumoniae TW-183
agaacuuuacaauua

SEQ ID NO: 554485 - RNA, 13 nt, Chlamydophila pneumoniae TW-183
agaacuucuccaa

SEQ ID NO: 554486 - RNA, 23 nt, Chlamydophila pneumoniae TW-183
agaucaaguccucgccgcugccc

SEQ ID NO: 554487 - RNA, 14 nt, Chlamydophila pneumoniae TW-183
agauagcucuugcg

SEQ ID NO: 554488 - RNA, 22 nt, Chlamydophila pneumoniae TW-183
agauagcucuuugauuuucuua

SEQ ID NO: 554489 - RNA, 24 nt, Chlamydophila pneumoniae TW-183
agauagcucuuugauuuucuuagc

SEQ ID NO: 554490 - RNA, 23 nt, Chlamydophila pneumoniae TW-183
agaguuuuuggccgauaggaaga

SEQ ID NO: 554491 - RNA, 19 nt, Chlamydophila pneumoniae TW-183
agaguuuuacaucaaugau

SEQ ID NO: 554492 - RNA, 14 nt, Chlamydophila pneumoniae TW-183
agauaacgagacau

SEQ ID NO: 554493 - RNA, 18 nt, Chlamydophila pneumoniae TW-183
agaugaauaccagaagca

SEQ ID NO: 554494 - RNA, 15 nt, Chlamydophila pneumoniae TW-183
agaugcuaacaacuc

SEQ ID NO: 554495 - RNA, 19 nt, Chlamydophila pneumoniae TW-183
agaucucuugaagcacuuu

SEQ ID NO: 554496 - RNA, 21 nt, Chlamydophila pneumoniae TW-183
agaucuucaucacaaaauuca

SEQ ID NO: 554497 - RNA, 15 nt, Chlamydophila pneumoniae TW-183
agaucuacaucaaau

SEQ ID NO: 554498 - RNA, 14 nt, Chlamydophila pneumoniae TW-183
agaucuacaucaaa

SEQ ID NO: 554499 - RNA, 20 nt, Chlamydophila pneumoniae TW-183
agaucgggucuacaacaguu

SEQ ID NO: 554500 - RNA, 22 nt, Chlamydophila pneumoniae TW-183
agaucgaucucugugguuccug

SEQ ID NO: 554501 - RNA, 20 nt, Chlamydophila pneumoniae TW-183
agaucgauuaccuaaaacaa

SEQ ID NO: 554502 - RNA, 15 nt, Chlamydophila pneumoniae TW-183
agaucgaucucugug

SEQ ID NO: 554503 - RNA, 13 nt, Chlamydophila pneumoniae TW-183
agaucccagaaga

SEQ ID NO: 554504 - RNA, 13 nt, Chlamydophila pneumoniae TW-183
agagcuaugauga

SEQ ID NO: 554505 - RNA, 19 nt, Chlamydophila pneumoniae TW-183
agagcucguaauccuucuu

SEQ ID NO: 554506 - RNA, 16 nt, Chlamydophila pneumoniae TW-183
agagcucaucaaugag

SEQ ID NO: 554507 - RNA, 18 nt, Chlamydophila pneumoniae TW-183
agagcuaacagcacguaa

SEQ ID NO: 554508 - RNA, 15 nt, Chlamydophila pneumoniae TW-183
agagaggguaagcug

SEQ ID NO: 554509 - RNA, 17 nt, Chlamydophila pneumoniae TW-183
agagaguucucucuuca

SEQ ID NO: 554510 - RNA, 23 nt, Chlamydophila pneumoniae TW-183
agagaguucuuguaauaaaagaa

SEQ ID NO: 554511 - RNA, 12 nt, Chlamydophila pneumoniae TW-183
agagaguuuuug

SEQ ID NO: 554512 - RNA, 22 nt, Chlamydophila pneumoniae TW-183
agagagcuugucacacugcgag

SEQ ID NO: 554513 - RNA, 13 nt, Chlamydophila pneumoniae TW-183
agagagaacagga

SEQ ID NO: 554514 - RNA, 17 nt, Chlamydophila pneumoniae TW-183
agagauucauaaaacug

SEQ ID NO: 554515 - RNA, 14 nt, Chlamydophila pneumoniae TW-183
agagauucuacaaa

SEQ ID NO: 554516 - RNA, 21 nt, Chlamydophila pneumoniae TW-183
agagauugccaggagagcuaa

SEQ ID NO: 554517 - RNA, 20 nt, Chlamydophila pneumoniae TW-183
agagaaaauaagcaguuuuc

SEQ ID NO: 554518 - RNA, 13 nt, Chlamydophila pneumoniae TW-183
agacuuuccucuc

SEQ ID NO: 554519 - RNA, 17 nt, Chlamydophila pneumoniae TW-183
agacuuuccucucuuua

SEQ ID NO: 554520 - RNA, 13 nt, Chlamydophila pneumoniae TW-183
agacuuucugacg

SEQ ID NO: 554521 - RNA, 20 nt, Chlamydophila pneumoniae TW-183
agagaacuuuaacgaagaag

SEQ ID NO: 554522 - RNA, 15 nt, Chlamydophila pneumoniae TW-183
agagaagcagaaucu

SEQ ID NO: 554523 - RNA, 15 nt, Chlamydophila pneumoniae TW-183
agacucucaucagca

SEQ ID NO: 554524 - RNA, 15 nt, Chlamydophila pneumoniae TW-183
agcggcaacauaauc

SEQ ID NO: 554525 - RNA, 21 nt, Chlamydophila pneumoniae TW-183
agccuugauugaacagucuug

SEQ ID NO: 554526 - RNA, 23 nt, Chlamydophila pneumoniae TW-183
agccuuacggccccuggaauuuc

SEQ ID NO: 554527 - RNA, 20 nt, Chlamydophila pneumoniae TW-183
agccuaugggaggaauuccu

SEQ ID NO: 554528 - RNA, 13 nt, Chlamydophila pneumoniae TW-183
agcccuauagaaa

SEQ ID NO: 554529 - RNA, 23 nt, Chlamydophila pneumoniae TW-183
agcccuagaguaaagaguagccc

SEQ ID NO: 554530 - RNA, 21 nt, Chlamydophila pneumoniae TW-183
agcauuuucucugagcagcuu

SEQ ID NO: 554531 - RNA, 13 nt, Chlamydophila pneumoniae TW-183
agcauuuucucug

SEQ ID NO: 554532 - RNA, 20 nt, Chlamydophila pneumoniae TW-183
agcaggugugugguaaaaau

SEQ ID NO: 554533 - RNA, 17 nt, Chlamydophila pneumoniae TW-183
agcauccuguagagcaa

SEQ ID NO: 554534 - RNA, 17 nt, Chlamydophila pneumoniae TW-183
agcagcuucgcaaucuu

SEQ ID NO: 554535 - RNA, 23 nt, Chlamydophila pneumoniae TW-183
agcagaccucucccuugggauuc

SEQ ID NO: 554536 - RNA, 17 nt, Chlamydophila pneumoniae TW-183
agcacgcacuaaucuau

SEQ ID NO: 554537 - RNA, 23 nt, Chlamydophila pneumoniae TW-183
agcaaguuguugauaauuacaga

SEQ ID NO: 554538 - RNA, 17 nt, Chlamydophila pneumoniae TW-183
agauuaugaugccucau

SEQ ID NO: 554539 - RNA, 22 nt, Chlamydophila pneumoniae TW-183
agcaacgcaugacgcuuuucca

SEQ ID NO: 554540 - RNA, 19 nt, Chlamydophila pneumoniae TW-183
agcaacgcaugacgcuuuu

SEQ ID NO: 554541 - RNA, 13 nt, Chlamydophila pneumoniae TW-183
acuuaagauacuu

SEQ ID NO: 554542 - RNA, 21 nt, Chlamydophila pneumoniae TW-183
acuuaagauacuucuccacag

SEQ ID NO: 554543 - RNA, 22 nt, Chlamydophila pneumoniae TW-183
acuuaggguucucaaagaucau

SEQ ID NO: 554544 - RNA, 17 nt, Chlamydophila pneumoniae TW-183
acugcuuuaggcccaag

SEQ ID NO: 554545 - RNA, 18 nt, Chlamydophila pneumoniae TW-183
acugccagcgaucacaua

SEQ ID NO: 554546 - RNA, 22 nt, Chlamydophila pneumoniae TW-183
acugaugccaagaaauauacug

SEQ ID NO: 554547 - RNA, 16 nt, Chlamydophila pneumoniae TW-183
acugaugccaagaaau

SEQ ID NO: 554548 - RNA, 14 nt, Chlamydophila pneumoniae TW-183
acucaucaguaaaa

SEQ ID NO: 554549 - RNA, 14 nt, Chlamydophila pneumoniae TW-183
acucagagauugcc

SEQ ID NO: 554550 - RNA, 21 nt, Chlamydophila pneumoniae TW-183
acucaggauauauagagcaga

SEQ ID NO: 554551 - RNA, 20 nt, Chlamydophila pneumoniae TW-183
acucaggauauauagagcag

SEQ ID NO: 554552 - RNA, 19 nt, Chlamydophila pneumoniae TW-183
acuccaagaauagcaggaa

SEQ ID NO: 554553 - RNA, 21 nt, Chlamydophila pneumoniae TW-183
acuccaaaauauucuuucaaa

SEQ ID NO: 554554 - RNA, 12 nt, Chlamydophila pneumoniae TW-183
acucaaagaacu

SEQ ID NO: 554555 - RNA, 18 nt, Chlamydophila pneumoniae TW-183
acuaucauggacaagcaa

SEQ ID NO: 554556 - RNA, 12 nt, Chlamydophila pneumoniae TW-183
acuacugaaaca

SEQ ID NO: 554557 - RNA, 16 nt, Chlamydophila pneumoniae TW-183
acgucuccaacagucu

SEQ ID NO: 554558 - RNA, 23 nt, Chlamydophila pneumoniae TW-183
acguuaauaaagaggcucccauc

SEQ ID NO: 554559 - RNA, 21 nt, Chlamydophila pneumoniae TW-183
acguccauuucauguaagaau

SEQ ID NO: 554560 - RNA, 19 nt, Chlamydophila pneumoniae TW-183
acguccucaccuugugaga

SEQ ID NO: 554561 - RNA, 16 nt, Chlamydophila pneumoniae TW-183
acgcuaaacuaaaaug

SEQ ID NO: 554562 - RNA, 18 nt, Chlamydophila pneumoniae TW-183
acgcccacggaaagcaca

SEQ ID NO: 554563 - RNA, 21 nt, Chlamydophila pneumoniae TW-183
acgcccacggaaagcacauac

SEQ ID NO: 554564 - RNA, 16 nt, Chlamydophila pneumoniae TW-183
acgaccucgaauuccu

SEQ ID NO: 554565 - RNA, 13 nt, Chlamydophila pneumoniae TW-183
accuucacaagaa

SEQ ID NO: 554566 - RNA, 14 nt, Chlamydophila pneumoniae TW-183
accuaaaacaaaau

SEQ ID NO: 554567 - RNA, 14 nt, Chlamydophila pneumoniae TW-183
accuaauaaagaag

SEQ ID NO: 554568 - RNA, 19 nt, Chlamydophila pneumoniae TW-183
accguaacugaggcaaaga

SEQ ID NO: 554569 - RNA, 19 nt, Chlamydophila pneumoniae TW-183
accgagcuuuuugcuuuuc

SEQ ID NO: 554570 - RNA, 16 nt, Chlamydophila pneumoniae TW-183
accgaaucucuccagc

SEQ ID NO: 554571 - RNA, 20 nt, Chlamydophila pneumoniae TW-183
accgaaucucuccagcuuga

SEQ ID NO: 554572 - RNA, 21 nt, Chlamydophila pneumoniae TW-183
acccucaaagaauacucuaag

SEQ ID NO: 554573 - RNA, 15 nt, Chlamydophila pneumoniae TW-183
acccucaaagaauac

SEQ ID NO: 554574 - RNA, 22 nt, Chlamydophila pneumoniae TW-183
accaucgucuccaaaaauuccc

SEQ ID NO: 554575 - RNA, 13 nt, Chlamydophila pneumoniae TW-183
accagaagcaacu

SEQ ID NO: 554576 - RNA, 14 nt, Chlamydophila pneumoniae TW-183
accagaauaccuuc

SEQ ID NO: 554577 - RNA, 15 nt, Chlamydophila pneumoniae TW-183
accagaauaccuuca

SEQ ID NO: 554578 - RNA, 14 nt, Chlamydophila pneumoniae TW-183
aguacgcaaaguac

SEQ ID NO: 554579 - RNA, 20 nt, Chlamydophila pneumoniae TW-183
agguuuuuccaacuucaacu

SEQ ID NO: 554580 - RNA, 21 nt, Chlamydophila pneumoniae TW-183
agguuuuuccaacuucaacuu

SEQ ID NO: 554581 - RNA, 13 nt, Chlamydophila pneumoniae TW-183
aguaaaguaugca

SEQ ID NO: 554582 - RNA, 13 nt, Chlamydophila pneumoniae TW-183
agguucaccagaa

SEQ ID NO: 554583 - RNA, 12 nt, Chlamydophila pneumoniae TW-183
agguucacuuca

SEQ ID NO: 554584 - RNA, 22 nt, Chlamydophila pneumoniae TW-183
agguguuuuggcugcuuuuguu

SEQ ID NO: 554585 - RNA, 17 nt, Chlamydophila pneumoniae TW-183
aggucugcugaggagag

SEQ ID NO: 554586 - RNA, 15 nt, Chlamydophila pneumoniae TW-183
agguaaccagagagc

SEQ ID NO: 554587 - RNA, 20 nt, Chlamydophila pneumoniae TW-183
agguauugcaaauuucauuu

SEQ ID NO: 554588 - RNA, 12 nt, Chlamydophila pneumoniae TW-183
aggguuugcaug

SEQ ID NO: 554589 - RNA, 17 nt, Chlamydophila pneumoniae TW-183
agguaaaacuacaggaa

SEQ ID NO: 554590 - RNA, 15 nt, Chlamydophila pneumoniae TW-183
aggguucucaaagau

SEQ ID NO: 554591 - RNA, 18 nt, Chlamydophila pneumoniae TW-183
agggggaucuucagagag

SEQ ID NO: 554592 - RNA, 17 nt, Chlamydophila pneumoniae TW-183
agggggaucuucagaga

SEQ ID NO: 554593 - RNA, 13 nt, Chlamydophila pneumoniae TW-183
agggcauucucua

SEQ ID NO: 554594 - RNA, 15 nt, Chlamydophila pneumoniae TW-183
aggcuguguaaaagu

SEQ ID NO: 554595 - RNA, 21 nt, Chlamydophila pneumoniae TW-183
aggcuguccuugcagcccugc

SEQ ID NO: 554596 - RNA, 13 nt, Chlamydophila pneumoniae TW-183
aggcuccagcaua

SEQ ID NO: 554597 - RNA, 17 nt, Chlamydophila pneumoniae TW-183
aggcucuacagcaacca

SEQ ID NO: 554598 - RNA, 18 nt, Chlamydophila pneumoniae TW-183
aggcucuacagcaaccac

SEQ ID NO: 554599 - RNA, 13 nt, Chlamydophila pneumoniae TW-183
aggcaucacuaau

SEQ ID NO: 554600 - RNA, 17 nt, Chlamydophila pneumoniae TW-183
aggauguuguggaucag

SEQ ID NO: 554601 - RNA, 16 nt, Chlamydophila pneumoniae TW-183
aggaugcuuagcaaag

SEQ ID NO: 554602 - RNA, 16 nt, Chlamydophila pneumoniae TW-183
aggauauauagagcag

SEQ ID NO: 554603 - RNA, 23 nt, Chlamydophila pneumoniae TW-183
aggaguccccuggcguucaggau

SEQ ID NO: 554604 - RNA, 13 nt, Chlamydophila pneumoniae TW-183
aggaguuuuccaa

SEQ ID NO: 554605 - RNA, 18 nt, Chlamydophila pneumoniae TW-183
aggaguuuucaagucugu

SEQ ID NO: 554606 - RNA, 16 nt, Chlamydophila pneumoniae TW-183
aggaccuguaguaaaa

SEQ ID NO: 554607 - RNA, 19 nt, Chlamydophila pneumoniae TW-183
aggaaucccugcacucuuu

SEQ ID NO: 554608 - RNA, 15 nt, Chlamydophila pneumoniae TW-183
aggaaacguucuuuc

SEQ ID NO: 554609 - RNA, 14 nt, Chlamydophila pneumoniae TW-183
aggaaucauaacca

SEQ ID NO: 554610 - RNA, 18 nt, Chlamydophila pneumoniae TW-183
agcuuuuugcuuuucccu

SEQ ID NO: 554611 - RNA, 12 nt, Chlamydophila pneumoniae TW-183
agcuuuuugcuu

SEQ ID NO: 554612 - RNA, 22 nt, Chlamydophila pneumoniae TW-183
agcuuuuuucucuugcuucaga

SEQ ID NO: 554613 - RNA, 13 nt, Chlamydophila pneumoniae TW-183
agcuuuugugaua

SEQ ID NO: 554614 - RNA, 13 nt, Chlamydophila pneumoniae TW-183
agcuucuugaugu

SEQ ID NO: 554615 - RNA, 19 nt, Chlamydophila pneumoniae TW-183
agcuucuuuagauagcucu

SEQ ID NO: 554616 - RNA, 14 nt, Chlamydophila pneumoniae TW-183
agcuugaaauaauu

SEQ ID NO: 554617 - RNA, 13 nt, Chlamydophila pneumoniae TW-183
agcuguuguucug

SEQ ID NO: 554618 - RNA, 22 nt, Chlamydophila pneumoniae TW-183
agcucuuugauuuucuuagcuu

SEQ ID NO: 554619 - RNA, 23 nt, Chlamydophila pneumoniae TW-183
agcucuuugauuuucuuagcuuc

SEQ ID NO: 554620 - RNA, 15 nt, Chlamydophila pneumoniae TW-183
agcugacuccuugua

SEQ ID NO: 554621 - RNA, 17 nt, Chlamydophila pneumoniae TW-183
agcucguaauccuucuu

SEQ ID NO: 554622 - RNA, 13 nt, Chlamydophila pneumoniae TW-183
agcuccuggauau

SEQ ID NO: 554623 - RNA, 15 nt, Chlamydophila pneumoniae TW-183
agcucgaccucuagc

SEQ ID NO: 554624 - RNA, 22 nt, Chlamydophila pneumoniae TW-183
agcucggauggacuacugaaac

SEQ ID NO: 554625 - RNA, 20 nt, Chlamydophila pneumoniae TW-183
auaacuuugcaugaggagac

SEQ ID NO: 554626 - RNA, 17 nt, Chlamydophila pneumoniae TW-183
auaaauuucucaugcau

SEQ ID NO: 554627 - RNA, 19 nt, Chlamydophila pneumoniae TW-183
auaaggauucugagaaguu

SEQ ID NO: 554628 - RNA, 21 nt, Chlamydophila pneumoniae TW-183
auaaggauguuguggaucaga

SEQ ID NO: 554629 - RNA, 18 nt, Chlamydophila pneumoniae TW-183
auaagggggaucuucaga

SEQ ID NO: 554630 - RNA, 15 nt, Chlamydophila pneumoniae TW-183
auaagauagcucuug

SEQ ID NO: 554631 - RNA, 15 nt, Chlamydophila pneumoniae TW-183
auaagauccaaaaau

SEQ ID NO: 554632 - RNA, 14 nt, Chlamydophila pneumoniae TW-183
auaagauuuugaaa

SEQ ID NO: 554633 - RNA, 22 nt, Chlamydophila pneumoniae TW-183
auaaucucaccagaagcaacua

SEQ ID NO: 554634 - RNA, 14 nt, Chlamydophila pneumoniae TW-183
auaaaaaaacccuc

SEQ ID NO: 554635 - RNA, 19 nt, Chlamydophila pneumoniae TW-183
aguuuuuguucauccagaa

SEQ ID NO: 554636 - RNA, 19 nt, Chlamydophila pneumoniae TW-183
aguuuucgauacacaagau

SEQ ID NO: 554637 - RNA, 13 nt, Chlamydophila pneumoniae TW-183
aguugggcauuua

SEQ ID NO: 554638 - RNA, 21 nt, Chlamydophila pneumoniae TW-183
auaaaugcuauuuuccucuau

SEQ ID NO: 554639 - RNA, 16 nt, Chlamydophila pneumoniae TW-183
auaaagaagguugaga

SEQ ID NO: 554640 - RNA, 16 nt, Chlamydophila pneumoniae TW-183
auaaagacaucucuuu

SEQ ID NO: 554641 - RNA, 12 nt, Chlamydophila pneumoniae TW-183
auaaagaggcuc

SEQ ID NO: 554642 - RNA, 21 nt, Chlamydophila pneumoniae TW-183
auaaagaucgggucuacaaca

SEQ ID NO: 554643 - RNA, 20 nt, Chlamydophila pneumoniae TW-183
auaaaggaccuguuuucuuu

SEQ ID NO: 554644 - RNA, 17 nt, Chlamydophila pneumoniae TW-183
aguuggaacauaucgau

SEQ ID NO: 554645 - RNA, 22 nt, Chlamydophila pneumoniae TW-183
aguugaccauauaauacgucuc

SEQ ID NO: 554646 - RNA, 22 nt, Chlamydophila pneumoniae TW-183
aguugagaaccuucacaagaaa

SEQ ID NO: 554647 - RNA, 20 nt, Chlamydophila pneumoniae TW-183
aguugagaaccuucacaaga

SEQ ID NO: 554648 - RNA, 12 nt, Chlamydophila pneumoniae TW-183
aguugaaaugag

SEQ ID NO: 554649 - RNA, 21 nt, Chlamydophila pneumoniae TW-183
aguucuuguaauaaaagaaca

SEQ ID NO: 554650 - RNA, 19 nt, Chlamydophila pneumoniae TW-183
aguucuuguaauaaaagaa

SEQ ID NO: 554651 - RNA, 17 nt, Chlamydophila pneumoniae TW-183
aguucgcggaucuucuu

SEQ ID NO: 554652 - RNA, 16 nt, Chlamydophila pneumoniae TW-183
aguuaaagagcauccu

SEQ ID NO: 554653 - RNA, 13 nt, Chlamydophila pneumoniae TW-183
aguggcgacugca

SEQ ID NO: 554654 - RNA, 15 nt, Chlamydophila pneumoniae TW-183
agugcuuucaggagu

SEQ ID NO: 554655 - RNA, 21 nt, Chlamydophila pneumoniae TW-183
agucuugcgccagcaaagauu

SEQ ID NO: 554656 - RNA, 23 nt, Chlamydophila pneumoniae TW-183
agucuugcgccagcaaagauuaa

SEQ ID NO: 554657 - RNA, 15 nt, Chlamydophila pneumoniae TW-183
agucuugcgccagca

SEQ ID NO: 554658 - RNA, 16 nt, Chlamydophila pneumoniae TW-183
agucucaguugagaac

SEQ ID NO: 554659 - RNA, 13 nt, Chlamydophila pneumoniae TW-183
aguccuucuuuuc

SEQ ID NO: 554660 - RNA, 23 nt, Chlamydophila pneumoniae TW-183
aguccuuuaccaucgucuccaaa

SEQ ID NO: 554661 - RNA, 18 nt, Chlamydophila pneumoniae TW-183
agucauacauuugauuca

SEQ ID NO: 554662 - RNA, 16 nt, Chlamydophila pneumoniae TW-183
aguccagacuuuccuc

SEQ ID NO: 554663 - RNA, 16 nt, Chlamydophila pneumoniae TW-183
agucaccuuacaucca

SEQ ID NO: 554664 - RNA, 21 nt, Chlamydophila pneumoniae TW-183
auagagagcgccuaaacccac

SEQ ID NO: 554665 - RNA, 18 nt, Chlamydophila pneumoniae TW-183
auagagagcgcagagucu

SEQ ID NO: 554666 - RNA, 17 nt, Chlamydophila pneumoniae TW-183
auagagccuagagaguu

SEQ ID NO: 554667 - RNA, 20 nt, Chlamydophila pneumoniae TW-183
auagagccuagagaguucuu

SEQ ID NO: 554668 - RNA, 16 nt, Chlamydophila pneumoniae TW-183
auagcuuugaagagca

SEQ ID NO: 554669 - RNA, 17 nt, Chlamydophila pneumoniae TW-183
auagcuuuggaacgugc

SEQ ID NO: 554670 - RNA, 16 nt, Chlamydophila pneumoniae TW-183
auaggauccaggaguu

SEQ ID NO: 554671 - RNA, 15 nt, Chlamydophila pneumoniae TW-183
auaggauccaggagu

SEQ ID NO: 554672 - RNA, 20 nt, Chlamydophila pneumoniae TW-183
auauccguauggauuucucc

SEQ ID NO: 554673 - RNA, 22 nt, Chlamydophila pneumoniae TW-183
auauagguuuagauugccuuug

SEQ ID NO: 554674 - RNA, 15 nt, Chlamydophila pneumoniae TW-183
auacuacucucauca

SEQ ID NO: 554675 - RNA, 16 nt, Chlamydophila pneumoniae TW-183
auaccguuuuaggaag

SEQ ID NO: 554676 - RNA, 18 nt, Chlamydophila pneumoniae TW-183
auacuguuaacaaguacc

SEQ ID NO: 554677 - RNA, 22 nt, Chlamydophila pneumoniae TW-183
auagaaauucuguagauacuau

SEQ ID NO: 554678 - RNA, 14 nt, Chlamydophila pneumoniae TW-183
auagaaauucugua

SEQ ID NO: 554679 - RNA, 16 nt, Chlamydophila pneumoniae TW-183
auagaaauucuguaga

SEQ ID NO: 554680 - RNA, 14 nt, Chlamydophila pneumoniae TW-183
auagaaaugagaga

SEQ ID NO: 554681 - RNA, 14 nt, Chlamydophila pneumoniae TW-183
auagaauagaaugu

SEQ ID NO: 554682 - RNA, 17 nt, Chlamydophila pneumoniae TW-183
auagaauacacagcuau

SEQ ID NO: 554683 - RNA, 17 nt, Chlamydophila pneumoniae TW-183
auaccagaagcaaaggu

SEQ ID NO: 554684 - RNA, 14 nt, Chlamydophila pneumoniae TW-183
auaccagaagcaaa

SEQ ID NO: 554685 - RNA, 16 nt, Chlamydophila pneumoniae TW-183
auacaguacgcaaagu

SEQ ID NO: 554686 - RNA, 15 nt, Chlamydophila pneumoniae TW-183
aucacuaucauggac

SEQ ID NO: 554687 - RNA, 16 nt, Chlamydophila pneumoniae TW-183
aucaguaaaagacuga

SEQ ID NO: 554688 - RNA, 22 nt, Chlamydophila pneumoniae TW-183
aaaacggcuguacuuccccaaa

SEQ ID NO: 554689 - RNA, 18 nt, Chlamydophila pneumoniae TW-183
aucacuuauauuuucuau

SEQ ID NO: 554690 - RNA, 16 nt, Chlamydophila pneumoniae TW-183
aucaaauagauuuuua

SEQ ID NO: 554691 - RNA, 22 nt, Chlamydophila pneumoniae TW-183
aucaacauucuucugucuguau

SEQ ID NO: 554692 - RNA, 16 nt, Chlamydophila pneumoniae TW-183
aucaacuacaucucca

SEQ ID NO: 554693 - RNA, 22 nt, Chlamydophila pneumoniae TW-183
auauggguguaaauuuuuccuu

SEQ ID NO: 554694 - RNA, 23 nt, Chlamydophila pneumoniae TW-183
augaagagaguucucucuucacu

SEQ ID NO: 554695 - RNA, 14 nt, Chlamydophila pneumoniae TW-183
augaauaccagaag

SEQ ID NO: 554696 - RNA, 20 nt, Chlamydophila pneumoniae TW-183
augaauaccagaagcaaagg

SEQ ID NO: 554697 - RNA, 17 nt, Chlamydophila pneumoniae TW-183
aucuuuuuaauaaaggg

SEQ ID NO: 554698 - RNA, 11 nt, Chlamydophila pneumoniae TW-183
aucuuguugua

SEQ ID NO: 554699 - RNA, 22 nt, Chlamydophila pneumoniae TW-183
aucuucuucuggcugagagaag

SEQ ID NO: 554700 - RNA, 23 nt, Chlamydophila pneumoniae TW-183
aucuucuucuggcugagagaagc

SEQ ID NO: 554701 - RNA, 16 nt, Chlamydophila pneumoniae TW-183
aucuugagaaaagaac

SEQ ID NO: 554702 - RNA, 13 nt, Chlamydophila pneumoniae TW-183
aucucaaaaucaa

SEQ ID NO: 554703 - RNA, 12 nt, Chlamydophila pneumoniae TW-183
aucuauuuagaa

SEQ ID NO: 554704 - RNA, 20 nt, Chlamydophila pneumoniae TW-183
aucuccccauucacaaaucu

SEQ ID NO: 554705 - RNA, 13 nt, Chlamydophila pneumoniae TW-183
aucucuccagcuu

SEQ ID NO: 554706 - RNA, 15 nt, Chlamydophila pneumoniae TW-183
aucucgggagaacau

SEQ ID NO: 554707 - RNA, 17 nt, Chlamydophila pneumoniae TW-183
aucuaaauaagauuuua

SEQ ID NO: 554708 - RNA, 15 nt, Chlamydophila pneumoniae TW-183
aucguccucaccgau

SEQ ID NO: 554709 - RNA, 18 nt, Chlamydophila pneumoniae TW-183
aucgccuuccuuaacaac

SEQ ID NO: 554710 - RNA, 23 nt, Chlamydophila pneumoniae TW-183
aucgaucucugugguuccuggau

SEQ ID NO: 554711 - RNA, 17 nt, Chlamydophila pneumoniae TW-183
aucgauuaccuaaaaca

SEQ ID NO: 554712 - RNA, 22 nt, Chlamydophila pneumoniae TW-183
auccuccuagguucuuuuuuug

SEQ ID NO: 554713 - RNA, 22 nt, Chlamydophila pneumoniae TW-183
auccguagugagguuugcaauu

SEQ ID NO: 554714 - RNA, 15 nt, Chlamydophila pneumoniae TW-183
auccauaagaucucu

SEQ ID NO: 554715 - RNA, 20 nt, Chlamydophila pneumoniae TW-183
auccacagaucguaaucugu

SEQ ID NO: 554716 - RNA, 21 nt, Chlamydophila pneumoniae TW-183
aaaagaacauuaagaggaaag

SEQ ID NO: 554717 - RNA, 20 nt, Chlamydophila pneumoniae TW-183
aucauggacaagcaaaagca

SEQ ID NO: 554718 - RNA, 21 nt, Chlamydophila pneumoniae TW-183
aucaucuacgauguuuucuua

SEQ ID NO: 554719 - RNA, 19 nt, Chlamydophila pneumoniae TW-183
caaaauucaugcaaaacaa

SEQ ID NO: 554720 - RNA, 18 nt, Chlamydophila pneumoniae TW-183
caaaagucaugaggacug

SEQ ID NO: 554721 - RNA, 16 nt, Chlamydophila pneumoniae TW-183
caaaagucaugaggac

SEQ ID NO: 554722 - RNA, 21 nt, Chlamydophila pneumoniae TW-183
caaaagguuuuauaaagaucg

SEQ ID NO: 554723 - RNA, 20 nt, Chlamydophila pneumoniae TW-183
caaaaguaaucacuucagca

SEQ ID NO: 554724 - RNA, 18 nt, Chlamydophila pneumoniae TW-183
caaaagcucuacaagcuc

SEQ ID NO: 554725 - RNA, 12 nt, Chlamydophila pneumoniae TW-183
caaaggcaacaa

SEQ ID NO: 554726 - RNA, 19 nt, Chlamydophila pneumoniae TW-183
caaaggagcgggauaggca

SEQ ID NO: 554727 - RNA, 13 nt, Chlamydophila pneumoniae TW-183
caaagauccuaau

SEQ ID NO: 554728 - RNA, 20 nt, Chlamydophila pneumoniae TW-183
caaaccacggauuuucucua

SEQ ID NO: 554729 - RNA, 15 nt, Chlamydophila pneumoniae TW-183
caaaccacggauuuu

SEQ ID NO: 554730 - RNA, 21 nt, Chlamydophila pneumoniae TW-183
caacaaaggcuccaaacgcaa

SEQ ID NO: 554731 - RNA, 16 nt, Chlamydophila pneumoniae TW-183
caaccaguugagucaa

SEQ ID NO: 554732 - RNA, 19 nt, Chlamydophila pneumoniae TW-183
caaaucuuccccuaaaaau

SEQ ID NO: 554733 - RNA, 19 nt, Chlamydophila pneumoniae TW-183
caaauuucauuuagacaau

SEQ ID NO: 554734 - RNA, 21 nt, Chlamydophila pneumoniae TW-183
caagaccacuuaggguucuca

SEQ ID NO: 554735 - RNA, 20 nt, Chlamydophila pneumoniae TW-183
caagauacuacuuacaagaa

SEQ ID NO: 554736 - RNA, 21 nt, Chlamydophila pneumoniae TW-183
caagaauagcaggaaggaaua

SEQ ID NO: 554737 - RNA, 17 nt, Chlamydophila pneumoniae TW-183
caaucuauuuagaaacu

SEQ ID NO: 554738 - RNA, 13 nt, Chlamydophila pneumoniae TW-183
caaucugcugaag

SEQ ID NO: 554739 - RNA, 18 nt, Chlamydophila pneumoniae TW-183
caaucaacauucuucugu

SEQ ID NO: 554740 - RNA, 13 nt, Chlamydophila pneumoniae TW-183
caaucaauaaaau

SEQ ID NO: 554741 - RNA, 15 nt, Chlamydophila pneumoniae TW-183
caaucacacuacauu

SEQ ID NO: 554742 - RNA, 12 nt, Chlamydophila pneumoniae TW-183
caagucuguaag

SEQ ID NO: 554743 - RNA, 16 nt, Chlamydophila pneumoniae TW-183
caagcuuagcaaccca

SEQ ID NO: 554744 - RNA, 12 nt, Chlamydophila pneumoniae TW-183
caauaaagauag

SEQ ID NO: 554745 - RNA, 17 nt, Chlamydophila pneumoniae TW-183
caauacagcauaaaaau

SEQ ID NO: 554746 - RNA, 20 nt, Chlamydophila pneumoniae TW-183
cacgcccugaugcuguaucu

SEQ ID NO: 554747 - RNA, 14 nt, Chlamydophila pneumoniae TW-183
caccuuacauccaa

SEQ ID NO: 554748 - RNA, 20 nt, Chlamydophila pneumoniae TW-183
caccuuagagugacucauca

SEQ ID NO: 554749 - RNA, 15 nt, Chlamydophila pneumoniae TW-183
caccuuacauccaau

SEQ ID NO: 554750 - RNA, 20 nt, Chlamydophila pneumoniae TW-183
caccuuaauggcuccuacuc

SEQ ID NO: 554751 - RNA, 14 nt, Chlamydophila pneumoniae TW-183
aaaauaaauuuuau

SEQ ID NO: 554752 - RNA, 18 nt, Chlamydophila pneumoniae TW-183
caccuaaaguuugagcua

SEQ ID NO: 554753 - RNA, 20 nt, Chlamydophila pneumoniae TW-183
cacauacaguacgcaaagua

SEQ ID NO: 554754 - RNA, 17 nt, Chlamydophila pneumoniae TW-183
cacagcuaaucaaucca

SEQ ID NO: 554755 - RNA, 18 nt, Chlamydophila pneumoniae TW-183
cacagcuaaucaauccaa

SEQ ID NO: 554756 - RNA, 17 nt, Chlamydophila pneumoniae TW-183
cacagcuaugauugaaa

SEQ ID NO: 554757 - RNA, 15 nt, Chlamydophila pneumoniae TW-183
cacagauaggaacca

SEQ ID NO: 554758 - RNA, 23 nt, Chlamydophila pneumoniae TW-183
cacagaucguaaucuguauaugc

SEQ ID NO: 554759 - RNA, 13 nt, Chlamydophila pneumoniae TW-183
cacagcauuuucu

SEQ ID NO: 554760 - RNA, 15 nt, Chlamydophila pneumoniae TW-183
cacagcauuuucucu

SEQ ID NO: 554761 - RNA, 16 nt, Chlamydophila pneumoniae TW-183
cacaaucuaaauaaga

SEQ ID NO: 554762 - RNA, 17 nt, Chlamydophila pneumoniae TW-183
caauuccccuucaucaa

SEQ ID NO: 554763 - RNA, 23 nt, Chlamydophila pneumoniae TW-183
caauuccccuucaucaauaaaga

SEQ ID NO: 554764 - RNA, 17 nt, Chlamydophila pneumoniae TW-183
auuuuuccuucaacaca

SEQ ID NO: 554765 - RNA, 15 nt, Chlamydophila pneumoniae TW-183
auuuuugaauaugau

SEQ ID NO: 554766 - RNA, 21 nt, Chlamydophila pneumoniae TW-183
auuuuacuugcgauacaauaa

SEQ ID NO: 554767 - RNA, 22 nt, Chlamydophila pneumoniae TW-183
auuuuacuugcgauacaauaaa

SEQ ID NO: 554768 - RNA, 11 nt, Chlamydophila pneumoniae TW-183
auuucuucuuc

SEQ ID NO: 554769 - RNA, 16 nt, Chlamydophila pneumoniae TW-183
auuugaacaugaggau

SEQ ID NO: 554770 - RNA, 13 nt, Chlamydophila pneumoniae TW-183
auuugaacaugag

SEQ ID NO: 554771 - RNA, 17 nt, Chlamydophila pneumoniae TW-183
aaaagucaugaggacug

SEQ ID NO: 554772 - RNA, 14 nt, Chlamydophila pneumoniae TW-183
auuguuaucaggaa

SEQ ID NO: 554773 - RNA, 22 nt, Chlamydophila pneumoniae TW-183
auuguaauuucuaaauagaaaa

SEQ ID NO: 554774 - RNA, 13 nt, Chlamydophila pneumoniae TW-183
auuguagagauua

SEQ ID NO: 554775 - RNA, 16 nt, Chlamydophila pneumoniae TW-183
auugggagguucgcag

SEQ ID NO: 554776 - RNA, 17 nt, Chlamydophila pneumoniae TW-183
auugcggaaauugaaua

SEQ ID NO: 554777 - RNA, 20 nt, Chlamydophila pneumoniae TW-183
auugcagauauacuuuuuca

SEQ ID NO: 554778 - RNA, 14 nt, Chlamydophila pneumoniae TW-183
auugcaaaauuuaa

SEQ ID NO: 554779 - RNA, 19 nt, Chlamydophila pneumoniae TW-183
auugaaaccguaacugagg

SEQ ID NO: 554780 - RNA, 17 nt, Chlamydophila pneumoniae TW-183
auugaugcuuaagaguu

SEQ ID NO: 554781 - RNA, 15 nt, Chlamydophila pneumoniae TW-183
auugauguuccuuga

SEQ ID NO: 554782 - RNA, 19 nt, Chlamydophila pneumoniae TW-183
auugcaaaaaugaaagaaa

SEQ ID NO: 554783 - RNA, 12 nt, Chlamydophila pneumoniae TW-183
auucuucugucu

SEQ ID NO: 554784 - RNA, 22 nt, Chlamydophila pneumoniae TW-183
auucuucauuguagaggucacu

SEQ ID NO: 554785 - RNA, 15 nt, Chlamydophila pneumoniae TW-183
auucucuaaaugauu

SEQ ID NO: 554786 - RNA, 18 nt, Chlamydophila pneumoniae TW-183
auucugagaaagaagucc

SEQ ID NO: 554787 - RNA, 18 nt, Chlamydophila pneumoniae TW-183
auucuaagcgcucuucaa

SEQ ID NO: 554788 - RNA, 15 nt, Chlamydophila pneumoniae TW-183
auuccccuucaucaa

SEQ ID NO: 554789 - RNA, 13 nt, Chlamydophila pneumoniae TW-183
auucaugcaaaac

SEQ ID NO: 554790 - RNA, 18 nt, Chlamydophila pneumoniae TW-183
aaaagcuuuuuucucuug

SEQ ID NO: 554791 - RNA, 14 nt, Chlamydophila pneumoniae TW-183
auuaagaauggaug

SEQ ID NO: 554792 - RNA, 15 nt, Chlamydophila pneumoniae TW-183
auuaagaauggaugu

SEQ ID NO: 554793 - RNA, 12 nt, Chlamydophila pneumoniae TW-183
auuaagaggagu

SEQ ID NO: 554794 - RNA, 18 nt, Chlamydophila pneumoniae TW-183
auuaacuuuauacagcug

SEQ ID NO: 554795 - RNA, 19 nt, Chlamydophila pneumoniae TW-183
auuaaaucguacuucacuu

SEQ ID NO: 554796 - RNA, 22 nt, Chlamydophila pneumoniae TW-183
auuaaaucguacuucacuucug

SEQ ID NO: 554797 - RNA, 20 nt, Chlamydophila pneumoniae TW-183
auguuuguaguguugaauaa

SEQ ID NO: 554798 - RNA, 21 nt, Chlamydophila pneumoniae TW-183
auguuaagcguauagaauaga

SEQ ID NO: 554799 - RNA, 20 nt, Chlamydophila pneumoniae TW-183
augucucuuaaaaaaaauua

SEQ ID NO: 554800 - RNA, 17 nt, Chlamydophila pneumoniae TW-183
augucgcuaccauaucu

SEQ ID NO: 554801 - RNA, 12 nt, Chlamydophila pneumoniae TW-183
auuauuaaacuc

SEQ ID NO: 554802 - RNA, 13 nt, Chlamydophila pneumoniae TW-183
auguacaaugaua

SEQ ID NO: 554803 - RNA, 22 nt, Chlamydophila pneumoniae TW-183
augguguucuucagcccacugu

SEQ ID NO: 554804 - RNA, 16 nt, Chlamydophila pneumoniae TW-183
auggcucaacuuaagu

SEQ ID NO: 554805 - RNA, 15 nt, Chlamydophila pneumoniae TW-183
auggcacuugagcac

SEQ ID NO: 554806 - RNA, 18 nt, Chlamydophila pneumoniae TW-183
auggagaaggacacuaga

SEQ ID NO: 554807 - RNA, 14 nt, Chlamydophila pneumoniae TW-183
auggaaagaaacaa

SEQ ID NO: 554808 - RNA, 17 nt, Chlamydophila pneumoniae TW-183
auggaauggcuuuuguu

SEQ ID NO: 554809 - RNA, 17 nt, Chlamydophila pneumoniae TW-183
augcuuagcaaaggcaa

SEQ ID NO: 554810 - RNA, 15 nt, Chlamydophila pneumoniae TW-183
augcuuggcaauagc

SEQ ID NO: 554811 - RNA, 15 nt, Chlamydophila pneumoniae TW-183
augccucaggucugc

SEQ ID NO: 554812 - RNA, 19 nt, Chlamydophila pneumoniae TW-183
augccucaggucugcugag

SEQ ID NO: 554813 - RNA, 23 nt, Chlamydophila pneumoniae TW-183
augccucaggucugcugaggaga

SEQ ID NO: 554814 - RNA, 14 nt, Chlamydophila pneumoniae TW-183
augcaagugcuuuc

SEQ ID NO: 554815 - RNA, 17 nt, Chlamydophila pneumoniae TW-183
aaaauucaugcaaaaca

SEQ ID NO: 554816 - RNA, 22 nt, Chlamydophila pneumoniae TW-183
cagcgugaauaucaucacuaag

SEQ ID NO: 554817 - RNA, 19 nt, Chlamydophila pneumoniae TW-183
cagcgguugccuuucucuu

SEQ ID NO: 554818 - RNA, 14 nt, Chlamydophila pneumoniae TW-183
aaaauuauuaaacu

SEQ ID NO: 554819 - RNA, 12 nt, Chlamydophila pneumoniae TW-183
cagcggcacccu

SEQ ID NO: 554820 - RNA, 12 nt, Chlamydophila pneumoniae TW-183
cagcccacuguu

SEQ ID NO: 554821 - RNA, 20 nt, Chlamydophila pneumoniae TW-183
cagccuugauugaacagucu

SEQ ID NO: 554822 - RNA, 13 nt, Chlamydophila pneumoniae TW-183
cagccugucuaua

SEQ ID NO: 554823 - RNA, 17 nt, Chlamydophila pneumoniae TW-183
cagcgaggaguuuucca

SEQ ID NO: 554824 - RNA, 22 nt, Chlamydophila pneumoniae TW-183
caggguuucucggauccuccaa

SEQ ID NO: 554825 - RNA, 23 nt, Chlamydophila pneumoniae TW-183
caggggaugugauguucugcugc

SEQ ID NO: 554826 - RNA, 17 nt, Chlamydophila pneumoniae TW-183
caggaguuuuccuaaau

SEQ ID NO: 554827 - RNA, 18 nt, Chlamydophila pneumoniae TW-183
caggaaacguucuuucaa

SEQ ID NO: 554828 - RNA, 16 nt, Chlamydophila pneumoniae TW-183
caggaacuaaaaguuu

SEQ ID NO: 554829 - RNA, 18 nt, Chlamydophila pneumoniae TW-183
cagcuucgcaaucuuuga

SEQ ID NO: 554830 - RNA, 15 nt, Chlamydophila pneumoniae TW-183
cagcuucgcaaucuu

SEQ ID NO: 554831 - RNA, 21 nt, Chlamydophila pneumoniae TW-183
aaaauugaacguagcuacaaa

SEQ ID NO: 554832 - RNA, 18 nt, Chlamydophila pneumoniae TW-183
cagcacgaauaaagcccu

SEQ ID NO: 554833 - RNA, 16 nt, Chlamydophila pneumoniae TW-183
cagagaugcuucuaaa

SEQ ID NO: 554834 - RNA, 17 nt, Chlamydophila pneumoniae TW-183
cagagaugcuaacaacu

SEQ ID NO: 554835 - RNA, 20 nt, Chlamydophila pneumoniae TW-183
cagaggucgauuugaacaug

SEQ ID NO: 554836 - RNA, 19 nt, Chlamydophila pneumoniae TW-183
cagaccucucccuugggau

SEQ ID NO: 554837 - RNA, 21 nt, Chlamydophila pneumoniae TW-183
cagaauaccuucaacaagaau

SEQ ID NO: 554838 - RNA, 14 nt, Chlamydophila pneumoniae TW-183
cagaaguuccuacu

SEQ ID NO: 554839 - RNA, 18 nt, Chlamydophila pneumoniae TW-183
cagaaguuccuacuucug

SEQ ID NO: 554840 - RNA, 15 nt, Chlamydophila pneumoniae TW-183
cagaaggcuuguuuc

SEQ ID NO: 554841 - RNA, 16 nt, Chlamydophila pneumoniae TW-183
cagaaggcuuguuucu

SEQ ID NO: 554842 - RNA, 16 nt, Chlamydophila pneumoniae TW-183
cagaaacuccaaaaua

SEQ ID NO: 554843 - RNA, 15 nt, Chlamydophila pneumoniae TW-183
aaaauauucuuucaa

SEQ ID NO: 554844 - RNA, 14 nt, Chlamydophila pneumoniae TW-183
cacuucagcacgaa

SEQ ID NO: 554845 - RNA, 15 nt, Chlamydophila pneumoniae TW-183
cacuguuuugcuucu

SEQ ID NO: 554846 - RNA, 18 nt, Chlamydophila pneumoniae TW-183
cacuuaaagguaaaacua

SEQ ID NO: 554847 - RNA, 17 nt, Chlamydophila pneumoniae TW-183
cacuuacagauaaggaa

SEQ ID NO: 554848 - RNA, 16 nt, Chlamydophila pneumoniae TW-183
cacuuaggguucucaa

SEQ ID NO: 554849 - RNA, 16 nt, Chlamydophila pneumoniae TW-183
cacuguaaaaaagaaa

SEQ ID NO: 554850 - RNA, 20 nt, Chlamydophila pneumoniae TW-183
cacuccuggagcuguuucug

SEQ ID NO: 554851 - RNA, 17 nt, Chlamydophila pneumoniae TW-183
cacucuuucagaaagaa

SEQ ID NO: 554852 - RNA, 23 nt, Chlamydophila pneumoniae TW-183
cacuaaucucaggcauucuucau

SEQ ID NO: 554853 - RNA, 23 nt, Chlamydophila pneumoniae TW-183
caucuuaucaagagcucguaauc

SEQ ID NO: 554854 - RNA, 17 nt, Chlamydophila pneumoniae TW-183
caucuacgauguuuucu

SEQ ID NO: 554855 - RNA, 21 nt, Chlamydophila pneumoniae TW-183
caucuacgauguuuucuuauc

SEQ ID NO: 554856 - RNA, 15 nt, Chlamydophila pneumoniae TW-183
cauccgaagacucaa

SEQ ID NO: 554857 - RNA, 14 nt, Chlamydophila pneumoniae TW-183
cauccugaucuucu

SEQ ID NO: 554858 - RNA, 20 nt, Chlamydophila pneumoniae TW-183
caucaguggcgacugcaaca

SEQ ID NO: 554859 - RNA, 13 nt, Chlamydophila pneumoniae TW-183
caucaguaaaaga

SEQ ID NO: 554860 - RNA, 23 nt, Chlamydophila pneumoniae TW-183
caucaaugauaucgccuuccuua

SEQ ID NO: 554861 - RNA, 18 nt, Chlamydophila pneumoniae TW-183
caucagaagccaccaaaa

SEQ ID NO: 554862 - RNA, 21 nt, Chlamydophila pneumoniae TW-183
caucaaccgaagauccuagag

SEQ ID NO: 554863 - RNA, 21 nt, Chlamydophila pneumoniae TW-183
cauauuacgcacuguaaaaaa

SEQ ID NO: 554864 - RNA, 16 nt, Chlamydophila pneumoniae TW-183
cauauaauacgucuca

SEQ ID NO: 554865 - RNA, 23 nt, Chlamydophila pneumoniae TW-183
cauacgccgugccuauagaaauu

SEQ ID NO: 554866 - RNA, 21 nt, Chlamydophila pneumoniae TW-183
cauacgccgugccuauagaaa

SEQ ID NO: 554867 - RNA, 15 nt, Chlamydophila pneumoniae TW-183
cauaaguauagagag

SEQ ID NO: 554868 - RNA, 15 nt, Chlamydophila pneumoniae TW-183
cauaaucucaccaga

SEQ ID NO: 554869 - RNA, 16 nt, Chlamydophila pneumoniae TW-183
cauaaaaauucucaua

SEQ ID NO: 554870 - RNA, 15 nt, Chlamydophila pneumoniae TW-183
cauaaaaauucucau

SEQ ID NO: 554871 - RNA, 20 nt, Chlamydophila pneumoniae TW-183
cauaaccuuugacaacacca

SEQ ID NO: 554872 - RNA, 14 nt, Chlamydophila pneumoniae TW-183
cauaaaaaaagcua

SEQ ID NO: 554873 - RNA, 22 nt, Chlamydophila pneumoniae TW-183
cagugcuguuuuuucacuuaca

SEQ ID NO: 554874 - RNA, 22 nt, Chlamydophila pneumoniae TW-183
ccacuaaguuuaggcaggaagu

SEQ ID NO: 554875 - RNA, 22 nt, Chlamydophila pneumoniae TW-183
ccacgaguucgcggaucuucuu

SEQ ID NO: 554876 - RNA, 12 nt, Chlamydophila pneumoniae TW-183
ccaaucugcuga

SEQ ID NO: 554877 - RNA, 20 nt, Chlamydophila pneumoniae TW-183
ccaauauccagaaauacguc

SEQ ID NO: 554878 - RNA, 14 nt, Chlamydophila pneumoniae TW-183
ccaaucgauaacgu

SEQ ID NO: 554879 - RNA, 13 nt, Chlamydophila pneumoniae TW-183
ccaauacagcaua

SEQ ID NO: 554880 - RNA, 20 nt, Chlamydophila pneumoniae TW-183
ccaagcuuugcgcuuguucu

SEQ ID NO: 554881 - RNA, 14 nt, Chlamydophila pneumoniae TW-183
ccaaagcuucuuuc

SEQ ID NO: 554882 - RNA, 17 nt, Chlamydophila pneumoniae TW-183
cauuuagacaaucuacg

SEQ ID NO: 554883 - RNA, 17 nt, Chlamydophila pneumoniae TW-183
cauuugauucauaaaga

SEQ ID NO: 554884 - RNA, 13 nt, Chlamydophila pneumoniae TW-183
cauuguuuaaguc

SEQ ID NO: 554885 - RNA, 22 nt, Chlamydophila pneumoniae TW-183
cauugcagauauacuuuuucag

SEQ ID NO: 554886 - RNA, 20 nt, Chlamydophila pneumoniae TW-183
cauguuaagcguauagaaua

SEQ ID NO: 554887 - RNA, 12 nt, Chlamydophila pneumoniae TW-183
cauuaaggugug

SEQ ID NO: 554888 - RNA, 16 nt, Chlamydophila pneumoniae TW-183
caugucucuuaaaaaa

SEQ ID NO: 554889 - RNA, 17 nt, Chlamydophila pneumoniae TW-183
caugucucuuaaaaaaa

SEQ ID NO: 554890 - RNA, 22 nt, Chlamydophila pneumoniae TW-183
caugucucuuaaaaaaaauuac

SEQ ID NO: 554891 - RNA, 20 nt, Chlamydophila pneumoniae TW-183
cauguacaaugauaucagca

SEQ ID NO: 554892 - RNA, 21 nt, Chlamydophila pneumoniae TW-183
cauguacaaugauaucagcau

SEQ ID NO: 554893 - RNA, 21 nt, Chlamydophila pneumoniae TW-183
cauguccuccauggaaagaaa

SEQ ID NO: 554894 - RNA, 17 nt, Chlamydophila pneumoniae TW-183
cauggauauggaauggc

SEQ ID NO: 554895 - RNA, 15 nt, Chlamydophila pneumoniae TW-183
cauggacuccaagaa

SEQ ID NO: 554896 - RNA, 22 nt, Chlamydophila pneumoniae TW-183
cauggaagugcggcucucuuca

SEQ ID NO: 554897 - RNA, 15 nt, Chlamydophila pneumoniae TW-183
cgaacagcuccugga

SEQ ID NO: 554898 - RNA, 18 nt, Chlamydophila pneumoniae TW-183
cgaaacucuuugaggaua

SEQ ID NO: 554899 - RNA, 19 nt, Chlamydophila pneumoniae TW-183
ccuuuuucauugaugcuua

SEQ ID NO: 554900 - RNA, 23 nt, Chlamydophila pneumoniae TW-183
ccuugggauuccuuaaugguagc

SEQ ID NO: 554901 - RNA, 15 nt, Chlamydophila pneumoniae TW-183
ccuuaguuuuuucua

SEQ ID NO: 554902 - RNA, 15 nt, Chlamydophila pneumoniae TW-183
ccuuaacaacaucac

SEQ ID NO: 554903 - RNA, 20 nt, Chlamydophila pneumoniae TW-183
ccuuacggccccuggaauuu

SEQ ID NO: 554904 - RNA, 19 nt, Chlamydophila pneumoniae TW-183
ccuuaaagagaaucuccuc

SEQ ID NO: 554905 - RNA, 21 nt, Chlamydophila pneumoniae TW-183
ccugugugguuggauccaucg

SEQ ID NO: 554906 - RNA, 22 nt, Chlamydophila pneumoniae TW-183
ccuguaguuucuaaaacagaaa

SEQ ID NO: 554907 - RNA, 19 nt, Chlamydophila pneumoniae TW-183
ccuguaguaaaauaagaaa

SEQ ID NO: 554908 - RNA, 14 nt, Chlamydophila pneumoniae TW-183
ccugaucuucuuga

SEQ ID NO: 554909 - RNA, 15 nt, Chlamydophila pneumoniae TW-183
ccugauguugcccua

SEQ ID NO: 554910 - RNA, 23 nt, Chlamydophila pneumoniae TW-183
ccugaguacuuugugauuacagc

SEQ ID NO: 554911 - RNA, 16 nt, Chlamydophila pneumoniae TW-183
ccugaaaaaagaagcu

SEQ ID NO: 554912 - RNA, 17 nt, Chlamydophila pneumoniae TW-183
ccugaaaaaagaagcuu

SEQ ID NO: 554913 - RNA, 20 nt, Chlamydophila pneumoniae TW-183
ccucugggaagacucucauc

SEQ ID NO: 554914 - RNA, 22 nt, Chlamydophila pneumoniae TW-183
ccucugggaagacucucaucag

SEQ ID NO: 554915 - RNA, 18 nt, Chlamydophila pneumoniae TW-183
ccucuguagguuuuucca

SEQ ID NO: 554916 - RNA, 18 nt, Chlamydophila pneumoniae TW-183
ccucucacauuugcagac

SEQ ID NO: 554917 - RNA, 17 nt, Chlamydophila pneumoniae TW-183
ccucuagaagacacagg

SEQ ID NO: 554918 - RNA, 18 nt, Chlamydophila pneumoniae TW-183
ccucuaaggacaaaucuc

SEQ ID NO: 554919 - RNA, 22 nt, Chlamydophila pneumoniae TW-183
ccucuaaggacaaaucucccaa

SEQ ID NO: 554920 - RNA, 16 nt, Chlamydophila pneumoniae TW-183
ccucgucaccugagcu

SEQ ID NO: 554921 - RNA, 12 nt, Chlamydophila pneumoniae TW-183
ccuccucuucuu

SEQ ID NO: 554922 - RNA, 16 nt, Chlamydophila pneumoniae TW-183
ccuccucuucuucauc

SEQ ID NO: 554923 - RNA, 21 nt, Chlamydophila pneumoniae TW-183
aaacgcccucuagaagacaca

SEQ ID NO: 554924 - RNA, 15 nt, Chlamydophila pneumoniae TW-183
ccgugacuccagaag

SEQ ID NO: 554925 - RNA, 17 nt, Chlamydophila pneumoniae TW-183
aaaccuucaaugauuuc

SEQ ID NO: 554926 - RNA, 21 nt, Chlamydophila pneumoniae TW-183
ccguaggguagccauccacga

SEQ ID NO: 554927 - RNA, 14 nt, Chlamydophila pneumoniae TW-183
ccguaacugaggca

SEQ ID NO: 554928 - RNA, 20 nt, Chlamydophila pneumoniae TW-183
ccguacgaguaucuacuuug

SEQ ID NO: 554929 - RNA, 16 nt, Chlamydophila pneumoniae TW-183
aaaccguaacugaggc

SEQ ID NO: 554930 - RNA, 20 nt, Chlamydophila pneumoniae TW-183
ccgccuugacggguugugaa

SEQ ID NO: 554931 - RNA, 14 nt, Chlamydophila pneumoniae TW-183
ccgccuuucuaccc

SEQ ID NO: 554932 - RNA, 22 nt, Chlamydophila pneumoniae TW-183
ccgaguccuaugucaagaagug

SEQ ID NO: 554933 - RNA, 13 nt, Chlamydophila pneumoniae TW-183
ccgagacuucucu

SEQ ID NO: 554934 - RNA, 22 nt, Chlamydophila pneumoniae TW-183
ccgacaagcuucguccugacac

SEQ ID NO: 554935 - RNA, 16 nt, Chlamydophila pneumoniae TW-183
aaaccaauugagcucu

SEQ ID NO: 554936 - RNA, 14 nt, Chlamydophila pneumoniae TW-183
aaacagaaauugcu

SEQ ID NO: 554937 - RNA, 16 nt, Chlamydophila pneumoniae TW-183
cccuugggauuccuua

SEQ ID NO: 554938 - RNA, 12 nt, Chlamydophila pneumoniae TW-183
cccuucuaauac

SEQ ID NO: 554939 - RNA, 20 nt, Chlamydophila pneumoniae TW-183
aaacacgcccugaugcugua

SEQ ID NO: 554940 - RNA, 21 nt, Chlamydophila pneumoniae TW-183
aaacaccuucuucuaaaaucu

SEQ ID NO: 554941 - RNA, 21 nt, Chlamydophila pneumoniae TW-183
ccccuggcguucaggauuuag

SEQ ID NO: 554942 - RNA, 14 nt, Chlamydophila pneumoniae TW-183
ccccacgcuaaacu

SEQ ID NO: 554943 - RNA, 19 nt, Chlamydophila pneumoniae TW-183
ccccacgcuaaacuaaaau

SEQ ID NO: 554944 - RNA, 20 nt, Chlamydophila pneumoniae TW-183
cccacggcaaguuguggcau

SEQ ID NO: 554945 - RNA, 14 nt, Chlamydophila pneumoniae TW-183
cccacuagcccuug

SEQ ID NO: 554946 - RNA, 18 nt, Chlamydophila pneumoniae TW-183
ccauucacaaaucuuccc

SEQ ID NO: 554947 - RNA, 14 nt, Chlamydophila pneumoniae TW-183
ccauucacaaaucu

SEQ ID NO: 554948 - RNA, 19 nt, Chlamydophila pneumoniae TW-183
ccauuucauguaagaaugu

SEQ ID NO: 554949 - RNA, 18 nt, Chlamydophila pneumoniae TW-183
ccauuucauguaagaaug

SEQ ID NO: 554950 - RNA, 13 nt, Chlamydophila pneumoniae TW-183
ccauuucauguaa

SEQ ID NO: 554951 - RNA, 19 nt, Chlamydophila pneumoniae TW-183
cccaaacugaugccaagaa

SEQ ID NO: 554952 - RNA, 19 nt, Chlamydophila pneumoniae TW-183
ccaugaucuuagcuccugu

SEQ ID NO: 554953 - RNA, 20 nt, Chlamydophila pneumoniae TW-183
ccaucucaugcggacuuuau

SEQ ID NO: 554954 - RNA, 16 nt, Chlamydophila pneumoniae TW-183
ccauagaguaucuaaa

SEQ ID NO: 554955 - RNA, 18 nt, Chlamydophila pneumoniae TW-183
ccaggagagcuaacagca

SEQ ID NO: 554956 - RNA, 19 nt, Chlamydophila pneumoniae TW-183
ccaggagagcuaacagcac

SEQ ID NO: 554957 - RNA, 20 nt, Chlamydophila pneumoniae TW-183
cgagcuuuuugcuuuucccu

SEQ ID NO: 554958 - RNA, 17 nt, Chlamydophila pneumoniae TW-183
cgagucggcucuauaaa

SEQ ID NO: 554959 - RNA, 18 nt, Chlamydophila pneumoniae TW-183
cgagauccuccuggaaga

SEQ ID NO: 554960 - RNA, 22 nt, Chlamydophila pneumoniae TW-183
cgagaggaaaucccgagauaug

SEQ ID NO: 554961 - RNA, 19 nt, Chlamydophila pneumoniae TW-183
cgagaguugccaggaaacg

SEQ ID NO: 554962 - RNA, 23 nt, Chlamydophila pneumoniae TW-183
cgcagauuuuaacaacuucacau

SEQ ID NO: 554963 - RNA, 18 nt, Chlamydophila pneumoniae TW-183
cgauuugaacaugaggau

SEQ ID NO: 554964 - RNA, 17 nt, Chlamydophila pneumoniae TW-183
cgccuuucuacccuucc

SEQ ID NO: 554965 - RNA, 13 nt, Chlamydophila pneumoniae TW-183
cggauuuucucua

SEQ ID NO: 554966 - RNA, 15 nt, Chlamydophila pneumoniae TW-183
cggcaacauaaucau

SEQ ID NO: 554967 - RNA, 12 nt, Chlamydophila pneumoniae TW-183
cggaucuguaau

SEQ ID NO: 554968 - RNA, 13 nt, Chlamydophila pneumoniae TW-183
cgcuuguucuuuu

SEQ ID NO: 554969 - RNA, 21 nt, Chlamydophila pneumoniae TW-183
cgcuuguucuuuucaucaaga

SEQ ID NO: 554970 - RNA, 17 nt, Chlamydophila pneumoniae TW-183
cgcuaccauaucuugag

SEQ ID NO: 554971 - RNA, 22 nt, Chlamydophila pneumoniae TW-183
cggcauuucuccacaugccugc

SEQ ID NO: 554972 - RNA, 23 nt, Human
uaaaauggugugaccacugcaga

SEQ ID NO: 554973 - RNA, 17 nt, Human
ugagaugcuagaacucc

SEQ ID NO: 554974 - RNA, 19 nt, Human
gccccgucccccucuggcu

SEQ ID NO: 554975 - RNA, 16 nt, Human
gccccgucccccucug

SEQ ID NO: 554976 - RNA, 20 nt, Human
gcccagcuugaaaccuucac

SEQ ID NO: 554977 - RNA, 23 nt, Human
gccacuaaauugacacuuaaaaa

SEQ ID NO: 554978 - RNA, 19 nt, Human
gcaauguaagacucgggau

SEQ ID NO: 554979 - RNA, 16 nt, Human
gcagcuuuccucaaaa

SEQ ID NO: 554980 - RNA, 12 nt, Human
cuguaaucacag

SEQ ID NO: 554981 - RNA, 14 nt, Human
gaaacccugucucu

SEQ ID NO: 554982 - RNA, 13 nt, Human
cuacuuccccuuc

SEQ ID NO: 554983 - RNA, 17 nt, Human
cuaauuccacagcugcu

SEQ ID NO: 554984 - RNA, 14 nt, Human
cucugagccuuggg

SEQ ID NO: 554985 - RNA, 16 nt, Human
cuccacuuggucugug

SEQ ID NO: 554986 - RNA, 18 nt, Human
ccucuggcuccagcuggc

SEQ ID NO: 554987 - RNA, 19 nt, Human
ccuaacgaaguauccuuca

SEQ ID NO: 554988 - RNA, 22 nt, Human
aacagugauuaccagggacuga

SEQ ID NO: 554989 - RNA, 18 nt, Human
ggagccugaucaccugcc

SEQ ID NO: 554990 - RNA, 19 nt, Human
ggagcucugcccauccugc

SEQ ID NO: 554991 - RNA, 14 nt, Human
gucucuacuaaaaa

SEQ ID NO: 554992 - RNA, 15 nt, Human
uccaccuuacuucuu

SEQ ID NO: 554993 - RNA, 14 nt, Human
gacacuuaaaaaug

SEQ ID NO: 554994 - RNA, 21 nt, Human
gagccgagauugugccccugc

SEQ ID NO: 554995 - RNA, 22 nt, Human
cccuauccuacuuccccuuccu

SEQ ID NO: 554996 - RNA, 20 nt, Human
ccaugaagauguagaggaga

SEQ ID NO: 554997 - RNA, 12 nt, Human
cccaaauguuca

SEQ ID NO: 554998 - RNA, 20 nt, Human
cccagcuugaaaccuucacu

SEQ ID NO: 554999 - RNA, 16 nt, Human
caggaaguagaggagg

SEQ ID NO: 555000 - RNA, 13 nt, Human
augguauuaaaga

SEQ ID NO: 555001 - RNA, 17 nt, Human
caaauuuacagagacag

SEQ ID NO: 555002 - RNA, 12 nt, Human
auguuuaggaug

SEQ ID NO: 555003 - RNA, 21 nt, Human
caauuuuguuauguauauuuu

SEQ ID NO: 555004 - RNA, 18 nt, Human
augagguacugagaguga

SEQ ID NO: 555005 - RNA, 21 nt, Human
auccaacuuauauuucugcuu

SEQ ID NO: 555006 - RNA, 17 nt, Human
agugagacucugucuca

SEQ ID NO: 555007 - RNA, 23 nt, Human
acucccugccccccagcccuccu

SEQ ID NO: 555008 - RNA, 16 nt, Human
acacagauuugagcuc

SEQ ID NO: 555009 - RNA, 16 nt, Human
gucucuacuaaaaaua

SEQ ID NO: 555010 - RNA, 16 nt, Human
ggcuagaaccaccugc

SEQ ID NO: 555011 - RNA, 16 nt, Human
cacuccagugagacag

SEQ ID NO: 555012 - RNA, 17 nt, Human
cacagauuugagcucag

SEQ ID NO: 555013 - RNA, 14 nt, Human
aucguguccccuau

SEQ ID NO: 555014 - RNA, 15 nt, Human
auacucauuaggaug

SEQ ID NO: 555015 - RNA, 14 nt, Human
agccuggcaaggga

SEQ ID NO: 555016 - RNA, 14 nt, Human
agcucagcccuggu

SEQ ID NO: 555017 - RNA, 13 nt, Human
accccugagcuug

SEQ ID NO: 555018 - RNA, 20 nt, Human
acccccugcaaagcccagcu

SEQ ID NO: 555019 - RNA, 14 nt, Human
acaacacacagauu

SEQ ID NO: 555020 - RNA, 20 nt, Human
acagcuacuugggaggcuga

SEQ ID NO: 555021 - RNA, 18 nt, Human
acauccuacaagacacag

SEQ ID NO: 555022 - RNA, 16 nt, Human
caccugccuauauuuu

SEQ ID NO: 555023 - RNA, 20 nt, Human
cacuccagccugagcgacag

SEQ ID NO: 555024 - RNA, 17 nt, Human
auuccacagcugcucaa

SEQ ID NO: 555025 - RNA, 17 nt, Human
auccccaagccuggcaa

SEQ ID NO: 555026 - RNA, 21 nt, Human
auaguucuacuccauuaaaua

SEQ ID NO: 555027 - RNA, 19 nt, Human
auguuuacagauccccaag

SEQ ID NO: 555028 - RNA, 23 nt, Human
auggcuaguaucaaaagaaagaa

SEQ ID NO: 555029 - RNA, 14 nt, Human
agcuugcagagaug

SEQ ID NO: 555030 - RNA, 14 nt, Human
aggauguugaaaaa

SEQ ID NO: 555031 - RNA, 22 nt, Human
aguauccuucagccugaaagag

SEQ ID NO: 555032 - RNA, 21 nt, Human
agccugaucaccugcccugcu

SEQ ID NO: 555033 - RNA, 19 nt, Human
agcccuccuuaucaaagga

SEQ ID NO: 555034 - RNA, 13 nt, Human
ucaaaacuucaga

SEQ ID NO: 555035 - RNA, 20 nt, Human
ucuucucauacuauuuaaga

SEQ ID NO: 555036 - RNA, 16 nt, Human
ucuacuaaaaauacaa

SEQ ID NO: 555037 - RNA, 13 nt, Human
gugagaugcuaga

SEQ ID NO: 555038 - RNA, 17 nt, Human
agauccccaagccuggc

SEQ ID NO: 555039 - RNA, 14 nt, Human
cuucucuucacagu

SEQ ID NO: 555040 - RNA, 18 nt, Human
cuuugagcgcccacuaga

SEQ ID NO: 555041 - RNA, 16 nt, Human
cugagcuugcagagau

SEQ ID NO: 555042 - RNA, 19 nt, Human
acuggacucaccuccccca

SEQ ID NO: 555043 - RNA, 18 nt, Human
cacuccagugagacagcu

SEQ ID NO: 555044 - RNA, 17 nt, Human
ggccaugggacagggag

SEQ ID NO: 555045 - RNA, 17 nt, Human
aggccaugggacaggga

SEQ ID NO: 555046 - RNA, 23 nt, Human
caaaagcgauuauuauuuuagag

SEQ ID NO: 555047 - RNA, 23 nt, Human
agcccuccuuaucaaaggacacc

SEQ ID NO: 555048 - RNA, 18 nt, Human
gagcgacagugagacucu

SEQ ID NO: 555049 - RNA, 21 nt, Human
uccauccugaggcuccacuug

SEQ ID NO: 555050 - RNA, 15 nt, Human
aucaauuuaaaaaaa

SEQ ID NO: 555051 - RNA, 18 nt, Human
cagagacagaaagcagaa

SEQ ID NO: 555052 - RNA, 22 nt, Human
accccugagcuugcagagauga

SEQ ID NO: 555053 - RNA, 16 nt, Human
ggcugagccucagucu

SEQ ID NO: 555054 - RNA, 23 nt, Human
gucucccucccuuggggccuaug

SEQ ID NO: 555055 - RNA, 20 nt, Human
caaacauccuacaagacaca

SEQ ID NO: 555056 - RNA, 16 nt, Human
aaaaugugauauguac

SEQ ID NO: 555057 - RNA, 21 nt, Human
gcugagucccaggcugagccu

SEQ ID NO: 555058 - RNA, 23 nt, Human
gcuuuggucuaucuuugagcgcc

SEQ ID NO: 555059 - RNA, 23 nt, Human
ucggccuccauccugaggcucca

SEQ ID NO: 555060 - RNA, 24 nt, Human
uggccgggagccugaucaccugcc

SEQ ID NO: 555061 - RNA, 13 nt, Human
cccuccuuaucaa

SEQ ID NO: 555062 - RNA, 22 nt, Human
cugaggcuccacuuggucugug

SEQ ID NO: 555063 - RNA, 13 nt, Human
ccucccccaucuc

SEQ ID NO: 555064 - RNA, 18 nt, Human
cugagccuugggaccccu

SEQ ID NO: 555065 - RNA, 19 nt, Human
uugugccccugcacuccag

SEQ ID NO: 555066 - RNA, 15 nt, Human
ccucauguccacugg

SEQ ID NO: 555067 - RNA, 20 nt, Human
uauaaagcaagauaauaaaa

SEQ ID NO: 555068 - RNA, 14 nt, Human
gucccaggcugagc

SEQ ID NO: 555069 - RNA, 18 nt, Human
gagccucagucucccucc

SEQ ID NO: 555070 - RNA, 11 nt, Human
aaccugagccc

SEQ ID NO: 555071 - RNA, 11 nt, Human
caacucccugc

SEQ ID NO: 555072 - RNA, 20 nt, Human
uuaacacaugauccugcaau

SEQ ID NO: 555073 - RNA, 21 nt, Human
gaaauguuuacagauccccaa

SEQ ID NO: 555074 - RNA, 22 nt, Human
gucucuacuaaaaauacaaaaa

SEQ ID NO: 555075 - RNA, 14 nt, Human
cagucucccucccu

SEQ ID NO: 555076 - RNA, 15 nt, Human
ugccccccagcccuc

SEQ ID NO: 555077 - RNA, 21 nt, Human
ccaagaagauaaucuccaaag

SEQ ID NO: 555078 - RNA, 20 nt, Human
ugagagugaacaaauuuaca

SEQ ID NO: 555079 - RNA, 17 nt, Human
caccucccccaucucuu

SEQ ID NO: 555080 - RNA, 15 nt, Human
cccccagcccuccuu

SEQ ID NO: 555081 - RNA, 14 nt, Human
ggccgggagccuga

SEQ ID NO: 555082 - RNA, 19 nt, Human
gaggcagagguugcaguga

SEQ ID NO: 555083 - RNA, 17 nt, Human
agguccacaacacacag

SEQ ID NO: 555084 - RNA, 16 nt, Human
ccugccccccagcccu

SEQ ID NO: 555085 - RNA, 14 nt, Human
ccaugggacaggga

SEQ ID NO: 555086 - RNA, 14 nt, Human
gcaagauaauaaaa

SEQ ID NO: 555087 - RNA, 15 nt, Human
acucaccucccccau

SEQ ID NO: 555088 - RNA, 18 nt, Human
cccaagccuggcaaggga

SEQ ID NO: 555089 - RNA, 16 nt, Human
uauccuacuuccccuu

SEQ ID NO: 555090 - RNA, 15 nt, Human
cagucucccucccuu

SEQ ID NO: 555091 - RNA, 22 nt, Human
gagucccaggcugagccucagu

SEQ ID NO: 555092 - RNA, 16 nt, Human
caaauauaaacagcaa

SEQ ID NO: 555093 - RNA, 21 nt, Human
gccugaucaccugcccugcug

SEQ ID NO: 555094 - RNA, 12 nt, Human
gccccugagccc

SEQ ID NO: 555095 - RNA, 12 nt, Human
cuucaacucccu

SEQ ID NO: 555096 - RNA, 14 nt, Human
ugcuagaacucccu

SEQ ID NO: 555097 - RNA, 15 nt, Human
ugagcgcccacuaga

SEQ ID NO: 555098 - RNA, 19 nt, Human
ccccugagcuugcagagau

SEQ ID NO: 555099 - RNA, 17 nt, Human
agcgacagugagacucu

SEQ ID NO: 555100 - RNA, 21 nt, Human
ugaccauacuaauuauacccc

SEQ ID NO: 555101 - RNA, 15 nt, Human
agagacagaaagcag

SEQ ID NO: 555102 - RNA, 19 nt, Human
uacaaaaaaaaaaaaaaau

SEQ ID NO: 555103 - RNA, 20 nt, Human
ccauacuaauuauacccccu

SEQ ID NO: 555104 - RNA, 15 nt, Human
aaaauacaaaaaaaa

SEQ ID NO: 555105 - RNA, 15 nt, Human
uaucaauuuaaaaaa

SEQ ID NO: 555106 - RNA, 21 nt, Human
uccuucagccugaaagaggaa

SEQ ID NO: 555107 - RNA, 23 nt, Human
aguacucauacauguuacaacac

SEQ ID NO: 555108 - RNA, 17 nt, Human
aaaguacaagagcuuaa

SEQ ID NO: 555109 - RNA, 12 nt, Human
aauaaaguacaa

SEQ ID NO: 555110 - RNA, 11 nt, Human
cccaacagcuc

SEQ ID NO: 555111 - RNA, 15 nt, Human
uaaaugaaauugaaa

SEQ ID NO: 555112 - RNA, 20 nt, Human
ugaggcuccacuuggucugu

SEQ ID NO: 555113 - RNA, 21 nt, Human
ugccuguaaucacagcuacuu

SEQ ID NO: 555114 - RNA, 20 nt, Human
cuuauucacaagacccaaaa

SEQ ID NO: 555115 - RNA, 18 nt, Human
gcacuccagccugagcga

SEQ ID NO: 555116 - RNA, 18 nt, Human
agcugcucaauaaaguac

SEQ ID NO: 555117 - RNA, 18 nt, Human
cugcucaauaaaguacaa

SEQ ID NO: 555118 - RNA, 16 nt, Human
ugcaugguuuagaaag

SEQ ID NO: 555119 - RNA, 14 nt, Human
acccgggaggcaga

SEQ ID NO: 555120 - RNA, 21 nt, Human
cccuauccuacuuccccuucc

SEQ ID NO: 555121 - RNA, 18 nt, Human
auccccaagccuggcaag

SEQ ID NO: 555122 - RNA, 22 nt, Human
ugaccauacuaauuauaccccc

SEQ ID NO: 555123 - RNA, 21 nt, Human
ccugaucaccugcccugcuga

SEQ ID NO: 555124 - RNA, 17 nt, Human
cguaaucguguccccua

SEQ ID NO: 555125 - RNA, 12 nt, Human
acaagaaaugaa

SEQ ID NO: 555126 - RNA, 14 nt, Human
uucagccugaaaga

SEQ ID NO: 555127 - RNA, 16 nt, Human
aauuucuucaacuccc

SEQ ID NO: 555128 - RNA, 14 nt, Human
gcuggagcucugcc

SEQ ID NO: 555129 - RNA, 22 nt, Human
agacucgggauuaguacacacu

SEQ ID NO: 555130 - RNA, 14 nt, Human
agagguccacaaca

SEQ ID NO: 555131 - RNA, 16 nt, Human
ggaugccccguccccc

SEQ ID NO: 555132 - RNA, 13 nt, Human
agccucagucucc

SEQ ID NO: 555133 - RNA, 16 nt, Human
cacuuaaaaaugguuu

SEQ ID NO: 555134 - RNA, 16 nt, Human
ugagcucagcccuggu

SEQ ID NO: 555135 - RNA, 22 nt, Human
cugcucaauaaaguacaagagc

SEQ ID NO: 555136 - RNA, 21 nt, Human
aauauaaagcaagauaauaaa

SEQ ID NO: 555137 - RNA, 23 nt, Human
ucaauaucuuuuuuuuaauaaac

SEQ ID NO: 555138 - RNA, 16 nt, Human
agagguccacaacaca

SEQ ID NO: 555139 - RNA, 18 nt, Human
gaugccccgucccccucu

SEQ ID NO: 555140 - RNA, 14 nt, Human
ugcuggagcucugc

SEQ ID NO: 555141 - RNA, 13 nt, Human
uuuaaaaaaaaac

SEQ ID NO: 555142 - RNA, 13 nt, Human
ugagcgacaguga

SEQ ID NO: 555143 - RNA, 20 nt, Human
gcagagaugaggccgccaug

SEQ ID NO: 555144 - RNA, 18 nt, Human
ggaggacgcucucuggcc

SEQ ID NO: 555145 - RNA, 17 nt, Human
cccaggcugagccucag

SEQ ID NO: 555146 - RNA, 17 nt, Human
ucagacauagaauuaac

SEQ ID NO: 555147 - RNA, 18 nt, Human
ccuuccuaauuccacagc

SEQ ID NO: 555148 - RNA, 17 nt, Human
agaaaugaaagcaggga

SEQ ID NO: 555149 - RNA, 16 nt, Human
aauugacccacaagaa

SEQ ID NO: 555150 - RNA, 18 nt, Human
ucuucuggguuccuuccu

SEQ ID NO: 555151 - RNA, 12 nt, Human
ucaccccuugcc

SEQ ID NO: 555152 - RNA, 20 nt, Human
ccagcuugaaaccuucacuu

SEQ ID NO: 555153 - RNA, 17 nt, Human
aaagcagggacuugaac

SEQ ID NO: 555154 - RNA, 19 nt, Human
cagauccccaagccuggca

SEQ ID NO: 555155 - RNA, 22 nt, Human
accuaacgaaguauccuucagc

SEQ ID NO: 555156 - RNA, 20 nt, Human
cuucaacucccugcccccca

SEQ ID NO: 555157 - RNA, 23 nt, Human
cgauuauuauuuuagagcaucuc

SEQ ID NO: 555158 - RNA, 15 nt, Human
ugcaauuccacuuau

SEQ ID NO: 555159 - RNA, 22 nt, Human
agccaaacauccuacaagacac

SEQ ID NO: 555160 - RNA, 19 nt, Human
cggccuccauccugaggcu

SEQ ID NO: 555161 - RNA, 19 nt, Human
uucauuguucuauaacaac

SEQ ID NO: 555162 - RNA, 14 nt, Human
cuuggucugugaga

SEQ ID NO: 555163 - RNA, 18 nt, Human
aaggaugccccguccccc

SEQ ID NO: 555164 - RNA, 14 nt, Human
cacaacacacagau

SEQ ID NO: 555165 - RNA, 16 nt, Human
ucaaaagaaagaaaau

SEQ ID NO: 555166 - RNA, 20 nt, Human
uuucuucaacucccugcccc

SEQ ID NO: 555167 - RNA, 20 nt, Human
ccuccugccuaagugcagcc

SEQ ID NO: 555168 - RNA, 16 nt, Human
ccucagucucccuccc

SEQ ID NO: 555169 - RNA, 14 nt, Human
cucccuuggggccu

SEQ ID NO: 555170 - RNA, 15 nt, Human
ggccuccauccugag

SEQ ID NO: 555171 - RNA, 22 nt, Human
uucaauaucuuuuuuuuaauaa

SEQ ID NO: 555172 - RNA, 22 nt, Human
cuucagccugaaagaggaauga

SEQ ID NO: 555173 - RNA, 18 nt, Human
agccugaucaccugcccu

SEQ ID NO: 555174 - RNA, 15 nt, Human
ucagucucccucccu

SEQ ID NO: 555175 - RNA, 19 nt, Human
gguuccuuccucugagccu

SEQ ID NO: 555176 - RNA, 13 nt, Human
cgggaggcagagg

SEQ ID NO: 555177 - RNA, 13 nt, Human
ggaaguagaggag

SEQ ID NO: 555178 - RNA, 19 nt, Human
augaaagcagggacuugaa

SEQ ID NO: 555179 - RNA, 15 nt, Human
ggcaagcucuaucac

SEQ ID NO: 555180 - RNA, 18 nt, Human
agcaaauauaaacagcaa

SEQ ID NO: 555181 - RNA, 20 nt, Human
acaugagguacugagaguga

SEQ ID NO: 555182 - RNA, 13 nt, Human
aucuacacuccag

SEQ ID NO: 555183 - RNA, 12 nt, Human
caacccaaaugu

SEQ ID NO: 555184 - RNA, 12 nt, Human
ccccuugccaua

SEQ ID NO: 555185 - RNA, 22 nt, Human
aucucuucuggguuccuuccuc

SEQ ID NO: 555186 - RNA, 23 nt, Human
caacggggugaaacccugucucu

SEQ ID NO: 555187 - RNA, 20 nt, Human
ugagcgcccacuagacccac

SEQ ID NO: 555188 - RNA, 22 nt, Human
aagacccaaaaggcagaagcaa

SEQ ID NO: 555189 - RNA, 16 nt, Human
aggccaugggacaggg

SEQ ID NO: 555190 - RNA, 22 nt, Human
caaggaugccccgucccccucu

SEQ ID NO: 555191 - RNA, 22 nt, Human
aauuuaaaaaaaaaccugagcc

SEQ ID NO: 555192 - RNA, 13 nt, Human
aaauauaaagcaa

SEQ ID NO: 555193 - RNA, 18 nt, Human
ccacuuggucugugagau

SEQ ID NO: 555194 - RNA, 18 nt, Human
gccccugcacuccagccu

SEQ ID NO: 555195 - RNA, 15 nt, Human
agacagcucugcaua

SEQ ID NO: 555196 - RNA, 18 nt, Human
uuggggccuaugcagagg

SEQ ID NO: 555197 - RNA, 12 nt, Human
gcucagcccugg

SEQ ID NO: 555198 - RNA, 14 nt, Human
aaaagaaagaaaau

SEQ ID NO: 555199 - RNA, 18 nt, Human
cuccagccugagcgacag

SEQ ID NO: 555200 - RNA, 23 nt, Human
gggccuaugcagagguccacaac

SEQ ID NO: 555201 - RNA, 16 nt, Human
uaucaaaagaaagaaa

SEQ ID NO: 555202 - RNA, 17 nt, Human
uggcuaagcaaaaugug

SEQ ID NO: 555203 - RNA, 14 nt, Human
cagagguugcagug

SEQ ID NO: 555204 - RNA, 19 nt, Human
ucagugucaaugcagcccc

SEQ ID NO: 555205 - RNA, 13 nt, Human
gcagaacagugau

SEQ ID NO: 555206 - RNA, 21 nt, Human
acuauuuaagagaacaagcaa

SEQ ID NO: 555207 - RNA, 13 nt, Human
uccuacuuccccu

SEQ ID NO: 555208 - RNA, 13 nt, Human
cucaccuccccca

SEQ ID NO: 555209 - RNA, 19 nt, Human
uccccuauccuacuucccc

SEQ ID NO: 555210 - RNA, 20 nt, Human
cccuuccuaauuccacagcu

SEQ ID NO: 555211 - RNA, 17 nt, Human
augcagagguccacaac

SEQ ID NO: 555212 - RNA, 12 nt, Human
caugggaaguga

SEQ ID NO: 555213 - RNA, 20 nt, Human
acuaaauugacacuuaaaaa

SEQ ID NO: 555214 - RNA, 13 nt, Human
ucucccucccuug

SEQ ID NO: 555215 - RNA, 14 nt, Human
cucccucccuuggg

SEQ ID NO: 555216 - RNA, 16 nt, Human
auuauacccccugcaa

SEQ ID NO: 555217 - RNA, 13 nt, Human
uggcuccagcugg

SEQ ID NO: 555218 - RNA, 14 nt, Human
cgucccccucuggc

SEQ ID NO: 555219 - RNA, 22 nt, Human
cagcccuggugggcagagaggu

SEQ ID NO: 555220 - RNA, 15 nt, Human
auccugccccugagc

SEQ ID NO: 555221 - RNA, 16 nt, Human
agaugcuagaacuccc

SEQ ID NO: 555222 - RNA, 15 nt, Human
uuaagagaacaagca

SEQ ID NO: 555223 - RNA, 21 nt, Human
uacaugagguacugagaguga

SEQ ID NO: 555224 - RNA, 23 nt, Human
cuggccgggagccugaucaccug

SEQ ID NO: 555225 - RNA, 18 nt, Human
cugagucccaggcugagc

SEQ ID NO: 555226 - RNA, 18 nt, Human
uccagcuggccgggagcc

SEQ ID NO: 555227 - RNA, 22 nt, Human
caaauuuacagagacagaaagc

SEQ ID NO: 555228 - RNA, 14 nt, Human
aaaacuucagacau

SEQ ID NO: 555229 - RNA, 15 nt, Human
ccacaagaaaugaaa

SEQ ID NO: 555230 - RNA, 13 nt, Human
ccaggcugagccu

SEQ ID NO: 555231 - RNA, 15 nt, Human
agccugaaagaggaa

SEQ ID NO: 555232 - RNA, 14 nt, Human
aagcucuaucacca

SEQ ID NO: 555233 - RNA, 14 nt, Human
ugagaugcuagaac

SEQ ID NO: 555234 - RNA, 13 nt, Human
auauaaagcaaga

SEQ ID NO: 555235 - RNA, 11 nt, Human
ggucacaggaa

SEQ ID NO: 555236 - RNA, 23 nt, Human
ggucuaucuuugagcgcccacua

SEQ ID NO: 555237 - RNA, 21 nt, Human
ccaaggaugccccgucccccu

SEQ ID NO: 555238 - RNA, 23 nt, Human
cucauguccacugguucuucuug

SEQ ID NO: 555239 - RNA, 20 nt, Human
uuaaauggucaauuuuguua

SEQ ID NO: 555240 - RNA, 15 nt, Human
ugguuuagaaagcuu

SEQ ID NO: 555241 - RNA, 15 nt, Human
gacaguauggcagcu

SEQ ID NO: 555242 - RNA, 19 nt, Human
uaguuuaugauuccaccua

SEQ ID NO: 555243 - RNA, 20 nt, Human
gagccugaucaccugcccug

SEQ ID NO: 555244 - RNA, 15 nt, Human
cucccuuggggccua

SEQ ID NO: 555245 - RNA, 23 nt, Human
auucaauaucuuuuuuuuaauaa

SEQ ID NO: 555246 - RNA, 14 nt, Human
caaggcuagaacca

SEQ ID NO: 555247 - RNA, 16 nt, Human
auacuauuuaagagaa

SEQ ID NO: 555248 - RNA, 22 nt, Human
uacugagagugaacaaauuuac

SEQ ID NO: 555249 - RNA, 21 nt, Human
cucaaaacuucagacauagaa

SEQ ID NO: 555250 - RNA, 22 nt, Human
gucacaggaaguagaggaggcc

SEQ ID NO: 555251 - RNA, 14 nt, Human
acaagcaaauauaa

SEQ ID NO: 555252 - RNA, 21 nt, Human
aaugugacuuaaugccacuaa

SEQ ID NO: 555253 - RNA, 14 nt, Human
aucaccaaggcuga

SEQ ID NO: 555254 - RNA, 17 nt, Human
ucugugagaugcuagaa

SEQ ID NO: 555255 - RNA, 14 nt, Human
uaaauaguuuauga

SEQ ID NO: 555256 - RNA, 17 nt, Human
guugcugggggggauug

SEQ ID NO: 555257 - RNA, 15 nt, Human
auauuuuuuguuaaa

SEQ ID NO: 555258 - RNA, 19 nt, Human
ccuccauccugaggcucca

SEQ ID NO: 555259 - RNA, 22 nt, Human
aggaugccccgucccccucugg

SEQ ID NO: 555260 - RNA, 16 nt, Human
agagaacaagcaaaua

SEQ ID NO: 555261 - RNA, 19 nt, Human
uggcaagcucuaucaccaa

SEQ ID NO: 555262 - RNA, 22 nt, Human
ucuggguuccuuccucugagcc

SEQ ID NO: 555263 - RNA, 12 nt, Human
ccuucagccuga

SEQ ID NO: 555264 - RNA, 14 nt, Human
ugagcuugcagaga

SEQ ID NO: 555265 - RNA, 11 nt, Human
augggacaggg

SEQ ID NO: 555266 - RNA, 16 nt, Human
ccaggcugagccucag

SEQ ID NO: 555267 - RNA, 14 nt, Human
uaguuucccuugca

SEQ ID NO: 555268 - RNA, 17 nt, Human
uaucaauuuaaaaaaaa

SEQ ID NO: 555269 - RNA, 19 nt, Human
uggugagugccuguaauca

SEQ ID NO: 555270 - RNA, 13 nt, Human
ccaccugccuaua

SEQ ID NO: 555271 - RNA, 16 nt, Human
ccuaagugcagccccg

SEQ ID NO: 555272 - RNA, 14 nt, Human
uugacccacaagaa

SEQ ID NO: 555273 - RNA, 19 nt, Human
uagcagcucauaaaugaaa

SEQ ID NO: 555274 - RNA, 16 nt, Human
cuuuauaguucuacuc

SEQ ID NO: 555275 - RNA, 23 nt, Human
aaguauccuucagccugaaagag

SEQ ID NO: 555276 - RNA, 21 nt, Human
cucagugucaaugcagccccc

SEQ ID NO: 555277 - RNA, 15 nt, Human
uccaagccucauguc

SEQ ID NO: 555278 - RNA, 14 nt, Human
acuggacucaccuc

SEQ ID NO: 555279 - RNA, 23 nt, Human
ggaggcagagguugcagugagcc

SEQ ID NO: 555280 - RNA, 14 nt, Human
ccucagucucccuc

SEQ ID NO: 555281 - RNA, 22 nt, Human
aggacaccauuuuggcaagcuc

SEQ ID NO: 555282 - RNA, 17 nt, Human
gcaugguuuagaaagcu

SEQ ID NO: 555283 - RNA, 20 nt, Human
gaugggcuuucccaacagcu

SEQ ID NO: 555284 - RNA, 18 nt, Human
auagaauuaacacaugau

SEQ ID NO: 555285 - RNA, 20 nt, Human
ccauuguggucacaggaagu

SEQ ID NO: 555286 - RNA, 22 nt, Human
aaacauccuacaagacacagug

SEQ ID NO: 555287 - RNA, 20 nt, Human
cccugcacuccagccugagc

SEQ ID NO: 555288 - RNA, 20 nt, Human
ucugcaacuacuauccaacu

SEQ ID NO: 555289 - RNA, 19 nt, Human
auacuaauuauacccccug

SEQ ID NO: 555290 - RNA, 22 nt, Human
acagauuugagcucagcccugg

SEQ ID NO: 555291 - RNA, 19 nt, Human
cuggccuucggccuccauc

SEQ ID NO: 555292 - RNA, 15 nt, Human
ggccuucggccucca

SEQ ID NO: 555293 - RNA, 20 nt, Human
agcccuggugggcagagagg

SEQ ID NO: 555294 - RNA, 18 nt, Human
gccccgucccccucuggc

SEQ ID NO: 555295 - RNA, 22 nt, Human
ugaauggcuaagcaaaauguga

SEQ ID NO: 555296 - RNA, 13 nt, Human
cucugagccuugg

SEQ ID NO: 555297 - RNA, 15 nt, Human
gaccacugcagaaga

SEQ ID NO: 555298 - RNA, 20 nt, Human
ccccuauccuacuuccccuu

SEQ ID NO: 555299 - RNA, 14 nt, Human
agcucauaaaugaa

SEQ ID NO: 555300 - RNA, 23 nt, Human
gggagccugaucaccugcccugc

SEQ ID NO: 555301 - RNA, 19 nt, Human
agcagcuuauucacaagac

SEQ ID NO: 555302 - RNA, 21 nt, Human
cugagccucagucucccuccc

SEQ ID NO: 555303 - RNA, 23 nt, Human
cuagacccacuggacucaccucc

SEQ ID NO: 555304 - RNA, 15 nt, Human
gucaaugcagccccc

SEQ ID NO: 555305 - RNA, 17 nt, Human
ccucagucucccucccu

SEQ ID NO: 555306 - RNA, 17 nt, Human
ccaacuuauauuucugc

SEQ ID NO: 555307 - RNA, 22 nt, Human
cuggguuccuuccucugagccu

SEQ ID NO: 555308 - RNA, 20 nt, Human
auaagccagacaucaacaga

SEQ ID NO: 555309 - RNA, 16 nt, Human
ugccucaccccuugcc

SEQ ID NO: 555310 - RNA, 20 nt, Human
guaucaaaagaaagaaaauc

SEQ ID NO: 555311 - RNA, 16 nt, Human
agugucaaugcagccc

SEQ ID NO: 555312 - RNA, 18 nt, Human
gcaaagcccagcuugaaa

SEQ ID NO: 555313 - RNA, 15 nt, Human
uucugcacacagcac

SEQ ID NO: 555314 - RNA, 18 nt, Human
aaagaaaaucaggcuggc

SEQ ID NO: 555315 - RNA, 14 nt, Human
ccugccccugagcc

SEQ ID NO: 555316 - RNA, 20 nt, Human
agcaucucauuuauaaugua

SEQ ID NO: 555317 - RNA, 16 nt, Human
agggaggacgcucucu

SEQ ID NO: 555318 - RNA, 21 nt, Human
agucucccucccuuggggccu

SEQ ID NO: 555319 - RNA, 15 nt, Human
gugaccacugcagaa

SEQ ID NO: 555320 - RNA, 21 nt, Human
cuaaauugacacuuaaaaaug

SEQ ID NO: 555321 - RNA, 22 nt, Human
uugacccacaagaaaugaaagc

SEQ ID NO: 555322 - RNA, 13 nt, Human
uuauucacaagac

SEQ ID NO: 555323 - RNA, 21 nt, Human
ugggaggcugagaugggagaa

SEQ ID NO: 555324 - RNA, 20 nt, Human
ggccuaugcagagguccaca

SEQ ID NO: 555325 - RNA, 16 nt, Human
ugugagaugcuagaac

SEQ ID NO: 555326 - RNA, 22 nt, Human
caucucuucuggguuccuuccu

SEQ ID NO: 555327 - RNA, 15 nt, Human
aaugaauggcuaagc

SEQ ID NO: 555328 - RNA, 18 nt, Human
caagccucauguccacug

SEQ ID NO: 555329 - RNA, 16 nt, Human
gugagacagcucugca

SEQ ID NO: 555330 - RNA, 20 nt, Human
cugagccucagucucccucc

SEQ ID NO: 555331 - RNA, 12 nt, Human
uauucacaagac

SEQ ID NO: 555332 - RNA, 16 nt, Human
ucuuggucucaguguc

SEQ ID NO: 555333 - RNA, 22 nt, Human
gcuugcagagaugaggccgcca

SEQ ID NO: 555334 - RNA, 15 nt, Human
ccaccuuacuucuuc

SEQ ID NO: 555335 - RNA, 13 nt, Human
aaaaaugguuuaa

SEQ ID NO: 555336 - RNA, 22 nt, Human
aucaccaaggcugauuaaacca

SEQ ID NO: 555337 - RNA, 14 nt, Human
cugucucaguccau

SEQ ID NO: 555338 - RNA, 14 nt, Human
auaaagcaagauaa

SEQ ID NO: 555339 - RNA, 13 nt, Human
aacucccugcccc

SEQ ID NO: 555340 - RNA, 15 nt, Human
ugagcucagcccugg

SEQ ID NO: 555341 - RNA, 23 nt, Human
aucaccaaggcugauuaaaccaa

SEQ ID NO: 555342 - RNA, 14 nt, Human
uccauuaaauauaa

SEQ ID NO: 555343 - RNA, 18 nt, Human
aaaaugguauuaaagauc

SEQ ID NO: 555344 - RNA, 14 nt, Human
cagauuugagcuca

SEQ ID NO: 555345 - RNA, 23 nt, Human
ggccuccauccugaggcuccacu

SEQ ID NO: 555346 - RNA, 14 nt, Human
auacaaaaaaaaaa

SEQ ID NO: 555347 - RNA, 15 nt, Human
uucggccuccauccu

SEQ ID NO: 555348 - RNA, 13 nt, Human
agcccagcuugaa

SEQ ID NO: 555349 - RNA, 16 nt, Human
aauuccacagcugcuc

SEQ ID NO: 555350 - RNA, 23 nt, Human
gaaaaaguucugcagauaaacag

SEQ ID NO: 555351 - RNA, 19 nt, Human
cagcacgggggccaaggau

SEQ ID NO: 555352 - RNA, 21 nt, Human
uguaaaauggugugaccacug

SEQ ID NO: 555353 - RNA, 22 nt, Human
agacucugucucaguccaugaa

SEQ ID NO: 555354 - RNA, 15 nt, Human
agaacaagcaaauau

SEQ ID NO: 555355 - RNA, 15 nt, Human
ugcagauaaacagua

SEQ ID NO: 555356 - RNA, 18 nt, Human
uggucaauuuuguuaugu

SEQ ID NO: 555357 - RNA, 16 nt, Human
guucugcacacagcac

SEQ ID NO: 555358 - RNA, 21 nt, Human
gacagaaagcagaacagugau

SEQ ID NO: 555359 - RNA, 17 nt, Human
ucucuggccuucggccu

SEQ ID NO: 555360 - RNA, 18 nt, Human
ccugcaaagcccagcuug

SEQ ID NO: 555361 - RNA, 16 nt, Human
cuucaacucccugccc

SEQ ID NO: 555362 - RNA, 17 nt, Human
gugccuguaaucacagc

SEQ ID NO: 555363 - RNA, 13 nt, Human
cccaaaaggcaga

SEQ ID NO: 555364 - RNA, 12 nt, Human
ucuacacuccag

SEQ ID NO: 555365 - RNA, 12 nt, Human
cacaacacacag

SEQ ID NO: 555366 - RNA, 23 nt, Human
uaggauggcuaguaucaaaagaa

SEQ ID NO: 555367 - RNA, 19 nt, Human
caagaagauaaucuccaaa

SEQ ID NO: 555368 - RNA, 23 nt, Human
gccccugcacuccagccugagcg

SEQ ID NO: 555369 - RNA, 14 nt, Human
cguguccccuaucc

SEQ ID NO: 555370 - RNA, 19 nt, Human
guacugagagugaacaaau

SEQ ID NO: 555371 - RNA, 16 nt, Human
caggaaguagaggagg

SEQ ID NO: 555372 - RNA, 11 nt, Human
gccaugggaca

SEQ ID NO: 555373 - RNA, 16 nt, Human
uuaagagaacaagcaa

SEQ ID NO: 555374 - RNA, 16 nt, Human
cuucuggguuccuucc

SEQ ID NO: 555375 - RNA, 14 nt, Human
ggaaguagaggagg

SEQ ID NO: 555376 - RNA, 19 nt, Human
uccauccugaggcuccacu

SEQ ID NO: 555377 - RNA, 22 nt, Human
cuuccuaauuccacagcugcuc

SEQ ID NO: 555378 - RNA, 15 nt, Human
ccauuaaauauaaag

SEQ ID NO: 555379 - RNA, 16 nt, Human
auccuacaagacacag

SEQ ID NO: 555380 - RNA, 17 nt, Human
uguucuaagaagugaaa

SEQ ID NO: 555381 - RNA, 15 nt, Human
ucaaaggacaccauu

SEQ ID NO: 555382 - RNA, 22 nt, Human
uauccuacuuccccuuccuaau

SEQ ID NO: 555383 - RNA, 14 nt, Human
aauaguuuaugauu

SEQ ID NO: 555384 - RNA, 15 nt, Human
aagaagugaaaaucu

SEQ ID NO: 555385 - RNA, 16 nt, Human
acagagacagaaagca

SEQ ID NO: 555386 - RNA, 19 nt, Human
gagccucagucucccuccc

SEQ ID NO: 555387 - RNA, 13 nt, Human
aagugcagccccg

SEQ ID NO: 555388 - RNA, 22 nt, Human
gaggggagcaugggaagugacg

SEQ ID NO: 555389 - RNA, 15 nt, Human
aaauauaaagcaaga

SEQ ID NO: 555390 - RNA, 18 nt, Human
ccugaaagaggaaugaag

SEQ ID NO: 555391 - RNA, 20 nt, Human
aaggagccaaacauccuaca

SEQ ID NO: 555392 - RNA, 22 nt, Human
auaucuuuuuuuuaauaaacca

SEQ ID NO: 555393 - RNA, 13 nt, Human
ccugagcuugcag

SEQ ID NO: 555394 - RNA, 12 nt, Human
aaaagaaagaaa

SEQ ID NO: 555395 - RNA, 14 nt, Human
uauguauauuuuau

SEQ ID NO: 555396 - RNA, 22 nt, Human
cacagauuugagcucagcccug

SEQ ID NO: 555397 - RNA, 23 nt, Human
aguucuacuccauuaaauauaaa

SEQ ID NO: 555398 - RNA, 13 nt, Human
cacgaugggcuuu

SEQ ID NO: 555399 - RNA, 19 nt, Human
agaacaagcaaauauaaac

SEQ ID NO: 555400 - RNA, 16 nt, Human
auuccaccuacaugag

SEQ ID NO: 555401 - RNA, 22 nt, Human
cccagcccuccuuaucaaagga

SEQ ID NO: 555402 - RNA, 17 nt, Human
guguccccuauccuacu

SEQ ID NO: 555403 - RNA, 21 nt, Human
ucuucaacucccugcccccca

SEQ ID NO: 555404 - RNA, 17 nt, Human
ugaccacugcagaagac

SEQ ID NO: 555405 - RNA, 17 nt, Human
cuuccucugagccuugg

SEQ ID NO: 555406 - RNA, 16 nt, Human
cacgggggccaaggau

SEQ ID NO: 555407 - RNA, 19 nt, Human
gccugaucaccugcccugc

SEQ ID NO: 555408 - RNA, 16 nt, Human
aucaauuuaaaaaaaa

SEQ ID NO: 555409 - RNA, 12 nt, Human
cccccagcccuc

SEQ ID NO: 555410 - RNA, 19 nt, Human
acuccauuaaauauaaagc

SEQ ID NO: 555411 - RNA, 21 nt, Human
aauuuucauuguucuauaaca

SEQ ID NO: 555412 - RNA, 14 nt, Human
agaugcuagaacuc

SEQ ID NO: 555413 - RNA, 20 nt, Human
uaagugaaauaagccagaca

SEQ ID NO: 555414 - RNA, 16 nt, Human
cuccauccugaggcuc

SEQ ID NO: 555415 - RNA, 17 nt, Human
cagacaucaacagauaa

SEQ ID NO: 555416 - RNA, 20 nt, Human
cuugccauaauuacuauguc

SEQ ID NO: 555417 - RNA, 14 nt, Human
aaaauacaaaaaaa

SEQ ID NO: 555418 - RNA, 14 nt, Human
aauugaaaauggua

SEQ ID NO: 555419 - RNA, 15 nt, Human
ugaaacccugucucu

SEQ ID NO: 555420 - RNA, 16 nt, Human
auaucaauuuaaaaaa

SEQ ID NO: 555421 - RNA, 19 nt, Human
cccacuggacucaccuccc

SEQ ID NO: 555422 - RNA, 20 nt, Human
acaagacacagugaccauac

SEQ ID NO: 555423 - RNA, 16 nt, Human
guuccuuccucugagc

SEQ ID NO: 555424 - RNA, 15 nt, Human
ccugcaaagcccagc

SEQ ID NO: 555425 - RNA, 15 nt, Human
cgggagccugaucac

SEQ ID NO: 555426 - RNA, 19 nt, Human
ggaauuucuucaacucccu

SEQ ID NO: 555427 - RNA, 18 nt, Human
cagucucccucccuuggg

SEQ ID NO: 555428 - RNA, 22 nt, Human
cccuauccuacuuccccuuccu

SEQ ID NO: 555429 - RNA, 15 nt, Human
uccauccugaggcuc

SEQ ID NO: 555430 - RNA, 17 nt, Human
augccccgucccccucu

SEQ ID NO: 555431 - RNA, 16 nt, Human
cagaagcaacccaaau

SEQ ID NO: 555432 - RNA, 13 nt, Human
ugggaggcugaga

SEQ ID NO: 555433 - RNA, 16 nt, Human
aaauaguuuaugauuc

SEQ ID NO: 555434 - RNA, 17 nt, Human
ccacuggacucaccucc

SEQ ID NO: 555435 - RNA, 20 nt, Human
gcuugcagagaugaggccgc

SEQ ID NO: 555436 - RNA, 22 nt, Human
acaugagguacugagagugaac

SEQ ID NO: 555437 - RNA, 21 nt, Human
cccccauuguggucacaggaa

SEQ ID NO: 555438 - RNA, 19 nt, Human
ccccucuggcuccagcugg

SEQ ID NO: 555439 - RNA, 12 nt, Human
uauaacaacaac

SEQ ID NO: 555440 - RNA, 13 nt, Human
agaaaugaaagca

SEQ ID NO: 555441 - RNA, 16 nt, Human
cagcuuuccucaaaac

SEQ ID NO: 555442 - RNA, 21 nt, Human
aauuuacagagacagaaagca

SEQ ID NO: 555443 - RNA, 14 nt, Human
cuggccgggagccu

SEQ ID NO: 555444 - RNA, 16 nt, Human
cccuauccuacuuccc

SEQ ID NO: 555445 - RNA, 13 nt, Human
ccaaggaugcccc

SEQ ID NO: 555446 - RNA, 19 nt, Human
auccuacaagacacaguga

SEQ ID NO: 555447 - RNA, 14 nt, Human
agucucccucccuu

SEQ ID NO: 555448 - RNA, 18 nt, Human
acauguuacaacacggac

SEQ ID NO: 555449 - RNA, 21 nt, Human
ugaacaaauuuacagagacag

SEQ ID NO: 555450 - RNA, 13 nt, Human
uacagagacagaa

SEQ ID NO: 555451 - RNA, 20 nt, Human
aaacuuuaugcuaagugaaa

SEQ ID NO: 555452 - RNA, 15 nt, Human
gucccaggcugagcc

SEQ ID NO: 555453 - RNA, 23 nt, Human
cccacuggacucaccucccccau

SEQ ID NO: 555454 - RNA, 12 nt, Human
uuaauaaaccau

SEQ ID NO: 555455 - RNA, 22 nt, Human
agacccacuggacucaccuccc

SEQ ID NO: 555456 - RNA, 22 nt, Human
ggcauuuaggccaugggacagg

SEQ ID NO: 555457 - RNA, 16 nt, Human
gccaaggaugccccgu

SEQ ID NO: 555458 - RNA, 15 nt, Human
auuucauucaauauc

SEQ ID NO: 555459 - RNA, 17 nt, Human
uaugcuaagugaaauaa

SEQ ID NO: 555460 - RNA, 15 nt, Human
augggacagggagga

SEQ ID NO: 555461 - RNA, 11 nt, Human
gcaugguuuag

SEQ ID NO: 555462 - RNA, 16 nt, Human
ccuacaugagguacug

SEQ ID NO: 555463 - RNA, 16 nt, Human
caggcugagccucagu

SEQ ID NO: 555464 - RNA, 20 nt, Human
auuuaagagaacaagcaaau

SEQ ID NO: 555465 - RNA, 15 nt, Human
cuucaacucccugcc

SEQ ID NO: 555466 - RNA, 18 nt, Human
uaucaaaagaaagaaaau

SEQ ID NO: 555467 - RNA, 17 nt, Human
uaaaugaaauugaaaau

SEQ ID NO: 555468 - RNA, 22 nt, Human
caucgcaauguaagacucggga

SEQ ID NO: 555469 - RNA, 22 nt, Human
ugagacucugucucaguccaug

SEQ ID NO: 555470 - RNA, 18 nt, Human
cccacuagacccacugga

SEQ ID NO: 555471 - RNA, 15 nt, Human
uucaaaguuaagaau

SEQ ID NO: 555472 - RNA, 17 nt, Human
agcagcucauaaaugaa

SEQ ID NO: 555473 - RNA, 17 nt, Human
ugaaauaagccagacau

SEQ ID NO: 555474 - RNA, 15 nt, Human
acaucaacagauaaa

SEQ ID NO: 555475 - RNA, 12 nt, Human
ccaggcugagcc

SEQ ID NO: 555476 - RNA, 20 nt, Human
ucuucuggguuccuuccucu

SEQ ID NO: 555477 - RNA, 16 nt, Human
gacauagaauuaacac

SEQ ID NO: 555478 - RNA, 22 nt, Human
uauuuaagagaacaagcaaaua

SEQ ID NO: 555479 - RNA, 16 nt, Human
ccuccuuaucaaagga

SEQ ID NO: 555480 - RNA, 20 nt, Human
guccccuauccuacuucccc

SEQ ID NO: 555481 - RNA, 14 nt, Human
gcaaagcccagcuu

SEQ ID NO: 555482 - RNA, 21 nt, Human
acuccauuaaauauaaagcaa

SEQ ID NO: 555483 - RNA, 11 nt, Human
aauuccacagc

SEQ ID NO: 555484 - RNA, 18 nt, Human
gaaaugaaagcagggacu

SEQ ID NO: 555485 - RNA, 14 nt, Human
ggcuccagcuggcc

SEQ ID NO: 555486 - RNA, 15 nt, Human
cuugaaaacuuuaug

SEQ ID NO: 555487 - RNA, 15 nt, Human
ccaaggagccaaaca

SEQ ID NO: 555488 - RNA, 19 nt, Human
aauguuuacagauccccaa

SEQ ID NO: 555489 - RNA, 22 nt, Human
gugccucaccccuugccauaau

SEQ ID NO: 555490 - RNA, 18 nt, Human
gaccccugagcuugcaga

SEQ ID NO: 555491 - RNA, 14 nt, Human
ucaaugcagccccc

SEQ ID NO: 555492 - RNA, 17 nt, Human
uccagcuggccgggagc

SEQ ID NO: 555493 - RNA, 22 nt, Human
acaagcaaauauaaacagcaac

SEQ ID NO: 555494 - RNA, 14 nt, Human
agacaucaacagau

SEQ ID NO: 555495 - RNA, 22 nt, Human
ggcagcuuuccucaaaacuuca

SEQ ID NO: 555496 - RNA, 16 nt, Human
gucuaucuuugagcgc

SEQ ID NO: 555497 - RNA, 22 nt, Human
aauguagcagcucauaaaugaa

SEQ ID NO: 555498 - RNA, 15 nt, Human
aagugaaaaucuaca

SEQ ID NO: 555499 - RNA, 22 nt, Human
cucugagccuugggaccccuga

SEQ ID NO: 555500 - RNA, 19 nt, Human
cagagaugaggccgccaug

SEQ ID NO: 555501 - RNA, 13 nt, Human
caccaaggagcca

SEQ ID NO: 555502 - RNA, 13 nt, Human
aaauauaaacagc

SEQ ID NO: 555503 - RNA, 17 nt, Human
ccaaaagguauuuuaau

SEQ ID NO: 555504 - RNA, 15 nt, Human
uugacacuuaaaaau

SEQ ID NO: 555505 - RNA, 19 nt, Human
uggaaauguuuacagaucc

SEQ ID NO: 555506 - RNA, 13 nt, Human
acaagaaaugaaa

SEQ ID NO: 555507 - RNA, 15 nt, Human
gccuugggaccccug

SEQ ID NO: 555508 - RNA, 16 nt, Human
uaaaugaaauugaaaa

SEQ ID NO: 555509 - RNA, 16 nt, Human
agguugcagugagccg

SEQ ID NO: 555510 - RNA, 22 nt, Human
ugauaguuguaccgcaauguga

SEQ ID NO: 555511 - RNA, 16 nt, Human
ccuaugcagaggucca

SEQ ID NO: 555512 - RNA, 21 nt, Human
agcaaauauaaacagcaacuu

SEQ ID NO: 555513 - RNA, 14 nt, Human
ugaagauguagagg

SEQ ID NO: 555514 - RNA, 18 nt, Human
ccuugggaccccugagcu

SEQ ID NO: 555515 - RNA, 16 nt, Human
ugaaguacucauacau

SEQ ID NO: 555516 - RNA, 13 nt, Human
gagacagcucugc

SEQ ID NO: 555517 - RNA, 20 nt, Human
uacuucuucucauacuauuu

SEQ ID NO: 555518 - RNA, 14 nt, Human
cugagucccaggcu

SEQ ID NO: 555519 - RNA, 12 nt, Human
cuggcuccagcu

SEQ ID NO: 555520 - RNA, 14 nt, Human
ccagcuggccggga

SEQ ID NO: 555521 - RNA, 19 nt, Human
cuggacucaccucccccau

SEQ ID NO: 555522 - RNA, 15 nt, Human
aucaaaggacaccau

SEQ ID NO: 555523 - RNA, 14 nt, Human
ugaucaccugcccu

SEQ ID NO: 555524 - RNA, 20 nt, Human
auauuuuauaucaauuuaaa

SEQ ID NO: 555525 - RNA, 13 nt, Human
caacucccugccc

SEQ ID NO: 555526 - RNA, 17 nt, Human
cauuaaauauaaagcaa

SEQ ID NO: 555527 - RNA, 21 nt, Human
cucaguccaugaagauguaga

SEQ ID NO: 555528 - RNA, 19 nt, Human
gccccccagcccuccuuau

SEQ ID NO: 555529 - RNA, 18 nt, Human
uuuuauaucaauuuaaaa

SEQ ID NO: 555530 - RNA, 16 nt, Human
cuggccuucggccucc

SEQ ID NO: 555531 - RNA, 14 nt, Human
gagagugaacaaau

SEQ ID NO: 555532 - RNA, 23 nt, Human
ggucucagugucaaugcagcccc

SEQ ID NO: 555533 - RNA, 12 nt, Human
aagagcuuaaca

SEQ ID NO: 555534 - RNA, 22 nt, Human
gacucaccucccccaucucuuc

SEQ ID NO: 555535 - RNA, 14 nt, Human
ugagacucugucuc

SEQ ID NO: 555536 - RNA, 19 nt, Human
ggagccugaucaccugccc

SEQ ID NO: 555537 - RNA, 20 nt, Human
ccaaauguucaucaaugaau

SEQ ID NO: 555538 - RNA, 21 nt, Human
aagacucgggauuaguacaca

SEQ ID NO: 555539 - RNA, 14 nt, Human
ucagucucccuccc

SEQ ID NO: 555540 - RNA, 21 nt, Human
cagcaacuuguguuccuaaca

SEQ ID NO: 555541 - RNA, 14 nt, Human
agauguagaggaga

SEQ ID NO: 555542 - RNA, 16 nt, Human
gccuaagugcagcccc

SEQ ID NO: 555543 - RNA, 14 nt, Human
aaagaggaaugaag

SEQ ID NO: 555544 - RNA, 17 nt, Human
ccuauccuacuuccccu

SEQ ID NO: 555545 - RNA, 22 nt, Human
gaauuucuucaacucccugccc

SEQ ID NO: 555546 - RNA, 21 nt, Human
cgacagugagacucugucuca

SEQ ID NO: 555547 - RNA, 17 nt, Human
acuugaacccauauuug

SEQ ID NO: 555548 - RNA, 23 nt, Human
gcaacuuguguuccuaacaggaa

SEQ ID NO: 555549 - RNA, 19 nt, Human
cuuccuaauuccacagcug

SEQ ID NO: 555550 - RNA, 19 nt, Human
gugacuuaaugccacuaaa

SEQ ID NO: 555551 - RNA, 17 nt, Human
caagaaaugaaagcagg

SEQ ID NO: 555552 - RNA, 18 nt, Human
uucaauaucuuuuuuuua

SEQ ID NO: 555553 - RNA, 13 nt, Human
aaacauccuacaa

SEQ ID NO: 555554 - RNA, 22 nt, Human
aggauggcuaguaucaaaagaa

SEQ ID NO: 555555 - RNA, 19 nt, Human
ggacucaccucccccaucu

SEQ ID NO: 555556 - RNA, 16 nt, Human
acuaguuucccuugca

SEQ ID NO: 555557 - RNA, 16 nt, Human
acauccuacaagacac

SEQ ID NO: 555558 - RNA, 16 nt, Human
gagaaacuggaacucu

SEQ ID NO: 555559 - RNA, 16 nt, Human
ccugcaaagcccagcu

SEQ ID NO: 555560 - RNA, 14 nt, Human
ggacucaccucccc

SEQ ID NO: 555561 - RNA, 18 nt, Human
uuuguuaaaugauuucau

SEQ ID NO: 555562 - RNA, 15 nt, Human
gaaaugaaagcaggg

SEQ ID NO: 555563 - RNA, 22 nt, Human
ccaaacauccuacaagacacag

SEQ ID NO: 555564 - RNA, 15 nt, Human
gaagauguagaggag

SEQ ID NO: 555565 - RNA, 22 nt, Human
cuacuauccaacuuauauuucu

SEQ ID NO: 555566 - RNA, 18 nt, Human
auccuucagccugaaaga

SEQ ID NO: 555567 - RNA, 21 nt, Human
cccacuggacucaccuccccc

SEQ ID NO: 555568 - RNA, 21 nt, Human
gcccugcugagucccaggcug

SEQ ID NO: 555569 - RNA, 17 nt, Human
cuaacaggaauuuucau

SEQ ID NO: 555570 - RNA, 18 nt, Human
uugaaaaugguauuaaag

SEQ ID NO: 555571 - RNA, 20 nt, Human
caagcucuaucaccaaggag

SEQ ID NO: 555572 - RNA, 23 nt, Human
aucucuucuggguuccuuccucu

SEQ ID NO: 555573 - RNA, 20 nt, Human
uugaaaaugguauuaaagau

SEQ ID NO: 555574 - RNA, 14 nt, Human
cagauccccaagcc

SEQ ID NO: 555575 - RNA, 18 nt, Human
ccuucggccuccauccug

SEQ ID NO: 555576 - RNA, 18 nt, Human
ccauccugccccugagcc

SEQ ID NO: 555577 - RNA, 20 nt, Human
acuccagugagacagcucug

SEQ ID NO: 555578 - RNA, 22 nt, Human
ccucccuuggggccuaugcaga

SEQ ID NO: 555579 - RNA, 14 nt, Human
agcaaauauaaaca

SEQ ID NO: 555580 - RNA, 19 nt, Human
cagaaagcagaacagugau

SEQ ID NO: 555581 - RNA, 14 nt, Human
cugaggcuccacuu

SEQ ID NO: 555582 - RNA, 11 nt, Human
ucaccugcccu

SEQ ID NO: 555583 - RNA, 16 nt, Human
ugacuuaaugccacua

SEQ ID NO: 555584 - RNA, 14 nt, Human
agagacagaaagca

SEQ ID NO: 555585 - RNA, 19 nt, Human
uuggcaagcucuaucacca

SEQ ID NO: 555586 - RNA, 15 nt, Human
ccuggugggcagaga

SEQ ID NO: 555587 - RNA, 13 nt, Human
aacaacaacaaca

SEQ ID NO: 555588 - RNA, 16 nt, Human
caugguuuagaaagcu

SEQ ID NO: 555589 - RNA, 12 nt, Human
acucccugcccc

SEQ ID NO: 555590 - RNA, 17 nt, Human
cuauccuacuuccccuu

SEQ ID NO: 555591 - RNA, 19 nt, Human
cccauggcacucuauguuc

SEQ ID NO: 555592 - RNA, 12 nt, Human
aaauauaaagca

SEQ ID NO: 555593 - RNA, 14 nt, Human
ggccuucggccucc

SEQ ID NO: 555594 - RNA, 17 nt, Human
auggcuaguaucaaaag

SEQ ID NO: 555595 - RNA, 22 nt, Human
aacucccugccccccagcccuc

SEQ ID NO: 555596 - RNA, 17 nt, Human
ccucuggcuccagcugg

SEQ ID NO: 555597 - RNA, 17 nt, Human
uccauccugaggcucca

SEQ ID NO: 555598 - RNA, 16 nt, Human
ccacuuauaggaauug

SEQ ID NO: 555599 - RNA, 17 nt, Human
accugagccccaaaagg

SEQ ID NO: 555600 - RNA, 14 nt, Human
cuguaaucacagcu

SEQ ID NO: 555601 - RNA, 14 nt, Human
cuacaagacacagu

SEQ ID NO: 555602 - RNA, 12 nt, Human
uaauuccacagc

SEQ ID NO: 555603 - RNA, 20 nt, Human
ucaaaacuucagacauagaa

SEQ ID NO: 555604 - RNA, 17 nt, Human
cccacuggacucaccuc

SEQ ID NO: 555605 - RNA, 23 nt, Human
uggaaauguuuacagauccccaa

SEQ ID NO: 555606 - RNA, 20 nt, Human
caggcugagccucagucucc

SEQ ID NO: 555607 - RNA, 17 nt, Human
caagacccaaaaggcag

SEQ ID NO: 555608 - RNA, 19 nt, Human
agaugcuagaacucccuuu

SEQ ID NO: 555609 - RNA, 16 nt, Human
ucugcagauaaacagu

SEQ ID NO: 555610 - RNA, 21 nt, Human
ccccugcaaagcccagcuuga

SEQ ID NO: 555611 - RNA, 15 nt, Human
gauccugcaauucca

SEQ ID NO: 555612 - RNA, 20 nt, Human
gggaggcagagguugcagug

SEQ ID NO: 555613 - RNA, 13 nt, Human
cacaacacacaga

SEQ ID NO: 555614 - RNA, 15 nt, Human
ccccugagcuugcag

SEQ ID NO: 555615 - RNA, 14 nt, Human
agaaaugaaagcag

SEQ ID NO: 555616 - RNA, 19 nt, Human
cuuggggccuaugcagagg

SEQ ID NO: 555617 - RNA, 18 nt, Human
auuuaggccaugggacag

SEQ ID NO: 555618 - RNA, 16 nt, Human
cucaauaaaguacaag

SEQ ID NO: 555619 - RNA, 19 nt, Human
ucaguccaugaagauguag

SEQ ID NO: 555620 - RNA, 22 nt, Human
cuucaacucccugccccccagc

SEQ ID NO: 555621 - RNA, 14 nt, Human
uccacuuggucugu

SEQ ID NO: 555622 - RNA, 18 nt, Human
ucuucucauacuauuuaa

SEQ ID NO: 555623 - RNA, 21 nt, Human
auaguuguaccgcaaugugac

SEQ ID NO: 555624 - RNA, 16 nt, Human
cugcacuccagccuga

SEQ ID NO: 555625 - RNA, 15 nt, Human
uguuaaaugauuuca

SEQ ID NO: 555626 - RNA, 16 nt, Human
ccccugcacuccagcc

SEQ ID NO: 555627 - RNA, 15 nt, Human
cccugcaaagcccag

SEQ ID NO: 555628 - RNA, 20 nt, Human
aaaaaccugagccccaaaag

SEQ ID NO: 555629 - RNA, 18 nt, Human
auuugcuggagcucugcc

SEQ ID NO: 555630 - RNA, 13 nt, Human
aucaaugaaugaa

SEQ ID NO: 555631 - RNA, 20 nt, Human
cacagcacgggggccaagga

SEQ ID NO: 555632 - RNA, 21 nt, Human
gucucagugucaaugcagccc

SEQ ID NO: 555633 - RNA, 21 nt, Human
auguuuacagauccccaagcc

SEQ ID NO: 555634 - RNA, 16 nt, Human
accuuacuucuucuca

SEQ ID NO: 555635 - RNA, 17 nt, Human
ccaaggaugccccgucc

SEQ ID NO: 555636 - RNA, 19 nt, Human
caaggaugccccguccccc

SEQ ID NO: 555637 - RNA, 19 nt, Human
ccccuauccuacuuccccu

SEQ ID NO: 555638 - RNA, 15 nt, Human
uccuacaagacacag

SEQ ID NO: 555639 - RNA, 17 nt, Human
ccugagcuugcagagau

SEQ ID NO: 555640 - RNA, 12 nt, Human
aaugcagccccc

SEQ ID NO: 555641 - RNA, 20 nt, Human
uccaagccucauguccacug

SEQ ID NO: 555642 - RNA, 22 nt, Human
gaacaagcaaauauaaacagca

SEQ ID NO: 555643 - RNA, 12 nt, Human
acaugagguacu

SEQ ID NO: 555644 - RNA, 16 nt, Human
cccacuggacucaccu

SEQ ID NO: 555645 - RNA, 16 nt, Human
agcuugaaaccuucac

SEQ ID NO: 555646 - RNA, 19 nt, Human
cucugcauacucauuagga

SEQ ID NO: 555647 - RNA, 14 nt, Human
aagcaacccaaaug

SEQ ID NO: 555648 - RNA, 18 nt, Human
ucuucaacucccugcccc

SEQ ID NO: 555649 - RNA, 20 nt, Human
aaggaugccccgucccccuc

SEQ ID NO: 555650 - RNA, 17 nt, Human
cuccuuaucaaaggaca

SEQ ID NO: 555651 - RNA, 13 nt, Human
aucaggcuggcca

SEQ ID NO: 555652 - RNA, 21 nt, Human
aucuuuuuuuuaauaaaccau

SEQ ID NO: 555653 - RNA, 15 nt, Human
uugacccacaagaaa

SEQ ID NO: 555654 - RNA, 15 nt, Human
gcagagguugcagug

SEQ ID NO: 555655 - RNA, 21 nt, Human
ugcucaauaaaguacaagagc

SEQ ID NO: 555656 - RNA, 18 nt, Human
caaggcuagaaccaccug

SEQ ID NO: 555657 - RNA, 22 nt, Human
gagccucagucucccucccuug

SEQ ID NO: 555658 - RNA, 20 nt, Human
gaacguaaucguguccccua

SEQ ID NO: 555659 - RNA, 17 nt, Human
gccugagcgacagugag

SEQ ID NO: 555660 - RNA, 15 nt, Human
gccucagucucccuc

SEQ ID NO: 555661 - RNA, 19 nt, Human
guacaagagcuuaacagug

SEQ ID NO: 555662 - RNA, 20 nt, Human
uugaacccgggaggcagagg

SEQ ID NO: 555663 - RNA, 15 nt, Human
auccaacuuauauuu

SEQ ID NO: 555664 - RNA, 14 nt, Human
cucaccccuugcca

SEQ ID NO: 555665 - RNA, 21 nt, Human
caacaacaaaagcgauuauua

SEQ ID NO: 555666 - RNA, 13 nt, Human
uguauauuuuaua

SEQ ID NO: 555667 - RNA, 23 nt, Human
aaauuuacagagacagaaagcag

SEQ ID NO: 555668 - RNA, 22 nt, Human
cauacuauuuaagagaacaagc

SEQ ID NO: 555669 - RNA, 19 nt, Human
ccaccugccuauauuuuuu

SEQ ID NO: 555670 - RNA, 21 nt, Human
caaagcccagcuugaaaccuu

SEQ ID NO: 555671 - RNA, 23 nt, Human
cucauacuauuuaagagaacaag

SEQ ID NO: 555672 - RNA, 18 nt, Human
acagagacagaaagcaga

SEQ ID NO: 555673 - RNA, 12 nt, Human
ucugcacacagc

SEQ ID NO: 555674 - RNA, 18 nt, Human
ccugccuaagugcagccc

SEQ ID NO: 555675 - RNA, 19 nt, Human
uacuauccaacuuauauuu

SEQ ID NO: 555676 - RNA, 16 nt, Human
ucaucaaugaaugaau

SEQ ID NO: 555677 - RNA, 22 nt, Human
ccccuuccuaauuccacagcug

SEQ ID NO: 555678 - RNA, 23 nt, Human
aauguagcagcucauaaaugaaa

SEQ ID NO: 555679 - RNA, 19 nt, Human
uuuauaucaauuuaaaaaa

SEQ ID NO: 555680 - RNA, 18 nt, Human
uccuaauuccacagcugc

SEQ ID NO: 555681 - RNA, 15 nt, Human
cuggacucaccuccc

SEQ ID NO: 555682 - RNA, 10 nt, Human
accugagccc

SEQ ID NO: 555683 - RNA, 22 nt, Human
agcccuccuuaucaaaggacac

SEQ ID NO: 555684 - RNA, 16 nt, Human
uguucuaagaagugaa

SEQ ID NO: 555685 - RNA, 14 nt, Human
ccugccccccagcc

SEQ ID NO: 555686 - RNA, 19 nt, Human
agcucugcccauccugccc

SEQ ID NO: 555687 - RNA, 16 nt, Human
gaagauguagaggaga

SEQ ID NO: 555688 - RNA, 20 nt, Human
uaggaauugacccacaagaa

SEQ ID NO: 555689 - RNA, 12 nt, Human
acaagacacagu

SEQ ID NO: 555690 - RNA, 21 nt, Human
acgcucucuggccuucggccu

SEQ ID NO: 555691 - RNA, 21 nt, Human
guccccuauccuacuuccccu

SEQ ID NO: 555692 - RNA, 19 nt, Human
agccugaucaccugcccug

SEQ ID NO: 555693 - RNA, 15 nt, Human
cuuacuucuucucau

SEQ ID NO: 555694 - RNA, 19 nt, Human
agacucgggauuaguacac

SEQ ID NO: 555695 - RNA, 22 nt, Human
ggguuccuuccucugagccuug

SEQ ID NO: 555696 - RNA, 15 nt, Human
ucugcagauaaacag

SEQ ID NO: 555697 - RNA, 15 nt, Human
cuacaagacacagug

SEQ ID NO: 555698 - RNA, 18 nt, Human
uguggucacaggaaguag

SEQ ID NO: 555699 - RNA, 17 nt, Human
uuacagagacagaaagc

SEQ ID NO: 555700 - RNA, 12 nt, Human
aaggaugccccg

SEQ ID NO: 555701 - RNA, 14 nt, Human
gauuaguacacacu

SEQ ID NO: 555702 - RNA, 15 nt, Human
cugcacuccagccug

SEQ ID NO: 555703 - RNA, 19 nt, Human
gagccugaucaccugcccu

SEQ ID NO: 555704 - RNA, 16 nt, Human
aaugaaagcagggacu

SEQ ID NO: 555705 - RNA, 21 nt, Human
ccucuguucugcacacagcac

SEQ ID NO: 555706 - RNA, 22 nt, Human
gaaauaagccagacaucaacag

SEQ ID NO: 555707 - RNA, 23 nt, Human
auaucuuuuuuuuaauaaaccau

SEQ ID NO: 555708 - RNA, 12 nt, Human
aucguguccccu

SEQ ID NO: 555709 - RNA, 12 nt, Human
accccugagcuu

SEQ ID NO: 555710 - RNA, 19 nt, Human
auuuaagagaacaagcaaa

SEQ ID NO: 555711 - RNA, 23 nt, Human
cuucaacucccugccccccagcc

SEQ ID NO: 555712 - RNA, 15 nt, Human
cccugccccccagcc

SEQ ID NO: 555713 - RNA, 17 nt, Human
uaauuccacagcugcuc

SEQ ID NO: 555714 - RNA, 12 nt, Human
cuuccucugagc

SEQ ID NO: 555715 - RNA, 14 nt, Human
cugcaaagcccagc

SEQ ID NO: 555716 - RNA, 14 nt, Human
aaccugagccccaa

SEQ ID NO: 555717 - RNA, 20 nt, Human
aauaucuuuuuuuuaauaaa

SEQ ID NO: 555718 - RNA, 12 nt, Human
gcaaagcccagc

SEQ ID NO: 555719 - RNA, 22 nt, Human
cuccugccuaagugcagccccg

SEQ ID NO: 555720 - RNA, 17 nt, Human
uccacaacacacagauu

SEQ ID NO: 555721 - RNA, 22 nt, Human
uuccccuuccuaauuccacagc

SEQ ID NO: 555722 - RNA, 19 nt, Human
ugaacaaauuuacagagac

SEQ ID NO: 555723 - RNA, 16 nt, Human
cugcugagucccaggc

SEQ ID NO: 555724 - RNA, 16 nt, Human
gaauggcuaagcaaaa

SEQ ID NO: 555725 - RNA, 23 nt, Human
acguaaucguguccccuauccua

SEQ ID NO: 555726 - RNA, 14 nt, Human
aucaaaagaaagaa

SEQ ID NO: 555727 - RNA, 17 nt, Human
cccacuagacccacugg

SEQ ID NO: 555728 - RNA, 15 nt, Human
acaagacccaaaagg

SEQ ID NO: 555729 - RNA, 17 nt, Human
cugagaugggagaauca

SEQ ID NO: 555730 - RNA, 11 nt, Human
accauuuuuac

SEQ ID NO: 555731 - RNA, 21 nt, Human
acagugauuaccagggacuga

SEQ ID NO: 555732 - RNA, 12 nt, Human
acacuuaaaaau

SEQ ID NO: 555733 - RNA, 18 nt, Human
cucccuuggggccuaugc

SEQ ID NO: 555734 - RNA, 17 nt, Human
agugauuaccagggacu

SEQ ID NO: 555735 - RNA, 18 nt, Human
cuccauccugaggcucca

SEQ ID NO: 555736 - RNA, 19 nt, Human
caaauauaaacagcaacuu

SEQ ID NO: 555737 - RNA, 17 nt, Human
gccaugggacagggagg

SEQ ID NO: 555738 - RNA, 16 nt, Human
cacuggacucaccucc

SEQ ID NO: 555739 - RNA, 17 nt, Human
gccuaagugcagccccg

SEQ ID NO: 555740 - RNA, 18 nt, Human
cccaggcugagccucagu

SEQ ID NO: 555741 - RNA, 19 nt, Human
ccauccugccccugagccc

SEQ ID NO: 555742 - RNA, 16 nt, Human
uguucuauaacaacaa

SEQ ID NO: 555743 - RNA, 15 nt, Human
ucugucucaguccau

SEQ ID NO: 555744 - RNA, 16 nt, Human
cuagaacucccuuuca

SEQ ID NO: 555745 - RNA, 13 nt, Human
ucuauaacaacaa

SEQ ID NO: 555746 - RNA, 16 nt, Human
uauguucuaagaagug

SEQ ID NO: 555747 - RNA, 12 nt, Human
gucccaggcuga

SEQ ID NO: 555748 - RNA, 15 nt, Human
aauauaaacagcaac

SEQ ID NO: 555749 - RNA, 20 nt, Human
acaagacccaaaaggcagaa

SEQ ID NO: 555750 - RNA, 18 nt, Human
aagggaauuucuucaacu

SEQ ID NO: 555751 - RNA, 15 nt, Human
gacucaccuccccca

SEQ ID NO: 555752 - RNA, 13 nt, Human
cuuaucaaaggac

SEQ ID NO: 555753 - RNA, 17 nt, Human
agaaucacuugaacccg

SEQ ID NO: 555754 - RNA, 21 nt, Human
ccucccuuggggccuaugcag

SEQ ID NO: 555755 - RNA, 15 nt, Human
cugcagauaaacagu

SEQ ID NO: 555756 - RNA, 20 nt, Human
agaggagaaacuggaacucu

SEQ ID NO: 555757 - RNA, 18 nt, Human
cuuccucugagccuuggg

SEQ ID NO: 555758 - RNA, 19 nt, Human
aaucuacacuccagugaga

SEQ ID NO: 555759 - RNA, 15 nt, Human
agcucuaucaccaag

SEQ ID NO: 555760 - RNA, 18 nt, Human
caaggcugauuaaaccaa

SEQ ID NO: 555761 - RNA, 13 nt, Human
ccccagcccuccu

SEQ ID NO: 555762 - RNA, 14 nt, Human
uugcuggagcucug

SEQ ID NO: 555763 - RNA, 15 nt, Human
cauguccacugguuc

SEQ ID NO: 555764 - RNA, 15 nt, Human
ucccccaucucuucu

SEQ ID NO: 555765 - RNA, 21 nt, Human
auucauagcagcuuauucaca

SEQ ID NO: 555766 - RNA, 13 nt, Human
ucuaagaagugaa

SEQ ID NO: 555767 - RNA, 21 nt, Human
gaagugaaaaucuacacucca

SEQ ID NO: 555768 - RNA, 18 nt, Human
ugaaaaaguucugcagau

SEQ ID NO: 555769 - RNA, 18 nt, Human
uaaauugacacuuaaaaa

SEQ ID NO: 555770 - RNA, 21 nt, Human
cagugagacagcucugcauac

SEQ ID NO: 555771 - RNA, 15 nt, Human
cacuuggucugugag

SEQ ID NO: 555772 - RNA, 13 nt, Human
cugagagugaaca

SEQ ID NO: 555773 - RNA, 18 nt, Human
cagcugcucaauaaagua

SEQ ID NO: 555774 - RNA, 16 nt, Human
uggucugugagaugcu

SEQ ID NO: 555775 - RNA, 16 nt, Human
caugggacagggagga

SEQ ID NO: 555776 - RNA, 14 nt, Human
ccuuaucaaaggac

SEQ ID NO: 555777 - RNA, 15 nt, Human
ccucagucucccucc

SEQ ID NO: 555778 - RNA, 21 nt, Human
gaaagcagggacuugaaccca

SEQ ID NO: 555779 - RNA, 22 nt, Human
ccauacuaauuauacccccugc

SEQ ID NO: 555780 - RNA, 15 nt, Human
cugaaagaggaauga

SEQ ID NO: 555781 - RNA, 16 nt, Human
aucaaaagaaagaaaa

SEQ ID NO: 555782 - RNA, 14 nt, Human
gagcccauggcacu

SEQ ID NO: 555783 - RNA, 22 nt, Human
caguauggcagcuuuccucaaa

SEQ ID NO: 555784 - RNA, 17 nt, Human
aaacauccuacaagaca

SEQ ID NO: 555785 - RNA, 23 nt, Human
agccuugggaccccugagcuugc

SEQ ID NO: 555786 - RNA, 15 nt, Human
uauaaagcaagauaa

SEQ ID NO: 555787 - RNA, 20 nt, Human
uccagccugagcgacaguga

SEQ ID NO: 555788 - RNA, 14 nt, Human
cucuggcuccagcu

SEQ ID NO: 555789 - RNA, 17 nt, Human
gcaagcucuaucaccaa

SEQ ID NO: 555790 - RNA, 21 nt, Human
auggcagcuuuccucaaaacu

SEQ ID NO: 555791 - RNA, 22 nt, Human
caagcucuaucaccaaggagcc

SEQ ID NO: 555792 - RNA, 19 nt, Human
ugcacacagcacgggggcc

SEQ ID NO: 555793 - RNA, 17 nt, Human
cuacacuccagugagac

SEQ ID NO: 555794 - RNA, 20 nt, Human
uaagaaucuuuauaguucua

SEQ ID NO: 555795 - RNA, 17 nt, Human
cuuucccaacagcucca

SEQ ID NO: 555796 - RNA, 17 nt, Human
cccccugcaaagcccag

SEQ ID NO: 555797 - RNA, 15 nt, Human
auaucaauuuaaaaa

SEQ ID NO: 555798 - RNA, 18 nt, Human
gaggcuccacuuggucug

SEQ ID NO: 555799 - RNA, 19 nt, Human
caacaaaagcgauuauuau

SEQ ID NO: 555800 - RNA, 19 nt, Human
cugagccucagucucccuc

SEQ ID NO: 555801 - RNA, 16 nt, Human
ccuggugggcagagag

SEQ ID NO: 555802 - RNA, 15 nt, Human
gcaagcucuaucacc

SEQ ID NO: 555803 - RNA, 22 nt, Human
aggcuccacuuggucugugaga

SEQ ID NO: 555804 - RNA, 16 nt, Human
ggcagagagguaggga

SEQ ID NO: 555805 - RNA, 21 nt, Human
cuggccuucggccuccauccu

SEQ ID NO: 555806 - RNA, 16 nt, Human
ccacuuggucugugag

SEQ ID NO: 555807 - RNA, 15 nt, Human
acaggguuuauguuu

SEQ ID NO: 555808 - RNA, 12 nt, Human
cuacaagacaca

SEQ ID NO: 555809 - RNA, 13 nt, Human
agacagcucugca

SEQ ID NO: 555810 - RNA, 17 nt, Human
uccucugagccuuggga

SEQ ID NO: 555811 - RNA, 14 nt, Human
uaguaucaaaagaa

SEQ ID NO: 555812 - RNA, 15 nt, Human
ugggacagggaggac

SEQ ID NO: 555813 - RNA, 15 nt, Human
aaagaaagaaaauca

SEQ ID NO: 555814 - RNA, 14 nt, Human
cugcugagucccag

SEQ ID NO: 555815 - RNA, 14 nt, Human
aauggcuaagcaaa

SEQ ID NO: 555816 - RNA, 21 nt, Human
aaaagguauuuuaaucaccaa

SEQ ID NO: 555817 - RNA, 12 nt, Human
ggaggcugagau

SEQ ID NO: 555818 - RNA, 19 nt, Human
acagugauuaccagggacu

SEQ ID NO: 555819 - RNA, 19 nt, Human
cccugcaaagcccagcuug

SEQ ID NO: 555820 - RNA, 17 nt, Human
cugcacuccagccugag

SEQ ID NO: 555821 - RNA, 20 nt, Human
ggagccugaucaccugcccu

SEQ ID NO: 555822 - RNA, 19 nt, Human
acucugucucaguccauga

SEQ ID NO: 555823 - RNA, 17 nt, Human
ccugccccccagcccuc

SEQ ID NO: 555824 - RNA, 19 nt, Human
auuuacagagacagaaagc

SEQ ID NO: 555825 - RNA, 22 nt, Human
cuccagccugagcgacagugag

SEQ ID NO: 555826 - RNA, 17 nt, Human
cucagucucccucccuu

SEQ ID NO: 555827 - RNA, 19 nt, Human
caacuuauauuucugcuuu

SEQ ID NO: 555828 - RNA, 17 nt, Human
uuaaauggucaauuuug

SEQ ID NO: 555829 - RNA, 20 nt, Human
acaagcaaauauaaacagca

SEQ ID NO: 555830 - RNA, 21 nt, Human
uuucauuguucuauaacaaca

SEQ ID NO: 555831 - RNA, 19 nt, Human
acgaugggcuuucccaaca

SEQ ID NO: 555832 - RNA, 20 nt, Human
gauugugccccugcacucca

SEQ ID NO: 555833 - RNA, 16 nt, Human
cugaucaccugcccug

SEQ ID NO: 555834 - RNA, 23 nt, Human
aucacagcuacuugggaggcuga

SEQ ID NO: 555835 - RNA, 18 nt, Human
aaaaguucugcagauaaa

SEQ ID NO: 555836 - RNA, 16 nt, Human
uggcaagcucuaucac

SEQ ID NO: 555837 - RNA, 15 nt, Human
cucccugccccccag

SEQ ID NO: 555838 - RNA, 19 nt, Human
uuccucccuucucuucaca

SEQ ID NO: 555839 - RNA, 16 nt, Human
cucagcccuggugggc

SEQ ID NO: 555840 - RNA, 17 nt, Human
uaucuuuuuuuuaauaa

SEQ ID NO: 555841 - RNA, 15 nt, Human
accucccccaucucu

SEQ ID NO: 555842 - RNA, 13 nt, Human
gcucucuggccuu

SEQ ID NO: 555843 - RNA, 13 nt, Human
acaagagcuuaac

SEQ ID NO: 555844 - RNA, 18 nt, Human
cagauuugagcucagccc

SEQ ID NO: 555845 - RNA, 22 nt, Human
caccucccccaucucuucuggg

SEQ ID NO: 555846 - RNA, 14 nt, Human
ugagcucagcccug

SEQ ID NO: 555847 - RNA, 14 nt, Human
caagcaaauauaaa

SEQ ID NO: 555848 - RNA, 22 nt, Human
gugugaccacugcagaagacag

SEQ ID NO: 555849 - RNA, 18 nt, Human
agugucaaugcagccccc

SEQ ID NO: 555850 - RNA, 17 nt, Human
acccacuggacucaccu

SEQ ID NO: 555851 - RNA, 19 nt, Human
ccgggcgugguggugagug

SEQ ID NO: 555852 - RNA, 18 nt, Human
uaguaucaaaagaaagaa

SEQ ID NO: 555853 - RNA, 13 nt, Human
gcuggagcucugc

SEQ ID NO: 555854 - RNA, 20 nt, Human
ccugccuaagugcagccccg

SEQ ID NO: 555855 - RNA, 19 nt, Human
ccugccuaagugcagcccc

SEQ ID NO: 555856 - RNA, 10 nt, Human
caacucccug

SEQ ID NO: 555857 - RNA, 18 nt, Human
agauccccaagccuggca

SEQ ID NO: 555858 - RNA, 14 nt, Human
acuacuauccaacu

SEQ ID NO: 555859 - RNA, 19 nt, Human
cagcuacuugggaggcuga

SEQ ID NO: 555860 - RNA, 15 nt, Human
uccaccuuacuucuu

SEQ ID NO: 555861 - RNA, 15 nt, Human
gccccugcacuccag

SEQ ID NO: 555862 - RNA, 19 nt, Human
cccugccccccagcccucc

SEQ ID NO: 555863 - RNA, 18 nt, Human
cccacuggacucaccucc

SEQ ID NO: 555864 - RNA, 15 nt, Human
ugauuucauucaaua

SEQ ID NO: 555865 - RNA, 17 nt, Human
agaacucccuuucaaca

SEQ ID NO: 555866 - RNA, 16 nt, Human
augcuaagugaaauaa

SEQ ID NO: 555867 - RNA, 17 nt, Human
uuccaagccucaugucc

SEQ ID NO: 555868 - RNA, 14 nt, Human
cuggagcucugccc

SEQ ID NO: 555869 - RNA, 17 nt, Human
ccacugcagaagacagu

SEQ ID NO: 555870 - RNA, 23 nt, Human
ugcagagguccacaacacacaga

SEQ ID NO: 555871 - RNA, 23 nt, Human
ccccucuggcuccagcuggccgg

SEQ ID NO: 555872 - RNA, 13 nt, Human
aagcaaauauaaa

SEQ ID NO: 555873 - RNA, 13 nt, Human
ucuacuaaaaaua

SEQ ID NO: 555874 - RNA, 12 nt, Human
cuaagaagugaa

SEQ ID NO: 555875 - RNA, 21 nt, Human
cccccucuggcuccagcuggc

SEQ ID NO: 555876 - RNA, 21 nt, Human
uuccuaauuccacagcugcuc

SEQ ID NO: 555877 - RNA, 16 nt, Human
cuccaccuuacuucuu

SEQ ID NO: 555878 - RNA, 14 nt, Human
aauauaaagcaaga

SEQ ID NO: 555879 - RNA, 17 nt, Human
gccccccagcccuccuu

SEQ ID NO: 555880 - RNA, 15 nt, Human
uggacucaccucccc

SEQ ID NO: 555881 - RNA, 14 nt, Human
gaaagcagaacagu

SEQ ID NO: 555882 - RNA, 17 nt, Human
agagacagaaagcagaa

SEQ ID NO: 555883 - RNA, 21 nt, Human
ugagcucagcccuggugggca

SEQ ID NO: 555884 - RNA, 14 nt, Human
acuuggucugugag

SEQ ID NO: 555885 - RNA, 16 nt, Human
cugagcgacagugaga

SEQ ID NO: 555886 - RNA, 22 nt, Human
acauccuacaagacacagugac

SEQ ID NO: 555887 - RNA, 20 nt, Human
acggacgaaccuugaaaacu

SEQ ID NO: 555888 - RNA, 13 nt, Human
gguccacaacaca

SEQ ID NO: 555889 - RNA, 16 nt, Human
ccccaucucuucuggg

SEQ ID NO: 555890 - RNA, 14 nt, Human
cucagucucccucc

SEQ ID NO: 555891 - RNA, 16 nt, Human
ccugagcuugcagaga

SEQ ID NO: 555892 - RNA, 21 nt, Human
cugcccugcugagucccaggc

SEQ ID NO: 555893 - RNA, 16 nt, Human
uggggauagugaggca

SEQ ID NO: 555894 - RNA, 22 nt, Human
aaaaaaccugagccccaaaagg

SEQ ID NO: 555895 - RNA, 17 nt, Human
uccuacaagacacagug

SEQ ID NO: 555896 - RNA, 22 nt, Human
cagcacgggggccaaggaugcc

SEQ ID NO: 555897 - RNA, 14 nt, Human
gagcucagcccugg

SEQ ID NO: 555898 - RNA, 23 nt, Human
acucuauguucuaagaagugaaa

SEQ ID NO: 555899 - RNA, 15 nt, Human
gacagggaggacgcu

SEQ ID NO: 555900 - RNA, 12 nt, Human
gguauuuuaauc

SEQ ID NO: 555901 - RNA, 18 nt, Human
uaaauauaaagcaagaua

SEQ ID NO: 555902 - RNA, 19 nt, Human
cuucuggguuccuuccucu

SEQ ID NO: 555903 - RNA, 14 nt, Human
aauauaaacagcaa

SEQ ID NO: 555904 - RNA, 15 nt, Human
uuacagagacagaaa

SEQ ID NO: 555905 - RNA, 18 nt, Human
caugaagauguagaggag

SEQ ID NO: 555906 - RNA, 17 nt, Human
ucgggauuaguacacac

SEQ ID NO: 555907 - RNA, 21 nt, Human
accaccugccuauauuuuuug

SEQ ID NO: 555908 - RNA, 16 nt, Human
auacauguuacaacac

SEQ ID NO: 555909 - RNA, 22 nt, Human
ccgggagccugaucaccugccc

SEQ ID NO: 555910 - RNA, 11 nt, Human
auaacaacaac

SEQ ID NO: 555911 - RNA, 21 nt, Human
aagagaacaagcaaauauaaa

SEQ ID NO: 555912 - RNA, 16 nt, Human
agccucagucucccuc

SEQ ID NO: 555913 - RNA, 19 nt, Human
caacucccugccccccagc

SEQ ID NO: 555914 - RNA, 22 nt, Human
uaagagaacaagcaaauauaaa

SEQ ID NO: 555915 - RNA, 18 nt, Human
cuacuccauuaaauauaa

SEQ ID NO: 555916 - RNA, 20 nt, Human
caaauguucaucaaugaaug

SEQ ID NO: 555917 - RNA, 19 nt, Human
auuucuucaacucccugcc

SEQ ID NO: 555918 - RNA, 17 nt, Human
uccugccccugagccca

SEQ ID NO: 555919 - RNA, 13 nt, Human
acggggugaaacc

SEQ ID NO: 555920 - RNA, 21 nt, Human
augucauuugcuggagcucug

SEQ ID NO: 555921 - RNA, 22 nt, Human
uacaugagguacugagagugaa

SEQ ID NO: 555922 - RNA, 18 nt, Human
acuuuaugcuaagugaaa

SEQ ID NO: 555923 - RNA, 22 nt, Human
ucuacuccauuaaauauaaagc

SEQ ID NO: 555924 - RNA, 17 nt, Human
cugaucaccugcccugc

SEQ ID NO: 555925 - RNA, 22 nt, Human
acuccauuaaauauaaagcaag

SEQ ID NO: 555926 - RNA, 16 nt, Human
cuucggccuccauccu

SEQ ID NO: 555927 - RNA, 22 nt, Human
cucagcccuggugggcagagag

SEQ ID NO: 555928 - RNA, 17 nt, Human
ccuacuuccccuuccua

SEQ ID NO: 555929 - RNA, 21 nt, Human
caagacccaaaaggcagaagc

SEQ ID NO: 555930 - RNA, 18 nt, Human
caacuuguguuccuaaca

SEQ ID NO: 555931 - RNA, 20 nt, Human
aggcugagaugggagaauca

SEQ ID NO: 555932 - RNA, 13 nt, Human
gauuguaaaaugg

SEQ ID NO: 555933 - RNA, 22 nt, Human
uggguuccuuccucugagccuu

SEQ ID NO: 555934 - RNA, 19 nt, Human
ugagcgcccacuagaccca

SEQ ID NO: 555935 - RNA, 23 nt, Human
cauuguggucacaggaaguagag

SEQ ID NO: 555936 - RNA, 23 nt, Human
uuuaagagaacaagcaaauauaa

SEQ ID NO: 555937 - RNA, 15 nt, Human
gcaacccaaauguuc

SEQ ID NO: 555938 - RNA, 16 nt, Human
ccucaaaacuucagac

SEQ ID NO: 555939 - RNA, 15 nt, Human
cauuccaagccucau

SEQ ID NO: 555940 - RNA, 20 nt, Human
cccugccccccagcccuccu

SEQ ID NO: 555941 - RNA, 14 nt, Human
cccugccccccagc

SEQ ID NO: 555942 - RNA, 20 nt, Human
ugagucccaggcugagccuc

SEQ ID NO: 555943 - RNA, 16 nt, Human
gaaaaugguauuaaag

SEQ ID NO: 555944 - RNA, 14 nt, Human
agcucuaucaccaa

SEQ ID NO: 555945 - RNA, 22 nt, Human
gaagugaaaaucuacacuccag

SEQ ID NO: 555946 - RNA, 16 nt, Human
ucuucaacucccugcc

SEQ ID NO: 555947 - RNA, 23 nt, Human
cacaagaaaugaaagcagggacu

SEQ ID NO: 555948 - RNA, 15 nt, Human
ucuggcuccagcugg

SEQ ID NO: 555949 - RNA, 20 nt, Human
gcccauccugccccugagcc

SEQ ID NO: 555950 - RNA, 19 nt, Human
auguuuacagauccccaag

SEQ ID NO: 555951 - RNA, 13 nt, Human
agagguccacaac

SEQ ID NO: 555952 - RNA, 14 nt, Human
cacaagaaaugaaa

SEQ ID NO: 555953 - RNA, 19 nt, Human
agcaucucauuuauaaugu

SEQ ID NO: 555954 - RNA, 20 nt, Human
ggccaugggacagggaggac

SEQ ID NO: 555955 - RNA, 18 nt, Human
ugggcacaggguuuaugu

SEQ ID NO: 555956 - RNA, 21 nt, Human
auccccaagccuggcaaggga

SEQ ID NO: 555957 - RNA, 18 nt, Human
ugagcucagcccuggugg

SEQ ID NO: 555958 - RNA, 16 nt, Human
uccugcaauuccacuu

SEQ ID NO: 555959 - RNA, 15 nt, Human
ccgucccccucuggc

SEQ ID NO: 555960 - RNA, 16 nt, Human
cuuuaugcuaagugaa

SEQ ID NO: 555961 - RNA, 13 nt, Human
caagcaaauauaa

SEQ ID NO: 555962 - RNA, 18 nt, Human
cagaaagcagaacaguga

SEQ ID NO: 555963 - RNA, 13 nt, Human
agcgacagugaga

SEQ ID NO: 555964 - RNA, 20 nt, Human
gccgggcgugguggugagug

SEQ ID NO: 555965 - RNA, 21 nt, Human
cagagguccacaacacacaga

SEQ ID NO: 555966 - RNA, 15 nt, Human
cuaagugcagccccg

SEQ ID NO: 555967 - RNA, 18 nt, Human
cagggaggacgcucucug

SEQ ID NO: 555968 - RNA, 16 nt, Human
ucccugccccccagcc

SEQ ID NO: 555969 - RNA, 12 nt, Human
cucccugccccc

SEQ ID NO: 555970 - RNA, 14 nt, Human
gcugauuaaaccaa

SEQ ID NO: 555971 - RNA, 18 nt, Human
cccucuggcuccagcugg

SEQ ID NO: 555972 - RNA, 16 nt, Human
ccugagcgacagugag

SEQ ID NO: 555973 - RNA, 18 nt, Human
gcccuggugggcagagag

SEQ ID NO: 555974 - RNA, 17 nt, Human
agaugggagaaucacuu

SEQ ID NO: 555975 - RNA, 16 nt, Human
agugagacagcucugc

SEQ ID NO: 555976 - RNA, 14 nt, Human
uuagagcaucucau

SEQ ID NO: 555977 - RNA, 13 nt, Human
acacuuaaaaaug

SEQ ID NO: 555978 - RNA, 16 nt, Human
aaagaucugcaacuac

SEQ ID NO: 555979 - RNA, 13 nt, Human
ccugccccccagc

SEQ ID NO: 555980 - RNA, 23 nt, Human
uauaguucuacuccauuaaauau

SEQ ID NO: 555981 - RNA, 13 nt, Human
uuaugcuaaguga

SEQ ID NO: 555982 - RNA, 16 nt, Human
uguccccuauccuacu

SEQ ID NO: 555983 - RNA, 15 nt, Human
accaaggcugauuaa

SEQ ID NO: 555984 - RNA, 19 nt, Human
cuaguaucaaaagaaagaa

SEQ ID NO: 555985 - RNA, 18 nt, Human
gccuucggccuccauccu

SEQ ID NO: 555986 - RNA, 23 nt, Human
gaaauugaaaaugguauuaaaga

SEQ ID NO: 555987 - RNA, 16 nt, Human
ugacacuuaaaaaugg

SEQ ID NO: 555988 - RNA, 17 nt, Human
agcucugcccauccugc

SEQ ID NO: 555989 - RNA, 17 nt, Human
auguuuacagaucccca

SEQ ID NO: 555990 - RNA, 13 nt, Human
ccaacuuauauuu

SEQ ID NO: 555991 - RNA, 17 nt, Human
aaauguucaucaaugaa

SEQ ID NO: 555992 - RNA, 15 nt, Human
ccugccccccagccc

SEQ ID NO: 555993 - RNA, 17 nt, Human
cuggacucaccuccccc

SEQ ID NO: 555994 - RNA, 14 nt, Human
aagaaucuuuauag

SEQ ID NO: 555995 - RNA, 20 nt, Human
cuuauauuucugcuuucaaa

SEQ ID NO: 555996 - RNA, 16 nt, Human
gaaucacuugaacccg

SEQ ID NO: 555997 - RNA, 17 nt, Human
auaaaguacaagagcuu

SEQ ID NO: 555998 - RNA, 16 nt, Human
cuagaaccaccugccu

SEQ ID NO: 555999 - RNA, 23 nt, Human
caccaaggagccaaacauccuac

SEQ ID NO: 556000 - RNA, 16 nt, Human
cugagccucagucucc

SEQ ID NO: 556001 - RNA, 17 nt, Human
gacucaccucccccauc

SEQ ID NO: 556002 - RNA, 14 nt, Human
cacuuauaggaauu

SEQ ID NO: 556003 - RNA, 14 nt, Human
uauaauguagcagc

SEQ ID NO: 556004 - RNA, 23 nt, Human
gaggcauuuaggccaugggacag

SEQ ID NO: 556005 - RNA, 20 nt, Human
cuacuuccccuuccuaauuc

SEQ ID NO: 556006 - RNA, 20 nt, Human
cugcacacagcacgggggcc

SEQ ID NO: 556007 - RNA, 15 nt, Human
ugccccgucccccuc

SEQ ID NO: 556008 - RNA, 23 nt, Human
agcucugcccauccugccccuga

SEQ ID NO: 556009 - RNA, 15 nt, Human
uuaaauauaaagcaa

SEQ ID NO: 556010 - RNA, 18 nt, Human
gagucccaggcugagccu

SEQ ID NO: 556011 - RNA, 19 nt, Human
aaugaauggcuaagcaaaa

SEQ ID NO: 556012 - RNA, 20 nt, Human
uuaagagaacaagcaaauau

SEQ ID NO: 556013 - RNA, 13 nt, Human
cugcacuccagcc

SEQ ID NO: 556014 - RNA, 18 nt, Human
aaacagcaacuuguguuc

SEQ ID NO: 556015 - RNA, 20 nt, Human
aauaagccagacaucaacag

SEQ ID NO: 556016 - RNA, 16 nt, Human
cagauccccaagccug

SEQ ID NO: 556017 - RNA, 20 nt, Human
augguuuagaaagcuugccc

SEQ ID NO: 556018 - RNA, 15 nt, Human
guucugcagauaaac

SEQ ID NO: 556019 - RNA, 21 nt, Human
cacuugaacccgggaggcaga

SEQ ID NO: 556020 - RNA, 20 nt, Human
cucuguucugcacacagcac

SEQ ID NO: 556021 - RNA, 22 nt, Human
cucuggccuucggccuccaucc

SEQ ID NO: 556022 - RNA, 20 nt, Human
cugcacuccagccugagcga

SEQ ID NO: 556023 - RNA, 22 nt, Human
guguccccuauccuacuucccc

SEQ ID NO: 556024 - RNA, 16 nt, Human
ugagaugcuagaacuc

SEQ ID NO: 556025 - RNA, 21 nt, Human
ugcccauccugccccugagcc

SEQ ID NO: 556026 - RNA, 19 nt, Human
cucaccucccccaucucuu

SEQ ID NO: 556027 - RNA, 17 nt, Human
gaaaaucaggcuggcca

SEQ ID NO: 556028 - RNA, 24 nt, Human
ccccugagcuugcagagaugaggc

SEQ ID NO: 556029 - RNA, 23 nt, Human
cacagauuugagcucagcccugg

SEQ ID NO: 556030 - RNA, 21 nt, Human
accaaggagccaaacauccua

SEQ ID NO: 556031 - RNA, 18 nt, Human
accaccugccuauauuuu

SEQ ID NO: 556032 - RNA, 19 nt, Human
cucuguucugcacacagca

SEQ ID NO: 556033 - RNA, 13 nt, Human
aaaugaaagcagg

SEQ ID NO: 556034 - RNA, 13 nt, Human
augcuagaacucc

SEQ ID NO: 556035 - RNA, 10 nt, Human
ccugagcccc

SEQ ID NO: 556036 - RNA, 21 nt, Human
caacacacagauuugagcuca

SEQ ID NO: 556037 - RNA, 18 nt, Human
acagaaagcagaacagug

SEQ ID NO: 556038 - RNA, 13 nt, Human
augauuccaccua

SEQ ID NO: 556039 - RNA, 15 nt, Human
aauugacccacaaga

SEQ ID NO: 556040 - RNA, 19 nt, Human
acaaauuuacagagacaga

SEQ ID NO: 556041 - RNA, 20 nt, Human
cagccugagcgacagugaga

SEQ ID NO: 556042 - RNA, 20 nt, Human
cacuagacccacuggacuca

SEQ ID NO: 556043 - RNA, 21 nt, Human
aaaaaguucugcagauaaaca

SEQ ID NO: 556044 - RNA, 20 nt, Human
uuaaugccacuaaauugaca

SEQ ID NO: 556045 - RNA, 20 nt, Human
ccagugagacagcucugcau

SEQ ID NO: 556046 - RNA, 12 nt, Human
uucagccugaaa

SEQ ID NO: 556047 - RNA, 14 nt, Human
accauuuuuacuug

SEQ ID NO: 556048 - RNA, 14 nt, Human
ccacuggacucacc

SEQ ID NO: 556049 - RNA, 23 nt, Human
cagagguugcagugagccgagau

SEQ ID NO: 556050 - RNA, 21 nt, Human
cucuucuggguuccuuccucu

SEQ ID NO: 556051 - RNA, 19 nt, Human
uauauuuuuuguuaaauga

SEQ ID NO: 556052 - RNA, 18 nt, Human
ccaagccuggcaagggaa

SEQ ID NO: 556053 - RNA, 15 nt, Human
cuaagcaaaauguga

SEQ ID NO: 556054 - RNA, 18 nt, Human
ugugaccacugcagaaga

SEQ ID NO: 556055 - RNA, 18 nt, Human
auaacaacaacaacaaaa

SEQ ID NO: 556056 - RNA, 19 nt, Human
accauuuuggcaagcucua

SEQ ID NO: 556057 - RNA, 19 nt, Human
gcacacagcacgggggcca

SEQ ID NO: 556058 - RNA, 18 nt, Human
agguccacaacacacaga

SEQ ID NO: 556059 - RNA, 13 nt, Human
cccugcacuccag

SEQ ID NO: 556060 - RNA, 14 nt, Human
uuaaagaucugcaa

SEQ ID NO: 556061 - RNA, 15 nt, Human
ggacucaccuccccc

SEQ ID NO: 556062 - RNA, 21 nt, Human
cuccagcuggccgggagccug

SEQ ID NO: 556063 - RNA, 18 nt, Human
cucuauguucuaagaagu

SEQ ID NO: 556064 - RNA, 23 nt, Human
caucucuucuggguuccuuccuc

SEQ ID NO: 556065 - RNA, 21 nt, Human
ccauccugccccugagcccau

SEQ ID NO: 556066 - RNA, 21 nt, Human
gcccauccugccccugagccc

SEQ ID NO: 556067 - RNA, 20 nt, Human
cucccugccccccagcccuc

SEQ ID NO: 556068 - RNA, 12 nt, Human
acagagacagaa

SEQ ID NO: 556069 - RNA, 15 nt, Human
aaaguuaagaaucuu

SEQ ID NO: 556070 - RNA, 16 nt, Human
uauaucaauuuaaaaa

SEQ ID NO: 556071 - RNA, 23 nt, Human
cucagcccuggugggcagagagg

SEQ ID NO: 556072 - RNA, 14 nt, Human
gcaaauauaaacag

SEQ ID NO: 556073 - RNA, 15 nt, Human
cuucucuucacaguc

SEQ ID NO: 556074 - RNA, 21 nt, Human
acaugagguacugagagugaa

SEQ ID NO: 556075 - RNA, 22 nt, Human
gcagagagguagggauggggcu

SEQ ID NO: 556076 - RNA, 16 nt, Human
aagagaacaagcaaau

SEQ ID NO: 556077 - RNA, 13 nt, Human
agacacagugacc

SEQ ID NO: 556078 - RNA, 21 nt, Human
caauuuuguuauguauauuuu

SEQ ID NO: 556079 - RNA, 13 nt, Human
uaagugcagcccc

SEQ ID NO: 556080 - RNA, 18 nt, Human
ugccauaauuacuauguc

SEQ ID NO: 556081 - RNA, 20 nt, Human
aaucuuuauaguucuacucc

SEQ ID NO: 556082 - RNA, 11 nt, Human
ugcagugagcc

SEQ ID NO: 556083 - RNA, 19 nt, Human
accccugagcuugcagaga

SEQ ID NO: 556084 - RNA, 13 nt, Human
auccugaggcucc

SEQ ID NO: 556085 - RNA, 22 nt, Human
ccgggaggcagagguugcagug

SEQ ID NO: 556086 - RNA, 16 nt, Human
cccccagcccuccuua

SEQ ID NO: 556087 - RNA, 16 nt, Human
uugccauaauuacuau

SEQ ID NO: 556088 - RNA, 14 nt, Human
ugacacuuaaaaau

SEQ ID NO: 556089 - RNA, 17 nt, Human
ugaucaccugcccugcu

SEQ ID NO: 556090 - RNA, 17 nt, Human
cugagcgacagugagac

SEQ ID NO: 556091 - RNA, 20 nt, Human
gaccauacuaauuauacccc

SEQ ID NO: 556092 - RNA, 11 nt, Human
ucaccuccccc

SEQ ID NO: 556093 - RNA, 23 nt, Human
cucuacuaaaaauacaaaaaaaa

SEQ ID NO: 556094 - RNA, 21 nt, Human
uccuacaagacacagugacca

SEQ ID NO: 556095 - RNA, 23 nt, Human
cucagucucccucccuuggggcc

SEQ ID NO: 556096 - RNA, 15 nt, Human
caggaaguagaggag

SEQ ID NO: 556097 - RNA, 12 nt, Human
ucccccucuggc

SEQ ID NO: 556098 - RNA, 15 nt, Human
gagaugcuagaacuc

SEQ ID NO: 556099 - RNA, 13 nt, Human
agcucugcccauc

SEQ ID NO: 556100 - RNA, 23 nt, Human
cacuggacucaccucccccaucu

SEQ ID NO: 556101 - RNA, 23 nt, Human
cccagcccuccuuaucaaaggac

SEQ ID NO: 556102 - RNA, 19 nt, Human
ucaccaaggcugauuaaac

SEQ ID NO: 556103 - RNA, 18 nt, Human
ccucuggcuccagcuggc

SEQ ID NO: 556104 - RNA, 18 nt, Human
aucuacacuccagugaga

SEQ ID NO: 556105 - RNA, 20 nt, Human
ccagcuggccgggagccuga

SEQ ID NO: 556106 - RNA, 16 nt, Human
uaggauguugaaaaag

SEQ ID NO: 556107 - RNA, 12 nt, Human
aaaugaaagcag

SEQ ID NO: 556108 - RNA, 16 nt, Human
ucagucucccucccuu

SEQ ID NO: 556109 - RNA, 14 nt, Human
uggacucaccuccc

SEQ ID NO: 556110 - RNA, 20 nt, Human
cagcuggccgggagccugau

SEQ ID NO: 556111 - RNA, 14 nt, Human
acaagagcuuaaca

SEQ ID NO: 556112 - RNA, 19 nt, Human
ugagucccaggcugagccu

SEQ ID NO: 556113 - RNA, 17 nt, Human
acaagaaaugaaagcag

SEQ ID NO: 556114 - RNA, 16 nt, Human
cagucucccucccuug

SEQ ID NO: 556115 - RNA, 17 nt, Human
agucccaggcugagccu

SEQ ID NO: 556116 - RNA, 21 nt, Human
cuauguucuaagaagugaaaa

SEQ ID NO: 556117 - RNA, 12 nt, Human
agugcagccccg

SEQ ID NO: 556118 - RNA, 14 nt, Human
aagaagugaaaauc

SEQ ID NO: 556119 - RNA, 16 nt, Human
ggccuccauccugagg

SEQ ID NO: 556120 - RNA, 15 nt, Human
cuaucuuugagcgcc

SEQ ID NO: 556121 - RNA, 20 nt, Human
gagccucagucucccucccu

SEQ ID NO: 556122 - RNA, 21 nt, Human
cuaguaucaaaagaaagaaaa

SEQ ID NO: 556123 - RNA, 19 nt, Human
ccccugcaaagcccagcuu

SEQ ID NO: 556124 - RNA, 21 nt, Human
ccuggugccucaccccuugcc

SEQ ID NO: 556125 - RNA, 19 nt, Human
augcagagguccacaacac

SEQ ID NO: 556126 - RNA, 23 nt, Human
aaagcccagcuugaaaccuucac

SEQ ID NO: 556127 - RNA, 17 nt, Human
aaaaugguauuaaagau

SEQ ID NO: 556128 - RNA, 22 nt, Human
ugucucuacuaaaaauacaaaa

SEQ ID NO: 556129 - RNA, 20 nt, Human
ggguuccuuccucugagccu

SEQ ID NO: 556130 - RNA, 22 nt, Human
ugaaaaaguucugcagauaaac

SEQ ID NO: 556131 - RNA, 12 nt, Human
agggauggggcu

SEQ ID NO: 556132 - RNA, 19 nt, Human
cuccagcuggccgggagcc

SEQ ID NO: 556133 - RNA, 21 nt, Human
aaugaauggcuaagcaaaaug

SEQ ID NO: 556134 - RNA, 21 nt, Human
gggagccugaucaccugcccu

SEQ ID NO: 556135 - RNA, 14 nt, Human
uaacaacaacaaca

SEQ ID NO: 556136 - RNA, 18 nt, Human
gacccacuggacucaccu

SEQ ID NO: 556137 - RNA, 22 nt, Human
gugaacaaauuuacagagacag

SEQ ID NO: 556138 - RNA, 19 nt, Human
augaaguacucauacaugu

SEQ ID NO: 556139 - RNA, 12 nt, Human
uaguacacacuu

SEQ ID NO: 556140 - RNA, 14 nt, Human
cuccagugagacag

SEQ ID NO: 556141 - RNA, 15 nt, Human
acauccuacaagaca

SEQ ID NO: 556142 - RNA, 16 nt, Human
augccccgucccccuc

SEQ ID NO: 556143 - RNA, 19 nt, Human
aauuuuguuauguauauuu

SEQ ID NO: 556144 - RNA, 16 nt, Human
cuacacuccagugaga

SEQ ID NO: 556145 - RNA, 12 nt, Human
cagaacagugau

SEQ ID NO: 556146 - RNA, 14 nt, Human
cucccugcccccca

SEQ ID NO: 556147 - RNA, 16 nt, Human
gccucagucucccucc

SEQ ID NO: 556148 - RNA, 17 nt, Human
aggcuagaaccaccugc

SEQ ID NO: 556149 - RNA, 15 nt, Human
gccuaagugcagccc

SEQ ID NO: 556150 - RNA, 20 nt, Human
agcaacuuguguuccuaaca

SEQ ID NO: 556151 - RNA, 14 nt, Human
ccccugagcuugca

SEQ ID NO: 556152 - RNA, 17 nt, Human
agugagacagcucugca

SEQ ID NO: 556153 - RNA, 21 nt, Human
aaucaccaaggcugauuaaac

SEQ ID NO: 556154 - RNA, 15 nt, Human
gcccacuagacccac

SEQ ID NO: 556155 - RNA, 21 nt, Human
cgaaguauccuucagccugaa

SEQ ID NO: 556156 - RNA, 17 nt, Human
aagaaucuuuauaguuc

SEQ ID NO: 556157 - RNA, 22 nt, Human
auggaaauguuuacagaucccc

SEQ ID NO: 556158 - RNA, 14 nt, Human
aacaacaacaacaa

SEQ ID NO: 556159 - RNA, 14 nt, Human
acccaaaaggcaga

SEQ ID NO: 556160 - RNA, 19 nt, Human
ugaucaccugcccugcuga

SEQ ID NO: 556161 - RNA, 14 nt, Human
caaaguuaagaauc

SEQ ID NO: 556162 - RNA, 13 nt, Human
cuuacuucuucuc

SEQ ID NO: 556163 - RNA, 16 nt, Human
cagggacuugaaccca

SEQ ID NO: 556164 - RNA, 22 nt, Human
aauugacccacaagaaaugaaa

SEQ ID NO: 556165 - RNA, 22 nt, Human
cccccugcaaagcccagcuuga

SEQ ID NO: 556166 - RNA, 18 nt, Human
cucuggccuucggccucc

SEQ ID NO: 556167 - RNA, 13 nt, Human
ccaaaagguauuu

SEQ ID NO: 556168 - RNA, 11 nt, Human
ccugagcccca

SEQ ID NO: 556169 - RNA, 20 nt, Human
ugccccccagcccuccuuau

SEQ ID NO: 556170 - RNA, 14 nt, Human
gccucagucucccu

SEQ ID NO: 556171 - RNA, 23 nt, Human
gaccccugagcuugcagagauga

SEQ ID NO: 556172 - RNA, 23 nt, Human
caucaacagauaaauaguuuaug

SEQ ID NO: 556173 - RNA, 23 nt, Human
aauuuucauuguucuauaacaac

SEQ ID NO: 556174 - RNA, 14 nt, Human
uccacaacacacag

SEQ ID NO: 556175 - RNA, 20 nt, Human
guucugcagauaaacaguag

SEQ ID NO: 556176 - RNA, 19 nt, Human
gagguacugagagugaaca

SEQ ID NO: 556177 - RNA, 20 nt, Human
uccuaacaggaauuuucauu

SEQ ID NO: 556178 - RNA, 19 nt, Human
agauuugagcucagcccug

SEQ ID NO: 556179 - RNA, 15 nt, Human
aagcaagauaauaaa

SEQ ID NO: 556180 - RNA, 15 nt, Human
cuggguuccuuccuc

SEQ ID NO: 556181 - RNA, 17 nt, Human
cuuccuaauuccacagc

SEQ ID NO: 556182 - RNA, 16 nt, Human
ugcaacuacuauccaa

SEQ ID NO: 556183 - RNA, 14 nt, Human
ucuuuuuuuuaaua

SEQ ID NO: 556184 - RNA, 14 nt, Human
cugccccccagccc

SEQ ID NO: 556185 - RNA, 20 nt, Human
cuggccuucggccuccaucc

SEQ ID NO: 556186 - RNA, 17 nt, Human
acucaccucccccaucu

SEQ ID NO: 556187 - RNA, 19 nt, Human
cccccucuggcuccagcug

SEQ ID NO: 556188 - RNA, 18 nt, Human
acuggacucaccuccccc

SEQ ID NO: 556189 - RNA, 22 nt, Human
augcagagguccacaacacaca

SEQ ID NO: 556190 - RNA, 23 nt, Human
acaacaaaagcgauuauuauuuu

SEQ ID NO: 556191 - RNA, 13 nt, Human
ccagcccuccuua

SEQ ID NO: 556192 - RNA, 13 nt, Human
ccucuggcuccag

SEQ ID NO: 556193 - RNA, 22 nt, Human
ucuacuaaaaauacaaaaaaaa

SEQ ID NO: 556194 - RNA, 19 nt, Human
cugcaaagcccagcuugaa

SEQ ID NO: 556195 - RNA, 14 nt, Human
agguugcagugagc

SEQ ID NO: 556196 - RNA, 12 nt, Human
cuauaacaacaa

SEQ ID NO: 556197 - RNA, 15 nt, Human
aagccuggcaaggga

SEQ ID NO: 556198 - RNA, 22 nt, Human
aaugggcacaggguuuauguuu

SEQ ID NO: 556199 - RNA, 16 nt, Human
ccugaucaccugcccu

SEQ ID NO: 556200 - RNA, 19 nt, Human
cugccccccagcccuccuu

SEQ ID NO: 556201 - RNA, 15 nt, Human
agccucagucucccu

SEQ ID NO: 556202 - RNA, 23 nt, Human
gcccuggugccucaccccuugcc

SEQ ID NO: 556203 - RNA, 19 nt, Human
auuaaauauaaagcaagau

SEQ ID NO: 556204 - RNA, 18 nt, Human
agaagcaacccaaauguu

SEQ ID NO: 556205 - RNA, 13 nt, Human
ccacaacacacag

SEQ ID NO: 556206 - RNA, 13 nt, Human
uuccucugagccu

SEQ ID NO: 556207 - RNA, 19 nt, Human
cgcccacuagacccacugg

SEQ ID NO: 556208 - RNA, 16 nt, Human
aagcaagauaauaaaa

SEQ ID NO: 556209 - RNA, 17 nt, Human
uuauaucaauuuaaaaa

SEQ ID NO: 556210 - RNA, 18 nt, Human
gccugagcgacagugaga

SEQ ID NO: 556211 - RNA, 20 nt, Human
guuccuuccucugagccuug

SEQ ID NO: 556212 - RNA, 17 nt, Human
caaaagcgauuauuauu

SEQ ID NO: 556213 - RNA, 17 nt, Human
auaucaauuuaaaaaaa

SEQ ID NO: 556214 - RNA, 18 nt, Coxiella burnetii RSA 493
uuuuucucugcaaucgca

SEQ ID NO: 556215 - RNA, 15 nt, Coxiella burnetii RSA 493
uuuucuucaauggca

SEQ ID NO: 556216 - RNA, 18 nt, Coxiella burnetii RSA 493
uuuugcaacuuccgcuac

SEQ ID NO: 556217 - RNA, 10 nt, Coxiella burnetii RSA 493
uuuuuugcgc

SEQ ID NO: 556218 - RNA, 13 nt, Coxiella burnetii RSA 493
uuuuauucuucug

SEQ ID NO: 556219 - RNA, 23 nt, Coxiella burnetii RSA 493
uuuuauuuaaaaaacuagaaaua

SEQ ID NO: 556220 - RNA, 19 nt, Coxiella burnetii RSA 493
uuuuaauuaagcuugaaaa

SEQ ID NO: 556221 - RNA, 22 nt, Coxiella burnetii RSA 493
uuugucuccuacgucggguuau

SEQ ID NO: 556222 - RNA, 20 nt, Coxiella burnetii RSA 493
uuucgcuucgcuacauacgg

SEQ ID NO: 556223 - RNA, 19 nt, Coxiella burnetii RSA 493
uuucgcuucgcucagacgg

SEQ ID NO: 556224 - RNA, 20 nt, Coxiella burnetii RSA 493
uuucgcuucgcuccauacgg

SEQ ID NO: 556225 - RNA, 19 nt, Coxiella burnetii RSA 493
uuucgcuucgcugcauacg

SEQ ID NO: 556226 - RNA, 15 nt, Coxiella burnetii RSA 493
uuugcauuaaucuuc

SEQ ID NO: 556227 - RNA, 16 nt, Coxiella burnetii RSA 493
uugggcucgaaaaacu

SEQ ID NO: 556228 - RNA, 18 nt, Coxiella burnetii RSA 493
uugggucuaccggcacaa

SEQ ID NO: 556229 - RNA, 20 nt, Coxiella burnetii RSA 493
uuguuuucccguauuucgcu

SEQ ID NO: 556230 - RNA, 19 nt, Coxiella burnetii RSA 493
uuguuuuuaagauuuuuau

SEQ ID NO: 556231 - RNA, 14 nt, Coxiella burnetii RSA 493
uugucuuuucgcau

SEQ ID NO: 556232 - RNA, 13 nt, Coxiella burnetii RSA 493
uuuccuucguuuc

SEQ ID NO: 556233 - RNA, 15 nt, Coxiella burnetii RSA 493
uuuccuuaaaagcgc

SEQ ID NO: 556234 - RNA, 21 nt, Coxiella burnetii RSA 493
uuucgagaauauauucauauc

SEQ ID NO: 556235 - RNA, 18 nt, Coxiella burnetii RSA 493
uuuccguguaauaacgug

SEQ ID NO: 556236 - RNA, 22 nt, Coxiella burnetii RSA 493
uuuccuagauuuuggcucccua

SEQ ID NO: 556237 - RNA, 18 nt, Coxiella burnetii RSA 493
uuucauuaagcaauuuuu

SEQ ID NO: 556238 - RNA, 17 nt, Coxiella burnetii RSA 493
uuucauucauucgcuuu

SEQ ID NO: 556239 - RNA, 14 nt, Coxiella burnetii RSA 493
uuucaacauauuuc

SEQ ID NO: 556240 - RNA, 16 nt, Coxiella burnetii RSA 493
uuucaauaaacccguu

SEQ ID NO: 556241 - RNA, 18 nt, Coxiella burnetii RSA 493
uuuauauguguaacaaaa

SEQ ID NO: 556242 - RNA, 18 nt, Coxiella burnetii RSA 493
uugcaauaacaaauaaac

SEQ ID NO: 556243 - RNA, 11 nt, Coxiella burnetii RSA 493
uugauagcgau

SEQ ID NO: 556244 - RNA, 21 nt, Coxiella burnetii RSA 493
uugccaauauaaauaaucuuc

SEQ ID NO: 556245 - RNA, 14 nt, Coxiella burnetii RSA 493
uugacgccuauugc

SEQ ID NO: 556246 - RNA, 23 nt, Coxiella burnetii RSA 493
uugcuuuaaaucccguuucgguu

SEQ ID NO: 556247 - RNA, 14 nt, Coxiella burnetii RSA 493
uugcugaacaaaag

SEQ ID NO: 556248 - RNA, 14 nt, Coxiella burnetii RSA 493
uugcgcguucaaua

SEQ ID NO: 556249 - RNA, 16 nt, Coxiella burnetii RSA 493
uggacccuguuuuuuu

SEQ ID NO: 556250 - RNA, 19 nt, Coxiella burnetii RSA 493
uggcugagcuugcgaagcc

SEQ ID NO: 556251 - RNA, 19 nt, Coxiella burnetii RSA 493
ugggugggauuguuuucga

SEQ ID NO: 556252 - RNA, 20 nt, Coxiella burnetii RSA 493
uggggcguuagcggaauacg

SEQ ID NO: 556253 - RNA, 22 nt, Coxiella burnetii RSA 493
uguuaaaaacgccugaaauauu

SEQ ID NO: 556254 - RNA, 15 nt, Coxiella burnetii RSA 493
uguguggcuucgcca

SEQ ID NO: 556255 - RNA, 14 nt, Coxiella burnetii RSA 493
uguuauugcuaaaa

SEQ ID NO: 556256 - RNA, 16 nt, Coxiella burnetii RSA 493
uguugagcuucgcgaa

SEQ ID NO: 556257 - RNA, 20 nt, Coxiella burnetii RSA 493
ugucgcuacgcgacaacuaa

SEQ ID NO: 556258 - RNA, 11 nt, Coxiella burnetii RSA 493
uguagaaugga

SEQ ID NO: 556259 - RNA, 15 nt, Coxiella burnetii RSA 493
uguacguuaaagccg

SEQ ID NO: 556260 - RNA, 15 nt, Coxiella burnetii RSA 493
ugguaaacaacgcac

SEQ ID NO: 556261 - RNA, 13 nt, Coxiella burnetii RSA 493
uguaauccuuguu

SEQ ID NO: 556262 - RNA, 19 nt, Coxiella burnetii RSA 493
uguaauuuaucccacguug

SEQ ID NO: 556263 - RNA, 17 nt, Coxiella burnetii RSA 493
uguaauuuccguguaau

SEQ ID NO: 556264 - RNA, 22 nt, Coxiella burnetii RSA 493
uuacuuguugcggauuggcuuu

SEQ ID NO: 556265 - RNA, 13 nt, Coxiella burnetii RSA 493
uuaggcgccacag

SEQ ID NO: 556266 - RNA, 16 nt, Coxiella burnetii RSA 493
uuaacuccuucgcuuu

SEQ ID NO: 556267 - RNA, 11 nt, Coxiella burnetii RSA 493
uuaagcgcgau

SEQ ID NO: 556268 - RNA, 15 nt, Coxiella burnetii RSA 493
uuaagacgugaaaug

SEQ ID NO: 556269 - RNA, 12 nt, Coxiella burnetii RSA 493
uuaagaaaaacc

SEQ ID NO: 556270 - RNA, 17 nt, Coxiella burnetii RSA 493
uuaaugauuuaccgccg

SEQ ID NO: 556271 - RNA, 21 nt, Coxiella burnetii RSA 493
uguuucgcaacuuuuuuccuu

SEQ ID NO: 556272 - RNA, 19 nt, Coxiella burnetii RSA 493
uguuuucccguauuucgcu

SEQ ID NO: 556273 - RNA, 19 nt, Coxiella burnetii RSA 493
uucaaaugaccaaauaauu

SEQ ID NO: 556274 - RNA, 20 nt, Coxiella burnetii RSA 493
uucccguauuccgcuuugcu

SEQ ID NO: 556275 - RNA, 21 nt, Coxiella burnetii RSA 493
gugucuccuuuuguuaauucu

SEQ ID NO: 556276 - RNA, 19 nt, Coxiella burnetii RSA 493
gugcguuccagcggggaca

SEQ ID NO: 556277 - RNA, 18 nt, Coxiella burnetii RSA 493
guuaauuuaucauuuuuc

SEQ ID NO: 556278 - RNA, 16 nt, Coxiella burnetii RSA 493
guuagcuuuucuuuaa

SEQ ID NO: 556279 - RNA, 14 nt, Coxiella burnetii RSA 493
guuauaauuucuuu

SEQ ID NO: 556280 - RNA, 23 nt, Coxiella burnetii RSA 493
guuauauuuaauuuuauuauuua

SEQ ID NO: 556281 - RNA, 22 nt, Coxiella burnetii RSA 493
guucccccacuucauacgggcu

SEQ ID NO: 556282 - RNA, 19 nt, Coxiella burnetii RSA 493
uaaaccuauccaaaaagau

SEQ ID NO: 556283 - RNA, 16 nt, Coxiella burnetii RSA 493
uaaaccaacgaacgcc

SEQ ID NO: 556284 - RNA, 16 nt, Coxiella burnetii RSA 493
uaaaguguuuuuuuga

SEQ ID NO: 556285 - RNA, 15 nt, Coxiella burnetii RSA 493
uaacaaaccaucgcc

SEQ ID NO: 556286 - RNA, 11 nt, Coxiella burnetii RSA 493
uaacaaaaaug

SEQ ID NO: 556287 - RNA, 14 nt, Coxiella burnetii RSA 493
uaaaugcgguacuu

SEQ ID NO: 556288 - RNA, 19 nt, Coxiella burnetii RSA 493
uaaccaagaguguucgcua

SEQ ID NO: 556289 - RNA, 12 nt, Coxiella burnetii RSA 493
uaacgauuucuc

SEQ ID NO: 556290 - RNA, 13 nt, Coxiella burnetii RSA 493
uaaccuuucgcuu

SEQ ID NO: 556291 - RNA, 18 nt, Coxiella burnetii RSA 493
uaaccugaaaaaauuaau

SEQ ID NO: 556292 - RNA, 21 nt, Coxiella burnetii RSA 493
uaacuaccuucuaaucgguuu

SEQ ID NO: 556293 - RNA, 12 nt, Coxiella burnetii RSA 493
uacaauucgcua

SEQ ID NO: 556294 - RNA, 22 nt, Coxiella burnetii RSA 493
uaauugaauuugagaacguuuc

SEQ ID NO: 556295 - RNA, 22 nt, Coxiella burnetii RSA 493
uaauugagguuuuaauuugccg

SEQ ID NO: 556296 - RNA, 16 nt, Coxiella burnetii RSA 493
uaauucaaauuuuaaa

SEQ ID NO: 556297 - RNA, 18 nt, Coxiella burnetii RSA 493
uaaugagcaucuuuucug

SEQ ID NO: 556298 - RNA, 16 nt, Coxiella burnetii RSA 493
uaaugaaauuucucau

SEQ ID NO: 556299 - RNA, 15 nt, Coxiella burnetii RSA 493
uaacuccuucgcuuu

SEQ ID NO: 556300 - RNA, 16 nt, Coxiella burnetii RSA 493
uaacuccguuacaucg

SEQ ID NO: 556301 - RNA, 21 nt, Coxiella burnetii RSA 493
uacccagguaguaauuucuuc

SEQ ID NO: 556302 - RNA, 15 nt, Coxiella burnetii RSA 493
uacauaauuuaaacu

SEQ ID NO: 556303 - RNA, 23 nt, Coxiella burnetii RSA 493
uagagucgggaaauaaaauuaau

SEQ ID NO: 556304 - RNA, 13 nt, Coxiella burnetii RSA 493
uacuucuuugagu

SEQ ID NO: 556305 - RNA, 17 nt, Coxiella burnetii RSA 493
uacuuguugcggauugg

SEQ ID NO: 556306 - RNA, 17 nt, Coxiella burnetii RSA 493
uacuuuacuuguugaaa

SEQ ID NO: 556307 - RNA, 21 nt, Coxiella burnetii RSA 493
uacuuuuagcgaccaccaugu

SEQ ID NO: 556308 - RNA, 21 nt, Coxiella burnetii RSA 493
uaugcagcgaagcgaaauacg

SEQ ID NO: 556309 - RNA, 22 nt, Coxiella burnetii RSA 493
uaugcagcgaagcgaaauacgg

SEQ ID NO: 556310 - RNA, 23 nt, Coxiella burnetii RSA 493
uaugcagcgaagcgaaauacggg

SEQ ID NO: 556311 - RNA, 23 nt, Coxiella burnetii RSA 493
uaucuguuuucgauaaaugcaau

SEQ ID NO: 556312 - RNA, 17 nt, Coxiella burnetii RSA 493
uaucgccguuucugcuu

SEQ ID NO: 556313 - RNA, 20 nt, Coxiella burnetii RSA 493
uagcgccagauacacauaau

SEQ ID NO: 556314 - RNA, 15 nt, Coxiella burnetii RSA 493
uauuauuaaaagagc

SEQ ID NO: 556315 - RNA, 15 nt, Coxiella burnetii RSA 493
uauugaucgcccaua

SEQ ID NO: 556316 - RNA, 18 nt, Coxiella burnetii RSA 493
uauucuuaauuuuuccuu

SEQ ID NO: 556317 - RNA, 12 nt, Coxiella burnetii RSA 493
uaugcuucaaua

SEQ ID NO: 556318 - RNA, 13 nt, Coxiella burnetii RSA 493
uauuuuuucuuug

SEQ ID NO: 556319 - RNA, 13 nt, Coxiella burnetii RSA 493
uauuuuuugcucu

SEQ ID NO: 556320 - RNA, 14 nt, Coxiella burnetii RSA 493
uauuuuuuugccag

SEQ ID NO: 556321 - RNA, 18 nt, Coxiella burnetii RSA 493
uauuuuuaaaagauuuua

SEQ ID NO: 556322 - RNA, 20 nt, Coxiella burnetii RSA 493
uauugcgcguaaauuucguu

SEQ ID NO: 556323 - RNA, 17 nt, Coxiella burnetii RSA 493
uauuucaccuucuucuu

SEQ ID NO: 556324 - RNA, 19 nt, Coxiella burnetii RSA 493
uauuucgcuucgcuccaua

SEQ ID NO: 556325 - RNA, 20 nt, Coxiella burnetii RSA 493
uauuucgcuucgcugcauac

SEQ ID NO: 556326 - RNA, 21 nt, Coxiella burnetii RSA 493
uauuuucuacggccaucgccc

SEQ ID NO: 556327 - RNA, 14 nt, Coxiella burnetii RSA 493
ucaaacaaaucaau

SEQ ID NO: 556328 - RNA, 20 nt, Coxiella burnetii RSA 493
ucaaauugcuccaaacagac

SEQ ID NO: 556329 - RNA, 14 nt, Coxiella burnetii RSA 493
ucaaauccuuuaau

SEQ ID NO: 556330 - RNA, 22 nt, Coxiella burnetii RSA 493
ucaacucgcccauggaaaucgc

SEQ ID NO: 556331 - RNA, 16 nt, Coxiella burnetii RSA 493
ucaauagaaaaaagaa

SEQ ID NO: 556332 - RNA, 22 nt, Coxiella burnetii RSA 493
ucaagguuauugcuauuuuccu

SEQ ID NO: 556333 - RNA, 12 nt, Coxiella burnetii RSA 493
ucaauaaacccg

SEQ ID NO: 556334 - RNA, 18 nt, Coxiella burnetii RSA 493
ucaauaagccguucaccc

SEQ ID NO: 556335 - RNA, 21 nt, Coxiella burnetii RSA 493
ucacccagacuuuugcagcua

SEQ ID NO: 556336 - RNA, 21 nt, Coxiella burnetii RSA 493
ucaauguaggcguaaucgcgg

SEQ ID NO: 556337 - RNA, 17 nt, Coxiella burnetii RSA 493
ucaauuagcauuuucuc

SEQ ID NO: 556338 - RNA, 14 nt, Coxiella burnetii RSA 493
ucacuaugaucaug

SEQ ID NO: 556339 - RNA, 17 nt, Coxiella burnetii RSA 493
ucacgguaauccaaacc

SEQ ID NO: 556340 - RNA, 15 nt, Coxiella burnetii RSA 493
ucagcccaacuacgg

SEQ ID NO: 556341 - RNA, 21 nt, Coxiella burnetii RSA 493
uccaauuauaacuauuuuaaa

SEQ ID NO: 556342 - RNA, 20 nt, Coxiella burnetii RSA 493
uccagccuuuaguuuuauuu

SEQ ID NO: 556343 - RNA, 12 nt, Coxiella burnetii RSA 493
ucaucgccaaaa

SEQ ID NO: 556344 - RNA, 15 nt, Coxiella burnetii RSA 493
ucaugccuuuuuugc

SEQ ID NO: 556345 - RNA, 17 nt, Coxiella burnetii RSA 493
ucaugccuuuuuugcgc

SEQ ID NO: 556346 - RNA, 15 nt, Coxiella burnetii RSA 493
ucaucuuguaaucgc

SEQ ID NO: 556347 - RNA, 22 nt, Coxiella burnetii RSA 493
ucauauccuuucuaacgucgca

SEQ ID NO: 556348 - RNA, 18 nt, Coxiella burnetii RSA 493
uccccuuauagcgugaga

SEQ ID NO: 556349 - RNA, 19 nt, Coxiella burnetii RSA 493
uccccguauuucgcuucgc

SEQ ID NO: 556350 - RNA, 20 nt, Coxiella burnetii RSA 493
uccccguauuucgcuucgcu

SEQ ID NO: 556351 - RNA, 18 nt, Coxiella burnetii RSA 493
uccggcguugauuuuuua

SEQ ID NO: 556352 - RNA, 17 nt, Coxiella burnetii RSA 493
uccgcuacguuuuuugc

SEQ ID NO: 556353 - RNA, 18 nt, Coxiella burnetii RSA 493
uccgcauugcauuucuuu

SEQ ID NO: 556354 - RNA, 22 nt, Coxiella burnetii RSA 493
ucuccaaagggaccuuuuuugc

SEQ ID NO: 556355 - RNA, 14 nt, Coxiella burnetii RSA 493
ucuccaccacuuug

SEQ ID NO: 556356 - RNA, 20 nt, Coxiella burnetii RSA 493
ucuagcauaaucuuuuuaga

SEQ ID NO: 556357 - RNA, 14 nt, Coxiella burnetii RSA 493
ucuaauaaaauagc

SEQ ID NO: 556358 - RNA, 19 nt, Coxiella burnetii RSA 493
ucgugcucuuuuuucaaaa

SEQ ID NO: 556359 - RNA, 18 nt, Coxiella burnetii RSA 493
ucguccaauucuuuaagu

SEQ ID NO: 556360 - RNA, 17 nt, Coxiella burnetii RSA 493
ucgguuucuucaacgaa

SEQ ID NO: 556361 - RNA, 17 nt, Coxiella burnetii RSA 493
ucgggcuaucggcuuca

SEQ ID NO: 556362 - RNA, 22 nt, Coxiella burnetii RSA 493
ucggccaaauggauuuccacuu

SEQ ID NO: 556363 - RNA, 16 nt, Coxiella burnetii RSA 493
ucgggaauaaaauaau

SEQ ID NO: 556364 - RNA, 18 nt, Coxiella burnetii RSA 493
ucgggaaauaaaauuaau

SEQ ID NO: 556365 - RNA, 21 nt, Coxiella burnetii RSA 493
ucgagucguucuugacaccac

SEQ ID NO: 556366 - RNA, 14 nt, Coxiella burnetii RSA 493
ucgauccuuuuaau

SEQ ID NO: 556367 - RNA, 15 nt, Coxiella burnetii RSA 493
ucuuucaauaucuuc

SEQ ID NO: 556368 - RNA, 17 nt, Coxiella burnetii RSA 493
ucuuugacauaucauuc

SEQ ID NO: 556369 - RNA, 13 nt, Coxiella burnetii RSA 493
ugaaauauuuucu

SEQ ID NO: 556370 - RNA, 14 nt, Coxiella burnetii RSA 493
ugaauagaaaaacu

SEQ ID NO: 556371 - RNA, 16 nt, Coxiella burnetii RSA 493
ugaauggcuuuguaau

SEQ ID NO: 556372 - RNA, 17 nt, Coxiella burnetii RSA 493
ugaauaauuuuuuuaau

SEQ ID NO: 556373 - RNA, 22 nt, Coxiella burnetii RSA 493
ugaagcuauccaaauaaucggg

SEQ ID NO: 556374 - RNA, 15 nt, Coxiella burnetii RSA 493
ugaagaguaaaaaac

SEQ ID NO: 556375 - RNA, 12 nt, Coxiella burnetii RSA 493
ugaagaaauacg

SEQ ID NO: 556376 - RNA, 17 nt, Coxiella burnetii RSA 493
ugaccaauauccuugua

SEQ ID NO: 556377 - RNA, 13 nt, Coxiella burnetii RSA 493
ugacauuuaaaaa

SEQ ID NO: 556378 - RNA, 13 nt, Coxiella burnetii RSA 493
ugauaaaauaaca

SEQ ID NO: 556379 - RNA, 16 nt, Coxiella burnetii RSA 493
ugaguggaaaaccacc

SEQ ID NO: 556380 - RNA, 17 nt, Coxiella burnetii RSA 493
ugcaauaacaaauaaac

SEQ ID NO: 556381 - RNA, 13 nt, Coxiella burnetii RSA 493
ugcaaaacggcau

SEQ ID NO: 556382 - RNA, 22 nt, Coxiella burnetii RSA 493
ugacgaucgucuaaaagcgcaa

SEQ ID NO: 556383 - RNA, 18 nt, Coxiella burnetii RSA 493
ugcauaaauuauuuuaau

SEQ ID NO: 556384 - RNA, 15 nt, Coxiella burnetii RSA 493
ugcagugaaauaacc

SEQ ID NO: 556385 - RNA, 18 nt, Coxiella burnetii RSA 493
ugccgcuaaaauuuuuug

SEQ ID NO: 556386 - RNA, 18 nt, Coxiella burnetii RSA 493
gcuguacauuuuucaagg

SEQ ID NO: 556387 - RNA, 19 nt, Coxiella burnetii RSA 493
gcuucgcuacauacgggcu

SEQ ID NO: 556388 - RNA, 19 nt, Coxiella burnetii RSA 493
gcuucgcuccauacgggcu

SEQ ID NO: 556389 - RNA, 17 nt, Coxiella burnetii RSA 493
gcuuccccaauuuauuc

SEQ ID NO: 556390 - RNA, 19 nt, Coxiella burnetii RSA 493
gcuuccagaaauucauuuu

SEQ ID NO: 556391 - RNA, 23 nt, Coxiella burnetii RSA 493
gcuuccagaaauucauuuuucag

SEQ ID NO: 556392 - RNA, 22 nt, Coxiella burnetii RSA 493
ggacuacacgguuagugggaag

SEQ ID NO: 556393 - RNA, 23 nt, Coxiella burnetii RSA 493
gcuucuuuuaauugacuuauuuu

SEQ ID NO: 556394 - RNA, 19 nt, Coxiella burnetii RSA 493
gcuuucccuuuuugauuuc

SEQ ID NO: 556395 - RNA, 18 nt, Coxiella burnetii RSA 493
ggaaacgaaguucucaaa

SEQ ID NO: 556396 - RNA, 17 nt, Coxiella burnetii RSA 493
gcuuuuaaacgcuucaa

SEQ ID NO: 556397 - RNA, 17 nt, Coxiella burnetii RSA 493
ggaaaaggagaaaguga

SEQ ID NO: 556398 - RNA, 20 nt, Coxiella burnetii RSA 493
ggaaauauuuaauugggaag

SEQ ID NO: 556399 - RNA, 17 nt, Coxiella burnetii RSA 493
ggaacaacgaaaucuac

SEQ ID NO: 556400 - RNA, 23 nt, Coxiella burnetii RSA 493
gcucgcgaaauuuaauaaaauua

SEQ ID NO: 556401 - RNA, 21 nt, Coxiella burnetii RSA 493
gcgucaacuuaagagagcgag

SEQ ID NO: 556402 - RNA, 17 nt, Coxiella burnetii RSA 493
gcuaaauccagcgauug

SEQ ID NO: 556403 - RNA, 21 nt, Coxiella burnetii RSA 493
gcggaaaauuuaaaccacuau

SEQ ID NO: 556404 - RNA, 12 nt, Coxiella burnetii RSA 493
gccuuuauuaga

SEQ ID NO: 556405 - RNA, 21 nt, Coxiella burnetii RSA 493
gcgaaauuuguuauugcuaaa

SEQ ID NO: 556406 - RNA, 21 nt, Coxiella burnetii RSA 493
gcgaagcggaauacggagaaa

SEQ ID NO: 556407 - RNA, 20 nt, Coxiella burnetii RSA 493
gcgaagcgaaauacggggac

SEQ ID NO: 556408 - RNA, 16 nt, Coxiella burnetii RSA 493
gcgcaucaaaaaaacc

SEQ ID NO: 556409 - RNA, 16 nt, Coxiella burnetii RSA 493
gcgcccaaaugaucgg

SEQ ID NO: 556410 - RNA, 14 nt, Coxiella burnetii RSA 493
ggcgaaauacagga

SEQ ID NO: 556411 - RNA, 14 nt, Coxiella burnetii RSA 493
ggccuuuuucauuu

SEQ ID NO: 556412 - RNA, 19 nt, Coxiella burnetii RSA 493
ggcuuuauucccgaugggg

SEQ ID NO: 556413 - RNA, 20 nt, Coxiella burnetii RSA 493
ggcugaagaggcugaauaag

SEQ ID NO: 556414 - RNA, 17 nt, Coxiella burnetii RSA 493
ggcuacuugaaaaccua

SEQ ID NO: 556415 - RNA, 13 nt, Coxiella burnetii RSA 493
guacagcuccaua

SEQ ID NO: 556416 - RNA, 15 nt, Coxiella burnetii RSA 493
guaacuuuuccaucu

SEQ ID NO: 556417 - RNA, 18 nt, Coxiella burnetii RSA 493
guaauugcgccgguuuaa

SEQ ID NO: 556418 - RNA, 15 nt, Coxiella burnetii RSA 493
gguuuuucuucauuu

SEQ ID NO: 556419 - RNA, 13 nt, Coxiella burnetii RSA 493
gguuagaguuaau

SEQ ID NO: 556420 - RNA, 13 nt, Coxiella burnetii RSA 493
gguguuuuucaaa

SEQ ID NO: 556421 - RNA, 18 nt, Coxiella burnetii RSA 493
gguuaaguagcuaaaaaa

SEQ ID NO: 556422 - RNA, 14 nt, Coxiella burnetii RSA 493
guaugaucauuuuc

SEQ ID NO: 556423 - RNA, 19 nt, Coxiella burnetii RSA 493
guaugagcgaagcgaaaua

SEQ ID NO: 556424 - RNA, 15 nt, Coxiella burnetii RSA 493
guaugagcggcaauu

SEQ ID NO: 556425 - RNA, 18 nt, Coxiella burnetii RSA 493
guaugagcggcaauuuug

SEQ ID NO: 556426 - RNA, 18 nt, Coxiella burnetii RSA 493
guauccaucccaauucuc

SEQ ID NO: 556427 - RNA, 21 nt, Coxiella burnetii RSA 493
guauggggcguuagcggaaua

SEQ ID NO: 556428 - RNA, 20 nt, Coxiella burnetii RSA 493
guaugcagcgaagcgaaaua

SEQ ID NO: 556429 - RNA, 22 nt, Coxiella burnetii RSA 493
gguaagaaaaaguuaaguauau

SEQ ID NO: 556430 - RNA, 23 nt, Coxiella burnetii RSA 493
ggugcagaaggcccgcuaauugu

SEQ ID NO: 556431 - RNA, 14 nt, Coxiella burnetii RSA 493
guccuguucuuuuc

SEQ ID NO: 556432 - RNA, 23 nt, Coxiella burnetii RSA 493
gucgcuacgcgacaacuaaauuu

SEQ ID NO: 556433 - RNA, 14 nt, Coxiella burnetii RSA 493
cuaaagguaaaaag

SEQ ID NO: 556434 - RNA, 12 nt, Coxiella burnetii RSA 493
cuaaaacgacag

SEQ ID NO: 556435 - RNA, 20 nt, Coxiella burnetii RSA 493
cguuuuucgagcgacuucau

SEQ ID NO: 556436 - RNA, 18 nt, Coxiella burnetii RSA 493
cuaaaaagcuagcgaaau

SEQ ID NO: 556437 - RNA, 19 nt, Coxiella burnetii RSA 493
cuaaaaagcuagcgaaauu

SEQ ID NO: 556438 - RNA, 22 nt, Coxiella burnetii RSA 493
cguuuuucauccagugaaaacc

SEQ ID NO: 556439 - RNA, 19 nt, Coxiella burnetii RSA 493
cguuugcacauaagcgaau

SEQ ID NO: 556440 - RNA, 18 nt, Coxiella burnetii RSA 493
cguuucgguuuucgcugc

SEQ ID NO: 556441 - RNA, 21 nt, Coxiella burnetii RSA 493
cguuucgucgauauccaaaac

SEQ ID NO: 556442 - RNA, 19 nt, Coxiella burnetii RSA 493
cguugcaagcguuuuucau

SEQ ID NO: 556443 - RNA, 21 nt, Coxiella burnetii RSA 493
cuauuauuaaaagagcgaaua

SEQ ID NO: 556444 - RNA, 18 nt, Coxiella burnetii RSA 493
cuaucgugccaguauuuu

SEQ ID NO: 556445 - RNA, 14 nt, Coxiella burnetii RSA 493
cuaucggcuucaca

SEQ ID NO: 556446 - RNA, 20 nt, Coxiella burnetii RSA 493
cuauaaauaacagcgaacau

SEQ ID NO: 556447 - RNA, 14 nt, Coxiella burnetii RSA 493
cuaaucccgcccca

SEQ ID NO: 556448 - RNA, 15 nt, Coxiella burnetii RSA 493
cuaauuugaaaaacc

SEQ ID NO: 556449 - RNA, 18 nt, Coxiella burnetii RSA 493
cuaaugauugcucugacc

SEQ ID NO: 556450 - RNA, 20 nt, Coxiella burnetii RSA 493
cuauugcgcaaauugcaaaa

SEQ ID NO: 556451 - RNA, 22 nt, Coxiella burnetii RSA 493
cucagcccaaccuacgggcuaa

SEQ ID NO: 556452 - RNA, 22 nt, Coxiella burnetii RSA 493
cuccacggaauuugaaauaaac

SEQ ID NO: 556453 - RNA, 18 nt, Coxiella burnetii RSA 493
cugacguuaucacuugau

SEQ ID NO: 556454 - RNA, 17 nt, Coxiella burnetii RSA 493
cugauugcggcucaauu

SEQ ID NO: 556455 - RNA, 20 nt, Coxiella burnetii RSA 493
cugauuggaguauaagcguu

SEQ ID NO: 556456 - RNA, 17 nt, Coxiella burnetii RSA 493
cugagggaauuuuuugc

SEQ ID NO: 556457 - RNA, 16 nt, Coxiella burnetii RSA 493
cucuuaucuuaaaccu

SEQ ID NO: 556458 - RNA, 20 nt, Coxiella burnetii RSA 493
cucucccuuaacuucucuuc

SEQ ID NO: 556459 - RNA, 20 nt, Coxiella burnetii RSA 493
cucguauuccgcuucgcugc

SEQ ID NO: 556460 - RNA, 21 nt, Coxiella burnetii RSA 493
cucguauuccgcuucgcugca

SEQ ID NO: 556461 - RNA, 23 nt, Coxiella burnetii RSA 493
cgugaaggaaauuugcauuaauc

SEQ ID NO: 556462 - RNA, 22 nt, Coxiella burnetii RSA 493
cgucuuuucuaagacuaagaau

SEQ ID NO: 556463 - RNA, 19 nt, Coxiella burnetii RSA 493
cguaugagcgaagcgaagu

SEQ ID NO: 556464 - RNA, 21 nt, Coxiella burnetii RSA 493
cgguuuuuuuaaaaaagaaaa

SEQ ID NO: 556465 - RNA, 12 nt, Coxiella burnetii RSA 493
cguaaaacgaua

SEQ ID NO: 556466 - RNA, 19 nt, Coxiella burnetii RSA 493
cguaauggaucgcgcgcca

SEQ ID NO: 556467 - RNA, 22 nt, Coxiella burnetii RSA 493
cguaauuauuaagccuuaauca

SEQ ID NO: 556468 - RNA, 14 nt, Coxiella burnetii RSA 493
cuggaaaaauaaau

SEQ ID NO: 556469 - RNA, 22 nt, Coxiella burnetii RSA 493
cuggaccaccacguguauugau

SEQ ID NO: 556470 - RNA, 18 nt, Coxiella burnetii RSA 493
cuuaacuccuucgcuuuu

SEQ ID NO: 556471 - RNA, 18 nt, Coxiella burnetii RSA 493
cuuaaugaaauuucucau

SEQ ID NO: 556472 - RNA, 14 nt, Coxiella burnetii RSA 493
cuucaaaaauaaaa

SEQ ID NO: 556473 - RNA, 21 nt, Coxiella burnetii RSA 493
cuucaacgaagccuaaacuua

SEQ ID NO: 556474 - RNA, 18 nt, Coxiella burnetii RSA 493
cugugauucacgcgcaua

SEQ ID NO: 556475 - RNA, 15 nt, Coxiella burnetii RSA 493
cuguaucagcgcgga

SEQ ID NO: 556476 - RNA, 15 nt, Coxiella burnetii RSA 493
cuucugcugaagcag

SEQ ID NO: 556477 - RNA, 14 nt, Coxiella burnetii RSA 493
cuucaauucuuuuu

SEQ ID NO: 556478 - RNA, 17 nt, Coxiella burnetii RSA 493
cuugagcgcaaacuuca

SEQ ID NO: 556479 - RNA, 16 nt, Coxiella burnetii RSA 493
cuugcgggaaugacgu

SEQ ID NO: 556480 - RNA, 13 nt, Coxiella burnetii RSA 493
cuuucgauaaauu

SEQ ID NO: 556481 - RNA, 15 nt, Coxiella burnetii RSA 493
cuuuggguuggcuuu

SEQ ID NO: 556482 - RNA, 20 nt, Coxiella burnetii RSA 493
gaaaaagcggauaagccauu

SEQ ID NO: 556483 - RNA, 15 nt, Coxiella burnetii RSA 493
gaagcgaaauacggg

SEQ ID NO: 556484 - RNA, 16 nt, Coxiella burnetii RSA 493
gaagcgaaauacggga

SEQ ID NO: 556485 - RNA, 20 nt, Coxiella burnetii RSA 493
gaagcgaaauacggggacga

SEQ ID NO: 556486 - RNA, 15 nt, Coxiella burnetii RSA 493
gaagcgaaguacggg

SEQ ID NO: 556487 - RNA, 21 nt, Coxiella burnetii RSA 493
gaagcuauccaaauaaucggg

SEQ ID NO: 556488 - RNA, 14 nt, Coxiella burnetii RSA 493
gaagcggaauacgg

SEQ ID NO: 556489 - RNA, 18 nt, Coxiella burnetii RSA 493
gaagaauuuguuuugauc

SEQ ID NO: 556490 - RNA, 15 nt, Coxiella burnetii RSA 493
gaaacgacgaucacc

SEQ ID NO: 556491 - RNA, 15 nt, Coxiella burnetii RSA 493
gaauugcuaccugcu

SEQ ID NO: 556492 - RNA, 21 nt, Coxiella burnetii RSA 493
gaauuagagguucaucgccuu

SEQ ID NO: 556493 - RNA, 17 nt, Coxiella burnetii RSA 493
gaauuauuuuaucgccc

SEQ ID NO: 556494 - RNA, 15 nt, Coxiella burnetii RSA 493
gacgauagaugacau

SEQ ID NO: 556495 - RNA, 16 nt, Coxiella burnetii RSA 493
gacguauugucaaaau

SEQ ID NO: 556496 - RNA, 15 nt, Coxiella burnetii RSA 493
gacgacgaugccaaa

SEQ ID NO: 556497 - RNA, 19 nt, Coxiella burnetii RSA 493
gaccgcugauaaugcgcga

SEQ ID NO: 556498 - RNA, 19 nt, Coxiella burnetii RSA 493
gaggucguuaaaaaauucg

SEQ ID NO: 556499 - RNA, 19 nt, Coxiella burnetii RSA 493
gaggaccagcucggggaca

SEQ ID NO: 556500 - RNA, 15 nt, Coxiella burnetii RSA 493
gauaauaauugcugu

SEQ ID NO: 556501 - RNA, 18 nt, Coxiella burnetii RSA 493
gauaauccgccuaaauua

SEQ ID NO: 556502 - RNA, 19 nt, Coxiella burnetii RSA 493
gauaucuccauuuucaagu

SEQ ID NO: 556503 - RNA, 20 nt, Coxiella burnetii RSA 493
gauauuuuuuaacuccgcaa

SEQ ID NO: 556504 - RNA, 11 nt, Coxiella burnetii RSA 493
gagcgggaauu

SEQ ID NO: 556505 - RNA, 20 nt, Coxiella burnetii RSA 493
gagcgaagcgaaauacggga

SEQ ID NO: 556506 - RNA, 16 nt, Coxiella burnetii RSA 493
gaugucgugcauaucg

SEQ ID NO: 556507 - RNA, 15 nt, Coxiella burnetii RSA 493
gauguuuuaaaauua

SEQ ID NO: 556508 - RNA, 22 nt, Coxiella burnetii RSA 493
gauuaaauaacucaucgaccuc

SEQ ID NO: 556509 - RNA, 16 nt, Coxiella burnetii RSA 493
gcaaaacuaaaucaau

SEQ ID NO: 556510 - RNA, 13 nt, Coxiella burnetii RSA 493
gcaaaaccaauag

SEQ ID NO: 556511 - RNA, 14 nt, Coxiella burnetii RSA 493
gauucacgcgcaua

SEQ ID NO: 556512 - RNA, 21 nt, Coxiella burnetii RSA 493
gauugauacugcguuuuucag

SEQ ID NO: 556513 - RNA, 24 nt, Coxiella burnetii RSA 493
gcaaucggauuaacgugcucguaa

SEQ ID NO: 556514 - RNA, 16 nt, Coxiella burnetii RSA 493
gcacacuuugaugagu

SEQ ID NO: 556515 - RNA, 14 nt, Coxiella burnetii RSA 493
gcaucaggcuaucg

SEQ ID NO: 556516 - RNA, 13 nt, Coxiella burnetii RSA 493
gcaggacauacgg

SEQ ID NO: 556517 - RNA, 21 nt, Coxiella burnetii RSA 493
gccaacuguacugaaaaguaa

SEQ ID NO: 556518 - RNA, 17 nt, Coxiella burnetii RSA 493
gccacauuucggacaac

SEQ ID NO: 556519 - RNA, 19 nt, Coxiella burnetii RSA 493
gcccguaugagcgaagcga

SEQ ID NO: 556520 - RNA, 20 nt, Coxiella burnetii RSA 493
gcccguaugcagcgaagcgg

SEQ ID NO: 556521 - RNA, 15 nt, Coxiella burnetii RSA 493
gccgccuuaauaacc

SEQ ID NO: 556522 - RNA, 20 nt, Coxiella burnetii RSA 493
ccuacgucggguuaucccga

SEQ ID NO: 556523 - RNA, 22 nt, Coxiella burnetii RSA 493
ccucuugcaacguuugauuuuc

SEQ ID NO: 556524 - RNA, 22 nt, Coxiella burnetii RSA 493
ccguauuccgcuuugcuccaua

SEQ ID NO: 556525 - RNA, 18 nt, Coxiella burnetii RSA 493
ccguauuucgcuucgcua

SEQ ID NO: 556526 - RNA, 20 nt, Coxiella burnetii RSA 493
ccguauuucgcuucgcuaca

SEQ ID NO: 556527 - RNA, 21 nt, Coxiella burnetii RSA 493
ccguauuucgcuucgcuacau

SEQ ID NO: 556528 - RNA, 21 nt, Coxiella burnetii RSA 493
ccguauuucgcuucgcucaua

SEQ ID NO: 556529 - RNA, 21 nt, Coxiella burnetii RSA 493
ccguauuucgcuucgcuccau

SEQ ID NO: 556530 - RNA, 22 nt, Coxiella burnetii RSA 493
ccguauuucgcuucgcuccaua

SEQ ID NO: 556531 - RNA, 20 nt, Coxiella burnetii RSA 493
ccguauuucgcuucgcugca

SEQ ID NO: 556532 - RNA, 21 nt, Coxiella burnetii RSA 493
ccguauuucgcuucgcugcau

SEQ ID NO: 556533 - RNA, 22 nt, Coxiella burnetii RSA 493
ccguauuucgcuucgcugcaua

SEQ ID NO: 556534 - RNA, 19 nt, Coxiella burnetii RSA 493
ccguaugcagcgaagcgaa

SEQ ID NO: 556535 - RNA, 19 nt, Coxiella burnetii RSA 493
ccguaugcagcgaagcgga

SEQ ID NO: 556536 - RNA, 20 nt, Coxiella burnetii RSA 493
ccguaugcagcgaagcggaa

SEQ ID NO: 556537 - RNA, 20 nt, Coxiella burnetii RSA 493
ccgguuuugauuuuugcucu

SEQ ID NO: 556538 - RNA, 21 nt, Coxiella burnetii RSA 493
ccgucuuuaauacaaggaaaa

SEQ ID NO: 556539 - RNA, 17 nt, Coxiella burnetii RSA 493
ccguucaccccauuuca

SEQ ID NO: 556540 - RNA, 14 nt, Coxiella burnetii RSA 493
ccgccuacgcggga

SEQ ID NO: 556541 - RNA, 15 nt, Coxiella burnetii RSA 493
ccgcgcaggcgggga

SEQ ID NO: 556542 - RNA, 17 nt, Coxiella burnetii RSA 493
ccgauauucuuuuucuu

SEQ ID NO: 556543 - RNA, 18 nt, Coxiella burnetii RSA 493
ccgauacuuuguuuuuuu

SEQ ID NO: 556544 - RNA, 11 nt, Coxiella burnetii RSA 493
cgauucuuuuu

SEQ ID NO: 556545 - RNA, 12 nt, Coxiella burnetii RSA 493
cgauuucuuuuu

SEQ ID NO: 556546 - RNA, 23 nt, Coxiella burnetii RSA 493
cgauauugauuuaaauuuaaagu

SEQ ID NO: 556547 - RNA, 12 nt, Coxiella burnetii RSA 493
cgauauucuuuu

SEQ ID NO: 556548 - RNA, 18 nt, Coxiella burnetii RSA 493
cgauaucgugcucuuuuu

SEQ ID NO: 556549 - RNA, 13 nt, Coxiella burnetii RSA 493
cgaucagcggaau

SEQ ID NO: 556550 - RNA, 12 nt, Coxiella burnetii RSA 493
cgcauucuuuua

SEQ ID NO: 556551 - RNA, 16 nt, Coxiella burnetii RSA 493
cgcauggauuaaaccc

SEQ ID NO: 556552 - RNA, 14 nt, Coxiella burnetii RSA 493
cgcaugaauuaaau

SEQ ID NO: 556553 - RNA, 18 nt, Coxiella burnetii RSA 493
cgcaucggccuuuuucau

SEQ ID NO: 556554 - RNA, 13 nt, Coxiella burnetii RSA 493
cgcacuacgugcg

SEQ ID NO: 556555 - RNA, 16 nt, Coxiella burnetii RSA 493
cgcaggauaauguuug

SEQ ID NO: 556556 - RNA, 14 nt, Coxiella burnetii RSA 493
cgcaggcggggacg

SEQ ID NO: 556557 - RNA, 17 nt, Coxiella burnetii RSA 493
ccuuucuaacgucgcaa

SEQ ID NO: 556558 - RNA, 22 nt, Coxiella burnetii RSA 493
cgaaaagccccuuugcggcuaa

SEQ ID NO: 556559 - RNA, 12 nt, Coxiella burnetii RSA 493
cgaaauacggga

SEQ ID NO: 556560 - RNA, 12 nt, Coxiella burnetii RSA 493
cgaaauacgggg

SEQ ID NO: 556561 - RNA, 12 nt, Coxiella burnetii RSA 493
cgacaauaaaag

SEQ ID NO: 556562 - RNA, 17 nt, Coxiella burnetii RSA 493
cgaagcgaaauacggga

SEQ ID NO: 556563 - RNA, 19 nt, Coxiella burnetii RSA 493
cgaagcgaaauacgggaaa

SEQ ID NO: 556564 - RNA, 17 nt, Coxiella burnetii RSA 493
cgaagcgaaauacgggg

SEQ ID NO: 556565 - RNA, 19 nt, Coxiella burnetii RSA 493
cgaagcgaaauacggggaa

SEQ ID NO: 556566 - RNA, 16 nt, Coxiella burnetii RSA 493
cgaccuucuuuuuuau

SEQ ID NO: 556567 - RNA, 16 nt, Coxiella burnetii RSA 493
cgacuaauagcucaua

SEQ ID NO: 556568 - RNA, 14 nt, Coxiella burnetii RSA 493
cggcauaaggaugg

SEQ ID NO: 556569 - RNA, 16 nt, Coxiella burnetii RSA 493
cggaauuugaaauaaa

SEQ ID NO: 556570 - RNA, 16 nt, Coxiella burnetii RSA 493
cggagacaccaauaau

SEQ ID NO: 556571 - RNA, 20 nt, Coxiella burnetii RSA 493
cgguauuuugcaaaugaaua

SEQ ID NO: 556572 - RNA, 20 nt, Coxiella burnetii RSA 493
cggucaccgcgucaccgguu

SEQ ID NO: 556573 - RNA, 14 nt, Coxiella burnetii RSA 493
cgcuccauacgggc

SEQ ID NO: 556574 - RNA, 20 nt, Coxiella burnetii RSA 493
cgcuccuaaauuuucuuguu

SEQ ID NO: 556575 - RNA, 13 nt, Coxiella burnetii RSA 493
cgcgcuucuuuua

SEQ ID NO: 556576 - RNA, 20 nt, Coxiella burnetii RSA 493
cgcgcuggauucccgccugc

SEQ ID NO: 556577 - RNA, 14 nt, Coxiella burnetii RSA 493
cgcccccccaaaca

SEQ ID NO: 556578 - RNA, 22 nt, Coxiella burnetii RSA 493
cgccgcaaaguaaaaaugaaau

SEQ ID NO: 556579 - RNA, 14 nt, Coxiella burnetii RSA 493
cgccggcguuugca

SEQ ID NO: 556580 - RNA, 19 nt, Coxiella burnetii RSA 493
cagcgaagcggaauacgga

SEQ ID NO: 556581 - RNA, 20 nt, Coxiella burnetii RSA 493
cagcgaagcgaaauacggga

SEQ ID NO: 556582 - RNA, 20 nt, Coxiella burnetii RSA 493
cagcgaagcgaaauacgggg

SEQ ID NO: 556583 - RNA, 21 nt, Coxiella burnetii RSA 493
cagcgaagcgaaauacgggga

SEQ ID NO: 556584 - RNA, 14 nt, Coxiella burnetii RSA 493
cacuuuaauaucgc

SEQ ID NO: 556585 - RNA, 13 nt, Coxiella burnetii RSA 493
cacuuucaaucgc

SEQ ID NO: 556586 - RNA, 19 nt, Coxiella burnetii RSA 493
cacggcaaauaaaggcgac

SEQ ID NO: 556587 - RNA, 21 nt, Coxiella burnetii RSA 493
cagcuuauacugcccaagaaa

SEQ ID NO: 556588 - RNA, 19 nt, Coxiella burnetii RSA 493
caucauuguuuucccguau

SEQ ID NO: 556589 - RNA, 14 nt, Coxiella burnetii RSA 493
caucaaaauuaaaa

SEQ ID NO: 556590 - RNA, 12 nt, Coxiella burnetii RSA 493
cauauucgcucc

SEQ ID NO: 556591 - RNA, 15 nt, Coxiella burnetii RSA 493
cauauucgcuccauu

SEQ ID NO: 556592 - RNA, 18 nt, Coxiella burnetii RSA 493
cauaucgggauaaguaaa

SEQ ID NO: 556593 - RNA, 20 nt, Coxiella burnetii RSA 493
cauaugaauauuaguggaau

SEQ ID NO: 556594 - RNA, 18 nt, Coxiella burnetii RSA 493
cauaucgccauauaaagu

SEQ ID NO: 556595 - RNA, 22 nt, Coxiella burnetii RSA 493
cauagguuuuuuuaaacguuuu

SEQ ID NO: 556596 - RNA, 18 nt, Coxiella burnetii RSA 493
cagugccgguucccgcuu

SEQ ID NO: 556597 - RNA, 20 nt, Coxiella burnetii RSA 493
ccaaagaguugagcgaagaa

SEQ ID NO: 556598 - RNA, 20 nt, Coxiella burnetii RSA 493
ccaaacuucucgggcuaaga

SEQ ID NO: 556599 - RNA, 21 nt, Coxiella burnetii RSA 493
cauuugccgccaggcuucaua

SEQ ID NO: 556600 - RNA, 23 nt, Coxiella burnetii RSA 493
cauuuguauggcgccugacaaag

SEQ ID NO: 556601 - RNA, 14 nt, Coxiella burnetii RSA 493
cauucauucuuuuu

SEQ ID NO: 556602 - RNA, 15 nt, Coxiella burnetii RSA 493
caugacaauuuaaua

SEQ ID NO: 556603 - RNA, 16 nt, Coxiella burnetii RSA 493
caucguugggaugauc

SEQ ID NO: 556604 - RNA, 17 nt, Coxiella burnetii RSA 493
ccagcgcacuacgugcg

SEQ ID NO: 556605 - RNA, 12 nt, Coxiella burnetii RSA 493
ccacuaaggugg

SEQ ID NO: 556606 - RNA, 22 nt, Coxiella burnetii RSA 493
cccaaaguuucacgaauuaaaa

SEQ ID NO: 556607 - RNA, 14 nt, Coxiella burnetii RSA 493
ccaguauuuuucuu

SEQ ID NO: 556608 - RNA, 14 nt, Coxiella burnetii RSA 493
cccuuuuuuuccau

SEQ ID NO: 556609 - RNA, 16 nt, Coxiella burnetii RSA 493
cccgucugggauggua

SEQ ID NO: 556610 - RNA, 15 nt, Coxiella burnetii RSA 493
cccguauuucgcuuc

SEQ ID NO: 556611 - RNA, 22 nt, Coxiella burnetii RSA 493
cccguauuucgcuucgcuacau

SEQ ID NO: 556612 - RNA, 23 nt, Coxiella burnetii RSA 493
cccguauuucgcuucgcuacaua

SEQ ID NO: 556613 - RNA, 21 nt, Coxiella burnetii RSA 493
cccguauuucgcuucgcucau

SEQ ID NO: 556614 - RNA, 22 nt, Coxiella burnetii RSA 493
cccguauuucgcuucgcuccau

SEQ ID NO: 556615 - RNA, 20 nt, Coxiella burnetii RSA 493
cccguaucaccaaaauacag

SEQ ID NO: 556616 - RNA, 23 nt, Coxiella burnetii RSA 493
cccguaugagcgaacgaauacgg

SEQ ID NO: 556617 - RNA, 18 nt, Coxiella burnetii RSA 493
cccguaugagcgaagcga

SEQ ID NO: 556618 - RNA, 20 nt, Coxiella burnetii RSA 493
cccguauuccgcuuugcucc

SEQ ID NO: 556619 - RNA, 13 nt, Coxiella burnetii RSA 493
cccgcuuaaaccc

SEQ ID NO: 556620 - RNA, 17 nt, Coxiella burnetii RSA 493
aucauacuuaauuucgc

SEQ ID NO: 556621 - RNA, 17 nt, Coxiella burnetii RSA 493
auccaaaauccaggcug

SEQ ID NO: 556622 - RNA, 21 nt, Coxiella burnetii RSA 493
auccaauuacuccaauuucau

SEQ ID NO: 556623 - RNA, 14 nt, Coxiella burnetii RSA 493
auccacaauuucaa

SEQ ID NO: 556624 - RNA, 23 nt, Coxiella burnetii RSA 493
aucaucugagauaucaauagcgc

SEQ ID NO: 556625 - RNA, 20 nt, Coxiella burnetii RSA 493
aucccgaaacggaugagcaa

SEQ ID NO: 556626 - RNA, 22 nt, Coxiella burnetii RSA 493
auccauccggaugucauaauca

SEQ ID NO: 556627 - RNA, 22 nt, Coxiella burnetii RSA 493
auccccaaaggugucaaaauua

SEQ ID NO: 556628 - RNA, 19 nt, Coxiella burnetii RSA 493
aucucuugcccccauugau

SEQ ID NO: 556629 - RNA, 19 nt, Coxiella burnetii RSA 493
aucucuuaaaauuccgauu

SEQ ID NO: 556630 - RNA, 23 nt, Coxiella burnetii RSA 493
aucucacgugagguuacauuaaa

SEQ ID NO: 556631 - RNA, 20 nt, Coxiella burnetii RSA 493
aucguccccguauuucgcuu

SEQ ID NO: 556632 - RNA, 17 nt, Coxiella burnetii RSA 493
aucgauaagaucaauua

SEQ ID NO: 556633 - RNA, 15 nt, Coxiella burnetii RSA 493
aucgauaaaaauaau

SEQ ID NO: 556634 - RNA, 16 nt, Coxiella burnetii RSA 493
augcaagguugaugcu

SEQ ID NO: 556635 - RNA, 17 nt, Coxiella burnetii RSA 493
augagcgaacgaauacg

SEQ ID NO: 556636 - RNA, 19 nt, Coxiella burnetii RSA 493
augagcgaacgaauacggg

SEQ ID NO: 556637 - RNA, 17 nt, Coxiella burnetii RSA 493
augagcgaagcgaaaua

SEQ ID NO: 556638 - RNA, 19 nt, Coxiella burnetii RSA 493
augagcgaagcgaaauacg

SEQ ID NO: 556639 - RNA, 21 nt, Coxiella burnetii RSA 493
augagcgaagcgaaauacggg

SEQ ID NO: 556640 - RNA, 21 nt, Coxiella burnetii RSA 493
augagcgaagcgaaguacggg

SEQ ID NO: 556641 - RNA, 13 nt, Coxiella burnetii RSA 493
augagauaacucu

SEQ ID NO: 556642 - RNA, 15 nt, Coxiella burnetii RSA 493
augagaugaucauca

SEQ ID NO: 556643 - RNA, 15 nt, Coxiella burnetii RSA 493
augaggccaaaaauu

SEQ ID NO: 556644 - RNA, 15 nt, Coxiella burnetii RSA 493
augacucgcgaaauu

SEQ ID NO: 556645 - RNA, 17 nt, Coxiella burnetii RSA 493
augccgcuugaaaaauu

SEQ ID NO: 556646 - RNA, 23 nt, Coxiella burnetii RSA 493
auuaaccacucggaaagcaucaa

SEQ ID NO: 556647 - RNA, 22 nt, Coxiella burnetii RSA 493
auuaauauuaaaacaagacaac

SEQ ID NO: 556648 - RNA, 11 nt, Coxiella burnetii RSA 493
auuaauuuccg

SEQ ID NO: 556649 - RNA, 15 nt, Coxiella burnetii RSA 493
auucauugaaagcgc

SEQ ID NO: 556650 - RNA, 20 nt, Coxiella burnetii RSA 493
auuccacaauuuuccggcuu

SEQ ID NO: 556651 - RNA, 15 nt, Coxiella burnetii RSA 493
auuagccagcgaaua

SEQ ID NO: 556652 - RNA, 19 nt, Coxiella burnetii RSA 493
auuaggaucaagcgccaac

SEQ ID NO: 556653 - RNA, 18 nt, Coxiella burnetii RSA 493
auuagcugccauuuucau

SEQ ID NO: 556654 - RNA, 17 nt, Coxiella burnetii RSA 493
auuauaacuauuuuaaa

SEQ ID NO: 556655 - RNA, 21 nt, Coxiella burnetii RSA 493
auguagcccaacaaaaugguu

SEQ ID NO: 556656 - RNA, 21 nt, Coxiella burnetii RSA 493
auuugaauuucuguuuuacug

SEQ ID NO: 556657 - RNA, 19 nt, Coxiella burnetii RSA 493
auuuccugucguuaauacg

SEQ ID NO: 556658 - RNA, 20 nt, Coxiella burnetii RSA 493
auuucgcuucgcuacauacg

SEQ ID NO: 556659 - RNA, 19 nt, Coxiella burnetii RSA 493
auuucgcuucgcucauacg

SEQ ID NO: 556660 - RNA, 20 nt, Coxiella burnetii RSA 493
auuucgcuucgcuccauacg

SEQ ID NO: 556661 - RNA, 20 nt, Coxiella burnetii RSA 493
auuucgcuucgcugcauacg

SEQ ID NO: 556662 - RNA, 21 nt, Coxiella burnetii RSA 493
auuucggauguuuuuucacuu

SEQ ID NO: 556663 - RNA, 15 nt, Coxiella burnetii RSA 493
auuugugauuuuaaa

SEQ ID NO: 556664 - RNA, 23 nt, Coxiella burnetii RSA 493
auuuguuauugcuaaaaucgaug

SEQ ID NO: 556665 - RNA, 19 nt, Coxiella burnetii RSA 493
auuugguuguggcugaaaa

SEQ ID NO: 556666 - RNA, 13 nt, Coxiella burnetii RSA 493
auuuguauugagg

SEQ ID NO: 556667 - RNA, 16 nt, Coxiella burnetii RSA 493
auuugcugaauuuuau

SEQ ID NO: 556668 - RNA, 14 nt, Coxiella burnetii RSA 493
auuuacaauauccc

SEQ ID NO: 556669 - RNA, 19 nt, Coxiella burnetii RSA 493
auuuaucaacgauuuuaag

SEQ ID NO: 556670 - RNA, 20 nt, Coxiella burnetii RSA 493
auuccccguauuucgcuucg

SEQ ID NO: 556671 - RNA, 14 nt, Coxiella burnetii RSA 493
auuucaauuagaau

SEQ ID NO: 556672 - RNA, 14 nt, Coxiella burnetii RSA 493
auuuccgauuuauu

SEQ ID NO: 556673 - RNA, 14 nt, Coxiella burnetii RSA 493
caaagaauuuuucc

SEQ ID NO: 556674 - RNA, 18 nt, Coxiella burnetii RSA 493
caaaagauauucgguuuu

SEQ ID NO: 556675 - RNA, 13 nt, Coxiella burnetii RSA 493
caaaacgaaaagc

SEQ ID NO: 556676 - RNA, 23 nt, Coxiella burnetii RSA 493
caaaaagauaaucccaauaaaac

SEQ ID NO: 556677 - RNA, 19 nt, Coxiella burnetii RSA 493
caaaaaauagcgagaaaac

SEQ ID NO: 556678 - RNA, 11 nt, Coxiella burnetii RSA 493
caaaaaaagaa

SEQ ID NO: 556679 - RNA, 20 nt, Coxiella burnetii RSA 493
auuuuuguaaauuaaucauc

SEQ ID NO: 556680 - RNA, 18 nt, Coxiella burnetii RSA 493
auuuuccucccauugaua

SEQ ID NO: 556681 - RNA, 16 nt, Coxiella burnetii RSA 493
auuuucucuaaugaua

SEQ ID NO: 556682 - RNA, 19 nt, Coxiella burnetii RSA 493
auuuugauuuuuuaauuca

SEQ ID NO: 556683 - RNA, 15 nt, Coxiella burnetii RSA 493
auuuugcuuaauacg

SEQ ID NO: 556684 - RNA, 14 nt, Coxiella burnetii RSA 493
caaaguucauuaag

SEQ ID NO: 556685 - RNA, 21 nt, Coxiella burnetii RSA 493
caacuuuauaguucauuaaau

SEQ ID NO: 556686 - RNA, 12 nt, Coxiella burnetii RSA 493
caagaagcaucg

SEQ ID NO: 556687 - RNA, 16 nt, Coxiella burnetii RSA 493
caagacucaaagaaau

SEQ ID NO: 556688 - RNA, 18 nt, Coxiella burnetii RSA 493
caacuugggugggauugu

SEQ ID NO: 556689 - RNA, 17 nt, Coxiella burnetii RSA 493
caagaguguucgcuaau

SEQ ID NO: 556690 - RNA, 20 nt, Coxiella burnetii RSA 493
caauucccguauuucgcuuc

SEQ ID NO: 556691 - RNA, 18 nt, Coxiella burnetii RSA 493
caauucgggggcaacggg

SEQ ID NO: 556692 - RNA, 20 nt, Coxiella burnetii RSA 493
caauuacgcccuuucucuuu

SEQ ID NO: 556693 - RNA, 22 nt, Coxiella burnetii RSA 493
cacaaauuauaucauugggcca

SEQ ID NO: 556694 - RNA, 13 nt, Coxiella burnetii RSA 493
cacauaagcgaau

SEQ ID NO: 556695 - RNA, 14 nt, Coxiella burnetii RSA 493
agcuguuuuuucua

SEQ ID NO: 556696 - RNA, 18 nt, Coxiella burnetii RSA 493
aggaccguuaugaaaaca

SEQ ID NO: 556697 - RNA, 22 nt, Coxiella burnetii RSA 493
agggcccacuuucacaauuuga

SEQ ID NO: 556698 - RNA, 13 nt, Coxiella burnetii RSA 493
aggcucuucauau

SEQ ID NO: 556699 - RNA, 16 nt, Coxiella burnetii RSA 493
aggcguagauuuuaaa

SEQ ID NO: 556700 - RNA, 13 nt, Coxiella burnetii RSA 493
auaaccuaaaaua

SEQ ID NO: 556701 - RNA, 14 nt, Coxiella burnetii RSA 493
auaaccuuucgcuu

SEQ ID NO: 556702 - RNA, 14 nt, Coxiella burnetii RSA 493
auaccaaaaagcgu

SEQ ID NO: 556703 - RNA, 23 nt, Coxiella burnetii RSA 493
auaaucaaaaucagaaacggcgc

SEQ ID NO: 556704 - RNA, 16 nt, Coxiella burnetii RSA 493
auacgggaaaacaaug

SEQ ID NO: 556705 - RNA, 15 nt, Coxiella burnetii RSA 493
auaggcuuucuuuuu

SEQ ID NO: 556706 - RNA, 21 nt, Coxiella burnetii RSA 493
auaggugcuugacgucguuug

SEQ ID NO: 556707 - RNA, 13 nt, Coxiella burnetii RSA 493
auaguuucaaauu

SEQ ID NO: 556708 - RNA, 12 nt, Coxiella burnetii RSA 493
auagugcuuuua

SEQ ID NO: 556709 - RNA, 19 nt, Coxiella burnetii RSA 493
auaguucauuaaauuuaau

SEQ ID NO: 556710 - RNA, 22 nt, Coxiella burnetii RSA 493
auauccuuguaauucaaauuuu

SEQ ID NO: 556711 - RNA, 13 nt, Coxiella burnetii RSA 493
auauaggcgaauc

SEQ ID NO: 556712 - RNA, 23 nt, Coxiella burnetii RSA 493
auaguuuuggcguaugaauaauu

SEQ ID NO: 556713 - RNA, 17 nt, Coxiella burnetii RSA 493
auaucugaucaaaaaua

SEQ ID NO: 556714 - RNA, 16 nt, Coxiella burnetii RSA 493
agugaucauaguggau

SEQ ID NO: 556715 - RNA, 13 nt, Coxiella burnetii RSA 493
agugccgcgaaua

SEQ ID NO: 556716 - RNA, 14 nt, Coxiella burnetii RSA 493
aguggaauuuuaac

SEQ ID NO: 556717 - RNA, 16 nt, Coxiella burnetii RSA 493
aguguuuuuuugaagc

SEQ ID NO: 556718 - RNA, 17 nt, Coxiella burnetii RSA 493
agucguuuuuuaauauu

SEQ ID NO: 556719 - RNA, 14 nt, Coxiella burnetii RSA 493
aguagaaaacuuuc

SEQ ID NO: 556720 - RNA, 13 nt, Coxiella burnetii RSA 493
agcauauaaaagu

SEQ ID NO: 556721 - RNA, 22 nt, Coxiella burnetii RSA 493
agauccgucgucguugacaaac

SEQ ID NO: 556722 - RNA, 20 nt, Coxiella burnetii RSA 493
agaucauacauaugaauauu

SEQ ID NO: 556723 - RNA, 15 nt, Coxiella burnetii RSA 493
agauugccacucuuu

SEQ ID NO: 556724 - RNA, 19 nt, Coxiella burnetii RSA 493
agaauaccccgcuguuuuc

SEQ ID NO: 556725 - RNA, 20 nt, Coxiella burnetii RSA 493
agaauuaauguuauuuauuu

SEQ ID NO: 556726 - RNA, 17 nt, Coxiella burnetii RSA 493
agaauuuguuuugauca

SEQ ID NO: 556727 - RNA, 17 nt, Coxiella burnetii RSA 493
agacauuguucauaaaa

SEQ ID NO: 556728 - RNA, 17 nt, Coxiella burnetii RSA 493
agaagauuuuuuuucuu

SEQ ID NO: 556729 - RNA, 14 nt, Coxiella burnetii RSA 493
agauaauaauuaua

SEQ ID NO: 556730 - RNA, 21 nt, Coxiella burnetii RSA 493
agcgaagcggaauacggagaa

SEQ ID NO: 556731 - RNA, 19 nt, Coxiella burnetii RSA 493
agcgaagcgaaauacggga

SEQ ID NO: 556732 - RNA, 15 nt, Coxiella burnetii RSA 493
agcgaaguacgggaa

SEQ ID NO: 556733 - RNA, 14 nt, Coxiella burnetii RSA 493
agcgaaauacggga

SEQ ID NO: 556734 - RNA, 17 nt, Coxiella burnetii RSA 493
agcgaaauacgggaaaa

SEQ ID NO: 556735 - RNA, 20 nt, Coxiella burnetii RSA 493
agcgaaauacgggaaaacaa

SEQ ID NO: 556736 - RNA, 19 nt, Coxiella burnetii RSA 493
agcgaaauacggggaaaua

SEQ ID NO: 556737 - RNA, 20 nt, Coxiella burnetii RSA 493
agcgaaauacggggaaauaa

SEQ ID NO: 556738 - RNA, 20 nt, Coxiella burnetii RSA 493
agcgaaauacggggacaaua

SEQ ID NO: 556739 - RNA, 20 nt, Coxiella burnetii RSA 493
agcgaaauacggggacgaua

SEQ ID NO: 556740 - RNA, 13 nt, Coxiella burnetii RSA 493
agcgaaauacgag

SEQ ID NO: 556741 - RNA, 15 nt, Coxiella burnetii RSA 493
agcgacuuuuuucuu

SEQ ID NO: 556742 - RNA, 18 nt, Coxiella burnetii RSA 493
guuuaaaguuauuucuuu

SEQ ID NO: 556743 - RNA, 14 nt, Coxiella burnetii RSA 493
guuuaagcugauac

SEQ ID NO: 556744 - RNA, 20 nt, Coxiella burnetii RSA 493
guuuauuuccgucaauuuuu

SEQ ID NO: 556745 - RNA, 16 nt, Coxiella burnetii RSA 493
guuuauuugaucgccc

SEQ ID NO: 556746 - RNA, 16 nt, Coxiella burnetii RSA 493
guugucuuggaaaaaa

SEQ ID NO: 556747 - RNA, 14 nt, Coxiella burnetii RSA 493
guucucaaauuuuc

SEQ ID NO: 556748 - RNA, 21 nt, Coxiella burnetii RSA 493
guucggauuucacuuuauuuu

SEQ ID NO: 556749 - RNA, 18 nt, Coxiella burnetii RSA 493
uaacacggccuucauuau

SEQ ID NO: 556750 - RNA, 15 nt, Coxiella burnetii RSA 493
uaaauaccauuuucc

SEQ ID NO: 556751 - RNA, 19 nt, Coxiella burnetii RSA 493
uaaauagcauuaauaagac

SEQ ID NO: 556752 - RNA, 21 nt, Coxiella burnetii RSA 493
uaaaagcgcaauuuccagauc

SEQ ID NO: 556753 - RNA, 14 nt, Coxiella burnetii RSA 493
guuuccaauuguuu

SEQ ID NO: 556754 - RNA, 18 nt, Coxiella burnetii RSA 493
guuucccguauuucgcuu

SEQ ID NO: 556755 - RNA, 19 nt, Coxiella burnetii RSA 493
guuucccguauuucgcuuc

SEQ ID NO: 556756 - RNA, 14 nt, Coxiella burnetii RSA 493
uaaagcagcaauug

SEQ ID NO: 556757 - RNA, 15 nt, Coxiella burnetii RSA 493
uaaagucuucaaaag

SEQ ID NO: 556758 - RNA, 16 nt, Coxiella burnetii RSA 493
uaaagugccgcgaaua

SEQ ID NO: 556759 - RNA, 15 nt, Coxiella burnetii RSA 493
uaaagguaaaaagau

SEQ ID NO: 556760 - RNA, 19 nt, Coxiella burnetii RSA 493
uaagaaggucuacguacug

SEQ ID NO: 556761 - RNA, 15 nt, Coxiella burnetii RSA 493
uaagcaauuuuuuau

SEQ ID NO: 556762 - RNA, 17 nt, Coxiella burnetii RSA 493
uaaggccaauuccaaua

SEQ ID NO: 556763 - RNA, 13 nt, Coxiella burnetii RSA 493
uaauaaaacccgu

SEQ ID NO: 556764 - RNA, 17 nt, Coxiella burnetii RSA 493
uaagcuagaaaauaacc

SEQ ID NO: 556765 - RNA, 13 nt, Coxiella burnetii RSA 493
uaauaauuuuccg

SEQ ID NO: 556766 - RNA, 20 nt, Coxiella burnetii RSA 493
uaauacaaggaaaauccgga

SEQ ID NO: 556767 - RNA, 12 nt, Coxiella burnetii RSA 493
uaauaaaucaau

SEQ ID NO: 556768 - RNA, 17 nt, Coxiella burnetii RSA 493
uaauucgagcaucuuuu

SEQ ID NO: 556769 - RNA, 15 nt, Coxiella burnetii RSA 493
uaauucauaaauaau

SEQ ID NO: 556770 - RNA, 16 nt, Coxiella burnetii RSA 493
uaaugaguucauuaau

SEQ ID NO: 556771 - RNA, 20 nt, Coxiella burnetii RSA 493
uaaugaucaaugaaacaaac

SEQ ID NO: 556772 - RNA, 20 nt, Coxiella burnetii RSA 493
uaauggaucgcgcgccauug

SEQ ID NO: 556773 - RNA, 18 nt, Coxiella burnetii RSA 493
uaauccgccuaaauuaau

SEQ ID NO: 556774 - RNA, 11 nt, Coxiella burnetii RSA 493
uaaucauuaac

SEQ ID NO: 556775 - RNA, 15 nt, Coxiella burnetii RSA 493
uaaucauuaacgaau

SEQ ID NO: 556776 - RNA, 18 nt, Coxiella burnetii RSA 493
uaaucguucggcuucaua

SEQ ID NO: 556777 - RNA, 14 nt, Coxiella burnetii RSA 493
uaaucgcgggauca

SEQ ID NO: 556778 - RNA, 22 nt, Coxiella burnetii RSA 493
uaaucgcuccgaaaauaaauac

SEQ ID NO: 556779 - RNA, 19 nt, Coxiella burnetii RSA 493
uaaucugcuggcgaucgcc

SEQ ID NO: 556780 - RNA, 15 nt, Coxiella burnetii RSA 493
gugcucuuuuucauu

SEQ ID NO: 556781 - RNA, 15 nt, Coxiella burnetii RSA 493
guuauguacucagcu

SEQ ID NO: 556782 - RNA, 17 nt, Coxiella burnetii RSA 493
aaguuaagauaauaauu

SEQ ID NO: 556783 - RNA, 11 nt, Coxiella burnetii RSA 493
guguaauugau

SEQ ID NO: 556784 - RNA, 15 nt, Coxiella burnetii RSA 493
guggggauaauugaa

SEQ ID NO: 556785 - RNA, 20 nt, Coxiella burnetii RSA 493
uagcuuucgucauucccgug

SEQ ID NO: 556786 - RNA, 18 nt, Coxiella burnetii RSA 493
uaguuauuuuucaucuug

SEQ ID NO: 556787 - RNA, 19 nt, Coxiella burnetii RSA 493
uagucgcguauaaaugaau

SEQ ID NO: 556788 - RNA, 15 nt, Coxiella burnetii RSA 493
uaucaauagcgcaau

SEQ ID NO: 556789 - RNA, 16 nt, Coxiella burnetii RSA 493
uaucaauagcgcaauu

SEQ ID NO: 556790 - RNA, 19 nt, Coxiella burnetii RSA 493
uaucaauauggaacccguu

SEQ ID NO: 556791 - RNA, 22 nt, Coxiella burnetii RSA 493
uaucauucacuaaucgucgaca

SEQ ID NO: 556792 - RNA, 20 nt, Coxiella burnetii RSA 493
uaguuucccguauuucgcuu

SEQ ID NO: 556793 - RNA, 19 nt, Coxiella burnetii RSA 493
uauaaucuuaucaauggga

SEQ ID NO: 556794 - RNA, 20 nt, Coxiella burnetii RSA 493
uauagcuuguuccuuuuuau

SEQ ID NO: 556795 - RNA, 14 nt, Coxiella burnetii RSA 493
uauaguucauuaaa

SEQ ID NO: 556796 - RNA, 12 nt, Coxiella burnetii RSA 493
ucaaauuuuccc

SEQ ID NO: 556797 - RNA, 17 nt, Coxiella burnetii RSA 493
ucaaaacaaucaaugca

SEQ ID NO: 556798 - RNA, 16 nt, Coxiella burnetii RSA 493
uauuuuuucccgcaac

SEQ ID NO: 556799 - RNA, 23 nt, Coxiella burnetii RSA 493
uauuucuaucgccguuucugcuu

SEQ ID NO: 556800 - RNA, 19 nt, Coxiella burnetii RSA 493
uauuucgcuucgcuacaua

SEQ ID NO: 556801 - RNA, 20 nt, Coxiella burnetii RSA 493
uauuucgcuucgcuacauac

SEQ ID NO: 556802 - RNA, 18 nt, Coxiella burnetii RSA 493
uauuucgcuucgcucaua

SEQ ID NO: 556803 - RNA, 19 nt, Coxiella burnetii RSA 493
uauuucgcuucgcucauac

SEQ ID NO: 556804 - RNA, 23 nt, Coxiella burnetii RSA 493
uauuucgcuucgcucauacgggc

SEQ ID NO: 556805 - RNA, 20 nt, Coxiella burnetii RSA 493
uauuucgcuucgcuccauac

SEQ ID NO: 556806 - RNA, 19 nt, Coxiella burnetii RSA 493
uauucggcaacaugggaau

SEQ ID NO: 556807 - RNA, 13 nt, Coxiella burnetii RSA 493
uauucgcuccauu

SEQ ID NO: 556808 - RNA, 20 nt, Coxiella burnetii RSA 493
uauuccgcuucgcugcauac

SEQ ID NO: 556809 - RNA, 20 nt, Coxiella burnetii RSA 493
uauuccgcuuugcuccauac

SEQ ID NO: 556810 - RNA, 21 nt, Coxiella burnetii RSA 493
uaucgaaggaauagccuucuc

SEQ ID NO: 556811 - RNA, 22 nt, Coxiella burnetii RSA 493
uagcauuguuggaaauaaugga

SEQ ID NO: 556812 - RNA, 23 nt, Coxiella burnetii RSA 493
uagccagcgaauacgaauuucaa

SEQ ID NO: 556813 - RNA, 15 nt, Coxiella burnetii RSA 493
uagcgauuuugacgu

SEQ ID NO: 556814 - RNA, 16 nt, Coxiella burnetii RSA 493
uacucucaaaaucacu

SEQ ID NO: 556815 - RNA, 20 nt, Coxiella burnetii RSA 493
uacuuaaaauuucuuuccag

SEQ ID NO: 556816 - RNA, 20 nt, Coxiella burnetii RSA 493
uacuucuauacaaugcguag

SEQ ID NO: 556817 - RNA, 15 nt, Coxiella burnetii RSA 493
uaccauuaaaagcga

SEQ ID NO: 556818 - RNA, 13 nt, Coxiella burnetii RSA 493
uaccauuuuuaaa

SEQ ID NO: 556819 - RNA, 11 nt, Coxiella burnetii RSA 493
uaccgauuaau

SEQ ID NO: 556820 - RNA, 14 nt, Coxiella burnetii RSA 493
uaccguauuuaauc

SEQ ID NO: 556821 - RNA, 13 nt, Coxiella burnetii RSA 493
ucaugaaaagcgg

SEQ ID NO: 556822 - RNA, 19 nt, Coxiella burnetii RSA 493
ucauccauucuuucauuau

SEQ ID NO: 556823 - RNA, 17 nt, Coxiella burnetii RSA 493
ucaucaaaauuaaaauc

SEQ ID NO: 556824 - RNA, 18 nt, Coxiella burnetii RSA 493
ucaucaauauauucgcua

SEQ ID NO: 556825 - RNA, 22 nt, Coxiella burnetii RSA 493
ucacacguaucugcuaaaaagc

SEQ ID NO: 556826 - RNA, 13 nt, Coxiella burnetii RSA 493
ucaaccagaaaua

SEQ ID NO: 556827 - RNA, 13 nt, Coxiella burnetii RSA 493
aauacauaaaauu

SEQ ID NO: 556828 - RNA, 21 nt, Coxiella burnetii RSA 493
ucccuucugcugaagcaguag

SEQ ID NO: 556829 - RNA, 15 nt, Coxiella burnetii RSA 493
uccgccuaaauuaau

SEQ ID NO: 556830 - RNA, 14 nt, Coxiella burnetii RSA 493
uccgccuuuauuag

SEQ ID NO: 556831 - RNA, 15 nt, Coxiella burnetii RSA 493
ucccacguuguuuga

SEQ ID NO: 556832 - RNA, 23 nt, Coxiella burnetii RSA 493
ucccagcguuuccaauuguuuga

SEQ ID NO: 556833 - RNA, 18 nt, Coxiella burnetii RSA 493
ucccauguccauccgcua

SEQ ID NO: 556834 - RNA, 17 nt, Coxiella burnetii RSA 493
ucccguauuucgcuucg

SEQ ID NO: 556835 - RNA, 18 nt, Coxiella burnetii RSA 493
uccuuuuguuaauucuuu

SEQ ID NO: 556836 - RNA, 23 nt, Coxiella burnetii RSA 493
ucgaaaaaaaucguuuugaaauu

SEQ ID NO: 556837 - RNA, 20 nt, Coxiella burnetii RSA 493
uccuuguaauucaaauuuua

SEQ ID NO: 556838 - RNA, 20 nt, Coxiella burnetii RSA 493
uccucguauuccgcuucgcu

SEQ ID NO: 556839 - RNA, 15 nt, Coxiella burnetii RSA 493
uccguaauuuuaacg

SEQ ID NO: 556840 - RNA, 17 nt, Coxiella burnetii RSA 493
ucgagguugucaacaaa

SEQ ID NO: 556841 - RNA, 15 nt, Coxiella burnetii RSA 493
ucgcaucauucgggc

SEQ ID NO: 556842 - RNA, 20 nt, Coxiella burnetii RSA 493
ucgcguagcgacacaaccac

SEQ ID NO: 556843 - RNA, 22 nt, Coxiella burnetii RSA 493
ucgcguauaaaugaauaauauu

SEQ ID NO: 556844 - RNA, 13 nt, Coxiella burnetii RSA 493
ucgcuaaauaaca

SEQ ID NO: 556845 - RNA, 23 nt, Coxiella burnetii RSA 493
ucgcuuuucguucugaaauuuua

SEQ ID NO: 556846 - RNA, 20 nt, Coxiella burnetii RSA 493
ucgcuucgcuacauacgggc

SEQ ID NO: 556847 - RNA, 19 nt, Coxiella burnetii RSA 493
ucgcuucgcucauacgggc

SEQ ID NO: 556848 - RNA, 20 nt, Coxiella burnetii RSA 493
ucgcuucgcuccauacgggc

SEQ ID NO: 556849 - RNA, 20 nt, Coxiella burnetii RSA 493
ucgcuucgcugcauacggac

SEQ ID NO: 556850 - RNA, 11 nt, Coxiella burnetii RSA 493
ucgguuuuuuu

SEQ ID NO: 556851 - RNA, 21 nt, Coxiella burnetii RSA 493
ucgguucaagcacuaguuuua

SEQ ID NO: 556852 - RNA, 14 nt, Coxiella burnetii RSA 493
ucgucccaaaaaac

SEQ ID NO: 556853 - RNA, 19 nt, Coxiella burnetii RSA 493
ucgucgaugauuuuuucga

SEQ ID NO: 556854 - RNA, 21 nt, Coxiella burnetii RSA 493
ucgggcgugaaggaaauuugc

SEQ ID NO: 556855 - RNA, 13 nt, Coxiella burnetii RSA 493
ucgggaaauaaaa

SEQ ID NO: 556856 - RNA, 17 nt, Coxiella burnetii RSA 493
ucucagcgucuuuuuua

SEQ ID NO: 556857 - RNA, 13 nt, Coxiella burnetii RSA 493
ucucuuuuuuugc

SEQ ID NO: 556858 - RNA, 14 nt, Coxiella burnetii RSA 493
ucugccuuuuuuua

SEQ ID NO: 556859 - RNA, 19 nt, Coxiella burnetii RSA 493
ucuuauuauucauaucuuu

SEQ ID NO: 556860 - RNA, 21 nt, Coxiella burnetii RSA 493
ucuuauuuucugggagauuua

SEQ ID NO: 556861 - RNA, 14 nt, Coxiella burnetii RSA 493
ucuugcugcaaaaa

SEQ ID NO: 556862 - RNA, 21 nt, Coxiella burnetii RSA 493
ucuugcugcaaaaacgugccg

SEQ ID NO: 556863 - RNA, 18 nt, Coxiella burnetii RSA 493
ucuuggagauuuagccaa

SEQ ID NO: 556864 - RNA, 20 nt, Coxiella burnetii RSA 493
ucuuccaauaacauaucuuc

SEQ ID NO: 556865 - RNA, 19 nt, Coxiella burnetii RSA 493
ucuuuccaucaccuucaac

SEQ ID NO: 556866 - RNA, 14 nt, Coxiella burnetii RSA 493
ugcagcgaagcgaa

SEQ ID NO: 556867 - RNA, 20 nt, Coxiella burnetii RSA 493
ugcagcgaagcgaaauacgg

SEQ ID NO: 556868 - RNA, 21 nt, Coxiella burnetii RSA 493
ugcagcgaagcgaaauacggg

SEQ ID NO: 556869 - RNA, 22 nt, Coxiella burnetii RSA 493
ugcagcgaagcgaaauacgggg

SEQ ID NO: 556870 - RNA, 21 nt, Coxiella burnetii RSA 493
ugcagcuucgugcaauuucug

SEQ ID NO: 556871 - RNA, 14 nt, Coxiella burnetii RSA 493
ugcagaguuauuau

SEQ ID NO: 556872 - RNA, 16 nt, Coxiella burnetii RSA 493
ugcauagcauccuuaa

SEQ ID NO: 556873 - RNA, 22 nt, Coxiella burnetii RSA 493
ugccagcaauggugauuucuuc

SEQ ID NO: 556874 - RNA, 13 nt, Coxiella burnetii RSA 493
ugcccauaaauaa

SEQ ID NO: 556875 - RNA, 20 nt, Coxiella burnetii RSA 493
ugagcgaacgaauacgggga

SEQ ID NO: 556876 - RNA, 18 nt, Coxiella burnetii RSA 493
ugagcgaagcgaaauacg

SEQ ID NO: 556877 - RNA, 19 nt, Coxiella burnetii RSA 493
ugagcgaagcgaaauacgg

SEQ ID NO: 556878 - RNA, 21 nt, Coxiella burnetii RSA 493
ugagcgaagcgaaauacggga

SEQ ID NO: 556879 - RNA, 22 nt, Coxiella burnetii RSA 493
ugagcgaagcgaaauacgggga

SEQ ID NO: 556880 - RNA, 20 nt, Coxiella burnetii RSA 493
ugagcgaagcgaaguacggg

SEQ ID NO: 556881 - RNA, 21 nt, Coxiella burnetii RSA 493
ugagcgaagcgaaguacggga

SEQ ID NO: 556882 - RNA, 21 nt, Coxiella burnetii RSA 493
ugaaccuaaauuauaaaugga

SEQ ID NO: 556883 - RNA, 16 nt, Coxiella burnetii RSA 493
aauuaaaaaucgguuu

SEQ ID NO: 556884 - RNA, 17 nt, Coxiella burnetii RSA 493
acaaacaaaaaauagcg

SEQ ID NO: 556885 - RNA, 16 nt, Coxiella burnetii RSA 493
aauuuuugcaucggua

SEQ ID NO: 556886 - RNA, 15 nt, Coxiella burnetii RSA 493
aauuuuuucauaacg

SEQ ID NO: 556887 - RNA, 14 nt, Coxiella burnetii RSA 493
acaaauaaagcagc

SEQ ID NO: 556888 - RNA, 12 nt, Coxiella burnetii RSA 493
acaauaaacaca

SEQ ID NO: 556889 - RNA, 18 nt, Coxiella burnetii RSA 493
acagcccccgaauugggg

SEQ ID NO: 556890 - RNA, 14 nt, Coxiella burnetii RSA 493
acaugauuuuucug

SEQ ID NO: 556891 - RNA, 21 nt, Coxiella burnetii RSA 493
accaaaucacgcuuuuuuucg

SEQ ID NO: 556892 - RNA, 17 nt, Coxiella burnetii RSA 493
accaaaaggaaugaaua

SEQ ID NO: 556893 - RNA, 23 nt, Coxiella burnetii RSA 493
acauacgggcuacucuuuuucuu

SEQ ID NO: 556894 - RNA, 19 nt, Coxiella burnetii RSA 493
accacuaagucgccauugg

SEQ ID NO: 556895 - RNA, 12 nt, Coxiella burnetii RSA 493
accccccgccgc

SEQ ID NO: 556896 - RNA, 19 nt, Coxiella burnetii RSA 493
acccgccaaagcaaaaaua

SEQ ID NO: 556897 - RNA, 22 nt, Coxiella burnetii RSA 493
accgacgaauaacggaaaaugg

SEQ ID NO: 556898 - RNA, 14 nt, Coxiella burnetii RSA 493
accggcaaacccau

SEQ ID NO: 556899 - RNA, 14 nt, Coxiella burnetii RSA 493
accgcuaaagcaaa

SEQ ID NO: 556900 - RNA, 18 nt, Coxiella burnetii RSA 493
accugagggaauuuuuug

SEQ ID NO: 556901 - RNA, 13 nt, Coxiella burnetii RSA 493
acuagucaacaaa

SEQ ID NO: 556902 - RNA, 15 nt, Coxiella burnetii RSA 493
acuaaaucaauugcc

SEQ ID NO: 556903 - RNA, 15 nt, Coxiella burnetii RSA 493
aauagcaaccgcaau

SEQ ID NO: 556904 - RNA, 23 nt, Coxiella burnetii RSA 493
ugccggauugauaaaguuuauug

SEQ ID NO: 556905 - RNA, 16 nt, Coxiella burnetii RSA 493
ugcugauagcauuguu

SEQ ID NO: 556906 - RNA, 22 nt, Coxiella burnetii RSA 493
ugcucauguagcccaacaaaau

SEQ ID NO: 556907 - RNA, 12 nt, Coxiella burnetii RSA 493
ugcuuaucgggc

SEQ ID NO: 556908 - RNA, 15 nt, Coxiella burnetii RSA 493
ugcuuuuauuuaagu

SEQ ID NO: 556909 - RNA, 15 nt, Coxiella burnetii RSA 493
uggaauuaaauaucc

SEQ ID NO: 556910 - RNA, 20 nt, Coxiella burnetii RSA 493
uggaauuauugaauuauacu

SEQ ID NO: 556911 - RNA, 20 nt, Coxiella burnetii RSA 493
uggcgaagccacacaaccac

SEQ ID NO: 556912 - RNA, 14 nt, Coxiella burnetii RSA 493
ugguauauuucauu

SEQ ID NO: 556913 - RNA, 15 nt, Coxiella burnetii RSA 493
aauaucgcuauaauu

SEQ ID NO: 556914 - RNA, 16 nt, Coxiella burnetii RSA 493
aauaugauaaaaggca

SEQ ID NO: 556915 - RNA, 11 nt, Coxiella burnetii RSA 493
ugggcggaauu

SEQ ID NO: 556916 - RNA, 19 nt, Coxiella burnetii RSA 493
ugguggcuuucauuacuug

SEQ ID NO: 556917 - RNA, 11 nt, Coxiella burnetii RSA 493
uucuucauauu

SEQ ID NO: 556918 - RNA, 16 nt, Coxiella burnetii RSA 493
uugauuaacuuucguu

SEQ ID NO: 556919 - RNA, 23 nt, Coxiella burnetii RSA 493
uucuggauaagcauauugcaaua

SEQ ID NO: 556920 - RNA, 17 nt, Coxiella burnetii RSA 493
uugauuccuucaaucac

SEQ ID NO: 556921 - RNA, 18 nt, Coxiella burnetii RSA 493
uugcagccgccaauuuug

SEQ ID NO: 556922 - RNA, 21 nt, Coxiella burnetii RSA 493
uuguuuucccguauuucgcuu

SEQ ID NO: 556923 - RNA, 14 nt, Coxiella burnetii RSA 493
uuuaaaaaacuaga

SEQ ID NO: 556924 - RNA, 20 nt, Coxiella burnetii RSA 493
uugucgcguagcgacacaac

SEQ ID NO: 556925 - RNA, 19 nt, Coxiella burnetii RSA 493
uugucaaugggcaguuuuc

SEQ ID NO: 556926 - RNA, 13 nt, Coxiella burnetii RSA 493
uuguaauugcuug

SEQ ID NO: 556927 - RNA, 16 nt, Coxiella burnetii RSA 493
aaucgauggaagaaca

SEQ ID NO: 556928 - RNA, 15 nt, Coxiella burnetii RSA 493
aaucgacaggacaaa

SEQ ID NO: 556929 - RNA, 15 nt, Coxiella burnetii RSA 493
uuucgguuuucgcug

SEQ ID NO: 556930 - RNA, 23 nt, Coxiella burnetii RSA 493
uuucggggcggcuuuuuucgcuu

SEQ ID NO: 556931 - RNA, 20 nt, Coxiella burnetii RSA 493
uuucgcuucgcucagacggg

SEQ ID NO: 556932 - RNA, 18 nt, Coxiella burnetii RSA 493
uuucgcuucgcucauacg

SEQ ID NO: 556933 - RNA, 19 nt, Coxiella burnetii RSA 493
uuucgcuucgcucauacgg

SEQ ID NO: 556934 - RNA, 19 nt, Coxiella burnetii RSA 493
uuucgcuucgcucauacgu

SEQ ID NO: 556935 - RNA, 20 nt, Coxiella burnetii RSA 493
uuucgcuucgcugcauacgg

SEQ ID NO: 556936 - RNA, 19 nt, Coxiella burnetii RSA 493
uuuaccgaaagcgcgggca

SEQ ID NO: 556937 - RNA, 13 nt, Coxiella burnetii RSA 493
uuuccacgcauac

SEQ ID NO: 556938 - RNA, 15 nt, Coxiella burnetii RSA 493
uuuccacgcauacga

SEQ ID NO: 556939 - RNA, 19 nt, Coxiella burnetii RSA 493
uuuccaucaccuucaacgg

SEQ ID NO: 556940 - RNA, 18 nt, Coxiella burnetii RSA 493
uuucccguauuucgcuuc

SEQ ID NO: 556941 - RNA, 19 nt, Coxiella burnetii RSA 493
uuucccguauuucgcuucg

SEQ ID NO: 556942 - RNA, 11 nt, Coxiella burnetii RSA 493
uuuaacaaaaa

SEQ ID NO: 556943 - RNA, 17 nt, Coxiella burnetii RSA 493
uuuaacaagaucaauac

SEQ ID NO: 556944 - RNA, 15 nt, Coxiella burnetii RSA 493
uuugucuuuucgcau

SEQ ID NO: 556945 - RNA, 16 nt, Coxiella burnetii RSA 493
uuuguauucauuacga

SEQ ID NO: 556946 - RNA, 21 nt, Coxiella burnetii RSA 493
uuuguauucauuacgauuaau

SEQ ID NO: 556947 - RNA, 15 nt, Coxiella burnetii RSA 493
uuugcuccauacggg

SEQ ID NO: 556948 - RNA, 19 nt, Coxiella burnetii RSA 493
uuugguggaugaucaucgg

SEQ ID NO: 556949 - RNA, 12 nt, Coxiella burnetii RSA 493
uuugacccgaaa

SEQ ID NO: 556950 - RNA, 22 nt, Coxiella burnetii RSA 493
uuugcauuaaucuuccauuaau

SEQ ID NO: 556951 - RNA, 13 nt, Coxiella burnetii RSA 493
uuugauucuauac

SEQ ID NO: 556952 - RNA, 18 nt, Coxiella burnetii RSA 493
uuugauuagagcgauuau

SEQ ID NO: 556953 - RNA, 14 nt, Coxiella burnetii RSA 493
aaugagugcuuuua

SEQ ID NO: 556954 - RNA, 17 nt, Coxiella burnetii RSA 493
aaugggaguaaugacag

SEQ ID NO: 556955 - RNA, 13 nt, Coxiella burnetii RSA 493
uuuuucuuugcuu

SEQ ID NO: 556956 - RNA, 20 nt, Coxiella burnetii RSA 493
aaugaaacgcgccaaacaac

SEQ ID NO: 556957 - RNA, 17 nt, Coxiella burnetii RSA 493
aaucguugcauaauauu

SEQ ID NO: 556958 - RNA, 17 nt, Coxiella burnetii RSA 493
aaucguuuguaauaauu

SEQ ID NO: 556959 - RNA, 18 nt, Coxiella burnetii RSA 493
uuuuagcucauugaaauc

SEQ ID NO: 556960 - RNA, 17 nt, Coxiella burnetii RSA 493
uuuuuauuaucaucgca

SEQ ID NO: 556961 - RNA, 21 nt, Coxiella burnetii RSA 493
uuuuucaaaacaaucaaugca

SEQ ID NO: 556962 - RNA, 23 nt, Coxiella burnetii RSA 493
aaucgggaaacuuacgcugaagu

SEQ ID NO: 556963 - RNA, 18 nt, Coxiella burnetii RSA 493
aaucgcuguuaauaauag

SEQ ID NO: 556964 - RNA, 22 nt, Coxiella burnetii RSA 493
uguucggcugcgcauucguaua

SEQ ID NO: 556965 - RNA, 17 nt, Coxiella burnetii RSA 493
ugugaaauaaacagagu

SEQ ID NO: 556966 - RNA, 18 nt, Coxiella burnetii RSA 493
uuaaaucuuccaauuuuu

SEQ ID NO: 556967 - RNA, 15 nt, Coxiella burnetii RSA 493
uuaaaguuucuaacu

SEQ ID NO: 556968 - RNA, 14 nt, Coxiella burnetii RSA 493
uuaaaauuacuuua

SEQ ID NO: 556969 - RNA, 15 nt, Coxiella burnetii RSA 493
uuaaucacaucccuu

SEQ ID NO: 556970 - RNA, 14 nt, Coxiella burnetii RSA 493
uuacauauuucuuu

SEQ ID NO: 556971 - RNA, 12 nt, Coxiella burnetii RSA 493
uuacaauucgcu

SEQ ID NO: 556972 - RNA, 13 nt, Coxiella burnetii RSA 493
uuaaugaaaaaua

SEQ ID NO: 556973 - RNA, 23 nt, Coxiella burnetii RSA 493
uuagaguaacgccagcgauuuau

SEQ ID NO: 556974 - RNA, 14 nt, Coxiella burnetii RSA 493
aaucagcaucgguu

SEQ ID NO: 556975 - RNA, 16 nt, Coxiella burnetii RSA 493
uucgccagaaacaacu

SEQ ID NO: 556976 - RNA, 19 nt, Coxiella burnetii RSA 493
uuccgcuuugcuccauacg

SEQ ID NO: 556977 - RNA, 20 nt, Coxiella burnetii RSA 493
uuccgcuuugcuccauacgg

SEQ ID NO: 556978 - RNA, 19 nt, Coxiella burnetii RSA 493
uucgcuucgcuacauacgg

SEQ ID NO: 556979 - RNA, 18 nt, Coxiella burnetii RSA 493
uucgcuucgcucauacgg

SEQ ID NO: 556980 - RNA, 19 nt, Coxiella burnetii RSA 493
uucgcuucgcucauacggg

SEQ ID NO: 556981 - RNA, 20 nt, Coxiella burnetii RSA 493
uucgcuucgcuccauacggg

SEQ ID NO: 556982 - RNA, 19 nt, Coxiella burnetii RSA 493
uucgcuucgcugcauacgg

SEQ ID NO: 556983 - RNA, 16 nt, Coxiella burnetii RSA 493
uucgcuugacgggcau

SEQ ID NO: 556984 - RNA, 20 nt, Coxiella burnetii RSA 493
uucggacaacaaauaaaucg

SEQ ID NO: 556985 - RNA, 13 nt, Coxiella burnetii RSA 493
uucagauuuuuua

SEQ ID NO: 556986 - RNA, 18 nt, Coxiella burnetii RSA 493
uuccaucaccuucaacgg

SEQ ID NO: 556987 - RNA, 20 nt, Coxiella burnetii RSA 493
uucccguauuucgcuucgcu

SEQ ID NO: 556988 - RNA, 14 nt, Coxiella burnetii RSA 493
uuccaaagcagaua

SEQ ID NO: 556989 - RNA, 20 nt, Coxiella burnetii RSA 493
aaaaauacucuuucauaaaa

SEQ ID NO: 556990 - RNA, 19 nt, Coxiella burnetii RSA 493
aaaaauuaauauaaucagc

SEQ ID NO: 556991 - RNA, 16 nt, Coxiella burnetii RSA 493
aaagcugauuccgauc

SEQ ID NO: 556992 - RNA, 17 nt, Coxiella burnetii RSA 493
aaacgaauggcccaaua

SEQ ID NO: 556993 - RNA, 22 nt, Coxiella burnetii RSA 493
aaacgugggagugguuauaauu

SEQ ID NO: 556994 - RNA, 23 nt, Coxiella burnetii RSA 493
aaacuucccauucuauaaucauu

SEQ ID NO: 556995 - RNA, 20 nt, Coxiella burnetii RSA 493
aaaaaguuuagaaaaaugcu

SEQ ID NO: 556996 - RNA, 15 nt, Coxiella burnetii RSA 493
aaaagcuagcgaaau

SEQ ID NO: 556997 - RNA, 19 nt, Coxiella burnetii RSA 493
aaauauuuuuauuuccagc

SEQ ID NO: 556998 - RNA, 16 nt, Coxiella burnetii RSA 493
aaaucaccagaaaacg

SEQ ID NO: 556999 - RNA, 21 nt, Coxiella burnetii RSA 493
aaaaccugcuauuugcccauc

SEQ ID NO: 557000 - RNA, 20 nt, Coxiella burnetii RSA 493
aacauccgcucgucuugcac

SEQ ID NO: 557001 - RNA, 14 nt, Coxiella burnetii RSA 493
aaccacccgccgag

SEQ ID NO: 557002 - RNA, 14 nt, Coxiella burnetii RSA 493
aacauuauugaugu

SEQ ID NO: 557003 - RNA, 16 nt, Coxiella burnetii RSA 493
aaccaaugaaacgcgc

SEQ ID NO: 557004 - RNA, 12 nt, Coxiella burnetii RSA 493
aacgaacggcga

SEQ ID NO: 557005 - RNA, 19 nt, Coxiella burnetii RSA 493
aacgaauggcccaauaaag

SEQ ID NO: 557006 - RNA, 16 nt, Coxiella burnetii RSA 493
aacgcaaucggauuaa

SEQ ID NO: 557007 - RNA, 22 nt, Coxiella burnetii RSA 493
aagaguugagcgaagaaaaaga

SEQ ID NO: 557008 - RNA, 22 nt, Coxiella burnetii RSA 493
aagccccuuuaaugcauuugaa

SEQ ID NO: 557009 - RNA, 16 nt, Coxiella burnetii RSA 493
aagcgaaauacgggaa

SEQ ID NO: 557010 - RNA, 19 nt, Coxiella burnetii RSA 493
aagcgaaauacggggaaau

SEQ ID NO: 557011 - RNA, 21 nt, Coxiella burnetii RSA 493
aagcgaaauacggggaaauaa

SEQ ID NO: 557012 - RNA, 20 nt, Coxiella burnetii RSA 493
aagcgaaauacggggacgau

SEQ ID NO: 557013 - RNA, 16 nt, Coxiella burnetii RSA 493
aagcgaaguacgggaa

SEQ ID NO: 557014 - RNA, 21 nt, Coxiella burnetii RSA 493
aagcgaaguacgggaaaacaa

SEQ ID NO: 557015 - RNA, 19 nt, Coxiella burnetii RSA 493
aaggacccgccggcaaaca

SEQ ID NO: 557016 - RNA, 19 nt, Coxiella burnetii RSA 493
aauaagccguucaccccau

SEQ ID NO: 557017 - RNA, 13 nt, Coxiella burnetii RSA 493
aauaaaauuaauu

SEQ ID NO: 557018 - RNA, 16 nt, Coxiella burnetii RSA 493
aauaaagaaagccuaa

SEQ ID NO: 557019 - RNA, 19 nt, Coxiella burnetii RSA 493
aauaauuuuccgucguuuu

SEQ ID NO: 557020 - RNA, 15 nt, Coxiella burnetii RSA 493
aauacaggaaaaaga

SEQ ID NO: 557021 - RNA, 17 nt, Coxiella burnetii RSA 493
aaugucuccaaccgaua

SEQ ID NO: 557022 - RNA, 12 nt, Coxiella burnetii RSA 493
aauguuaauucg

SEQ ID NO: 557023 - RNA, 20 nt, Coxiella burnetii RSA 493
aauuuacuuuacgcucaauu

SEQ ID NO: 557024 - RNA, 15 nt, Coxiella burnetii RSA 493
aauuugagguugaau

SEQ ID NO: 557025 - RNA, 23 nt, Coxiella burnetii RSA 493
aaugaucggcgcauuuuuauucg

SEQ ID NO: 557026 - RNA, 22 nt, Coxiella burnetii RSA 493
aaugguugauuuuuuaauuaag

SEQ ID NO: 557027 - RNA, 14 nt, Coxiella burnetii RSA 493
aauggauucuucuu

SEQ ID NO: 557028 - RNA, 15 nt, Coxiella burnetii RSA 493
aauccguaucccaau

SEQ ID NO: 557029 - RNA, 18 nt, Coxiella burnetii RSA 493
aauccgccgguaccccau

SEQ ID NO: 557030 - RNA, 22 nt, Coxiella burnetii RSA 493
aauccguuuugaaaaauaaaag

SEQ ID NO: 557031 - RNA, 23 nt, Coxiella burnetii RSA 493
aaucgauaaucaacggcgcguga

SEQ ID NO: 557032 - RNA, 17 nt, Coxiella burnetii RSA 493
aaucguuuuacccuuug

SEQ ID NO: 557033 - RNA, 23 nt, Coxiella burnetii RSA 493
aauccaacgguucucaaauugcu

SEQ ID NO: 557034 - RNA, 20 nt, Coxiella burnetii RSA 493
aaucauaggggguuaauucg

SEQ ID NO: 557035 - RNA, 16 nt, Coxiella burnetii RSA 493
aaucaucaauucggau

SEQ ID NO: 557036 - RNA, 13 nt, Coxiella burnetii RSA 493
accacuugcacac

SEQ ID NO: 557037 - RNA, 15 nt, Coxiella burnetii RSA 493
accaauaauucuuca

SEQ ID NO: 557038 - RNA, 18 nt, Coxiella burnetii RSA 493
accaaaagcaugcccaua

SEQ ID NO: 557039 - RNA, 14 nt, Coxiella burnetii RSA 493
accaaaauuccucg

SEQ ID NO: 557040 - RNA, 20 nt, Coxiella burnetii RSA 493
acauucuucaguaauuuuua

SEQ ID NO: 557041 - RNA, 21 nt, Coxiella burnetii RSA 493
acauaucgcuccccuugccga

SEQ ID NO: 557042 - RNA, 21 nt, Coxiella burnetii RSA 493
acagcucugaaagcaauaggg

SEQ ID NO: 557043 - RNA, 14 nt, Coxiella burnetii RSA 493
acccauaacgaaaa

SEQ ID NO: 557044 - RNA, 20 nt, Coxiella burnetii RSA 493
acccacggcgccaucaacca

SEQ ID NO: 557045 - RNA, 14 nt, Coxiella burnetii RSA 493
acccuucuguuuaa

SEQ ID NO: 557046 - RNA, 15 nt, Coxiella burnetii RSA 493
accggaaauuuuuug

SEQ ID NO: 557047 - RNA, 15 nt, Coxiella burnetii RSA 493
acuucaugcaaaaau

SEQ ID NO: 557048 - RNA, 18 nt, Coxiella burnetii RSA 493
acucauuauucagacguu

SEQ ID NO: 557049 - RNA, 21 nt, Coxiella burnetii RSA 493
acuauugcgcaaauugcaaaa

SEQ ID NO: 557050 - RNA, 18 nt, Coxiella burnetii RSA 493
acuauuuaccacgacgau

SEQ ID NO: 557051 - RNA, 22 nt, Coxiella burnetii RSA 493
acucggaacugaugaauaacaa

SEQ ID NO: 557052 - RNA, 19 nt, Coxiella burnetii RSA 493
aaaccauucaaugcuaaau

SEQ ID NO: 557053 - RNA, 21 nt, Coxiella burnetii RSA 493
acggcucacguauugcaauau

SEQ ID NO: 557054 - RNA, 17 nt, Coxiella burnetii RSA 493
acggggaaauaaugaca

SEQ ID NO: 557055 - RNA, 14 nt, Coxiella burnetii RSA 493
acgggggauuggga

SEQ ID NO: 557056 - RNA, 19 nt, Coxiella burnetii RSA 493
acguaucugcuaaaaagcu

SEQ ID NO: 557057 - RNA, 17 nt, Coxiella burnetii RSA 493
acgccaaaaccgccggc

SEQ ID NO: 557058 - RNA, 14 nt, Coxiella burnetii RSA 493
acgccugaaauauu

SEQ ID NO: 557059 - RNA, 22 nt, Coxiella burnetii RSA 493
aaacauccuccauuacauaauu

SEQ ID NO: 557060 - RNA, 23 nt, Coxiella burnetii RSA 493
acgcgauaucuccauuuucaagu

SEQ ID NO: 557061 - RNA, 19 nt, Coxiella burnetii RSA 493
agcaauugucuaacauuug

SEQ ID NO: 557062 - RNA, 19 nt, Coxiella burnetii RSA 493
acuuuauaguucauuaaau

SEQ ID NO: 557063 - RNA, 19 nt, Coxiella burnetii RSA 493
acuuucugaagaaucauac

SEQ ID NO: 557064 - RNA, 22 nt, Coxiella burnetii RSA 493
acuuucuuagcaucgaucccuc

SEQ ID NO: 557065 - RNA, 11 nt, Coxiella burnetii RSA 493
aaacccauuug

SEQ ID NO: 557066 - RNA, 13 nt, Coxiella burnetii RSA 493
agccacaaagaau

SEQ ID NO: 557067 - RNA, 13 nt, Coxiella burnetii RSA 493
agcuauaagcaau

SEQ ID NO: 557068 - RNA, 18 nt, Coxiella burnetii RSA 493
aaacgcgcccgccccaau

SEQ ID NO: 557069 - RNA, 22 nt, Coxiella burnetii RSA 493
agcgaggaccguuaugaaaaca

SEQ ID NO: 557070 - RNA, 15 nt, Coxiella burnetii RSA 493
agcgcgcugccuugg

SEQ ID NO: 557071 - RNA, 15 nt, Coxiella burnetii RSA 493
agcgcgcagcgcacg

SEQ ID NO: 557072 - RNA, 13 nt, Coxiella burnetii RSA 493
aggcagcauaaag

SEQ ID NO: 557073 - RNA, 21 nt, Coxiella burnetii RSA 493
aggcagaugauuaaaagcaac

SEQ ID NO: 557074 - RNA, 15 nt, Coxiella burnetii RSA 493
aggccgcgcagaaua

SEQ ID NO: 557075 - RNA, 20 nt, Coxiella burnetii RSA 493
aggcgaggacccagcgcacu

SEQ ID NO: 557076 - RNA, 21 nt, Coxiella burnetii RSA 493
aggcgcauccgguuaauagca

SEQ ID NO: 557077 - RNA, 19 nt, Coxiella burnetii RSA 493
aguaugagcggcaauuuug

SEQ ID NO: 557078 - RNA, 12 nt, Coxiella burnetii RSA 493
agguuuucgcug

SEQ ID NO: 557079 - RNA, 12 nt, Coxiella burnetii RSA 493
agguauuuuaag

SEQ ID NO: 557080 - RNA, 14 nt, Coxiella burnetii RSA 493
aggcucuucauauc

SEQ ID NO: 557081 - RNA, 18 nt, Coxiella burnetii RSA 493
agugugauucauuaucau

SEQ ID NO: 557082 - RNA, 22 nt, Coxiella burnetii RSA 493
agugugcccccccaauuccucg

SEQ ID NO: 557083 - RNA, 13 nt, Coxiella burnetii RSA 493
aguucauuaaauu

SEQ ID NO: 557084 - RNA, 21 nt, Coxiella burnetii RSA 493
aguuuaucccuguuacgggau

SEQ ID NO: 557085 - RNA, 20 nt, Coxiella burnetii RSA 493
agugaaccaaucuauuagcu

SEQ ID NO: 557086 - RNA, 19 nt, Coxiella burnetii RSA 493
agugaaaacccgagcggau

SEQ ID NO: 557087 - RNA, 17 nt, Coxiella burnetii RSA 493
agucagacuugcuuuuu

SEQ ID NO: 557088 - RNA, 19 nt, Coxiella burnetii RSA 493
agugagccgcuaauaacau

SEQ ID NO: 557089 - RNA, 15 nt, Coxiella burnetii RSA 493
auaccgguaaucauu

SEQ ID NO: 557090 - RNA, 18 nt, Coxiella burnetii RSA 493
auaccaauucaaauaaua

SEQ ID NO: 557091 - RNA, 13 nt, Coxiella burnetii RSA 493
auaaaaaauuacu

SEQ ID NO: 557092 - RNA, 19 nt, Coxiella burnetii RSA 493
auacuaaauuaguaauauu

SEQ ID NO: 557093 - RNA, 14 nt, Coxiella burnetii RSA 493
auaguggaugaucg

SEQ ID NO: 557094 - RNA, 20 nt, Coxiella burnetii RSA 493
auauaagcuuucaauaaaua

SEQ ID NO: 557095 - RNA, 17 nt, Coxiella burnetii RSA 493
auauaauuuaaugaggu

SEQ ID NO: 557096 - RNA, 15 nt, Coxiella burnetii RSA 493
aucaaaggccgcgca

SEQ ID NO: 557097 - RNA, 16 nt, Coxiella burnetii RSA 493
aucaaacgcugccaua

SEQ ID NO: 557098 - RNA, 21 nt, Coxiella burnetii RSA 493
aucaccuuugcuaacaauugu

SEQ ID NO: 557099 - RNA, 22 nt, Coxiella burnetii RSA 493
aucacccacguugcaauaacaa

SEQ ID NO: 557100 - RNA, 14 nt, Coxiella burnetii RSA 493
aucuaaaaacccca

SEQ ID NO: 557101 - RNA, 14 nt, Coxiella burnetii RSA 493
aucguuugaucauu

SEQ ID NO: 557102 - RNA, 13 nt, Coxiella burnetii RSA 493
aucguuuuauaca

SEQ ID NO: 557103 - RNA, 21 nt, Coxiella burnetii RSA 493
aucguccuauccccaaaggug

SEQ ID NO: 557104 - RNA, 19 nt, Coxiella burnetii RSA 493
aucguccccguauuucgcu

SEQ ID NO: 557105 - RNA, 17 nt, Coxiella burnetii RSA 493
aucggaugaugcauuaa

SEQ ID NO: 557106 - RNA, 23 nt, Coxiella burnetii RSA 493
aucggccuuuuucauuuccgcuu

SEQ ID NO: 557107 - RNA, 16 nt, Coxiella burnetii RSA 493
aucuguaauuuuucuu

SEQ ID NO: 557108 - RNA, 18 nt, Coxiella burnetii RSA 493
aucuuaaugaaauuucuc

SEQ ID NO: 557109 - RNA, 21 nt, Coxiella burnetii RSA 493
augaguugucauauuaauauu

SEQ ID NO: 557110 - RNA, 13 nt, Coxiella burnetii RSA 493
augauaauccaca

SEQ ID NO: 557111 - RNA, 15 nt, Coxiella burnetii RSA 493
augaauucaaaccaa

SEQ ID NO: 557112 - RNA, 15 nt, Coxiella burnetii RSA 493
augaauauuuuucuc

SEQ ID NO: 557113 - RNA, 19 nt, Coxiella burnetii RSA 493
augaauggaauguuaaagg

SEQ ID NO: 557114 - RNA, 17 nt, Coxiella burnetii RSA 493
augaaucagcuuaauca

SEQ ID NO: 557115 - RNA, 20 nt, Coxiella burnetii RSA 493
aucuuuauccaaaucggcaa

SEQ ID NO: 557116 - RNA, 13 nt, Coxiella burnetii RSA 493
aucgcaaaauuca

SEQ ID NO: 557117 - RNA, 18 nt, Coxiella burnetii RSA 493
aucgcauacagcggaaca

SEQ ID NO: 557118 - RNA, 22 nt, Coxiella burnetii RSA 493
aucgcauacagcggaacaccau

SEQ ID NO: 557119 - RNA, 16 nt, Coxiella burnetii RSA 493
aucgcuccuaaauuuu

SEQ ID NO: 557120 - RNA, 21 nt, Coxiella burnetii RSA 493
aucgcugauacuucuucauua

SEQ ID NO: 557121 - RNA, 14 nt, Coxiella burnetii RSA 493
auuaucaaaacgua

SEQ ID NO: 557122 - RNA, 14 nt, Coxiella burnetii RSA 493
auuaucggaugaug

SEQ ID NO: 557123 - RNA, 16 nt, Coxiella burnetii RSA 493
auguuuuuuaauaaau

SEQ ID NO: 557124 - RNA, 17 nt, Coxiella burnetii RSA 493
auuaaaaaauaagaaag

SEQ ID NO: 557125 - RNA, 12 nt, Coxiella burnetii RSA 493
auuaaaaauauu

SEQ ID NO: 557126 - RNA, 13 nt, Coxiella burnetii RSA 493
auuaaaaauuuga

SEQ ID NO: 557127 - RNA, 16 nt, Coxiella burnetii RSA 493
auugaaagaauuucuc

SEQ ID NO: 557128 - RNA, 19 nt, Coxiella burnetii RSA 493
auugaauuauacuuuuuug

SEQ ID NO: 557129 - RNA, 21 nt, Coxiella burnetii RSA 493
auuccugccccgacaauuccc

SEQ ID NO: 557130 - RNA, 20 nt, Coxiella burnetii RSA 493
auucauuaguuugguugaac

SEQ ID NO: 557131 - RNA, 18 nt, Coxiella burnetii RSA 493
auuccuuuuucuuuuaau

SEQ ID NO: 557132 - RNA, 15 nt, Coxiella burnetii RSA 493
auuccuuuuuuuaau

SEQ ID NO: 557133 - RNA, 21 nt, Coxiella burnetii RSA 493
auuuaaaaaacuagaaauauu

SEQ ID NO: 557134 - RNA, 20 nt, Coxiella burnetii RSA 493
auugggggucuuuuuuucuu

SEQ ID NO: 557135 - RNA, 15 nt, Coxiella burnetii RSA 493
auugcaaaacuuccc

SEQ ID NO: 557136 - RNA, 19 nt, Coxiella burnetii RSA 493
auugaguauccaacucucu

SEQ ID NO: 557137 - RNA, 21 nt, Coxiella burnetii RSA 493
auugauuagcaucuugaauca

SEQ ID NO: 557138 - RNA, 19 nt, Coxiella burnetii RSA 493
augccgcuugaaaaauuga

SEQ ID NO: 557139 - RNA, 22 nt, Coxiella burnetii RSA 493
augcuuuuuuuacuuuuucaaa

SEQ ID NO: 557140 - RNA, 22 nt, Coxiella burnetii RSA 493
auguccgcauagguauuuccuu

SEQ ID NO: 557141 - RNA, 16 nt, Coxiella burnetii RSA 493
auggcuuguuccgcca

SEQ ID NO: 557142 - RNA, 22 nt, Coxiella burnetii RSA 493
caacgaaaauaccuuugcaaac

SEQ ID NO: 557143 - RNA, 18 nt, Coxiella burnetii RSA 493
caaaugaguaaaaaagag

SEQ ID NO: 557144 - RNA, 16 nt, Coxiella burnetii RSA 493
caaauagaugacuuug

SEQ ID NO: 557145 - RNA, 17 nt, Coxiella burnetii RSA 493
caaaugaccaaauaauu

SEQ ID NO: 557146 - RNA, 19 nt, Coxiella burnetii RSA 493
caaauaaucguaucgauuu

SEQ ID NO: 557147 - RNA, 19 nt, Coxiella burnetii RSA 493
caaugaugucaucuaucgu

SEQ ID NO: 557148 - RNA, 17 nt, Coxiella burnetii RSA 493
caauuccauuaaaaaca

SEQ ID NO: 557149 - RNA, 19 nt, Coxiella burnetii RSA 493
caauucccguauuucgcuu

SEQ ID NO: 557150 - RNA, 20 nt, Coxiella burnetii RSA 493
caauugagcggcuuuuucaa

SEQ ID NO: 557151 - RNA, 14 nt, Coxiella burnetii RSA 493
caauguuucaaucu

SEQ ID NO: 557152 - RNA, 18 nt, Coxiella burnetii RSA 493
caauguuuccaaauaaug

SEQ ID NO: 557153 - RNA, 17 nt, Coxiella burnetii RSA 493
caauuaacuuugcaaag

SEQ ID NO: 557154 - RNA, 19 nt, Coxiella burnetii RSA 493
caauuaauuuauaaaauuu

SEQ ID NO: 557155 - RNA, 20 nt, Coxiella burnetii RSA 493
caauccucucucucacaaaa

SEQ ID NO: 557156 - RNA, 11 nt, Coxiella burnetii RSA 493
caacuacuuga

SEQ ID NO: 557157 - RNA, 20 nt, Coxiella burnetii RSA 493
caagaggaguucuaaaaaau

SEQ ID NO: 557158 - RNA, 19 nt, Coxiella burnetii RSA 493
cacuuaacuccuucgcuuu

SEQ ID NO: 557159 - RNA, 23 nt, Coxiella burnetii RSA 493
cagagaaguaugaucauuuucuc

SEQ ID NO: 557160 - RNA, 17 nt, Coxiella burnetii RSA 493
aaagaagaaggucguuu

SEQ ID NO: 557161 - RNA, 17 nt, Coxiella burnetii RSA 493
cacguaucugcuaaaaa

SEQ ID NO: 557162 - RNA, 17 nt, Coxiella burnetii RSA 493
aaacuuagccaaucgua

SEQ ID NO: 557163 - RNA, 18 nt, Coxiella burnetii RSA 493
cagccgaagugcuaaaaa

SEQ ID NO: 557164 - RNA, 20 nt, Coxiella burnetii RSA 493
cagccgaaugaucugcucuu

SEQ ID NO: 557165 - RNA, 14 nt, Coxiella burnetii RSA 493
cagcgaaauacgag

SEQ ID NO: 557166 - RNA, 23 nt, Coxiella burnetii RSA 493
cagcguauuuguguaaaauacug

SEQ ID NO: 557167 - RNA, 16 nt, Coxiella burnetii RSA 493
cagcuucuuuaaaaua

SEQ ID NO: 557168 - RNA, 21 nt, Coxiella burnetii RSA 493
cauaauagcgaucagcggaau

SEQ ID NO: 557169 - RNA, 17 nt, Coxiella burnetii RSA 493
cauaaauagcauuaaua

SEQ ID NO: 557170 - RNA, 23 nt, Coxiella burnetii RSA 493
cauaauauuuucugccgcugaua

SEQ ID NO: 557171 - RNA, 22 nt, Coxiella burnetii RSA 493
cauaguaauucaucauuuucca

SEQ ID NO: 557172 - RNA, 17 nt, Coxiella burnetii RSA 493
caucaaccaauaacucg

SEQ ID NO: 557173 - RNA, 21 nt, Coxiella burnetii RSA 493
caucaaccaauccuacuuucg

SEQ ID NO: 557174 - RNA, 19 nt, Coxiella burnetii RSA 493
cauauaggguagauaacgc

SEQ ID NO: 557175 - RNA, 19 nt, Coxiella burnetii RSA 493
caucaucgccggauaauca

SEQ ID NO: 557176 - RNA, 23 nt, Coxiella burnetii RSA 493
caguucuuaacgaagguuucaua

SEQ ID NO: 557177 - RNA, 23 nt, Coxiella burnetii RSA 493
cauugaagaauuuguuuugauca

SEQ ID NO: 557178 - RNA, 11 nt, Coxiella burnetii RSA 493
cauucgcuuuu

SEQ ID NO: 557179 - RNA, 15 nt, Coxiella burnetii RSA 493
cauugauaaaccguu

SEQ ID NO: 557180 - RNA, 14 nt, Coxiella burnetii RSA 493
cauucauucgcuuu

SEQ ID NO: 557181 - RNA, 15 nt, Coxiella burnetii RSA 493
cauuaccccaucuac

SEQ ID NO: 557182 - RNA, 15 nt, Coxiella burnetii RSA 493
cauuaauuucuuuuu

SEQ ID NO: 557183 - RNA, 18 nt, Coxiella burnetii RSA 493
cauuaaaaaauaagaaag

SEQ ID NO: 557184 - RNA, 15 nt, Coxiella burnetii RSA 493
caugcucaagcgaac

SEQ ID NO: 557185 - RNA, 15 nt, Coxiella burnetii RSA 493
ccaaaaacccauaac

SEQ ID NO: 557186 - RNA, 22 nt, Coxiella burnetii RSA 493
cauuuuuaugcuucaauaaaaa

SEQ ID NO: 557187 - RNA, 20 nt, Coxiella burnetii RSA 493
cauuucccguauuucgcuuc

SEQ ID NO: 557188 - RNA, 16 nt, Coxiella burnetii RSA 493
cauugguaaagccguu

SEQ ID NO: 557189 - RNA, 13 nt, Coxiella burnetii RSA 493
cauuguggauuau

SEQ ID NO: 557190 - RNA, 20 nt, Coxiella burnetii RSA 493
ccaauguuuccaaauaauga

SEQ ID NO: 557191 - RNA, 14 nt, Coxiella burnetii RSA 493
ccaauguuugcuca

SEQ ID NO: 557192 - RNA, 23 nt, Coxiella burnetii RSA 493
ccaauuucuuuucuaaauaauga

SEQ ID NO: 557193 - RNA, 22 nt, Coxiella burnetii RSA 493
aaauacgggaaaacaaugaugu

SEQ ID NO: 557194 - RNA, 18 nt, Coxiella burnetii RSA 493
aaaguuuuuggcauaaau

SEQ ID NO: 557195 - RNA, 18 nt, Coxiella burnetii RSA 493
aaauagagaggguugcac

SEQ ID NO: 557196 - RNA, 13 nt, Coxiella burnetii RSA 493
aaauagcuccuuu

SEQ ID NO: 557197 - RNA, 19 nt, Coxiella burnetii RSA 493
cccuguaucccuuaaauca

SEQ ID NO: 557198 - RNA, 16 nt, Coxiella burnetii RSA 493
cccuuaacuucucuuc

SEQ ID NO: 557199 - RNA, 12 nt, Coxiella burnetii RSA 493
ccaguuuuuugg

SEQ ID NO: 557200 - RNA, 12 nt, Coxiella burnetii RSA 493
ccaugacgauuu

SEQ ID NO: 557201 - RNA, 18 nt, Coxiella burnetii RSA 493
ccgguuucgguuucguuc

SEQ ID NO: 557202 - RNA, 13 nt, Coxiella burnetii RSA 493
ccuaaucggccua

SEQ ID NO: 557203 - RNA, 19 nt, Coxiella burnetii RSA 493
ccguuggcaaacagcgaaa

SEQ ID NO: 557204 - RNA, 17 nt, Coxiella burnetii RSA 493
ccguugagcaagcagaa

SEQ ID NO: 557205 - RNA, 21 nt, Coxiella burnetii RSA 493
aaauugggaguuguauaaagg

SEQ ID NO: 557206 - RNA, 12 nt, Coxiella burnetii RSA 493
aaauugacaaau

SEQ ID NO: 557207 - RNA, 23 nt, Coxiella burnetii RSA 493
aaauuuuccgugcagaaacaaua

SEQ ID NO: 557208 - RNA, 20 nt, Coxiella burnetii RSA 493
ccgcuuugcuccauacgggc

SEQ ID NO: 557209 - RNA, 14 nt, Coxiella burnetii RSA 493
ccgcuugcacggga

SEQ ID NO: 557210 - RNA, 14 nt, Coxiella burnetii RSA 493
ccgccugcgcggga

SEQ ID NO: 557211 - RNA, 20 nt, Coxiella burnetii RSA 493
aaauguuaggaaggacaaaa

SEQ ID NO: 557212 - RNA, 11 nt, Coxiella burnetii RSA 493
aaauuaacaug

SEQ ID NO: 557213 - RNA, 23 nt, Coxiella burnetii RSA 493
ccgcuuccagcaaacccauuuca

SEQ ID NO: 557214 - RNA, 23 nt, Coxiella burnetii RSA 493
ccgcuauacugcuuguaccugcc

SEQ ID NO: 557215 - RNA, 11 nt, Coxiella burnetii RSA 493
ccgauaauaug

SEQ ID NO: 557216 - RNA, 21 nt, Coxiella burnetii RSA 493
ccgauaauccgccgguacccc

SEQ ID NO: 557217 - RNA, 15 nt, Coxiella burnetii RSA 493
cgaauuguaaaaaga

SEQ ID NO: 557218 - RNA, 15 nt, Coxiella burnetii RSA 493
cgagagaauuaaaaa

SEQ ID NO: 557219 - RNA, 18 nt, Coxiella burnetii RSA 493
cgacggacauuuuuucaa

SEQ ID NO: 557220 - RNA, 21 nt, Coxiella burnetii RSA 493
cgaaauuuguuauugcuaaaa

SEQ ID NO: 557221 - RNA, 18 nt, Coxiella burnetii RSA 493
cgaacgaauacggggacg

SEQ ID NO: 557222 - RNA, 14 nt, Coxiella burnetii RSA 493
cgaaucgucuaaaa

SEQ ID NO: 557223 - RNA, 20 nt, Coxiella burnetii RSA 493
cgaagcgaaauacggggaca

SEQ ID NO: 557224 - RNA, 20 nt, Coxiella burnetii RSA 493
cgaagcgaaauacggggacg

SEQ ID NO: 557225 - RNA, 19 nt, Coxiella burnetii RSA 493
cgaagcgaaguacgggaaa

SEQ ID NO: 557226 - RNA, 23 nt, Coxiella burnetii RSA 493
cgaagaagcgucugauccgccuu

SEQ ID NO: 557227 - RNA, 12 nt, Coxiella burnetii RSA 493
cgaagcccaaca

SEQ ID NO: 557228 - RNA, 19 nt, Coxiella burnetii RSA 493
ccuuuuuauaaaugauuuc

SEQ ID NO: 557229 - RNA, 13 nt, Coxiella burnetii RSA 493
ccuuuuugauuuc

SEQ ID NO: 557230 - RNA, 18 nt, Coxiella burnetii RSA 493
ccuuuaauucgcgcugca

SEQ ID NO: 557231 - RNA, 15 nt, Coxiella burnetii RSA 493
cgaaaauugucgaua

SEQ ID NO: 557232 - RNA, 16 nt, Coxiella burnetii RSA 493
cgaaagcuaaaaaaga

SEQ ID NO: 557233 - RNA, 20 nt, Coxiella burnetii RSA 493
ccuugcauaauagcgaucag

SEQ ID NO: 557234 - RNA, 14 nt, Coxiella burnetii RSA 493
ccuuguuuuaaccu

SEQ ID NO: 557235 - RNA, 17 nt, Coxiella burnetii RSA 493
ccuuaauguuuuuucua

SEQ ID NO: 557236 - RNA, 15 nt, Coxiella burnetii RSA 493
ccuuacaaaaauacu

SEQ ID NO: 557237 - RNA, 15 nt, Coxiella burnetii RSA 493
cgagucaaaaauaaa

SEQ ID NO: 557238 - RNA, 15 nt, Coxiella burnetii RSA 493
cgauccgucgcuuug

SEQ ID NO: 557239 - RNA, 21 nt, Coxiella burnetii RSA 493
cgauuuauugcuuaucgcaga

SEQ ID NO: 557240 - RNA, 16 nt, Coxiella burnetii RSA 493
cgcaaagcucagccca

SEQ ID NO: 557241 - RNA, 15 nt, Coxiella burnetii RSA 493
cgcauacagcggaac

SEQ ID NO: 557242 - RNA, 21 nt, Coxiella burnetii RSA 493
cgcauccgccccgaaauauga

SEQ ID NO: 557243 - RNA, 17 nt, Coxiella burnetii RSA 493
aacauucuaauaaaaua

SEQ ID NO: 557244 - RNA, 15 nt, Coxiella burnetii RSA 493
cgggaauguuuuuua

SEQ ID NO: 557245 - RNA, 12 nt, Coxiella burnetii RSA 493
cggcugcggcga

SEQ ID NO: 557246 - RNA, 17 nt, Coxiella burnetii RSA 493
cggcuuuugauuaacca

SEQ ID NO: 557247 - RNA, 15 nt, Coxiella burnetii RSA 493
cggcuuuuuucgcuu

SEQ ID NO: 557248 - RNA, 13 nt, Coxiella burnetii RSA 493
cgggaaauaaaau

SEQ ID NO: 557249 - RNA, 23 nt, Coxiella burnetii RSA 493
cggcaaaugauugggcucaaaaa

SEQ ID NO: 557250 - RNA, 22 nt, Coxiella burnetii RSA 493
cgccgagcuuuucacccaacca

SEQ ID NO: 557251 - RNA, 13 nt, Coxiella burnetii RSA 493
cgcucauacgggc

SEQ ID NO: 557252 - RNA, 16 nt, Coxiella burnetii RSA 493
cgcguacaguuuuuuu

SEQ ID NO: 557253 - RNA, 20 nt, Coxiella burnetii RSA 493
cgcgcuagauucccgccuac

SEQ ID NO: 557254 - RNA, 22 nt, Coxiella burnetii RSA 493
aaggcaaauguugauaauaaau

SEQ ID NO: 557255 - RNA, 16 nt, Coxiella burnetii RSA 493
ggagcgauaaaauaac

SEQ ID NO: 557256 - RNA, 14 nt, Coxiella burnetii RSA 493
ggagacaccaauaa

SEQ ID NO: 557257 - RNA, 21 nt, Coxiella burnetii RSA 493
ggagaaaucuuuuuuuugaaa

SEQ ID NO: 557258 - RNA, 13 nt, Coxiella burnetii RSA 493
ggacucgauggga

SEQ ID NO: 557259 - RNA, 19 nt, Coxiella burnetii RSA 493
ggaaugacguauugucaaa

SEQ ID NO: 557260 - RNA, 23 nt, Coxiella burnetii RSA 493
ggaaugugugucauaaauaaaag

SEQ ID NO: 557261 - RNA, 18 nt, Coxiella burnetii RSA 493
ggaacauucuaauaaaau

SEQ ID NO: 557262 - RNA, 21 nt, Coxiella burnetii RSA 493
ggacgagggguuuuuuuugaa

SEQ ID NO: 557263 - RNA, 17 nt, Coxiella burnetii RSA 493
ggacacauuuuuucaaa

SEQ ID NO: 557264 - RNA, 20 nt, Coxiella burnetii RSA 493
ggcccaguaacuaaguagcc

SEQ ID NO: 557265 - RNA, 22 nt, Coxiella burnetii RSA 493
aaggugauucucucaaagaaac

SEQ ID NO: 557266 - RNA, 23 nt, Coxiella burnetii RSA 493
aaggucuuaauuucuaaaaauca

SEQ ID NO: 557267 - RNA, 17 nt, Coxiella burnetii RSA 493
aaguacuagcaucaaua

SEQ ID NO: 557268 - RNA, 22 nt, Coxiella burnetii RSA 493
gguaaucucacuuggauuuuau

SEQ ID NO: 557269 - RNA, 16 nt, Coxiella burnetii RSA 493
gggaccuuuuuugcaa

SEQ ID NO: 557270 - RNA, 19 nt, Coxiella burnetii RSA 493
guaaucguucggcuucaua

SEQ ID NO: 557271 - RNA, 21 nt, Coxiella burnetii RSA 493
gguuuugugcauaaauuauuu

SEQ ID NO: 557272 - RNA, 20 nt, Coxiella burnetii RSA 493
aagucagcuuuggaaaaaca

SEQ ID NO: 557273 - RNA, 20 nt, Coxiella burnetii RSA 493
aaguaugauguuuccguuug

SEQ ID NO: 557274 - RNA, 15 nt, Coxiella burnetii RSA 493
guauaguucuaauaa

SEQ ID NO: 557275 - RNA, 18 nt, Coxiella burnetii RSA 493
guagguuagagagcuugc

SEQ ID NO: 557276 - RNA, 24 nt, Coxiella burnetii RSA 493
gucaauuucaaugacuuuaacucg

SEQ ID NO: 557277 - RNA, 19 nt, Coxiella burnetii RSA 493
guaugcagcgaagcgaaau

SEQ ID NO: 557278 - RNA, 20 nt, Coxiella burnetii RSA 493
guaugcagcgaagcggaaua

SEQ ID NO: 557279 - RNA, 14 nt, Coxiella burnetii RSA 493
guaugagcggcaau

SEQ ID NO: 557280 - RNA, 20 nt, Coxiella burnetii RSA 493
guauuucgcuucgcuacaua

SEQ ID NO: 557281 - RNA, 19 nt, Coxiella burnetii RSA 493
guauuucgcuucgcucaua

SEQ ID NO: 557282 - RNA, 20 nt, Coxiella burnetii RSA 493
guauuucgcuucgcucauac

SEQ ID NO: 557283 - RNA, 20 nt, Coxiella burnetii RSA 493
guauuucgcuucgcuccaua

SEQ ID NO: 557284 - RNA, 20 nt, Coxiella burnetii RSA 493
guauuucgcuucgcugcaua

SEQ ID NO: 557285 - RNA, 22 nt, Coxiella burnetii RSA 493
guauuucgcuucgcugcauacg

SEQ ID NO: 557286 - RNA, 20 nt, Coxiella burnetii RSA 493
guauuccgcuucgcugcaua

SEQ ID NO: 557287 - RNA, 21 nt, Coxiella burnetii RSA 493
guauuccgcuucgcugcauac

SEQ ID NO: 557288 - RNA, 22 nt, Coxiella burnetii RSA 493
guauuccgcuucgcugcauacg

SEQ ID NO: 557289 - RNA, 20 nt, Coxiella burnetii RSA 493
guauuccgcuuugcuccaua

SEQ ID NO: 557290 - RNA, 16 nt, Coxiella burnetii RSA 493
guauugaucgcccaua

SEQ ID NO: 557291 - RNA, 15 nt, Coxiella burnetii RSA 493
guauugggcggaauu

SEQ ID NO: 557292 - RNA, 15 nt, Coxiella burnetii RSA 493
guccugcuuuugcau

SEQ ID NO: 557293 - RNA, 20 nt, Coxiella burnetii RSA 493
guccccguauuucgcuucgc

SEQ ID NO: 557294 - RNA, 21 nt, Coxiella burnetii RSA 493
guccccguauuucgcuucgcu

SEQ ID NO: 557295 - RNA, 20 nt, Coxiella burnetii RSA 493
gucgcguagcgacacaacca

SEQ ID NO: 557296 - RNA, 17 nt, Coxiella burnetii RSA 493
gcuaagugauugauuuu

SEQ ID NO: 557297 - RNA, 21 nt, Coxiella burnetii RSA 493
gcguuuuuuuauuaucaucgc

SEQ ID NO: 557298 - RNA, 14 nt, Coxiella burnetii RSA 493
gcguugccgccugu

SEQ ID NO: 557299 - RNA, 11 nt, Coxiella burnetii RSA 493
gcguugauuuu

SEQ ID NO: 557300 - RNA, 15 nt, Coxiella burnetii RSA 493
gcuaucggcuucaca

SEQ ID NO: 557301 - RNA, 16 nt, Coxiella burnetii RSA 493
gcuacguuuuuugcau

SEQ ID NO: 557302 - RNA, 18 nt, Coxiella burnetii RSA 493
gcuagcuggaauucauaa

SEQ ID NO: 557303 - RNA, 13 nt, Coxiella burnetii RSA 493
gcuacauacgggc

SEQ ID NO: 557304 - RNA, 16 nt, Coxiella burnetii RSA 493
gcuaauucuuuuuuaa

SEQ ID NO: 557305 - RNA, 12 nt, Coxiella burnetii RSA 493
aaggaaaagcac

SEQ ID NO: 557306 - RNA, 21 nt, Coxiella burnetii RSA 493
gcucuguuuacuauaaucucg

SEQ ID NO: 557307 - RNA, 14 nt, Coxiella burnetii RSA 493
gcuggaaaaauaaa

SEQ ID NO: 557308 - RNA, 16 nt, Coxiella burnetii RSA 493
aagcuauccaaauaau

SEQ ID NO: 557309 - RNA, 14 nt, Coxiella burnetii RSA 493
aagcuagcgaaauu

SEQ ID NO: 557310 - RNA, 16 nt, Coxiella burnetii RSA 493
aagcucaugaaaagca

SEQ ID NO: 557311 - RNA, 15 nt, Coxiella burnetii RSA 493
aagcucagcccaacc

SEQ ID NO: 557312 - RNA, 14 nt, Coxiella burnetii RSA 493
aagcgcggcgaaau

SEQ ID NO: 557313 - RNA, 16 nt, Coxiella burnetii RSA 493
gcggcuaaugcuuuuu

SEQ ID NO: 557314 - RNA, 20 nt, Coxiella burnetii RSA 493
aagcgaaauacgggaaaaca

SEQ ID NO: 557315 - RNA, 21 nt, Coxiella burnetii RSA 493
aagcauuaaaaaauaagaaag

SEQ ID NO: 557316 - RNA, 16 nt, Coxiella burnetii RSA 493
gccgcuuuuuauugga

SEQ ID NO: 557317 - RNA, 15 nt, Coxiella burnetii RSA 493
gccgcugugccugcc

SEQ ID NO: 557318 - RNA, 17 nt, Coxiella burnetii RSA 493
gccuuaauguuuuuucu

SEQ ID NO: 557319 - RNA, 11 nt, Coxiella burnetii RSA 493
gcgauucauuc

SEQ ID NO: 557320 - RNA, 14 nt, Coxiella burnetii RSA 493
gcgauaaucauuaa

SEQ ID NO: 557321 - RNA, 16 nt, Coxiella burnetii RSA 493
gcgccaugcauaucgg

SEQ ID NO: 557322 - RNA, 21 nt, Coxiella burnetii RSA 493
aagaguauuuuuuuuaaaauu

SEQ ID NO: 557323 - RNA, 16 nt, Coxiella burnetii RSA 493
gcccgaaaaaguagcg

SEQ ID NO: 557324 - RNA, 18 nt, Coxiella burnetii RSA 493
gcccguaugagcgaacga

SEQ ID NO: 557325 - RNA, 20 nt, Coxiella burnetii RSA 493
gcccguaugcagcgaagcga

SEQ ID NO: 557326 - RNA, 23 nt, Coxiella burnetii RSA 493
gccauauaauuuaaugagguuaa

SEQ ID NO: 557327 - RNA, 18 nt, Coxiella burnetii RSA 493
gccaggacuuuaagauuu

SEQ ID NO: 557328 - RNA, 22 nt, Coxiella burnetii RSA 493
gccaccuuuuggcaauuuauuc

SEQ ID NO: 557329 - RNA, 19 nt, Coxiella burnetii RSA 493
gccagaagcguaccaaugu

SEQ ID NO: 557330 - RNA, 15 nt, Coxiella burnetii RSA 493
gccaaaauaauaacc

SEQ ID NO: 557331 - RNA, 18 nt, Coxiella burnetii RSA 493
gcauuucccaaucaucaa

SEQ ID NO: 557332 - RNA, 18 nt, Coxiella burnetii RSA 493
gcauuguuggaaauaaug

SEQ ID NO: 557333 - RNA, 14 nt, Coxiella burnetii RSA 493
gcauucuugcaacg

SEQ ID NO: 557334 - RNA, 13 nt, Coxiella burnetii RSA 493
gccacacaaccac

SEQ ID NO: 557335 - RNA, 19 nt, Coxiella burnetii RSA 493
gcauucauucuuuuuucaa

SEQ ID NO: 557336 - RNA, 16 nt, Coxiella burnetii RSA 493
gcauuaaaaaauaaga

SEQ ID NO: 557337 - RNA, 14 nt, Coxiella burnetii RSA 493
gcauauauuccaca

SEQ ID NO: 557338 - RNA, 17 nt, Coxiella burnetii RSA 493
gcauagcauccuuaaug

SEQ ID NO: 557339 - RNA, 19 nt, Coxiella burnetii RSA 493
gcauacgauauaaaagcau

SEQ ID NO: 557340 - RNA, 23 nt, Coxiella burnetii RSA 493
gcaucguuaaacucggcuuuaua

SEQ ID NO: 557341 - RNA, 19 nt, Coxiella burnetii RSA 493
gagcaucuuuuugcaaaua

SEQ ID NO: 557342 - RNA, 13 nt, Coxiella burnetii RSA 493
aacuccuucgcuu

SEQ ID NO: 557343 - RNA, 11 nt, Coxiella burnetii RSA 493
aacucauaacg

SEQ ID NO: 557344 - RNA, 19 nt, Coxiella burnetii RSA 493
gagcaguugaacagcgcga

SEQ ID NO: 557345 - RNA, 20 nt, Coxiella burnetii RSA 493
gagcgaagcgaaauacgggg

SEQ ID NO: 557346 - RNA, 20 nt, Coxiella burnetii RSA 493
gagcgaagcgaaguacggga

SEQ ID NO: 557347 - RNA, 16 nt, Coxiella burnetii RSA 493
gagcaauucaauuuuu

SEQ ID NO: 557348 - RNA, 18 nt, Coxiella burnetii RSA 493
aacuauuauuaaaagagc

SEQ ID NO: 557349 - RNA, 18 nt, Coxiella burnetii RSA 493
aacguuugauuuucaagu

SEQ ID NO: 557350 - RNA, 18 nt, Coxiella burnetii RSA 493
aacuaaagggggaacgaa

SEQ ID NO: 557351 - RNA, 21 nt, Coxiella burnetii RSA 493
gagggauuuugcaggggauaa

SEQ ID NO: 557352 - RNA, 19 nt, Coxiella burnetii RSA 493
gagucgggaaauaaaauua

SEQ ID NO: 557353 - RNA, 14 nt, Coxiella burnetii RSA 493
gaguuaauuucaua

SEQ ID NO: 557354 - RNA, 23 nt, Coxiella burnetii RSA 493
gauaaaguguugucggcgauacg

SEQ ID NO: 557355 - RNA, 20 nt, Coxiella burnetii RSA 493
gauaaaaacaaagugaaaua

SEQ ID NO: 557356 - RNA, 15 nt, Coxiella burnetii RSA 493
gauagugcuuuuaaa

SEQ ID NO: 557357 - RNA, 18 nt, Coxiella burnetii RSA 493
gauaucgacacaaacgau

SEQ ID NO: 557358 - RNA, 22 nt, Coxiella burnetii RSA 493
gauagucucuauaucuuuuaaa

SEQ ID NO: 557359 - RNA, 14 nt, Coxiella burnetii RSA 493
gauagacaauuuuu

SEQ ID NO: 557360 - RNA, 16 nt, Coxiella burnetii RSA 493
gauagaccaucguuuu

SEQ ID NO: 557361 - RNA, 18 nt, Coxiella burnetii RSA 493
gauaucuccauuuucaag

SEQ ID NO: 557362 - RNA, 13 nt, Coxiella burnetii RSA 493
gaucuaaucgucu

SEQ ID NO: 557363 - RNA, 24 nt, Coxiella burnetii RSA 493
gaucguuaaaucgggugcauaacg

SEQ ID NO: 557364 - RNA, 22 nt, Coxiella burnetii RSA 493
gaucauuaucucuuaaaauucc

SEQ ID NO: 557365 - RNA, 18 nt, Coxiella burnetii RSA 493
gaucgcccacuuguaaug

SEQ ID NO: 557366 - RNA, 23 nt, Coxiella burnetii RSA 493
gcagccuaauuuaaugccgauaa

SEQ ID NO: 557367 - RNA, 17 nt, Coxiella burnetii RSA 493
gcaagaggaguucuaaa

SEQ ID NO: 557368 - RNA, 15 nt, Coxiella burnetii RSA 493
gcaacguuugauuuu

SEQ ID NO: 557369 - RNA, 15 nt, Coxiella burnetii RSA 493
gcaagcguucuuaaa

SEQ ID NO: 557370 - RNA, 16 nt, Coxiella burnetii RSA 493
gcaaugaauucaaacc

SEQ ID NO: 557371 - RNA, 20 nt, Coxiella burnetii RSA 493
gcaauuccauuaaaaacaau

SEQ ID NO: 557372 - RNA, 21 nt, Coxiella burnetii RSA 493
gcaauacaucuugauccuuuu

SEQ ID NO: 557373 - RNA, 15 nt, Coxiella burnetii RSA 493
gcaauaacaaauaaa

SEQ ID NO: 557374 - RNA, 22 nt, Coxiella burnetii RSA 493
gauucguaauauuauugagaau

SEQ ID NO: 557375 - RNA, 15 nt, Coxiella burnetii RSA 493
gauucccaccaaaau

SEQ ID NO: 557376 - RNA, 22 nt, Coxiella burnetii RSA 493
cuuagcaauguuucaaucuggg

SEQ ID NO: 557377 - RNA, 21 nt, Coxiella burnetii RSA 493
cuugcccccauugauaauaau

SEQ ID NO: 557378 - RNA, 14 nt, Coxiella burnetii RSA 493
cuugcgagcgcaaa

SEQ ID NO: 557379 - RNA, 23 nt, Coxiella burnetii RSA 493
cuucuugucauucccuuuuucgu

SEQ ID NO: 557380 - RNA, 23 nt, Coxiella burnetii RSA 493
cuucuucuuuuaaguggauuuca

SEQ ID NO: 557381 - RNA, 16 nt, Coxiella burnetii RSA 493
cuucucaguuaaaaua

SEQ ID NO: 557382 - RNA, 15 nt, Coxiella burnetii RSA 493
cuuccgaaacuaaaa

SEQ ID NO: 557383 - RNA, 22 nt, Coxiella burnetii RSA 493
cuuccguugucuuggaaaaaaa

SEQ ID NO: 557384 - RNA, 12 nt, Coxiella burnetii RSA 493
cuuccauuaauu

SEQ ID NO: 557385 - RNA, 22 nt, Coxiella burnetii RSA 493
cugcuaagguguucaaccgcau

SEQ ID NO: 557386 - RNA, 19 nt, Coxiella burnetii RSA 493
cugcuuuugaauuuuuuga

SEQ ID NO: 557387 - RNA, 22 nt, Coxiella burnetii RSA 493
gaaaggucaggcaauuuugaua

SEQ ID NO: 557388 - RNA, 19 nt, Coxiella burnetii RSA 493
gaaauccguaauuuuaacg

SEQ ID NO: 557389 - RNA, 17 nt, Coxiella burnetii RSA 493
gaaaucguuuuguuuua

SEQ ID NO: 557390 - RNA, 15 nt, Coxiella burnetii RSA 493
gaagaaaaagaaauu

SEQ ID NO: 557391 - RNA, 20 nt, Coxiella burnetii RSA 493
gaagaaggcucuucauaucc

SEQ ID NO: 557392 - RNA, 22 nt, Coxiella burnetii RSA 493
gaacauuaagaaagcgagcaau

SEQ ID NO: 557393 - RNA, 18 nt, Coxiella burnetii RSA 493
gaaugagcauaacgaauc

SEQ ID NO: 557394 - RNA, 14 nt, Coxiella burnetii RSA 493
gaagcgaaauacgg

SEQ ID NO: 557395 - RNA, 16 nt, Coxiella burnetii RSA 493
gaagcgaaauacgggg

SEQ ID NO: 557396 - RNA, 19 nt, Coxiella burnetii RSA 493
gaagcgaaauacggggaaa

SEQ ID NO: 557397 - RNA, 21 nt, Coxiella burnetii RSA 493
gaagcgaaauacggggaaaua

SEQ ID NO: 557398 - RNA, 19 nt, Coxiella burnetii RSA 493
gaagcgaaauacggggaca

SEQ ID NO: 557399 - RNA, 17 nt, Coxiella burnetii RSA 493
gaagcaugcugauuuuc

SEQ ID NO: 557400 - RNA, 17 nt, Coxiella burnetii RSA 493
gacauuucacccagacu

SEQ ID NO: 557401 - RNA, 18 nt, Coxiella burnetii RSA 493
gacaguuuagaaucucac

SEQ ID NO: 557402 - RNA, 23 nt, Coxiella burnetii RSA 493
aacgaaucguuuguaauaauuca

SEQ ID NO: 557403 - RNA, 18 nt, Coxiella burnetii RSA 493
aacgaauacggggacgau

SEQ ID NO: 557404 - RNA, 15 nt, Coxiella burnetii RSA 493
aacgaacggcgauac

SEQ ID NO: 557405 - RNA, 23 nt, Coxiella burnetii RSA 493
gaauguuuuuuaauaaauagcau

SEQ ID NO: 557406 - RNA, 17 nt, Coxiella burnetii RSA 493
aacgcuuaacaguaacu

SEQ ID NO: 557407 - RNA, 12 nt, Coxiella burnetii RSA 493
cuaauucuuuuu

SEQ ID NO: 557408 - RNA, 22 nt, Coxiella burnetii RSA 493
cuaagauagggaaagagcggau

SEQ ID NO: 557409 - RNA, 15 nt, Coxiella burnetii RSA 493
cuacgaauagccaau

SEQ ID NO: 557410 - RNA, 19 nt, Coxiella burnetii RSA 493
cuaggcugagccagcuaag

SEQ ID NO: 557411 - RNA, 17 nt, Coxiella burnetii RSA 493
cuacuuagcuucggccg

SEQ ID NO: 557412 - RNA, 22 nt, Coxiella burnetii RSA 493
cuagaaauauuagaaauaauac

SEQ ID NO: 557413 - RNA, 17 nt, Coxiella burnetii RSA 493
cguuuugucguuuucau

SEQ ID NO: 557414 - RNA, 12 nt, Coxiella burnetii RSA 493
cguuuuccgcua

SEQ ID NO: 557415 - RNA, 22 nt, Coxiella burnetii RSA 493
cguuuuccgcuaaauauuuagc

SEQ ID NO: 557416 - RNA, 20 nt, Coxiella burnetii RSA 493
cguuuuaauuccgccauuaa

SEQ ID NO: 557417 - RNA, 19 nt, Coxiella burnetii RSA 493
cguuucuuauucauuaaau

SEQ ID NO: 557418 - RNA, 19 nt, Coxiella burnetii RSA 493
cguuucggauuuugaacag

SEQ ID NO: 557419 - RNA, 15 nt, Coxiella burnetii RSA 493
cguuaguuucuuuua

SEQ ID NO: 557420 - RNA, 19 nt, Coxiella burnetii RSA 493
cguuggcaaacagcgaaaa

SEQ ID NO: 557421 - RNA, 23 nt, Coxiella burnetii RSA 493
cguugcugugcgguauuuuuccu

SEQ ID NO: 557422 - RNA, 17 nt, Coxiella burnetii RSA 493
cgguugaagaaauacga

SEQ ID NO: 557423 - RNA, 16 nt, Coxiella burnetii RSA 493
cgguuuuuuucuuuuu

SEQ ID NO: 557424 - RNA, 20 nt, Coxiella burnetii RSA 493
cguccccguauuucgcuucg

SEQ ID NO: 557425 - RNA, 15 nt, Coxiella burnetii RSA 493
cguauugggcggaau

SEQ ID NO: 557426 - RNA, 19 nt, Coxiella burnetii RSA 493
cguauuccgcuucgcugca

SEQ ID NO: 557427 - RNA, 21 nt, Coxiella burnetii RSA 493
cguauuccgcuucgcugcaua

SEQ ID NO: 557428 - RNA, 22 nt, Coxiella burnetii RSA 493
cguauuccgcuucgcugcauac

SEQ ID NO: 557429 - RNA, 21 nt, Coxiella burnetii RSA 493
cguauuccgcuuugcuccaua

SEQ ID NO: 557430 - RNA, 22 nt, Coxiella burnetii RSA 493
cguauuccgcuuugcuccauac

SEQ ID NO: 557431 - RNA, 17 nt, Coxiella burnetii RSA 493
cguauaaaugaauaaua

SEQ ID NO: 557432 - RNA, 14 nt, Coxiella burnetii RSA 493
cgucaauuuuucuu

SEQ ID NO: 557433 - RNA, 17 nt, Coxiella burnetii RSA 493
cgucaauuuuucuuuuu

SEQ ID NO: 557434 - RNA, 15 nt, Coxiella burnetii RSA 493
cgucagaaaacagcc

SEQ ID NO: 557435 - RNA, 20 nt, Coxiella burnetii RSA 493
uuucacuuuauuuucauacg

SEQ ID NO: 557436 - RNA, 18 nt, Coxiella burnetii RSA 493
uuucacgauuuuucucau

SEQ ID NO: 557437 - RNA, 18 nt, Coxiella burnetii RSA 493
uuuaugcuucaauaaaaa

SEQ ID NO: 557438 - RNA, 22 nt, Coxiella burnetii RSA 493
uuguucauccagccaaaucgca

SEQ ID NO: 557439 - RNA, 18 nt, Coxiella burnetii RSA 493
uuguguggcuucgccaca

SEQ ID NO: 557440 - RNA, 15 nt, Coxiella burnetii RSA 493
uuuaauuaagcuuga

SEQ ID NO: 557441 - RNA, 13 nt, Coxiella burnetii RSA 493
uugaaaaauaaaa

SEQ ID NO: 557442 - RNA, 18 nt, Coxiella burnetii RSA 493
uugaaaaucccuuuuaau

SEQ ID NO: 557443 - RNA, 19 nt, Coxiella burnetii RSA 493
uugucggccggauuuuaau

SEQ ID NO: 557444 - RNA, 22 nt, Coxiella burnetii RSA 493
uuucucucucauaaucgauaau

SEQ ID NO: 557445 - RNA, 11 nt, Coxiella burnetii RSA 493
uuucuucauau

SEQ ID NO: 557446 - RNA, 12 nt, Coxiella burnetii RSA 493
uuucuucauauu

SEQ ID NO: 557447 - RNA, 19 nt, Coxiella burnetii RSA 493
uuucuguuuuacugccuac

SEQ ID NO: 557448 - RNA, 17 nt, Coxiella burnetii RSA 493
uuucccguauuucgcuu

SEQ ID NO: 557449 - RNA, 17 nt, Coxiella burnetii RSA 493
uuucaggauuaauuuuc

SEQ ID NO: 557450 - RNA, 18 nt, Coxiella burnetii RSA 493
uuuccaauuguuugaaaa

SEQ ID NO: 557451 - RNA, 15 nt, Coxiella burnetii RSA 493
uuucuuccucaacgg

SEQ ID NO: 557452 - RNA, 20 nt, Coxiella burnetii RSA 493
uuugaacaguuccugaaacg

SEQ ID NO: 557453 - RNA, 16 nt, Coxiella burnetii RSA 493
uuugagugguugaaaa

SEQ ID NO: 557454 - RNA, 15 nt, Coxiella burnetii RSA 493
uuugauaaaacuuga

SEQ ID NO: 557455 - RNA, 16 nt, Coxiella burnetii RSA 493
uuugaguaaucagcau

SEQ ID NO: 557456 - RNA, 19 nt, Coxiella burnetii RSA 493
uuuucccguauuucgcuuc

SEQ ID NO: 557457 - RNA, 22 nt, Coxiella burnetii RSA 493
uuuucccguauuucgcuucgcu

SEQ ID NO: 557458 - RNA, 22 nt, Coxiella burnetii RSA 493
uuuucgcggagaggucaucauu

SEQ ID NO: 557459 - RNA, 18 nt, Coxiella burnetii RSA 493
uuuucauccagugaaaac

SEQ ID NO: 557460 - RNA, 15 nt, Coxiella burnetii RSA 493
uuuucagucaccauu

SEQ ID NO: 557461 - RNA, 19 nt, Coxiella burnetii RSA 493
uuuuaacuucucuugaaua

SEQ ID NO: 557462 - RNA, 13 nt, Coxiella burnetii RSA 493
uuuuucauccagu

SEQ ID NO: 557463 - RNA, 21 nt, Coxiella burnetii RSA 493
uguaugaagcgcggcgaaaua

SEQ ID NO: 557464 - RNA, 14 nt, Coxiella burnetii RSA 493
uguauuaacauuug

SEQ ID NO: 557465 - RNA, 18 nt, Coxiella burnetii RSA 493
ugucuuccguugucuugg

SEQ ID NO: 557466 - RNA, 14 nt, Coxiella burnetii RSA 493
ugucggauuucuuu

SEQ ID NO: 557467 - RNA, 20 nt, Coxiella burnetii RSA 493
ugguuaauucuucuucauuu

SEQ ID NO: 557468 - RNA, 18 nt, Coxiella burnetii RSA 493
uggucacaugauuuuucu

SEQ ID NO: 557469 - RNA, 19 nt, Coxiella burnetii RSA 493
ugggcugagcuugcgaagc

SEQ ID NO: 557470 - RNA, 20 nt, Coxiella burnetii RSA 493
ugggccuacuuuauuuauug

SEQ ID NO: 557471 - RNA, 21 nt, Coxiella burnetii RSA 493
uggcucccagcguuuccaauu

SEQ ID NO: 557472 - RNA, 17 nt, Coxiella burnetii RSA 493
ugggaucguuaugggaa

SEQ ID NO: 557473 - RNA, 16 nt, Coxiella burnetii RSA 493
uucccaggaaagaaaa

SEQ ID NO: 557474 - RNA, 17 nt, Coxiella burnetii RSA 493
uuccauacuaauuucag

SEQ ID NO: 557475 - RNA, 22 nt, Coxiella burnetii RSA 493
uuccauccgcgucauaccggcg

SEQ ID NO: 557476 - RNA, 14 nt, Coxiella burnetii RSA 493
uucauuuuuuuugc

SEQ ID NO: 557477 - RNA, 23 nt, Coxiella burnetii RSA 493
uucauuaauccaguuuuuuaacu

SEQ ID NO: 557478 - RNA, 17 nt, Coxiella burnetii RSA 493
uucauuuaauuuuaaau

SEQ ID NO: 557479 - RNA, 18 nt, Coxiella burnetii RSA 493
uucagcauaacuaauugc

SEQ ID NO: 557480 - RNA, 12 nt, Coxiella burnetii RSA 493
uucaauugcuuu

SEQ ID NO: 557481 - RNA, 19 nt, Coxiella burnetii RSA 493
uucaagcacuaguuuuacu

SEQ ID NO: 557482 - RNA, 18 nt, Coxiella burnetii RSA 493
uuaaaugaauuacuuuca

SEQ ID NO: 557483 - RNA, 18 nt, Coxiella burnetii RSA 493
uuaaaugcuuuucuuuca

SEQ ID NO: 557484 - RNA, 23 nt, Coxiella burnetii RSA 493
uuaaucaaccucagguuuuaccu

SEQ ID NO: 557485 - RNA, 21 nt, Coxiella burnetii RSA 493
uuaaaauuagcgaugucagcc

SEQ ID NO: 557486 - RNA, 17 nt, Coxiella burnetii RSA 493
uuaaacgcgauaucucc

SEQ ID NO: 557487 - RNA, 13 nt, Coxiella burnetii RSA 493
uguuuuuucacuu

SEQ ID NO: 557488 - RNA, 12 nt, Coxiella burnetii RSA 493
uuaaaaauaaau

SEQ ID NO: 557489 - RNA, 13 nt, Coxiella burnetii RSA 493
uuagcggaauacg

SEQ ID NO: 557490 - RNA, 17 nt, Coxiella burnetii RSA 493
uuauaacuauuuuaaau

SEQ ID NO: 557491 - RNA, 15 nt, Coxiella burnetii RSA 493
uucgcuuuuuugcuu

SEQ ID NO: 557492 - RNA, 20 nt, Coxiella burnetii RSA 493
uucgcuucgcuacauacggg

SEQ ID NO: 557493 - RNA, 19 nt, Coxiella burnetii RSA 493
uucgcuucgcucagacggg

SEQ ID NO: 557494 - RNA, 19 nt, Coxiella burnetii RSA 493
uucgcuucgcuccauacgg

SEQ ID NO: 557495 - RNA, 15 nt, Coxiella burnetii RSA 493
uucgcuaacgccaca

SEQ ID NO: 557496 - RNA, 14 nt, Coxiella burnetii RSA 493
uucgcuccauacgg

SEQ ID NO: 557497 - RNA, 21 nt, Coxiella burnetii RSA 493
uucgcacaaugcuuuucucaa

SEQ ID NO: 557498 - RNA, 18 nt, Coxiella burnetii RSA 493
uucgcaacuuuuuuccuu

SEQ ID NO: 557499 - RNA, 20 nt, Coxiella burnetii RSA 493
uucgagaauauauucauauc

SEQ ID NO: 557500 - RNA, 19 nt, Coxiella burnetii RSA 493
uucgaaagaaauaacugug

SEQ ID NO: 557501 - RNA, 17 nt, Coxiella burnetii RSA 493
uucccccacuucauacg

SEQ ID NO: 557502 - RNA, 18 nt, Coxiella burnetii RSA 493
uucccguauuucgcuucg

SEQ ID NO: 557503 - RNA, 22 nt, Coxiella burnetii RSA 493
uucguuucgaaaaauuauuaau

SEQ ID NO: 557504 - RNA, 16 nt, Coxiella burnetii RSA 493
uucuaaguaaacagca

SEQ ID NO: 557505 - RNA, 22 nt, Coxiella burnetii RSA 493
uucggggcggcuuuuuucgcuu

SEQ ID NO: 557506 - RNA, 15 nt, Coxiella burnetii RSA 493
uucuucaauacugug

SEQ ID NO: 557507 - RNA, 15 nt, Coxiella burnetii RSA 493
uucuucacuuuccuu

SEQ ID NO: 557508 - RNA, 15 nt, Coxiella burnetii RSA 493
uucugugaaauaaac

SEQ ID NO: 557509 - RNA, 15 nt, Coxiella burnetii RSA 493
guuuacauaagaaac

SEQ ID NO: 557510 - RNA, 21 nt, Coxiella burnetii RSA 493
guuuccuccguaauuaccuga

SEQ ID NO: 557511 - RNA, 21 nt, Coxiella burnetii RSA 493
guugucaacaaaauuuuucau

SEQ ID NO: 557512 - RNA, 15 nt, Coxiella burnetii RSA 493
guuucgguuucguuc

SEQ ID NO: 557513 - RNA, 16 nt, Coxiella burnetii RSA 493
guuucgguuucuaucg

SEQ ID NO: 557514 - RNA, 16 nt, Coxiella burnetii RSA 493
guuucuuggauuuuuu

SEQ ID NO: 557515 - RNA, 16 nt, Coxiella burnetii RSA 493
guuugcguuuuucgca

SEQ ID NO: 557516 - RNA, 19 nt, Coxiella burnetii RSA 493
guuugcacauaagcgaaua

SEQ ID NO: 557517 - RNA, 20 nt, Coxiella burnetii RSA 493
guuuucccguauuucgcuuc

SEQ ID NO: 557518 - RNA, 14 nt, Coxiella burnetii RSA 493
guuuuacugccuac

SEQ ID NO: 557519 - RNA, 17 nt, Coxiella burnetii RSA 493
guggucugaaaauaauu

SEQ ID NO: 557520 - RNA, 17 nt, Coxiella burnetii RSA 493
guugagagucaggaaau

SEQ ID NO: 557521 - RNA, 22 nt, Coxiella burnetii RSA 493
guugaaucaaauuaaaauaauc

SEQ ID NO: 557522 - RNA, 13 nt, Coxiella burnetii RSA 493
uaagagaaaaaac

SEQ ID NO: 557523 - RNA, 14 nt, Coxiella burnetii RSA 493
uaagagcauaucaa

SEQ ID NO: 557524 - RNA, 17 nt, Coxiella burnetii RSA 493
uaaucgucuugaccaau

SEQ ID NO: 557525 - RNA, 16 nt, Coxiella burnetii RSA 493
uaaucguucggcuuca

SEQ ID NO: 557526 - RNA, 14 nt, Coxiella burnetii RSA 493
uaaucucgucgccc

SEQ ID NO: 557527 - RNA, 14 nt, Coxiella burnetii RSA 493
uacaggaaaaagau

SEQ ID NO: 557528 - RNA, 12 nt, Coxiella burnetii RSA 493
uaaugaaaaaua

SEQ ID NO: 557529 - RNA, 21 nt, Coxiella burnetii RSA 493
uaauggauucccauaaccguu

SEQ ID NO: 557530 - RNA, 19 nt, Coxiella burnetii RSA 493
uaauuggaggacugcucuu

SEQ ID NO: 557531 - RNA, 23 nt, Coxiella burnetii RSA 493
uaaauccauccggaugucauaau

SEQ ID NO: 557532 - RNA, 13 nt, Coxiella burnetii RSA 493
uaaaccucaacag

SEQ ID NO: 557533 - RNA, 22 nt, Coxiella burnetii RSA 493
uaaauauccgcaauaugcagcc

SEQ ID NO: 557534 - RNA, 11 nt, Coxiella burnetii RSA 493
uaaaaacaauu

SEQ ID NO: 557535 - RNA, 20 nt, Coxiella burnetii RSA 493
uaaaagacguaccauuaaaa

SEQ ID NO: 557536 - RNA, 15 nt, Coxiella burnetii RSA 493
uaaaacuugauuauu

SEQ ID NO: 557537 - RNA, 15 nt, Coxiella burnetii RSA 493
uaaaacccgauggca

SEQ ID NO: 557538 - RNA, 23 nt, Coxiella burnetii RSA 493
uaaaacgccguaaccaaaacuau

SEQ ID NO: 557539 - RNA, 23 nt, Coxiella burnetii RSA 493
uacuccgcccccccaaacaaaag

SEQ ID NO: 557540 - RNA, 13 nt, Coxiella burnetii RSA 493
uacuaaacaaaau

SEQ ID NO: 557541 - RNA, 15 nt, Coxiella burnetii RSA 493
uacguuaaagccguu

SEQ ID NO: 557542 - RNA, 19 nt, Coxiella burnetii RSA 493
uagggcaucaggcuaucgc

SEQ ID NO: 557543 - RNA, 18 nt, Coxiella burnetii RSA 493
uagcucauugaaaucaau

SEQ ID NO: 557544 - RNA, 13 nt, Coxiella burnetii RSA 493
uagcggaauacgg

SEQ ID NO: 557545 - RNA, 14 nt, Coxiella burnetii RSA 493
uagcggaauacggg

SEQ ID NO: 557546 - RNA, 20 nt, Coxiella burnetii RSA 493
uaucauacuuaauuucgcuc

SEQ ID NO: 557547 - RNA, 14 nt, Coxiella burnetii RSA 493
uaucagaaaccguu

SEQ ID NO: 557548 - RNA, 13 nt, Coxiella burnetii RSA 493
uaugaaaacauac

SEQ ID NO: 557549 - RNA, 19 nt, Coxiella burnetii RSA 493
uaugaagcgcggcgaaaua

SEQ ID NO: 557550 - RNA, 20 nt, Coxiella burnetii RSA 493
uaucguccccguauuucgcu

SEQ ID NO: 557551 - RNA, 21 nt, Coxiella burnetii RSA 493
uaucguccccguauuucgcuu

SEQ ID NO: 557552 - RNA, 18 nt, Coxiella burnetii RSA 493
uauccuaauaaaaauauu

SEQ ID NO: 557553 - RNA, 21 nt, Coxiella burnetii RSA 493
uaugagcgaagcgaaauacgg

SEQ ID NO: 557554 - RNA, 22 nt, Coxiella burnetii RSA 493
uaugagcgaagcgaaguacggg

SEQ ID NO: 557555 - RNA, 16 nt, Coxiella burnetii RSA 493
uauggcgcucuccuac

SEQ ID NO: 557556 - RNA, 20 nt, Coxiella burnetii RSA 493
uauuggauuuacuucuauac

SEQ ID NO: 557557 - RNA, 19 nt, Coxiella burnetii RSA 493
uauuccgcuucgcugcaua

SEQ ID NO: 557558 - RNA, 19 nt, Coxiella burnetii RSA 493
uauuccgcuuugcuccaua

SEQ ID NO: 557559 - RNA, 17 nt, Coxiella burnetii RSA 493
uauuauucauaucuuuu

SEQ ID NO: 557560 - RNA, 13 nt, Coxiella burnetii RSA 493
uagguuuucgcug

SEQ ID NO: 557561 - RNA, 19 nt, Coxiella burnetii RSA 493
uaggggugaauuuuugcca

SEQ ID NO: 557562 - RNA, 13 nt, Coxiella burnetii RSA 493
uauaaaauuuuau

SEQ ID NO: 557563 - RNA, 20 nt, Coxiella burnetii RSA 493
uaguuugguggaugaucauc

SEQ ID NO: 557564 - RNA, 23 nt, Coxiella burnetii RSA 493
uauaauugagguuuuaauuugcc

SEQ ID NO: 557565 - RNA, 14 nt, Coxiella burnetii RSA 493
ucaguuaaaauaau

SEQ ID NO: 557566 - RNA, 16 nt, Coxiella burnetii RSA 493
ucauaaucgauaauca

SEQ ID NO: 557567 - RNA, 15 nt, Coxiella burnetii RSA 493
ucauucauucgcuuu

SEQ ID NO: 557568 - RNA, 14 nt, Coxiella burnetii RSA 493
ucauugaaaucaau

SEQ ID NO: 557569 - RNA, 22 nt, Coxiella burnetii RSA 493
ucauugaaaucaauuuucuucg

SEQ ID NO: 557570 - RNA, 21 nt, Coxiella burnetii RSA 493
ucauuauugaguaaugguuuu

SEQ ID NO: 557571 - RNA, 20 nt, Coxiella burnetii RSA 493
uccagguaguuuguuuuuua

SEQ ID NO: 557572 - RNA, 18 nt, Coxiella burnetii RSA 493
uauuuggguuuucuuuug

SEQ ID NO: 557573 - RNA, 13 nt, Coxiella burnetii RSA 493
uauuucuuuucug

SEQ ID NO: 557574 - RNA, 16 nt, Coxiella burnetii RSA 493
ucacgauuuuucucau

SEQ ID NO: 557575 - RNA, 14 nt, Coxiella burnetii RSA 493
ucacuuggauuuua

SEQ ID NO: 557576 - RNA, 23 nt, Coxiella burnetii RSA 493
ucagcaaguugcagaguuauuau

SEQ ID NO: 557577 - RNA, 15 nt, Coxiella burnetii RSA 493
ucccguauuucgcuu

SEQ ID NO: 557578 - RNA, 19 nt, Coxiella burnetii RSA 493
ucccguauuucgcuucgcu

SEQ ID NO: 557579 - RNA, 21 nt, Coxiella burnetii RSA 493
uccauuaauuucuuuuuuugu

SEQ ID NO: 557580 - RNA, 21 nt, Coxiella burnetii RSA 493
uccauuccaaaaacagauuua

SEQ ID NO: 557581 - RNA, 14 nt, Coxiella burnetii RSA 493
uccgcauaaaaacc

SEQ ID NO: 557582 - RNA, 16 nt, Coxiella burnetii RSA 493
ucgaaaaauuauuaau

SEQ ID NO: 557583 - RNA, 22 nt, Coxiella burnetii RSA 493
uccuuuuguuuuuaagauuuuu

SEQ ID NO: 557584 - RNA, 20 nt, Coxiella burnetii RSA 493
ucgccauugucucacaacau

SEQ ID NO: 557585 - RNA, 14 nt, Coxiella burnetii RSA 493
ucgcuuuauucauu

SEQ ID NO: 557586 - RNA, 16 nt, Coxiella burnetii RSA 493
ucgcguagcgacacaa

SEQ ID NO: 557587 - RNA, 14 nt, Coxiella burnetii RSA 493
ucuauccaauaaac

SEQ ID NO: 557588 - RNA, 18 nt, Coxiella burnetii RSA 493
ucguucgaagguauuuug

SEQ ID NO: 557589 - RNA, 24 nt, Coxiella burnetii RSA 493
ucguuaaaucgggugcauaacggg

SEQ ID NO: 557590 - RNA, 23 nt, Coxiella burnetii RSA 493
ucguuccaugacaugcgccacua

SEQ ID NO: 557591 - RNA, 13 nt, Coxiella burnetii RSA 493
ucuauuuuuuugc

SEQ ID NO: 557592 - RNA, 17 nt, Coxiella burnetii RSA 493
ucucguuagaaaagcgc

SEQ ID NO: 557593 - RNA, 20 nt, Coxiella burnetii RSA 493
ucuguuuacaauucgcuagg

SEQ ID NO: 557594 - RNA, 21 nt, Coxiella burnetii RSA 493
ucucuugaauaagccgcgcca

SEQ ID NO: 557595 - RNA, 14 nt, Coxiella burnetii RSA 493
ucuuaucuaaaaac

SEQ ID NO: 557596 - RNA, 20 nt, Coxiella burnetii RSA 493
ucuuaucuaaaaaccccaac

SEQ ID NO: 557597 - RNA, 21 nt, Coxiella burnetii RSA 493
ucuucgaagugugauucauua

SEQ ID NO: 557598 - RNA, 24 nt, Coxiella burnetii RSA 493
ucuucuuuuuuguaaaugacgggc

SEQ ID NO: 557599 - RNA, 22 nt, Coxiella burnetii RSA 493
ucuugaaaaacuuccgccacua

SEQ ID NO: 557600 - RNA, 14 nt, Coxiella burnetii RSA 493
ucuuuuucaaucgc

SEQ ID NO: 557601 - RNA, 21 nt, Coxiella burnetii RSA 493
ucuugggcaauuugugaaaua

SEQ ID NO: 557602 - RNA, 18 nt, Coxiella burnetii RSA 493
ugaaaaucaaauuuuccg

SEQ ID NO: 557603 - RNA, 22 nt, Coxiella burnetii RSA 493
ugaaaaccuacacuuuuaauca

SEQ ID NO: 557604 - RNA, 19 nt, Coxiella burnetii RSA 493
ugaaaacgacuuauuuuau

SEQ ID NO: 557605 - RNA, 20 nt, Coxiella burnetii RSA 493
ugagcgaagcgaaauacggg

SEQ ID NO: 557606 - RNA, 19 nt, Coxiella burnetii RSA 493
ugagcgaagcgaaguacgg

SEQ ID NO: 557607 - RNA, 17 nt, Coxiella burnetii RSA 493
ugagcgaacgaauacgg

SEQ ID NO: 557608 - RNA, 18 nt, Coxiella burnetii RSA 493
ugagcgaacgaauacggg

SEQ ID NO: 557609 - RNA, 19 nt, Coxiella burnetii RSA 493
ugagauaucaauagcgcaa

SEQ ID NO: 557610 - RNA, 16 nt, Coxiella burnetii RSA 493
ugaacgcucuuccaac

SEQ ID NO: 557611 - RNA, 16 nt, Coxiella burnetii RSA 493
ugcacauaagcgaaua

SEQ ID NO: 557612 - RNA, 11 nt, Coxiella burnetii RSA 493
ugaugaaaucg

SEQ ID NO: 557613 - RNA, 22 nt, Coxiella burnetii RSA 493
ugccaacccaaggaaccaccaa

SEQ ID NO: 557614 - RNA, 18 nt, Coxiella burnetii RSA 493
ugcagcuucgugcaauuu

SEQ ID NO: 557615 - RNA, 15 nt, Coxiella burnetii RSA 493
ugcagcugauuucug

SEQ ID NO: 557616 - RNA, 19 nt, Coxiella burnetii RSA 493
ugcagcgaagcgaaauacg

SEQ ID NO: 557617 - RNA, 23 nt, Coxiella burnetii RSA 493
ugcagcgaagcgaaauacgggaa

SEQ ID NO: 557618 - RNA, 20 nt, Coxiella burnetii RSA 493
ugcagcgaagcggaauacgg

SEQ ID NO: 557619 - RNA, 14 nt, Coxiella burnetii RSA 493
ugccuugccuuguu

SEQ ID NO: 557620 - RNA, 18 nt, Coxiella burnetii RSA 493
ugccuugccuuguuuuaa

SEQ ID NO: 557621 - RNA, 17 nt, Coxiella burnetii RSA 493
ugcgaauaacaaagacu

SEQ ID NO: 557622 - RNA, 21 nt, Coxiella burnetii RSA 493
ugcgcgggaaugacgauuaaa

SEQ ID NO: 557623 - RNA, 16 nt, Coxiella burnetii RSA 493
ugcucaaguccuugcu

SEQ ID NO: 557624 - RNA, 22 nt, Coxiella burnetii RSA 493
ugcuuuaaaucccguuucgguu

SEQ ID NO: 557625 - RNA, 19 nt, Coxiella burnetii RSA 493
ugcuucuaauuugaaaaac

SEQ ID NO: 557626 - RNA, 19 nt, Coxiella burnetii RSA 493
ugcuuccaaguaagccaua

SEQ ID NO: 557627 - RNA, 23 nt, Coxiella burnetii RSA 493
ugcuguuucuaauauguuuuuua

SEQ ID NO: 557628 - RNA, 15 nt, Coxiella burnetii RSA 493
ugcucuuuuucauuu

SEQ ID NO: 557629 - RNA, 19 nt, Coxiella burnetii RSA 493
ugcucuuuuucauuucuuc

SEQ ID NO: 557630 - RNA, 22 nt, Coxiella burnetii RSA 493
ugcucucccuuaacuucucuuc

SEQ ID NO: 557631 - RNA, 21 nt, Coxiella burnetii RSA 493
ugcugcgaccuucuuuuuuau

SEQ ID NO: 557632 - RNA, 15 nt, Coxiella burnetii RSA 493
gcugacgucagaaaa

SEQ ID NO: 557633 - RNA, 21 nt, Coxiella burnetii RSA 493
gcugauuccgaucuugguccg

SEQ ID NO: 557634 - RNA, 22 nt, Coxiella burnetii RSA 493
ggaaugacgaaagcuaaaaaag

SEQ ID NO: 557635 - RNA, 12 nt, Coxiella burnetii RSA 493
gcuuuuuucgcu

SEQ ID NO: 557636 - RNA, 22 nt, Coxiella burnetii RSA 493
ggaacgacggacauuuuuucaa

SEQ ID NO: 557637 - RNA, 20 nt, Coxiella burnetii RSA 493
gcuuucaauuacuuuuauaa

SEQ ID NO: 557638 - RNA, 23 nt, Coxiella burnetii RSA 493
gcuugcuaugaugccgcuccaua

SEQ ID NO: 557639 - RNA, 21 nt, Coxiella burnetii RSA 493
ggauacgcuucucguaacaaa

SEQ ID NO: 557640 - RNA, 15 nt, Coxiella burnetii RSA 493
gcuacguuguccuga

SEQ ID NO: 557641 - RNA, 21 nt, Coxiella burnetii RSA 493
gcuacguuuuuugcauuuuua

SEQ ID NO: 557642 - RNA, 15 nt, Coxiella burnetii RSA 493
gcuaguaugcuauaa

SEQ ID NO: 557643 - RNA, 14 nt, Coxiella burnetii RSA 493
gcuauuuuccuaau

SEQ ID NO: 557644 - RNA, 18 nt, Coxiella burnetii RSA 493
gcguuaauugaagaauug

SEQ ID NO: 557645 - RNA, 19 nt, Coxiella burnetii RSA 493
gcggcgauaaucauuaacg

SEQ ID NO: 557646 - RNA, 13 nt, Coxiella burnetii RSA 493
gccuccagggcuu

SEQ ID NO: 557647 - RNA, 15 nt, Coxiella burnetii RSA 493
gccuuaauuucuaaa

SEQ ID NO: 557648 - RNA, 24 nt, Coxiella burnetii RSA 493
gcgcaagacaauguuaaaacacau

SEQ ID NO: 557649 - RNA, 21 nt, Coxiella burnetii RSA 493
gcgaaguacgggaaaacaaug

SEQ ID NO: 557650 - RNA, 16 nt, Coxiella burnetii RSA 493
gcgaaugguugaaaga

SEQ ID NO: 557651 - RNA, 18 nt, Coxiella burnetii RSA 493
gcgccgacucuaauugag

SEQ ID NO: 557652 - RNA, 23 nt, Coxiella burnetii RSA 493
gcgcgaucaagacucaaagaaau

SEQ ID NO: 557653 - RNA, 17 nt, Coxiella burnetii RSA 493
gugaaccgauucauaaa

SEQ ID NO: 557654 - RNA, 23 nt, Coxiella burnetii RSA 493
gugaugcacgggcaccauuuuuc

SEQ ID NO: 557655 - RNA, 20 nt, Coxiella burnetii RSA 493
guggcagcuucuuuaaaaua

SEQ ID NO: 557656 - RNA, 23 nt, Coxiella burnetii RSA 493
gucugauaggaauucuuuuucau

SEQ ID NO: 557657 - RNA, 17 nt, Coxiella burnetii RSA 493
gucuaguuauuuuucau

SEQ ID NO: 557658 - RNA, 21 nt, Coxiella burnetii RSA 493
guauuccgcuuugcuccauac

SEQ ID NO: 557659 - RNA, 21 nt, Coxiella burnetii RSA 493
guauuuguguaaaauacuggc

SEQ ID NO: 557660 - RNA, 19 nt, Coxiella burnetii RSA 493
guauuaacgcaggaucaac

SEQ ID NO: 557661 - RNA, 20 nt, Coxiella burnetii RSA 493
guaugaagcgcggcgaaaua

SEQ ID NO: 557662 - RNA, 20 nt, Coxiella burnetii RSA 493
guagguugggcugagcuugc

SEQ ID NO: 557663 - RNA, 16 nt, Coxiella burnetii RSA 493
guacugugcggauuaa

SEQ ID NO: 557664 - RNA, 20 nt, Coxiella burnetii RSA 493
gucauucauuucaauauuuc

SEQ ID NO: 557665 - RNA, 14 nt, Coxiella burnetii RSA 493
gguucguguuuauu

SEQ ID NO: 557666 - RNA, 15 nt, Coxiella burnetii RSA 493
ggugguuaaguagcu

SEQ ID NO: 557667 - RNA, 19 nt, Coxiella burnetii RSA 493
ggugcauaacgggaauguu

SEQ ID NO: 557668 - RNA, 14 nt, Coxiella burnetii RSA 493
ggguaagaauaaac

SEQ ID NO: 557669 - RNA, 21 nt, Coxiella burnetii RSA 493
gggcuuugggugauagacaga

SEQ ID NO: 557670 - RNA, 18 nt, Coxiella burnetii RSA 493
gggcuacuugaaaaccua

SEQ ID NO: 557671 - RNA, 21 nt, Coxiella burnetii RSA 493
gggcuacuuguugaaaaccua

SEQ ID NO: 557672 - RNA, 16 nt, Coxiella burnetii RSA 493
ccuauccuauucuuuu

SEQ ID NO: 557673 - RNA, 18 nt, Coxiella burnetii RSA 493
ccguuuugaaaaauaaaa

SEQ ID NO: 557674 - RNA, 16 nt, Coxiella burnetii RSA 493
ccguugagcaagcaga

SEQ ID NO: 557675 - RNA, 13 nt, Coxiella burnetii RSA 493
ccgcaaaguaaaa

SEQ ID NO: 557676 - RNA, 23 nt, Coxiella burnetii RSA 493
cgauaaugcacaucagcguaaau

SEQ ID NO: 557677 - RNA, 15 nt, Coxiella burnetii RSA 493
cgauagcgucuuuuu

SEQ ID NO: 557678 - RNA, 19 nt, Coxiella burnetii RSA 493
cgauggccggcagcguaau

SEQ ID NO: 557679 - RNA, 12 nt, Coxiella burnetii RSA 493
cgcaaacgcugc

SEQ ID NO: 557680 - RNA, 22 nt, Coxiella burnetii RSA 493
cgauucauuccgcggcgcucaa

SEQ ID NO: 557681 - RNA, 15 nt, Coxiella burnetii RSA 493
cgcaagucaucggga

SEQ ID NO: 557682 - RNA, 20 nt, Coxiella burnetii RSA 493
cgcaagugaccgagauuuuu

SEQ ID NO: 557683 - RNA, 17 nt, Coxiella burnetii RSA 493
cgcaauccucgcguuuu

SEQ ID NO: 557684 - RNA, 20 nt, Coxiella burnetii RSA 493
cgcauaaaaacccauuaagu

SEQ ID NO: 557685 - RNA, 15 nt, Coxiella burnetii RSA 493
cgcagaauagcggau

SEQ ID NO: 557686 - RNA, 15 nt, Coxiella burnetii RSA 493
cgaggcaaaauaaac

SEQ ID NO: 557687 - RNA, 11 nt, Coxiella burnetii RSA 493
cgagcuucaug

SEQ ID NO: 557688 - RNA, 13 nt, Coxiella burnetii RSA 493
cgaagaaaaagaa

SEQ ID NO: 557689 - RNA, 15 nt, Coxiella burnetii RSA 493
cgaacgacuuuuuuu

SEQ ID NO: 557690 - RNA, 14 nt, Coxiella burnetii RSA 493
cgcuacauacgggc

SEQ ID NO: 557691 - RNA, 11 nt, Coxiella burnetii RSA 493
cgcuaauugau

SEQ ID NO: 557692 - RNA, 12 nt, Coxiella burnetii RSA 493
cgcuaagcgaaa

SEQ ID NO: 557693 - RNA, 13 nt, Coxiella burnetii RSA 493
cgcuaagcgaaaa

SEQ ID NO: 557694 - RNA, 22 nt, Coxiella burnetii RSA 493
cgcuaaguugggccaaaauaga

SEQ ID NO: 557695 - RNA, 22 nt, Coxiella burnetii RSA 493
cgcuuuuauuccuuuuuuuaau

SEQ ID NO: 557696 - RNA, 15 nt, Coxiella burnetii RSA 493
cggaaauuucgauuu

SEQ ID NO: 557697 - RNA, 18 nt, Coxiella burnetii RSA 493
cgcuucgcucauacgggc

SEQ ID NO: 557698 - RNA, 19 nt, Coxiella burnetii RSA 493
cgcuucgcuccauacgggc

SEQ ID NO: 557699 - RNA, 22 nt, Coxiella burnetii RSA 493
cgcuuaaacccagaaaaguaaa

SEQ ID NO: 557700 - RNA, 16 nt, Coxiella burnetii RSA 493
cgccuaucuuuuucaa

SEQ ID NO: 557701 - RNA, 17 nt, Coxiella burnetii RSA 493
cggguuuacauaagaaa

SEQ ID NO: 557702 - RNA, 18 nt, Coxiella burnetii RSA 493
cggguuuacauaagaaac

SEQ ID NO: 557703 - RNA, 19 nt, Coxiella burnetii RSA 493
cggggaaauaaugacaauu

SEQ ID NO: 557704 - RNA, 22 nt, Coxiella burnetii RSA 493
cggcuugauuucaggcgccugc

SEQ ID NO: 557705 - RNA, 15 nt, Coxiella burnetii RSA 493
cggauguuuuuucac

SEQ ID NO: 557706 - RNA, 19 nt, Coxiella burnetii RSA 493
cggauucucucgcucaaug

SEQ ID NO: 557707 - RNA, 13 nt, Coxiella burnetii RSA 493
cggccuucauuau

SEQ ID NO: 557708 - RNA, 18 nt, Coxiella burnetii RSA 493
gauuuauugcuuaucgca

SEQ ID NO: 557709 - RNA, 18 nt, Coxiella burnetii RSA 493
gcaaaugaguaaaaaaga

SEQ ID NO: 557710 - RNA, 15 nt, Coxiella burnetii RSA 493
gauucuguaacuuuu

SEQ ID NO: 557711 - RNA, 18 nt, Coxiella burnetii RSA 493
gauucuguaacuuuucca

SEQ ID NO: 557712 - RNA, 17 nt, Coxiella burnetii RSA 493
gauucuacagaacuuuu

SEQ ID NO: 557713 - RNA, 19 nt, Coxiella burnetii RSA 493
gauucuacgaaacgcuuau

SEQ ID NO: 557714 - RNA, 18 nt, Coxiella burnetii RSA 493
gauuauucaauuucgcgg

SEQ ID NO: 557715 - RNA, 15 nt, Coxiella burnetii RSA 493
gauuaccuuugcgca

SEQ ID NO: 557716 - RNA, 14 nt, Coxiella burnetii RSA 493
gauuacgccaaacu

SEQ ID NO: 557717 - RNA, 15 nt, Coxiella burnetii RSA 493
gcaaguuuucuauau

SEQ ID NO: 557718 - RNA, 19 nt, Coxiella burnetii RSA 493
gcaacguuugauuuucaag

SEQ ID NO: 557719 - RNA, 19 nt, Coxiella burnetii RSA 493
gaucaugccuuuuuugcgc

SEQ ID NO: 557720 - RNA, 16 nt, Coxiella burnetii RSA 493
gauccaagauuuuuuu

SEQ ID NO: 557721 - RNA, 17 nt, Coxiella burnetii RSA 493
gagguagacuuuugcgc

SEQ ID NO: 557722 - RNA, 20 nt, Coxiella burnetii RSA 493
gagucggaaguucuauuucc

SEQ ID NO: 557723 - RNA, 15 nt, Coxiella burnetii RSA 493
gagugguaaugacga

SEQ ID NO: 557724 - RNA, 17 nt, Coxiella burnetii RSA 493
gauaucaauagcgcaau

SEQ ID NO: 557725 - RNA, 14 nt, Coxiella burnetii RSA 493
gcauuaaaagauuu

SEQ ID NO: 557726 - RNA, 14 nt, Coxiella burnetii RSA 493
gcauuaaucauuac

SEQ ID NO: 557727 - RNA, 21 nt, Coxiella burnetii RSA 493
gcauucccauagaagaacaau

SEQ ID NO: 557728 - RNA, 16 nt, Coxiella burnetii RSA 493
gcauuaucggaugaug

SEQ ID NO: 557729 - RNA, 22 nt, Coxiella burnetii RSA 493
gcaguuuuuuacuugcuucauc

SEQ ID NO: 557730 - RNA, 19 nt, Coxiella burnetii RSA 493
gcagcgaagcgaaauacgg

SEQ ID NO: 557731 - RNA, 19 nt, Coxiella burnetii RSA 493
gcagcgaagcggaauacgg

SEQ ID NO: 557732 - RNA, 17 nt, Coxiella burnetii RSA 493
gccccucaagcaaagcg

SEQ ID NO: 557733 - RNA, 22 nt, Coxiella burnetii RSA 493
gccaacgguaacccucgauuua

SEQ ID NO: 557734 - RNA, 11 nt, Coxiella burnetii RSA 493
cuguacuuuca

SEQ ID NO: 557735 - RNA, 22 nt, Coxiella burnetii RSA 493
cuguaacuuuuccaucuccuuu

SEQ ID NO: 557736 - RNA, 22 nt, Coxiella burnetii RSA 493
cuguuuuaucccaauaguaaaa

SEQ ID NO: 557737 - RNA, 16 nt, Coxiella burnetii RSA 493
cuucauauccuuucua

SEQ ID NO: 557738 - RNA, 21 nt, Coxiella burnetii RSA 493
cuucgcaaagcucagcccaac

SEQ ID NO: 557739 - RNA, 20 nt, Coxiella burnetii RSA 493
cuucgcgaacucagcccaac

SEQ ID NO: 557740 - RNA, 13 nt, Coxiella burnetii RSA 493
cuuguuaaguaga

SEQ ID NO: 557741 - RNA, 16 nt, Coxiella burnetii RSA 493
cuuuaauaucgcuaua

SEQ ID NO: 557742 - RNA, 17 nt, Coxiella burnetii RSA 493
cuuuaauugcuuccuua

SEQ ID NO: 557743 - RNA, 19 nt, Coxiella burnetii RSA 493
cuucuaaagaauuuuucau

SEQ ID NO: 557744 - RNA, 15 nt, Coxiella burnetii RSA 493
cuugcgaagcccaac

SEQ ID NO: 557745 - RNA, 12 nt, Coxiella burnetii RSA 493
gaaaauugauua

SEQ ID NO: 557746 - RNA, 18 nt, Coxiella burnetii RSA 493
gaaagcuucguuugcaaa

SEQ ID NO: 557747 - RNA, 19 nt, Coxiella burnetii RSA 493
gaaaguguagguuuucaac

SEQ ID NO: 557748 - RNA, 17 nt, Coxiella burnetii RSA 493
gaaauagaauuuuugac

SEQ ID NO: 557749 - RNA, 17 nt, Coxiella burnetii RSA 493
gaaauaauucgcacaau

SEQ ID NO: 557750 - RNA, 19 nt, Coxiella burnetii RSA 493
gaaauuggucaggaacaac

SEQ ID NO: 557751 - RNA, 18 nt, Coxiella burnetii RSA 493
gaacgaauacggggacga

SEQ ID NO: 557752 - RNA, 21 nt, Coxiella burnetii RSA 493
gacucuuuucggcguuaacgg

SEQ ID NO: 557753 - RNA, 19 nt, Coxiella burnetii RSA 493
gacuaaaaugcuucauacc

SEQ ID NO: 557754 - RNA, 15 nt, Coxiella burnetii RSA 493
gacuugcuuuuuucu

SEQ ID NO: 557755 - RNA, 15 nt, Coxiella burnetii RSA 493
gaauuucaccguuuu

SEQ ID NO: 557756 - RNA, 23 nt, Coxiella burnetii RSA 493
gaaugagcauaacgaaucguuug

SEQ ID NO: 557757 - RNA, 22 nt, Coxiella burnetii RSA 493
gaaucacuucuuccaugguuuc

SEQ ID NO: 557758 - RNA, 24 nt, Coxiella burnetii RSA 493
gaaucauccaaucaacgaacacau

SEQ ID NO: 557759 - RNA, 20 nt, Coxiella burnetii RSA 493
cguauuucgcuucgcuacau

SEQ ID NO: 557760 - RNA, 22 nt, Coxiella burnetii RSA 493
cguauuucgcuucgcuacauac

SEQ ID NO: 557761 - RNA, 20 nt, Coxiella burnetii RSA 493
cguauuucgcuucgcuccau

SEQ ID NO: 557762 - RNA, 22 nt, Coxiella burnetii RSA 493
cguauuucgcuucgcuccauac

SEQ ID NO: 557763 - RNA, 22 nt, Coxiella burnetii RSA 493
cguauuucgcuucgcugcauac

SEQ ID NO: 557764 - RNA, 20 nt, Coxiella burnetii RSA 493
cguauuuguguaaaauacug

SEQ ID NO: 557765 - RNA, 21 nt, Coxiella burnetii RSA 493
cguauggggcguuagcggaau

SEQ ID NO: 557766 - RNA, 16 nt, Coxiella burnetii RSA 493
cguauuccaaauaauc

SEQ ID NO: 557767 - RNA, 20 nt, Coxiella burnetii RSA 493
cguauuccgcuucgcugcau

SEQ ID NO: 557768 - RNA, 19 nt, Coxiella burnetii RSA 493
cguauuccuuuuucuuuua

SEQ ID NO: 557769 - RNA, 15 nt, Coxiella burnetii RSA 493
cgguugggucguuug

SEQ ID NO: 557770 - RNA, 16 nt, Coxiella burnetii RSA 493
cgucaugaaaagcgga

SEQ ID NO: 557771 - RNA, 20 nt, Coxiella burnetii RSA 493
cguccagguaguuuguuuuu

SEQ ID NO: 557772 - RNA, 18 nt, Coxiella burnetii RSA 493
cguucagcuagccauugu

SEQ ID NO: 557773 - RNA, 14 nt, Coxiella burnetii RSA 493
cguucggcuucaua

SEQ ID NO: 557774 - RNA, 18 nt, Coxiella burnetii RSA 493
cguguuaaaagcgcccaa

SEQ ID NO: 557775 - RNA, 18 nt, Coxiella burnetii RSA 493
cguuagcggaauacggga

SEQ ID NO: 557776 - RNA, 15 nt, Coxiella burnetii RSA 493
cgugucaucgcauac

SEQ ID NO: 557777 - RNA, 22 nt, Coxiella burnetii RSA 493
cguggcguuauugaucaaacgc

SEQ ID NO: 557778 - RNA, 20 nt, Coxiella burnetii RSA 493
cuauccacaaaggcucgaua

SEQ ID NO: 557779 - RNA, 20 nt, Coxiella burnetii RSA 493
cuagccgaauguuuaaauua

SEQ ID NO: 557780 - RNA, 19 nt, Coxiella burnetii RSA 493
cucccagacacaugggaca

SEQ ID NO: 557781 - RNA, 12 nt, Coxiella burnetii RSA 493
cuccuucgcuuu

SEQ ID NO: 557782 - RNA, 20 nt, Coxiella burnetii RSA 493
cuccuugaggaauuuuucaa

SEQ ID NO: 557783 - RNA, 19 nt, Coxiella burnetii RSA 493
cucuuuggcgccgcuggau

SEQ ID NO: 557784 - RNA, 13 nt, Coxiella burnetii RSA 493
cugaaaaauaauu

SEQ ID NO: 557785 - RNA, 20 nt, Coxiella burnetii RSA 493
cugccuuaagagauagugcu

SEQ ID NO: 557786 - RNA, 14 nt, Coxiella burnetii RSA 493
cugcauauauucca

SEQ ID NO: 557787 - RNA, 17 nt, Coxiella burnetii RSA 493
cagacggggcuacuuag

SEQ ID NO: 557788 - RNA, 21 nt, Coxiella burnetii RSA 493
cagacucuuuuuauccguuuu

SEQ ID NO: 557789 - RNA, 12 nt, Coxiella burnetii RSA 493
cacuuuuuucag

SEQ ID NO: 557790 - RNA, 16 nt, Coxiella burnetii RSA 493
cacguaucugcuaaaa

SEQ ID NO: 557791 - RNA, 19 nt, Coxiella burnetii RSA 493
cacuaauaauccgcauugc

SEQ ID NO: 557792 - RNA, 14 nt, Coxiella burnetii RSA 493
cacuaggguacuau

SEQ ID NO: 557793 - RNA, 22 nt, Coxiella burnetii RSA 493
cagcgaaauacgagguuuuuuu

SEQ ID NO: 557794 - RNA, 21 nt, Coxiella burnetii RSA 493
cagcaagaggaguucuaaaaa

SEQ ID NO: 557795 - RNA, 22 nt, Coxiella burnetii RSA 493
caggauaauguuugauaucaau

SEQ ID NO: 557796 - RNA, 13 nt, Coxiella burnetii RSA 493
cagcuccauagau

SEQ ID NO: 557797 - RNA, 14 nt, Coxiella burnetii RSA 493
cauaaucaaaauca

SEQ ID NO: 557798 - RNA, 14 nt, Coxiella burnetii RSA 493
cauaauugccgaua

SEQ ID NO: 557799 - RNA, 11 nt, Coxiella burnetii RSA 493
cauaaauaauu

SEQ ID NO: 557800 - RNA, 17 nt, Coxiella burnetii RSA 493
cauaaauaaaagcccgc

SEQ ID NO: 557801 - RNA, 20 nt, Coxiella burnetii RSA 493
cauaaaggcuaauaggaaaa

SEQ ID NO: 557802 - RNA, 17 nt, Coxiella burnetii RSA 493
caggugacuguuaauca

SEQ ID NO: 557803 - RNA, 19 nt, Coxiella burnetii RSA 493
caucaacggaaaaacaaaa

SEQ ID NO: 557804 - RNA, 17 nt, Coxiella burnetii RSA 493
ccagagauuuuuuucuu

SEQ ID NO: 557805 - RNA, 17 nt, Coxiella burnetii RSA 493
caugucuuugagauugc

SEQ ID NO: 557806 - RNA, 16 nt, Coxiella burnetii RSA 493
caugggaugucgcuuu

SEQ ID NO: 557807 - RNA, 20 nt, Coxiella burnetii RSA 493
cauuaagcaauuuuuuauca

SEQ ID NO: 557808 - RNA, 17 nt, Coxiella burnetii RSA 493
cauuaaaaaauaagaaa

SEQ ID NO: 557809 - RNA, 16 nt, Coxiella burnetii RSA 493
cauuaauuuccgauuu

SEQ ID NO: 557810 - RNA, 17 nt, Coxiella burnetii RSA 493
cauuuuuuugauucuau

SEQ ID NO: 557811 - RNA, 21 nt, Coxiella burnetii RSA 493
ccaaaauaauaacccacuaac

SEQ ID NO: 557812 - RNA, 12 nt, Coxiella burnetii RSA 493
cauuucgcuuuu

SEQ ID NO: 557813 - RNA, 16 nt, Coxiella burnetii RSA 493
cauuuuuaugcuucaa

SEQ ID NO: 557814 - RNA, 13 nt, Coxiella burnetii RSA 493
cauugagcgggau

SEQ ID NO: 557815 - RNA, 19 nt, Coxiella burnetii RSA 493
cauuucccguauuucgcuu

SEQ ID NO: 557816 - RNA, 12 nt, Coxiella burnetii RSA 493
ccaaccaauaag

SEQ ID NO: 557817 - RNA, 20 nt, Coxiella burnetii RSA 493
cccguuucgguuuucgcugc

SEQ ID NO: 557818 - RNA, 22 nt, Coxiella burnetii RSA 493
cccucgaucuuucgcccauagc

SEQ ID NO: 557819 - RNA, 12 nt, Coxiella burnetii RSA 493
cccugcaacggu

SEQ ID NO: 557820 - RNA, 11 nt, Coxiella burnetii RSA 493
cccuuuaaccg

SEQ ID NO: 557821 - RNA, 18 nt, Coxiella burnetii RSA 493
ccaugacaugcgccacua

SEQ ID NO: 557822 - RNA, 18 nt, Coxiella burnetii RSA 493
ccagucuguuauacuguu

SEQ ID NO: 557823 - RNA, 21 nt, Coxiella burnetii RSA 493
cccagcguuuccaauuguuug

SEQ ID NO: 557824 - RNA, 15 nt, Coxiella burnetii RSA 493
cccccgcuguuuaua

SEQ ID NO: 557825 - RNA, 14 nt, Coxiella burnetii RSA 493
agcguuuuccgcua

SEQ ID NO: 557826 - RNA, 17 nt, Coxiella burnetii RSA 493
agcucaaacaaaucaau

SEQ ID NO: 557827 - RNA, 14 nt, Coxiella burnetii RSA 493
agcuaagauaggga

SEQ ID NO: 557828 - RNA, 18 nt, Coxiella burnetii RSA 493
agcuagcgaaauuuguua

SEQ ID NO: 557829 - RNA, 21 nt, Coxiella burnetii RSA 493
agcgugcucuuuuucauuucu

SEQ ID NO: 557830 - RNA, 22 nt, Coxiella burnetii RSA 493
agcgguggcgguuguaauaaug

SEQ ID NO: 557831 - RNA, 17 nt, Coxiella burnetii RSA 493
agcgaaguacgggaaaa

SEQ ID NO: 557832 - RNA, 15 nt, Coxiella burnetii RSA 493
agcagguugcuuuug

SEQ ID NO: 557833 - RNA, 17 nt, Coxiella burnetii RSA 493
agccauagaauuaaugu

SEQ ID NO: 557834 - RNA, 19 nt, Coxiella burnetii RSA 493
agcaaucaaaugagccgua

SEQ ID NO: 557835 - RNA, 21 nt, Coxiella burnetii RSA 493
agauucaugaaaaucuaaagg

SEQ ID NO: 557836 - RNA, 12 nt, Coxiella burnetii RSA 493
agcagagccgca

SEQ ID NO: 557837 - RNA, 21 nt, Coxiella burnetii RSA 493
agauaucaauagcgcaauugg

SEQ ID NO: 557838 - RNA, 17 nt, Coxiella burnetii RSA 493
agagauagugcuauuuu

SEQ ID NO: 557839 - RNA, 22 nt, Coxiella burnetii RSA 493
agagaugggaucguuaugggaa

SEQ ID NO: 557840 - RNA, 11 nt, Coxiella burnetii RSA 493
agaaagacaac

SEQ ID NO: 557841 - RNA, 11 nt, Coxiella burnetii RSA 493
agaaaaugauu

SEQ ID NO: 557842 - RNA, 18 nt, Coxiella burnetii RSA 493
agaaaaugauuucauccu

SEQ ID NO: 557843 - RNA, 22 nt, Coxiella burnetii RSA 493
aggguaauaaaguaauuuuaaa

SEQ ID NO: 557844 - RNA, 14 nt, Coxiella burnetii RSA 493
aguaauuuuuaaag

SEQ ID NO: 557845 - RNA, 16 nt, Coxiella burnetii RSA 493
agguuuuauuuuuaau

SEQ ID NO: 557846 - RNA, 19 nt, Coxiella burnetii RSA 493
agguuauuuuuuccuauua

SEQ ID NO: 557847 - RNA, 20 nt, Coxiella burnetii RSA 493
aggcggggacccagcgcacu

SEQ ID NO: 557848 - RNA, 20 nt, Coxiella burnetii RSA 493
aggcgggaauccagcgcgcu

SEQ ID NO: 557849 - RNA, 14 nt, Coxiella burnetii RSA 493
agucgcaacaagca

SEQ ID NO: 557850 - RNA, 18 nt, Coxiella burnetii RSA 493
auaaaauuacuauugcgc

SEQ ID NO: 557851 - RNA, 20 nt, Coxiella burnetii RSA 493
auaaaguaguugaaaaaucu

SEQ ID NO: 557852 - RNA, 14 nt, Coxiella burnetii RSA 493
aguugucgauaaau

SEQ ID NO: 557853 - RNA, 16 nt, Coxiella burnetii RSA 493
aguuuagaaaaaugcu

SEQ ID NO: 557854 - RNA, 14 nt, Coxiella burnetii RSA 493
auaaggaggcaaua

SEQ ID NO: 557855 - RNA, 15 nt, Coxiella burnetii RSA 493
auaaauuauuuuaau

SEQ ID NO: 557856 - RNA, 15 nt, Coxiella burnetii RSA 493
auaauuacgacaguu

SEQ ID NO: 557857 - RNA, 14 nt, Coxiella burnetii RSA 493
auacagaaugauag

SEQ ID NO: 557858 - RNA, 17 nt, Coxiella burnetii RSA 493
auaaugagaugaucauc

SEQ ID NO: 557859 - RNA, 22 nt, Coxiella burnetii RSA 493
auaaugagaugaucaucaucaa

SEQ ID NO: 557860 - RNA, 18 nt, Coxiella burnetii RSA 493
auagcauuaauaagaccc

SEQ ID NO: 557861 - RNA, 16 nt, Coxiella burnetii RSA 493
aucacuugauaaucaa

SEQ ID NO: 557862 - RNA, 13 nt, Coxiella burnetii RSA 493
aucacuacaaauu

SEQ ID NO: 557863 - RNA, 19 nt, Coxiella burnetii RSA 493
aucacuagcuauucuuuug

SEQ ID NO: 557864 - RNA, 16 nt, Coxiella burnetii RSA 493
aucaaaauuaaaaucu

SEQ ID NO: 557865 - RNA, 22 nt, Coxiella burnetii RSA 493
aucaaaauucuccuuaauaaag

SEQ ID NO: 557866 - RNA, 12 nt, Coxiella burnetii RSA 493
aucaacaaaaua

SEQ ID NO: 557867 - RNA, 13 nt, Coxiella burnetii RSA 493
aucaacaaaauau

SEQ ID NO: 557868 - RNA, 17 nt, Coxiella burnetii RSA 493
aucaaguagccaaaaua

SEQ ID NO: 557869 - RNA, 19 nt, Coxiella burnetii RSA 493
aucaaguagccaaaauaau

SEQ ID NO: 557870 - RNA, 20 nt, Coxiella burnetii RSA 493
auaugauaaggaggcaauac

SEQ ID NO: 557871 - RNA, 19 nt, Coxiella burnetii RSA 493
caaacuacucucaaaauca

SEQ ID NO: 557872 - RNA, 13 nt, Coxiella burnetii RSA 493
caaagaaauaauc

SEQ ID NO: 557873 - RNA, 16 nt, Coxiella burnetii RSA 493
auuguguuuuaauucc

SEQ ID NO: 557874 - RNA, 19 nt, Coxiella burnetii RSA 493
auuguggcgaagccacaca

SEQ ID NO: 557875 - RNA, 21 nt, Coxiella burnetii RSA 493
caaaugaauaacaucaguuuu

SEQ ID NO: 557876 - RNA, 15 nt, Coxiella burnetii RSA 493
caacaaaaccgugcg

SEQ ID NO: 557877 - RNA, 12 nt, Coxiella burnetii RSA 493
caaauucaaugu

SEQ ID NO: 557878 - RNA, 22 nt, Coxiella burnetii RSA 493
caacaaguaaaguagcccguau

SEQ ID NO: 557879 - RNA, 14 nt, Coxiella burnetii RSA 493
caacaaucaguuuu

SEQ ID NO: 557880 - RNA, 18 nt, Coxiella burnetii RSA 493
caacuacuugauauuccc

SEQ ID NO: 557881 - RNA, 16 nt, Coxiella burnetii RSA 493
caacgcuguuaaaauc

SEQ ID NO: 557882 - RNA, 20 nt, Coxiella burnetii RSA 493
caagucaucgggagcgauaa

SEQ ID NO: 557883 - RNA, 20 nt, Coxiella burnetii RSA 493
caaguccuugcugaauuccc

SEQ ID NO: 557884 - RNA, 12 nt, Coxiella burnetii RSA 493
caauaagccguu

SEQ ID NO: 557885 - RNA, 12 nt, Coxiella burnetii RSA 493
caauaauaaaac

SEQ ID NO: 557886 - RNA, 20 nt, Coxiella burnetii RSA 493
caauacaucuugauccuuuu

SEQ ID NO: 557887 - RNA, 17 nt, Coxiella burnetii RSA 493
caauauuucuugaaaaa

SEQ ID NO: 557888 - RNA, 19 nt, Coxiella burnetii RSA 493
caauguaggugaaaacguc

SEQ ID NO: 557889 - RNA, 20 nt, Coxiella burnetii RSA 493
augcugagaucggcugaaac

SEQ ID NO: 557890 - RNA, 18 nt, Coxiella burnetii RSA 493
augcgguacuuaagaaag

SEQ ID NO: 557891 - RNA, 14 nt, Coxiella burnetii RSA 493
auggauauuuuaag

SEQ ID NO: 557892 - RNA, 16 nt, Coxiella burnetii RSA 493
auggaacugauauacg

SEQ ID NO: 557893 - RNA, 15 nt, Coxiella burnetii RSA 493
augcuuucuuuuaau

SEQ ID NO: 557894 - RNA, 15 nt, Coxiella burnetii RSA 493
augguagcaacgccu

SEQ ID NO: 557895 - RNA, 16 nt, Coxiella burnetii RSA 493
augggauaaaaaaccc

SEQ ID NO: 557896 - RNA, 21 nt, Coxiella burnetii RSA 493
auggggcguuagcggaauacg

SEQ ID NO: 557897 - RNA, 22 nt, Coxiella burnetii RSA 493
augucagguucggauuucacuu

SEQ ID NO: 557898 - RNA, 17 nt, Coxiella burnetii RSA 493
auucugaaucacuucuu

SEQ ID NO: 557899 - RNA, 19 nt, Coxiella burnetii RSA 493
auucucucgcucaauggcg

SEQ ID NO: 557900 - RNA, 22 nt, Coxiella burnetii RSA 493
auucguauaggaacauucuaau

SEQ ID NO: 557901 - RNA, 15 nt, Coxiella burnetii RSA 493
auucgcuuaaauuuu

SEQ ID NO: 557902 - RNA, 13 nt, Coxiella burnetii RSA 493
auucgggcauacg

SEQ ID NO: 557903 - RNA, 18 nt, Coxiella burnetii RSA 493
auucgcggguaaauuuau

SEQ ID NO: 557904 - RNA, 18 nt, Coxiella burnetii RSA 493
auucgcuccucaauuucc

SEQ ID NO: 557905 - RNA, 13 nt, Coxiella burnetii RSA 493
auucgcgcugcaa

SEQ ID NO: 557906 - RNA, 14 nt, Coxiella burnetii RSA 493
auuauuaacgccag

SEQ ID NO: 557907 - RNA, 21 nt, Coxiella burnetii RSA 493
auucaugaaaaguaaauuuau

SEQ ID NO: 557908 - RNA, 22 nt, Coxiella burnetii RSA 493
auuccggagucacuaugaucau

SEQ ID NO: 557909 - RNA, 17 nt, Coxiella burnetii RSA 493
auugcgcguaaaauucc

SEQ ID NO: 557910 - RNA, 11 nt, Coxiella burnetii RSA 493
auucuucauac

SEQ ID NO: 557911 - RNA, 23 nt, Coxiella burnetii RSA 493
auugaauggacgugcaaaugagu

SEQ ID NO: 557912 - RNA, 13 nt, Coxiella burnetii RSA 493
auugacccuuuuc

SEQ ID NO: 557913 - RNA, 17 nt, Coxiella burnetii RSA 493
auugacccuuuucaauu

SEQ ID NO: 557914 - RNA, 13 nt, Coxiella burnetii RSA 493
auugauaauaauu

SEQ ID NO: 557915 - RNA, 20 nt, Coxiella burnetii RSA 493
auugagaguccuaaaauacu

SEQ ID NO: 557916 - RNA, 23 nt, Coxiella burnetii RSA 493
auugaugucacaauuaucuuaau

SEQ ID NO: 557917 - RNA, 16 nt, Coxiella burnetii RSA 493
auugauaguucauaug

SEQ ID NO: 557918 - RNA, 18 nt, Coxiella burnetii RSA 493
auugcccucguuuuaucg

SEQ ID NO: 557919 - RNA, 17 nt, Coxiella burnetii RSA 493
auugccaaaguucauua

SEQ ID NO: 557920 - RNA, 21 nt, Coxiella burnetii RSA 493
aucuucuugugcuaaacgugc

SEQ ID NO: 557921 - RNA, 20 nt, Coxiella burnetii RSA 493
aucugugggaauguucugau

SEQ ID NO: 557922 - RNA, 15 nt, Coxiella burnetii RSA 493
aucguugggaugauc

SEQ ID NO: 557923 - RNA, 14 nt, Coxiella burnetii RSA 493
aucuaaaggaauac

SEQ ID NO: 557924 - RNA, 20 nt, Coxiella burnetii RSA 493
augcagcgaagcgaaauacg

SEQ ID NO: 557925 - RNA, 18 nt, Coxiella burnetii RSA 493
augcagcgaagcggaaua

SEQ ID NO: 557926 - RNA, 13 nt, Coxiella burnetii RSA 493
augacgcagaaua

SEQ ID NO: 557927 - RNA, 18 nt, Coxiella burnetii RSA 493
augaagcgcggcgaaaua

SEQ ID NO: 557928 - RNA, 17 nt, Coxiella burnetii RSA 493
augaaacaaacaaaaaa

SEQ ID NO: 557929 - RNA, 12 nt, Coxiella burnetii RSA 493
auccuucuuuua

SEQ ID NO: 557930 - RNA, 20 nt, Coxiella burnetii RSA 493
auccgcgucauaccggcgac

SEQ ID NO: 557931 - RNA, 15 nt, Coxiella burnetii RSA 493
auccgcgugcggaua

SEQ ID NO: 557932 - RNA, 18 nt, Coxiella burnetii RSA 493
auccgagcccaauaacaa

SEQ ID NO: 557933 - RNA, 15 nt, Coxiella burnetii RSA 493
aucgcgcgccauuga

SEQ ID NO: 557934 - RNA, 21 nt, Coxiella burnetii RSA 493
aucgcugccggcguuucgguu

SEQ ID NO: 557935 - RNA, 20 nt, Coxiella burnetii RSA 493
aucgccaugagugcauucau

SEQ ID NO: 557936 - RNA, 13 nt, Coxiella burnetii RSA 493
aucgccggauuac

SEQ ID NO: 557937 - RNA, 16 nt, Coxiella burnetii RSA 493
aucgccguuucugcuu

SEQ ID NO: 557938 - RNA, 21 nt, Coxiella burnetii RSA 493
acagcaauuaaucccuuugca

SEQ ID NO: 557939 - RNA, 23 nt, Coxiella burnetii RSA 493
aauuucugcuugcacaucuucac

SEQ ID NO: 557940 - RNA, 21 nt, Coxiella burnetii RSA 493
aauuuguuauugcuaaaaucg

SEQ ID NO: 557941 - RNA, 15 nt, Coxiella burnetii RSA 493
acaucgcaauuaaua

SEQ ID NO: 557942 - RNA, 18 nt, Coxiella burnetii RSA 493
acauccaauuacuccaau

SEQ ID NO: 557943 - RNA, 22 nt, Coxiella burnetii RSA 493
accguaugaaucagcuuaauca

SEQ ID NO: 557944 - RNA, 15 nt, Coxiella burnetii RSA 493
accgagauuuuuccg

SEQ ID NO: 557945 - RNA, 16 nt, Coxiella burnetii RSA 493
accgcacgccaaggcu

SEQ ID NO: 557946 - RNA, 13 nt, Coxiella burnetii RSA 493
accgauuaauucu

SEQ ID NO: 557947 - RNA, 23 nt, Coxiella burnetii RSA 493
acgauaauccgccuaaauuaaug

SEQ ID NO: 557948 - RNA, 14 nt, Coxiella burnetii RSA 493
acgaaaccuuguua

SEQ ID NO: 557949 - RNA, 15 nt, Coxiella burnetii RSA 493
accuuuggcaauaau

SEQ ID NO: 557950 - RNA, 21 nt, Coxiella burnetii RSA 493
acgaaccacuggaaucaaucg

SEQ ID NO: 557951 - RNA, 22 nt, Coxiella burnetii RSA 493
acgauauaaaagcaucaauaau

SEQ ID NO: 557952 - RNA, 18 nt, Coxiella burnetii RSA 493
acgccccaaaguuccgcu

SEQ ID NO: 557953 - RNA, 19 nt, Coxiella burnetii RSA 493
acgcucgguuccaaaaauu

SEQ ID NO: 557954 - RNA, 10 nt, Coxiella burnetii RSA 493
acgcuauuuu

SEQ ID NO: 557955 - RNA, 22 nt, Coxiella burnetii RSA 493
acuuguuuaucacuccaauaau

SEQ ID NO: 557956 - RNA, 20 nt, Coxiella burnetii RSA 493
acuuuccuguuuuuccucgu

SEQ ID NO: 557957 - RNA, 19 nt, Coxiella burnetii RSA 493
acuuauaaauuaaauugcu

SEQ ID NO: 557958 - RNA, 18 nt, Coxiella burnetii RSA 493
acuauugcgcaaauugca

SEQ ID NO: 557959 - RNA, 15 nt, Coxiella burnetii RSA 493
acucggcuuuauaug

SEQ ID NO: 557960 - RNA, 17 nt, Coxiella burnetii RSA 493
acuaaucgucgacaaaa

SEQ ID NO: 557961 - RNA, 20 nt, Coxiella burnetii RSA 493
acuauugaagucugguuaaa

SEQ ID NO: 557962 - RNA, 23 nt, Coxiella burnetii RSA 493
acuauugaagucugguuaaaccc

SEQ ID NO: 557963 - RNA, 15 nt, Coxiella burnetii RSA 493
acguauugccaaaau

SEQ ID NO: 557964 - RNA, 13 nt, Coxiella burnetii RSA 493
acguacuauuuca

SEQ ID NO: 557965 - RNA, 13 nt, Coxiella burnetii RSA 493
uuaaggaaaagca

SEQ ID NO: 557966 - RNA, 21 nt, Coxiella burnetii RSA 493
uuaacuucgacgggaaaaaua

SEQ ID NO: 557967 - RNA, 13 nt, Coxiella burnetii RSA 493
uuaagaucgcugu

SEQ ID NO: 557968 - RNA, 15 nt, Coxiella burnetii RSA 493
uuaagcaauuuuuua

SEQ ID NO: 557969 - RNA, 21 nt, Coxiella burnetii RSA 493
uuaauuuuggguuuuggcgua

SEQ ID NO: 557970 - RNA, 16 nt, Coxiella burnetii RSA 493
uuaaaaaagcaugauu

SEQ ID NO: 557971 - RNA, 15 nt, Coxiella burnetii RSA 493
uuaaaacgccaaaac

SEQ ID NO: 557972 - RNA, 16 nt, Coxiella burnetii RSA 493
uuaaaagauuuuaucu

SEQ ID NO: 557973 - RNA, 15 nt, Coxiella burnetii RSA 493
uguuuucagauuuuu

SEQ ID NO: 557974 - RNA, 14 nt, Coxiella burnetii RSA 493
uguuuuuucacuuc

SEQ ID NO: 557975 - RNA, 19 nt, Coxiella burnetii RSA 493
uuaaaaaaaaacuggagcc

SEQ ID NO: 557976 - RNA, 22 nt, Coxiella burnetii RSA 493
uguuugauaucaaucgaaaaaa

SEQ ID NO: 557977 - RNA, 22 nt, Coxiella burnetii RSA 493
uguuucgcaacuuuuuuccuuc

SEQ ID NO: 557978 - RNA, 12 nt, Coxiella burnetii RSA 493
uguuugaaaaaa

SEQ ID NO: 557979 - RNA, 22 nt, Coxiella burnetii RSA 493
uguuaaaagcgcccaaaugauc

SEQ ID NO: 557980 - RNA, 15 nt, Coxiella burnetii RSA 493
ugucggcgauacggu

SEQ ID NO: 557981 - RNA, 20 nt, Coxiella burnetii RSA 493
ugucgcguagcgacacaacc

SEQ ID NO: 557982 - RNA, 18 nt, Coxiella burnetii RSA 493
uguucccccacuucauac

SEQ ID NO: 557983 - RNA, 19 nt, Coxiella burnetii RSA 493
uuauucuuaauuuuuccuu

SEQ ID NO: 557984 - RNA, 18 nt, Coxiella burnetii RSA 493
uuacuugcuucaucgauu

SEQ ID NO: 557985 - RNA, 18 nt, Coxiella burnetii RSA 493
uuacuccccccaaaaaaa

SEQ ID NO: 557986 - RNA, 21 nt, Coxiella burnetii RSA 493
uucaacuccugaaaaauaauu

SEQ ID NO: 557987 - RNA, 16 nt, Coxiella burnetii RSA 493
uucaaugacuuuaacu

SEQ ID NO: 557988 - RNA, 10 nt, Coxiella burnetii RSA 493
uucaauggca

SEQ ID NO: 557989 - RNA, 15 nt, Coxiella burnetii RSA 493
uuccgugguuuaacg

SEQ ID NO: 557990 - RNA, 18 nt, Coxiella burnetii RSA 493
uucccccacuucauacgg

SEQ ID NO: 557991 - RNA, 13 nt, Coxiella burnetii RSA 493
uucgcauaauaau

SEQ ID NO: 557992 - RNA, 16 nt, Coxiella burnetii RSA 493
uucgcuggauuuuuua

SEQ ID NO: 557993 - RNA, 19 nt, Coxiella burnetii RSA 493
uucuuucuucacuuuccuu

SEQ ID NO: 557994 - RNA, 18 nt, Coxiella burnetii RSA 493
uucuuuuagaaaaucaaa

SEQ ID NO: 557995 - RNA, 23 nt, Coxiella burnetii RSA 493
uucuugaaaaacuuccgccacua

SEQ ID NO: 557996 - RNA, 20 nt, Coxiella burnetii RSA 493
uucuaucgccguuucugcuu

SEQ ID NO: 557997 - RNA, 15 nt, Coxiella burnetii RSA 493
uucucaguuaaaaua

SEQ ID NO: 557998 - RNA, 13 nt, Coxiella burnetii RSA 493
uugacaaauaaag

SEQ ID NO: 557999 - RNA, 13 nt, Coxiella burnetii RSA 493
uugaagaaauacg

SEQ ID NO: 558000 - RNA, 15 nt, Coxiella burnetii RSA 493
uugcuccaaacagac

SEQ ID NO: 558001 - RNA, 13 nt, Coxiella burnetii RSA 493
uugcggcgauaau

SEQ ID NO: 558002 - RNA, 15 nt, Coxiella burnetii RSA 493
uugcggaaauuucac

SEQ ID NO: 558003 - RNA, 23 nt, Coxiella burnetii RSA 493
uugcggaauucaggacugaaaua

SEQ ID NO: 558004 - RNA, 16 nt, Coxiella burnetii RSA 493
uugcgcguucaauaug

SEQ ID NO: 558005 - RNA, 21 nt, Coxiella burnetii RSA 493
uuggaaggcugcuugaagucg

SEQ ID NO: 558006 - RNA, 22 nt, Coxiella burnetii RSA 493
uuguagauuagaaaaagcgauu

SEQ ID NO: 558007 - RNA, 16 nt, Coxiella burnetii RSA 493
uuggcucauuguuaau

SEQ ID NO: 558008 - RNA, 22 nt, Coxiella burnetii RSA 493
uuguuucgcaacuuuuuuccuu

SEQ ID NO: 558009 - RNA, 20 nt, Coxiella burnetii RSA 493
uuuaacuuauaaauuaaauu

SEQ ID NO: 558010 - RNA, 19 nt, Coxiella burnetii RSA 493
aauccuuguugaauuccuu

SEQ ID NO: 558011 - RNA, 16 nt, Coxiella burnetii RSA 493
uuucaaagauaucguc

SEQ ID NO: 558012 - RNA, 14 nt, Coxiella burnetii RSA 493
uuucaacgccucuc

SEQ ID NO: 558013 - RNA, 19 nt, Coxiella burnetii RSA 493
uuucaaggccgugaauucg

SEQ ID NO: 558014 - RNA, 22 nt, Coxiella burnetii RSA 493
uuuaucauacuuaauuucgcuc

SEQ ID NO: 558015 - RNA, 15 nt, Coxiella burnetii RSA 493
uuuccugucguuaau

SEQ ID NO: 558016 - RNA, 19 nt, Coxiella burnetii RSA 493
uuuccugucguuaauacga

SEQ ID NO: 558017 - RNA, 20 nt, Coxiella burnetii RSA 493
uuuccuucguuucuuccauu

SEQ ID NO: 558018 - RNA, 19 nt, Coxiella burnetii RSA 493
uuucgagauuauuauacgg

SEQ ID NO: 558019 - RNA, 15 nt, Coxiella burnetii RSA 493
uuuucgcugcgguca

SEQ ID NO: 558020 - RNA, 20 nt, Coxiella burnetii RSA 493
uuucuauccagaaaccaaaa

SEQ ID NO: 558021 - RNA, 22 nt, Coxiella burnetii RSA 493
uuuuaucguucgcaauugaaaa

SEQ ID NO: 558022 - RNA, 12 nt, Coxiella burnetii RSA 493
uuuuuucuucug

SEQ ID NO: 558023 - RNA, 12 nt, Coxiella burnetii RSA 493
uuuuuugaaauu

SEQ ID NO: 558024 - RNA, 21 nt, Coxiella burnetii RSA 493
aaugcugaugaaauugcacau

SEQ ID NO: 558025 - RNA, 20 nt, Coxiella burnetii RSA 493
aauuaacguauaaauaacau

SEQ ID NO: 558026 - RNA, 15 nt, Coxiella burnetii RSA 493
aauuaaaaucuucug

SEQ ID NO: 558027 - RNA, 20 nt, Coxiella burnetii RSA 493
aauuaaugauuuaccgccgu

SEQ ID NO: 558028 - RNA, 19 nt, Coxiella burnetii RSA 493
aauucgcuaggcugagcca

SEQ ID NO: 558029 - RNA, 15 nt, Coxiella burnetii RSA 493
aauugacaaauaaag

SEQ ID NO: 558030 - RNA, 15 nt, Coxiella burnetii RSA 493
aauugcgacucguuu

SEQ ID NO: 558031 - RNA, 17 nt, Coxiella burnetii RSA 493
aauugggaagcaauuuc

SEQ ID NO: 558032 - RNA, 13 nt, Coxiella burnetii RSA 493
aauuuauucgaua

SEQ ID NO: 558033 - RNA, 22 nt, Coxiella burnetii RSA 493
ugggcaaggcaugaaauuuuug

SEQ ID NO: 558034 - RNA, 19 nt, Coxiella burnetii RSA 493
uggcucgacuuauuuguug

SEQ ID NO: 558035 - RNA, 23 nt, Coxiella burnetii RSA 493
uggcguaagcgccagagauuuuu

SEQ ID NO: 558036 - RNA, 19 nt, Coxiella burnetii RSA 493
uggguaggcugaaauaacg

SEQ ID NO: 558037 - RNA, 16 nt, Coxiella burnetii RSA 493
ugggccuacuuuauuu

SEQ ID NO: 558038 - RNA, 23 nt, Coxiella burnetii RSA 493
aaucaaaugcugcgccauuggca

SEQ ID NO: 558039 - RNA, 21 nt, Coxiella burnetii RSA 493
ugguuaugauguuuuaaaauu

SEQ ID NO: 558040 - RNA, 11 nt, Coxiella burnetii RSA 493
uggaugaucau

SEQ ID NO: 558041 - RNA, 14 nt, Coxiella burnetii RSA 493
ugcucaaaggcaua

SEQ ID NO: 558042 - RNA, 18 nt, Coxiella burnetii RSA 493
aauaguuacgagcuguuu

SEQ ID NO: 558043 - RNA, 22 nt, Coxiella burnetii RSA 493
aauagacuucgcuaaauaacau

SEQ ID NO: 558044 - RNA, 18 nt, Coxiella burnetii RSA 493
ugcgcauccgccccgaaa

SEQ ID NO: 558045 - RNA, 20 nt, Coxiella burnetii RSA 493
guggauaaaggagauccacu

SEQ ID NO: 558046 - RNA, 19 nt, Coxiella burnetii RSA 493
guuagaguuaauuucauaa

SEQ ID NO: 558047 - RNA, 17 nt, Coxiella burnetii RSA 493
guuagcggaauacggga

SEQ ID NO: 558048 - RNA, 11 nt, Coxiella burnetii RSA 493
guguuuuuacg

SEQ ID NO: 558049 - RNA, 11 nt, Coxiella burnetii RSA 493
guguuuuucaa

SEQ ID NO: 558050 - RNA, 18 nt, Coxiella burnetii RSA 493
guuccaauauuuucggau

SEQ ID NO: 558051 - RNA, 12 nt, Coxiella burnetii RSA 493
gugguuaauucu

SEQ ID NO: 558052 - RNA, 19 nt, Coxiella burnetii RSA 493
gugucuccuuuuguuaauu

SEQ ID NO: 558053 - RNA, 20 nt, Coxiella burnetii RSA 493
gugucgcuacgcgacaacua

SEQ ID NO: 558054 - RNA, 15 nt, Coxiella burnetii RSA 493
guugaucggcggaaa

SEQ ID NO: 558055 - RNA, 19 nt, Coxiella burnetii RSA 493
guugccaguguuaauggau

SEQ ID NO: 558056 - RNA, 24 nt, Coxiella burnetii RSA 493
guugccgauaaaaaggcaaauguu

SEQ ID NO: 558057 - RNA, 20 nt, Coxiella burnetii RSA 493
guuuugugcauaaauuauuu

SEQ ID NO: 558058 - RNA, 20 nt, Coxiella burnetii RSA 493
uaaaacacagcccccgaauu

SEQ ID NO: 558059 - RNA, 19 nt, Coxiella burnetii RSA 493
uaaaaccugcuauuugccc

SEQ ID NO: 558060 - RNA, 18 nt, Coxiella burnetii RSA 493
uaaaaagcuagcgaaauu

SEQ ID NO: 558061 - RNA, 22 nt, Coxiella burnetii RSA 493
guuuuaagaaaaaccaguuuuc

SEQ ID NO: 558062 - RNA, 17 nt, Coxiella burnetii RSA 493
guuuuaagcugcggaua

SEQ ID NO: 558063 - RNA, 17 nt, Coxiella burnetii RSA 493
guuuccgccucaauuuc

SEQ ID NO: 558064 - RNA, 21 nt, Coxiella burnetii RSA 493
guuucuagagcaacgauuuuc

SEQ ID NO: 558065 - RNA, 14 nt, Coxiella burnetii RSA 493
guuucgguuucguu

SEQ ID NO: 558066 - RNA, 17 nt, Coxiella burnetii RSA 493
guuucgguuuucgcugc

SEQ ID NO: 558067 - RNA, 15 nt, Coxiella burnetii RSA 493
uaacgauuucucuua

SEQ ID NO: 558068 - RNA, 16 nt, Coxiella burnetii RSA 493
uaacgucgcaaauaau

SEQ ID NO: 558069 - RNA, 14 nt, Coxiella burnetii RSA 493
uaacauuaucaugu

SEQ ID NO: 558070 - RNA, 16 nt, Coxiella burnetii RSA 493
uaacauuuggccaaac

SEQ ID NO: 558071 - RNA, 22 nt, Coxiella burnetii RSA 493
uaacaguaacucuaauuuuccu

SEQ ID NO: 558072 - RNA, 23 nt, Coxiella burnetii RSA 493
uaagugacagcucugaaagcaau

SEQ ID NO: 558073 - RNA, 20 nt, Coxiella burnetii RSA 493
uaaguagucccugacguuuu

SEQ ID NO: 558074 - RNA, 17 nt, Coxiella burnetii RSA 493
uaauagcaucaagggca

SEQ ID NO: 558075 - RNA, 21 nt, Coxiella burnetii RSA 493
uaaucaauaaaacucuugccg

SEQ ID NO: 558076 - RNA, 14 nt, Coxiella burnetii RSA 493
uaacuccuucgcuu

SEQ ID NO: 558077 - RNA, 17 nt, Coxiella burnetii RSA 493
uaauguuugauaucaau

SEQ ID NO: 558078 - RNA, 22 nt, Coxiella burnetii RSA 493
uaauugauagcgauuuccaucg

SEQ ID NO: 558079 - RNA, 23 nt, Coxiella burnetii RSA 493
uaauugaucacgcaauucgcggg

SEQ ID NO: 558080 - RNA, 15 nt, Coxiella burnetii RSA 493
uaauugcuuccaaua

SEQ ID NO: 558081 - RNA, 15 nt, Coxiella burnetii RSA 493
uacaaggccggcccu

SEQ ID NO: 558082 - RNA, 20 nt, Coxiella burnetii RSA 493
uacacauaaugaucgacaag

SEQ ID NO: 558083 - RNA, 13 nt, Coxiella burnetii RSA 493
uacaucgucggca

SEQ ID NO: 558084 - RNA, 13 nt, Coxiella burnetii RSA 493
uacauauuucuuu

SEQ ID NO: 558085 - RNA, 13 nt, Coxiella burnetii RSA 493
uacagcuccauag

SEQ ID NO: 558086 - RNA, 16 nt, Coxiella burnetii RSA 493
uagccgaauguuuaaa

SEQ ID NO: 558087 - RNA, 19 nt, Coxiella burnetii RSA 493
aaguugggguuuaauugca

SEQ ID NO: 558088 - RNA, 12 nt, Coxiella burnetii RSA 493
aauaaaauuaaa

SEQ ID NO: 558089 - RNA, 14 nt, Coxiella burnetii RSA 493
aauaaaggcgacca

SEQ ID NO: 558090 - RNA, 16 nt, Coxiella burnetii RSA 493
uaggcgaaucaucuuu

SEQ ID NO: 558091 - RNA, 14 nt, Coxiella burnetii RSA 493
uaggccgcuuuuug

SEQ ID NO: 558092 - RNA, 12 nt, Coxiella burnetii RSA 493
uagaaaaucaaa

SEQ ID NO: 558093 - RNA, 23 nt, Coxiella burnetii RSA 493
uacuggaauguccgcauagguau

SEQ ID NO: 558094 - RNA, 17 nt, Coxiella burnetii RSA 493
uacguuauaauuucuuu

SEQ ID NO: 558095 - RNA, 13 nt, Coxiella burnetii RSA 493
uacggcuuuauuu

SEQ ID NO: 558096 - RNA, 21 nt, Coxiella burnetii RSA 493
uacgcgggaaugacgauuaac

SEQ ID NO: 558097 - RNA, 13 nt, Coxiella burnetii RSA 493
uauacuuuuuuga

SEQ ID NO: 558098 - RNA, 17 nt, Coxiella burnetii RSA 493
uaucccuguuacgggau

SEQ ID NO: 558099 - RNA, 20 nt, Coxiella burnetii RSA 493
uaugaagcgcggcgaaauac

SEQ ID NO: 558100 - RNA, 19 nt, Coxiella burnetii RSA 493
uaugagcgaagcgaaauac

SEQ ID NO: 558101 - RNA, 20 nt, Coxiella burnetii RSA 493
uaugagcgaagcgaaauacg

SEQ ID NO: 558102 - RNA, 20 nt, Coxiella burnetii RSA 493
uaugagcgaagcgaaguacg

SEQ ID NO: 558103 - RNA, 18 nt, Coxiella burnetii RSA 493
uaugagcgaacgaauacg

SEQ ID NO: 558104 - RNA, 19 nt, Coxiella burnetii RSA 493
uaugagcgaacgaauacgg

SEQ ID NO: 558105 - RNA, 19 nt, Coxiella burnetii RSA 493
uaugcagcgaagcgaaaua

SEQ ID NO: 558106 - RNA, 20 nt, Coxiella burnetii RSA 493
uaugcagcgaagcgaaauac

SEQ ID NO: 558107 - RNA, 21 nt, Coxiella burnetii RSA 493
uaugcagcgaagcggaauacg

SEQ ID NO: 558108 - RNA, 17 nt, Coxiella burnetii RSA 493
uaugaucauuuucucag

SEQ ID NO: 558109 - RNA, 13 nt, Coxiella burnetii RSA 493
uauuaaucgauuu

SEQ ID NO: 558110 - RNA, 18 nt, Coxiella burnetii RSA 493
ucaaagaaacgauuaaaa

SEQ ID NO: 558111 - RNA, 15 nt, Coxiella burnetii RSA 493
ucaaacgguaaucgu

SEQ ID NO: 558112 - RNA, 17 nt, Coxiella burnetii RSA 493
ucaaaauucuccuuaau

SEQ ID NO: 558113 - RNA, 20 nt, Coxiella burnetii RSA 493
uauugcgcaaauugcaaaac

SEQ ID NO: 558114 - RNA, 23 nt, Coxiella burnetii RSA 493
uauucaacacaauaucguagccu

SEQ ID NO: 558115 - RNA, 19 nt, Coxiella burnetii RSA 493
ucaacuacuugauauuccc

SEQ ID NO: 558116 - RNA, 16 nt, Coxiella burnetii RSA 493
ucaagaacgauuuccc

SEQ ID NO: 558117 - RNA, 16 nt, Coxiella burnetii RSA 493
ucaaguguauuuucac

SEQ ID NO: 558118 - RNA, 17 nt, Coxiella burnetii RSA 493
ucaaggccaacauucuu

SEQ ID NO: 558119 - RNA, 13 nt, Coxiella burnetii RSA 493
ucaauaacccaca

SEQ ID NO: 558120 - RNA, 19 nt, Coxiella burnetii RSA 493
ucaaugagugcuuuuaacc

SEQ ID NO: 558121 - RNA, 22 nt, Coxiella burnetii RSA 493
ucaauagagcgggaauuuucga

SEQ ID NO: 558122 - RNA, 15 nt, Coxiella burnetii RSA 493
ucaauauggaacccg

SEQ ID NO: 558123 - RNA, 21 nt, Coxiella burnetii RSA 493
ucaauauuucuugaaaaacuu

SEQ ID NO: 558124 - RNA, 12 nt, Coxiella burnetii RSA 493
ucauaaauaaaa

SEQ ID NO: 558125 - RNA, 16 nt, Coxiella burnetii RSA 493
ucauacgguacaggua

SEQ ID NO: 558126 - RNA, 19 nt, Coxiella burnetii RSA 493
ucauccuccgauuuauuau

SEQ ID NO: 558127 - RNA, 16 nt, Coxiella burnetii RSA 493
ucaucauuuuccaaaa

SEQ ID NO: 558128 - RNA, 19 nt, Coxiella burnetii RSA 493
ucaucauccuuaagccguc

SEQ ID NO: 558129 - RNA, 17 nt, Coxiella burnetii RSA 493
ucauuaacgaaucgucu

SEQ ID NO: 558130 - RNA, 15 nt, Coxiella burnetii RSA 493
ucauuaucaugcauu

SEQ ID NO: 558131 - RNA, 23 nt, Coxiella burnetii RSA 493
ucauguggucucuuuuuuugcgc

SEQ ID NO: 558132 - RNA, 12 nt, Coxiella burnetii RSA 493
uccaagauuuuu

SEQ ID NO: 558133 - RNA, 20 nt, Coxiella burnetii RSA 493
uccaaaaagauaaucccaau

SEQ ID NO: 558134 - RNA, 16 nt, Coxiella burnetii RSA 493
ucauuuuccaaaaaau

SEQ ID NO: 558135 - RNA, 19 nt, Coxiella burnetii RSA 493
ucauucuuuuuucaagccc

SEQ ID NO: 558136 - RNA, 21 nt, Coxiella burnetii RSA 493
ucauucuuuuuucaagcccuu

SEQ ID NO: 558137 - RNA, 13 nt, Coxiella burnetii RSA 493
ucauuuaauuuua

SEQ ID NO: 558138 - RNA, 15 nt, Coxiella burnetii RSA 493
ucauuuaauuuuaaa

SEQ ID NO: 558139 - RNA, 17 nt, Coxiella burnetii RSA 493
ucauuuccuagauuuug

SEQ ID NO: 558140 - RNA, 15 nt, Coxiella burnetii RSA 493
uccaugauaaagcgc

SEQ ID NO: 558141 - RNA, 12 nt, Coxiella burnetii RSA 493
uccaguuuuuua

SEQ ID NO: 558142 - RNA, 18 nt, Coxiella burnetii RSA 493
uccacaaugcauuugcgc

SEQ ID NO: 558143 - RNA, 13 nt, Coxiella burnetii RSA 493
uccaauuuuuugc

SEQ ID NO: 558144 - RNA, 22 nt, Coxiella burnetii RSA 493
uccaauuguuugaaaaaauacc

SEQ ID NO: 558145 - RNA, 22 nt, Coxiella burnetii RSA 493
uccagccuuuaguuuuauuuga

SEQ ID NO: 558146 - RNA, 18 nt, Coxiella burnetii RSA 493
aauaauaguuugcaauac

SEQ ID NO: 558147 - RNA, 16 nt, Coxiella burnetii RSA 493
ucacuagcuauucuuu

SEQ ID NO: 558148 - RNA, 17 nt, Coxiella burnetii RSA 493
ucacguuaucauucuua

SEQ ID NO: 558149 - RNA, 15 nt, Coxiella burnetii RSA 493
ucagcguugauaggg

SEQ ID NO: 558150 - RNA, 17 nt, Coxiella burnetii RSA 493
ucguugccuuuuugaau

SEQ ID NO: 558151 - RNA, 16 nt, Coxiella burnetii RSA 493
ucuacaauaaacacau

SEQ ID NO: 558152 - RNA, 21 nt, Coxiella burnetii RSA 493
ucuaagucuauugaaaaaaac

SEQ ID NO: 558153 - RNA, 23 nt, Coxiella burnetii RSA 493
ucuaacguuaguuucuuuuauga

SEQ ID NO: 558154 - RNA, 13 nt, Coxiella burnetii RSA 493
ucuaaaucgguug

SEQ ID NO: 558155 - RNA, 19 nt, Coxiella burnetii RSA 493
ucuaaccuauugcggaauu

SEQ ID NO: 558156 - RNA, 13 nt, Coxiella burnetii RSA 493
ucuauaaauaaca

SEQ ID NO: 558157 - RNA, 16 nt, Coxiella burnetii RSA 493
ucuauucccccgcaac

SEQ ID NO: 558158 - RNA, 18 nt, Coxiella burnetii RSA 493
ucuauuucgagauuauua

SEQ ID NO: 558159 - RNA, 22 nt, Coxiella burnetii RSA 493
ucuccaaauugggugcauugcu

SEQ ID NO: 558160 - RNA, 20 nt, Coxiella burnetii RSA 493
ucgguuuuuuuaaaaaagaa

SEQ ID NO: 558161 - RNA, 19 nt, Coxiella burnetii RSA 493
ucguccccguauuucgcuu

SEQ ID NO: 558162 - RNA, 20 nt, Coxiella burnetii RSA 493
ucguccccguauuucgcuuc

SEQ ID NO: 558163 - RNA, 13 nt, Coxiella burnetii RSA 493
ucguccugaaaac

SEQ ID NO: 558164 - RNA, 23 nt, Coxiella burnetii RSA 493
ucugcgcuaauuaacuucgccau

SEQ ID NO: 558165 - RNA, 20 nt, Coxiella burnetii RSA 493
ucugucguuucugauuuuug

SEQ ID NO: 558166 - RNA, 23 nt, Coxiella burnetii RSA 493
ugaaacaaacaaaaaauagcgag

SEQ ID NO: 558167 - RNA, 15 nt, Coxiella burnetii RSA 493
ucuugcacauugcac

SEQ ID NO: 558168 - RNA, 20 nt, Coxiella burnetii RSA 493
ucuuccgaaacuaaaagagg

SEQ ID NO: 558169 - RNA, 11 nt, Coxiella burnetii RSA 493
ugaagcgauug

SEQ ID NO: 558170 - RNA, 20 nt, Coxiella burnetii RSA 493
ugaagcgcggcgaaauacag

SEQ ID NO: 558171 - RNA, 15 nt, Coxiella burnetii RSA 493
ugaaguccuuaucac

SEQ ID NO: 558172 - RNA, 13 nt, Coxiella burnetii RSA 493
ugaagaaauacga

SEQ ID NO: 558173 - RNA, 12 nt, Coxiella burnetii RSA 493
ugacaaauaaag

SEQ ID NO: 558174 - RNA, 19 nt, Coxiella burnetii RSA 493
ugaaugcguucuuuaaucc

SEQ ID NO: 558175 - RNA, 19 nt, Coxiella burnetii RSA 493
ugacauugguaaagccguu

SEQ ID NO: 558176 - RNA, 16 nt, Coxiella burnetii RSA 493
ugaccaaauaauugau

SEQ ID NO: 558177 - RNA, 18 nt, Coxiella burnetii RSA 493
ugagacucaguggcagcu

SEQ ID NO: 558178 - RNA, 13 nt, Coxiella burnetii RSA 493
ugagguaacuguc

SEQ ID NO: 558179 - RNA, 17 nt, Coxiella burnetii RSA 493
ugauugauuuuuuaaug

SEQ ID NO: 558180 - RNA, 15 nt, Coxiella burnetii RSA 493
ugaucauuuucucag

SEQ ID NO: 558181 - RNA, 14 nt, Coxiella burnetii RSA 493
ugcaacuuccgcua

SEQ ID NO: 558182 - RNA, 19 nt, Coxiella burnetii RSA 493
ugcaauaccauuuuuaaau

SEQ ID NO: 558183 - RNA, 17 nt, Coxiella burnetii RSA 493
ugccaauauaaauaauc

SEQ ID NO: 558184 - RNA, 20 nt, Coxiella burnetii RSA 493
ugcauucaauacagauuuua

SEQ ID NO: 558185 - RNA, 19 nt, Coxiella burnetii RSA 493
ugcaugaggagucaucgcc

SEQ ID NO: 558186 - RNA, 18 nt, Coxiella burnetii RSA 493
ucgcaauugaaaaaccau

SEQ ID NO: 558187 - RNA, 11 nt, Coxiella burnetii RSA 493
ucgauuucuuu

SEQ ID NO: 558188 - RNA, 17 nt, Coxiella burnetii RSA 493
ucgauauguuucaauaa

SEQ ID NO: 558189 - RNA, 19 nt, Coxiella burnetii RSA 493
ucgaagugugauucauuau

SEQ ID NO: 558190 - RNA, 17 nt, Coxiella burnetii RSA 493
ucgaagcauuuuuuugu

SEQ ID NO: 558191 - RNA, 13 nt, Coxiella burnetii RSA 493
ucccaauuucuuu

SEQ ID NO: 558192 - RNA, 20 nt, Coxiella burnetii RSA 493
uccgcuuugcuccauacggg

SEQ ID NO: 558193 - RNA, 19 nt, Coxiella burnetii RSA 493
uccguuuugaaaaauaaaa

SEQ ID NO: 558194 - RNA, 17 nt, Coxiella burnetii RSA 493
uccgugcagaaacaaua

SEQ ID NO: 558195 - RNA, 14 nt, Coxiella burnetii RSA 493
uccguucauucggg

SEQ ID NO: 558196 - RNA, 15 nt, Coxiella burnetii RSA 493
ucgcgcguuuuuuua

SEQ ID NO: 558197 - RNA, 21 nt, Coxiella burnetii RSA 493
ucgccaucgcuuucggcgcca

SEQ ID NO: 558198 - RNA, 16 nt, Coxiella burnetii RSA 493
aggaaggacaaaaaua

SEQ ID NO: 558199 - RNA, 15 nt, Coxiella burnetii RSA 493
agcuuguuuuuggca

SEQ ID NO: 558200 - RNA, 23 nt, Coxiella burnetii RSA 493
aggauaauguuugauaucaaucg

SEQ ID NO: 558201 - RNA, 15 nt, Coxiella burnetii RSA 493
aaacuaagcauuaaa

SEQ ID NO: 558202 - RNA, 17 nt, Coxiella burnetii RSA 493
aaacgugccgccgaaau

SEQ ID NO: 558203 - RNA, 13 nt, Coxiella burnetii RSA 493
aaacgugcuuaau

SEQ ID NO: 558204 - RNA, 22 nt, Coxiella burnetii RSA 493
aggauuuuacgucuaaaacaac

SEQ ID NO: 558205 - RNA, 15 nt, Coxiella burnetii RSA 493
aggcacgaugcacag

SEQ ID NO: 558206 - RNA, 13 nt, Coxiella burnetii RSA 493
agcguaaucauca

SEQ ID NO: 558207 - RNA, 15 nt, Coxiella burnetii RSA 493
agcuaaaaaagaaau

SEQ ID NO: 558208 - RNA, 16 nt, Coxiella burnetii RSA 493
agcuaagaucaagaaa

SEQ ID NO: 558209 - RNA, 22 nt, Coxiella burnetii RSA 493
agcuccaaacgguccgccuaaa

SEQ ID NO: 558210 - RNA, 14 nt, Coxiella burnetii RSA 493
agcggaauacggga

SEQ ID NO: 558211 - RNA, 13 nt, Coxiella burnetii RSA 493
agcgcuuuuggcu

SEQ ID NO: 558212 - RNA, 18 nt, Coxiella burnetii RSA 493
agcgaacgaauacgggga

SEQ ID NO: 558213 - RNA, 20 nt, Coxiella burnetii RSA 493
agcgaagcgaaauacgggaa

SEQ ID NO: 558214 - RNA, 19 nt, Coxiella burnetii RSA 493
agcgaagcgaaauacgggg

SEQ ID NO: 558215 - RNA, 20 nt, Coxiella burnetii RSA 493
agcgaagcgaaauacgggga

SEQ ID NO: 558216 - RNA, 20 nt, Coxiella burnetii RSA 493
agcgaagcggaauacggaga

SEQ ID NO: 558217 - RNA, 14 nt, Coxiella burnetii RSA 493
agcgaaguacggga

SEQ ID NO: 558218 - RNA, 20 nt, Coxiella burnetii RSA 493
agcgaaguacgggaaaacaa

SEQ ID NO: 558219 - RNA, 21 nt, Coxiella burnetii RSA 493
agcgaaauacgggaaaacaau

SEQ ID NO: 558220 - RNA, 14 nt, Coxiella burnetii RSA 493
agcgaaauacgggg

SEQ ID NO: 558221 - RNA, 13 nt, Coxiella burnetii RSA 493
agccgcuuuuuau

SEQ ID NO: 558222 - RNA, 15 nt, Coxiella burnetii RSA 493
agccauuaauaaagu

SEQ ID NO: 558223 - RNA, 17 nt, Coxiella burnetii RSA 493
aggguagauaacgcaau

SEQ ID NO: 558224 - RNA, 17 nt, Coxiella burnetii RSA 493
aguaaugguuuugauca

SEQ ID NO: 558225 - RNA, 17 nt, Coxiella burnetii RSA 493
aguagcucuuaaaagac

SEQ ID NO: 558226 - RNA, 18 nt, Coxiella burnetii RSA 493
auaaugagaucaaagcgc

SEQ ID NO: 558227 - RNA, 20 nt, Coxiella burnetii RSA 493
auacacccauacaaggccgg

SEQ ID NO: 558228 - RNA, 13 nt, Coxiella burnetii RSA 493
auaauugagcauc

SEQ ID NO: 558229 - RNA, 15 nt, Coxiella burnetii RSA 493
auaauguuugauauc

SEQ ID NO: 558230 - RNA, 22 nt, Coxiella burnetii RSA 493
auaaucgguccggccggcgauu

SEQ ID NO: 558231 - RNA, 22 nt, Coxiella burnetii RSA 493
auaaggaaauugauguguuuuc

SEQ ID NO: 558232 - RNA, 17 nt, Coxiella burnetii RSA 493
auaaaaggagaaauuga

SEQ ID NO: 558233 - RNA, 16 nt, Coxiella burnetii RSA 493
aguuacguaauuauua

SEQ ID NO: 558234 - RNA, 12 nt, Coxiella burnetii RSA 493
auaaaauaacag

SEQ ID NO: 558235 - RNA, 18 nt, Coxiella burnetii RSA 493
auaaagugccgcgaauac

SEQ ID NO: 558236 - RNA, 19 nt, Coxiella burnetii RSA 493
auaaaggcgaccaaaaauc

SEQ ID NO: 558237 - RNA, 16 nt, Coxiella burnetii RSA 493
auaucaauagcgcaau

SEQ ID NO: 558238 - RNA, 19 nt, Coxiella burnetii RSA 493
auauaggcgaaucaucuuu

SEQ ID NO: 558239 - RNA, 22 nt, Coxiella burnetii RSA 493
auaggucauuuuuuauaaaauu

SEQ ID NO: 558240 - RNA, 18 nt, Coxiella burnetii RSA 493
aucaaccccagccgccac

SEQ ID NO: 558241 - RNA, 13 nt, Coxiella burnetii RSA 493
auaugacgaauac

SEQ ID NO: 558242 - RNA, 14 nt, Coxiella burnetii RSA 493
aucagaaaccguuu

SEQ ID NO: 558243 - RNA, 14 nt, Coxiella burnetii RSA 493
aucacgcuuuuuuu

SEQ ID NO: 558244 - RNA, 20 nt, Coxiella burnetii RSA 493
aucaaguuuauaagauucuu

SEQ ID NO: 558245 - RNA, 19 nt, Coxiella burnetii RSA 493
aucauacuuaauuucgcuc

SEQ ID NO: 558246 - RNA, 22 nt, Coxiella burnetii RSA 493
aucccgccagcgaugaaaaagu

SEQ ID NO: 558247 - RNA, 19 nt, Coxiella burnetii RSA 493
auccccgaaggcgccuaau

SEQ ID NO: 558248 - RNA, 15 nt, Coxiella burnetii RSA 493
auccaucccaauucu

SEQ ID NO: 558249 - RNA, 22 nt, Coxiella burnetii RSA 493
auccaagggaucauaaucgguu

SEQ ID NO: 558250 - RNA, 16 nt, Coxiella burnetii RSA 493
auccacaaaggcucga

SEQ ID NO: 558251 - RNA, 14 nt, Coxiella burnetii RSA 493
auccuccauuacau

SEQ ID NO: 558252 - RNA, 17 nt, Coxiella burnetii RSA 493
auccuuacaaaaauacu

SEQ ID NO: 558253 - RNA, 13 nt, Coxiella burnetii RSA 493
auccuuuaauucg

SEQ ID NO: 558254 - RNA, 12 nt, Coxiella burnetii RSA 493
auccuucuuuug

SEQ ID NO: 558255 - RNA, 22 nt, Coxiella burnetii RSA 493
auccgucgucguugacaaaccg

SEQ ID NO: 558256 - RNA, 12 nt, Coxiella burnetii RSA 493
auccgcaauaug

SEQ ID NO: 558257 - RNA, 14 nt, Coxiella burnetii RSA 493
aucucuuaaaauuc

SEQ ID NO: 558258 - RNA, 21 nt, Coxiella burnetii RSA 493
aucucacuuggauuuuauuug

SEQ ID NO: 558259 - RNA, 16 nt, Coxiella burnetii RSA 493
aucguaaagaucauca

SEQ ID NO: 558260 - RNA, 18 nt, Coxiella burnetii RSA 493
aucgguugaagaaauacg

SEQ ID NO: 558261 - RNA, 16 nt, Coxiella burnetii RSA 493
augauuauagaauggg

SEQ ID NO: 558262 - RNA, 18 nt, Coxiella burnetii RSA 493
augcaaaaaccgacgcca

SEQ ID NO: 558263 - RNA, 19 nt, Coxiella burnetii RSA 493
augauugggcucaaaaaga

SEQ ID NO: 558264 - RNA, 18 nt, Coxiella burnetii RSA 493
augagcgaacgaauacgg

SEQ ID NO: 558265 - RNA, 20 nt, Coxiella burnetii RSA 493
augagcgaagcgaaauacgg

SEQ ID NO: 558266 - RNA, 18 nt, Coxiella burnetii RSA 493
augcagcgaagcgaaaua

SEQ ID NO: 558267 - RNA, 21 nt, Coxiella burnetii RSA 493
augcagcgaagcgaaauacgg

SEQ ID NO: 558268 - RNA, 22 nt, Coxiella burnetii RSA 493
augcagcgaagcgaaauacggg

SEQ ID NO: 558269 - RNA, 20 nt, Coxiella burnetii RSA 493
augcagcgaagcggaauacg

SEQ ID NO: 558270 - RNA, 21 nt, Coxiella burnetii RSA 493
augcagcgaagcggaauacgg

SEQ ID NO: 558271 - RNA, 19 nt, Coxiella burnetii RSA 493
augacagaaaaagcggaua

SEQ ID NO: 558272 - RNA, 22 nt, Coxiella burnetii RSA 493
augaccuuaaucgugaaauacc

SEQ ID NO: 558273 - RNA, 19 nt, Coxiella burnetii RSA 493
augaacaacacgaucaaca

SEQ ID NO: 558274 - RNA, 23 nt, Coxiella burnetii RSA 493
augaaacuaagcauuaaaaaaua

SEQ ID NO: 558275 - RNA, 20 nt, Coxiella burnetii RSA 493
auggauucccauaaccguuu

SEQ ID NO: 558276 - RNA, 18 nt, Coxiella burnetii RSA 493
auggccggcagcguaaua

SEQ ID NO: 558277 - RNA, 20 nt, Coxiella burnetii RSA 493
auggcgccugacaaagcggc

SEQ ID NO: 558278 - RNA, 17 nt, Coxiella burnetii RSA 493
augucagcuuccgacaa

SEQ ID NO: 558279 - RNA, 21 nt, Coxiella burnetii RSA 493
auguaaaaaccgagcuucaug

SEQ ID NO: 558280 - RNA, 21 nt, Coxiella burnetii RSA 493
auguauccuaauaaaaauauu

SEQ ID NO: 558281 - RNA, 23 nt, Coxiella burnetii RSA 493
augcccauucuuucauuaauucc

SEQ ID NO: 558282 - RNA, 23 nt, Coxiella burnetii RSA 493
auuccaaauaaucguaucgauuu

SEQ ID NO: 558283 - RNA, 18 nt, Coxiella burnetii RSA 493
auuccccguauuucgcuu

SEQ ID NO: 558284 - RNA, 19 nt, Coxiella burnetii RSA 493
auucccguauuucgcuucg

SEQ ID NO: 558285 - RNA, 16 nt, Coxiella burnetii RSA 493
auuccgguuucaaaug

SEQ ID NO: 558286 - RNA, 15 nt, Coxiella burnetii RSA 493
augucgcuuuauuca

SEQ ID NO: 558287 - RNA, 16 nt, Coxiella burnetii RSA 493
auuaauggacauucuc

SEQ ID NO: 558288 - RNA, 14 nt, Coxiella burnetii RSA 493
auuucauccaaaau

SEQ ID NO: 558289 - RNA, 23 nt, Coxiella burnetii RSA 493
auuuccaacgcuuguuuuauacc

SEQ ID NO: 558290 - RNA, 18 nt, Coxiella burnetii RSA 493
auuucccguauuucgcuu

SEQ ID NO: 558291 - RNA, 20 nt, Coxiella burnetii RSA 493
auuucccguauuucgcuucg

SEQ ID NO: 558292 - RNA, 19 nt, Coxiella burnetii RSA 493
auuucguugauuaauaaug

SEQ ID NO: 558293 - RNA, 22 nt, Coxiella burnetii RSA 493
auuucggauguuuuuucacuuc

SEQ ID NO: 558294 - RNA, 20 nt, Coxiella burnetii RSA 493
auuucgcuucgcucauacgg

SEQ ID NO: 558295 - RNA, 20 nt, Coxiella burnetii RSA 493
auuucgcuucgcucauacgu

SEQ ID NO: 558296 - RNA, 23 nt, Coxiella burnetii RSA 493
auuucgcuucgcuccauacgggc

SEQ ID NO: 558297 - RNA, 23 nt, Coxiella burnetii RSA 493
auuucgcuucgcugcauacggac

SEQ ID NO: 558298 - RNA, 19 nt, Coxiella burnetii RSA 493
auuucgagauuauuauacg

SEQ ID NO: 558299 - RNA, 13 nt, Coxiella burnetii RSA 493
auuucaauuagaa

SEQ ID NO: 558300 - RNA, 13 nt, Coxiella burnetii RSA 493
auuuaauuuuaaa

SEQ ID NO: 558301 - RNA, 14 nt, Coxiella burnetii RSA 493
auuuacaauacggu

SEQ ID NO: 558302 - RNA, 22 nt, Coxiella burnetii RSA 493
auuuauaacaaaccaucgccac

SEQ ID NO: 558303 - RNA, 21 nt, Coxiella burnetii RSA 493
auuuaauaaaucaauuaaauu

SEQ ID NO: 558304 - RNA, 20 nt, Coxiella burnetii RSA 493
auuuaaggguacaaaccacc

SEQ ID NO: 558305 - RNA, 16 nt, Coxiella burnetii RSA 493
auugcgcguaaaauuc

SEQ ID NO: 558306 - RNA, 19 nt, Coxiella burnetii RSA 493
auugcgcguaaauuucguu

SEQ ID NO: 558307 - RNA, 15 nt, Coxiella burnetii RSA 493
auugcggaaauuuca

SEQ ID NO: 558308 - RNA, 16 nt, Coxiella burnetii RSA 493
auugcggaaauuucac

SEQ ID NO: 558309 - RNA, 16 nt, Coxiella burnetii RSA 493
auugucaaaauuagaa

SEQ ID NO: 558310 - RNA, 14 nt, Coxiella burnetii RSA 493
caaagcaaaaauac

SEQ ID NO: 558311 - RNA, 15 nt, Coxiella burnetii RSA 493
caaagcaaaaauaca

SEQ ID NO: 558312 - RNA, 23 nt, Coxiella burnetii RSA 493
caaaguccuguuccgcagccuaa

SEQ ID NO: 558313 - RNA, 19 nt, Coxiella burnetii RSA 493
caaaauacaguaaauaauc

SEQ ID NO: 558314 - RNA, 15 nt, Coxiella burnetii RSA 493
caaaauaauaaccca

SEQ ID NO: 558315 - RNA, 18 nt, Coxiella burnetii RSA 493
auuuuuccgauuuugaau

SEQ ID NO: 558316 - RNA, 17 nt, Coxiella burnetii RSA 493
auuuuucgcucaauugu

SEQ ID NO: 558317 - RNA, 15 nt, Coxiella burnetii RSA 493
auuuuucucaucauu

SEQ ID NO: 558318 - RNA, 13 nt, Coxiella burnetii RSA 493
auuuuuucaaauu

SEQ ID NO: 558319 - RNA, 15 nt, Coxiella burnetii RSA 493
caaaaauuucauuua

SEQ ID NO: 558320 - RNA, 14 nt, Coxiella burnetii RSA 493
auuucugguugaau

SEQ ID NO: 558321 - RNA, 23 nt, Coxiella burnetii RSA 493
auuugucuuuucgcauaauaauc

SEQ ID NO: 558322 - RNA, 17 nt, Coxiella burnetii RSA 493
caauaaaagcgccugcc

SEQ ID NO: 558323 - RNA, 14 nt, Coxiella burnetii RSA 493
caauaaauaaauca

SEQ ID NO: 558324 - RNA, 16 nt, Coxiella burnetii RSA 493
caauaaggcauuugca

SEQ ID NO: 558325 - RNA, 13 nt, Coxiella burnetii RSA 493
caagugugggaaa

SEQ ID NO: 558326 - RNA, 12 nt, Coxiella burnetii RSA 493
caacuuccgcua

SEQ ID NO: 558327 - RNA, 18 nt, Coxiella burnetii RSA 493
caacuuccgcuacguuuu

SEQ ID NO: 558328 - RNA, 13 nt, Coxiella burnetii RSA 493
caauguuaaaaca

SEQ ID NO: 558329 - RNA, 22 nt, Coxiella burnetii RSA 493
caauugcuuucccuuuuugauu

SEQ ID NO: 558330 - RNA, 19 nt, Coxiella burnetii RSA 493
caauuucauucauucgcuu

SEQ ID NO: 558331 - RNA, 19 nt, Coxiella burnetii RSA 493
caaugagugcuuuuaacca

SEQ ID NO: 558332 - RNA, 22 nt, Coxiella burnetii RSA 493
caaucaucauccuuaagccguc

SEQ ID NO: 558333 - RNA, 16 nt, Coxiella burnetii RSA 493
cacagagccaccguau

SEQ ID NO: 558334 - RNA, 15 nt, Coxiella burnetii RSA 493
cacgaucaacaaaau

SEQ ID NO: 558335 - RNA, 14 nt, Coxiella burnetii RSA 493
cacgaugauuaaau

SEQ ID NO: 558336 - RNA, 16 nt, Coxiella burnetii RSA 493
aaagacuuugcuguuc

SEQ ID NO: 558337 - RNA, 20 nt, Coxiella burnetii RSA 493
cagcaagaggaguucuaaaa

SEQ ID NO: 558338 - RNA, 18 nt, Coxiella burnetii RSA 493
cagcagaaaagaugguug

SEQ ID NO: 558339 - RNA, 19 nt, Coxiella burnetii RSA 493
cagccgaugacaaauaaac

SEQ ID NO: 558340 - RNA, 14 nt, Coxiella burnetii RSA 493
cagccgcuuuuuau

SEQ ID NO: 558341 - RNA, 16 nt, Coxiella burnetii RSA 493
caggauuuucauuaau

SEQ ID NO: 558342 - RNA, 16 nt, Coxiella burnetii RSA 493
cagguucggauuucac

SEQ ID NO: 558343 - RNA, 13 nt, Coxiella burnetii RSA 493
caguaguuuauca

SEQ ID NO: 558344 - RNA, 20 nt, Coxiella burnetii RSA 493
cagugaaaacccgagcggau

SEQ ID NO: 558345 - RNA, 21 nt, Coxiella burnetii RSA 493
cauccgguuucgguuucguuc

SEQ ID NO: 558346 - RNA, 16 nt, Coxiella burnetii RSA 493
caucgcgcguuuuuuu

SEQ ID NO: 558347 - RNA, 20 nt, Coxiella burnetii RSA 493
cauccuccauuacauaauuu

SEQ ID NO: 558348 - RNA, 14 nt, Coxiella burnetii RSA 493
caguuaaaauaaug

SEQ ID NO: 558349 - RNA, 13 nt, Coxiella burnetii RSA 493
cauagaauuaaug

SEQ ID NO: 558350 - RNA, 14 nt, Coxiella burnetii RSA 493
cauauucgcuccau

SEQ ID NO: 558351 - RNA, 13 nt, Coxiella burnetii RSA 493
cauauuucuuuuc

SEQ ID NO: 558352 - RNA, 18 nt, Coxiella burnetii RSA 493
cauauuaauauuaaaaca

SEQ ID NO: 558353 - RNA, 16 nt, Coxiella burnetii RSA 493
caucucucguucuuuu

SEQ ID NO: 558354 - RNA, 18 nt, Coxiella burnetii RSA 493
caucuaucguccccguau

SEQ ID NO: 558355 - RNA, 14 nt, Coxiella burnetii RSA 493
caucugucaucauc

SEQ ID NO: 558356 - RNA, 14 nt, Coxiella burnetii RSA 493
caucuugcugcaua

SEQ ID NO: 558357 - RNA, 12 nt, Coxiella burnetii RSA 493
caugaaaagcag

SEQ ID NO: 558358 - RNA, 19 nt, Coxiella burnetii RSA 493
ccagaaauucauuuuucag

SEQ ID NO: 558359 - RNA, 19 nt, Coxiella burnetii RSA 493
aaaguuauuucuuuugauu

SEQ ID NO: 558360 - RNA, 22 nt, Coxiella burnetii RSA 493
aaaguugaugaucuaacguuuu

SEQ ID NO: 558361 - RNA, 21 nt, Coxiella burnetii RSA 493
aaaguaauuuuaaaaaaaaua

SEQ ID NO: 558362 - RNA, 15 nt, Coxiella burnetii RSA 493
aaaguagaaugaauu

SEQ ID NO: 558363 - RNA, 14 nt, Coxiella burnetii RSA 493
aaagguaaaaaacu

SEQ ID NO: 558364 - RNA, 20 nt, Coxiella burnetii RSA 493
aaaucauccaccacuuccau

SEQ ID NO: 558365 - RNA, 21 nt, Coxiella burnetii RSA 493
aaauccagggagucgccguuu

SEQ ID NO: 558366 - RNA, 22 nt, Coxiella burnetii RSA 493
aaaucacuacgaauagccaaug

SEQ ID NO: 558367 - RNA, 14 nt, Coxiella burnetii RSA 493
ccaggcugcuagaa

SEQ ID NO: 558368 - RNA, 23 nt, Coxiella burnetii RSA 493
ccauugucucguuagaaaagcgc

SEQ ID NO: 558369 - RNA, 21 nt, Coxiella burnetii RSA 493
ccauuacauaauuuaaacuca

SEQ ID NO: 558370 - RNA, 13 nt, Coxiella burnetii RSA 493
cccaacaauaaaa

SEQ ID NO: 558371 - RNA, 17 nt, Coxiella burnetii RSA 493
aaaucuucugaucgaua

SEQ ID NO: 558372 - RNA, 19 nt, Coxiella burnetii RSA 493
cccguauuucgcuucgcua

SEQ ID NO: 558373 - RNA, 20 nt, Coxiella burnetii RSA 493
cccguauuucgcuucgcuca

SEQ ID NO: 558374 - RNA, 21 nt, Coxiella burnetii RSA 493
cccguauuucgcuucgcucag

SEQ ID NO: 558375 - RNA, 22 nt, Coxiella burnetii RSA 493
cccguauuucgcuucgcucaga

SEQ ID NO: 558376 - RNA, 22 nt, Coxiella burnetii RSA 493
cccguauuucgcuucgcucaua

SEQ ID NO: 558377 - RNA, 20 nt, Coxiella burnetii RSA 493
cccguauuucgcuucgcucc

SEQ ID NO: 558378 - RNA, 23 nt, Coxiella burnetii RSA 493
cccguauuucgcuucgcuccaua

SEQ ID NO: 558379 - RNA, 21 nt, Coxiella burnetii RSA 493
cccguauuucgcuucgcugca

SEQ ID NO: 558380 - RNA, 22 nt, Coxiella burnetii RSA 493
cccguauuucgcuucgcugcau

SEQ ID NO: 558381 - RNA, 23 nt, Coxiella burnetii RSA 493
cccguauuucgcuucgcugcaua

SEQ ID NO: 558382 - RNA, 13 nt, Coxiella burnetii RSA 493
aaaugaauaagca

SEQ ID NO: 558383 - RNA, 20 nt, Coxiella burnetii RSA 493
cgaagcggaauacggagaaa

SEQ ID NO: 558384 - RNA, 22 nt, Coxiella burnetii RSA 493
aacaacggcaucaacggaaaaa

SEQ ID NO: 558385 - RNA, 20 nt, Coxiella burnetii RSA 493
cgauaaaaacaaagugaaau

SEQ ID NO: 558386 - RNA, 21 nt, Coxiella burnetii RSA 493
cgauaaaaacaaagugaaaua

SEQ ID NO: 558387 - RNA, 14 nt, Coxiella burnetii RSA 493
cgauaaaaauaaug

SEQ ID NO: 558388 - RNA, 17 nt, Coxiella burnetii RSA 493
cgacgcucgguuccaaa

SEQ ID NO: 558389 - RNA, 15 nt, Coxiella burnetii RSA 493
cgauuaacaacgaaa

SEQ ID NO: 558390 - RNA, 16 nt, Coxiella burnetii RSA 493
cgaucuuucgcccaua

SEQ ID NO: 558391 - RNA, 19 nt, Coxiella burnetii RSA 493
cgaugauucccaccaaaau

SEQ ID NO: 558392 - RNA, 14 nt, Coxiella burnetii RSA 493
cgcaggcggggacc

SEQ ID NO: 558393 - RNA, 20 nt, Coxiella burnetii RSA 493
cgcaggcgggaauccagcgc

SEQ ID NO: 558394 - RNA, 14 nt, Coxiella burnetii RSA 493
ccugcgcgggaaug

SEQ ID NO: 558395 - RNA, 15 nt, Coxiella burnetii RSA 493
ccggcuaauaauccg

SEQ ID NO: 558396 - RNA, 22 nt, Coxiella burnetii RSA 493
ccguauuucgcuucgcuacaua

SEQ ID NO: 558397 - RNA, 19 nt, Coxiella burnetii RSA 493
ccguauuucgcuucgcuca

SEQ ID NO: 558398 - RNA, 20 nt, Coxiella burnetii RSA 493
ccguauuucgcuucgcucag

SEQ ID NO: 558399 - RNA, 20 nt, Coxiella burnetii RSA 493
ccguauuucgcuucgcucau

SEQ ID NO: 558400 - RNA, 20 nt, Coxiella burnetii RSA 493
ccguauuucgcuucgcucca

SEQ ID NO: 558401 - RNA, 18 nt, Coxiella burnetii RSA 493
ccguaugagcgaagcgaa

SEQ ID NO: 558402 - RNA, 21 nt, Coxiella burnetii RSA 493
ccguauggggcguuagcggaa

SEQ ID NO: 558403 - RNA, 14 nt, Coxiella burnetii RSA 493
ccgcugauauuccc

SEQ ID NO: 558404 - RNA, 21 nt, Coxiella burnetii RSA 493
ccgcagccgaagugcuaaaaa

SEQ ID NO: 558405 - RNA, 13 nt, Coxiella burnetii RSA 493
aaaugcgccauug

SEQ ID NO: 558406 - RNA, 19 nt, Coxiella burnetii RSA 493
cggaacaccauucgcuaau

SEQ ID NO: 558407 - RNA, 20 nt, Coxiella burnetii RSA 493
cgcuuuuuugcuucuuccaa

SEQ ID NO: 558408 - RNA, 15 nt, Coxiella burnetii RSA 493
cgcuuuuuccaccaa

SEQ ID NO: 558409 - RNA, 12 nt, Coxiella burnetii RSA 493
cgcuuguuuaua

SEQ ID NO: 558410 - RNA, 13 nt, Coxiella burnetii RSA 493
cggaauugggaua

SEQ ID NO: 558411 - RNA, 17 nt, Coxiella burnetii RSA 493
cggaauuugaaauaaac

SEQ ID NO: 558412 - RNA, 19 nt, Coxiella burnetii RSA 493
cgcuucgcugcauacggac

SEQ ID NO: 558413 - RNA, 15 nt, Coxiella burnetii RSA 493
cgcuucaauucuuuu

SEQ ID NO: 558414 - RNA, 21 nt, Coxiella burnetii RSA 493
cgcuguuuucagauuuuuuau

SEQ ID NO: 558415 - RNA, 17 nt, Coxiella burnetii RSA 493
cgcugauacuucuucau

SEQ ID NO: 558416 - RNA, 22 nt, Coxiella burnetii RSA 493
cgcugauacuucuucauuaaau

SEQ ID NO: 558417 - RNA, 22 nt, Coxiella burnetii RSA 493
cgcucccuuaaguugacgccua

SEQ ID NO: 558418 - RNA, 23 nt, Coxiella burnetii RSA 493
cgcggugguaaacaacgcacgaa

SEQ ID NO: 558419 - RNA, 21 nt, Coxiella burnetii RSA 493
cgccuuuuuuaaauuucucau

SEQ ID NO: 558420 - RNA, 18 nt, Coxiella burnetii RSA 493
cgcgaaauuuaauaaaau

SEQ ID NO: 558421 - RNA, 21 nt, Coxiella burnetii RSA 493
cgcgaccccguuaucccgcuu

SEQ ID NO: 558422 - RNA, 17 nt, Coxiella burnetii RSA 493
aacaccguuggaaaagg

SEQ ID NO: 558423 - RNA, 14 nt, Coxiella burnetii RSA 493
cgccggguuuuuug

SEQ ID NO: 558424 - RNA, 19 nt, Coxiella burnetii RSA 493
cgguaauaauauaauugag

SEQ ID NO: 558425 - RNA, 14 nt, Coxiella burnetii RSA 493
cgguacuuaagaaa

SEQ ID NO: 558426 - RNA, 22 nt, Coxiella burnetii RSA 493
aaccacagacucuuuuuauccg

SEQ ID NO: 558427 - RNA, 20 nt, Coxiella burnetii RSA 493
cgggguuaaggaaaagcacg

SEQ ID NO: 558428 - RNA, 14 nt, Coxiella burnetii RSA 493
cggcuucuaaguaa

SEQ ID NO: 558429 - RNA, 22 nt, Coxiella burnetii RSA 493
cgggcgggaugaccuccaacga

SEQ ID NO: 558430 - RNA, 15 nt, Coxiella burnetii RSA 493
cggcgaaauacagga

SEQ ID NO: 558431 - RNA, 17 nt, Coxiella burnetii RSA 493
ggauuuccuuuucauuu

SEQ ID NO: 558432 - RNA, 20 nt, Coxiella burnetii RSA 493
ggaugaguauucaucaauau

SEQ ID NO: 558433 - RNA, 22 nt, Coxiella burnetii RSA 493
ggccggauuuuuucuucugaau

SEQ ID NO: 558434 - RNA, 12 nt, Coxiella burnetii RSA 493
ggcuuuuucaag

SEQ ID NO: 558435 - RNA, 12 nt, Coxiella burnetii RSA 493
ggcuuuuucaau

SEQ ID NO: 558436 - RNA, 18 nt, Coxiella burnetii RSA 493
ggcuucgagaggaauguu

SEQ ID NO: 558437 - RNA, 18 nt, Coxiella burnetii RSA 493
ggcuguacauuuuucaag

SEQ ID NO: 558438 - RNA, 14 nt, Coxiella burnetii RSA 493
ggcucagugauuaa

SEQ ID NO: 558439 - RNA, 20 nt, Coxiella burnetii RSA 493
ggcuacuuguugaaaaccua

SEQ ID NO: 558440 - RNA, 20 nt, Coxiella burnetii RSA 493
guacuauuuccaacccagcu

SEQ ID NO: 558441 - RNA, 19 nt, Coxiella burnetii RSA 493
guaauugcuugggaacaac

SEQ ID NO: 558442 - RNA, 16 nt, Coxiella burnetii RSA 493
guaauucacgauuuuc

SEQ ID NO: 558443 - RNA, 14 nt, Coxiella burnetii RSA 493
guaauugcaacaau

SEQ ID NO: 558444 - RNA, 21 nt, Coxiella burnetii RSA 493
guaaugacagaaaaagcggau

SEQ ID NO: 558445 - RNA, 16 nt, Coxiella burnetii RSA 493
guaaugagcaucuuuu

SEQ ID NO: 558446 - RNA, 15 nt, Coxiella burnetii RSA 493
guaaugguuuugauc

SEQ ID NO: 558447 - RNA, 18 nt, Coxiella burnetii RSA 493
guaguuugguggaugauc

SEQ ID NO: 558448 - RNA, 16 nt, Coxiella burnetii RSA 493
guagcuaaaaaauuca

SEQ ID NO: 558449 - RNA, 14 nt, Coxiella burnetii RSA 493
gguuaauaaaaagg

SEQ ID NO: 558450 - RNA, 20 nt, Coxiella burnetii RSA 493
gguugugucgcuacgcgaca

SEQ ID NO: 558451 - RNA, 20 nt, Coxiella burnetii RSA 493
gguuguguggcuucgccaca

SEQ ID NO: 558452 - RNA, 12 nt, Coxiella burnetii RSA 493
ggugucauaacc

SEQ ID NO: 558453 - RNA, 14 nt, Coxiella burnetii RSA 493
gguggguaaugaua

SEQ ID NO: 558454 - RNA, 22 nt, Coxiella burnetii RSA 493
ggugauaauugauaguucauau

SEQ ID NO: 558455 - RNA, 19 nt, Coxiella burnetii RSA 493
gguacugaagaguaaaaaa

SEQ ID NO: 558456 - RNA, 13 nt, Coxiella burnetii RSA 493
gugaaaagccaaa

SEQ ID NO: 558457 - RNA, 14 nt, Coxiella burnetii RSA 493
gucguuaauacgau

SEQ ID NO: 558458 - RNA, 14 nt, Coxiella burnetii RSA 493
gucguaauugcuug

SEQ ID NO: 558459 - RNA, 21 nt, Coxiella burnetii RSA 493
gucggucaauuucaaugacuu

SEQ ID NO: 558460 - RNA, 14 nt, Coxiella burnetii RSA 493
gucaggcaauuuug

SEQ ID NO: 558461 - RNA, 21 nt, Coxiella burnetii RSA 493
gucccaaaaaacuuagccaau

SEQ ID NO: 558462 - RNA, 15 nt, Coxiella burnetii RSA 493
gcugaaguccuuguu

SEQ ID NO: 558463 - RNA, 13 nt, Coxiella burnetii RSA 493
gcugauaauugaa

SEQ ID NO: 558464 - RNA, 11 nt, Coxiella burnetii RSA 493
gcugacaccua

SEQ ID NO: 558465 - RNA, 18 nt, Coxiella burnetii RSA 493
gcugacaccuagccaaau

SEQ ID NO: 558466 - RNA, 13 nt, Coxiella burnetii RSA 493
gcuccauacgggc

SEQ ID NO: 558467 - RNA, 16 nt, Coxiella burnetii RSA 493
gcucauugaaaucaau

SEQ ID NO: 558468 - RNA, 12 nt, Coxiella burnetii RSA 493
gcucauacgggc

SEQ ID NO: 558469 - RNA, 22 nt, Coxiella burnetii RSA 493
gcucagcccaaccuacgggcua

SEQ ID NO: 558470 - RNA, 21 nt, Coxiella burnetii RSA 493
gcuuugggugggugagaagaa

SEQ ID NO: 558471 - RNA, 13 nt, Coxiella burnetii RSA 493
gcuuuuuucgcuu

SEQ ID NO: 558472 - RNA, 17 nt, Coxiella burnetii RSA 493
gcuuuaauacaguuuau

SEQ ID NO: 558473 - RNA, 22 nt, Coxiella burnetii RSA 493
gcuuuauuauuuuuuucuauua

SEQ ID NO: 558474 - RNA, 16 nt, Coxiella burnetii RSA 493
gcuugcucuucuucau

SEQ ID NO: 558475 - RNA, 19 nt, Coxiella burnetii RSA 493
gcuucaggugacggauuaa

SEQ ID NO: 558476 - RNA, 18 nt, Coxiella burnetii RSA 493
gcuuccagaaauucauuu

SEQ ID NO: 558477 - RNA, 18 nt, Coxiella burnetii RSA 493
gcuucgcucauacgggcu

SEQ ID NO: 558478 - RNA, 13 nt, Coxiella burnetii RSA 493
gcuucgcugcaua

SEQ ID NO: 558479 - RNA, 21 nt, Coxiella burnetii RSA 493
gcuugaaaaauugaaagaauu

SEQ ID NO: 558480 - RNA, 23 nt, Coxiella burnetii RSA 493
gcuucuaaguaaacagcauuagc

SEQ ID NO: 558481 - RNA, 14 nt, Coxiella burnetii RSA 493
gcuucaauucuuuu

SEQ ID NO: 558482 - RNA, 14 nt, Coxiella burnetii RSA 493
gcguaaagauaaaa

SEQ ID NO: 558483 - RNA, 19 nt, Coxiella burnetii RSA 493
gcguaaagauaaaaugacc

SEQ ID NO: 558484 - RNA, 23 nt, Coxiella burnetii RSA 493
aagcgucugcgacgacgcuuugg

SEQ ID NO: 558485 - RNA, 20 nt, Coxiella burnetii RSA 493
aagcgaaguacgggaaaaca

SEQ ID NO: 558486 - RNA, 19 nt, Coxiella burnetii RSA 493
aagcgagcaaucaaaacag

SEQ ID NO: 558487 - RNA, 23 nt, Coxiella burnetii RSA 493
aagcgaggaccguuaugaaaaca

SEQ ID NO: 558488 - RNA, 21 nt, Coxiella burnetii RSA 493
aagcgaaauacgggaaaacaa

SEQ ID NO: 558489 - RNA, 20 nt, Coxiella burnetii RSA 493
aagcgaaauacggggacaau

SEQ ID NO: 558490 - RNA, 18 nt, Coxiella burnetii RSA 493
aagcggaauaagaaaucu

SEQ ID NO: 558491 - RNA, 21 nt, Coxiella burnetii RSA 493
aagcgggguuaaggaaaagca

SEQ ID NO: 558492 - RNA, 14 nt, Coxiella burnetii RSA 493
gccuucuuuuucaa

SEQ ID NO: 558493 - RNA, 20 nt, Coxiella burnetii RSA 493
gcgaaauacgggaaaacaau

SEQ ID NO: 558494 - RNA, 21 nt, Coxiella burnetii RSA 493
gcgaaauacgggaaaacaaug

SEQ ID NO: 558495 - RNA, 21 nt, Coxiella burnetii RSA 493
gcgaaauacggggaaauaaug

SEQ ID NO: 558496 - RNA, 16 nt, Coxiella burnetii RSA 493
gcgaagcggaauacgg

SEQ ID NO: 558497 - RNA, 19 nt, Coxiella burnetii RSA 493
gcgaagcggaauacggaga

SEQ ID NO: 558498 - RNA, 16 nt, Coxiella burnetii RSA 493
gcgaagcgaaauacgg

SEQ ID NO: 558499 - RNA, 19 nt, Coxiella burnetii RSA 493
gcgaagcgaaauacgggaa

SEQ ID NO: 558500 - RNA, 20 nt, Coxiella burnetii RSA 493
gcgaagcgaaauacgggaaa

SEQ ID NO: 558501 - RNA, 20 nt, Coxiella burnetii RSA 493
gcgaagcgaaauacggggaa

SEQ ID NO: 558502 - RNA, 19 nt, Coxiella burnetii RSA 493
gcgaagcgaaguacgggaa

SEQ ID NO: 558503 - RNA, 20 nt, Coxiella burnetii RSA 493
gcgaagcgaaguacgggaaa

SEQ ID NO: 558504 - RNA, 14 nt, Coxiella burnetii RSA 493
gcgaacucagccca

SEQ ID NO: 558505 - RNA, 20 nt, Coxiella burnetii RSA 493
gcgaaguacgggaaaacaau

SEQ ID NO: 558506 - RNA, 21 nt, Coxiella burnetii RSA 493
gcgaaugguugaaagaaaaaa

SEQ ID NO: 558507 - RNA, 14 nt, Coxiella burnetii RSA 493
gccuaucuuuuuca

SEQ ID NO: 558508 - RNA, 13 nt, Coxiella burnetii RSA 493
gccgguucuuuuc

SEQ ID NO: 558509 - RNA, 14 nt, Coxiella burnetii RSA 493
gcgccaucaaccaa

SEQ ID NO: 558510 - RNA, 17 nt, Coxiella burnetii RSA 493
gcgcguaaaauuccacc

SEQ ID NO: 558511 - RNA, 21 nt, Coxiella burnetii RSA 493
gcgcuaaugagaaacgugaga

SEQ ID NO: 558512 - RNA, 19 nt, Coxiella burnetii RSA 493
gaugaauaacaaugccaac

SEQ ID NO: 558513 - RNA, 22 nt, Coxiella burnetii RSA 493
gauucaggaaacguuucuguaa

SEQ ID NO: 558514 - RNA, 18 nt, Coxiella burnetii RSA 493
gauucgcuugacgggcau

SEQ ID NO: 558515 - RNA, 21 nt, Coxiella burnetii RSA 493
gauuuuuaagggcucgcuaau

SEQ ID NO: 558516 - RNA, 21 nt, Coxiella burnetii RSA 493
gauuucaggcgccugcaaaau

SEQ ID NO: 558517 - RNA, 18 nt, Coxiella burnetii RSA 493
gauuucaucuugcugcau

SEQ ID NO: 558518 - RNA, 19 nt, Coxiella burnetii RSA 493
gauuucaucuugcugcaua

SEQ ID NO: 558519 - RNA, 16 nt, Coxiella burnetii RSA 493
gauuuauugcuuaucg

SEQ ID NO: 558520 - RNA, 17 nt, Coxiella burnetii RSA 493
gauuuuaagaaucgucg

SEQ ID NO: 558521 - RNA, 14 nt, Coxiella burnetii RSA 493
gauuuuaauugaau

SEQ ID NO: 558522 - RNA, 15 nt, Coxiella burnetii RSA 493
gauuuuacgucuaaa

SEQ ID NO: 558523 - RNA, 13 nt, Coxiella burnetii RSA 493
gcaaaugaauaac

SEQ ID NO: 558524 - RNA, 15 nt, Coxiella burnetii RSA 493
gaugucacaauuauc

SEQ ID NO: 558525 - RNA, 21 nt, Coxiella burnetii RSA 493
gauauucccucuuuaccuccu

SEQ ID NO: 558526 - RNA, 17 nt, Coxiella burnetii RSA 493
gauauauuaagccgaug

SEQ ID NO: 558527 - RNA, 21 nt, Coxiella burnetii RSA 493
gauagcgacaauuucgcuaug

SEQ ID NO: 558528 - RNA, 16 nt, Coxiella burnetii RSA 493
gauaacgcuucuuuua

SEQ ID NO: 558529 - RNA, 19 nt, Coxiella burnetii RSA 493
gauaacggggucgcggaaa

SEQ ID NO: 558530 - RNA, 18 nt, Coxiella burnetii RSA 493
gauaagcuguuucuuuua

SEQ ID NO: 558531 - RNA, 15 nt, Coxiella burnetii RSA 493
gagcguaaaacacgg

SEQ ID NO: 558532 - RNA, 14 nt, Coxiella burnetii RSA 493
gagcgaaagccaag

SEQ ID NO: 558533 - RNA, 17 nt, Coxiella burnetii RSA 493
gagcgaacgaauacggg

SEQ ID NO: 558534 - RNA, 18 nt, Coxiella burnetii RSA 493
gagcgaacgaauacgggg

SEQ ID NO: 558535 - RNA, 13 nt, Coxiella burnetii RSA 493
aagaaggcgauca

SEQ ID NO: 558536 - RNA, 12 nt, Coxiella burnetii RSA 493
gcaggaucuugu

SEQ ID NO: 558537 - RNA, 23 nt, Coxiella burnetii RSA 493
gcagacccauuuuuuugauucua

SEQ ID NO: 558538 - RNA, 12 nt, Coxiella burnetii RSA 493
gcacuucuuuua

SEQ ID NO: 558539 - RNA, 23 nt, Coxiella burnetii RSA 493
gcccauauucaacacaauaucgu

SEQ ID NO: 558540 - RNA, 21 nt, Coxiella burnetii RSA 493
gccauuuguauggcgccugac

SEQ ID NO: 558541 - RNA, 16 nt, Coxiella burnetii RSA 493
gccgaugacaaauaaa

SEQ ID NO: 558542 - RNA, 21 nt, Coxiella burnetii RSA 493
gccgcuauuucuagcguugaa

SEQ ID NO: 558543 - RNA, 15 nt, Coxiella burnetii RSA 493
aaccggcccguugca

SEQ ID NO: 558544 - RNA, 15 nt, Coxiella burnetii RSA 493
cuucaauaaaaaagc

SEQ ID NO: 558545 - RNA, 21 nt, Coxiella burnetii RSA 493
cuuccuucuugucauucccuu

SEQ ID NO: 558546 - RNA, 18 nt, Coxiella burnetii RSA 493
cuugucacaaguguggau

SEQ ID NO: 558547 - RNA, 15 nt, Coxiella burnetii RSA 493
cuuucaauaaauaaa

SEQ ID NO: 558548 - RNA, 12 nt, Coxiella burnetii RSA 493
cuuuauuacccu

SEQ ID NO: 558549 - RNA, 20 nt, Coxiella burnetii RSA 493
cuuuauucccgauggggaua

SEQ ID NO: 558550 - RNA, 17 nt, Coxiella burnetii RSA 493
gaaaaaaugauuuuauc

SEQ ID NO: 558551 - RNA, 20 nt, Coxiella burnetii RSA 493
cuuucuuuuaauucauaaau

SEQ ID NO: 558552 - RNA, 20 nt, Coxiella burnetii RSA 493
cuuugcuccauacgggcuac

SEQ ID NO: 558553 - RNA, 14 nt, Coxiella burnetii RSA 493
cuuucucgcuuaau

SEQ ID NO: 558554 - RNA, 20 nt, Coxiella burnetii RSA 493
gaacaccuaaaucaauuuuc

SEQ ID NO: 558555 - RNA, 16 nt, Coxiella burnetii RSA 493
gaaauuauuugauuuu

SEQ ID NO: 558556 - RNA, 14 nt, Coxiella burnetii RSA 493
gaaauuuuuugcug

SEQ ID NO: 558557 - RNA, 18 nt, Coxiella burnetii RSA 493
gaaauacggggacgauug

SEQ ID NO: 558558 - RNA, 15 nt, Coxiella burnetii RSA 493
gaaacggcuuguuua

SEQ ID NO: 558559 - RNA, 12 nt, Coxiella burnetii RSA 493
gaauauuuucgg

SEQ ID NO: 558560 - RNA, 22 nt, Coxiella burnetii RSA 493
gaauaaccggcuucuaaguaaa

SEQ ID NO: 558561 - RNA, 22 nt, Coxiella burnetii RSA 493
gacccucuuuuuaaaaaauucc

SEQ ID NO: 558562 - RNA, 13 nt, Coxiella burnetii RSA 493
aacgcgggacgac

SEQ ID NO: 558563 - RNA, 12 nt, Coxiella burnetii RSA 493
aacggagaaaau

SEQ ID NO: 558564 - RNA, 19 nt, Coxiella burnetii RSA 493
aacgauagaccaucguuuu

SEQ ID NO: 558565 - RNA, 14 nt, Coxiella burnetii RSA 493
aacguagaaguuua

SEQ ID NO: 558566 - RNA, 15 nt, Coxiella burnetii RSA 493
gacgcguaaaauagc

SEQ ID NO: 558567 - RNA, 18 nt, Coxiella burnetii RSA 493
cguaugagcgaacgaaua

SEQ ID NO: 558568 - RNA, 19 nt, Coxiella burnetii RSA 493
cguaugagcgaagcgaaau

SEQ ID NO: 558569 - RNA, 20 nt, Coxiella burnetii RSA 493
cguaugagcgaagcgaaaua

SEQ ID NO: 558570 - RNA, 20 nt, Coxiella burnetii RSA 493
cguaugagcgaagcgaagua

SEQ ID NO: 558571 - RNA, 20 nt, Coxiella burnetii RSA 493
cguaugcagcgaagcgaaau

SEQ ID NO: 558572 - RNA, 21 nt, Coxiella burnetii RSA 493
cguaugcagcgaagcgaaaua

SEQ ID NO: 558573 - RNA, 20 nt, Coxiella burnetii RSA 493
cguaugcagcgaagcggaau

SEQ ID NO: 558574 - RNA, 21 nt, Coxiella burnetii RSA 493
cguauuucgcuucgcuacaua

SEQ ID NO: 558575 - RNA, 20 nt, Coxiella burnetii RSA 493
cguauuucgcuucgcucaga

SEQ ID NO: 558576 - RNA, 19 nt, Coxiella burnetii RSA 493
cguauuucgcuucgcucau

SEQ ID NO: 558577 - RNA, 20 nt, Coxiella burnetii RSA 493
cguauuucgcuucgcucaua

SEQ ID NO: 558578 - RNA, 21 nt, Coxiella burnetii RSA 493
cguauuucgcuucgcuccaua

SEQ ID NO: 558579 - RNA, 20 nt, Coxiella burnetii RSA 493
cguauuucgcuucgcugcau

SEQ ID NO: 558580 - RNA, 21 nt, Coxiella burnetii RSA 493
cguauuucgcuucgcugcaua

SEQ ID NO: 558581 - RNA, 22 nt, Coxiella burnetii RSA 493
cguaagcacaaaaguggggaua

SEQ ID NO: 558582 - RNA, 20 nt, Coxiella burnetii RSA 493
cguaauucuugcagugaaau

SEQ ID NO: 558583 - RNA, 17 nt, Coxiella burnetii RSA 493
cgucaugaaaagcggag

SEQ ID NO: 558584 - RNA, 14 nt, Coxiella burnetii RSA 493
cgucgcaaauaaua

SEQ ID NO: 558585 - RNA, 21 nt, Coxiella burnetii RSA 493
aaccgccggccauaucgccau

SEQ ID NO: 558586 - RNA, 18 nt, Coxiella burnetii RSA 493
cguucuugggcaauuugu

SEQ ID NO: 558587 - RNA, 21 nt, Coxiella burnetii RSA 493
cgucuuccacggaguuuucau

SEQ ID NO: 558588 - RNA, 15 nt, Coxiella burnetii RSA 493
aaccgacgaauaacg

SEQ ID NO: 558589 - RNA, 19 nt, Coxiella burnetii RSA 493
cucuacaaaauagguggau

SEQ ID NO: 558590 - RNA, 22 nt, Coxiella burnetii RSA 493
cuauaaauaacagcgaacaucc

SEQ ID NO: 558591 - RNA, 20 nt, Coxiella burnetii RSA 493
cucagcccaaccuacgggcu

SEQ ID NO: 558592 - RNA, 14 nt, Coxiella burnetii RSA 493
cuccaauaauaaaa

SEQ ID NO: 558593 - RNA, 14 nt, Coxiella burnetii RSA 493
cucggauagcgaca

SEQ ID NO: 558594 - RNA, 19 nt, Coxiella burnetii RSA 493
cucgaaugcagcucuuuca

SEQ ID NO: 558595 - RNA, 15 nt, Coxiella burnetii RSA 493
acgauauaaaagcau

SEQ ID NO: 558596 - RNA, 15 nt, Coxiella burnetii RSA 493
acgauaaaauuacua

SEQ ID NO: 558597 - RNA, 19 nt, Coxiella burnetii RSA 493
acgauggucaaaccaauca

SEQ ID NO: 558598 - RNA, 17 nt, Coxiella burnetii RSA 493
acgauugcuaaaccacg

SEQ ID NO: 558599 - RNA, 13 nt, Coxiella burnetii RSA 493
aaaauuugauuaa

SEQ ID NO: 558600 - RNA, 14 nt, Coxiella burnetii RSA 493
aaacaaagugaaau

SEQ ID NO: 558601 - RNA, 19 nt, Coxiella burnetii RSA 493
aaacaacuaccugauaaaa

SEQ ID NO: 558602 - RNA, 15 nt, Coxiella burnetii RSA 493
aaaauuucauuuaau

SEQ ID NO: 558603 - RNA, 21 nt, Coxiella burnetii RSA 493
acgacgaucacccacguugca

SEQ ID NO: 558604 - RNA, 16 nt, Coxiella burnetii RSA 493
acgacggguuuuaagu

SEQ ID NO: 558605 - RNA, 20 nt, Coxiella burnetii RSA 493
acgaaccgccggguuuuuug

SEQ ID NO: 558606 - RNA, 18 nt, Coxiella burnetii RSA 493
acgaauggcccaauaaag

SEQ ID NO: 558607 - RNA, 20 nt, Coxiella burnetii RSA 493
acgaauuaaaaaauucaaua

SEQ ID NO: 558608 - RNA, 19 nt, Coxiella burnetii RSA 493
acgaccucgcgggaggacg

SEQ ID NO: 558609 - RNA, 15 nt, Coxiella burnetii RSA 493
accguucagccgauu

SEQ ID NO: 558610 - RNA, 20 nt, Coxiella burnetii RSA 493
accuaauuugauuuuuuuug

SEQ ID NO: 558611 - RNA, 23 nt, Coxiella burnetii RSA 493
accgauacuuuguuuuuuuucag

SEQ ID NO: 558612 - RNA, 19 nt, Coxiella burnetii RSA 493
accgaggucuuuuauuuca

SEQ ID NO: 558613 - RNA, 15 nt, Coxiella burnetii RSA 493
accauugggauucga

SEQ ID NO: 558614 - RNA, 20 nt, Coxiella burnetii RSA 493
acuaaaccaacgaacgccaa

SEQ ID NO: 558615 - RNA, 12 nt, Coxiella burnetii RSA 493
acuaaauuucca

SEQ ID NO: 558616 - RNA, 15 nt, Coxiella burnetii RSA 493
acuaaacaaaauaau

SEQ ID NO: 558617 - RNA, 16 nt, Coxiella burnetii RSA 493
acuaaacaaaauaaua

SEQ ID NO: 558618 - RNA, 20 nt, Coxiella burnetii RSA 493
acguuaucacuugauaauca

SEQ ID NO: 558619 - RNA, 20 nt, Coxiella burnetii RSA 493
acgugcuuugggauaauuca

SEQ ID NO: 558620 - RNA, 13 nt, Coxiella burnetii RSA 493
acgggaaugacga

SEQ ID NO: 558621 - RNA, 12 nt, Coxiella burnetii RSA 493
acgguaauaaua

SEQ ID NO: 558622 - RNA, 21 nt, Coxiella burnetii RSA 493
acgcgaaaagauuccaauauu

SEQ ID NO: 558623 - RNA, 15 nt, Coxiella burnetii RSA 493
acgcgcucaaugaau

SEQ ID NO: 558624 - RNA, 17 nt, Coxiella burnetii RSA 493
acgcuggaaaaauaaau

SEQ ID NO: 558625 - RNA, 18 nt, Coxiella burnetii RSA 493
acuaguuauuuuuaaaag

SEQ ID NO: 558626 - RNA, 22 nt, Coxiella burnetii RSA 493
acuucccauucaaggaauuauu

SEQ ID NO: 558627 - RNA, 22 nt, Coxiella burnetii RSA 493
acuuccuucuugucauucccuu

SEQ ID NO: 558628 - RNA, 23 nt, Coxiella burnetii RSA 493
agaaaacguuucaucaaaauucu

SEQ ID NO: 558629 - RNA, 18 nt, Coxiella burnetii RSA 493
agaaaaguaaaaaauaau

SEQ ID NO: 558630 - RNA, 19 nt, Coxiella burnetii RSA 493
agaauuuguacaaaagcgc

SEQ ID NO: 558631 - RNA, 20 nt, Coxiella burnetii RSA 493
agaguccuaaaauacuuaaa

SEQ ID NO: 558632 - RNA, 19 nt, Coxiella burnetii RSA 493
agaugacaucauuguuuuc

SEQ ID NO: 558633 - RNA, 20 nt, Coxiella burnetii RSA 493
agacaagcgagggcuauauu

SEQ ID NO: 558634 - RNA, 19 nt, Coxiella burnetii RSA 493
agaccaaauccgcauaaaa

SEQ ID NO: 558635 - RNA, 17 nt, Coxiella burnetii RSA 493
agaccuguuaaaaacgc

SEQ ID NO: 558636 - RNA, 13 nt, Coxiella burnetii RSA 493
aagaaauugaucu

SEQ ID NO: 558637 - RNA, 13 nt, Coxiella burnetii RSA 493
aagacaauguuaa

SEQ ID NO: 558638 - RNA, 13 nt, Coxiella burnetii RSA 493
aacuggaaaaagg

SEQ ID NO: 558639 - RNA, 20 nt, Coxiella burnetii RSA 493
aacgccucuugcaacguuug

SEQ ID NO: 558640 - RNA, 15 nt, Coxiella burnetii RSA 493
aaccgugcggggacg

SEQ ID NO: 558641 - RNA, 15 nt, Coxiella burnetii RSA 493
aagacugauaacuau

SEQ ID NO: 558642 - RNA, 15 nt, Coxiella burnetii RSA 493
aaggagcggcugaau

SEQ ID NO: 558643 - RNA, 14 nt, Coxiella burnetii RSA 493
aauauuuuuauucu

SEQ ID NO: 558644 - RNA, 15 nt, Coxiella burnetii RSA 493
aauaucaaaaaacca

SEQ ID NO: 558645 - RNA, 23 nt, Coxiella burnetii RSA 493
aauaaaggcgaccaaaaaucgcc

SEQ ID NO: 558646 - RNA, 12 nt, Coxiella burnetii RSA 493
aauaaauuaauu

SEQ ID NO: 558647 - RNA, 22 nt, Coxiella burnetii RSA 493
aauaauccaagggaucauaauc

SEQ ID NO: 558648 - RNA, 21 nt, Coxiella burnetii RSA 493
aauaaugaucccgaaacggau

SEQ ID NO: 558649 - RNA, 13 nt, Coxiella burnetii RSA 493
aauaauucgguuu

SEQ ID NO: 558650 - RNA, 19 nt, Coxiella burnetii RSA 493
aagguggcgcuuuaauuua

SEQ ID NO: 558651 - RNA, 16 nt, Coxiella burnetii RSA 493
aagugugggaaaaaua

SEQ ID NO: 558652 - RNA, 15 nt, Coxiella burnetii RSA 493
aaguuauuucuuuug

SEQ ID NO: 558653 - RNA, 18 nt, Coxiella burnetii RSA 493
aaugcugaugaaauugca

SEQ ID NO: 558654 - RNA, 14 nt, Coxiella burnetii RSA 493
aaugcuuuucucaa

SEQ ID NO: 558655 - RNA, 13 nt, Coxiella burnetii RSA 493
aaugaaaaauagg

SEQ ID NO: 558656 - RNA, 15 nt, Coxiella burnetii RSA 493
aaucacaaaagguaa

SEQ ID NO: 558657 - RNA, 17 nt, Coxiella burnetii RSA 493
aauuggucaggaacaac

SEQ ID NO: 558658 - RNA, 14 nt, Coxiella burnetii RSA 493
aauuucauaaauca

SEQ ID NO: 558659 - RNA, 15 nt, Coxiella burnetii RSA 493
aauuucauuaucgca

SEQ ID NO: 558660 - RNA, 21 nt, Coxiella burnetii RSA 493
aauuuccaaacgccaucgauu

SEQ ID NO: 558661 - RNA, 17 nt, Coxiella burnetii RSA 493
aauugcuugggaacaac

SEQ ID NO: 558662 - RNA, 15 nt, Coxiella burnetii RSA 493
aauucauaaauaauu

SEQ ID NO: 558663 - RNA, 19 nt, Coxiella burnetii RSA 493
aauuccccguauuucgcuu

SEQ ID NO: 558664 - RNA, 20 nt, Coxiella burnetii RSA 493
aauuccaaaaacauugguau

SEQ ID NO: 558665 - RNA, 21 nt, Coxiella burnetii RSA 493
aauucaggggcaaucaaucgc

SEQ ID NO: 558666 - RNA, 16 nt, Coxiella burnetii RSA 493
aauguugauaauaaau

SEQ ID NO: 558667 - RNA, 20 nt, Coxiella burnetii RSA 493
aauguuugauaucaaucgaa

SEQ ID NO: 558668 - RNA, 17 nt, Coxiella burnetii RSA 493
aauguuuuuuaauaaau

SEQ ID NO: 558669 - RNA, 17 nt, Coxiella burnetii RSA 493
acaaugcguuuuaaaug

SEQ ID NO: 558670 - RNA, 18 nt, Coxiella burnetii RSA 493
acaauguuaaaacacaua

SEQ ID NO: 558671 - RNA, 14 nt, Coxiella burnetii RSA 493
acaauuugaugauc

SEQ ID NO: 558672 - RNA, 13 nt, Coxiella burnetii RSA 493
acaauaaaagcgc

SEQ ID NO: 558673 - RNA, 17 nt, Coxiella burnetii RSA 493
acaaaagguaaaaaacu

SEQ ID NO: 558674 - RNA, 16 nt, Coxiella burnetii RSA 493
acaaaugcgccauugc

SEQ ID NO: 558675 - RNA, 18 nt, Coxiella burnetii RSA 493
aauuucucgauaaaaaca

SEQ ID NO: 558676 - RNA, 13 nt, Coxiella burnetii RSA 493
aaaauaaugagau

SEQ ID NO: 558677 - RNA, 20 nt, Coxiella burnetii RSA 493
acacauuuuuucaaauugcu

SEQ ID NO: 558678 - RNA, 14 nt, Coxiella burnetii RSA 493
acagaaaaagcgga

SEQ ID NO: 558679 - RNA, 18 nt, Coxiella burnetii RSA 493
acagacccccauuuuuua

SEQ ID NO: 558680 - RNA, 15 nt, Coxiella burnetii RSA 493
acagcgaaauacgag

SEQ ID NO: 558681 - RNA, 16 nt, Coxiella burnetii RSA 493
aaaacuuccgccacua

SEQ ID NO: 558682 - RNA, 24 nt, Coxiella burnetii RSA 493
aaaaauggguuuugucaaugggca

SEQ ID NO: 558683 - RNA, 13 nt, Coxiella burnetii RSA 493
aaaagauuuuauc

SEQ ID NO: 558684 - RNA, 24 nt, Coxiella burnetii RSA 493
aaaauagcguguaauugaugccga

SEQ ID NO: 558685 - RNA, 18 nt, Coxiella burnetii RSA 493
aaaauggaaacgacgauc

SEQ ID NO: 558686 - RNA, 9 nt, Coxiella burnetii RSA 493
aaaaaacug

SEQ ID NO: 558687 - RNA, 18 nt, Coxiella burnetii RSA 493
aaaauuccuucuccuuuu

SEQ ID NO: 558688 - RNA, 15 nt, Coxiella burnetii RSA 493
aaaccuucaaaaaua

SEQ ID NO: 558689 - RNA, 15 nt, Coxiella burnetii RSA 493
aaaccgcgcugaagu

SEQ ID NO: 558690 - RNA, 20 nt, Coxiella burnetii RSA 493
aaacagcauuagcuucguuu

SEQ ID NO: 558691 - RNA, 22 nt, Coxiella burnetii RSA 493
aaagaggccacaaaugcucuuu

SEQ ID NO: 558692 - RNA, 17 nt, Coxiella burnetii RSA 493
aaacgaaaagcugaaau

SEQ ID NO: 558693 - RNA, 15 nt, Coxiella burnetii RSA 493
aaaagaaccgaacaa

SEQ ID NO: 558694 - RNA, 23 nt, Coxiella burnetii RSA 493
aaauuucucucucauaaucgaua

SEQ ID NO: 558695 - RNA, 13 nt, Coxiella burnetii RSA 493
aaauuuuuaaaug

SEQ ID NO: 558696 - RNA, 15 nt, Coxiella burnetii RSA 493
aaauuaauauaauca

SEQ ID NO: 558697 - RNA, 22 nt, Coxiella burnetii RSA 493
aacaauuaacuuugcaaagcgc

SEQ ID NO: 558698 - RNA, 17 nt, Coxiella burnetii RSA 493
aacaaagucucgauccu

SEQ ID NO: 558699 - RNA, 23 nt, Coxiella burnetii RSA 493
aaaguuuaucccuguuacgggau

SEQ ID NO: 558700 - RNA, 21 nt, Coxiella burnetii RSA 493
aaauaauuauagaaugggaag

SEQ ID NO: 558701 - RNA, 17 nt, Coxiella burnetii RSA 493
uuuuuuggaaugagcau

SEQ ID NO: 558702 - RNA, 12 nt, Coxiella burnetii RSA 493
uuuuuucuucug

SEQ ID NO: 558703 - RNA, 14 nt, Coxiella burnetii RSA 493
uuuuucauccagug

SEQ ID NO: 558704 - RNA, 21 nt, Coxiella burnetii RSA 493
uuuugaauuuuuugaaaaacu

SEQ ID NO: 558705 - RNA, 19 nt, Coxiella burnetii RSA 493
uuuugcaaugccagugcau

SEQ ID NO: 558706 - RNA, 12 nt, Coxiella burnetii RSA 493
uuuugcauuuuu

SEQ ID NO: 558707 - RNA, 21 nt, Coxiella burnetii RSA 493
uuuucugggagauuuauuccu

SEQ ID NO: 558708 - RNA, 23 nt, Coxiella burnetii RSA 493
uuuucugaaacaucaauaccgau

SEQ ID NO: 558709 - RNA, 21 nt, Coxiella burnetii RSA 493
uuuucuucuugcaucugacau

SEQ ID NO: 558710 - RNA, 14 nt, Coxiella burnetii RSA 493
uuuucuucuuuucu

SEQ ID NO: 558711 - RNA, 18 nt, Coxiella burnetii RSA 493
uuuucgcuucaauucuuu

SEQ ID NO: 558712 - RNA, 23 nt, Coxiella burnetii RSA 493
uuuucgauaaaugcaauuuuuua

SEQ ID NO: 558713 - RNA, 17 nt, Coxiella burnetii RSA 493
uuuaccuaacucaaccu

SEQ ID NO: 558714 - RNA, 15 nt, Coxiella burnetii RSA 493
uuuucaugcaaaaac

SEQ ID NO: 558715 - RNA, 16 nt, Coxiella burnetii RSA 493
uuuuccgcuaaauauu

SEQ ID NO: 558716 - RNA, 18 nt, Coxiella burnetii RSA 493
uuuuccgugcagaaacaa

SEQ ID NO: 558717 - RNA, 23 nt, Coxiella burnetii RSA 493
uuuuuaaugcgauucuuuuucgu

SEQ ID NO: 558718 - RNA, 15 nt, Coxiella burnetii RSA 493
uuuuuaaauuucuca

SEQ ID NO: 558719 - RNA, 15 nt, Coxiella burnetii RSA 493
uuuuuaagucccaau

SEQ ID NO: 558720 - RNA, 18 nt, Coxiella burnetii RSA 493
uuuuuaaaugaauuacuu

SEQ ID NO: 558721 - RNA, 11 nt, Coxiella burnetii RSA 493
uuuuuaaaagu

SEQ ID NO: 558722 - RNA, 22 nt, Coxiella burnetii RSA 493
uuuuucaagcccuuuuuuucca

SEQ ID NO: 558723 - RNA, 14 nt, Coxiella burnetii RSA 493
uuuuuauuuucaaa

SEQ ID NO: 558724 - RNA, 22 nt, Coxiella burnetii RSA 493
uuuuucaacuacuugauauucc

SEQ ID NO: 558725 - RNA, 14 nt, Coxiella burnetii RSA 493
uuuuuauuugaaau

SEQ ID NO: 558726 - RNA, 12 nt, Coxiella burnetii RSA 493
uuuuuaugcuuc

SEQ ID NO: 558727 - RNA, 15 nt, Coxiella burnetii RSA 493
uuuuuaugcuucaau

SEQ ID NO: 558728 - RNA, 23 nt, Coxiella burnetii RSA 493
uuuuuauaaggucuuaauuucua

SEQ ID NO: 558729 - RNA, 16 nt, Coxiella burnetii RSA 493
uuuuguuugauuuguu

SEQ ID NO: 558730 - RNA, 22 nt, Coxiella burnetii RSA 493
uuuuguuugauuuguucuaaau

SEQ ID NO: 558731 - RNA, 11 nt, Coxiella burnetii RSA 493
uuuuguuuuaa

SEQ ID NO: 558732 - RNA, 12 nt, Coxiella burnetii RSA 493
uuuuguuuuaag

SEQ ID NO: 558733 - RNA, 18 nt, Coxiella burnetii RSA 493
uuuuguuuuuaagauuuu

SEQ ID NO: 558734 - RNA, 15 nt, Coxiella burnetii RSA 493
uuuugucgaauuuuu

SEQ ID NO: 558735 - RNA, 21 nt, Coxiella burnetii RSA 493
uuuugccgcgguaaggaacag

SEQ ID NO: 558736 - RNA, 24 nt, Coxiella burnetii RSA 493
uuuugcugaauugaugauguuuau

SEQ ID NO: 558737 - RNA, 22 nt, Coxiella burnetii RSA 493
uuuugcucuaagcguaacguca

SEQ ID NO: 558738 - RNA, 13 nt, Coxiella burnetii RSA 493
uuuuguaaauuuu

SEQ ID NO: 558739 - RNA, 15 nt, Coxiella burnetii RSA 493
uuuuggcauccucau

SEQ ID NO: 558740 - RNA, 17 nt, Coxiella burnetii RSA 493
uucucauuugacuuguc

SEQ ID NO: 558741 - RNA, 21 nt, Coxiella burnetii RSA 493
uucucgacauaggagauuuuu

SEQ ID NO: 558742 - RNA, 18 nt, Coxiella burnetii RSA 493
uucuccuuaauaaaguuu

SEQ ID NO: 558743 - RNA, 14 nt, Coxiella burnetii RSA 493
uucuccuuuuaaag

SEQ ID NO: 558744 - RNA, 15 nt, Coxiella burnetii RSA 493
uucucaguuaaaaua

SEQ ID NO: 558745 - RNA, 16 nt, Coxiella burnetii RSA 493
uucucaguuaaaauaa

SEQ ID NO: 558746 - RNA, 17 nt, Coxiella burnetii RSA 493
uucucaguuaaaauaau

SEQ ID NO: 558747 - RNA, 18 nt, Coxiella burnetii RSA 493
uucuauaaguccaagacu

SEQ ID NO: 558748 - RNA, 14 nt, Coxiella burnetii RSA 493
uucuauacuucauc

SEQ ID NO: 558749 - RNA, 12 nt, Coxiella burnetii RSA 493
uucuaauaaaau

SEQ ID NO: 558750 - RNA, 17 nt, Coxiella burnetii RSA 493
uucuaaguaaacagcau

SEQ ID NO: 558751 - RNA, 17 nt, Coxiella burnetii RSA 493
uucuaagagcugucgcc

SEQ ID NO: 558752 - RNA, 19 nt, Coxiella burnetii RSA 493
uucuaauaaucgauaauua

SEQ ID NO: 558753 - RNA, 23 nt, Coxiella burnetii RSA 493
uucuaauuaaauuacuugggggu

SEQ ID NO: 558754 - RNA, 17 nt, Coxiella burnetii RSA 493
uucuagagcaacgauuu

SEQ ID NO: 558755 - RNA, 20 nt, Coxiella burnetii RSA 493
uucuaaccacccugucauau

SEQ ID NO: 558756 - RNA, 17 nt, Coxiella burnetii RSA 493
uucgugauagugcuuuu

SEQ ID NO: 558757 - RNA, 13 nt, Coxiella burnetii RSA 493
uucguaagauucu

SEQ ID NO: 558758 - RNA, 16 nt, Coxiella burnetii RSA 493
uucgucauuuccgugc

SEQ ID NO: 558759 - RNA, 16 nt, Coxiella burnetii RSA 493
uucggauuuugaacag

SEQ ID NO: 558760 - RNA, 23 nt, Coxiella burnetii RSA 493
uucucguccgaucauuaccccau

SEQ ID NO: 558761 - RNA, 21 nt, Coxiella burnetii RSA 493
uucucgauauucuaucucaaa

SEQ ID NO: 558762 - RNA, 12 nt, Coxiella burnetii RSA 493
uucugguugaau

SEQ ID NO: 558763 - RNA, 20 nt, Coxiella burnetii RSA 493
uucuggcggugcgaauaaca

SEQ ID NO: 558764 - RNA, 16 nt, Coxiella burnetii RSA 493
uucuggcuugcuauga

SEQ ID NO: 558765 - RNA, 17 nt, Coxiella burnetii RSA 493
uucuggcuugcuaugau

SEQ ID NO: 558766 - RNA, 12 nt, Coxiella burnetii RSA 493
uucuggaugaaa

SEQ ID NO: 558767 - RNA, 23 nt, Coxiella burnetii RSA 493
uucuggcaaagccgcuauuucua

SEQ ID NO: 558768 - RNA, 13 nt, Coxiella burnetii RSA 493
uucuucaucuaaa

SEQ ID NO: 558769 - RNA, 13 nt, Coxiella burnetii RSA 493
uucuucauuugaa

SEQ ID NO: 558770 - RNA, 20 nt, Coxiella burnetii RSA 493
uucuucacggauaauaucua

SEQ ID NO: 558771 - RNA, 17 nt, Coxiella burnetii RSA 493
uucuuagcgcuaaugag

SEQ ID NO: 558772 - RNA, 20 nt, Coxiella burnetii RSA 493
uugaacggcaaaaccaauag

SEQ ID NO: 558773 - RNA, 14 nt, Coxiella burnetii RSA 493
uugaagaaauacga

SEQ ID NO: 558774 - RNA, 15 nt, Coxiella burnetii RSA 493
uugaacuucaaaucg

SEQ ID NO: 558775 - RNA, 19 nt, Coxiella burnetii RSA 493
uugaaugcguucuuuaauc

SEQ ID NO: 558776 - RNA, 9 nt, Coxiella burnetii RSA 493
uugacaaau

SEQ ID NO: 558777 - RNA, 21 nt, Coxiella burnetii RSA 493
uugaauuugagaacguuuccc

SEQ ID NO: 558778 - RNA, 16 nt, Coxiella burnetii RSA 493
uugaauuuuuugaaaa

SEQ ID NO: 558779 - RNA, 14 nt, Coxiella burnetii RSA 493
uucuuguaaggauu

SEQ ID NO: 558780 - RNA, 20 nt, Coxiella burnetii RSA 493
uucuuucugaaaauucugaa

SEQ ID NO: 558781 - RNA, 22 nt, Coxiella burnetii RSA 493
uucuuucugauuuuacgcuauu

SEQ ID NO: 558782 - RNA, 16 nt, Coxiella burnetii RSA 493
uucuugucauucccuu

SEQ ID NO: 558783 - RNA, 15 nt, Coxiella burnetii RSA 493
uucuuugauaaaaga

SEQ ID NO: 558784 - RNA, 19 nt, Coxiella burnetii RSA 493
uucuuuuuuagcuuucguc

SEQ ID NO: 558785 - RNA, 14 nt, Coxiella burnetii RSA 493
uucuuuuuccaugu

SEQ ID NO: 558786 - RNA, 17 nt, Coxiella burnetii RSA 493
uugaaaaaauugauaau

SEQ ID NO: 558787 - RNA, 14 nt, Coxiella burnetii RSA 493
uugaaaaauaaaag

SEQ ID NO: 558788 - RNA, 23 nt, Coxiella burnetii RSA 493
uugaaagaauuucucgauaaaaa

SEQ ID NO: 558789 - RNA, 15 nt, Coxiella burnetii RSA 493
uugaaagaaaaaaaa

SEQ ID NO: 558790 - RNA, 21 nt, Coxiella burnetii RSA 493
uugaaagaaaaaaaaccaaug

SEQ ID NO: 558791 - RNA, 20 nt, Coxiella burnetii RSA 493
uugaaauaaacuggaaaaag

SEQ ID NO: 558792 - RNA, 21 nt, Coxiella burnetii RSA 493
uugauaucgaccauuaaccaa

SEQ ID NO: 558793 - RNA, 15 nt, Coxiella burnetii RSA 493
uugauaaaagacuuu

SEQ ID NO: 558794 - RNA, 11 nt, Coxiella burnetii RSA 493
uugauccuuuu

SEQ ID NO: 558795 - RNA, 13 nt, Coxiella burnetii RSA 493
uugauccuugagg

SEQ ID NO: 558796 - RNA, 17 nt, Coxiella burnetii RSA 493
uugaguaaccucuccau

SEQ ID NO: 558797 - RNA, 18 nt, Coxiella burnetii RSA 493
uugaguaaugguuuugau

SEQ ID NO: 558798 - RNA, 12 nt, Coxiella burnetii RSA 493
uugagcgaaagc

SEQ ID NO: 558799 - RNA, 17 nt, Coxiella burnetii RSA 493
uugagcggcuuuuucaa

SEQ ID NO: 558800 - RNA, 14 nt, Coxiella burnetii RSA 493
uugagaaguaaaaa

SEQ ID NO: 558801 - RNA, 14 nt, Coxiella burnetii RSA 493
uugaugccauaauu

SEQ ID NO: 558802 - RNA, 21 nt, Coxiella burnetii RSA 493
uugaugaauuaugcaagguug

SEQ ID NO: 558803 - RNA, 19 nt, Coxiella burnetii RSA 493
uugaucuugggcaaaaaaa

SEQ ID NO: 558804 - RNA, 22 nt, Coxiella burnetii RSA 493
uugaucuugggcaaaaaaagaa

SEQ ID NO: 558805 - RNA, 12 nt, Coxiella burnetii RSA 493
uugcaauccuuu

SEQ ID NO: 558806 - RNA, 14 nt, Coxiella burnetii RSA 493
uugcaauccuuuuu

SEQ ID NO: 558807 - RNA, 22 nt, Coxiella burnetii RSA 493
uugcaauacaccggaaauuuuu

SEQ ID NO: 558808 - RNA, 15 nt, Coxiella burnetii RSA 493
uugauuuuuuaauuc

SEQ ID NO: 558809 - RNA, 19 nt, Coxiella burnetii RSA 493
uugcaauaacaaauaaacc

SEQ ID NO: 558810 - RNA, 15 nt, Coxiella burnetii RSA 493
uugcagguugaccac

SEQ ID NO: 558811 - RNA, 17 nt, Coxiella burnetii RSA 493
uugcagugaaauaaccu

SEQ ID NO: 558812 - RNA, 13 nt, Coxiella burnetii RSA 493
uugcaguugguuu

SEQ ID NO: 558813 - RNA, 21 nt, Coxiella burnetii RSA 493
uugccgguauuuugcaaauga

SEQ ID NO: 558814 - RNA, 16 nt, Coxiella burnetii RSA 493
uugccauccaaaugag

SEQ ID NO: 558815 - RNA, 13 nt, Coxiella burnetii RSA 493
uugccauauaauu

SEQ ID NO: 558816 - RNA, 15 nt, Coxiella burnetii RSA 493
uugcggaaaaggaga

SEQ ID NO: 558817 - RNA, 17 nt, Coxiella burnetii RSA 493
uugcuaagauaauuaca

SEQ ID NO: 558818 - RNA, 16 nt, Coxiella burnetii RSA 493
uugcuaacaauuguug

SEQ ID NO: 558819 - RNA, 19 nt, Coxiella burnetii RSA 493
uugcuaaugacgauugugg

SEQ ID NO: 558820 - RNA, 14 nt, Coxiella burnetii RSA 493
uugcuaaauguuua

SEQ ID NO: 558821 - RNA, 13 nt, Coxiella burnetii RSA 493
uugcucccaagcg

SEQ ID NO: 558822 - RNA, 19 nt, Coxiella burnetii RSA 493
uugcucuuuguuuauuuga

SEQ ID NO: 558823 - RNA, 18 nt, Coxiella burnetii RSA 493
uuggaaucgcggacaaua

SEQ ID NO: 558824 - RNA, 14 nt, Coxiella burnetii RSA 493
uugcugucaaaaaa

SEQ ID NO: 558825 - RNA, 21 nt, Coxiella burnetii RSA 493
uugcuuccccaauuuauucaa

SEQ ID NO: 558826 - RNA, 17 nt, Coxiella burnetii RSA 493
uuggcuugcuccaaaau

SEQ ID NO: 558827 - RNA, 14 nt, Coxiella burnetii RSA 493
uugguuuuccauga

SEQ ID NO: 558828 - RNA, 20 nt, Coxiella burnetii RSA 493
uugguuuuccaugaggccaa

SEQ ID NO: 558829 - RNA, 13 nt, Coxiella burnetii RSA 493
uugguuugcaaaa

SEQ ID NO: 558830 - RNA, 19 nt, Coxiella burnetii RSA 493
uugggucuccguaauaagg

SEQ ID NO: 558831 - RNA, 15 nt, Coxiella burnetii RSA 493
uugucgccacugggu

SEQ ID NO: 558832 - RNA, 14 nt, Coxiella burnetii RSA 493
uugucaauuuaccu

SEQ ID NO: 558833 - RNA, 20 nt, Coxiella burnetii RSA 493
uuguccgugauuacuucuuu

SEQ ID NO: 558834 - RNA, 21 nt, Coxiella burnetii RSA 493
uuguccuguucuuuuuccaug

SEQ ID NO: 558835 - RNA, 15 nt, Coxiella burnetii RSA 493
uuguaagaauucucc

SEQ ID NO: 558836 - RNA, 21 nt, Coxiella burnetii RSA 493
uuguagacaguuuagaaucuc

SEQ ID NO: 558837 - RNA, 23 nt, Coxiella burnetii RSA 493
uuguagauuagaaaaagcgauuc

SEQ ID NO: 558838 - RNA, 19 nt, Coxiella burnetii RSA 493
uugugagucgccaauaaua

SEQ ID NO: 558839 - RNA, 23 nt, Coxiella burnetii RSA 493
uugugagucgccaauaauaguuu

SEQ ID NO: 558840 - RNA, 15 nt, Coxiella burnetii RSA 493
uuuacauuaaggcca

SEQ ID NO: 558841 - RNA, 11 nt, Coxiella burnetii RSA 493
uuuacaauacg

SEQ ID NO: 558842 - RNA, 17 nt, Coxiella burnetii RSA 493
uuuaaugucuuuuauuu

SEQ ID NO: 558843 - RNA, 17 nt, Coxiella burnetii RSA 493
uuuaauuuuuucauaac

SEQ ID NO: 558844 - RNA, 15 nt, Coxiella burnetii RSA 493
uuuaauuuuuucucu

SEQ ID NO: 558845 - RNA, 22 nt, Coxiella burnetii RSA 493
uuuaaugagguuaauaaaaagg

SEQ ID NO: 558846 - RNA, 15 nt, Coxiella burnetii RSA 493
uuuaauaucaaaaaa

SEQ ID NO: 558847 - RNA, 16 nt, Coxiella burnetii RSA 493
uuuaauaucaaaaaac

SEQ ID NO: 558848 - RNA, 19 nt, Coxiella burnetii RSA 493
uuuaaggcagggaaaguau

SEQ ID NO: 558849 - RNA, 19 nt, Coxiella burnetii RSA 493
uuuaacuucucuugaauaa

SEQ ID NO: 558850 - RNA, 12 nt, Coxiella burnetii RSA 493
uuuaagaaaaac

SEQ ID NO: 558851 - RNA, 20 nt, Coxiella burnetii RSA 493
uuuaagaugccagugcucgc

SEQ ID NO: 558852 - RNA, 12 nt, Coxiella burnetii RSA 493
uuuaagauuuuu

SEQ ID NO: 558853 - RNA, 18 nt, Coxiella burnetii RSA 493
uuuaagagagucucagca

SEQ ID NO: 558854 - RNA, 22 nt, Coxiella burnetii RSA 493
uuuaaaugcgguacuuaagaaa

SEQ ID NO: 558855 - RNA, 16 nt, Coxiella burnetii RSA 493
uuguuugaaaaaauac

SEQ ID NO: 558856 - RNA, 12 nt, Coxiella burnetii RSA 493
uuuaaaaaacua

SEQ ID NO: 558857 - RNA, 13 nt, Coxiella burnetii RSA 493
uuuaaaaaacuag

SEQ ID NO: 558858 - RNA, 22 nt, Coxiella burnetii RSA 493
uuuaaaaaacuagaaauauuag

SEQ ID NO: 558859 - RNA, 18 nt, Coxiella burnetii RSA 493
uuccggguuauauuuaau

SEQ ID NO: 558860 - RNA, 14 nt, Coxiella burnetii RSA 493
uuccgucaauuuuu

SEQ ID NO: 558861 - RNA, 15 nt, Coxiella burnetii RSA 493
uuccguugucuugga

SEQ ID NO: 558862 - RNA, 20 nt, Coxiella burnetii RSA 493
uuccucacggcaauucucau

SEQ ID NO: 558863 - RNA, 20 nt, Coxiella burnetii RSA 493
uuccuguccgauauaacacc

SEQ ID NO: 558864 - RNA, 15 nt, Coxiella burnetii RSA 493
uuccuucaaacagug

SEQ ID NO: 558865 - RNA, 14 nt, Coxiella burnetii RSA 493
uuccuuuucuauuu

SEQ ID NO: 558866 - RNA, 22 nt, Coxiella burnetii RSA 493
uuccuuuucuauuuuuuugcca

SEQ ID NO: 558867 - RNA, 22 nt, Coxiella burnetii RSA 493
uuccuuguugaauuccuugcuc

SEQ ID NO: 558868 - RNA, 14 nt, Coxiella burnetii RSA 493
uuccuuucaucaaa

SEQ ID NO: 558869 - RNA, 23 nt, Coxiella burnetii RSA 493
uuccuuuuuauaaaugauuucca

SEQ ID NO: 558870 - RNA, 15 nt, Coxiella burnetii RSA 493
uucgccuggccaaga

SEQ ID NO: 558871 - RNA, 16 nt, Coxiella burnetii RSA 493
uucgcuuaaauuuuga

SEQ ID NO: 558872 - RNA, 22 nt, Coxiella burnetii RSA 493
uucgccagaaacaacuaccuga

SEQ ID NO: 558873 - RNA, 18 nt, Coxiella burnetii RSA 493
uucgauacagccuucaug

SEQ ID NO: 558874 - RNA, 14 nt, Coxiella burnetii RSA 493
uucgcaacuuuuuu

SEQ ID NO: 558875 - RNA, 16 nt, Coxiella burnetii RSA 493
uucgcacaaugcuuuu

SEQ ID NO: 558876 - RNA, 19 nt, Coxiella burnetii RSA 493
uucgauuuuacaauaaucc

SEQ ID NO: 558877 - RNA, 23 nt, Coxiella burnetii RSA 493
uucgaacgacuuuuuuuaccauu

SEQ ID NO: 558878 - RNA, 23 nt, Coxiella burnetii RSA 493
uucgacguggaaccuagcaauaa

SEQ ID NO: 558879 - RNA, 17 nt, Coxiella burnetii RSA 493
uucgaggaagaccgcua

SEQ ID NO: 558880 - RNA, 14 nt, Coxiella burnetii RSA 493
uucgagauuauuca

SEQ ID NO: 558881 - RNA, 15 nt, Coxiella burnetii RSA 493
uuccaugaggccaaa

SEQ ID NO: 558882 - RNA, 19 nt, Coxiella burnetii RSA 493
uuccauuaauuucuuuuuu

SEQ ID NO: 558883 - RNA, 19 nt, Coxiella burnetii RSA 493
uucccaauuacgcccuuuc

SEQ ID NO: 558884 - RNA, 11 nt, Coxiella burnetii RSA 493
uucccauucag

SEQ ID NO: 558885 - RNA, 17 nt, Coxiella burnetii RSA 493
uucccauucuauaauca

SEQ ID NO: 558886 - RNA, 14 nt, Coxiella burnetii RSA 493
uucccaggaaagaa

SEQ ID NO: 558887 - RNA, 20 nt, Coxiella burnetii RSA 493
uucccaggaaagaaaaugag

SEQ ID NO: 558888 - RNA, 15 nt, Coxiella burnetii RSA 493
uuccgauaagcguuu

SEQ ID NO: 558889 - RNA, 15 nt, Coxiella burnetii RSA 493
uuccgcuacguuuuu

SEQ ID NO: 558890 - RNA, 13 nt, Coxiella burnetii RSA 493
uuccgccauuaau

SEQ ID NO: 558891 - RNA, 20 nt, Coxiella burnetii RSA 493
uucccuuuuggaauuuuuga

SEQ ID NO: 558892 - RNA, 15 nt, Coxiella burnetii RSA 493
uuccagugacucauc

SEQ ID NO: 558893 - RNA, 15 nt, Coxiella burnetii RSA 493
uuccauaauguuuga

SEQ ID NO: 558894 - RNA, 19 nt, Coxiella burnetii RSA 493
uuccagcaguaaugagcau

SEQ ID NO: 558895 - RNA, 17 nt, Coxiella burnetii RSA 493
uuccaauuguuugaaaa

SEQ ID NO: 558896 - RNA, 13 nt, Coxiella burnetii RSA 493
uuccaaauaaucg

SEQ ID NO: 558897 - RNA, 17 nt, Coxiella burnetii RSA 493
uuccaaaaaauuaagag

SEQ ID NO: 558898 - RNA, 12 nt, Coxiella burnetii RSA 493
uuccaaaaacau

SEQ ID NO: 558899 - RNA, 13 nt, Coxiella burnetii RSA 493
uuccaaaaacauu

SEQ ID NO: 558900 - RNA, 21 nt, Coxiella burnetii RSA 493
uucauuuuuuccucuuaagga

SEQ ID NO: 558901 - RNA, 11 nt, Coxiella burnetii RSA 493
uuccaaaaauu

SEQ ID NO: 558902 - RNA, 12 nt, Coxiella burnetii RSA 493
uuccaaaaauuu

SEQ ID NO: 558903 - RNA, 14 nt, Coxiella burnetii RSA 493
uuccaaaaauuuca

SEQ ID NO: 558904 - RNA, 23 nt, Coxiella burnetii RSA 493
uuccaaaaauuucauuuaauaaa

SEQ ID NO: 558905 - RNA, 19 nt, Coxiella burnetii RSA 493
uuccaagcgauuaaauauu

SEQ ID NO: 558906 - RNA, 14 nt, Coxiella burnetii RSA 493
uucagcggggagga

SEQ ID NO: 558907 - RNA, 16 nt, Coxiella burnetii RSA 493
uucaggacugaaauaa

SEQ ID NO: 558908 - RNA, 15 nt, Coxiella burnetii RSA 493
uucaguaauuuuuaa

SEQ ID NO: 558909 - RNA, 14 nt, Coxiella burnetii RSA 493
uucauaucuuuuuc

SEQ ID NO: 558910 - RNA, 19 nt, Coxiella burnetii RSA 493
uucaucaaaucaauaauca

SEQ ID NO: 558911 - RNA, 18 nt, Coxiella burnetii RSA 493
uucauaauuuuauaaagc

SEQ ID NO: 558912 - RNA, 20 nt, Coxiella burnetii RSA 493
uucauaaucaaaaucagaaa

SEQ ID NO: 558913 - RNA, 21 nt, Coxiella burnetii RSA 493
uucauaagcgcuuuuggcuac

SEQ ID NO: 558914 - RNA, 18 nt, Coxiella burnetii RSA 493
uucauaaggccaauuucu

SEQ ID NO: 558915 - RNA, 22 nt, Coxiella burnetii RSA 493
uucauaaggccaauuucuaauc

SEQ ID NO: 558916 - RNA, 13 nt, Coxiella burnetii RSA 493
uucauaaauaauu

SEQ ID NO: 558917 - RNA, 16 nt, Coxiella burnetii RSA 493
uucauaaaaaaugauu

SEQ ID NO: 558918 - RNA, 16 nt, Coxiella burnetii RSA 493
uucaguucgcuaaaua

SEQ ID NO: 558919 - RNA, 15 nt, Coxiella burnetii RSA 493
uucauuuaaggguac

SEQ ID NO: 558920 - RNA, 23 nt, Coxiella burnetii RSA 493
uucauuuucucuaaugauaaucc

SEQ ID NO: 558921 - RNA, 13 nt, Coxiella burnetii RSA 493
uucauucgcuuuu

SEQ ID NO: 558922 - RNA, 22 nt, Coxiella burnetii RSA 493
uucauugagcgggauauuuuuu

SEQ ID NO: 558923 - RNA, 23 nt, Coxiella burnetii RSA 493
uucaugcgcgcgauagccuccuc

SEQ ID NO: 558924 - RNA, 22 nt, Coxiella burnetii RSA 493
uucauuaacauuauuacauauu

SEQ ID NO: 558925 - RNA, 14 nt, Coxiella burnetii RSA 493
uucauuaucuagau

SEQ ID NO: 558926 - RNA, 13 nt, Coxiella burnetii RSA 493
uucauccaaaauu

SEQ ID NO: 558927 - RNA, 19 nt, Coxiella burnetii RSA 493
uucauccagugaaaacccg

SEQ ID NO: 558928 - RNA, 19 nt, Coxiella burnetii RSA 493
uucaucccccgcuguuuau

SEQ ID NO: 558929 - RNA, 20 nt, Coxiella burnetii RSA 493
uucaucgccuugcaaacaaa

SEQ ID NO: 558930 - RNA, 16 nt, Coxiella burnetii RSA 493
uucaucggauaucuga

SEQ ID NO: 558931 - RNA, 14 nt, Coxiella burnetii RSA 493
uucaugaaaaagau

SEQ ID NO: 558932 - RNA, 13 nt, Coxiella burnetii RSA 493
uucaugagaggau

SEQ ID NO: 558933 - RNA, 14 nt, Coxiella burnetii RSA 493
uucacagagccacc

SEQ ID NO: 558934 - RNA, 18 nt, Coxiella burnetii RSA 493
uucaauuacuuuuauaau

SEQ ID NO: 558935 - RNA, 21 nt, Coxiella burnetii RSA 493
uucaauucuuuuuaagacgga

SEQ ID NO: 558936 - RNA, 22 nt, Coxiella burnetii RSA 493
uucaaucacaaguucuucuaaa

SEQ ID NO: 558937 - RNA, 19 nt, Coxiella burnetii RSA 493
uucaauauuucuugaaaaa

SEQ ID NO: 558938 - RNA, 15 nt, Coxiella burnetii RSA 493
uucaauaaacccguu

SEQ ID NO: 558939 - RNA, 21 nt, Coxiella burnetii RSA 493
uucaagugcaacguccugaau

SEQ ID NO: 558940 - RNA, 17 nt, Coxiella burnetii RSA 493
uucaccguuuucuaucc

SEQ ID NO: 558941 - RNA, 13 nt, Coxiella burnetii RSA 493
uucaccuuuuccc

SEQ ID NO: 558942 - RNA, 19 nt, Coxiella burnetii RSA 493
uucaccuuuucccuaggaa

SEQ ID NO: 558943 - RNA, 23 nt, Coxiella burnetii RSA 493
uucacgauuuuucucaucauuuu

SEQ ID NO: 558944 - RNA, 23 nt, Coxiella burnetii RSA 493
uucagaauccaacgguucucaaa

SEQ ID NO: 558945 - RNA, 20 nt, Coxiella burnetii RSA 493
uggcuccagccgaagcgcgg

SEQ ID NO: 558946 - RNA, 23 nt, Coxiella burnetii RSA 493
uggcuccagccgaagcgcggcca

SEQ ID NO: 558947 - RNA, 21 nt, Coxiella burnetii RSA 493
uggcgugacccuuaauuugga

SEQ ID NO: 558948 - RNA, 15 nt, Coxiella burnetii RSA 493
uggaaaaucgaugga

SEQ ID NO: 558949 - RNA, 20 nt, Coxiella burnetii RSA 493
uggaaaaucgauggaagaac

SEQ ID NO: 558950 - RNA, 21 nt, Coxiella burnetii RSA 493
uggcgcucuccuaccaaauaa

SEQ ID NO: 558951 - RNA, 21 nt, Coxiella burnetii RSA 493
ugggaaccgucacuucuucuc

SEQ ID NO: 558952 - RNA, 18 nt, Coxiella burnetii RSA 493
ugggaacgcuaucaaggc

SEQ ID NO: 558953 - RNA, 20 nt, Coxiella burnetii RSA 493
uggcuuucauuacuuggccg

SEQ ID NO: 558954 - RNA, 18 nt, Coxiella burnetii RSA 493
uggcuuggacaaaucauc

SEQ ID NO: 558955 - RNA, 17 nt, Coxiella burnetii RSA 493
uggcuguacuuucacua

SEQ ID NO: 558956 - RNA, 22 nt, Coxiella burnetii RSA 493
uggcuggugcgauaguuuuauu

SEQ ID NO: 558957 - RNA, 20 nt, Coxiella burnetii RSA 493
uggcugcggguuuugaagaa

SEQ ID NO: 558958 - RNA, 20 nt, Coxiella burnetii RSA 493
ugggaguaaugacagaaaaa

SEQ ID NO: 558959 - RNA, 15 nt, Coxiella burnetii RSA 493
ugggcggaauuucgg

SEQ ID NO: 558960 - RNA, 17 nt, Coxiella burnetii RSA 493
uggucuugauuccuuca

SEQ ID NO: 558961 - RNA, 15 nt, Coxiella burnetii RSA 493
uggucuguuucuucu

SEQ ID NO: 558962 - RNA, 16 nt, Coxiella burnetii RSA 493
uggucuguuucuucuu

SEQ ID NO: 558963 - RNA, 15 nt, Coxiella burnetii RSA 493
ugguacacgcaaaaa

SEQ ID NO: 558964 - RNA, 16 nt, Coxiella burnetii RSA 493
ugguaauaauuuuccg

SEQ ID NO: 558965 - RNA, 13 nt, Coxiella burnetii RSA 493
ugguuuauagcac

SEQ ID NO: 558966 - RNA, 14 nt, Coxiella burnetii RSA 493
ugguuuaaaaaguu

SEQ ID NO: 558967 - RNA, 15 nt, Coxiella burnetii RSA 493
ugguugguuugcaaa

SEQ ID NO: 558968 - RNA, 14 nt, Coxiella burnetii RSA 493
ugguuaaguagcua

SEQ ID NO: 558969 - RNA, 17 nt, Coxiella burnetii RSA 493
ugguuaauucuucuuca

SEQ ID NO: 558970 - RNA, 18 nt, Coxiella burnetii RSA 493
ugguuaauucuucuucau

SEQ ID NO: 558971 - RNA, 20 nt, Coxiella burnetii RSA 493
ugguucguguuuauuuucau

SEQ ID NO: 558972 - RNA, 17 nt, Coxiella burnetii RSA 493
ugguugauuuuuuaauu

SEQ ID NO: 558973 - RNA, 19 nt, Coxiella burnetii RSA 493
uguaaggcaucuuuuucuc

SEQ ID NO: 558974 - RNA, 20 nt, Coxiella burnetii RSA 493
uguaacacggccuucauuau

SEQ ID NO: 558975 - RNA, 13 nt, Coxiella burnetii RSA 493
ugguuuuccauga

SEQ ID NO: 558976 - RNA, 17 nt, Coxiella burnetii RSA 493
uguaaucuuuuggcaua

SEQ ID NO: 558977 - RNA, 20 nt, Coxiella burnetii RSA 493
uguaauccuuguugaauucc

SEQ ID NO: 558978 - RNA, 20 nt, Coxiella burnetii RSA 493
uguaaguugggguuuaauug

SEQ ID NO: 558979 - RNA, 14 nt, Coxiella burnetii RSA 493
uguaaucaauugcu

SEQ ID NO: 558980 - RNA, 21 nt, Coxiella burnetii RSA 493
uguauugaggucguuaaaaaa

SEQ ID NO: 558981 - RNA, 22 nt, Coxiella burnetii RSA 493
ugucaaugggcaguuuucuuca

SEQ ID NO: 558982 - RNA, 11 nt, Coxiella burnetii RSA 493
uguauuuaggg

SEQ ID NO: 558983 - RNA, 15 nt, Coxiella burnetii RSA 493
uguauuuaucauccu

SEQ ID NO: 558984 - RNA, 19 nt, Coxiella burnetii RSA 493
ugucaaacguccuucucca

SEQ ID NO: 558985 - RNA, 16 nt, Coxiella burnetii RSA 493
ugucaacaaucaguuu

SEQ ID NO: 558986 - RNA, 22 nt, Coxiella burnetii RSA 493
ugucagguucggauuucacuuu

SEQ ID NO: 558987 - RNA, 19 nt, Coxiella burnetii RSA 493
ugucaauuuaccuccaaaa

SEQ ID NO: 558988 - RNA, 14 nt, Coxiella burnetii RSA 493
ugucauaaauaaaa

SEQ ID NO: 558989 - RNA, 18 nt, Coxiella burnetii RSA 493
ugucaucuaucguccccg

SEQ ID NO: 558990 - RNA, 17 nt, Coxiella burnetii RSA 493
uguccuuggaacaaacc

SEQ ID NO: 558991 - RNA, 14 nt, Coxiella burnetii RSA 493
uguccuguucuuuu

SEQ ID NO: 558992 - RNA, 16 nt, Coxiella burnetii RSA 493
uguccuguucuuuuuc

SEQ ID NO: 558993 - RNA, 17 nt, Coxiella burnetii RSA 493
uguccgugauuacuucu

SEQ ID NO: 558994 - RNA, 23 nt, Coxiella burnetii RSA 493
uguccgccguguuguaagaauuc

SEQ ID NO: 558995 - RNA, 20 nt, Coxiella burnetii RSA 493
ugucgccacuggguuuuccc

SEQ ID NO: 558996 - RNA, 21 nt, Coxiella burnetii RSA 493
ugucucuauaccauacagaau

SEQ ID NO: 558997 - RNA, 20 nt, Coxiella burnetii RSA 493
ugucuccuuuuguuaauucu

SEQ ID NO: 558998 - RNA, 17 nt, Coxiella burnetii RSA 493
ugucucaaggcucguug

SEQ ID NO: 558999 - RNA, 23 nt, Coxiella burnetii RSA 493
ugucguuucugauuuuugaagcu

SEQ ID NO: 559000 - RNA, 16 nt, Coxiella burnetii RSA 493
ugucguuaauacgaua

SEQ ID NO: 559001 - RNA, 14 nt, Coxiella burnetii RSA 493
ugucgugcauaucg

SEQ ID NO: 559002 - RNA, 18 nt, Coxiella burnetii RSA 493
ugucggccggauuuuaau

SEQ ID NO: 559003 - RNA, 19 nt, Coxiella burnetii RSA 493
ugucuuuucgcauaauaau

SEQ ID NO: 559004 - RNA, 20 nt, Coxiella burnetii RSA 493
ugucuuuucgcauaauaauc

SEQ ID NO: 559005 - RNA, 16 nt, Coxiella burnetii RSA 493
ugucugcauuuuuaau

SEQ ID NO: 559006 - RNA, 14 nt, Coxiella burnetii RSA 493
uguguaaaauacug

SEQ ID NO: 559007 - RNA, 15 nt, Coxiella burnetii RSA 493
uguguaacaaaaacg

SEQ ID NO: 559008 - RNA, 16 nt, Coxiella burnetii RSA 493
ugugguuaauucuucu

SEQ ID NO: 559009 - RNA, 23 nt, Coxiella burnetii RSA 493
ugugguuaauucuucuucauuua

SEQ ID NO: 559010 - RNA, 16 nt, Coxiella burnetii RSA 493
ugugauuuuaaaaaua

SEQ ID NO: 559011 - RNA, 17 nt, Coxiella burnetii RSA 493
ugugauuuuaaaaauaa

SEQ ID NO: 559012 - RNA, 19 nt, Coxiella burnetii RSA 493
uguucaaccgcaugaauua

SEQ ID NO: 559013 - RNA, 23 nt, Coxiella burnetii RSA 493
uguucacaagucucagaaucugu

SEQ ID NO: 559014 - RNA, 21 nt, Coxiella burnetii RSA 493
uguuaauucgagcaucuuuuu

SEQ ID NO: 559015 - RNA, 17 nt, Coxiella burnetii RSA 493
uguugauaauaaauggc

SEQ ID NO: 559016 - RNA, 20 nt, Coxiella burnetii RSA 493
uguucuugaucuaaucgucu

SEQ ID NO: 559017 - RNA, 16 nt, Coxiella burnetii RSA 493
uguucgggcacaaaaa

SEQ ID NO: 559018 - RNA, 16 nt, Coxiella burnetii RSA 493
uuacuuuauuacccuc

SEQ ID NO: 559019 - RNA, 18 nt, Coxiella burnetii RSA 493
uuagaaaaucaaaugcua

SEQ ID NO: 559020 - RNA, 17 nt, Coxiella burnetii RSA 493
uuacuccccccaaaaaa

SEQ ID NO: 559021 - RNA, 23 nt, Coxiella burnetii RSA 493
uuacuccccccaaaaaaaaaccu

SEQ ID NO: 559022 - RNA, 19 nt, Coxiella burnetii RSA 493
uuacgcgcuucuuuuaauu

SEQ ID NO: 559023 - RNA, 19 nt, Coxiella burnetii RSA 493
uuacguuuaaauaacaaau

SEQ ID NO: 559024 - RNA, 18 nt, Coxiella burnetii RSA 493
uuacauaauuuaaacuca

SEQ ID NO: 559025 - RNA, 16 nt, Coxiella burnetii RSA 493
uuacaucgguuuuucc

SEQ ID NO: 559026 - RNA, 11 nt, Coxiella burnetii RSA 493
uuaauuuaggc

SEQ ID NO: 559027 - RNA, 19 nt, Coxiella burnetii RSA 493
uuaaugcugaugaaauugc

SEQ ID NO: 559028 - RNA, 14 nt, Coxiella burnetii RSA 493
uuaauggauuccca

SEQ ID NO: 559029 - RNA, 18 nt, Coxiella burnetii RSA 493
uuaaugcgccuacaaaua

SEQ ID NO: 559030 - RNA, 21 nt, Coxiella burnetii RSA 493
uuaauuauccaaaauccaggc

SEQ ID NO: 559031 - RNA, 14 nt, Coxiella burnetii RSA 493
uuaauucauaaaua

SEQ ID NO: 559032 - RNA, 16 nt, Coxiella burnetii RSA 493
uuaauucauaaauaau

SEQ ID NO: 559033 - RNA, 21 nt, Coxiella burnetii RSA 493
uuaauuccccguauuucgcuu

SEQ ID NO: 559034 - RNA, 21 nt, Coxiella burnetii RSA 493
uuaauacccguuucuuauuca

SEQ ID NO: 559035 - RNA, 14 nt, Coxiella burnetii RSA 493
uuaaugaaaaauag

SEQ ID NO: 559036 - RNA, 17 nt, Coxiella burnetii RSA 493
uuaaugaguucauuaau

SEQ ID NO: 559037 - RNA, 15 nt, Coxiella burnetii RSA 493
uuaaugcagcacaaa

SEQ ID NO: 559038 - RNA, 17 nt, Coxiella burnetii RSA 493
uuaaugcauuugaagua

SEQ ID NO: 559039 - RNA, 20 nt, Coxiella burnetii RSA 493
uuaaacccagaaaaguaaaa

SEQ ID NO: 559040 - RNA, 24 nt, Coxiella burnetii RSA 493
uuaaaccgacgcgcucaaugaauu

SEQ ID NO: 559041 - RNA, 18 nt, Coxiella burnetii RSA 493
uuaaacgcuucaaaguga

SEQ ID NO: 559042 - RNA, 14 nt, Coxiella burnetii RSA 493
uuaaauagcuccuu

SEQ ID NO: 559043 - RNA, 14 nt, Coxiella burnetii RSA 493
uuaaauaccauuuu

SEQ ID NO: 559044 - RNA, 23 nt, Coxiella burnetii RSA 493
uuaaaugggugcaguuugggggc

SEQ ID NO: 559045 - RNA, 19 nt, Coxiella burnetii RSA 493
uuaaaugcuuuucuuucau

SEQ ID NO: 559046 - RNA, 15 nt, Coxiella burnetii RSA 493
uuaaaugcuuuuuaa

SEQ ID NO: 559047 - RNA, 15 nt, Coxiella burnetii RSA 493
uuaaaucaacacccc

SEQ ID NO: 559048 - RNA, 23 nt, Coxiella burnetii RSA 493
uuaaaucaacaccccaauuuuug

SEQ ID NO: 559049 - RNA, 12 nt, Coxiella burnetii RSA 493
uuaaauuucuca

SEQ ID NO: 559050 - RNA, 15 nt, Coxiella burnetii RSA 493
uuaaauuuuucauuu

SEQ ID NO: 559051 - RNA, 14 nt, Coxiella burnetii RSA 493
uuaaauuuuuaaau

SEQ ID NO: 559052 - RNA, 12 nt, Coxiella burnetii RSA 493
uuaacaaaaaug

SEQ ID NO: 559053 - RNA, 21 nt, Coxiella burnetii RSA 493
uuaacaaaaucaccagaaaac

SEQ ID NO: 559054 - RNA, 23 nt, Coxiella burnetii RSA 493
uuaaauucucgccuacuuuuguu

SEQ ID NO: 559055 - RNA, 16 nt, Coxiella burnetii RSA 493
uuaacacuuuaauauc

SEQ ID NO: 559056 - RNA, 16 nt, Coxiella burnetii RSA 493
uuaacauauuuacuug

SEQ ID NO: 559057 - RNA, 12 nt, Coxiella burnetii RSA 493
uuaaccacagac

SEQ ID NO: 559058 - RNA, 20 nt, Coxiella burnetii RSA 493
uuaacgauaaaucaaaucgg

SEQ ID NO: 559059 - RNA, 11 nt, Coxiella burnetii RSA 493
uuaacuucauu

SEQ ID NO: 559060 - RNA, 22 nt, Coxiella burnetii RSA 493
uuaacuucgacgggaaaaauau

SEQ ID NO: 559061 - RNA, 12 nt, Coxiella burnetii RSA 493
uuaagaaaguau

SEQ ID NO: 559062 - RNA, 13 nt, Coxiella burnetii RSA 493
uuaacuuugcaaa

SEQ ID NO: 559063 - RNA, 13 nt, Coxiella burnetii RSA 493
uuaauaaaguuuu

SEQ ID NO: 559064 - RNA, 22 nt, Coxiella burnetii RSA 493
uuaagcucgagaagaugucccg

SEQ ID NO: 559065 - RNA, 15 nt, Coxiella burnetii RSA 493
uuaagcugauacacc

SEQ ID NO: 559066 - RNA, 13 nt, Coxiella burnetii RSA 493
uuaagcguaaauu

SEQ ID NO: 559067 - RNA, 17 nt, Coxiella burnetii RSA 493
uuaauaaaauuaaauaa

SEQ ID NO: 559068 - RNA, 13 nt, Coxiella burnetii RSA 493
uuaaguuuuucac

SEQ ID NO: 559069 - RNA, 16 nt, Coxiella burnetii RSA 493
uuaaguuuuuugcucu

SEQ ID NO: 559070 - RNA, 13 nt, Coxiella burnetii RSA 493
uuauccucacaaa

SEQ ID NO: 559071 - RNA, 17 nt, Coxiella burnetii RSA 493
uuaucguaaauauuuuu

SEQ ID NO: 559072 - RNA, 16 nt, Coxiella burnetii RSA 493
uuaucuuauuauucau

SEQ ID NO: 559073 - RNA, 15 nt, Coxiella burnetii RSA 493
uuaucuggccagcga

SEQ ID NO: 559074 - RNA, 19 nt, Coxiella burnetii RSA 493
uuauguauuuuuuggaaug

SEQ ID NO: 559075 - RNA, 23 nt, Coxiella burnetii RSA 493
uuaugggggacagccaauuuauu

SEQ ID NO: 559076 - RNA, 15 nt, Coxiella burnetii RSA 493
uuaugacgguuaugu

SEQ ID NO: 559077 - RNA, 17 nt, Coxiella burnetii RSA 493
uuaugagacuuuaauaa

SEQ ID NO: 559078 - RNA, 18 nt, Coxiella burnetii RSA 493
uuaugaaagaguauuuuu

SEQ ID NO: 559079 - RNA, 21 nt, Coxiella burnetii RSA 493
uuaucuuuuuucuuaucccag

SEQ ID NO: 559080 - RNA, 12 nt, Coxiella burnetii RSA 493
uuaugaaaacau

SEQ ID NO: 559081 - RNA, 20 nt, Coxiella burnetii RSA 493
uuauaaaacuucccauucua

SEQ ID NO: 559082 - RNA, 16 nt, Coxiella burnetii RSA 493
uuauaaaauuuaauaa

SEQ ID NO: 559083 - RNA, 22 nt, Coxiella burnetii RSA 493
uuauaaaauuuaauaagucuuu

SEQ ID NO: 559084 - RNA, 18 nt, Coxiella burnetii RSA 493
uuagagcgauuauguauu

SEQ ID NO: 559085 - RNA, 22 nt, Coxiella burnetii RSA 493
uuagaauuccuuuuaugaaaga

SEQ ID NO: 559086 - RNA, 14 nt, Coxiella burnetii RSA 493
uuauacacaucuuu

SEQ ID NO: 559087 - RNA, 23 nt, Coxiella burnetii RSA 493
uuauacacaucuuuuaaaacgcc

SEQ ID NO: 559088 - RNA, 13 nt, Coxiella burnetii RSA 493
uuauaauuaucca

SEQ ID NO: 559089 - RNA, 14 nt, Coxiella burnetii RSA 493
uuauccgcuuaauc

SEQ ID NO: 559090 - RNA, 21 nt, Coxiella burnetii RSA 493
uuauccggcaucguuaaacuc

SEQ ID NO: 559091 - RNA, 16 nt, Coxiella burnetii RSA 493
uuaucaugcauuugau

SEQ ID NO: 559092 - RNA, 17 nt, Coxiella burnetii RSA 493
uuaucauguucauccaa

SEQ ID NO: 559093 - RNA, 21 nt, Coxiella burnetii RSA 493
uuaucauuugggucuccguaa

SEQ ID NO: 559094 - RNA, 22 nt, Coxiella burnetii RSA 493
uuaucauuugggucuccguaau

SEQ ID NO: 559095 - RNA, 13 nt, Coxiella burnetii RSA 493
uuaucauuuuucc

SEQ ID NO: 559096 - RNA, 14 nt, Coxiella burnetii RSA 493
uuauccaaaaucca

SEQ ID NO: 559097 - RNA, 16 nt, Coxiella burnetii RSA 493
uuauaucauggucagc

SEQ ID NO: 559098 - RNA, 13 nt, Coxiella burnetii RSA 493
uucaagaaagaca

SEQ ID NO: 559099 - RNA, 17 nt, Coxiella burnetii RSA 493
uucaagaacgauuuccc

SEQ ID NO: 559100 - RNA, 13 nt, Coxiella burnetii RSA 493
uucaagaugccca

SEQ ID NO: 559101 - RNA, 20 nt, Coxiella burnetii RSA 493
uucaacuccugaaaaauaau

SEQ ID NO: 559102 - RNA, 20 nt, Coxiella burnetii RSA 493
uucaacgccucucucauaau

SEQ ID NO: 559103 - RNA, 13 nt, Coxiella burnetii RSA 493
uucaacauauuuc

SEQ ID NO: 559104 - RNA, 16 nt, Coxiella burnetii RSA 493
uucaacaucaacccca

SEQ ID NO: 559105 - RNA, 13 nt, Coxiella burnetii RSA 493
uucaaauugcuga

SEQ ID NO: 559106 - RNA, 16 nt, Coxiella burnetii RSA 493
uucaaaugaccaaaua

SEQ ID NO: 559107 - RNA, 19 nt, Coxiella burnetii RSA 493
uucaaaugaccaaauaauu

SEQ ID NO: 559108 - RNA, 20 nt, Coxiella burnetii RSA 493
uucaaaagugauuuuucuuu

SEQ ID NO: 559109 - RNA, 12 nt, Coxiella burnetii RSA 493
uucaaacagugc

SEQ ID NO: 559110 - RNA, 20 nt, Coxiella burnetii RSA 493
uuauuuuucaucuuguaauc

SEQ ID NO: 559111 - RNA, 22 nt, Coxiella burnetii RSA 493
uuauuaugggggacagccaauu

SEQ ID NO: 559112 - RNA, 20 nt, Coxiella burnetii RSA 493
uuauuacccucgcccuuccc

SEQ ID NO: 559113 - RNA, 21 nt, Coxiella burnetii RSA 493
uuauuaauacaggaaaaagau

SEQ ID NO: 559114 - RNA, 21 nt, Coxiella burnetii RSA 493
uuauugagaaucucuuguaug

SEQ ID NO: 559115 - RNA, 17 nt, Coxiella burnetii RSA 493
uuauucauuaguucuau

SEQ ID NO: 559116 - RNA, 20 nt, Coxiella burnetii RSA 493
uuauuccuguggaagguuga

SEQ ID NO: 559117 - RNA, 21 nt, Coxiella burnetii RSA 493
uuauucgguaacguuucacaa

SEQ ID NO: 559118 - RNA, 18 nt, Coxiella burnetii RSA 493
uuauuauuuuuuucuauu

SEQ ID NO: 559119 - RNA, 23 nt, Coxiella burnetii RSA 493
uuauuuuaauaugauaaaaggca

SEQ ID NO: 559120 - RNA, 21 nt, Coxiella burnetii RSA 493
uuauuuucaaaugaauaagca

SEQ ID NO: 559121 - RNA, 23 nt, Coxiella burnetii RSA 493
uuauuuccagcaguaaugagcau

SEQ ID NO: 559122 - RNA, 22 nt, Coxiella burnetii RSA 493
uuauuuccugucguuaauacga

SEQ ID NO: 559123 - RNA, 20 nt, Coxiella burnetii RSA 493
uuauuucugcagauuguaaa

SEQ ID NO: 559124 - RNA, 22 nt, Coxiella burnetii RSA 493
uuauuuaacgccucuugcaacg

SEQ ID NO: 559125 - RNA, 17 nt, Coxiella burnetii RSA 493
uuauuggagucgcuuuc

SEQ ID NO: 559126 - RNA, 21 nt, Coxiella burnetii RSA 493
ugcauaacgggaauguuuuuu

SEQ ID NO: 559127 - RNA, 21 nt, Coxiella burnetii RSA 493
ugcacucuuuaauuugcacaa

SEQ ID NO: 559128 - RNA, 14 nt, Coxiella burnetii RSA 493
ugcaucgaacaacc

SEQ ID NO: 559129 - RNA, 22 nt, Coxiella burnetii RSA 493
ugcauucaauacagauuuuagu

SEQ ID NO: 559130 - RNA, 15 nt, Coxiella burnetii RSA 493
ugcauuugauuuucu

SEQ ID NO: 559131 - RNA, 16 nt, Coxiella burnetii RSA 493
ugcauuucuuucaaua

SEQ ID NO: 559132 - RNA, 13 nt, Coxiella burnetii RSA 493
ugcauuuuuaaug

SEQ ID NO: 559133 - RNA, 18 nt, Coxiella burnetii RSA 493
ugcauuucaauggauucu

SEQ ID NO: 559134 - RNA, 21 nt, Coxiella burnetii RSA 493
ugcauuucaauggauucuucu

SEQ ID NO: 559135 - RNA, 16 nt, Coxiella burnetii RSA 493
ugcauucauucuuuuu

SEQ ID NO: 559136 - RNA, 17 nt, Coxiella burnetii RSA 493
ugcauucauucuuuuuu

SEQ ID NO: 559137 - RNA, 15 nt, Coxiella burnetii RSA 493
ugcauugcucaauau

SEQ ID NO: 559138 - RNA, 21 nt, Coxiella burnetii RSA 493
ugcccuagugaggcuucuucc

SEQ ID NO: 559139 - RNA, 23 nt, Coxiella burnetii RSA 493
ugcccuagugaggcuucuuccag

SEQ ID NO: 559140 - RNA, 16 nt, Coxiella burnetii RSA 493
ugcccucaaaguuuuu

SEQ ID NO: 559141 - RNA, 15 nt, Coxiella burnetii RSA 493
ugccauuugcggaaa

SEQ ID NO: 559142 - RNA, 19 nt, Coxiella burnetii RSA 493
ugccauuugcggaaaagga

SEQ ID NO: 559143 - RNA, 21 nt, Coxiella burnetii RSA 493
ugccauuugcggaaaaggaga

SEQ ID NO: 559144 - RNA, 13 nt, Coxiella burnetii RSA 493
ugcccccccaauu

SEQ ID NO: 559145 - RNA, 19 nt, Coxiella burnetii RSA 493
ugccauuuucauuuucucu

SEQ ID NO: 559146 - RNA, 13 nt, Coxiella burnetii RSA 493
ugccgaguccuau

SEQ ID NO: 559147 - RNA, 16 nt, Coxiella burnetii RSA 493
ugccgauauucuuuuu

SEQ ID NO: 559148 - RNA, 23 nt, Coxiella burnetii RSA 493
ugccgauauucuuuuucuuuauu

SEQ ID NO: 559149 - RNA, 16 nt, Coxiella burnetii RSA 493
ugccgccgaaauuuaa

SEQ ID NO: 559150 - RNA, 15 nt, Coxiella burnetii RSA 493
ugccuacaaauagag

SEQ ID NO: 559151 - RNA, 12 nt, Coxiella burnetii RSA 493
ugccucuuuuug

SEQ ID NO: 559152 - RNA, 21 nt, Coxiella burnetii RSA 493
ugccugcuaggauuuccuuuu

SEQ ID NO: 559153 - RNA, 16 nt, Coxiella burnetii RSA 493
ugccgcuaaaauuuuu

SEQ ID NO: 559154 - RNA, 14 nt, Coxiella burnetii RSA 493
ugcggaaauuucac

SEQ ID NO: 559155 - RNA, 15 nt, Coxiella burnetii RSA 493
ugcggaaauuucaca

SEQ ID NO: 559156 - RNA, 14 nt, Coxiella burnetii RSA 493
ugcggaaaaggaga

SEQ ID NO: 559157 - RNA, 19 nt, Coxiella burnetii RSA 493
ugccuucguaaacuuuacc

SEQ ID NO: 559158 - RNA, 14 nt, Coxiella burnetii RSA 493
ugcgccagaagcgu

SEQ ID NO: 559159 - RNA, 19 nt, Coxiella burnetii RSA 493
ugcgcgauguguaucccaa

SEQ ID NO: 559160 - RNA, 20 nt, Coxiella burnetii RSA 493
ugcgcgcuaaagcgcgcugg

SEQ ID NO: 559161 - RNA, 23 nt, Coxiella burnetii RSA 493
ugcgcgggaaugacgauuaaaaa

SEQ ID NO: 559162 - RNA, 16 nt, Coxiella burnetii RSA 493
ugcugauagcauuguu

SEQ ID NO: 559163 - RNA, 16 nt, Coxiella burnetii RSA 493
ugcucuuuuucauuuc

SEQ ID NO: 559164 - RNA, 19 nt, Coxiella burnetii RSA 493
ugcucuuuuucauuucuuc

SEQ ID NO: 559165 - RNA, 15 nt, Coxiella burnetii RSA 493
ugcuccaaaauaaga

SEQ ID NO: 559166 - RNA, 17 nt, Coxiella burnetii RSA 493
ugcuccaaaauaagaaa

SEQ ID NO: 559167 - RNA, 17 nt, Coxiella burnetii RSA 493
ugcuccgcguuuuucca

SEQ ID NO: 559168 - RNA, 20 nt, Coxiella burnetii RSA 493
ugcuccgcguuuuuccacaa

SEQ ID NO: 559169 - RNA, 21 nt, Coxiella burnetii RSA 493
ugcucguaagucguuuuaaug

SEQ ID NO: 559170 - RNA, 23 nt, Coxiella burnetii RSA 493
ugcucaaguccuugcugaauucc

SEQ ID NO: 559171 - RNA, 21 nt, Coxiella burnetii RSA 493
ugcguuuccgccucaauuuca

SEQ ID NO: 559172 - RNA, 23 nt, Coxiella burnetii RSA 493
ugcucauguagcccaacaaaaug

SEQ ID NO: 559173 - RNA, 16 nt, Coxiella burnetii RSA 493
ugcuuugggauaauuc

SEQ ID NO: 559174 - RNA, 23 nt, Coxiella burnetii RSA 493
ugcuuuucucaacgcuucagaau

SEQ ID NO: 559175 - RNA, 21 nt, Coxiella burnetii RSA 493
ugcuugccgggcgcacuuuaa

SEQ ID NO: 559176 - RNA, 18 nt, Coxiella burnetii RSA 493
ugcuugcacaucuucacg

SEQ ID NO: 559177 - RNA, 12 nt, Coxiella burnetii RSA 493
ugcuucauaccu

SEQ ID NO: 559178 - RNA, 23 nt, Coxiella burnetii RSA 493
ugcuugacgucguuuguauucau

SEQ ID NO: 559179 - RNA, 14 nt, Coxiella burnetii RSA 493
ugcuucaauaaaaa

SEQ ID NO: 559180 - RNA, 19 nt, Coxiella burnetii RSA 493
ugagucgccaauaauaguu

SEQ ID NO: 559181 - RNA, 17 nt, Coxiella burnetii RSA 493
ugaguccgugucguuca

SEQ ID NO: 559182 - RNA, 16 nt, Coxiella burnetii RSA 493
ugagucccauuuacga

SEQ ID NO: 559183 - RNA, 20 nt, Coxiella burnetii RSA 493
ugagucggaaguucuauuuc

SEQ ID NO: 559184 - RNA, 12 nt, Coxiella burnetii RSA 493
ugaguuagcaua

SEQ ID NO: 559185 - RNA, 15 nt, Coxiella burnetii RSA 493
ugauaaaacuugauu

SEQ ID NO: 559186 - RNA, 13 nt, Coxiella burnetii RSA 493
ugauaaaauaaca

SEQ ID NO: 559187 - RNA, 16 nt, Coxiella burnetii RSA 493
ugaguuggauuuguuu

SEQ ID NO: 559188 - RNA, 16 nt, Coxiella burnetii RSA 493
ugaguucgcuaaaagu

SEQ ID NO: 559189 - RNA, 13 nt, Coxiella burnetii RSA 493
ugaguugucauau

SEQ ID NO: 559190 - RNA, 11 nt, Coxiella burnetii RSA 493
ugauaauaauu

SEQ ID NO: 559191 - RNA, 17 nt, Coxiella burnetii RSA 493
ugauaagguaucccuuc

SEQ ID NO: 559192 - RNA, 19 nt, Coxiella burnetii RSA 493
ugauaauccacaauuucaa

SEQ ID NO: 559193 - RNA, 16 nt, Coxiella burnetii RSA 493
ugauaacuauuauuaa

SEQ ID NO: 559194 - RNA, 17 nt, Coxiella burnetii RSA 493
ugauacaaauuuuuaag

SEQ ID NO: 559195 - RNA, 15 nt, Coxiella burnetii RSA 493
ugauacuucuucauu

SEQ ID NO: 559196 - RNA, 18 nt, Coxiella burnetii RSA 493
ugauacugcguuuuucag

SEQ ID NO: 559197 - RNA, 14 nt, Coxiella burnetii RSA 493
ugaucaaguuucuc

SEQ ID NO: 559198 - RNA, 15 nt, Coxiella burnetii RSA 493
ugaucaaguuucucc

SEQ ID NO: 559199 - RNA, 23 nt, Coxiella burnetii RSA 493
ugaucaaugaaacaaacaaaaaa

SEQ ID NO: 559200 - RNA, 14 nt, Coxiella burnetii RSA 493
ugaugaucuaacgu

SEQ ID NO: 559201 - RNA, 17 nt, Coxiella burnetii RSA 493
ugaucugcucuuuugua

SEQ ID NO: 559202 - RNA, 20 nt, Coxiella burnetii RSA 493
ugaucaucaucaaaauuaaa

SEQ ID NO: 559203 - RNA, 20 nt, Coxiella burnetii RSA 493
ugaucguuaauugcuucaau

SEQ ID NO: 559204 - RNA, 18 nt, Coxiella burnetii RSA 493
ugauugggcucaaaaaga

SEQ ID NO: 559205 - RNA, 19 nt, Coxiella burnetii RSA 493
ugcaaacaugcgaaagcaa

SEQ ID NO: 559206 - RNA, 15 nt, Coxiella burnetii RSA 493
ugcaaauaaugagug

SEQ ID NO: 559207 - RNA, 21 nt, Coxiella burnetii RSA 493
ugauucauuaguuugguugaa

SEQ ID NO: 559208 - RNA, 13 nt, Coxiella burnetii RSA 493
ugauugauuuugu

SEQ ID NO: 559209 - RNA, 23 nt, Coxiella burnetii RSA 493
ugauuauagaaugggaaguuuua

SEQ ID NO: 559210 - RNA, 14 nt, Coxiella burnetii RSA 493
ugauuaauuaaugc

SEQ ID NO: 559211 - RNA, 14 nt, Coxiella burnetii RSA 493
ugauuaaaucaaca

SEQ ID NO: 559212 - RNA, 21 nt, Coxiella burnetii RSA 493
ugauuaaacguauuccaaaua

SEQ ID NO: 559213 - RNA, 17 nt, Coxiella burnetii RSA 493
ugcaauuccauuaaaaa

SEQ ID NO: 559214 - RNA, 21 nt, Coxiella burnetii RSA 493
ugcaccauaacuaaaucgcgu

SEQ ID NO: 559215 - RNA, 14 nt, Coxiella burnetii RSA 493
ugcaccauuuuccu

SEQ ID NO: 559216 - RNA, 19 nt, Coxiella burnetii RSA 493
ugcacgccuccagggcuug

SEQ ID NO: 559217 - RNA, 13 nt, Coxiella burnetii RSA 493
ugcaacguccuga

SEQ ID NO: 559218 - RNA, 18 nt, Coxiella burnetii RSA 493
ugcaacggcagaaacgag

SEQ ID NO: 559219 - RNA, 18 nt, Coxiella burnetii RSA 493
ugcaacggucauuuguuc

SEQ ID NO: 559220 - RNA, 15 nt, Coxiella burnetii RSA 493
ugacgugucaucgca

SEQ ID NO: 559221 - RNA, 12 nt, Coxiella burnetii RSA 493
ugacuuccagau

SEQ ID NO: 559222 - RNA, 15 nt, Coxiella burnetii RSA 493
ugacuuauuuuuauu

SEQ ID NO: 559223 - RNA, 18 nt, Coxiella burnetii RSA 493
ugacuuauuuuuauucuu

SEQ ID NO: 559224 - RNA, 14 nt, Coxiella burnetii RSA 493
ugagaguaaauguu

SEQ ID NO: 559225 - RNA, 20 nt, Coxiella burnetii RSA 493
ugagaguagauaacgacaac

SEQ ID NO: 559226 - RNA, 11 nt, Coxiella burnetii RSA 493
ugagcaagcaa

SEQ ID NO: 559227 - RNA, 13 nt, Coxiella burnetii RSA 493
ugagcaagcagaa

SEQ ID NO: 559228 - RNA, 18 nt, Coxiella burnetii RSA 493
ugagcaaagcguuuaugc

SEQ ID NO: 559229 - RNA, 13 nt, Coxiella burnetii RSA 493
ugaccuuuuccuu

SEQ ID NO: 559230 - RNA, 16 nt, Coxiella burnetii RSA 493
ugacgaaugugcucau

SEQ ID NO: 559231 - RNA, 19 nt, Coxiella burnetii RSA 493
ugacgaaagcuaaaaaaga

SEQ ID NO: 559232 - RNA, 14 nt, Coxiella burnetii RSA 493
ugacgauuuuaauu

SEQ ID NO: 559233 - RNA, 14 nt, Coxiella burnetii RSA 493
ugacgcguggcuuu

SEQ ID NO: 559234 - RNA, 16 nt, Coxiella burnetii RSA 493
ugaccaaauaauugau

SEQ ID NO: 559235 - RNA, 16 nt, Coxiella burnetii RSA 493
ugacaucuuaucuaaa

SEQ ID NO: 559236 - RNA, 21 nt, Coxiella burnetii RSA 493
ugacccuuuucaauuucuuuc

SEQ ID NO: 559237 - RNA, 18 nt, Coxiella burnetii RSA 493
ugaagaguaaaaaaccaa

SEQ ID NO: 559238 - RNA, 20 nt, Coxiella burnetii RSA 493
ugaaggaaauuugcauuaau

SEQ ID NO: 559239 - RNA, 20 nt, Coxiella burnetii RSA 493
ugaagcgcggcgaaauacag

SEQ ID NO: 559240 - RNA, 14 nt, Coxiella burnetii RSA 493
ugaauuaaauauaa

SEQ ID NO: 559241 - RNA, 16 nt, Coxiella burnetii RSA 493
ugaaucacuucuucca

SEQ ID NO: 559242 - RNA, 18 nt, Coxiella burnetii RSA 493
ugaaucgaccacuguccc

SEQ ID NO: 559243 - RNA, 19 nt, Coxiella burnetii RSA 493
ugaaugggcgcguauuuaa

SEQ ID NO: 559244 - RNA, 15 nt, Coxiella burnetii RSA 493
ugaaugcguucuuua

SEQ ID NO: 559245 - RNA, 16 nt, Coxiella burnetii RSA 493
ugaaugcguucuuuaa

SEQ ID NO: 559246 - RNA, 18 nt, Coxiella burnetii RSA 493
ugaaugcguucuuuaauc

SEQ ID NO: 559247 - RNA, 18 nt, Coxiella burnetii RSA 493
ugaauauuuuucucuuuc

SEQ ID NO: 559248 - RNA, 17 nt, Coxiella burnetii RSA 493
uccuuaauaaaguuuua

SEQ ID NO: 559249 - RNA, 23 nt, Coxiella burnetii RSA 493
uccuuauacuaaauuguccuuuu

SEQ ID NO: 559250 - RNA, 22 nt, Coxiella burnetii RSA 493
uccuugcaagcugcugacauug

SEQ ID NO: 559251 - RNA, 13 nt, Coxiella burnetii RSA 493
uccuugcaauaag

SEQ ID NO: 559252 - RNA, 23 nt, Coxiella burnetii RSA 493
uccuugcaauaagcuaucagcag

SEQ ID NO: 559253 - RNA, 17 nt, Coxiella burnetii RSA 493
uccuugcucaaguccuu

SEQ ID NO: 559254 - RNA, 23 nt, Coxiella burnetii RSA 493
uccuugcucaaguccuugcugaa

SEQ ID NO: 559255 - RNA, 20 nt, Coxiella burnetii RSA 493
uccuugcugaauucccuuuu

SEQ ID NO: 559256 - RNA, 15 nt, Coxiella burnetii RSA 493
uccuuuuucuuuuaa

SEQ ID NO: 559257 - RNA, 12 nt, Coxiella burnetii RSA 493
uccuuuucauuu

SEQ ID NO: 559258 - RNA, 18 nt, Coxiella burnetii RSA 493
uccuuguugcaauccuuu

SEQ ID NO: 559259 - RNA, 20 nt, Coxiella burnetii RSA 493
uccuuguugaauuccuuguu

SEQ ID NO: 559260 - RNA, 19 nt, Coxiella burnetii RSA 493
uccuuguaauucaaauuuu

SEQ ID NO: 559261 - RNA, 13 nt, Coxiella burnetii RSA 493
uccuuucuuucuu

SEQ ID NO: 559262 - RNA, 17 nt, Coxiella burnetii RSA 493
ucgaagugugauucauu

SEQ ID NO: 559263 - RNA, 22 nt, Coxiella burnetii RSA 493
ucgaagugugauucauuaucau

SEQ ID NO: 559264 - RNA, 23 nt, Coxiella burnetii RSA 493
ucgaagugugauucauuaucaug

SEQ ID NO: 559265 - RNA, 14 nt, Coxiella burnetii RSA 493
ucgauaaauuuuga

SEQ ID NO: 559266 - RNA, 19 nt, Coxiella burnetii RSA 493
ucgauuuuacaauaaucca

SEQ ID NO: 559267 - RNA, 21 nt, Coxiella burnetii RSA 493
ucgauugcuaaagcggaagca

SEQ ID NO: 559268 - RNA, 14 nt, Coxiella burnetii RSA 493
ucgcaccucgccuu

SEQ ID NO: 559269 - RNA, 18 nt, Coxiella burnetii RSA 493
ucgcaaugcuucuucaau

SEQ ID NO: 559270 - RNA, 21 nt, Coxiella burnetii RSA 493
ucgcaauuugaugccauaauu

SEQ ID NO: 559271 - RNA, 16 nt, Coxiella burnetii RSA 493
ucgcacaaugcuuuuc

SEQ ID NO: 559272 - RNA, 22 nt, Coxiella burnetii RSA 493
ucgcaauuaauacauucuucag

SEQ ID NO: 559273 - RNA, 23 nt, Coxiella burnetii RSA 493
ucgcauagccaaccgccauuucg

SEQ ID NO: 559274 - RNA, 15 nt, Coxiella burnetii RSA 493
ucgccguuucugcuu

SEQ ID NO: 559275 - RNA, 21 nt, Coxiella burnetii RSA 493
ucgcuuucaauuacuuuuaua

SEQ ID NO: 559276 - RNA, 15 nt, Coxiella burnetii RSA 493
ucgcuuaaauuuuga

SEQ ID NO: 559277 - RNA, 15 nt, Coxiella burnetii RSA 493
ucgcuuugcggccuc

SEQ ID NO: 559278 - RNA, 19 nt, Coxiella burnetii RSA 493
ucgcuuugcggccucgccu

SEQ ID NO: 559279 - RNA, 13 nt, Coxiella burnetii RSA 493
ucggaucaauuuu

SEQ ID NO: 559280 - RNA, 16 nt, Coxiella burnetii RSA 493
ucggaucaauuuuggu

SEQ ID NO: 559281 - RNA, 20 nt, Coxiella burnetii RSA 493
ucggauacgaccuucugaau

SEQ ID NO: 559282 - RNA, 21 nt, Coxiella burnetii RSA 493
ucgcuguuaauaauagcguau

SEQ ID NO: 559283 - RNA, 14 nt, Coxiella burnetii RSA 493
ucggccuuuuucau

SEQ ID NO: 559284 - RNA, 17 nt, Coxiella burnetii RSA 493
ucggccuuuuucauuuc

SEQ ID NO: 559285 - RNA, 18 nt, Coxiella burnetii RSA 493
ucggcuaaaucuugcugc

SEQ ID NO: 559286 - RNA, 15 nt, Coxiella burnetii RSA 493
ucgggugauugaaaa

SEQ ID NO: 559287 - RNA, 18 nt, Coxiella burnetii RSA 493
ucggcuuuauauguguaa

SEQ ID NO: 559288 - RNA, 16 nt, Coxiella burnetii RSA 493
ucgggaauaaaauaau

SEQ ID NO: 559289 - RNA, 16 nt, Coxiella burnetii RSA 493
ucgggcaccauaucca

SEQ ID NO: 559290 - RNA, 13 nt, Coxiella burnetii RSA 493
ucguaaauauuuu

SEQ ID NO: 559291 - RNA, 17 nt, Coxiella burnetii RSA 493
ucgguuuuuuucuuuuu

SEQ ID NO: 559292 - RNA, 17 nt, Coxiella burnetii RSA 493
ucgguuuuuuuaaaaaa

SEQ ID NO: 559293 - RNA, 18 nt, Coxiella burnetii RSA 493
ucggguucuacaauaauu

SEQ ID NO: 559294 - RNA, 17 nt, Coxiella burnetii RSA 493
ucgguagaaugauacca

SEQ ID NO: 559295 - RNA, 19 nt, Coxiella burnetii RSA 493
ucgguagaaugauaccauc

SEQ ID NO: 559296 - RNA, 23 nt, Coxiella burnetii RSA 493
ucgguagagcaggugacuguuaa

SEQ ID NO: 559297 - RNA, 18 nt, Coxiella burnetii RSA 493
ucguaucgauuucuuuuu

SEQ ID NO: 559298 - RNA, 16 nt, Coxiella burnetii RSA 493
ucguauccaaauauuu

SEQ ID NO: 559299 - RNA, 19 nt, Coxiella burnetii RSA 493
ucguauccaaauauuuaaa

SEQ ID NO: 559300 - RNA, 20 nt, Coxiella burnetii RSA 493
ucguauccaaauauuuaaau

SEQ ID NO: 559301 - RNA, 19 nt, Coxiella burnetii RSA 493
ucguccccguauuucgcuu

SEQ ID NO: 559302 - RNA, 15 nt, Coxiella burnetii RSA 493
ucuaauaauuuuuua

SEQ ID NO: 559303 - RNA, 22 nt, Coxiella burnetii RSA 493
ucuaaaguacuagcaucaauaa

SEQ ID NO: 559304 - RNA, 19 nt, Coxiella burnetii RSA 493
ucuaaaaaccccaacucuu

SEQ ID NO: 559305 - RNA, 22 nt, Coxiella burnetii RSA 493
ucuaacuuugauaagcauaauu

SEQ ID NO: 559306 - RNA, 15 nt, Coxiella burnetii RSA 493
ucguuuuuuaauauu

SEQ ID NO: 559307 - RNA, 21 nt, Coxiella burnetii RSA 493
ucguuucgaaaaauuauuaau

SEQ ID NO: 559308 - RNA, 18 nt, Coxiella burnetii RSA 493
ucguuuacuuguugcgga

SEQ ID NO: 559309 - RNA, 20 nt, Coxiella burnetii RSA 493
ucguucgaagguauuuugcg

SEQ ID NO: 559310 - RNA, 21 nt, Coxiella burnetii RSA 493
ucguuauugcucaucucuaac

SEQ ID NO: 559311 - RNA, 22 nt, Coxiella burnetii RSA 493
ucguuaaaaccuuuuuuuucaa

SEQ ID NO: 559312 - RNA, 14 nt, Coxiella burnetii RSA 493
ucugaucaaaaaua

SEQ ID NO: 559313 - RNA, 15 nt, Coxiella burnetii RSA 493
ucugaucaaaaauaa

SEQ ID NO: 559314 - RNA, 22 nt, Coxiella burnetii RSA 493
ucugauaggaauucuuuuucau

SEQ ID NO: 559315 - RNA, 16 nt, Coxiella burnetii RSA 493
ucugacguuaucacuu

SEQ ID NO: 559316 - RNA, 20 nt, Coxiella burnetii RSA 493
ucugaaaauaauugaggaaa

SEQ ID NO: 559317 - RNA, 18 nt, Coxiella burnetii RSA 493
ucucuuuuuuugcgcccg

SEQ ID NO: 559318 - RNA, 21 nt, Coxiella burnetii RSA 493
ucucuuucauaauuuuauaaa

SEQ ID NO: 559319 - RNA, 20 nt, Coxiella burnetii RSA 493
ucucucuaagauaucuguuu

SEQ ID NO: 559320 - RNA, 22 nt, Coxiella burnetii RSA 493
ucucuuauugcccucguuuuau

SEQ ID NO: 559321 - RNA, 16 nt, Coxiella burnetii RSA 493
ucucuugcccccauug

SEQ ID NO: 559322 - RNA, 18 nt, Coxiella burnetii RSA 493
ucuccagcuuauacugcc

SEQ ID NO: 559323 - RNA, 13 nt, Coxiella burnetii RSA 493
ucucguucuuuua

SEQ ID NO: 559324 - RNA, 14 nt, Coxiella burnetii RSA 493
ucucuaaugauaau

SEQ ID NO: 559325 - RNA, 17 nt, Coxiella burnetii RSA 493
ucugcuaggauuuuuua

SEQ ID NO: 559326 - RNA, 20 nt, Coxiella burnetii RSA 493
ucuggcucagugauuaaauu

SEQ ID NO: 559327 - RNA, 17 nt, Coxiella burnetii RSA 493
ucugucaucaucgucaa

SEQ ID NO: 559328 - RNA, 22 nt, Coxiella burnetii RSA 493
ucugucaucaucgucaaaugga

SEQ ID NO: 559329 - RNA, 17 nt, Coxiella burnetii RSA 493
ucuucacgcauuuccca

SEQ ID NO: 559330 - RNA, 11 nt, Coxiella burnetii RSA 493
ucuucaucuuu

SEQ ID NO: 559331 - RNA, 20 nt, Coxiella burnetii RSA 493
ucuuccacggaguuuucauu

SEQ ID NO: 559332 - RNA, 21 nt, Coxiella burnetii RSA 493
ucuucaaaagugauuuuucuu

SEQ ID NO: 559333 - RNA, 12 nt, Coxiella burnetii RSA 493
ucuucaauggca

SEQ ID NO: 559334 - RNA, 21 nt, Coxiella burnetii RSA 493
ucuucaacgccagcuuccuuc

SEQ ID NO: 559335 - RNA, 20 nt, Coxiella burnetii RSA 493
ucuucaacuccugaaaaaua

SEQ ID NO: 559336 - RNA, 23 nt, Coxiella burnetii RSA 493
ucuucaacuccugaaaaauaauu

SEQ ID NO: 559337 - RNA, 14 nt, Coxiella burnetii RSA 493
ucuuaucuaaaaac

SEQ ID NO: 559338 - RNA, 21 nt, Coxiella burnetii RSA 493
ucuuauaaucuuaucaauggg

SEQ ID NO: 559339 - RNA, 21 nt, Coxiella burnetii RSA 493
ucuuaccaugguuccagaaac

SEQ ID NO: 559340 - RNA, 19 nt, Coxiella burnetii RSA 493
ucuuuccagcuucccgaua

SEQ ID NO: 559341 - RNA, 17 nt, Coxiella burnetii RSA 493
ucuuucccgacuguuca

SEQ ID NO: 559342 - RNA, 15 nt, Coxiella burnetii RSA 493
ucuuucacuaaaaga

SEQ ID NO: 559343 - RNA, 17 nt, Coxiella burnetii RSA 493
ucuuucacuaaaagaac

SEQ ID NO: 559344 - RNA, 18 nt, Coxiella burnetii RSA 493
ucuuuauuauaaaaaaaa

SEQ ID NO: 559345 - RNA, 21 nt, Coxiella burnetii RSA 493
ucuucccauguccauccgcua

SEQ ID NO: 559346 - RNA, 17 nt, Coxiella burnetii RSA 493
ucuugcugcuuuugaau

SEQ ID NO: 559347 - RNA, 21 nt, Coxiella burnetii RSA 493
ucuuuaacuuuagcuaauucu

SEQ ID NO: 559348 - RNA, 20 nt, Coxiella burnetii RSA 493
ucuuguuucuggcguaagcg

SEQ ID NO: 559349 - RNA, 14 nt, Coxiella burnetii RSA 493
ucuuguuccauguc

SEQ ID NO: 559350 - RNA, 19 nt, Coxiella burnetii RSA 493
ucuuguuccaugucuugaa

SEQ ID NO: 559351 - RNA, 19 nt, Coxiella burnetii RSA 493
ucuuggagauuuagccaaa

SEQ ID NO: 559352 - RNA, 15 nt, Coxiella burnetii RSA 493
ucuuugaugugaaaa

SEQ ID NO: 559353 - RNA, 17 nt, Coxiella burnetii RSA 493
ucuuuggguauaaauaa

SEQ ID NO: 559354 - RNA, 16 nt, Coxiella burnetii RSA 493
ucuuuuaauucauaaa

SEQ ID NO: 559355 - RNA, 14 nt, Coxiella burnetii RSA 493
ucuuuuaauugauc

SEQ ID NO: 559356 - RNA, 21 nt, Coxiella burnetii RSA 493
ucuuuuaaaacgccaaaaccg

SEQ ID NO: 559357 - RNA, 14 nt, Coxiella burnetii RSA 493
ucuuuguagauucu

SEQ ID NO: 559358 - RNA, 16 nt, Coxiella burnetii RSA 493
ucuuuguagauucuuu

SEQ ID NO: 559359 - RNA, 23 nt, Coxiella burnetii RSA 493
ucuuugugagucgccaauaauag

SEQ ID NO: 559360 - RNA, 22 nt, Coxiella burnetii RSA 493
ucuuuuaugucguucaauucug

SEQ ID NO: 559361 - RNA, 19 nt, Coxiella burnetii RSA 493
ucuuuuagagccucaaagu

SEQ ID NO: 559362 - RNA, 16 nt, Coxiella burnetii RSA 493
ugaaaaaauuaaauau

SEQ ID NO: 559363 - RNA, 18 nt, Coxiella burnetii RSA 493
ugaaaaaauugauaaucu

SEQ ID NO: 559364 - RNA, 15 nt, Coxiella burnetii RSA 493
ucuuuuucuccuuuu

SEQ ID NO: 559365 - RNA, 16 nt, Coxiella burnetii RSA 493
ucuuuuucuccuuuuc

SEQ ID NO: 559366 - RNA, 15 nt, Coxiella burnetii RSA 493
ucuuuuugcaaauaa

SEQ ID NO: 559367 - RNA, 12 nt, Coxiella burnetii RSA 493
ucuuuuuuaaua

SEQ ID NO: 559368 - RNA, 21 nt, Coxiella burnetii RSA 493
ucuuuucugaaacaucaauac

SEQ ID NO: 559369 - RNA, 22 nt, Coxiella burnetii RSA 493
ugaaagaauuucucgauaaaaa

SEQ ID NO: 559370 - RNA, 16 nt, Coxiella burnetii RSA 493
ugaaaguaguuuggug

SEQ ID NO: 559371 - RNA, 16 nt, Coxiella burnetii RSA 493
ugaaaguagaaaacuu

SEQ ID NO: 559372 - RNA, 18 nt, Coxiella burnetii RSA 493
ugaaaguuucauaagucc

SEQ ID NO: 559373 - RNA, 12 nt, Coxiella burnetii RSA 493
ugaaauaaacag

SEQ ID NO: 559374 - RNA, 20 nt, Coxiella burnetii RSA 493
ugaaacuaagcauuaaaaaa

SEQ ID NO: 559375 - RNA, 19 nt, Coxiella burnetii RSA 493
ugaaaaugucauucaagag

SEQ ID NO: 559376 - RNA, 15 nt, Coxiella burnetii RSA 493
ugaaaauaauugagg

SEQ ID NO: 559377 - RNA, 14 nt, Coxiella burnetii RSA 493
ugaaaaguaaauuu

SEQ ID NO: 559378 - RNA, 15 nt, Coxiella burnetii RSA 493
ugaaaaguaaauuua

SEQ ID NO: 559379 - RNA, 21 nt, Coxiella burnetii RSA 493
ugaaaagugguaagcuugcuu

SEQ ID NO: 559380 - RNA, 12 nt, Coxiella burnetii RSA 493
ugaaaaguaaau

SEQ ID NO: 559381 - RNA, 19 nt, Coxiella burnetii RSA 493
ugaaaacgacuuauuuuau

SEQ ID NO: 559382 - RNA, 20 nt, Coxiella burnetii RSA 493
ugaaaacgauagucucuaua

SEQ ID NO: 559383 - RNA, 21 nt, Coxiella burnetii RSA 493
ugaaaaacuuccgccacuaag

SEQ ID NO: 559384 - RNA, 14 nt, Coxiella burnetii RSA 493
ugaaccuaaauuau

SEQ ID NO: 559385 - RNA, 21 nt, Coxiella burnetii RSA 493
ugaacaggagcgauaaaauaa

SEQ ID NO: 559386 - RNA, 17 nt, Coxiella burnetii RSA 493
ugaacaggauuuucauu

SEQ ID NO: 559387 - RNA, 15 nt, Coxiella burnetii RSA 493
ugaaauucuuguccu

SEQ ID NO: 559388 - RNA, 20 nt, Coxiella burnetii RSA 493
ugaaauucuuguccuuuaua

SEQ ID NO: 559389 - RNA, 19 nt, Coxiella burnetii RSA 493
ugaacaaaagccaugcguu

SEQ ID NO: 559390 - RNA, 18 nt, Coxiella burnetii RSA 493
ugaaauuuuuuuucuucu

SEQ ID NO: 559391 - RNA, 12 nt, Coxiella burnetii RSA 493
ugaaauuuuaua

SEQ ID NO: 559392 - RNA, 23 nt, Coxiella burnetii RSA 493
ugaaauagccauuaauaaagugc

SEQ ID NO: 559393 - RNA, 21 nt, Coxiella burnetii RSA 493
ugaaaucccgagccccaaaac

SEQ ID NO: 559394 - RNA, 19 nt, Coxiella burnetii RSA 493
ugaaaucguuuuguuuuaa

SEQ ID NO: 559395 - RNA, 16 nt, Coxiella burnetii RSA 493
gggaaggcaaugauaa

SEQ ID NO: 559396 - RNA, 17 nt, Coxiella burnetii RSA 493
gggaaucgacuuucuca

SEQ ID NO: 559397 - RNA, 20 nt, Coxiella burnetii RSA 493
gggacuuuaagcacuucuuu

SEQ ID NO: 559398 - RNA, 13 nt, Coxiella burnetii RSA 493
gggacgaccgcgg

SEQ ID NO: 559399 - RNA, 14 nt, Coxiella burnetii RSA 493
ggcuucauauaaag

SEQ ID NO: 559400 - RNA, 13 nt, Coxiella burnetii RSA 493
gggagauaggacu

SEQ ID NO: 559401 - RNA, 16 nt, Coxiella burnetii RSA 493
gggcaaaaaaagaaaa

SEQ ID NO: 559402 - RNA, 13 nt, Coxiella burnetii RSA 493
gggcaacuaaagg

SEQ ID NO: 559403 - RNA, 15 nt, Coxiella burnetii RSA 493
gggccgguucuuuuc

SEQ ID NO: 559404 - RNA, 19 nt, Coxiella burnetii RSA 493
gggcuacuuccuucuuguc

SEQ ID NO: 559405 - RNA, 19 nt, Coxiella burnetii RSA 493
gggcuacuugaaaaccuac

SEQ ID NO: 559406 - RNA, 15 nt, Coxiella burnetii RSA 493
gggcuacuuuacuuu

SEQ ID NO: 559407 - RNA, 16 nt, Coxiella burnetii RSA 493
gggguuuaauugcaug

SEQ ID NO: 559408 - RNA, 15 nt, Coxiella burnetii RSA 493
gggguuagcuuccau

SEQ ID NO: 559409 - RNA, 16 nt, Coxiella burnetii RSA 493
gggguuagcuuccauu

SEQ ID NO: 559410 - RNA, 23 nt, Coxiella burnetii RSA 493
gggguucauuuuuuuugccgcgg

SEQ ID NO: 559411 - RNA, 14 nt, Coxiella burnetii RSA 493
ggggugaauuuuug

SEQ ID NO: 559412 - RNA, 21 nt, Coxiella burnetii RSA 493
ggucaauuucaaugacuuuaa

SEQ ID NO: 559413 - RNA, 18 nt, Coxiella burnetii RSA 493
gguauuuccuugcgcuga

SEQ ID NO: 559414 - RNA, 23 nt, Coxiella burnetii RSA 493
gguauuuuuucccgcaacauggc

SEQ ID NO: 559415 - RNA, 17 nt, Coxiella burnetii RSA 493
gguauuuugcguaaaug

SEQ ID NO: 559416 - RNA, 17 nt, Coxiella burnetii RSA 493
gguagcccgaaaaagua

SEQ ID NO: 559417 - RNA, 17 nt, Coxiella burnetii RSA 493
ggucauuuguucuauca

SEQ ID NO: 559418 - RNA, 14 nt, Coxiella burnetii RSA 493
ggugagaagaauaa

SEQ ID NO: 559419 - RNA, 15 nt, Coxiella burnetii RSA 493
ggucucaacagccuu

SEQ ID NO: 559420 - RNA, 23 nt, Coxiella burnetii RSA 493
ggucggggguucaagucccuccc

SEQ ID NO: 559421 - RNA, 21 nt, Coxiella burnetii RSA 493
gguggccauuauauuuguauc

SEQ ID NO: 559422 - RNA, 23 nt, Coxiella burnetii RSA 493
gguggccguaucuauuugcauag

SEQ ID NO: 559423 - RNA, 14 nt, Coxiella burnetii RSA 493
ggugcccuagugag

SEQ ID NO: 559424 - RNA, 17 nt, Coxiella burnetii RSA 493
gguucauuuuuuuugcc

SEQ ID NO: 559425 - RNA, 15 nt, Coxiella burnetii RSA 493
gguuaaggaaaagca

SEQ ID NO: 559426 - RNA, 17 nt, Coxiella burnetii RSA 493
gguuaauucuucuucau

SEQ ID NO: 559427 - RNA, 22 nt, Coxiella burnetii RSA 493
gguuagcaaugggaacuuuuaa

SEQ ID NO: 559428 - RNA, 18 nt, Coxiella burnetii RSA 493
gguuuuuuuaaaaaagaa

SEQ ID NO: 559429 - RNA, 22 nt, Coxiella burnetii RSA 493
gguuuuuuuaaaaaagaaaaua

SEQ ID NO: 559430 - RNA, 18 nt, Coxiella burnetii RSA 493
gguuuuuuucuuuuugcc

SEQ ID NO: 559431 - RNA, 17 nt, Coxiella burnetii RSA 493
gguuuuuuuugaaauua

SEQ ID NO: 559432 - RNA, 16 nt, Coxiella burnetii RSA 493
gguugaaagaaaaaaa

SEQ ID NO: 559433 - RNA, 15 nt, Coxiella burnetii RSA 493
guaauucaaauuuua

SEQ ID NO: 559434 - RNA, 13 nt, Coxiella burnetii RSA 493
guaauucaucauu

SEQ ID NO: 559435 - RNA, 17 nt, Coxiella burnetii RSA 493
guaauucaucauuuucc

SEQ ID NO: 559436 - RNA, 21 nt, Coxiella burnetii RSA 493
guaauucuugcagugaaauaa

SEQ ID NO: 559437 - RNA, 22 nt, Coxiella burnetii RSA 493
guaauugcuugguugauucaau

SEQ ID NO: 559438 - RNA, 13 nt, Coxiella burnetii RSA 493
guaaucaauugcu

SEQ ID NO: 559439 - RNA, 16 nt, Coxiella burnetii RSA 493
guacacaaaauuucaa

SEQ ID NO: 559440 - RNA, 14 nt, Coxiella burnetii RSA 493
guaauuuaucccac

SEQ ID NO: 559441 - RNA, 20 nt, Coxiella burnetii RSA 493
guaauuucucgaaugacaac

SEQ ID NO: 559442 - RNA, 18 nt, Coxiella burnetii RSA 493
guacagguuguuugcuua

SEQ ID NO: 559443 - RNA, 22 nt, Coxiella burnetii RSA 493
guacugaaaaguaaaaguccuc

SEQ ID NO: 559444 - RNA, 17 nt, Coxiella burnetii RSA 493
guagcccgaaaaaguag

SEQ ID NO: 559445 - RNA, 19 nt, Coxiella burnetii RSA 493
guagcaacgccuuucccuc

SEQ ID NO: 559446 - RNA, 19 nt, Coxiella burnetii RSA 493
guagauuuuaaauaccauu

SEQ ID NO: 559447 - RNA, 12 nt, Coxiella burnetii RSA 493
guauccauccca

SEQ ID NO: 559448 - RNA, 15 nt, Coxiella burnetii RSA 493
guauuaacauuugga

SEQ ID NO: 559449 - RNA, 15 nt, Coxiella burnetii RSA 493
guaucuuucauguaa

SEQ ID NO: 559450 - RNA, 16 nt, Coxiella burnetii RSA 493
guaugaauaauuuuuu

SEQ ID NO: 559451 - RNA, 22 nt, Coxiella burnetii RSA 493
guaucuauuugcauaggagaua

SEQ ID NO: 559452 - RNA, 17 nt, Coxiella burnetii RSA 493
gucacgaauuuuuucag

SEQ ID NO: 559453 - RNA, 22 nt, Coxiella burnetii RSA 493
gucacccaaaucauggcgguga

SEQ ID NO: 559454 - RNA, 14 nt, Coxiella burnetii RSA 493
gucacaugauuuuu

SEQ ID NO: 559455 - RNA, 14 nt, Coxiella burnetii RSA 493
gucaaaccaaucac

SEQ ID NO: 559456 - RNA, 20 nt, Coxiella burnetii RSA 493
guauuccuuuuucuuuuaau

SEQ ID NO: 559457 - RNA, 17 nt, Coxiella burnetii RSA 493
guauugaguuuuugaca

SEQ ID NO: 559458 - RNA, 14 nt, Coxiella burnetii RSA 493
guauuccaaauaau

SEQ ID NO: 559459 - RNA, 19 nt, Coxiella burnetii RSA 493
guauuccgccuuaaaacau

SEQ ID NO: 559460 - RNA, 17 nt, Coxiella burnetii RSA 493
guauuuaaucucgauuu

SEQ ID NO: 559461 - RNA, 21 nt, Coxiella burnetii RSA 493
guauuuaggggugaauuuuug

SEQ ID NO: 559462 - RNA, 22 nt, Coxiella burnetii RSA 493
guauuuaggggugaauuuuugc

SEQ ID NO: 559463 - RNA, 15 nt, Coxiella burnetii RSA 493
guauuuaucauccug

SEQ ID NO: 559464 - RNA, 17 nt, Coxiella burnetii RSA 493
guauuggaugguucuuu

SEQ ID NO: 559465 - RNA, 18 nt, Coxiella burnetii RSA 493
guauuguaauuugggcug

SEQ ID NO: 559466 - RNA, 13 nt, Coxiella burnetii RSA 493
guauuuuguagau

SEQ ID NO: 559467 - RNA, 17 nt, Coxiella burnetii RSA 493
guauuuugcaaaugaau

SEQ ID NO: 559468 - RNA, 20 nt, Coxiella burnetii RSA 493
guccaauuauaacuauuuua

SEQ ID NO: 559469 - RNA, 19 nt, Coxiella burnetii RSA 493
gucaucgucguuaucuauu

SEQ ID NO: 559470 - RNA, 16 nt, Coxiella burnetii RSA 493
gucaucgccaaaaggu

SEQ ID NO: 559471 - RNA, 21 nt, Coxiella burnetii RSA 493
gucauauuaauauuaaaacaa

SEQ ID NO: 559472 - RNA, 20 nt, Coxiella burnetii RSA 493
gucccaaaaaacuuagccaa

SEQ ID NO: 559473 - RNA, 16 nt, Coxiella burnetii RSA 493
gucuaguuauuuuuca

SEQ ID NO: 559474 - RNA, 22 nt, Coxiella burnetii RSA 493
gucguauuccuuuuucuuuuaa

SEQ ID NO: 559475 - RNA, 11 nt, Coxiella burnetii RSA 493
gucgguaaaac

SEQ ID NO: 559476 - RNA, 20 nt, Coxiella burnetii RSA 493
gucugucguuucugauuuuu

SEQ ID NO: 559477 - RNA, 23 nt, Coxiella burnetii RSA 493
gucugucguuucugauuuuugaa

SEQ ID NO: 559478 - RNA, 18 nt, Coxiella burnetii RSA 493
gucuguuuacaauucgcu

SEQ ID NO: 559479 - RNA, 13 nt, Coxiella burnetii RSA 493
gucuuaauuucua

SEQ ID NO: 559480 - RNA, 20 nt, Coxiella burnetii RSA 493
gucuuaauuucuaaaaauca

SEQ ID NO: 559481 - RNA, 22 nt, Coxiella burnetii RSA 493
gucugggaugguaaucucacuu

SEQ ID NO: 559482 - RNA, 21 nt, Coxiella burnetii RSA 493
gucuggccugccacaaucacu

SEQ ID NO: 559483 - RNA, 22 nt, Coxiella burnetii RSA 493
gucugauaggaauucuuuuuca

SEQ ID NO: 559484 - RNA, 14 nt, Coxiella burnetii RSA 493
gucugcauuuuuaa

SEQ ID NO: 559485 - RNA, 16 nt, Coxiella burnetii RSA 493
gucucuauaucuuuua

SEQ ID NO: 559486 - RNA, 22 nt, Coxiella burnetii RSA 493
gucucuauaucuuuuaaauuaa

SEQ ID NO: 559487 - RNA, 15 nt, Coxiella burnetii RSA 493
gucucguuagaaaag

SEQ ID NO: 559488 - RNA, 15 nt, Coxiella burnetii RSA 493
gucucuuuuuuugcg

SEQ ID NO: 559489 - RNA, 13 nt, Coxiella burnetii RSA 493
gucugaaaauaau

SEQ ID NO: 559490 - RNA, 14 nt, Coxiella burnetii RSA 493
gucuugcacauugc

SEQ ID NO: 559491 - RNA, 15 nt, Coxiella burnetii RSA 493
gucuugcacauugca

SEQ ID NO: 559492 - RNA, 14 nt, Coxiella burnetii RSA 493
gucuuuuauuuuca

SEQ ID NO: 559493 - RNA, 17 nt, Coxiella burnetii RSA 493
gucuuuuuuucuuguug

SEQ ID NO: 559494 - RNA, 21 nt, Coxiella burnetii RSA 493
gucuuugcuaagauaauuaca

SEQ ID NO: 559495 - RNA, 18 nt, Coxiella burnetii RSA 493
gucuuugguuuuccauga

SEQ ID NO: 559496 - RNA, 15 nt, Coxiella burnetii RSA 493
gucuuuaauacaagg

SEQ ID NO: 559497 - RNA, 11 nt, Coxiella burnetii RSA 493
gugaagaaccc

SEQ ID NO: 559498 - RNA, 20 nt, Coxiella burnetii RSA 493
gugaaauaaccugagggaau

SEQ ID NO: 559499 - RNA, 13 nt, Coxiella burnetii RSA 493
gugaaaguuucau

SEQ ID NO: 559500 - RNA, 15 nt, Coxiella burnetii RSA 493
gugaaugaucgaugg

SEQ ID NO: 559501 - RNA, 17 nt, Coxiella burnetii RSA 493
gugagacucaguggcag

SEQ ID NO: 559502 - RNA, 15 nt, Coxiella burnetii RSA 493
gugacgaggaaagau

SEQ ID NO: 559503 - RNA, 19 nt, Coxiella burnetii RSA 493
gugauaauugauaguucau

SEQ ID NO: 559504 - RNA, 14 nt, Coxiella burnetii RSA 493
gugagcaauaucug

SEQ ID NO: 559505 - RNA, 21 nt, Coxiella burnetii RSA 493
gugcagcugauuucugguuga

SEQ ID NO: 559506 - RNA, 13 nt, Coxiella burnetii RSA 493
gugauuucuucca

SEQ ID NO: 559507 - RNA, 22 nt, Coxiella burnetii RSA 493
gugcaaaaaaggcggaccuuug

SEQ ID NO: 559508 - RNA, 12 nt, Coxiella burnetii RSA 493
gugcccaagaac

SEQ ID NO: 559509 - RNA, 14 nt, Coxiella burnetii RSA 493
gugccaguauuuuu

SEQ ID NO: 559510 - RNA, 15 nt, Coxiella burnetii RSA 493
gugcaugguaacgca

SEQ ID NO: 559511 - RNA, 15 nt, Coxiella burnetii RSA 493
guggaagguugagaa

SEQ ID NO: 559512 - RNA, 19 nt, Coxiella burnetii RSA 493
guggcagcuucuuuaaaau

SEQ ID NO: 559513 - RNA, 14 nt, Coxiella burnetii RSA 493
guggaauuaaauau

SEQ ID NO: 559514 - RNA, 23 nt, Coxiella burnetii RSA 493
guggcguacaagugcuuccaagu

SEQ ID NO: 559515 - RNA, 13 nt, Coxiella burnetii RSA 493
guggcaguuaaau

SEQ ID NO: 559516 - RNA, 15 nt, Coxiella burnetii RSA 493
guggcaguuaaauuu

SEQ ID NO: 559517 - RNA, 15 nt, Coxiella burnetii RSA 493
gugucauaaauaaaa

SEQ ID NO: 559518 - RNA, 13 nt, Coxiella burnetii RSA 493
guguagaaagaaa

SEQ ID NO: 559519 - RNA, 18 nt, Coxiella burnetii RSA 493
guuaagauaauaauuaua

SEQ ID NO: 559520 - RNA, 15 nt, Coxiella burnetii RSA 493
guuaaggaaaagcac

SEQ ID NO: 559521 - RNA, 12 nt, Coxiella burnetii RSA 493
guuaaaacacau

SEQ ID NO: 559522 - RNA, 13 nt, Coxiella burnetii RSA 493
guuaaaauaauga

SEQ ID NO: 559523 - RNA, 11 nt, Coxiella burnetii RSA 493
guguuuuucaa

SEQ ID NO: 559524 - RNA, 20 nt, Coxiella burnetii RSA 493
guguucacaagucucagaau

SEQ ID NO: 559525 - RNA, 16 nt, Coxiella burnetii RSA 493
guuauccaugagcagu

SEQ ID NO: 559526 - RNA, 15 nt, Coxiella burnetii RSA 493
guuaguuucuuuuau

SEQ ID NO: 559527 - RNA, 14 nt, Coxiella burnetii RSA 493
guuauuuauuuuuc

SEQ ID NO: 559528 - RNA, 13 nt, Coxiella burnetii RSA 493
guuauuuuuaaaa

SEQ ID NO: 559529 - RNA, 23 nt, Coxiella burnetii RSA 493
guuauuuuuaaaagauuuuaucu

SEQ ID NO: 559530 - RNA, 16 nt, Coxiella burnetii RSA 493
guuauuuuuuccuauu

SEQ ID NO: 559531 - RNA, 19 nt, Coxiella burnetii RSA 493
guucaagcacuaguuuuac

SEQ ID NO: 559532 - RNA, 20 nt, Coxiella burnetii RSA 493
guucaagcacuaguuuuacu

SEQ ID NO: 559533 - RNA, 21 nt, Coxiella burnetii RSA 493
guucacaagucucagaaucug

SEQ ID NO: 559534 - RNA, 17 nt, Coxiella burnetii RSA 493
guuauugggauuuaccu

SEQ ID NO: 559535 - RNA, 15 nt, Coxiella burnetii RSA 493
guuauuaagcguucc

SEQ ID NO: 559536 - RNA, 12 nt, Coxiella burnetii RSA 493
guuaugagacuu

SEQ ID NO: 559537 - RNA, 17 nt, Coxiella burnetii RSA 493
guuaugauguuuuaaaa

SEQ ID NO: 559538 - RNA, 19 nt, Coxiella burnetii RSA 493
guuaugauguuuuaaaauu

SEQ ID NO: 559539 - RNA, 16 nt, Coxiella burnetii RSA 493
guucaccccauuucaa

SEQ ID NO: 559540 - RNA, 12 nt, Coxiella burnetii RSA 493
guucaugaaaaa

SEQ ID NO: 559541 - RNA, 16 nt, Coxiella burnetii RSA 493
guuccaugucuugaac

SEQ ID NO: 559542 - RNA, 15 nt, Coxiella burnetii RSA 493
guuccgccauuuccc

SEQ ID NO: 559543 - RNA, 23 nt, Coxiella burnetii RSA 493
guucuaucaauauggaacccguu

SEQ ID NO: 559544 - RNA, 12 nt, Coxiella burnetii RSA 493
guuccuuacucc

SEQ ID NO: 559545 - RNA, 14 nt, Coxiella burnetii RSA 493
guuccuugaauaaa

SEQ ID NO: 559546 - RNA, 20 nt, Coxiella burnetii RSA 493
guuccuuuuuauaaaugauu

SEQ ID NO: 559547 - RNA, 14 nt, Coxiella burnetii RSA 493
guucguaauaauaa

SEQ ID NO: 559548 - RNA, 19 nt, Coxiella burnetii RSA 493
guucgggucguucuuuucc

SEQ ID NO: 559549 - RNA, 15 nt, Coxiella burnetii RSA 493
guucgagauuauuca

SEQ ID NO: 559550 - RNA, 15 nt, Coxiella burnetii RSA 493
guuucgguuucguuc

SEQ ID NO: 559551 - RNA, 13 nt, Coxiella burnetii RSA 493
guuucguggcuuc

SEQ ID NO: 559552 - RNA, 13 nt, Coxiella burnetii RSA 493
guuuccaaauaau

SEQ ID NO: 559553 - RNA, 23 nt, Coxiella burnetii RSA 493
guuuccaauuguuugaaaaaaua

SEQ ID NO: 559554 - RNA, 19 nt, Coxiella burnetii RSA 493
guuucggauuuugaacagu

SEQ ID NO: 559555 - RNA, 13 nt, Coxiella burnetii RSA 493
guuucaaauuucu

SEQ ID NO: 559556 - RNA, 19 nt, Coxiella burnetii RSA 493
guuuauuugagaauaaaac

SEQ ID NO: 559557 - RNA, 15 nt, Coxiella burnetii RSA 493
guuuauuugaucgcc

SEQ ID NO: 559558 - RNA, 20 nt, Coxiella burnetii RSA 493
guuuaauugcauguuugcug

SEQ ID NO: 559559 - RNA, 21 nt, Coxiella burnetii RSA 493
guuguuagcuuuucuuuaaac

SEQ ID NO: 559560 - RNA, 19 nt, Coxiella burnetii RSA 493
guuuaagcugauacaccau

SEQ ID NO: 559561 - RNA, 20 nt, Coxiella burnetii RSA 493
guuguccuuggaacaaacca

SEQ ID NO: 559562 - RNA, 16 nt, Coxiella burnetii RSA 493
guuucugguuuccuuu

SEQ ID NO: 559563 - RNA, 20 nt, Coxiella burnetii RSA 493
guuugccauuacgcauguca

SEQ ID NO: 559564 - RNA, 14 nt, Coxiella burnetii RSA 493
guuuucagauuuuu

SEQ ID NO: 559565 - RNA, 16 nt, Coxiella burnetii RSA 493
guuuuauuuaaaaaac

SEQ ID NO: 559566 - RNA, 17 nt, Coxiella burnetii RSA 493
guuuuauuuauaauuua

SEQ ID NO: 559567 - RNA, 19 nt, Coxiella burnetii RSA 493
guuuucuauccagaaacca

SEQ ID NO: 559568 - RNA, 18 nt, Coxiella burnetii RSA 493
guuuuccgcuaaauauuu

SEQ ID NO: 559569 - RNA, 14 nt, Coxiella burnetii RSA 493
guuuuaagaaaaac

SEQ ID NO: 559570 - RNA, 20 nt, Coxiella burnetii RSA 493
guuuuaaccugaaaaaauua

SEQ ID NO: 559571 - RNA, 17 nt, Coxiella burnetii RSA 493
guuuuaaguuuuuugcu

SEQ ID NO: 559572 - RNA, 17 nt, Coxiella burnetii RSA 493
guuuuacugccuacaaa

SEQ ID NO: 559573 - RNA, 19 nt, Coxiella burnetii RSA 493
guuuuaccuuacuuucauc

SEQ ID NO: 559574 - RNA, 13 nt, Coxiella burnetii RSA 493
guuuugaugaaaa

SEQ ID NO: 559575 - RNA, 11 nt, Coxiella burnetii RSA 493
guuuuggcugc

SEQ ID NO: 559576 - RNA, 12 nt, Coxiella burnetii RSA 493
guuuuggcugca

SEQ ID NO: 559577 - RNA, 13 nt, Coxiella burnetii RSA 493
guuuugguucgug

SEQ ID NO: 559578 - RNA, 22 nt, Coxiella burnetii RSA 493
guuuugcauccgaacuaauggu

SEQ ID NO: 559579 - RNA, 22 nt, Coxiella burnetii RSA 493
guuuuucgcaacgauaaaauua

SEQ ID NO: 559580 - RNA, 18 nt, Coxiella burnetii RSA 493
guuuuucgguuucuucaa

SEQ ID NO: 559581 - RNA, 12 nt, Coxiella burnetii RSA 493
guuuuuccuuuu

SEQ ID NO: 559582 - RNA, 15 nt, Coxiella burnetii RSA 493
guuuuuccuuuuauu

SEQ ID NO: 559583 - RNA, 17 nt, Coxiella burnetii RSA 493
guuuuuccacaaaauaa

SEQ ID NO: 559584 - RNA, 18 nt, Coxiella burnetii RSA 493
guuuuugacaagcuucuc

SEQ ID NO: 559585 - RNA, 17 nt, Coxiella burnetii RSA 493
guuuuugauugccaaag

SEQ ID NO: 559586 - RNA, 15 nt, Coxiella burnetii RSA 493
guuuuuugcauuuuu

SEQ ID NO: 559587 - RNA, 17 nt, Coxiella burnetii RSA 493
guuuuuuuaaaaaagaa

SEQ ID NO: 559588 - RNA, 12 nt, Coxiella burnetii RSA 493
guuuuuuuaaac

SEQ ID NO: 559589 - RNA, 14 nt, Coxiella burnetii RSA 493
guuuuuuucuuuuu

SEQ ID NO: 559590 - RNA, 18 nt, Coxiella burnetii RSA 493
guuuuuuucuuuuugcca

SEQ ID NO: 559591 - RNA, 12 nt, Coxiella burnetii RSA 493
guuuuuucuagg

SEQ ID NO: 559592 - RNA, 14 nt, Coxiella burnetii RSA 493
uaaaaaauaagaaa

SEQ ID NO: 559593 - RNA, 11 nt, Coxiella burnetii RSA 493
uaaaaaagaaa

SEQ ID NO: 559594 - RNA, 21 nt, Coxiella burnetii RSA 493
uaaaaaaccaauaccaauuca

SEQ ID NO: 559595 - RNA, 14 nt, Coxiella burnetii RSA 493
uaaaaaauucaaua

SEQ ID NO: 559596 - RNA, 12 nt, Coxiella burnetii RSA 493
uaaaaaauucau

SEQ ID NO: 559597 - RNA, 18 nt, Coxiella burnetii RSA 493
uaaaaccuuguuauaaaa

SEQ ID NO: 559598 - RNA, 21 nt, Coxiella burnetii RSA 493
uaaaaccuuguuauaaaacuu

SEQ ID NO: 559599 - RNA, 22 nt, Coxiella burnetii RSA 493
uaaaacuuuguagaccaaucga

SEQ ID NO: 559600 - RNA, 20 nt, Coxiella burnetii RSA 493
uaaaacgauauuaucaaaac

SEQ ID NO: 559601 - RNA, 21 nt, Coxiella burnetii RSA 493
uaaaacuucccauucuauaau

SEQ ID NO: 559602 - RNA, 20 nt, Coxiella burnetii RSA 493
uaaaacuugauuauucaauu

SEQ ID NO: 559603 - RNA, 21 nt, Coxiella burnetii RSA 493
uaaaacuugauuauucaauuu

SEQ ID NO: 559604 - RNA, 21 nt, Coxiella burnetii RSA 493
uaaaaguccuguucuuuucaa

SEQ ID NO: 559605 - RNA, 22 nt, Coxiella burnetii RSA 493
uaaaaguuacgccccaaaguuc

SEQ ID NO: 559606 - RNA, 15 nt, Coxiella burnetii RSA 493
uaaaagugacaaugc

SEQ ID NO: 559607 - RNA, 15 nt, Coxiella burnetii RSA 493
uaaaauacuuaaaau

SEQ ID NO: 559608 - RNA, 17 nt, Coxiella burnetii RSA 493
uaacccuuucauuuaau

SEQ ID NO: 559609 - RNA, 20 nt, Coxiella burnetii RSA 493
uaaccgcugacgucagaaaa

SEQ ID NO: 559610 - RNA, 16 nt, Coxiella burnetii RSA 493
uaacgaagguuucaua

SEQ ID NO: 559611 - RNA, 19 nt, Coxiella burnetii RSA 493
uaacgcuccaguauuucau

SEQ ID NO: 559612 - RNA, 17 nt, Coxiella burnetii RSA 493
uaacccucgauuuaccg

SEQ ID NO: 559613 - RNA, 13 nt, Coxiella burnetii RSA 493
uaacauuaucaug

SEQ ID NO: 559614 - RNA, 13 nt, Coxiella burnetii RSA 493
uaaccaaaacuau

SEQ ID NO: 559615 - RNA, 14 nt, Coxiella burnetii RSA 493
uaacagcaagagga

SEQ ID NO: 559616 - RNA, 17 nt, Coxiella burnetii RSA 493
uaacacccuuuaguaaa

SEQ ID NO: 559617 - RNA, 21 nt, Coxiella burnetii RSA 493
uaacacccuuuaguaaaacua

SEQ ID NO: 559618 - RNA, 15 nt, Coxiella burnetii RSA 493
uaaauuuuauaaauu

SEQ ID NO: 559619 - RNA, 15 nt, Coxiella burnetii RSA 493
uaaauuuucccaugu

SEQ ID NO: 559620 - RNA, 18 nt, Coxiella burnetii RSA 493
uaaauugcucuuuuucca

SEQ ID NO: 559621 - RNA, 12 nt, Coxiella burnetii RSA 493
uaaauuaauauu

SEQ ID NO: 559622 - RNA, 14 nt, Coxiella burnetii RSA 493
uaaauuaauauuau

SEQ ID NO: 559623 - RNA, 20 nt, Coxiella burnetii RSA 493
uaaauuaauuauccaaaauc

SEQ ID NO: 559624 - RNA, 22 nt, Coxiella burnetii RSA 493
uaaauuaauuauccaaaaucca

SEQ ID NO: 559625 - RNA, 16 nt, Coxiella burnetii RSA 493
uaaauuaguaauauuu

SEQ ID NO: 559626 - RNA, 14 nt, Coxiella burnetii RSA 493
uaaauuauaaaugg

SEQ ID NO: 559627 - RNA, 23 nt, Coxiella burnetii RSA 493
uaaauuauuuuaauaugauaaaa

SEQ ID NO: 559628 - RNA, 15 nt, Coxiella burnetii RSA 493
uaaaguaauuuuaaa

SEQ ID NO: 559629 - RNA, 22 nt, Coxiella burnetii RSA 493
uaaaguugccgguauuuugcaa

SEQ ID NO: 559630 - RNA, 13 nt, Coxiella burnetii RSA 493
uaaagguuuucuu

SEQ ID NO: 559631 - RNA, 20 nt, Coxiella burnetii RSA 493
uaaagguggcgcuuuaauuu

SEQ ID NO: 559632 - RNA, 16 nt, Coxiella burnetii RSA 493
uaaauagcauuaauaa

SEQ ID NO: 559633 - RNA, 23 nt, Coxiella burnetii RSA 493
uaaauagcauuucguauaauuca

SEQ ID NO: 559634 - RNA, 13 nt, Coxiella burnetii RSA 493
uaaauaaugaaua

SEQ ID NO: 559635 - RNA, 18 nt, Coxiella burnetii RSA 493
uaaauauuuuuauuucca

SEQ ID NO: 559636 - RNA, 21 nt, Coxiella burnetii RSA 493
uaaauauccgcaauaugcagc

SEQ ID NO: 559637 - RNA, 16 nt, Coxiella burnetii RSA 493
uaaauuaaaaaucggu

SEQ ID NO: 559638 - RNA, 19 nt, Coxiella burnetii RSA 493
uaaauguuucuuuuauaaa

SEQ ID NO: 559639 - RNA, 19 nt, Coxiella burnetii RSA 493
uaaaugcgucaugaaauaa

SEQ ID NO: 559640 - RNA, 14 nt, Coxiella burnetii RSA 493
uaaaugcuuuucuu

SEQ ID NO: 559641 - RNA, 19 nt, Coxiella burnetii RSA 493
uaaaugcuuuucuuucauu

SEQ ID NO: 559642 - RNA, 13 nt, Coxiella burnetii RSA 493
uaaaugaauaaua

SEQ ID NO: 559643 - RNA, 13 nt, Coxiella burnetii RSA 493
uaaaugaauuacu

SEQ ID NO: 559644 - RNA, 20 nt, Coxiella burnetii RSA 493
uaaaugaauuacuuucagua

SEQ ID NO: 559645 - RNA, 21 nt, Coxiella burnetii RSA 493
uaaaucuuuggguauaaauaa

SEQ ID NO: 559646 - RNA, 23 nt, Coxiella burnetii RSA 493
uaaaucuuuggguauaaauaacu

SEQ ID NO: 559647 - RNA, 18 nt, Coxiella burnetii RSA 493
uaaagagggacuauaaag

SEQ ID NO: 559648 - RNA, 18 nt, Coxiella burnetii RSA 493
uaaagcagguugcuuuug

SEQ ID NO: 559649 - RNA, 22 nt, Coxiella burnetii RSA 493
uaaagcgcgcuggauucccgcc

SEQ ID NO: 559650 - RNA, 15 nt, Coxiella burnetii RSA 493
uauuacauauuucuu

SEQ ID NO: 559651 - RNA, 17 nt, Coxiella burnetii RSA 493
uauuaaucauucuccag

SEQ ID NO: 559652 - RNA, 20 nt, Coxiella burnetii RSA 493
uauuaauccuuauacuaaau

SEQ ID NO: 559653 - RNA, 15 nt, Coxiella burnetii RSA 493
uauuaacauuuggau

SEQ ID NO: 559654 - RNA, 16 nt, Coxiella burnetii RSA 493
uauuaacauuuggauu

SEQ ID NO: 559655 - RNA, 18 nt, Coxiella burnetii RSA 493
uauuaauacaggaaaaag

SEQ ID NO: 559656 - RNA, 17 nt, Coxiella burnetii RSA 493
uauuaagcguuccuuuc

SEQ ID NO: 559657 - RNA, 17 nt, Coxiella burnetii RSA 493
uauuauccgguuuugau

SEQ ID NO: 559658 - RNA, 16 nt, Coxiella burnetii RSA 493
uauuauucauaucuuu

SEQ ID NO: 559659 - RNA, 12 nt, Coxiella burnetii RSA 493
uauuauaaaaaa

SEQ ID NO: 559660 - RNA, 20 nt, Coxiella burnetii RSA 493
uauuauaaaaaaaaguuuag

SEQ ID NO: 559661 - RNA, 14 nt, Coxiella burnetii RSA 493
uauuagucuuaauu

SEQ ID NO: 559662 - RNA, 21 nt, Coxiella burnetii RSA 493
uauuaguggaauuaaauaucc

SEQ ID NO: 559663 - RNA, 14 nt, Coxiella burnetii RSA 493
uauuagccuuaauu

SEQ ID NO: 559664 - RNA, 17 nt, Coxiella burnetii RSA 493
uauuagccuuaauuucu

SEQ ID NO: 559665 - RNA, 19 nt, Coxiella burnetii RSA 493
uauuagccuuaauuucuaa

SEQ ID NO: 559666 - RNA, 14 nt, Coxiella burnetii RSA 493
uauuagcugccauu

SEQ ID NO: 559667 - RNA, 15 nt, Coxiella burnetii RSA 493
uauuagcuggcagau

SEQ ID NO: 559668 - RNA, 21 nt, Coxiella burnetii RSA 493
uauucuuaauuuuuccuuucu

SEQ ID NO: 559669 - RNA, 19 nt, Coxiella burnetii RSA 493
uauucuucuagaaaaccca

SEQ ID NO: 559670 - RNA, 14 nt, Coxiella burnetii RSA 493
uauucuucaauacu

SEQ ID NO: 559671 - RNA, 14 nt, Coxiella burnetii RSA 493
uauugaaaaaaacg

SEQ ID NO: 559672 - RNA, 20 nt, Coxiella burnetii RSA 493
uauucuuuuucuuuauuugg

SEQ ID NO: 559673 - RNA, 14 nt, Coxiella burnetii RSA 493
uauuccuuuuucuu

SEQ ID NO: 559674 - RNA, 11 nt, Coxiella burnetii RSA 493
uauucgcucca

SEQ ID NO: 559675 - RNA, 12 nt, Coxiella burnetii RSA 493
uauucgcuccau

SEQ ID NO: 559676 - RNA, 21 nt, Coxiella burnetii RSA 493
uauucgguuuuuuuaaaaaag

SEQ ID NO: 559677 - RNA, 20 nt, Coxiella burnetii RSA 493
uauucgguaacguuucacaa

SEQ ID NO: 559678 - RNA, 20 nt, Coxiella burnetii RSA 493
uauucuaacuuugauaagca

SEQ ID NO: 559679 - RNA, 17 nt, Coxiella burnetii RSA 493
uauucaagguuauuuuu

SEQ ID NO: 559680 - RNA, 21 nt, Coxiella burnetii RSA 493
uauucaauaggguagucagga

SEQ ID NO: 559681 - RNA, 22 nt, Coxiella burnetii RSA 493
uauucauauugcgcguaaauuu

SEQ ID NO: 559682 - RNA, 14 nt, Coxiella burnetii RSA 493
uauucauuaaauau

SEQ ID NO: 559683 - RNA, 14 nt, Coxiella burnetii RSA 493
uauucccgccauca

SEQ ID NO: 559684 - RNA, 17 nt, Coxiella burnetii RSA 493
uauucccgccaucacca

SEQ ID NO: 559685 - RNA, 21 nt, Coxiella burnetii RSA 493
uauucccgccaucaccacaau

SEQ ID NO: 559686 - RNA, 19 nt, Coxiella burnetii RSA 493
uauucccucuuuaccuccu

SEQ ID NO: 559687 - RNA, 20 nt, Coxiella burnetii RSA 493
uauugauccggcuuuugauu

SEQ ID NO: 559688 - RNA, 15 nt, Coxiella burnetii RSA 493
uauugauuuaaauuu

SEQ ID NO: 559689 - RNA, 17 nt, Coxiella burnetii RSA 493
uauugauuuaaauuuaa

SEQ ID NO: 559690 - RNA, 14 nt, Coxiella burnetii RSA 493
uauugccaaaauuu

SEQ ID NO: 559691 - RNA, 13 nt, Coxiella burnetii RSA 493
uauugcuaaaauc

SEQ ID NO: 559692 - RNA, 16 nt, Coxiella burnetii RSA 493
uauuuacugagaaaac

SEQ ID NO: 559693 - RNA, 18 nt, Coxiella burnetii RSA 493
uauuuacgaguuaacuuu

SEQ ID NO: 559694 - RNA, 21 nt, Coxiella burnetii RSA 493
uauuuaagugauaauuauaag

SEQ ID NO: 559695 - RNA, 17 nt, Coxiella burnetii RSA 493
uauuuaauuuuauuauu

SEQ ID NO: 559696 - RNA, 15 nt, Coxiella burnetii RSA 493
uauugucauguucaa

SEQ ID NO: 559697 - RNA, 17 nt, Coxiella burnetii RSA 493
uauuugcuuucuuugaa

SEQ ID NO: 559698 - RNA, 22 nt, Coxiella burnetii RSA 493
uauuugcaauagucacgagaua

SEQ ID NO: 559699 - RNA, 15 nt, Coxiella burnetii RSA 493
uauuugaaauagcca

SEQ ID NO: 559700 - RNA, 14 nt, Coxiella burnetii RSA 493
uauuucuuuugauu

SEQ ID NO: 559701 - RNA, 14 nt, Coxiella burnetii RSA 493
uauuucuuuugccu

SEQ ID NO: 559702 - RNA, 19 nt, Coxiella burnetii RSA 493
uauuuuaaguaauuuuacu

SEQ ID NO: 559703 - RNA, 17 nt, Coxiella burnetii RSA 493
uauuuuaauaugauaaa

SEQ ID NO: 559704 - RNA, 23 nt, Coxiella burnetii RSA 493
uauuuguucguaauaauaagcgu

SEQ ID NO: 559705 - RNA, 20 nt, Coxiella burnetii RSA 493
uauuucaccuucuucuuugg

SEQ ID NO: 559706 - RNA, 15 nt, Coxiella burnetii RSA 493
uauuucgucagugaa

SEQ ID NO: 559707 - RNA, 15 nt, Coxiella burnetii RSA 493
uauuucguuccauga

SEQ ID NO: 559708 - RNA, 18 nt, Coxiella burnetii RSA 493
uauuucgcuucgcuacau

SEQ ID NO: 559709 - RNA, 18 nt, Coxiella burnetii RSA 493
uauuuaucauguggucuc

SEQ ID NO: 559710 - RNA, 16 nt, Coxiella burnetii RSA 493
uauuuauuuauugacu

SEQ ID NO: 559711 - RNA, 16 nt, Coxiella burnetii RSA 493
uauuuauuuuucucuu

SEQ ID NO: 559712 - RNA, 19 nt, Coxiella burnetii RSA 493
ucaaaaguugaugaucuaa

SEQ ID NO: 559713 - RNA, 19 nt, Coxiella burnetii RSA 493
ucaaaacaaucaaugcagu

SEQ ID NO: 559714 - RNA, 21 nt, Coxiella burnetii RSA 493
ucaaaaaaccauaaauggaua

SEQ ID NO: 559715 - RNA, 14 nt, Coxiella burnetii RSA 493
uauuuuuuggaaug

SEQ ID NO: 559716 - RNA, 16 nt, Coxiella burnetii RSA 493
uauuuuucucuucuuu

SEQ ID NO: 559717 - RNA, 22 nt, Coxiella burnetii RSA 493
uauuuuuuaaaucugacguuau

SEQ ID NO: 559718 - RNA, 11 nt, Coxiella burnetii RSA 493
uauuuuucauc

SEQ ID NO: 559719 - RNA, 16 nt, Coxiella burnetii RSA 493
uauuuuuauucuucug

SEQ ID NO: 559720 - RNA, 14 nt, Coxiella burnetii RSA 493
uauuuucauucuca

SEQ ID NO: 559721 - RNA, 21 nt, Coxiella burnetii RSA 493
ucaaagacaucggauaaugcu

SEQ ID NO: 559722 - RNA, 22 nt, Coxiella burnetii RSA 493
ucaaagaacgccagucauuuuc

SEQ ID NO: 559723 - RNA, 13 nt, Coxiella burnetii RSA 493
ucaaagaaauaau

SEQ ID NO: 559724 - RNA, 14 nt, Coxiella burnetii RSA 493
ucaaagaaauaauc

SEQ ID NO: 559725 - RNA, 16 nt, Coxiella burnetii RSA 493
ucaaagaaauaaucau

SEQ ID NO: 559726 - RNA, 19 nt, Coxiella burnetii RSA 493
ucaaagcgccuaagccgcu

SEQ ID NO: 559727 - RNA, 18 nt, Coxiella burnetii RSA 493
ucaaagaaacgauuaaaa

SEQ ID NO: 559728 - RNA, 11 nt, Coxiella burnetii RSA 493
ucaaaccaauc

SEQ ID NO: 559729 - RNA, 17 nt, Coxiella burnetii RSA 493
ucaaacguccuucucca

SEQ ID NO: 559730 - RNA, 22 nt, Coxiella burnetii RSA 493
ucaagacucaaagaaauaauca

SEQ ID NO: 559731 - RNA, 21 nt, Coxiella burnetii RSA 493
ucaagcccgcagcgcccacuu

SEQ ID NO: 559732 - RNA, 23 nt, Coxiella burnetii RSA 493
ucaacggaucguacuuggaaaau

SEQ ID NO: 559733 - RNA, 14 nt, Coxiella burnetii RSA 493
ucaacgucaaaacc

SEQ ID NO: 559734 - RNA, 16 nt, Coxiella burnetii RSA 493
ucaaccgguuuuucuu

SEQ ID NO: 559735 - RNA, 19 nt, Coxiella burnetii RSA 493
ucaaccucagguuuuaccu

SEQ ID NO: 559736 - RNA, 15 nt, Coxiella burnetii RSA 493
ucaaccucagucugu

SEQ ID NO: 559737 - RNA, 22 nt, Coxiella burnetii RSA 493
ucaaccgcaugaauuaaauaua

SEQ ID NO: 559738 - RNA, 16 nt, Coxiella burnetii RSA 493
ucaacgcuucagaauc

SEQ ID NO: 559739 - RNA, 14 nt, Coxiella burnetii RSA 493
ucaaaucaauaauc

SEQ ID NO: 559740 - RNA, 17 nt, Coxiella burnetii RSA 493
ucaaaugaacuuucuua

SEQ ID NO: 559741 - RNA, 11 nt, Coxiella burnetii RSA 493
ucaaaugaaua

SEQ ID NO: 559742 - RNA, 13 nt, Coxiella burnetii RSA 493
ucaaaugaccaaa

SEQ ID NO: 559743 - RNA, 17 nt, Coxiella burnetii RSA 493
ucaaauuaaaauaaucc

SEQ ID NO: 559744 - RNA, 23 nt, Coxiella burnetii RSA 493
ucaaauuuuccgugcagaaacaa

SEQ ID NO: 559745 - RNA, 22 nt, Coxiella burnetii RSA 493
ucaaauucagccguuauaaagu

SEQ ID NO: 559746 - RNA, 18 nt, Coxiella burnetii RSA 493
ucaacaaaauuuuucaug

SEQ ID NO: 559747 - RNA, 21 nt, Coxiella burnetii RSA 493
ucaacaaaauuuuucaugccu

SEQ ID NO: 559748 - RNA, 18 nt, Coxiella burnetii RSA 493
ucaacaaacgaauggccc

SEQ ID NO: 559749 - RNA, 17 nt, Coxiella burnetii RSA 493
ucaacaucaaccccagc

SEQ ID NO: 559750 - RNA, 21 nt, Coxiella burnetii RSA 493
ucaaccaauccuacuuucgua

SEQ ID NO: 559751 - RNA, 13 nt, Coxiella burnetii RSA 493
ucaacaccccaau

SEQ ID NO: 559752 - RNA, 21 nt, Coxiella burnetii RSA 493
ucaacaccccaauuuuuggcu

SEQ ID NO: 559753 - RNA, 18 nt, Coxiella burnetii RSA 493
ucaacagaacaacugcgc

SEQ ID NO: 559754 - RNA, 16 nt, Coxiella burnetii RSA 493
ucaauauauucgcuaa

SEQ ID NO: 559755 - RNA, 22 nt, Coxiella burnetii RSA 493
ucaauauauucgcuaagcuuag

SEQ ID NO: 559756 - RNA, 15 nt, Coxiella burnetii RSA 493
ucaaucaaauccuuu

SEQ ID NO: 559757 - RNA, 13 nt, Coxiella burnetii RSA 493
ucaauauuucuug

SEQ ID NO: 559758 - RNA, 15 nt, Coxiella burnetii RSA 493
ucaauaccaagcuca

SEQ ID NO: 559759 - RNA, 16 nt, Coxiella burnetii RSA 493
ucaauacuacagcaca

SEQ ID NO: 559760 - RNA, 18 nt, Coxiella burnetii RSA 493
ucaagcgaacgcggccuu

SEQ ID NO: 559761 - RNA, 22 nt, Coxiella burnetii RSA 493
ucaaguccuugcugaauucccu

SEQ ID NO: 559762 - RNA, 23 nt, Coxiella burnetii RSA 493
ucaaguggcuccgauaagugaau

SEQ ID NO: 559763 - RNA, 13 nt, Coxiella burnetii RSA 493
ucaaguguauuuu

SEQ ID NO: 559764 - RNA, 15 nt, Coxiella burnetii RSA 493
ucaaguguauuuuca

SEQ ID NO: 559765 - RNA, 15 nt, Coxiella burnetii RSA 493
ucaauaaaaauauac

SEQ ID NO: 559766 - RNA, 15 nt, Coxiella burnetii RSA 493
ucacaaauuauauca

SEQ ID NO: 559767 - RNA, 16 nt, Coxiella burnetii RSA 493
ucacaaaagguaaaaa

SEQ ID NO: 559768 - RNA, 19 nt, Coxiella burnetii RSA 493
ucaauuuuuuugauaggau

SEQ ID NO: 559769 - RNA, 20 nt, Coxiella burnetii RSA 493
ucaauuuugcgcucauuuuc

SEQ ID NO: 559770 - RNA, 18 nt, Coxiella burnetii RSA 493
ucaauuucgggugauaau

SEQ ID NO: 559771 - RNA, 18 nt, Coxiella burnetii RSA 493
ucaauuucaacgccucuc

SEQ ID NO: 559772 - RNA, 17 nt, Coxiella burnetii RSA 493
ucaauuucaauuagaau

SEQ ID NO: 559773 - RNA, 19 nt, Coxiella burnetii RSA 493
ucaauuucaauuagaaugc

SEQ ID NO: 559774 - RNA, 17 nt, Coxiella burnetii RSA 493
ucaauucgcuuaaauuu

SEQ ID NO: 559775 - RNA, 21 nt, Coxiella burnetii RSA 493
ucaauucgcuuaaauuuugac

SEQ ID NO: 559776 - RNA, 19 nt, Coxiella burnetii RSA 493
ucaauuccgauaagcguuu

SEQ ID NO: 559777 - RNA, 13 nt, Coxiella burnetii RSA 493
ucaauugcuuucc

SEQ ID NO: 559778 - RNA, 17 nt, Coxiella burnetii RSA 493
ucaauuacuuuuauaau

SEQ ID NO: 559779 - RNA, 18 nt, Coxiella burnetii RSA 493
ucaaucgcagcauuuuuc

SEQ ID NO: 559780 - RNA, 15 nt, Coxiella burnetii RSA 493
ucaaucguguagaaa

SEQ ID NO: 559781 - RNA, 14 nt, Coxiella burnetii RSA 493
ucaauggcuuuauu

SEQ ID NO: 559782 - RNA, 20 nt, Coxiella burnetii RSA 493
ucacaagucucagaaucugu

SEQ ID NO: 559783 - RNA, 20 nt, Coxiella burnetii RSA 493
ucacaaguguggauuaucuu

SEQ ID NO: 559784 - RNA, 18 nt, Coxiella burnetii RSA 493
ucacaaguucuucuaaag

SEQ ID NO: 559785 - RNA, 21 nt, Coxiella burnetii RSA 493
ucacaaguucuucuaaagaau

SEQ ID NO: 559786 - RNA, 14 nt, Coxiella burnetii RSA 493
ucacaccaagaaau

SEQ ID NO: 559787 - RNA, 14 nt, Coxiella burnetii RSA 493
ucaccaaaauacag

SEQ ID NO: 559788 - RNA, 21 nt, Coxiella burnetii RSA 493
ucaccagacguacaaggaaug

SEQ ID NO: 559789 - RNA, 18 nt, Coxiella burnetii RSA 493
ucaccguuuucuauccag

SEQ ID NO: 559790 - RNA, 13 nt, Coxiella burnetii RSA 493
ucacgaacgcuuu

SEQ ID NO: 559791 - RNA, 14 nt, Coxiella burnetii RSA 493
ucacgaauuaaaaa

SEQ ID NO: 559792 - RNA, 21 nt, Coxiella burnetii RSA 493
ucacgauuuuucucaucauuu

SEQ ID NO: 559793 - RNA, 13 nt, Coxiella burnetii RSA 493
ucacuucugcgcu

SEQ ID NO: 559794 - RNA, 14 nt, Coxiella burnetii RSA 493
ucacuugauaauca

SEQ ID NO: 559795 - RNA, 14 nt, Coxiella burnetii RSA 493
ucacuuuauuuuca

SEQ ID NO: 559796 - RNA, 16 nt, Coxiella burnetii RSA 493
ucacuuuauuuucaua

SEQ ID NO: 559797 - RNA, 22 nt, Coxiella burnetii RSA 493
ucacguuaucauucuuauccuu

SEQ ID NO: 559798 - RNA, 20 nt, Coxiella burnetii RSA 493
ucacuaugaucaugccuuuu

SEQ ID NO: 559799 - RNA, 14 nt, Coxiella burnetii RSA 493
ucacuacaaauucu

SEQ ID NO: 559800 - RNA, 18 nt, Coxiella burnetii RSA 493
ucacucgcaaaaauuuca

SEQ ID NO: 559801 - RNA, 22 nt, Coxiella burnetii RSA 493
ucacucggccugggcaaggcau

SEQ ID NO: 559802 - RNA, 13 nt, Coxiella burnetii RSA 493
ucagacuugcuuu

SEQ ID NO: 559803 - RNA, 20 nt, Coxiella burnetii RSA 493
ucagcauucccauagaagaa

SEQ ID NO: 559804 - RNA, 20 nt, Coxiella burnetii RSA 493
ucagcagaaaagaugguugg

SEQ ID NO: 559805 - RNA, 18 nt, Coxiella burnetii RSA 493
ucagcagaggugagagca

SEQ ID NO: 559806 - RNA, 18 nt, Coxiella burnetii RSA 493
uaucacuagcuauucuuu

SEQ ID NO: 559807 - RNA, 20 nt, Coxiella burnetii RSA 493
uaucacuagcuauucuuuug

SEQ ID NO: 559808 - RNA, 19 nt, Coxiella burnetii RSA 493
uaucacgccaaucuagcau

SEQ ID NO: 559809 - RNA, 18 nt, Coxiella burnetii RSA 493
uauauuuguauccgcuuu

SEQ ID NO: 559810 - RNA, 14 nt, Coxiella burnetii RSA 493
uauauuucauucgg

SEQ ID NO: 559811 - RNA, 17 nt, Coxiella burnetii RSA 493
uauaguucauuaaauuu

SEQ ID NO: 559812 - RNA, 17 nt, Coxiella burnetii RSA 493
uauaaucauuuuuccua

SEQ ID NO: 559813 - RNA, 18 nt, Coxiella burnetii RSA 493
uauauaagcuuucaauaa

SEQ ID NO: 559814 - RNA, 13 nt, Coxiella burnetii RSA 493
uauccuauucuuu

SEQ ID NO: 559815 - RNA, 18 nt, Coxiella burnetii RSA 493
uauccgguuuugauuuuu

SEQ ID NO: 559816 - RNA, 14 nt, Coxiella burnetii RSA 493
uauccaugaaagga

SEQ ID NO: 559817 - RNA, 23 nt, Coxiella burnetii RSA 493
uauccaugccauaaugccuccuu

SEQ ID NO: 559818 - RNA, 18 nt, Coxiella burnetii RSA 493
uauccaaauauuuaaauu

SEQ ID NO: 559819 - RNA, 14 nt, Coxiella burnetii RSA 493
uauccaaaaagaua

SEQ ID NO: 559820 - RNA, 15 nt, Coxiella burnetii RSA 493
uauccaaaaagauaa

SEQ ID NO: 559821 - RNA, 22 nt, Coxiella burnetii RSA 493
uaucauucuuauccuuacaaaa

SEQ ID NO: 559822 - RNA, 14 nt, Coxiella burnetii RSA 493
uaucgccguuucug

SEQ ID NO: 559823 - RNA, 18 nt, Coxiella burnetii RSA 493
uauccucacaaauuauau

SEQ ID NO: 559824 - RNA, 12 nt, Coxiella burnetii RSA 493
uauccucagaag

SEQ ID NO: 559825 - RNA, 15 nt, Coxiella burnetii RSA 493
uauccucagaaguuu

SEQ ID NO: 559826 - RNA, 16 nt, Coxiella burnetii RSA 493
uaucgguaauuuguuu

SEQ ID NO: 559827 - RNA, 13 nt, Coxiella burnetii RSA 493
uaucggcuucaca

SEQ ID NO: 559828 - RNA, 16 nt, Coxiella burnetii RSA 493
uaucguaaauauuuuu

SEQ ID NO: 559829 - RNA, 12 nt, Coxiella burnetii RSA 493
uaucguuuucac

SEQ ID NO: 559830 - RNA, 12 nt, Coxiella burnetii RSA 493
uaucguuuucau

SEQ ID NO: 559831 - RNA, 14 nt, Coxiella burnetii RSA 493
uauguguaacaaaa

SEQ ID NO: 559832 - RNA, 18 nt, Coxiella burnetii RSA 493
uaugucguucaauucugg

SEQ ID NO: 559833 - RNA, 14 nt, Coxiella burnetii RSA 493
uauggauaauuccg

SEQ ID NO: 559834 - RNA, 14 nt, Coxiella burnetii RSA 493
uauggauaguuuca

SEQ ID NO: 559835 - RNA, 21 nt, Coxiella burnetii RSA 493
uauggauaguuucaaauuucu

SEQ ID NO: 559836 - RNA, 13 nt, Coxiella burnetii RSA 493
uaugcuucaauaa

SEQ ID NO: 559837 - RNA, 13 nt, Coxiella burnetii RSA 493
uaucugcuaaaaa

SEQ ID NO: 559838 - RNA, 15 nt, Coxiella burnetii RSA 493
uaucugcuaaaaagc

SEQ ID NO: 559839 - RNA, 17 nt, Coxiella burnetii RSA 493
uaucuuucauguaauuu

SEQ ID NO: 559840 - RNA, 21 nt, Coxiella burnetii RSA 493
uaugaauaauuuuuuuaauuu

SEQ ID NO: 559841 - RNA, 12 nt, Coxiella burnetii RSA 493
uaugaaucagcu

SEQ ID NO: 559842 - RNA, 13 nt, Coxiella burnetii RSA 493
uaugaaugcugga

SEQ ID NO: 559843 - RNA, 12 nt, Coxiella burnetii RSA 493
uaugaaaacaua

SEQ ID NO: 559844 - RNA, 13 nt, Coxiella burnetii RSA 493
uaugaaaacauac

SEQ ID NO: 559845 - RNA, 22 nt, Coxiella burnetii RSA 493
uaugaaaacgacuuauuuuaua

SEQ ID NO: 559846 - RNA, 14 nt, Coxiella burnetii RSA 493
uagaaaacuuucag

SEQ ID NO: 559847 - RNA, 12 nt, Coxiella burnetii RSA 493
uagaaaaucaaa

SEQ ID NO: 559848 - RNA, 19 nt, Coxiella burnetii RSA 493
uagaugacaucauuguuuu

SEQ ID NO: 559849 - RNA, 14 nt, Coxiella burnetii RSA 493
uagauuuuccugcu

SEQ ID NO: 559850 - RNA, 11 nt, Coxiella burnetii RSA 493
uagauuuuaaa

SEQ ID NO: 559851 - RNA, 17 nt, Coxiella burnetii RSA 493
uagauuagaaaaagcga

SEQ ID NO: 559852 - RNA, 21 nt, Coxiella burnetii RSA 493
uagcauuguuggaaauaaugg

SEQ ID NO: 559853 - RNA, 19 nt, Coxiella burnetii RSA 493
uagcaucuugaaucauuga

SEQ ID NO: 559854 - RNA, 17 nt, Coxiella burnetii RSA 493
uagccauugguuuaaaa

SEQ ID NO: 559855 - RNA, 19 nt, Coxiella burnetii RSA 493
uagccauugguuuaaaaag

SEQ ID NO: 559856 - RNA, 20 nt, Coxiella burnetii RSA 493
uagcauuucguauaauucac

SEQ ID NO: 559857 - RNA, 15 nt, Coxiella burnetii RSA 493
uagcccacacuaaag

SEQ ID NO: 559858 - RNA, 16 nt, Coxiella burnetii RSA 493
uagcccgaaaaaguag

SEQ ID NO: 559859 - RNA, 15 nt, Coxiella burnetii RSA 493
uagcguaaucaucaa

SEQ ID NO: 559860 - RNA, 21 nt, Coxiella burnetii RSA 493
uagccgaauguuuaaauuaau

SEQ ID NO: 559861 - RNA, 16 nt, Coxiella burnetii RSA 493
uagcccguaugcagcg

SEQ ID NO: 559862 - RNA, 11 nt, Coxiella burnetii RSA 493
uagcccuugcg

SEQ ID NO: 559863 - RNA, 17 nt, Coxiella burnetii RSA 493
uaggauuuuuuauccaa

SEQ ID NO: 559864 - RNA, 23 nt, Coxiella burnetii RSA 493
uaggauuuccuuuucauuuugau

SEQ ID NO: 559865 - RNA, 14 nt, Coxiella burnetii RSA 493
uaggagaucuuuua

SEQ ID NO: 559866 - RNA, 22 nt, Coxiella burnetii RSA 493
uaggccgccucgugggcccagu

SEQ ID NO: 559867 - RNA, 14 nt, Coxiella burnetii RSA 493
uagcuauucuuuug

SEQ ID NO: 559868 - RNA, 16 nt, Coxiella burnetii RSA 493
uauaaggucuuaauuu

SEQ ID NO: 559869 - RNA, 17 nt, Coxiella burnetii RSA 493
uauaaguccaagacuga

SEQ ID NO: 559870 - RNA, 22 nt, Coxiella burnetii RSA 493
uauaaguugucagcguuuuccg

SEQ ID NO: 559871 - RNA, 11 nt, Coxiella burnetii RSA 493
uauaacuauuu

SEQ ID NO: 559872 - RNA, 14 nt, Coxiella burnetii RSA 493
uauaacuuucgaga

SEQ ID NO: 559873 - RNA, 23 nt, Coxiella burnetii RSA 493
uauaagacgcuuucaacauauuu

SEQ ID NO: 559874 - RNA, 17 nt, Coxiella burnetii RSA 493
uauaaagguuuuuccuu

SEQ ID NO: 559875 - RNA, 18 nt, Coxiella burnetii RSA 493
uauaaagguuuuuccuuu

SEQ ID NO: 559876 - RNA, 19 nt, Coxiella burnetii RSA 493
uauaaagucgcauagccaa

SEQ ID NO: 559877 - RNA, 17 nt, Coxiella burnetii RSA 493
uauaacaaaauuaaaaa

SEQ ID NO: 559878 - RNA, 23 nt, Coxiella burnetii RSA 493
uauaacugaccggguuuacauaa

SEQ ID NO: 559879 - RNA, 18 nt, Coxiella burnetii RSA 493
uagugcuauuuuucccac

SEQ ID NO: 559880 - RNA, 17 nt, Coxiella burnetii RSA 493
uaguucauuaaauuuaa

SEQ ID NO: 559881 - RNA, 17 nt, Coxiella burnetii RSA 493
uauaaaagcaucaauaa

SEQ ID NO: 559882 - RNA, 18 nt, Coxiella burnetii RSA 493
uauaaaagcaucaauaau

SEQ ID NO: 559883 - RNA, 24 nt, Coxiella burnetii RSA 493
uagucauagcuaagaucaagaaag

SEQ ID NO: 559884 - RNA, 17 nt, Coxiella burnetii RSA 493
uagugaggcuucuucca

SEQ ID NO: 559885 - RNA, 22 nt, Coxiella burnetii RSA 493
uaguaugagcggcaauuuugau

SEQ ID NO: 559886 - RNA, 17 nt, Coxiella burnetii RSA 493
uaguaugcuauaauuga

SEQ ID NO: 559887 - RNA, 21 nt, Coxiella burnetii RSA 493
uaggucauuuuuuauaaaauu

SEQ ID NO: 559888 - RNA, 14 nt, Coxiella burnetii RSA 493
uaggcuuucuuuuu

SEQ ID NO: 559889 - RNA, 23 nt, Coxiella burnetii RSA 493
uagguuaaguuaagauaauaauu

SEQ ID NO: 559890 - RNA, 14 nt, Coxiella burnetii RSA 493
uaguaauucaucau

SEQ ID NO: 559891 - RNA, 13 nt, Coxiella burnetii RSA 493
uacgcuauuuuuu

SEQ ID NO: 559892 - RNA, 17 nt, Coxiella burnetii RSA 493
uacgcaugauacaaauu

SEQ ID NO: 559893 - RNA, 15 nt, Coxiella burnetii RSA 493
uacguauucaugaca

SEQ ID NO: 559894 - RNA, 20 nt, Coxiella burnetii RSA 493
uacgggacgcguaaaauagc

SEQ ID NO: 559895 - RNA, 17 nt, Coxiella burnetii RSA 493
uaccuugucacaagugu

SEQ ID NO: 559896 - RNA, 13 nt, Coxiella burnetii RSA 493
uaccuucuaaucg

SEQ ID NO: 559897 - RNA, 19 nt, Coxiella burnetii RSA 493
uacgaaccacuggaaucaa

SEQ ID NO: 559898 - RNA, 22 nt, Coxiella burnetii RSA 493
uacgauagcgucuuuuuuauuu

SEQ ID NO: 559899 - RNA, 12 nt, Coxiella burnetii RSA 493
uaccuuuuuccc

SEQ ID NO: 559900 - RNA, 17 nt, Coxiella burnetii RSA 493
uaccuuuuucccauuca

SEQ ID NO: 559901 - RNA, 21 nt, Coxiella burnetii RSA 493
uaccuuuguucgguuaaagca

SEQ ID NO: 559902 - RNA, 23 nt, Coxiella burnetii RSA 493
uacauaaaauuagguaauuuaua

SEQ ID NO: 559903 - RNA, 15 nt, Coxiella burnetii RSA 493
uacauaauuuaaacu

SEQ ID NO: 559904 - RNA, 18 nt, Coxiella burnetii RSA 493
uacauaauuuaaacucaa

SEQ ID NO: 559905 - RNA, 13 nt, Coxiella burnetii RSA 493
uacauaauuuaaa

SEQ ID NO: 559906 - RNA, 13 nt, Coxiella burnetii RSA 493
uaccauuuuccuu

SEQ ID NO: 559907 - RNA, 15 nt, Coxiella burnetii RSA 493
uacccaaaaacccau

SEQ ID NO: 559908 - RNA, 23 nt, Coxiella burnetii RSA 493
uacccaaaaacccauaacgaaaa

SEQ ID NO: 559909 - RNA, 15 nt, Coxiella burnetii RSA 493
uacccguuuaaauuu

SEQ ID NO: 559910 - RNA, 21 nt, Coxiella burnetii RSA 493
uacccugguggccauuauauu

SEQ ID NO: 559911 - RNA, 18 nt, Coxiella burnetii RSA 493
uacccuucaauugcuuuc

SEQ ID NO: 559912 - RNA, 19 nt, Coxiella burnetii RSA 493
uaccccgcuguuuucagau

SEQ ID NO: 559913 - RNA, 14 nt, Coxiella burnetii RSA 493
uacuccaauuucau

SEQ ID NO: 559914 - RNA, 21 nt, Coxiella burnetii RSA 493
uacucagcuuuccccccaacu

SEQ ID NO: 559915 - RNA, 21 nt, Coxiella burnetii RSA 493
uacuccccccaaaaaaaaacc

SEQ ID NO: 559916 - RNA, 23 nt, Coxiella burnetii RSA 493
uacucgagguagacuuuugcgcu

SEQ ID NO: 559917 - RNA, 19 nt, Coxiella burnetii RSA 493
uacuauuuccaacccagcu

SEQ ID NO: 559918 - RNA, 21 nt, Coxiella burnetii RSA 493
uacugacaaugcguuuuaaau

SEQ ID NO: 559919 - RNA, 22 nt, Coxiella burnetii RSA 493
uacugaagaguaaaaaaccaau

SEQ ID NO: 559920 - RNA, 13 nt, Coxiella burnetii RSA 493
uacucuuauuuuc

SEQ ID NO: 559921 - RNA, 15 nt, Coxiella burnetii RSA 493
uacugcguuuuucag

SEQ ID NO: 559922 - RNA, 19 nt, Coxiella burnetii RSA 493
uacugcuuguaccugccau

SEQ ID NO: 559923 - RNA, 16 nt, Coxiella burnetii RSA 493
uacugcccaagaaauu

SEQ ID NO: 559924 - RNA, 20 nt, Coxiella burnetii RSA 493
uacugccuacaaauagagag

SEQ ID NO: 559925 - RNA, 14 nt, Coxiella burnetii RSA 493
uacugagaaaacuu

SEQ ID NO: 559926 - RNA, 19 nt, Coxiella burnetii RSA 493
uacugagaaaacuuuucau

SEQ ID NO: 559927 - RNA, 23 nt, Coxiella burnetii RSA 493
uacuucuucauuaaauccucuuu

SEQ ID NO: 559928 - RNA, 12 nt, Coxiella burnetii RSA 493
uacuucuuuuuc

SEQ ID NO: 559929 - RNA, 23 nt, Coxiella burnetii RSA 493
uacuugcuucaucgauugcuaaa

SEQ ID NO: 559930 - RNA, 21 nt, Coxiella burnetii RSA 493
uacuuguugaaaaccuacacu

SEQ ID NO: 559931 - RNA, 13 nt, Coxiella burnetii RSA 493
uagaaaaaagaaa

SEQ ID NO: 559932 - RNA, 21 nt, Coxiella burnetii RSA 493
uacuuagcugauuucucuuuu

SEQ ID NO: 559933 - RNA, 22 nt, Coxiella burnetii RSA 493
uacuuagcugauuucucuuuua

SEQ ID NO: 559934 - RNA, 14 nt, Coxiella burnetii RSA 493
uacuguuugggagc

SEQ ID NO: 559935 - RNA, 23 nt, Coxiella burnetii RSA 493
uaauaggaaaaaugauuauagaa

SEQ ID NO: 559936 - RNA, 16 nt, Coxiella burnetii RSA 493
uaauaggucauuuuuu

SEQ ID NO: 559937 - RNA, 20 nt, Coxiella burnetii RSA 493
uaauaggucauuuuuuauaa

SEQ ID NO: 559938 - RNA, 22 nt, Coxiella burnetii RSA 493
uaauaguacuguauugagcagc

SEQ ID NO: 559939 - RNA, 21 nt, Coxiella burnetii RSA 493
uaauaguuugcaauaccauuu

SEQ ID NO: 559940 - RNA, 15 nt, Coxiella burnetii RSA 493
uaacggacucaaccg

SEQ ID NO: 559941 - RNA, 14 nt, Coxiella burnetii RSA 493
uaacgcuucuuuua

SEQ ID NO: 559942 - RNA, 18 nt, Coxiella burnetii RSA 493
uaauaucuagauuuaaaa

SEQ ID NO: 559943 - RNA, 15 nt, Coxiella burnetii RSA 493
uaauaucaaaaaacc

SEQ ID NO: 559944 - RNA, 14 nt, Coxiella burnetii RSA 493
uaauccuuguugaa

SEQ ID NO: 559945 - RNA, 22 nt, Coxiella burnetii RSA 493
uaauccuuguugaauuccuugu

SEQ ID NO: 559946 - RNA, 13 nt, Coxiella burnetii RSA 493
uaauccuucuuuu

SEQ ID NO: 559947 - RNA, 19 nt, Coxiella burnetii RSA 493
uaaucaugcgcaacagccc

SEQ ID NO: 559948 - RNA, 13 nt, Coxiella burnetii RSA 493
uaaugcgccuaca

SEQ ID NO: 559949 - RNA, 20 nt, Coxiella burnetii RSA 493
uaaugcgccuacaaauacca

SEQ ID NO: 559950 - RNA, 14 nt, Coxiella burnetii RSA 493
uaaugcaaaaccaa

SEQ ID NO: 559951 - RNA, 17 nt, Coxiella burnetii RSA 493
uaaugaugccuuaaaua

SEQ ID NO: 559952 - RNA, 18 nt, Coxiella burnetii RSA 493
uaaugaugccuuaaauag

SEQ ID NO: 559953 - RNA, 14 nt, Coxiella burnetii RSA 493
uaaugaaaaauagg

SEQ ID NO: 559954 - RNA, 21 nt, Coxiella burnetii RSA 493
uaaucuuuuuagaguaacgcc

SEQ ID NO: 559955 - RNA, 22 nt, Coxiella burnetii RSA 493
uaaugaaacuaagcauuaaaaa

SEQ ID NO: 559956 - RNA, 14 nt, Coxiella burnetii RSA 493
uaaugacuuugaua

SEQ ID NO: 559957 - RNA, 22 nt, Coxiella burnetii RSA 493
uaaugguagcuaccagucuguu

SEQ ID NO: 559958 - RNA, 14 nt, Coxiella burnetii RSA 493
uaauguuugaauau

SEQ ID NO: 559959 - RNA, 21 nt, Coxiella burnetii RSA 493
uaauguuugauccuugcaaua

SEQ ID NO: 559960 - RNA, 16 nt, Coxiella burnetii RSA 493
uaauuauccaaaaucc

SEQ ID NO: 559961 - RNA, 14 nt, Coxiella burnetii RSA 493
uaauuacaauccaa

SEQ ID NO: 559962 - RNA, 21 nt, Coxiella burnetii RSA 493
uaauucacggauacgcuuuau

SEQ ID NO: 559963 - RNA, 14 nt, Coxiella burnetii RSA 493
uaauucauaaauaa

SEQ ID NO: 559964 - RNA, 20 nt, Coxiella burnetii RSA 493
uaauucaaauuuuaaagguu

SEQ ID NO: 559965 - RNA, 17 nt, Coxiella burnetii RSA 493
uaauuuccguguaauaa

SEQ ID NO: 559966 - RNA, 17 nt, Coxiella burnetii RSA 493
uaauuugaauuucuguu

SEQ ID NO: 559967 - RNA, 16 nt, Coxiella burnetii RSA 493
uaauuugaaaaaccca

SEQ ID NO: 559968 - RNA, 17 nt, Coxiella burnetii RSA 493
uaauuucuuagguuuua

SEQ ID NO: 559969 - RNA, 21 nt, Coxiella burnetii RSA 493
uaauuugccggcauauucaua

SEQ ID NO: 559970 - RNA, 19 nt, Coxiella burnetii RSA 493
uaauuuauaacaaaccauc

SEQ ID NO: 559971 - RNA, 14 nt, Coxiella burnetii RSA 493
uaauuuaggccuua

SEQ ID NO: 559972 - RNA, 15 nt, Coxiella burnetii RSA 493
uaauucguuagcauu

SEQ ID NO: 559973 - RNA, 16 nt, Coxiella burnetii RSA 493
uaauucguugcauuca

SEQ ID NO: 559974 - RNA, 13 nt, Coxiella burnetii RSA 493
uaauuuuuucaua

SEQ ID NO: 559975 - RNA, 14 nt, Coxiella burnetii RSA 493
uaauuuuuuuaauu

SEQ ID NO: 559976 - RNA, 22 nt, Coxiella burnetii RSA 493
uaauuuuccuuuucuauuuuuu

SEQ ID NO: 559977 - RNA, 11 nt, Coxiella burnetii RSA 493
uaauuuuaaau

SEQ ID NO: 559978 - RNA, 12 nt, Coxiella burnetii RSA 493
uaauuuuaaaaa

SEQ ID NO: 559979 - RNA, 19 nt, Coxiella burnetii RSA 493
uaauuuuaaaaaaaauacu

SEQ ID NO: 559980 - RNA, 21 nt, Coxiella burnetii RSA 493
uacaagugcuuccaaguaagc

SEQ ID NO: 559981 - RNA, 16 nt, Coxiella burnetii RSA 493
uacaaggaaugucagg

SEQ ID NO: 559982 - RNA, 18 nt, Coxiella burnetii RSA 493
uacacaucuuuuaaaacg

SEQ ID NO: 559983 - RNA, 20 nt, Coxiella burnetii RSA 493
uacaccggaaauuuuuugcu

SEQ ID NO: 559984 - RNA, 22 nt, Coxiella burnetii RSA 493
uacagguuguuugcuuauuuug

SEQ ID NO: 559985 - RNA, 21 nt, Coxiella burnetii RSA 493
gcugauuucugguugaaucaa

SEQ ID NO: 559986 - RNA, 14 nt, Coxiella burnetii RSA 493
gcugcaagcccuuu

SEQ ID NO: 559987 - RNA, 19 nt, Coxiella burnetii RSA 493
gcugcacgccuccagggcu

SEQ ID NO: 559988 - RNA, 18 nt, Coxiella burnetii RSA 493
gcuggaaaaauaaaucca

SEQ ID NO: 559989 - RNA, 16 nt, Coxiella burnetii RSA 493
gcugcgguauuguuca

SEQ ID NO: 559990 - RNA, 13 nt, Coxiella burnetii RSA 493
gcuguuuuuucua

SEQ ID NO: 559991 - RNA, 11 nt, Coxiella burnetii RSA 493
gcuguuuauag

SEQ ID NO: 559992 - RNA, 15 nt, Coxiella burnetii RSA 493
gcugugguuguuucg

SEQ ID NO: 559993 - RNA, 19 nt, Coxiella burnetii RSA 493
gcuguucgggcacaaaaaa

SEQ ID NO: 559994 - RNA, 12 nt, Coxiella burnetii RSA 493
gcugucaaaaaa

SEQ ID NO: 559995 - RNA, 20 nt, Coxiella burnetii RSA 493
gcuguaaccgccuuuaagau

SEQ ID NO: 559996 - RNA, 15 nt, Coxiella burnetii RSA 493
gcugguagagcacaa

SEQ ID NO: 559997 - RNA, 17 nt, Coxiella burnetii RSA 493
gcuuauagcuuguuccu

SEQ ID NO: 559998 - RNA, 17 nt, Coxiella burnetii RSA 493
gcuuauaggaaucugaa

SEQ ID NO: 559999 - RNA, 22 nt, Coxiella burnetii RSA 493
gcuuaauaacgcuggggacgca

SEQ ID NO: 560000 - RNA, 19 nt, Coxiella burnetii RSA 493
gcuuaccgaggucuuuuau

SEQ ID NO: 560001 - RNA, 18 nt, Coxiella burnetii RSA 493
gcuucaucgauugcuaaa

SEQ ID NO: 560002 - RNA, 19 nt, Coxiella burnetii RSA 493
gcuucaucgauugcuaaag

SEQ ID NO: 560003 - RNA, 15 nt, Coxiella burnetii RSA 493
gcuucaauucuuuuu

SEQ ID NO: 560004 - RNA, 12 nt, Coxiella burnetii RSA 493
gcuucaaacaaa

SEQ ID NO: 560005 - RNA, 22 nt, Coxiella burnetii RSA 493
gcuuccccaauuuauucaacuc

SEQ ID NO: 560006 - RNA, 18 nt, Coxiella burnetii RSA 493
gcuuccauugcucaaagg

SEQ ID NO: 560007 - RNA, 16 nt, Coxiella burnetii RSA 493
gcuuccuuaaagcaac

SEQ ID NO: 560008 - RNA, 16 nt, Coxiella burnetii RSA 493
gcuucgaaaaucgaau

SEQ ID NO: 560009 - RNA, 15 nt, Coxiella burnetii RSA 493
gcuucgcucauacgg

SEQ ID NO: 560010 - RNA, 17 nt, Coxiella burnetii RSA 493
gcuucgucauuuccgug

SEQ ID NO: 560011 - RNA, 22 nt, Coxiella burnetii RSA 493
gcuucgucauuuccgugcaggg

SEQ ID NO: 560012 - RNA, 14 nt, Coxiella burnetii RSA 493
gcuucuuuaaaaua

SEQ ID NO: 560013 - RNA, 15 nt, Coxiella burnetii RSA 493
gcuucuuuaaaauaa

SEQ ID NO: 560014 - RNA, 18 nt, Coxiella burnetii RSA 493
gcuucuaaguaaacagca

SEQ ID NO: 560015 - RNA, 17 nt, Coxiella burnetii RSA 493
gcuucgugcaauuucug

SEQ ID NO: 560016 - RNA, 22 nt, Coxiella burnetii RSA 493
gcuuuacauagccucuauaaau

SEQ ID NO: 560017 - RNA, 24 nt, Coxiella burnetii RSA 493
gcuuuacauagccucuauaaauaa

SEQ ID NO: 560018 - RNA, 12 nt, Coxiella burnetii RSA 493
gcuuguuuauau

SEQ ID NO: 560019 - RNA, 14 nt, Coxiella burnetii RSA 493
gcuugcguaaaguu

SEQ ID NO: 560020 - RNA, 22 nt, Coxiella burnetii RSA 493
gcuugcuuaccgaggucuuuua

SEQ ID NO: 560021 - RNA, 18 nt, Coxiella burnetii RSA 493
gcuuugcgcguucaauau

SEQ ID NO: 560022 - RNA, 13 nt, Coxiella burnetii RSA 493
gcuuugcggccuc

SEQ ID NO: 560023 - RNA, 23 nt, Coxiella burnetii RSA 493
gcuuugcggccucgccuucuucg

SEQ ID NO: 560024 - RNA, 14 nt, Coxiella burnetii RSA 493
gcuuuuaaacgcuu

SEQ ID NO: 560025 - RNA, 14 nt, Coxiella burnetii RSA 493
gcuuuugaauuuuu

SEQ ID NO: 560026 - RNA, 14 nt, Coxiella burnetii RSA 493
gcuuuucuuucauu

SEQ ID NO: 560027 - RNA, 20 nt, Coxiella burnetii RSA 493
gcuuuucguucugaaauuuu

SEQ ID NO: 560028 - RNA, 13 nt, Coxiella burnetii RSA 493
gcuuucuuugaac

SEQ ID NO: 560029 - RNA, 15 nt, Coxiella burnetii RSA 493
gcuuucaauaaauaa

SEQ ID NO: 560030 - RNA, 11 nt, Coxiella burnetii RSA 493
ggaaagaaaau

SEQ ID NO: 560031 - RNA, 11 nt, Coxiella burnetii RSA 493
gcuuuuuugcu

SEQ ID NO: 560032 - RNA, 18 nt, Coxiella burnetii RSA 493
gcuuuuuugcuucuucca

SEQ ID NO: 560033 - RNA, 20 nt, Coxiella burnetii RSA 493
ggaaaaaaaccuaaagaaag

SEQ ID NO: 560034 - RNA, 20 nt, Coxiella burnetii RSA 493
gcuuuuuucgcuucaauucu

SEQ ID NO: 560035 - RNA, 14 nt, Coxiella burnetii RSA 493
gcuuuuuguuugau

SEQ ID NO: 560036 - RNA, 17 nt, Coxiella burnetii RSA 493
ggaaaaaugauuauaga

SEQ ID NO: 560037 - RNA, 23 nt, Coxiella burnetii RSA 493
ggaaaaauagcacuaucucuuaa

SEQ ID NO: 560038 - RNA, 12 nt, Coxiella burnetii RSA 493
ggaaaauaagau

SEQ ID NO: 560039 - RNA, 16 nt, Coxiella burnetii RSA 493
ggaaaaggagaaagug

SEQ ID NO: 560040 - RNA, 15 nt, Coxiella burnetii RSA 493
ggaaccuagcaauaa

SEQ ID NO: 560041 - RNA, 14 nt, Coxiella burnetii RSA 493
ggaaccgccaaaag

SEQ ID NO: 560042 - RNA, 14 nt, Coxiella burnetii RSA 493
ggaaauccaggguu

SEQ ID NO: 560043 - RNA, 18 nt, Coxiella burnetii RSA 493
ggaaauuucgauuuuaca

SEQ ID NO: 560044 - RNA, 18 nt, Coxiella burnetii RSA 493
ggaacgcgaaaagauucc

SEQ ID NO: 560045 - RNA, 13 nt, Coxiella burnetii RSA 493
ggaacuuauccau

SEQ ID NO: 560046 - RNA, 23 nt, Coxiella burnetii RSA 493
ggaacuuuuaacuucucuugaau

SEQ ID NO: 560047 - RNA, 17 nt, Coxiella burnetii RSA 493
ggaaggcaaugauaauu

SEQ ID NO: 560048 - RNA, 17 nt, Coxiella burnetii RSA 493
ggaauauuggccuuagc

SEQ ID NO: 560049 - RNA, 23 nt, Coxiella burnetii RSA 493
ggaauaguuuuggcguaugaaua

SEQ ID NO: 560050 - RNA, 19 nt, Coxiella burnetii RSA 493
ggacaccguugagcaagca

SEQ ID NO: 560051 - RNA, 23 nt, Coxiella burnetii RSA 493
ggacacauuuuuucaaauugcug

SEQ ID NO: 560052 - RNA, 15 nt, Coxiella burnetii RSA 493
ggaauuauugaauua

SEQ ID NO: 560053 - RNA, 23 nt, Coxiella burnetii RSA 493
ggaaugugugucauaaauaaaag

SEQ ID NO: 560054 - RNA, 19 nt, Coxiella burnetii RSA 493
ggaauguuuuuuaauaaau

SEQ ID NO: 560055 - RNA, 17 nt, Coxiella burnetii RSA 493
ggaauuguguuuuaauu

SEQ ID NO: 560056 - RNA, 15 nt, Coxiella burnetii RSA 493
ggaauuugaaauaaa

SEQ ID NO: 560057 - RNA, 23 nt, Coxiella burnetii RSA 493
ggacuacacgguuagugggaagc

SEQ ID NO: 560058 - RNA, 19 nt, Coxiella burnetii RSA 493
ggacuacaucaaauagaug

SEQ ID NO: 560059 - RNA, 16 nt, Coxiella burnetii RSA 493
ggagacaccaauaauu

SEQ ID NO: 560060 - RNA, 18 nt, Coxiella burnetii RSA 493
ggaguuguauaaagguuu

SEQ ID NO: 560061 - RNA, 15 nt, Coxiella burnetii RSA 493
ggagcaaguuuucua

SEQ ID NO: 560062 - RNA, 21 nt, Coxiella burnetii RSA 493
ggaucauuaucucuuaaaauu

SEQ ID NO: 560063 - RNA, 22 nt, Coxiella burnetii RSA 493
ggaucauuaucucuuaaaauuc

SEQ ID NO: 560064 - RNA, 17 nt, Coxiella burnetii RSA 493
ggaugcgacuuuuugca

SEQ ID NO: 560065 - RNA, 22 nt, Coxiella burnetii RSA 493
ggcauagggaucauuaucucuu

SEQ ID NO: 560066 - RNA, 19 nt, Coxiella burnetii RSA 493
ggcaccaaaauccaaauuu

SEQ ID NO: 560067 - RNA, 13 nt, Coxiella burnetii RSA 493
ggcagaggacaga

SEQ ID NO: 560068 - RNA, 23 nt, Coxiella burnetii RSA 493
ggcagaggacagaggacaguggu

SEQ ID NO: 560069 - RNA, 18 nt, Coxiella burnetii RSA 493
gcggcaagccagccgcca

SEQ ID NO: 560070 - RNA, 13 nt, Coxiella burnetii RSA 493
gcggauuguaaac

SEQ ID NO: 560071 - RNA, 21 nt, Coxiella burnetii RSA 493
gcggauaagccauuaaaagca

SEQ ID NO: 560072 - RNA, 18 nt, Coxiella burnetii RSA 493
gcggacaauaagagcucc

SEQ ID NO: 560073 - RNA, 18 nt, Coxiella burnetii RSA 493
gcggaccguaagccgccc

SEQ ID NO: 560074 - RNA, 12 nt, Coxiella burnetii RSA 493
gcggaaaaggag

SEQ ID NO: 560075 - RNA, 20 nt, Coxiella burnetii RSA 493
gcgcuuucguguagcccuug

SEQ ID NO: 560076 - RNA, 22 nt, Coxiella burnetii RSA 493
gcgcuuuuggcuacuuucucaa

SEQ ID NO: 560077 - RNA, 21 nt, Coxiella burnetii RSA 493
gcgcgauuuucucuucaacgc

SEQ ID NO: 560078 - RNA, 20 nt, Coxiella burnetii RSA 493
gcgcgauguagccuaaccaa

SEQ ID NO: 560079 - RNA, 19 nt, Coxiella burnetii RSA 493
gcgcaagacaauguuaaaa

SEQ ID NO: 560080 - RNA, 13 nt, Coxiella burnetii RSA 493
gcgcauucuagga

SEQ ID NO: 560081 - RNA, 14 nt, Coxiella burnetii RSA 493
gcgcauuuuuauuc

SEQ ID NO: 560082 - RNA, 22 nt, Coxiella burnetii RSA 493
gcgaguaaaccgcucgggggag

SEQ ID NO: 560083 - RNA, 21 nt, Coxiella burnetii RSA 493
gcgauaucuccauuuucaagu

SEQ ID NO: 560084 - RNA, 19 nt, Coxiella burnetii RSA 493
gcgaucaagacucaaagaa

SEQ ID NO: 560085 - RNA, 18 nt, Coxiella burnetii RSA 493
gcgaucuauagcuucaag

SEQ ID NO: 560086 - RNA, 17 nt, Coxiella burnetii RSA 493
gcgacgggcuguacauu

SEQ ID NO: 560087 - RNA, 19 nt, Coxiella burnetii RSA 493
gcgaaugguugaaagaaaa

SEQ ID NO: 560088 - RNA, 22 nt, Coxiella burnetii RSA 493
gcgaaagccaaguuuuaagaaa

SEQ ID NO: 560089 - RNA, 23 nt, Coxiella burnetii RSA 493
gcgaacagccgaugacaaauaaa

SEQ ID NO: 560090 - RNA, 13 nt, Coxiella burnetii RSA 493
gcggcuuuuucaa

SEQ ID NO: 560091 - RNA, 18 nt, Coxiella burnetii RSA 493
gcggcuagguaacuuaaa

SEQ ID NO: 560092 - RNA, 12 nt, Coxiella burnetii RSA 493
gcguucaauuau

SEQ ID NO: 560093 - RNA, 15 nt, Coxiella burnetii RSA 493
gcguuguaaauuuug

SEQ ID NO: 560094 - RNA, 13 nt, Coxiella burnetii RSA 493
gcuaucaaggccc

SEQ ID NO: 560095 - RNA, 20 nt, Coxiella burnetii RSA 493
gcuagcuggaauucauaauc

SEQ ID NO: 560096 - RNA, 16 nt, Coxiella burnetii RSA 493
gcuagaaguauuucca

SEQ ID NO: 560097 - RNA, 22 nt, Coxiella burnetii RSA 493
gcuauggaguucuugcucccaa

SEQ ID NO: 560098 - RNA, 18 nt, Coxiella burnetii RSA 493
gcuauuaggaucaagcgc

SEQ ID NO: 560099 - RNA, 23 nt, Coxiella burnetii RSA 493
gcucaacgucuuuguacuucagu

SEQ ID NO: 560100 - RNA, 12 nt, Coxiella burnetii RSA 493
gcucaagcgaac

SEQ ID NO: 560101 - RNA, 19 nt, Coxiella burnetii RSA 493
gcucaagcgaacgcggccu

SEQ ID NO: 560102 - RNA, 14 nt, Coxiella burnetii RSA 493
gcucgacuuauuug

SEQ ID NO: 560103 - RNA, 19 nt, Coxiella burnetii RSA 493
gcucgauaucuguuuuauc

SEQ ID NO: 560104 - RNA, 16 nt, Coxiella burnetii RSA 493
gcuccgcguuuuucca

SEQ ID NO: 560105 - RNA, 17 nt, Coxiella burnetii RSA 493
gcuccauuguuucgaaa

SEQ ID NO: 560106 - RNA, 21 nt, Coxiella burnetii RSA 493
gcuccauuguuucgaaauaua

SEQ ID NO: 560107 - RNA, 14 nt, Coxiella burnetii RSA 493
gcugaagaggcuga

SEQ ID NO: 560108 - RNA, 19 nt, Coxiella burnetii RSA 493
gcugaagaggcugaauaag

SEQ ID NO: 560109 - RNA, 14 nt, Coxiella burnetii RSA 493
gcugaacaaaagcc

SEQ ID NO: 560110 - RNA, 14 nt, Coxiella burnetii RSA 493
gcugaaguccuugu

SEQ ID NO: 560111 - RNA, 17 nt, Coxiella burnetii RSA 493
gcugacuagucaacaaa

SEQ ID NO: 560112 - RNA, 22 nt, Coxiella burnetii RSA 493
gcugacgucagaaaacagccuc

SEQ ID NO: 560113 - RNA, 19 nt, Coxiella burnetii RSA 493
gcugagcuugcgaagccca

SEQ ID NO: 560114 - RNA, 20 nt, Coxiella burnetii RSA 493
gcugagcuugcgaagcccaa

SEQ ID NO: 560115 - RNA, 22 nt, Coxiella burnetii RSA 493
gcugauuaagguggauuuucaa

SEQ ID NO: 560116 - RNA, 11 nt, Coxiella burnetii RSA 493
gcucuuccaac

SEQ ID NO: 560117 - RNA, 13 nt, Coxiella burnetii RSA 493
gcucuuuguuuau

SEQ ID NO: 560118 - RNA, 20 nt, Coxiella burnetii RSA 493
gcucuuuuucauuucuucga

SEQ ID NO: 560119 - RNA, 23 nt, Coxiella burnetii RSA 493
gcucugaccuaauuugauuuuuu

SEQ ID NO: 560120 - RNA, 12 nt, Coxiella burnetii RSA 493
gcucuaauucug

SEQ ID NO: 560121 - RNA, 14 nt, Coxiella burnetii RSA 493
gcaugaaauuuuug

SEQ ID NO: 560122 - RNA, 23 nt, Coxiella burnetii RSA 493
gcaugauacaaauuuuuaagacg

SEQ ID NO: 560123 - RNA, 13 nt, Coxiella burnetii RSA 493
gcaugccaaauuc

SEQ ID NO: 560124 - RNA, 14 nt, Coxiella burnetii RSA 493
gcauuaaaaaauaa

SEQ ID NO: 560125 - RNA, 16 nt, Coxiella burnetii RSA 493
gcauuaaaaaauaaga

SEQ ID NO: 560126 - RNA, 17 nt, Coxiella burnetii RSA 493
gcauuaaaaaauaagaa

SEQ ID NO: 560127 - RNA, 13 nt, Coxiella burnetii RSA 493
gcauuaauaagac

SEQ ID NO: 560128 - RNA, 20 nt, Coxiella burnetii RSA 493
gcauuaaucuuccauuaauu

SEQ ID NO: 560129 - RNA, 20 nt, Coxiella burnetii RSA 493
gcauuucaauggauucuucu

SEQ ID NO: 560130 - RNA, 17 nt, Coxiella burnetii RSA 493
gcauugcauuucuuuca

SEQ ID NO: 560131 - RNA, 18 nt, Coxiella burnetii RSA 493
gcauucccauagaagaac

SEQ ID NO: 560132 - RNA, 22 nt, Coxiella burnetii RSA 493
gccaacuuauagcccacacuaa

SEQ ID NO: 560133 - RNA, 16 nt, Coxiella burnetii RSA 493
gccaacgcgacaagaa

SEQ ID NO: 560134 - RNA, 20 nt, Coxiella burnetii RSA 493
gccaacauucuuugaucuua

SEQ ID NO: 560135 - RNA, 16 nt, Coxiella burnetii RSA 493
gccaaccgccauuucg

SEQ ID NO: 560136 - RNA, 16 nt, Coxiella burnetii RSA 493
gcauuuuuaaaaguga

SEQ ID NO: 560137 - RNA, 21 nt, Coxiella burnetii RSA 493
gcauuuuuuugucgaauuuuu

SEQ ID NO: 560138 - RNA, 17 nt, Coxiella burnetii RSA 493
gccaaagaaauggaacg

SEQ ID NO: 560139 - RNA, 19 nt, Coxiella burnetii RSA 493
gccaaaacggcgaaaggga

SEQ ID NO: 560140 - RNA, 17 nt, Coxiella burnetii RSA 493
gccaaaaauucguuaaa

SEQ ID NO: 560141 - RNA, 12 nt, Coxiella burnetii RSA 493
gccaaaauaaua

SEQ ID NO: 560142 - RNA, 21 nt, Coxiella burnetii RSA 493
gccaaacaacgcguucuugcu

SEQ ID NO: 560143 - RNA, 20 nt, Coxiella burnetii RSA 493
gccaaggcuauuccccuucu

SEQ ID NO: 560144 - RNA, 19 nt, Coxiella burnetii RSA 493
gccaaucgccgucccuucu

SEQ ID NO: 560145 - RNA, 15 nt, Coxiella burnetii RSA 493
gccaauuuaagcgcg

SEQ ID NO: 560146 - RNA, 22 nt, Coxiella burnetii RSA 493
gccacaauauacgcaauuguuc

SEQ ID NO: 560147 - RNA, 15 nt, Coxiella burnetii RSA 493
gccagcuaaguaacc

SEQ ID NO: 560148 - RNA, 20 nt, Coxiella burnetii RSA 493
gccauuugcggaaaaggaga

SEQ ID NO: 560149 - RNA, 23 nt, Coxiella burnetii RSA 493
gccauuuucauuuucucuaauga

SEQ ID NO: 560150 - RNA, 20 nt, Coxiella burnetii RSA 493
gccauuuuguguuaagucgu

SEQ ID NO: 560151 - RNA, 16 nt, Coxiella burnetii RSA 493
gccauuggcucuguuu

SEQ ID NO: 560152 - RNA, 21 nt, Coxiella burnetii RSA 493
gccauugguuuaaaaaguuca

SEQ ID NO: 560153 - RNA, 12 nt, Coxiella burnetii RSA 493
gcccaaaugauc

SEQ ID NO: 560154 - RNA, 17 nt, Coxiella burnetii RSA 493
gccauuuuuuagcaccg

SEQ ID NO: 560155 - RNA, 14 nt, Coxiella burnetii RSA 493
gcccaauaaagaaa

SEQ ID NO: 560156 - RNA, 22 nt, Coxiella burnetii RSA 493
gcccaacuacggacucuuuuca

SEQ ID NO: 560157 - RNA, 19 nt, Coxiella burnetii RSA 493
gccauugagaauggcgguc

SEQ ID NO: 560158 - RNA, 14 nt, Coxiella burnetii RSA 493
gccauccaaaugag

SEQ ID NO: 560159 - RNA, 13 nt, Coxiella burnetii RSA 493
gccaguauuuuuc

SEQ ID NO: 560160 - RNA, 14 nt, Coxiella burnetii RSA 493
gcccucgaucuuuc

SEQ ID NO: 560161 - RNA, 23 nt, Coxiella burnetii RSA 493
gccccuuugcggcuaaugcuuuu

SEQ ID NO: 560162 - RNA, 18 nt, Coxiella burnetii RSA 493
gccgagcuuuucacccaa

SEQ ID NO: 560163 - RNA, 23 nt, Coxiella burnetii RSA 493
gccgauaauccgccgguacccca

SEQ ID NO: 560164 - RNA, 21 nt, Coxiella burnetii RSA 493
gccgaagugcuaaaaaauuac

SEQ ID NO: 560165 - RNA, 16 nt, Coxiella burnetii RSA 493
gcccuuuugaauccca

SEQ ID NO: 560166 - RNA, 17 nt, Coxiella burnetii RSA 493
gcccuuuagccacgcuu

SEQ ID NO: 560167 - RNA, 15 nt, Coxiella burnetii RSA 493
gccguucaccccauu

SEQ ID NO: 560168 - RNA, 15 nt, Coxiella burnetii RSA 493
gccgucauccaaacg

SEQ ID NO: 560169 - RNA, 16 nt, Coxiella burnetii RSA 493
gccggcuaauuuuuua

SEQ ID NO: 560170 - RNA, 14 nt, Coxiella burnetii RSA 493
gccgguaccccaug

SEQ ID NO: 560171 - RNA, 13 nt, Coxiella burnetii RSA 493
gccgcaagugacc

SEQ ID NO: 560172 - RNA, 23 nt, Coxiella burnetii RSA 493
gccgcuauuucuagcguugaaaa

SEQ ID NO: 560173 - RNA, 18 nt, Coxiella burnetii RSA 493
gccgcugcgguauuguuc

SEQ ID NO: 560174 - RNA, 18 nt, Coxiella burnetii RSA 493
gccggacuuuuucaaugc

SEQ ID NO: 560175 - RNA, 23 nt, Coxiella burnetii RSA 493
gaauuugagaacguuucccaagg

SEQ ID NO: 560176 - RNA, 18 nt, Coxiella burnetii RSA 493
gaauuugaaauaaacugg

SEQ ID NO: 560177 - RNA, 19 nt, Coxiella burnetii RSA 493
gaguauccaacucucuagc

SEQ ID NO: 560178 - RNA, 12 nt, Coxiella burnetii RSA 493
gagugccacaaa

SEQ ID NO: 560179 - RNA, 20 nt, Coxiella burnetii RSA 493
gagugcguuaaggccucuuu

SEQ ID NO: 560180 - RNA, 23 nt, Coxiella burnetii RSA 493
gagucguauuccuuuuucuuuua

SEQ ID NO: 560181 - RNA, 21 nt, Coxiella burnetii RSA 493
gagucgggaaauaaaauuaau

SEQ ID NO: 560182 - RNA, 16 nt, Coxiella burnetii RSA 493
gaguucuugcucccaa

SEQ ID NO: 560183 - RNA, 12 nt, Coxiella burnetii RSA 493
gauaaaaaaccc

SEQ ID NO: 560184 - RNA, 20 nt, Coxiella burnetii RSA 493
gaguuaauuucauaaaucaa

SEQ ID NO: 560185 - RNA, 13 nt, Coxiella burnetii RSA 493
gauaaaaauaaug

SEQ ID NO: 560186 - RNA, 14 nt, Coxiella burnetii RSA 493
gauaaaaauaauga

SEQ ID NO: 560187 - RNA, 16 nt, Coxiella burnetii RSA 493
gauaaagugguuucga

SEQ ID NO: 560188 - RNA, 13 nt, Coxiella burnetii RSA 493
gauacuucuucau

SEQ ID NO: 560189 - RNA, 12 nt, Coxiella burnetii RSA 493
gauacagccuuc

SEQ ID NO: 560190 - RNA, 18 nt, Coxiella burnetii RSA 493
gauacagccuucaugaau

SEQ ID NO: 560191 - RNA, 20 nt, Coxiella burnetii RSA 493
gauaauaguuacgagcuguu

SEQ ID NO: 560192 - RNA, 16 nt, Coxiella burnetii RSA 493
gauaaucucaucaucu

SEQ ID NO: 560193 - RNA, 22 nt, Coxiella burnetii RSA 493
gauaaucggcgguguaauuacu

SEQ ID NO: 560194 - RNA, 19 nt, Coxiella burnetii RSA 493
gauaauccgccuaaauuaa

SEQ ID NO: 560195 - RNA, 18 nt, Coxiella burnetii RSA 493
gauaaugcuugcucuucu

SEQ ID NO: 560196 - RNA, 20 nt, Coxiella burnetii RSA 493
gauaaugcuugcucuucuuc

SEQ ID NO: 560197 - RNA, 18 nt, Coxiella burnetii RSA 493
gauaaugggguaaagcuu

SEQ ID NO: 560198 - RNA, 15 nt, Coxiella burnetii RSA 493
gauaauuuuggugcu

SEQ ID NO: 560199 - RNA, 13 nt, Coxiella burnetii RSA 493
gauacaaauuuuu

SEQ ID NO: 560200 - RNA, 15 nt, Coxiella burnetii RSA 493
gauacaaauuuuuaa

SEQ ID NO: 560201 - RNA, 17 nt, Coxiella burnetii RSA 493
gauaauugauaguucau

SEQ ID NO: 560202 - RNA, 18 nt, Coxiella burnetii RSA 493
gauaauucauaaauaguu

SEQ ID NO: 560203 - RNA, 15 nt, Coxiella burnetii RSA 493
gauaauuacaaucca

SEQ ID NO: 560204 - RNA, 14 nt, Coxiella burnetii RSA 493
gauaugggggccca

SEQ ID NO: 560205 - RNA, 17 nt, Coxiella burnetii RSA 493
gauaucuguuuuauccc

SEQ ID NO: 560206 - RNA, 18 nt, Coxiella burnetii RSA 493
gauauugcauuguuuucu

SEQ ID NO: 560207 - RNA, 18 nt, Coxiella burnetii RSA 493
gaucaagacucaaagaaa

SEQ ID NO: 560208 - RNA, 23 nt, Coxiella burnetii RSA 493
gaucauuaucucuuaaaauuccg

SEQ ID NO: 560209 - RNA, 17 nt, Coxiella burnetii RSA 493
gaucauuuccuagauuu

SEQ ID NO: 560210 - RNA, 12 nt, Coxiella burnetii RSA 493
gauccucaacag

SEQ ID NO: 560211 - RNA, 21 nt, Coxiella burnetii RSA 493
gauccuugcaauaagcuauca

SEQ ID NO: 560212 - RNA, 17 nt, Coxiella burnetii RSA 493
gaucggcggcucauugu

SEQ ID NO: 560213 - RNA, 19 nt, Coxiella burnetii RSA 493
gaucgcccauauucaacac

SEQ ID NO: 560214 - RNA, 14 nt, Coxiella burnetii RSA 493
gaugaucaucauca

SEQ ID NO: 560215 - RNA, 22 nt, Coxiella burnetii RSA 493
gaugauccccaucgugcaauuu

SEQ ID NO: 560216 - RNA, 18 nt, Coxiella burnetii RSA 493
gaugaucuuaugcguuau

SEQ ID NO: 560217 - RNA, 14 nt, Coxiella burnetii RSA 493
gaugagcaaugaca

SEQ ID NO: 560218 - RNA, 20 nt, Coxiella burnetii RSA 493
gaugccaaaauuagaauuac

SEQ ID NO: 560219 - RNA, 23 nt, Coxiella burnetii RSA 493
gaugcauuaaucauuacagacaa

SEQ ID NO: 560220 - RNA, 12 nt, Coxiella burnetii RSA 493
gaugaugcauua

SEQ ID NO: 560221 - RNA, 14 nt, Coxiella burnetii RSA 493
gaugacaucauugu

SEQ ID NO: 560222 - RNA, 12 nt, Coxiella burnetii RSA 493
gaugacaaauaa

SEQ ID NO: 560223 - RNA, 16 nt, Coxiella burnetii RSA 493
gauggauuaaaugcaa

SEQ ID NO: 560224 - RNA, 22 nt, Coxiella burnetii RSA 493
gauggaacugauauacgccaug

SEQ ID NO: 560225 - RNA, 17 nt, Coxiella burnetii RSA 493
gaugggauaaaaaaccc

SEQ ID NO: 560226 - RNA, 22 nt, Coxiella burnetii RSA 493
gauggcgaagucgggugauuga

SEQ ID NO: 560227 - RNA, 19 nt, Coxiella burnetii RSA 493
gauguauccuaauaaaaau

SEQ ID NO: 560228 - RNA, 20 nt, Coxiella burnetii RSA 493
gauguauccuaauaaaaaua

SEQ ID NO: 560229 - RNA, 19 nt, Coxiella burnetii RSA 493
gauggugccgcuaacagag

SEQ ID NO: 560230 - RNA, 20 nt, Coxiella burnetii RSA 493
gauuaugcuugaacuucaaa

SEQ ID NO: 560231 - RNA, 18 nt, Coxiella burnetii RSA 493
gauuaucgaggaaaauug

SEQ ID NO: 560232 - RNA, 23 nt, Coxiella burnetii RSA 493
gauuaaacgcgauaucuccauuu

SEQ ID NO: 560233 - RNA, 13 nt, Coxiella burnetii RSA 493
gauguuuuuucac

SEQ ID NO: 560234 - RNA, 14 nt, Coxiella burnetii RSA 493
gauuaaaaauuuua

SEQ ID NO: 560235 - RNA, 15 nt, Coxiella burnetii RSA 493
gauuaaaaauuuuaa

SEQ ID NO: 560236 - RNA, 18 nt, Coxiella burnetii RSA 493
gauuaaaaauuuuaaaaa

SEQ ID NO: 560237 - RNA, 20 nt, Coxiella burnetii RSA 493
gauuaaaaauuuuaaaaaaa

SEQ ID NO: 560238 - RNA, 21 nt, Coxiella burnetii RSA 493
gauuaaaaauuuuaaaaaaau

SEQ ID NO: 560239 - RNA, 13 nt, Coxiella burnetii RSA 493
gauuaaaagcaac

SEQ ID NO: 560240 - RNA, 19 nt, Coxiella burnetii RSA 493
gauuaaauaacucaucgac

SEQ ID NO: 560241 - RNA, 12 nt, Coxiella burnetii RSA 493
gaugucccccga

SEQ ID NO: 560242 - RNA, 12 nt, Coxiella burnetii RSA 493
gaugucaucuau

SEQ ID NO: 560243 - RNA, 21 nt, Coxiella burnetii RSA 493
gauucuuuuucgucuguuucu

SEQ ID NO: 560244 - RNA, 22 nt, Coxiella burnetii RSA 493
gauucuuuuucgucuguuucuu

SEQ ID NO: 560245 - RNA, 17 nt, Coxiella burnetii RSA 493
gauugaaaccgacaauu

SEQ ID NO: 560246 - RNA, 20 nt, Coxiella burnetii RSA 493
gauugacgacaucguuguuu

SEQ ID NO: 560247 - RNA, 17 nt, Coxiella burnetii RSA 493
gauucucucaaagaaac

SEQ ID NO: 560248 - RNA, 15 nt, Coxiella burnetii RSA 493
gauuauguauuuuuu

SEQ ID NO: 560249 - RNA, 17 nt, Coxiella burnetii RSA 493
gauuauguauuuuuugg

SEQ ID NO: 560250 - RNA, 20 nt, Coxiella burnetii RSA 493
gauuauuauacgggaaguug

SEQ ID NO: 560251 - RNA, 13 nt, Coxiella burnetii RSA 493
gauuuucaaaaga

SEQ ID NO: 560252 - RNA, 22 nt, Coxiella burnetii RSA 493
gauuuuggcucccuaauacugu

SEQ ID NO: 560253 - RNA, 15 nt, Coxiella burnetii RSA 493
gauuuuguuucuuug

SEQ ID NO: 560254 - RNA, 15 nt, Coxiella burnetii RSA 493
gauuuuuaugaaaaa

SEQ ID NO: 560255 - RNA, 23 nt, Coxiella burnetii RSA 493
gauuucuuuacgcgcuucuuuua

SEQ ID NO: 560256 - RNA, 13 nt, Coxiella burnetii RSA 493
gauuuuaauuuuu

SEQ ID NO: 560257 - RNA, 22 nt, Coxiella burnetii RSA 493
gauuuuaauuuuuucucugcaa

SEQ ID NO: 560258 - RNA, 14 nt, Coxiella burnetii RSA 493
gauuugaguaagaa

SEQ ID NO: 560259 - RNA, 18 nt, Coxiella burnetii RSA 493
gcaaacaugcgaaagcaa

SEQ ID NO: 560260 - RNA, 20 nt, Coxiella burnetii RSA 493
gcaaacccacggcaaauaaa

SEQ ID NO: 560261 - RNA, 18 nt, Coxiella burnetii RSA 493
gcaaagccgcuauuucua

SEQ ID NO: 560262 - RNA, 18 nt, Coxiella burnetii RSA 493
gcaaagcucagcccaacc

SEQ ID NO: 560263 - RNA, 16 nt, Coxiella burnetii RSA 493
gcaaaguaaaaaugaa

SEQ ID NO: 560264 - RNA, 19 nt, Coxiella burnetii RSA 493
gcaaauguugauaauaaau

SEQ ID NO: 560265 - RNA, 20 nt, Coxiella burnetii RSA 493
gcaggcggggacgagggguu

SEQ ID NO: 560266 - RNA, 12 nt, Coxiella burnetii RSA 493
gcagauuguaaa

SEQ ID NO: 560267 - RNA, 20 nt, Coxiella burnetii RSA 493
gcagcaucccccaagagaac

SEQ ID NO: 560268 - RNA, 13 nt, Coxiella burnetii RSA 493
gcaguaucuauuc

SEQ ID NO: 560269 - RNA, 13 nt, Coxiella burnetii RSA 493
gcauaaucuuuuu

SEQ ID NO: 560270 - RNA, 23 nt, Coxiella burnetii RSA 493
gcauauauuccacaauuuuccgg

SEQ ID NO: 560271 - RNA, 12 nt, Coxiella burnetii RSA 493
gcauauaaaagu

SEQ ID NO: 560272 - RNA, 15 nt, Coxiella burnetii RSA 493
gcauagggaucauua

SEQ ID NO: 560273 - RNA, 14 nt, Coxiella burnetii RSA 493
gcauaauauuuucu

SEQ ID NO: 560274 - RNA, 12 nt, Coxiella burnetii RSA 493
gcauaaaaaccc

SEQ ID NO: 560275 - RNA, 19 nt, Coxiella burnetii RSA 493
gcauaaaaccgauacuuug

SEQ ID NO: 560276 - RNA, 12 nt, Coxiella burnetii RSA 493
gcauccuuaaug

SEQ ID NO: 560277 - RNA, 21 nt, Coxiella burnetii RSA 493
gcauccgguuaauagcaucaa

SEQ ID NO: 560278 - RNA, 17 nt, Coxiella burnetii RSA 493
gcaucccccaagagaac

SEQ ID NO: 560279 - RNA, 20 nt, Coxiella burnetii RSA 493
gcauccgccccgaaauauga

SEQ ID NO: 560280 - RNA, 15 nt, Coxiella burnetii RSA 493
gcaucacgcucgagg

SEQ ID NO: 560281 - RNA, 14 nt, Coxiella burnetii RSA 493
gcauauugcaauaa

SEQ ID NO: 560282 - RNA, 22 nt, Coxiella burnetii RSA 493
gcauauucgccuucuugccgcc

SEQ ID NO: 560283 - RNA, 15 nt, Coxiella burnetii RSA 493
gcaucaaaaaaaccu

SEQ ID NO: 560284 - RNA, 19 nt, Coxiella burnetii RSA 493
gcaauuuauucgauaugaa

SEQ ID NO: 560285 - RNA, 20 nt, Coxiella burnetii RSA 493
gcacaaaaaaauuauuuuua

SEQ ID NO: 560286 - RNA, 17 nt, Coxiella burnetii RSA 493
gcacaaugcuuuucuca

SEQ ID NO: 560287 - RNA, 21 nt, Coxiella burnetii RSA 493
gcaauucgcggguaaauuuau

SEQ ID NO: 560288 - RNA, 12 nt, Coxiella burnetii RSA 493
gcaauguucuuc

SEQ ID NO: 560289 - RNA, 20 nt, Coxiella burnetii RSA 493
gcaauuaauacauucuucag

SEQ ID NO: 560290 - RNA, 18 nt, Coxiella burnetii RSA 493
gcacauaagcgaauaaua

SEQ ID NO: 560291 - RNA, 19 nt, Coxiella burnetii RSA 493
gcaaauucgggcaacgagg

SEQ ID NO: 560292 - RNA, 14 nt, Coxiella burnetii RSA 493
gcaaauugcccaaa

SEQ ID NO: 560293 - RNA, 21 nt, Coxiella burnetii RSA 493
gcaagaugaggaauagggaga

SEQ ID NO: 560294 - RNA, 14 nt, Coxiella burnetii RSA 493
gcaagcagaagggc

SEQ ID NO: 560295 - RNA, 18 nt, Coxiella burnetii RSA 493
gcaacuuuaacauuauca

SEQ ID NO: 560296 - RNA, 19 nt, Coxiella burnetii RSA 493
gcaagucaucgggagcgau

SEQ ID NO: 560297 - RNA, 18 nt, Coxiella burnetii RSA 493
gcaauaggguuaguaacu

SEQ ID NO: 560298 - RNA, 15 nt, Coxiella burnetii RSA 493
gcaauaucagaaacc

SEQ ID NO: 560299 - RNA, 21 nt, Coxiella burnetii RSA 493
gcaauaucugaucaaaaauaa

SEQ ID NO: 560300 - RNA, 17 nt, Coxiella burnetii RSA 493
gcaaugaaauauauaaa

SEQ ID NO: 560301 - RNA, 23 nt, Coxiella burnetii RSA 493
gcaaugaaauauauaaaggaacc

SEQ ID NO: 560302 - RNA, 16 nt, Coxiella burnetii RSA 493
gcacucagaaagcaaa

SEQ ID NO: 560303 - RNA, 23 nt, Coxiella burnetii RSA 493
gcacugccuucgggaggcagggg

SEQ ID NO: 560304 - RNA, 17 nt, Coxiella burnetii RSA 493
gcacucuuuaauuugca

SEQ ID NO: 560305 - RNA, 14 nt, Coxiella burnetii RSA 493
gcacgguaauaaua

SEQ ID NO: 560306 - RNA, 16 nt, Coxiella burnetii RSA 493
gcacgggcguucaauu

SEQ ID NO: 560307 - RNA, 17 nt, Coxiella burnetii RSA 493
cuuuguuccuugagagu

SEQ ID NO: 560308 - RNA, 12 nt, Coxiella burnetii RSA 493
cuuuguuuuuuu

SEQ ID NO: 560309 - RNA, 18 nt, Coxiella burnetii RSA 493
cuuuuaaagugauuuuuu

SEQ ID NO: 560310 - RNA, 19 nt, Coxiella burnetii RSA 493
cuuuuaaagugauuuuuuu

SEQ ID NO: 560311 - RNA, 20 nt, Coxiella burnetii RSA 493
cuuuuaauugacuuauuuuu

SEQ ID NO: 560312 - RNA, 18 nt, Coxiella burnetii RSA 493
cuuuuaacuucucuugaa

SEQ ID NO: 560313 - RNA, 22 nt, Coxiella burnetii RSA 493
cuuuuaaccacagacucuuuuu

SEQ ID NO: 560314 - RNA, 12 nt, Coxiella burnetii RSA 493
cuuucuuuuaau

SEQ ID NO: 560315 - RNA, 15 nt, Coxiella burnetii RSA 493
cuuucuuugaaccac

SEQ ID NO: 560316 - RNA, 17 nt, Coxiella burnetii RSA 493
cuuuuccaucuccuuuu

SEQ ID NO: 560317 - RNA, 14 nt, Coxiella burnetii RSA 493
cuuuucauuuugau

SEQ ID NO: 560318 - RNA, 22 nt, Coxiella burnetii RSA 493
cuuuucauuaagcaauuuuuua

SEQ ID NO: 560319 - RNA, 18 nt, Coxiella burnetii RSA 493
cuuuucacccaaccaaua

SEQ ID NO: 560320 - RNA, 22 nt, Coxiella burnetii RSA 493
cuuuuauuugggagauaggacu

SEQ ID NO: 560321 - RNA, 17 nt, Coxiella burnetii RSA 493
cuuuuauuuaagugaua

SEQ ID NO: 560322 - RNA, 16 nt, Coxiella burnetii RSA 493
cuuuuauuucacguaa

SEQ ID NO: 560323 - RNA, 15 nt, Coxiella burnetii RSA 493
cuuuuauaaaaccug

SEQ ID NO: 560324 - RNA, 17 nt, Coxiella burnetii RSA 493
cuuuuauacccaaaaac

SEQ ID NO: 560325 - RNA, 20 nt, Coxiella burnetii RSA 493
cuuuuauacccaaaaaccca

SEQ ID NO: 560326 - RNA, 21 nt, Coxiella burnetii RSA 493
cuuuuagcgaccaccauguga

SEQ ID NO: 560327 - RNA, 23 nt, Coxiella burnetii RSA 493
cuuuuagcgaccaccaugugaau

SEQ ID NO: 560328 - RNA, 19 nt, Coxiella burnetii RSA 493
cuuuuagcucauugaaauc

SEQ ID NO: 560329 - RNA, 13 nt, Coxiella burnetii RSA 493
cuuuucuauuuuu

SEQ ID NO: 560330 - RNA, 14 nt, Coxiella burnetii RSA 493
cuuuucuauuuuuu

SEQ ID NO: 560331 - RNA, 16 nt, Coxiella burnetii RSA 493
cuuuucuauuuuuuug

SEQ ID NO: 560332 - RNA, 20 nt, Coxiella burnetii RSA 493
cuuuucucaacgcuucagaa

SEQ ID NO: 560333 - RNA, 14 nt, Coxiella burnetii RSA 493
cuuuucuuucauua

SEQ ID NO: 560334 - RNA, 19 nt, Coxiella burnetii RSA 493
cuuuucuucuggcaaagcc

SEQ ID NO: 560335 - RNA, 22 nt, Coxiella burnetii RSA 493
cuuuucuguuuucguaaucuuu

SEQ ID NO: 560336 - RNA, 18 nt, Coxiella burnetii RSA 493
cuuuucggagaaaucuuu

SEQ ID NO: 560337 - RNA, 20 nt, Coxiella burnetii RSA 493
cuuuucggagaaaucuuuuu

SEQ ID NO: 560338 - RNA, 22 nt, Coxiella burnetii RSA 493
cuuuucuaagacuaagaauaag

SEQ ID NO: 560339 - RNA, 23 nt, Coxiella burnetii RSA 493
cuuuucuaagacuaagaauaaga

SEQ ID NO: 560340 - RNA, 16 nt, Coxiella burnetii RSA 493
cuuuucguaaaccuuu

SEQ ID NO: 560341 - RNA, 20 nt, Coxiella burnetii RSA 493
cuuuucguucugaaauuuua

SEQ ID NO: 560342 - RNA, 12 nt, Coxiella burnetii RSA 493
cuuuucuaaaua

SEQ ID NO: 560343 - RNA, 23 nt, Coxiella burnetii RSA 493
cuuuugugcgucuucugccucca

SEQ ID NO: 560344 - RNA, 18 nt, Coxiella burnetii RSA 493
cuuuuguuaauucuuuuu

SEQ ID NO: 560345 - RNA, 19 nt, Coxiella burnetii RSA 493
cuuuuggaagcggauaaau

SEQ ID NO: 560346 - RNA, 23 nt, Coxiella burnetii RSA 493
cuuuugcgcuuauagcuuguucc

SEQ ID NO: 560347 - RNA, 22 nt, Coxiella burnetii RSA 493
cuuuugccucuuuuuguaaauu

SEQ ID NO: 560348 - RNA, 18 nt, Coxiella burnetii RSA 493
cuuuugaauuuuuugaaa

SEQ ID NO: 560349 - RNA, 22 nt, Coxiella burnetii RSA 493
cuuuuucuagggagaaaaauuu

SEQ ID NO: 560350 - RNA, 22 nt, Coxiella burnetii RSA 493
cuuuuucuuucacuaaaagaac

SEQ ID NO: 560351 - RNA, 21 nt, Coxiella burnetii RSA 493
cuuuuucuuuuaauugaucac

SEQ ID NO: 560352 - RNA, 12 nt, Coxiella burnetii RSA 493
cuuuuucauuuc

SEQ ID NO: 560353 - RNA, 19 nt, Coxiella burnetii RSA 493
cuuuuucauuucuucgagu

SEQ ID NO: 560354 - RNA, 21 nt, Coxiella burnetii RSA 493
cuuuuucauuucuucgaguuu

SEQ ID NO: 560355 - RNA, 16 nt, Coxiella burnetii RSA 493
cuuuuucgauuuuuuu

SEQ ID NO: 560356 - RNA, 19 nt, Coxiella burnetii RSA 493
cuuuuucguuuaacaauga

SEQ ID NO: 560357 - RNA, 13 nt, Coxiella burnetii RSA 493
cuuuuuaaauaac

SEQ ID NO: 560358 - RNA, 20 nt, Coxiella burnetii RSA 493
gaaaaaauaccggaaacaag

SEQ ID NO: 560359 - RNA, 13 nt, Coxiella burnetii RSA 493
gaaaaaauuaaau

SEQ ID NO: 560360 - RNA, 12 nt, Coxiella burnetii RSA 493
cuuuuuuuaaug

SEQ ID NO: 560361 - RNA, 19 nt, Coxiella burnetii RSA 493
cuuuuuuuacuuuuucaaa

SEQ ID NO: 560362 - RNA, 18 nt, Coxiella burnetii RSA 493
gaaaaaaaaccaaugaaa

SEQ ID NO: 560363 - RNA, 17 nt, Coxiella burnetii RSA 493
cuuuuuuuucuucuuuu

SEQ ID NO: 560364 - RNA, 13 nt, Coxiella burnetii RSA 493
cuuuuuguaaauu

SEQ ID NO: 560365 - RNA, 19 nt, Coxiella burnetii RSA 493
cuuuuuuccuucguuucuu

SEQ ID NO: 560366 - RNA, 19 nt, Coxiella burnetii RSA 493
cuuuuuucgcuucaauucu

SEQ ID NO: 560367 - RNA, 23 nt, Coxiella burnetii RSA 493
gaaaacgauagucucuauaucuu

SEQ ID NO: 560368 - RNA, 17 nt, Coxiella burnetii RSA 493
gaaaaccgcagcucaaa

SEQ ID NO: 560369 - RNA, 17 nt, Coxiella burnetii RSA 493
gaaaaccuacacguuaa

SEQ ID NO: 560370 - RNA, 22 nt, Coxiella burnetii RSA 493
gaaaaccaccgcucgcuugaaa

SEQ ID NO: 560371 - RNA, 18 nt, Coxiella burnetii RSA 493
gaaaaaugauuauagaau

SEQ ID NO: 560372 - RNA, 17 nt, Coxiella burnetii RSA 493
gaaaaaguuaaguauau

SEQ ID NO: 560373 - RNA, 17 nt, Coxiella burnetii RSA 493
gaaaaaguaucacggcc

SEQ ID NO: 560374 - RNA, 11 nt, Coxiella burnetii RSA 493
gaaaaauaauu

SEQ ID NO: 560375 - RNA, 15 nt, Coxiella burnetii RSA 493
gaaaauaccuuugca

SEQ ID NO: 560376 - RNA, 17 nt, Coxiella burnetii RSA 493
gaaaaggaaauguaaaa

SEQ ID NO: 560377 - RNA, 17 nt, Coxiella burnetii RSA 493
gaaaaugauuucauccu

SEQ ID NO: 560378 - RNA, 17 nt, Coxiella burnetii RSA 493
gaaaaucgauggaagaa

SEQ ID NO: 560379 - RNA, 11 nt, Coxiella burnetii RSA 493
gaaaauccaua

SEQ ID NO: 560380 - RNA, 23 nt, Coxiella burnetii RSA 493
gaaacaacuaccugauaaaauaa

SEQ ID NO: 560381 - RNA, 12 nt, Coxiella burnetii RSA 493
gaaacaaacaaa

SEQ ID NO: 560382 - RNA, 14 nt, Coxiella burnetii RSA 493
gaaaauucaugaaa

SEQ ID NO: 560383 - RNA, 23 nt, Coxiella burnetii RSA 493
gaaaauugauuagcaucuugaau

SEQ ID NO: 560384 - RNA, 19 nt, Coxiella burnetii RSA 493
gaaaauugucgauaauaua

SEQ ID NO: 560385 - RNA, 17 nt, Coxiella burnetii RSA 493
gaaacgacgaucaccca

SEQ ID NO: 560386 - RNA, 21 nt, Coxiella burnetii RSA 493
gaaacgacgaucacccacguu

SEQ ID NO: 560387 - RNA, 17 nt, Coxiella burnetii RSA 493
gaaacgcgccaaacaac

SEQ ID NO: 560388 - RNA, 16 nt, Coxiella burnetii RSA 493
gaaaccguuucuacgu

SEQ ID NO: 560389 - RNA, 16 nt, Coxiella burnetii RSA 493
gaaagacaacuuuaua

SEQ ID NO: 560390 - RNA, 17 nt, Coxiella burnetii RSA 493
gaaagaagaaggucguu

SEQ ID NO: 560391 - RNA, 15 nt, Coxiella burnetii RSA 493
gaaacuaagcauuaa

SEQ ID NO: 560392 - RNA, 14 nt, Coxiella burnetii RSA 493
gaaacgugagagag

SEQ ID NO: 560393 - RNA, 22 nt, Coxiella burnetii RSA 493
gaaacgcuuauaggaaucugaa

SEQ ID NO: 560394 - RNA, 23 nt, Coxiella burnetii RSA 493
gaaacgcuuauaggaaucugaau

SEQ ID NO: 560395 - RNA, 21 nt, Coxiella burnetii RSA 493
gaaacggaugagcaaugacau

SEQ ID NO: 560396 - RNA, 20 nt, Coxiella burnetii RSA 493
gaaauacgggaaaacaauga

SEQ ID NO: 560397 - RNA, 13 nt, Coxiella burnetii RSA 493
gaaauaauucgca

SEQ ID NO: 560398 - RNA, 14 nt, Coxiella burnetii RSA 493
gaaauauuagaaau

SEQ ID NO: 560399 - RNA, 18 nt, Coxiella burnetii RSA 493
gaaauauuagaaauaaua

SEQ ID NO: 560400 - RNA, 15 nt, Coxiella burnetii RSA 493
gaaaguuuaccuuuc

SEQ ID NO: 560401 - RNA, 14 nt, Coxiella burnetii RSA 493
gaaaguuucccaca

SEQ ID NO: 560402 - RNA, 22 nt, Coxiella burnetii RSA 493
gaaagugagccgcuaauaacau

SEQ ID NO: 560403 - RNA, 23 nt, Coxiella burnetii RSA 493
gaaagugagccgcuaauaacauu

SEQ ID NO: 560404 - RNA, 13 nt, Coxiella burnetii RSA 493
gaaauaaaauuaa

SEQ ID NO: 560405 - RNA, 20 nt, Coxiella burnetii RSA 493
gaaauaacguugucuuauuu

SEQ ID NO: 560406 - RNA, 13 nt, Coxiella burnetii RSA 493
gaaauaaugacaa

SEQ ID NO: 560407 - RNA, 19 nt, Coxiella burnetii RSA 493
gaaauaaugacaauucccg

SEQ ID NO: 560408 - RNA, 22 nt, Coxiella burnetii RSA 493
gaaagcaucaaccaauccuacu

SEQ ID NO: 560409 - RNA, 12 nt, Coxiella burnetii RSA 493
gaaagccuaagu

SEQ ID NO: 560410 - RNA, 19 nt, Coxiella burnetii RSA 493
gaaauauuuuuauucuucu

SEQ ID NO: 560411 - RNA, 18 nt, Coxiella burnetii RSA 493
gaaaucuaccguauuuaa

SEQ ID NO: 560412 - RNA, 19 nt, Coxiella burnetii RSA 493
gaaaucuaccguauuuaau

SEQ ID NO: 560413 - RNA, 18 nt, Coxiella burnetii RSA 493
gaaauugauguguuuucu

SEQ ID NO: 560414 - RNA, 18 nt, Coxiella burnetii RSA 493
gaaauugcgcguaaaauu

SEQ ID NO: 560415 - RNA, 13 nt, Coxiella burnetii RSA 493
gaaauuuuauaag

SEQ ID NO: 560416 - RNA, 18 nt, Coxiella burnetii RSA 493
gaaauuuguuauugcuaa

SEQ ID NO: 560417 - RNA, 15 nt, Coxiella burnetii RSA 493
gaaauugacaaauaa

SEQ ID NO: 560418 - RNA, 16 nt, Coxiella burnetii RSA 493
gaaauugacaaauaaa

SEQ ID NO: 560419 - RNA, 18 nt, Coxiella burnetii RSA 493
gaaauugacaaauaaaga

SEQ ID NO: 560420 - RNA, 19 nt, Coxiella burnetii RSA 493
gaaauguuuagucggaaau

SEQ ID NO: 560421 - RNA, 17 nt, Coxiella burnetii RSA 493
gaacaauuaacuuugca

SEQ ID NO: 560422 - RNA, 21 nt, Coxiella burnetii RSA 493
gaacagccgaugacaaauaaa

SEQ ID NO: 560423 - RNA, 21 nt, Coxiella burnetii RSA 493
gaacaggggcuaaauaaggag

SEQ ID NO: 560424 - RNA, 14 nt, Coxiella burnetii RSA 493
gaaccaaucuauua

SEQ ID NO: 560425 - RNA, 13 nt, Coxiella burnetii RSA 493
gaauauccagcac

SEQ ID NO: 560426 - RNA, 21 nt, Coxiella burnetii RSA 493
gaauauuaguggaauuaaaua

SEQ ID NO: 560427 - RNA, 21 nt, Coxiella burnetii RSA 493
gaauagccuucucaauuucaa

SEQ ID NO: 560428 - RNA, 20 nt, Coxiella burnetii RSA 493
gaauauaaugggaguaauga

SEQ ID NO: 560429 - RNA, 20 nt, Coxiella burnetii RSA 493
gaauauagacaaugcuuucu

SEQ ID NO: 560430 - RNA, 19 nt, Coxiella burnetii RSA 493
gaauagggagaagaagcca

SEQ ID NO: 560431 - RNA, 13 nt, Coxiella burnetii RSA 493
gaauaagccgcgc

SEQ ID NO: 560432 - RNA, 14 nt, Coxiella burnetii RSA 493
gaauaagaauaagg

SEQ ID NO: 560433 - RNA, 19 nt, Coxiella burnetii RSA 493
gaauaacuucuucuuuuaa

SEQ ID NO: 560434 - RNA, 19 nt, Coxiella burnetii RSA 493
gaauaacaucaguuuugau

SEQ ID NO: 560435 - RNA, 16 nt, Coxiella burnetii RSA 493
gaauaacggaaaaugg

SEQ ID NO: 560436 - RNA, 21 nt, Coxiella burnetii RSA 493
gaauacaacgcuguuaaaauc

SEQ ID NO: 560437 - RNA, 20 nt, Coxiella burnetii RSA 493
gaauaauugccgguaaugag

SEQ ID NO: 560438 - RNA, 14 nt, Coxiella burnetii RSA 493
gaaggcucuucaua

SEQ ID NO: 560439 - RNA, 22 nt, Coxiella burnetii RSA 493
gaaggcucuucauauccuuucu

SEQ ID NO: 560440 - RNA, 23 nt, Coxiella burnetii RSA 493
gaagugaccaacgcacucugugc

SEQ ID NO: 560441 - RNA, 20 nt, Coxiella burnetii RSA 493
gaagugggggaacagaggac

SEQ ID NO: 560442 - RNA, 23 nt, Coxiella burnetii RSA 493
gaaguugccgauaaaaaggcaaa

SEQ ID NO: 560443 - RNA, 16 nt, Coxiella burnetii RSA 493
gaauaaaaccuucaaa

SEQ ID NO: 560444 - RNA, 15 nt, Coxiella burnetii RSA 493
gaaguuuaaaguuau

SEQ ID NO: 560445 - RNA, 14 nt, Coxiella burnetii RSA 493
gaaucgacuuucuc

SEQ ID NO: 560446 - RNA, 19 nt, Coxiella burnetii RSA 493
gaaucauacgguacaggua

SEQ ID NO: 560447 - RNA, 19 nt, Coxiella burnetii RSA 493
gaaucagcuuaaucaaccu

SEQ ID NO: 560448 - RNA, 22 nt, Coxiella burnetii RSA 493
gaaucagcuuaaucaaccucag

SEQ ID NO: 560449 - RNA, 17 nt, Coxiella burnetii RSA 493
gaaucgcggacaauaag

SEQ ID NO: 560450 - RNA, 13 nt, Coxiella burnetii RSA 493
gaaugauaccauc

SEQ ID NO: 560451 - RNA, 14 nt, Coxiella burnetii RSA 493
gaaugaucugcucu

SEQ ID NO: 560452 - RNA, 16 nt, Coxiella burnetii RSA 493
gaaugacgauuaaaaa

SEQ ID NO: 560453 - RNA, 22 nt, Coxiella burnetii RSA 493
gaaugaauuuaaugucuuuuau

SEQ ID NO: 560454 - RNA, 17 nt, Coxiella burnetii RSA 493
gaauggcccaauaaaga

SEQ ID NO: 560455 - RNA, 13 nt, Coxiella burnetii RSA 493
gaaugcguucuuu

SEQ ID NO: 560456 - RNA, 18 nt, Coxiella burnetii RSA 493
gaaugcagcucuuucaau

SEQ ID NO: 560457 - RNA, 21 nt, Coxiella burnetii RSA 493
gaaugauucgacauaaggcug

SEQ ID NO: 560458 - RNA, 14 nt, Coxiella burnetii RSA 493
gaauuaaaaauauu

SEQ ID NO: 560459 - RNA, 21 nt, Coxiella burnetii RSA 493
gaauguuaauucgagcaucuu

SEQ ID NO: 560460 - RNA, 21 nt, Coxiella burnetii RSA 493
gaauggccuuacuuaccguuu

SEQ ID NO: 560461 - RNA, 11 nt, Coxiella burnetii RSA 493
gaaugggaaga

SEQ ID NO: 560462 - RNA, 19 nt, Coxiella burnetii RSA 493
gaaugggaagauuuauaac

SEQ ID NO: 560463 - RNA, 14 nt, Coxiella burnetii RSA 493
gaaugggauugaac

SEQ ID NO: 560464 - RNA, 21 nt, Coxiella burnetii RSA 493
gaaugggauugaaccacgauu

SEQ ID NO: 560465 - RNA, 20 nt, Coxiella burnetii RSA 493
gaauucgggguucuguaagu

SEQ ID NO: 560466 - RNA, 12 nt, Coxiella burnetii RSA 493
gaauucucccau

SEQ ID NO: 560467 - RNA, 17 nt, Coxiella burnetii RSA 493
gaauugaaguccuuauc

SEQ ID NO: 560468 - RNA, 14 nt, Coxiella burnetii RSA 493
gaauuguaaaaaga

SEQ ID NO: 560469 - RNA, 18 nt, Coxiella burnetii RSA 493
gaauucccuuuugaauuc

SEQ ID NO: 560470 - RNA, 22 nt, Coxiella burnetii RSA 493
gaauucauaaucaaaaucagaa

SEQ ID NO: 560471 - RNA, 16 nt, Coxiella burnetii RSA 493
gaauuauuuuaucgcc

SEQ ID NO: 560472 - RNA, 13 nt, Coxiella burnetii RSA 493
gaauucaaaccaa

SEQ ID NO: 560473 - RNA, 18 nt, Coxiella burnetii RSA 493
gaauuagagguucaucgc

SEQ ID NO: 560474 - RNA, 17 nt, Coxiella burnetii RSA 493
gaacgcgaaaagauucc

SEQ ID NO: 560475 - RNA, 18 nt, Coxiella burnetii RSA 493
gaacgcgaaaagauucca

SEQ ID NO: 560476 - RNA, 21 nt, Coxiella burnetii RSA 493
gaacgacuuuuuuuaccauuu

SEQ ID NO: 560477 - RNA, 23 nt, Coxiella burnetii RSA 493
gaacgacuuuuuuuaccauuuca

SEQ ID NO: 560478 - RNA, 16 nt, Coxiella burnetii RSA 493
gaaccuaaauuauaaa

SEQ ID NO: 560479 - RNA, 15 nt, Coxiella burnetii RSA 493
gaacguuucccaagg

SEQ ID NO: 560480 - RNA, 15 nt, Coxiella burnetii RSA 493
gaacugaugaauaac

SEQ ID NO: 560481 - RNA, 13 nt, Coxiella burnetii RSA 493
gaaggcagaggac

SEQ ID NO: 560482 - RNA, 15 nt, Coxiella burnetii RSA 493
gaaggaaauuugcau

SEQ ID NO: 560483 - RNA, 15 nt, Coxiella burnetii RSA 493
gaaggaauagccuuc

SEQ ID NO: 560484 - RNA, 16 nt, Coxiella burnetii RSA 493
gaagcgauugacuucu

SEQ ID NO: 560485 - RNA, 20 nt, Coxiella burnetii RSA 493
gaagagaguaagucucugcu

SEQ ID NO: 560486 - RNA, 15 nt, Coxiella burnetii RSA 493
gaagaguaaaaaacc

SEQ ID NO: 560487 - RNA, 21 nt, Coxiella burnetii RSA 493
gaagcaacuuuaacauuauca

SEQ ID NO: 560488 - RNA, 16 nt, Coxiella burnetii RSA 493
gaacuuuuuuuaaugc

SEQ ID NO: 560489 - RNA, 12 nt, Coxiella burnetii RSA 493
cuucuucauuua

SEQ ID NO: 560490 - RNA, 17 nt, Coxiella burnetii RSA 493
cuucuuccaauaacaua

SEQ ID NO: 560491 - RNA, 16 nt, Coxiella burnetii RSA 493
cuucuugucauucccu

SEQ ID NO: 560492 - RNA, 18 nt, Coxiella burnetii RSA 493
cuucuuguaaggauucua

SEQ ID NO: 560493 - RNA, 20 nt, Coxiella burnetii RSA 493
cuucuuauaaucuuaucaau

SEQ ID NO: 560494 - RNA, 14 nt, Coxiella burnetii RSA 493
cuucuggcaaagcc

SEQ ID NO: 560495 - RNA, 22 nt, Coxiella burnetii RSA 493
cuucuggcaaagccgcuauuuc

SEQ ID NO: 560496 - RNA, 21 nt, Coxiella burnetii RSA 493
cuucucuugaauaagccgcgc

SEQ ID NO: 560497 - RNA, 12 nt, Coxiella burnetii RSA 493
cuucucuuucug

SEQ ID NO: 560498 - RNA, 22 nt, Coxiella burnetii RSA 493
cuucucuuucugagcuuguuuu

SEQ ID NO: 560499 - RNA, 17 nt, Coxiella burnetii RSA 493
cuucucguaacaaaaga

SEQ ID NO: 560500 - RNA, 21 nt, Coxiella burnetii RSA 493
cuugaacaggagcgauaaaau

SEQ ID NO: 560501 - RNA, 23 nt, Coxiella burnetii RSA 493
cuugaacaggagcgauaaaauaa

SEQ ID NO: 560502 - RNA, 13 nt, Coxiella burnetii RSA 493
cuucuuuuuuaug

SEQ ID NO: 560503 - RNA, 22 nt, Coxiella burnetii RSA 493
cuugaguauuuggcagaauuug

SEQ ID NO: 560504 - RNA, 16 nt, Coxiella burnetii RSA 493
cuugcucaaguccuug

SEQ ID NO: 560505 - RNA, 21 nt, Coxiella burnetii RSA 493
cuugcucaaguccuugcugaa

SEQ ID NO: 560506 - RNA, 16 nt, Coxiella burnetii RSA 493
cuugcgguacaagcgc

SEQ ID NO: 560507 - RNA, 11 nt, Coxiella burnetii RSA 493
cuuguuuuaag

SEQ ID NO: 560508 - RNA, 12 nt, Coxiella burnetii RSA 493
cuuguugaauuc

SEQ ID NO: 560509 - RNA, 16 nt, Coxiella burnetii RSA 493
cuuguugaauuccuug

SEQ ID NO: 560510 - RNA, 17 nt, Coxiella burnetii RSA 493
cuuguugcaauccuuuu

SEQ ID NO: 560511 - RNA, 12 nt, Coxiella burnetii RSA 493
cuuguuccuuuu

SEQ ID NO: 560512 - RNA, 15 nt, Coxiella burnetii RSA 493
cuuuaacauuaucau

SEQ ID NO: 560513 - RNA, 20 nt, Coxiella burnetii RSA 493
cuuuaacauuaucauguuca

SEQ ID NO: 560514 - RNA, 18 nt, Coxiella burnetii RSA 493
cuuuaauacaguuuaucg

SEQ ID NO: 560515 - RNA, 23 nt, Coxiella burnetii RSA 493
cuuuaaaauaaguauccauccca

SEQ ID NO: 560516 - RNA, 23 nt, Coxiella burnetii RSA 493
cuugugcaauuccauuaaaaaca

SEQ ID NO: 560517 - RNA, 18 nt, Coxiella burnetii RSA 493
cuuggacaaaucaucaaa

SEQ ID NO: 560518 - RNA, 14 nt, Coxiella burnetii RSA 493
cuuguaaggauucu

SEQ ID NO: 560519 - RNA, 18 nt, Coxiella burnetii RSA 493
cuuggagauuuagccaaa

SEQ ID NO: 560520 - RNA, 15 nt, Coxiella burnetii RSA 493
cuuguaccugccauu

SEQ ID NO: 560521 - RNA, 13 nt, Coxiella burnetii RSA 493
cuuuaaugcauuu

SEQ ID NO: 560522 - RNA, 15 nt, Coxiella burnetii RSA 493
cuuuaaugcauuuga

SEQ ID NO: 560523 - RNA, 22 nt, Coxiella burnetii RSA 493
cuuuaaucgcuccgaaaauaaa

SEQ ID NO: 560524 - RNA, 16 nt, Coxiella burnetii RSA 493
cuuuaccuccucccca

SEQ ID NO: 560525 - RNA, 23 nt, Coxiella burnetii RSA 493
cuuuauaguucauuaaauuuaau

SEQ ID NO: 560526 - RNA, 21 nt, Coxiella burnetii RSA 493
cuuuauauguguaacaaaaac

SEQ ID NO: 560527 - RNA, 12 nt, Coxiella burnetii RSA 493
cuuuauucauua

SEQ ID NO: 560528 - RNA, 14 nt, Coxiella burnetii RSA 493
cuuuauuauaaaaa

SEQ ID NO: 560529 - RNA, 17 nt, Coxiella burnetii RSA 493
cuuucccuccacggaau

SEQ ID NO: 560530 - RNA, 21 nt, Coxiella burnetii RSA 493
cuuucauguaauuuaucccac

SEQ ID NO: 560531 - RNA, 15 nt, Coxiella burnetii RSA 493
cuuucauuaauucca

SEQ ID NO: 560532 - RNA, 14 nt, Coxiella burnetii RSA 493
cuuucucaauuucu

SEQ ID NO: 560533 - RNA, 17 nt, Coxiella burnetii RSA 493
cuuuccuguuuuuccuc

SEQ ID NO: 560534 - RNA, 20 nt, Coxiella burnetii RSA 493
cuuucgauaaauuuugaauc

SEQ ID NO: 560535 - RNA, 22 nt, Coxiella burnetii RSA 493
cuuucgauaaauuuugaauccu

SEQ ID NO: 560536 - RNA, 22 nt, Coxiella burnetii RSA 493
cuucauugagcgggauauuuuu

SEQ ID NO: 560537 - RNA, 14 nt, Coxiella burnetii RSA 493
cuucauuaaauccg

SEQ ID NO: 560538 - RNA, 18 nt, Coxiella burnetii RSA 493
cuucauuaaauccucuuu

SEQ ID NO: 560539 - RNA, 17 nt, Coxiella burnetii RSA 493
cuuccauacuaauuuca

SEQ ID NO: 560540 - RNA, 12 nt, Coxiella burnetii RSA 493
cuucgcaaagcu

SEQ ID NO: 560541 - RNA, 15 nt, Coxiella burnetii RSA 493
cuucauccaaaauuu

SEQ ID NO: 560542 - RNA, 20 nt, Coxiella burnetii RSA 493
cuucagucgccguugcuuuu

SEQ ID NO: 560543 - RNA, 16 nt, Coxiella burnetii RSA 493
cuuauuauucauaucu

SEQ ID NO: 560544 - RNA, 20 nt, Coxiella burnetii RSA 493
cuuauuauucauaucuuuuu

SEQ ID NO: 560545 - RNA, 17 nt, Coxiella burnetii RSA 493
cuuauuaccgguugaaa

SEQ ID NO: 560546 - RNA, 16 nt, Coxiella burnetii RSA 493
cuuagcauaaaaugcg

SEQ ID NO: 560547 - RNA, 23 nt, Coxiella burnetii RSA 493
cuuauacuaaauuguccuuuucu

SEQ ID NO: 560548 - RNA, 20 nt, Coxiella burnetii RSA 493
cuuauagcccacacuaaagg

SEQ ID NO: 560549 - RNA, 16 nt, Coxiella burnetii RSA 493
cuuauagcuuguuccu

SEQ ID NO: 560550 - RNA, 21 nt, Coxiella burnetii RSA 493
cuuauagcuuguuccuuuuua

SEQ ID NO: 560551 - RNA, 15 nt, Coxiella burnetii RSA 493
cuuauauaaagggcc

SEQ ID NO: 560552 - RNA, 22 nt, Coxiella burnetii RSA 493
cuuaucacuagcuauucuuuug

SEQ ID NO: 560553 - RNA, 12 nt, Coxiella burnetii RSA 493
cuuaaagcaacg

SEQ ID NO: 560554 - RNA, 24 nt, Coxiella burnetii RSA 493
cuuaaagcaacgacuucucuuucu

SEQ ID NO: 560555 - RNA, 15 nt, Coxiella burnetii RSA 493
cuuaaagucuucaaa

SEQ ID NO: 560556 - RNA, 18 nt, Coxiella burnetii RSA 493
cuuaaucaaccucagguu

SEQ ID NO: 560557 - RNA, 22 nt, Coxiella burnetii RSA 493
cuuaaucaaccucagguuuuac

SEQ ID NO: 560558 - RNA, 17 nt, Coxiella burnetii RSA 493
cuuaauuucuaaaaauc

SEQ ID NO: 560559 - RNA, 18 nt, Coxiella burnetii RSA 493
cuuaauuucuaaaaauca

SEQ ID NO: 560560 - RNA, 17 nt, Coxiella burnetii RSA 493
cuuaauuuuuccuuucu

SEQ ID NO: 560561 - RNA, 13 nt, Coxiella burnetii RSA 493
cuguugauacuaa

SEQ ID NO: 560562 - RNA, 20 nt, Coxiella burnetii RSA 493
cuguugauacuaaauuagua

SEQ ID NO: 560563 - RNA, 17 nt, Coxiella burnetii RSA 493
cugucguuucugauuuu

SEQ ID NO: 560564 - RNA, 21 nt, Coxiella burnetii RSA 493
cuguucuuuuuccauguuuac

SEQ ID NO: 560565 - RNA, 15 nt, Coxiella burnetii RSA 493
cuguuuguugcuuug

SEQ ID NO: 560566 - RNA, 14 nt, Coxiella burnetii RSA 493
cuguuuuacugccu

SEQ ID NO: 560567 - RNA, 12 nt, Coxiella burnetii RSA 493
cuguuuuauccc

SEQ ID NO: 560568 - RNA, 16 nt, Coxiella burnetii RSA 493
cuguuucuucuuuggc

SEQ ID NO: 560569 - RNA, 15 nt, Coxiella burnetii RSA 493
cuuaaaauuucuuuc

SEQ ID NO: 560570 - RNA, 22 nt, Coxiella burnetii RSA 493
cuggaaaaaggugcccaagaac

SEQ ID NO: 560571 - RNA, 14 nt, Coxiella burnetii RSA 493
cuggaaaaauaaau

SEQ ID NO: 560572 - RNA, 17 nt, Coxiella burnetii RSA 493
cuggaaaaauaaaucca

SEQ ID NO: 560573 - RNA, 17 nt, Coxiella burnetii RSA 493
cugcuuguaccugccau

SEQ ID NO: 560574 - RNA, 20 nt, Coxiella burnetii RSA 493
cugcuaggauuuccuuuuca

SEQ ID NO: 560575 - RNA, 16 nt, Coxiella burnetii RSA 493
cugcuaggauuuuuua

SEQ ID NO: 560576 - RNA, 11 nt, Coxiella burnetii RSA 493
cugcuucuuua

SEQ ID NO: 560577 - RNA, 15 nt, Coxiella burnetii RSA 493
cuggaaacuuuccug

SEQ ID NO: 560578 - RNA, 22 nt, Coxiella burnetii RSA 493
cuggaagagaguaagucucugc

SEQ ID NO: 560579 - RNA, 18 nt, Coxiella burnetii RSA 493
cuggcauugaaaaucaau

SEQ ID NO: 560580 - RNA, 13 nt, Coxiella burnetii RSA 493
cuguacauuuuuc

SEQ ID NO: 560581 - RNA, 20 nt, Coxiella burnetii RSA 493
cuguaaccgccuuuaagauc

SEQ ID NO: 560582 - RNA, 20 nt, Coxiella burnetii RSA 493
cugucaaacguccuucucca

SEQ ID NO: 560583 - RNA, 16 nt, Coxiella burnetii RSA 493
cugucaaaaaaccuua

SEQ ID NO: 560584 - RNA, 18 nt, Coxiella burnetii RSA 493
cuguauuaacauuuggau

SEQ ID NO: 560585 - RNA, 22 nt, Coxiella burnetii RSA 493
cuguauugaucgcccauauuca

SEQ ID NO: 560586 - RNA, 15 nt, Coxiella burnetii RSA 493
cugucacuaauaauc

SEQ ID NO: 560587 - RNA, 22 nt, Coxiella burnetii RSA 493
cugucgcacgcgcaccaggggu

SEQ ID NO: 560588 - RNA, 22 nt, Coxiella burnetii RSA 493
cuggugagacucaguggcagcu

SEQ ID NO: 560589 - RNA, 16 nt, Coxiella burnetii RSA 493
cuggggauacacccau

SEQ ID NO: 560590 - RNA, 16 nt, Coxiella burnetii RSA 493
cugcccgggugguuaa

SEQ ID NO: 560591 - RNA, 13 nt, Coxiella burnetii RSA 493
cugcguuuuucag

SEQ ID NO: 560592 - RNA, 20 nt, Coxiella burnetii RSA 493
cugccugcuaggauuuccuu

SEQ ID NO: 560593 - RNA, 16 nt, Coxiella burnetii RSA 493
cugauuucugguugaa

SEQ ID NO: 560594 - RNA, 20 nt, Coxiella burnetii RSA 493
cugauuuacaauaacaaaug

SEQ ID NO: 560595 - RNA, 16 nt, Coxiella burnetii RSA 493
cugcagauuguaaauc

SEQ ID NO: 560596 - RNA, 14 nt, Coxiella burnetii RSA 493
cugcacguaucuga

SEQ ID NO: 560597 - RNA, 14 nt, Coxiella burnetii RSA 493
cugcaauaauucuu

SEQ ID NO: 560598 - RNA, 22 nt, Coxiella burnetii RSA 493
cugcaauggcgguacgucauca

SEQ ID NO: 560599 - RNA, 11 nt, Coxiella burnetii RSA 493
cugagugucug

SEQ ID NO: 560600 - RNA, 13 nt, Coxiella burnetii RSA 493
cugauaaaauaac

SEQ ID NO: 560601 - RNA, 21 nt, Coxiella burnetii RSA 493
cugauacuucuucauuaaauc

SEQ ID NO: 560602 - RNA, 16 nt, Coxiella burnetii RSA 493
cugaucgauaaaaaua

SEQ ID NO: 560603 - RNA, 21 nt, Coxiella burnetii RSA 493
cugaucgauaaaaauaaugau

SEQ ID NO: 560604 - RNA, 14 nt, Coxiella burnetii RSA 493
cugauaguuaaaug

SEQ ID NO: 560605 - RNA, 13 nt, Coxiella burnetii RSA 493
cugauauuuuuua

SEQ ID NO: 560606 - RNA, 20 nt, Coxiella burnetii RSA 493
cuccaaaacccauccauccc

SEQ ID NO: 560607 - RNA, 16 nt, Coxiella burnetii RSA 493
cucauuuuguauugga

SEQ ID NO: 560608 - RNA, 17 nt, Coxiella burnetii RSA 493
cuccagaugauaucccc

SEQ ID NO: 560609 - RNA, 17 nt, Coxiella burnetii RSA 493
cuccauaacaauggaca

SEQ ID NO: 560610 - RNA, 17 nt, Coxiella burnetii RSA 493
cuccaucaugauaucca

SEQ ID NO: 560611 - RNA, 14 nt, Coxiella burnetii RSA 493
cuccaguauuucau

SEQ ID NO: 560612 - RNA, 15 nt, Coxiella burnetii RSA 493
cuccaguauuucauc

SEQ ID NO: 560613 - RNA, 20 nt, Coxiella burnetii RSA 493
cuccagccgaagcgcggcca

SEQ ID NO: 560614 - RNA, 19 nt, Coxiella burnetii RSA 493
cuccauuuagaaaaaauac

SEQ ID NO: 560615 - RNA, 21 nt, Coxiella burnetii RSA 493
cuccauugaguggugguagaa

SEQ ID NO: 560616 - RNA, 18 nt, Coxiella burnetii RSA 493
cuccccacucucuuuauu

SEQ ID NO: 560617 - RNA, 21 nt, Coxiella burnetii RSA 493
cuccccacucucuuuauuuuu

SEQ ID NO: 560618 - RNA, 20 nt, Coxiella burnetii RSA 493
cucccuuaacuucucuucaa

SEQ ID NO: 560619 - RNA, 15 nt, Coxiella burnetii RSA 493
cuccccccaaaaaaa

SEQ ID NO: 560620 - RNA, 21 nt, Coxiella burnetii RSA 493
cuccgcccccccaaacaaaag

SEQ ID NO: 560621 - RNA, 23 nt, Coxiella burnetii RSA 493
cucgcuaaucgcaaugcuucuuc

SEQ ID NO: 560622 - RNA, 18 nt, Coxiella burnetii RSA 493
cucgcucuuguuucuggc

SEQ ID NO: 560623 - RNA, 20 nt, Coxiella burnetii RSA 493
cucgcgcggcaaggaauuga

SEQ ID NO: 560624 - RNA, 16 nt, Coxiella burnetii RSA 493
cucguaauugagaggg

SEQ ID NO: 560625 - RNA, 14 nt, Coxiella burnetii RSA 493
cucguaacaaaaga

SEQ ID NO: 560626 - RNA, 14 nt, Coxiella burnetii RSA 493
cucgguuccaaaaa

SEQ ID NO: 560627 - RNA, 16 nt, Coxiella burnetii RSA 493
cucgguuggugugucu

SEQ ID NO: 560628 - RNA, 22 nt, Coxiella burnetii RSA 493
cucgguuggugugucuccuuuu

SEQ ID NO: 560629 - RNA, 19 nt, Coxiella burnetii RSA 493
cucgucuggggauacaccc

SEQ ID NO: 560630 - RNA, 21 nt, Coxiella burnetii RSA 493
cucgucuggggauacacccau

SEQ ID NO: 560631 - RNA, 17 nt, Coxiella burnetii RSA 493
cucuacaucuucauuuu

SEQ ID NO: 560632 - RNA, 22 nt, Coxiella burnetii RSA 493
cucuacaucuucauuuucugua

SEQ ID NO: 560633 - RNA, 13 nt, Coxiella burnetii RSA 493
cucuaaaaauuaa

SEQ ID NO: 560634 - RNA, 23 nt, Coxiella burnetii RSA 493
cucguuguccccgcgaaggcgca

SEQ ID NO: 560635 - RNA, 15 nt, Coxiella burnetii RSA 493
cucguuuuggcugca

SEQ ID NO: 560636 - RNA, 15 nt, Coxiella burnetii RSA 493
cuaccugauaaaaua

SEQ ID NO: 560637 - RNA, 17 nt, Coxiella burnetii RSA 493
cuaccucgcuuaaagca

SEQ ID NO: 560638 - RNA, 18 nt, Coxiella burnetii RSA 493
cuaccgggcgaugauaaa

SEQ ID NO: 560639 - RNA, 15 nt, Coxiella burnetii RSA 493
cuaccguauuuaauc

SEQ ID NO: 560640 - RNA, 17 nt, Coxiella burnetii RSA 493
cuaauacuaaacaaaau

SEQ ID NO: 560641 - RNA, 20 nt, Coxiella burnetii RSA 493
cuaauacuaaacaaaauaau

SEQ ID NO: 560642 - RNA, 18 nt, Coxiella burnetii RSA 493
cuaauaggaaaaaugauu

SEQ ID NO: 560643 - RNA, 21 nt, Coxiella burnetii RSA 493
cuaauaggaaaaaugauuaua

SEQ ID NO: 560644 - RNA, 21 nt, Coxiella burnetii RSA 493
cuaccuuccgucaauuuuucu

SEQ ID NO: 560645 - RNA, 14 nt, Coxiella burnetii RSA 493
cuacgaagcggcuc

SEQ ID NO: 560646 - RNA, 21 nt, Coxiella burnetii RSA 493
cuagaaauauuagaaauaaua

SEQ ID NO: 560647 - RNA, 18 nt, Coxiella burnetii RSA 493
cuagaaguauuuccauuu

SEQ ID NO: 560648 - RNA, 21 nt, Coxiella burnetii RSA 493
cuacguuuuuugcauuuuuaa

SEQ ID NO: 560649 - RNA, 22 nt, Coxiella burnetii RSA 493
cuacguuuuuugcauuuuuaaa

SEQ ID NO: 560650 - RNA, 12 nt, Coxiella burnetii RSA 493
cuagaaaauaac

SEQ ID NO: 560651 - RNA, 21 nt, Coxiella burnetii RSA 493
cuagaaaauaaccuaaaauag

SEQ ID NO: 560652 - RNA, 18 nt, Coxiella burnetii RSA 493
cuagaggcgggaauagcu

SEQ ID NO: 560653 - RNA, 17 nt, Coxiella burnetii RSA 493
cuagcauaaucuuuuua

SEQ ID NO: 560654 - RNA, 18 nt, Coxiella burnetii RSA 493
cuagcauaaucuuuuuag

SEQ ID NO: 560655 - RNA, 14 nt, Coxiella burnetii RSA 493
cuagcaucaauaag

SEQ ID NO: 560656 - RNA, 14 nt, Coxiella burnetii RSA 493
cuagccauuguuuu

SEQ ID NO: 560657 - RNA, 18 nt, Coxiella burnetii RSA 493
cuauaucuuuuaaauuaa

SEQ ID NO: 560658 - RNA, 18 nt, Coxiella burnetii RSA 493
cuauauacccgaggauga

SEQ ID NO: 560659 - RNA, 20 nt, Coxiella burnetii RSA 493
cuauauaagcuuucaauaaa

SEQ ID NO: 560660 - RNA, 22 nt, Coxiella burnetii RSA 493
cuaucgccguuucugcuuuuau

SEQ ID NO: 560661 - RNA, 17 nt, Coxiella burnetii RSA 493
cuaugaucaugccuuuu

SEQ ID NO: 560662 - RNA, 15 nt, Coxiella burnetii RSA 493
cuaggcccuguaucc

SEQ ID NO: 560663 - RNA, 15 nt, Coxiella burnetii RSA 493
cuaggauuuccuuuu

SEQ ID NO: 560664 - RNA, 16 nt, Coxiella burnetii RSA 493
cuauaccauacagaau

SEQ ID NO: 560665 - RNA, 13 nt, Coxiella burnetii RSA 493
cuauaauuagaua

SEQ ID NO: 560666 - RNA, 14 nt, Coxiella burnetii RSA 493
cuauaaucauuuuu

SEQ ID NO: 560667 - RNA, 15 nt, Coxiella burnetii RSA 493
cuauaaucauuuuuc

SEQ ID NO: 560668 - RNA, 18 nt, Coxiella burnetii RSA 493
cuauaaguccaagacuga

SEQ ID NO: 560669 - RNA, 23 nt, Coxiella burnetii RSA 493
cucaaccgguuuuucuucauuug

SEQ ID NO: 560670 - RNA, 13 nt, Coxiella burnetii RSA 493
cucaauuguuuca

SEQ ID NO: 560671 - RNA, 20 nt, Coxiella burnetii RSA 493
cucaauucgcuuaaauuuug

SEQ ID NO: 560672 - RNA, 22 nt, Coxiella burnetii RSA 493
cucaauucgcuuaaauuuugac

SEQ ID NO: 560673 - RNA, 21 nt, Coxiella burnetii RSA 493
cucaauuucaauuagaaugcc

SEQ ID NO: 560674 - RNA, 11 nt, Coxiella burnetii RSA 493
cucaauuauua

SEQ ID NO: 560675 - RNA, 16 nt, Coxiella burnetii RSA 493
cucaaugagugcuuuu

SEQ ID NO: 560676 - RNA, 13 nt, Coxiella burnetii RSA 493
cuauuuuaaaucu

SEQ ID NO: 560677 - RNA, 21 nt, Coxiella burnetii RSA 493
cuauuugguuguggcugaaaa

SEQ ID NO: 560678 - RNA, 12 nt, Coxiella burnetii RSA 493
cucaaagaaacg

SEQ ID NO: 560679 - RNA, 22 nt, Coxiella burnetii RSA 493
cucaaagaaacgauuaaaaauu

SEQ ID NO: 560680 - RNA, 23 nt, Coxiella burnetii RSA 493
cucaaaggccuuggguaagugaa

SEQ ID NO: 560681 - RNA, 15 nt, Coxiella burnetii RSA 493
cucaaacaaaucaau

SEQ ID NO: 560682 - RNA, 19 nt, Coxiella burnetii RSA 493
cuauuugcccaucugaugg

SEQ ID NO: 560683 - RNA, 22 nt, Coxiella burnetii RSA 493
cucaguaauuucucgaaugaca

SEQ ID NO: 560684 - RNA, 20 nt, Coxiella burnetii RSA 493
cucauccuccgauuuauuau

SEQ ID NO: 560685 - RNA, 23 nt, Coxiella burnetii RSA 493
cucaucuccuuuugcuaacucca

SEQ ID NO: 560686 - RNA, 20 nt, Coxiella burnetii RSA 493
cucagacucucuuauugccc

SEQ ID NO: 560687 - RNA, 17 nt, Coxiella burnetii RSA 493
cucacuuggauuuuauu

SEQ ID NO: 560688 - RNA, 17 nt, Coxiella burnetii RSA 493
cucagcaucagccugau

SEQ ID NO: 560689 - RNA, 18 nt, Coxiella burnetii RSA 493
cguggcuucgagaggaau

SEQ ID NO: 560690 - RNA, 20 nt, Coxiella burnetii RSA 493
cguggccggcaaugcaccau

SEQ ID NO: 560691 - RNA, 15 nt, Coxiella burnetii RSA 493
cguuagaaaagcgcu

SEQ ID NO: 560692 - RNA, 21 nt, Coxiella burnetii RSA 493
cguuauuguuaacaccuuuuu

SEQ ID NO: 560693 - RNA, 22 nt, Coxiella burnetii RSA 493
cguuauuguuaacaccuuuuuc

SEQ ID NO: 560694 - RNA, 12 nt, Coxiella burnetii RSA 493
cguuccagcggg

SEQ ID NO: 560695 - RNA, 14 nt, Coxiella burnetii RSA 493
cguuccaugacaug

SEQ ID NO: 560696 - RNA, 15 nt, Coxiella burnetii RSA 493
cguucagcuagccau

SEQ ID NO: 560697 - RNA, 14 nt, Coxiella burnetii RSA 493
cguuaaaaaauucg

SEQ ID NO: 560698 - RNA, 15 nt, Coxiella burnetii RSA 493
cguuaaauagccaac

SEQ ID NO: 560699 - RNA, 16 nt, Coxiella burnetii RSA 493
cgugugagucgaauua

SEQ ID NO: 560700 - RNA, 14 nt, Coxiella burnetii RSA 493
cguguagaaagaaa

SEQ ID NO: 560701 - RNA, 15 nt, Coxiella burnetii RSA 493
cuaaagcaaaaguaa

SEQ ID NO: 560702 - RNA, 21 nt, Coxiella burnetii RSA 493
cuaaagcaaaaguaauauuuc

SEQ ID NO: 560703 - RNA, 12 nt, Coxiella burnetii RSA 493
cuaaauuaaaaa

SEQ ID NO: 560704 - RNA, 16 nt, Coxiella burnetii RSA 493
cuaaauggucuguuuc

SEQ ID NO: 560705 - RNA, 16 nt, Coxiella burnetii RSA 493
cuaaaugcgucaugaa

SEQ ID NO: 560706 - RNA, 16 nt, Coxiella burnetii RSA 493
cuaaauuguccuuuuc

SEQ ID NO: 560707 - RNA, 16 nt, Coxiella burnetii RSA 493
cuaagcauuaaaaaau

SEQ ID NO: 560708 - RNA, 17 nt, Coxiella burnetii RSA 493
cuaagcauuaaaaaaua

SEQ ID NO: 560709 - RNA, 18 nt, Coxiella burnetii RSA 493
cuaagcauuaaaaaauaa

SEQ ID NO: 560710 - RNA, 23 nt, Coxiella burnetii RSA 493
cuaaguagucccugacguuuucc

SEQ ID NO: 560711 - RNA, 20 nt, Coxiella burnetii RSA 493
cuaaguugggccaaaauaga

SEQ ID NO: 560712 - RNA, 14 nt, Coxiella burnetii RSA 493
cuaacgccacacaa

SEQ ID NO: 560713 - RNA, 20 nt, Coxiella burnetii RSA 493
cuaacgcguacaguuuuuuu

SEQ ID NO: 560714 - RNA, 17 nt, Coxiella burnetii RSA 493
cguuuccgccucaauuu

SEQ ID NO: 560715 - RNA, 11 nt, Coxiella burnetii RSA 493
cuaaaaaagaa

SEQ ID NO: 560716 - RNA, 23 nt, Coxiella burnetii RSA 493
cguuuuugcuagaucguuuuuug

SEQ ID NO: 560717 - RNA, 15 nt, Coxiella burnetii RSA 493
cuaaaaccuccugca

SEQ ID NO: 560718 - RNA, 14 nt, Coxiella burnetii RSA 493
cguucugaaauuuu

SEQ ID NO: 560719 - RNA, 12 nt, Coxiella burnetii RSA 493
cguugcuuuaaa

SEQ ID NO: 560720 - RNA, 15 nt, Coxiella burnetii RSA 493
cguuuaaauaacaaa

SEQ ID NO: 560721 - RNA, 13 nt, Coxiella burnetii RSA 493
cguuuacuuguug

SEQ ID NO: 560722 - RNA, 18 nt, Coxiella burnetii RSA 493
cguuucccgcuccagauu

SEQ ID NO: 560723 - RNA, 22 nt, Coxiella burnetii RSA 493
cguuguuuucccguauuucgcu

SEQ ID NO: 560724 - RNA, 21 nt, Coxiella burnetii RSA 493
cgucccaaaaaacuuagccaa

SEQ ID NO: 560725 - RNA, 16 nt, Coxiella burnetii RSA 493
cgucccccaauaccag

SEQ ID NO: 560726 - RNA, 17 nt, Coxiella burnetii RSA 493
cgucgaagcauuuuuuu

SEQ ID NO: 560727 - RNA, 12 nt, Coxiella burnetii RSA 493
cgucgcaaauaa

SEQ ID NO: 560728 - RNA, 13 nt, Coxiella burnetii RSA 493
cgucuuuuuuagu

SEQ ID NO: 560729 - RNA, 17 nt, Coxiella burnetii RSA 493
cgugaugggauaaaaaa

SEQ ID NO: 560730 - RNA, 22 nt, Coxiella burnetii RSA 493
cgugcagcugauuucugguuga

SEQ ID NO: 560731 - RNA, 20 nt, Coxiella burnetii RSA 493
cgcucauacgggcuacuuua

SEQ ID NO: 560732 - RNA, 12 nt, Coxiella burnetii RSA 493
cgcugcaauaau

SEQ ID NO: 560733 - RNA, 20 nt, Coxiella burnetii RSA 493
cgcucgauucuuugucuguc

SEQ ID NO: 560734 - RNA, 15 nt, Coxiella burnetii RSA 493
cgcuccaguauuuca

SEQ ID NO: 560735 - RNA, 18 nt, Coxiella burnetii RSA 493
cgcucaugggaugucgcu

SEQ ID NO: 560736 - RNA, 22 nt, Coxiella burnetii RSA 493
cgcucauuuucacuauuuguau

SEQ ID NO: 560737 - RNA, 18 nt, Coxiella burnetii RSA 493
cgcgcuuuagcgcgcagc

SEQ ID NO: 560738 - RNA, 14 nt, Coxiella burnetii RSA 493
cgcggcaaggaauu

SEQ ID NO: 560739 - RNA, 13 nt, Coxiella burnetii RSA 493
cgcuuugcggccu

SEQ ID NO: 560740 - RNA, 15 nt, Coxiella burnetii RSA 493
cggaaguucuauuuc

SEQ ID NO: 560741 - RNA, 12 nt, Coxiella burnetii RSA 493
cggaauauaauu

SEQ ID NO: 560742 - RNA, 19 nt, Coxiella burnetii RSA 493
cgcuucgaaaaucgaauuc

SEQ ID NO: 560743 - RNA, 21 nt, Coxiella burnetii RSA 493
cgcuucaaacaauugagcggc

SEQ ID NO: 560744 - RNA, 20 nt, Coxiella burnetii RSA 493
cggauaaugcuugcucuucu

SEQ ID NO: 560745 - RNA, 18 nt, Coxiella burnetii RSA 493
cggaguccccaaaguuuc

SEQ ID NO: 560746 - RNA, 17 nt, Coxiella burnetii RSA 493
cggagacaccaauaauu

SEQ ID NO: 560747 - RNA, 12 nt, Coxiella burnetii RSA 493
cggacuuuuuca

SEQ ID NO: 560748 - RNA, 18 nt, Coxiella burnetii RSA 493
cggaccguaagccgcccg

SEQ ID NO: 560749 - RNA, 19 nt, Coxiella burnetii RSA 493
cggacaauaagagcuccaa

SEQ ID NO: 560750 - RNA, 12 nt, Coxiella burnetii RSA 493
cggaauuugaua

SEQ ID NO: 560751 - RNA, 15 nt, Coxiella burnetii RSA 493
cggauauaacgccaa

SEQ ID NO: 560752 - RNA, 19 nt, Coxiella burnetii RSA 493
cggcaaucagaaugcugau

SEQ ID NO: 560753 - RNA, 16 nt, Coxiella burnetii RSA 493
cggcauucaauggcgu

SEQ ID NO: 560754 - RNA, 15 nt, Coxiella burnetii RSA 493
cgggauucaauuuca

SEQ ID NO: 560755 - RNA, 15 nt, Coxiella burnetii RSA 493
cgggaugauuuuucc

SEQ ID NO: 560756 - RNA, 22 nt, Coxiella burnetii RSA 493
cggcuugagggcuguccucugc

SEQ ID NO: 560757 - RNA, 22 nt, Coxiella burnetii RSA 493
cgggaaccgccaaaagggaaca

SEQ ID NO: 560758 - RNA, 18 nt, Coxiella burnetii RSA 493
cggguggcggacuuuucg

SEQ ID NO: 560759 - RNA, 23 nt, Coxiella burnetii RSA 493
cggguuuugaagaagagcggcuu

SEQ ID NO: 560760 - RNA, 17 nt, Coxiella burnetii RSA 493
cgguaaugagaaccauu

SEQ ID NO: 560761 - RNA, 19 nt, Coxiella burnetii RSA 493
cgguauaaaauuuuauucu

SEQ ID NO: 560762 - RNA, 23 nt, Coxiella burnetii RSA 493
cgguauuuugcaaaugaauaaca

SEQ ID NO: 560763 - RNA, 22 nt, Coxiella burnetii RSA 493
cgguauggauaguuucaaauuu

SEQ ID NO: 560764 - RNA, 15 nt, Coxiella burnetii RSA 493
cgguacuuaagaaag

SEQ ID NO: 560765 - RNA, 22 nt, Coxiella burnetii RSA 493
cggggcauucuuacggcucacg

SEQ ID NO: 560766 - RNA, 15 nt, Coxiella burnetii RSA 493
cguaagcacaaaagu

SEQ ID NO: 560767 - RNA, 20 nt, Coxiella burnetii RSA 493
cguaaauuucguugauuaau

SEQ ID NO: 560768 - RNA, 11 nt, Coxiella burnetii RSA 493
cguaacaaaag

SEQ ID NO: 560769 - RNA, 13 nt, Coxiella burnetii RSA 493
cgguuuuuuucuu

SEQ ID NO: 560770 - RNA, 17 nt, Coxiella burnetii RSA 493
cgguuuuuuucuuuuug

SEQ ID NO: 560771 - RNA, 14 nt, Coxiella burnetii RSA 493
cgguuuuuuuaaaa

SEQ ID NO: 560772 - RNA, 20 nt, Coxiella burnetii RSA 493
cgguuuuuuuaaaaaagaaa

SEQ ID NO: 560773 - RNA, 14 nt, Coxiella burnetii RSA 493
cgguucaugaaaaa

SEQ ID NO: 560774 - RNA, 14 nt, Coxiella burnetii RSA 493
cguaaucuuuaaca

SEQ ID NO: 560775 - RNA, 14 nt, Coxiella burnetii RSA 493
cguacaaagagaag

SEQ ID NO: 560776 - RNA, 12 nt, Coxiella burnetii RSA 493
cguaccacgcug

SEQ ID NO: 560777 - RNA, 20 nt, Coxiella burnetii RSA 493
cggucuugggaggcauucug

SEQ ID NO: 560778 - RNA, 15 nt, Coxiella burnetii RSA 493
cggugcgauuuuccg

SEQ ID NO: 560779 - RNA, 14 nt, Coxiella burnetii RSA 493
cggugaucuaaccu

SEQ ID NO: 560780 - RNA, 19 nt, Coxiella burnetii RSA 493
cgguggcguacaagugcuu

SEQ ID NO: 560781 - RNA, 21 nt, Coxiella burnetii RSA 493
cccucuuuaccccgcucccuu

SEQ ID NO: 560782 - RNA, 14 nt, Coxiella burnetii RSA 493
cccucuuuaccucc

SEQ ID NO: 560783 - RNA, 18 nt, Coxiella burnetii RSA 493
cccucuuuaccuccuccc

SEQ ID NO: 560784 - RNA, 19 nt, Coxiella burnetii RSA 493
cccucugaaaaauauucua

SEQ ID NO: 560785 - RNA, 13 nt, Coxiella burnetii RSA 493
cccuuuuuuucca

SEQ ID NO: 560786 - RNA, 18 nt, Coxiella burnetii RSA 493
cccuuauagcgugagagg

SEQ ID NO: 560787 - RNA, 20 nt, Coxiella burnetii RSA 493
cccuuauagcgugagaggac

SEQ ID NO: 560788 - RNA, 22 nt, Coxiella burnetii RSA 493
cccuucaauugcuuucccuuuu

SEQ ID NO: 560789 - RNA, 17 nt, Coxiella burnetii RSA 493
ccgacgacauuaaaaau

SEQ ID NO: 560790 - RNA, 13 nt, Coxiella burnetii RSA 493
ccgauauucuuuu

SEQ ID NO: 560791 - RNA, 15 nt, Coxiella burnetii RSA 493
ccgauuaauucuuua

SEQ ID NO: 560792 - RNA, 21 nt, Coxiella burnetii RSA 493
ccgcaaaccaggcuuaaaccc

SEQ ID NO: 560793 - RNA, 17 nt, Coxiella burnetii RSA 493
ccgcuuagcgccgacuc

SEQ ID NO: 560794 - RNA, 14 nt, Coxiella burnetii RSA 493
ccgcuucaaacaau

SEQ ID NO: 560795 - RNA, 15 nt, Coxiella burnetii RSA 493
ccgcuaaaauuuuuu

SEQ ID NO: 560796 - RNA, 13 nt, Coxiella burnetii RSA 493
ccgcuaauuguuc

SEQ ID NO: 560797 - RNA, 16 nt, Coxiella burnetii RSA 493
ccgcuuuuuguuugau

SEQ ID NO: 560798 - RNA, 20 nt, Coxiella burnetii RSA 493
ccuaaucggccuacuuuuuc

SEQ ID NO: 560799 - RNA, 20 nt, Coxiella burnetii RSA 493
ccguugcaagcguuuuucau

SEQ ID NO: 560800 - RNA, 17 nt, Coxiella burnetii RSA 493
ccgguauuuugcaaaug

SEQ ID NO: 560801 - RNA, 17 nt, Coxiella burnetii RSA 493
ccggcucgaugcaauua

SEQ ID NO: 560802 - RNA, 21 nt, Coxiella burnetii RSA 493
ccucauucaguucgcuaaaua

SEQ ID NO: 560803 - RNA, 19 nt, Coxiella burnetii RSA 493
ccuccacggaauuugaaau

SEQ ID NO: 560804 - RNA, 18 nt, Coxiella burnetii RSA 493
ccuccaaaaacugcaucg

SEQ ID NO: 560805 - RNA, 18 nt, Coxiella burnetii RSA 493
ccuccucgcgauuuucgu

SEQ ID NO: 560806 - RNA, 14 nt, Coxiella burnetii RSA 493
ccuccuugcaagcu

SEQ ID NO: 560807 - RNA, 22 nt, Coxiella burnetii RSA 493
ccuccggcgcgcgcuugacuuu

SEQ ID NO: 560808 - RNA, 19 nt, Coxiella burnetii RSA 493
ccucccggcuuuaaaaccc

SEQ ID NO: 560809 - RNA, 21 nt, Coxiella burnetii RSA 493
ccucuugcaacguuugauuuu

SEQ ID NO: 560810 - RNA, 12 nt, Coxiella burnetii RSA 493
ccucuucuaaag

SEQ ID NO: 560811 - RNA, 21 nt, Coxiella burnetii RSA 493
ccucucgucggguauuuucau

SEQ ID NO: 560812 - RNA, 15 nt, Coxiella burnetii RSA 493
ccucgugggcccagu

SEQ ID NO: 560813 - RNA, 22 nt, Coxiella burnetii RSA 493
ccugaacaggauuuucauuaau

SEQ ID NO: 560814 - RNA, 13 nt, Coxiella burnetii RSA 493
ccucuuuuuaaaa

SEQ ID NO: 560815 - RNA, 13 nt, Coxiella burnetii RSA 493
ccucuuuaccucc

SEQ ID NO: 560816 - RNA, 13 nt, Coxiella burnetii RSA 493
ccugaaaaauaau

SEQ ID NO: 560817 - RNA, 17 nt, Coxiella burnetii RSA 493
ccucgcguuuuaucauu

SEQ ID NO: 560818 - RNA, 18 nt, Coxiella burnetii RSA 493
ccucgacggguugucuga

SEQ ID NO: 560819 - RNA, 16 nt, Coxiella burnetii RSA 493
ccugaaugagauaacu

SEQ ID NO: 560820 - RNA, 17 nt, Coxiella burnetii RSA 493
ccugaaugcuuuuaaag

SEQ ID NO: 560821 - RNA, 22 nt, Coxiella burnetii RSA 493
ccugaaugcuuuuaaagugaug

SEQ ID NO: 560822 - RNA, 13 nt, Coxiella burnetii RSA 493
cgacuucucuuuc

SEQ ID NO: 560823 - RNA, 22 nt, Coxiella burnetii RSA 493
cgagaaaaccgcagcucaaaca

SEQ ID NO: 560824 - RNA, 12 nt, Coxiella burnetii RSA 493
cgacuucauuuc

SEQ ID NO: 560825 - RNA, 15 nt, Coxiella burnetii RSA 493
cgacggcucucucua

SEQ ID NO: 560826 - RNA, 13 nt, Coxiella burnetii RSA 493
cgacgggaaaaau

SEQ ID NO: 560827 - RNA, 14 nt, Coxiella burnetii RSA 493
cgagcaaucaaaac

SEQ ID NO: 560828 - RNA, 12 nt, Coxiella burnetii RSA 493
cgagcaaagcau

SEQ ID NO: 560829 - RNA, 14 nt, Coxiella burnetii RSA 493
cgagcaucuuuuug

SEQ ID NO: 560830 - RNA, 18 nt, Coxiella burnetii RSA 493
cgagccccaaaacgcuga

SEQ ID NO: 560831 - RNA, 21 nt, Coxiella burnetii RSA 493
cgagcccaauaacaagcuccc

SEQ ID NO: 560832 - RNA, 17 nt, Coxiella burnetii RSA 493
cgagaguaacgauuucu

SEQ ID NO: 560833 - RNA, 13 nt, Coxiella burnetii RSA 493
cgagaaggccaca

SEQ ID NO: 560834 - RNA, 17 nt, Coxiella burnetii RSA 493
cgagaauauauucauau

SEQ ID NO: 560835 - RNA, 13 nt, Coxiella burnetii RSA 493
cgagugcgcccgu

SEQ ID NO: 560836 - RNA, 16 nt, Coxiella burnetii RSA 493
cgagucaaaaauaaaa

SEQ ID NO: 560837 - RNA, 13 nt, Coxiella burnetii RSA 493
cgagggcugcaac

SEQ ID NO: 560838 - RNA, 17 nt, Coxiella burnetii RSA 493
cgaggguaauaaaguaa

SEQ ID NO: 560839 - RNA, 21 nt, Coxiella burnetii RSA 493
cgauaagcguuugguugguuu

SEQ ID NO: 560840 - RNA, 14 nt, Coxiella burnetii RSA 493
cgauaaugcacauc

SEQ ID NO: 560841 - RNA, 19 nt, Coxiella burnetii RSA 493
cgauaucgugcucuuuuuu

SEQ ID NO: 560842 - RNA, 20 nt, Coxiella burnetii RSA 493
cgagcuuuucacccaaccaa

SEQ ID NO: 560843 - RNA, 19 nt, Coxiella burnetii RSA 493
cgaggaggguaagaauaaa

SEQ ID NO: 560844 - RNA, 22 nt, Coxiella burnetii RSA 493
cgaggaggguaagaauaaacuu

SEQ ID NO: 560845 - RNA, 14 nt, Coxiella burnetii RSA 493
cgaggcaaaauaaa

SEQ ID NO: 560846 - RNA, 16 nt, Coxiella burnetii RSA 493
cgagcgcccauuuuuu

SEQ ID NO: 560847 - RNA, 17 nt, Coxiella burnetii RSA 493
cgauuguaauugcuugg

SEQ ID NO: 560848 - RNA, 13 nt, Coxiella burnetii RSA 493
cgauucuuugucu

SEQ ID NO: 560849 - RNA, 11 nt, Coxiella burnetii RSA 493
cgauugcuaaa

SEQ ID NO: 560850 - RNA, 15 nt, Coxiella burnetii RSA 493
cgcaaaaauuucauu

SEQ ID NO: 560851 - RNA, 17 nt, Coxiella burnetii RSA 493
cgauuuugaauuuugcc

SEQ ID NO: 560852 - RNA, 16 nt, Coxiella burnetii RSA 493
cgauuucuuuuugugu

SEQ ID NO: 560853 - RNA, 18 nt, Coxiella burnetii RSA 493
cgauuuuaauuuuuucuc

SEQ ID NO: 560854 - RNA, 16 nt, Coxiella burnetii RSA 493
cgauuuucucuucaac

SEQ ID NO: 560855 - RNA, 21 nt, Coxiella burnetii RSA 493
cgauuucccggcugugaauua

SEQ ID NO: 560856 - RNA, 13 nt, Coxiella burnetii RSA 493
cgaucaacaaaau

SEQ ID NO: 560857 - RNA, 21 nt, Coxiella burnetii RSA 493
cgaucaagacucaaagaaaua

SEQ ID NO: 560858 - RNA, 14 nt, Coxiella burnetii RSA 493
cgcaagcacugcac

SEQ ID NO: 560859 - RNA, 14 nt, Coxiella burnetii RSA 493
cgcaagaaucucca

SEQ ID NO: 560860 - RNA, 12 nt, Coxiella burnetii RSA 493
cgcaauccucuc

SEQ ID NO: 560861 - RNA, 15 nt, Coxiella burnetii RSA 493
cgcacaaacgcgccc

SEQ ID NO: 560862 - RNA, 21 nt, Coxiella burnetii RSA 493
cgcacaaacgcgcccgcccca

SEQ ID NO: 560863 - RNA, 14 nt, Coxiella burnetii RSA 493
cgcaugguccaaaa

SEQ ID NO: 560864 - RNA, 16 nt, Coxiella burnetii RSA 493
cgcauuagcuucguua

SEQ ID NO: 560865 - RNA, 22 nt, Coxiella burnetii RSA 493
cgcauuaguuuaaauuuuucau

SEQ ID NO: 560866 - RNA, 13 nt, Coxiella burnetii RSA 493
cgcauugcauuuc

SEQ ID NO: 560867 - RNA, 15 nt, Coxiella burnetii RSA 493
cgcauugcauuucuu

SEQ ID NO: 560868 - RNA, 18 nt, Coxiella burnetii RSA 493
cgcauugcauuucuuuca

SEQ ID NO: 560869 - RNA, 23 nt, Coxiella burnetii RSA 493
cgccaaaagguauguugucauca

SEQ ID NO: 560870 - RNA, 19 nt, Coxiella burnetii RSA 493
cgccagaaacaacuaccug

SEQ ID NO: 560871 - RNA, 13 nt, Coxiella burnetii RSA 493
cgcaucaaaaaaa

SEQ ID NO: 560872 - RNA, 17 nt, Coxiella burnetii RSA 493
cgcaucgcgccaugcau

SEQ ID NO: 560873 - RNA, 22 nt, Coxiella burnetii RSA 493
cgcagcaaaaugagggggagcc

SEQ ID NO: 560874 - RNA, 18 nt, Coxiella burnetii RSA 493
ccuucgcauaaaacgcau

SEQ ID NO: 560875 - RNA, 15 nt, Coxiella burnetii RSA 493
ccuucgcuuuuucca

SEQ ID NO: 560876 - RNA, 22 nt, Coxiella burnetii RSA 493
ccuucccggagcgaucaacgcg

SEQ ID NO: 560877 - RNA, 22 nt, Coxiella burnetii RSA 493
ccuucuuuuaaagugauuuuuu

SEQ ID NO: 560878 - RNA, 16 nt, Coxiella burnetii RSA 493
ccuucuuuuucaaucg

SEQ ID NO: 560879 - RNA, 21 nt, Coxiella burnetii RSA 493
ccuucuugccgcccuugcugc

SEQ ID NO: 560880 - RNA, 13 nt, Coxiella burnetii RSA 493
ccuucuucuuugg

SEQ ID NO: 560881 - RNA, 19 nt, Coxiella burnetii RSA 493
ccuucuugucauucccuuu

SEQ ID NO: 560882 - RNA, 20 nt, Coxiella burnetii RSA 493
ccuucuugucauucccuuuu

SEQ ID NO: 560883 - RNA, 22 nt, Coxiella burnetii RSA 493
ccuucuugucauucccuuuuuc

SEQ ID NO: 560884 - RNA, 14 nt, Coxiella burnetii RSA 493
ccuucucaauuuca

SEQ ID NO: 560885 - RNA, 21 nt, Coxiella burnetii RSA 493
ccuucguaggccgcuuuuugu

SEQ ID NO: 560886 - RNA, 14 nt, Coxiella burnetii RSA 493
ccuugcaagcugcu

SEQ ID NO: 560887 - RNA, 12 nt, Coxiella burnetii RSA 493
ccuugcaauaag

SEQ ID NO: 560888 - RNA, 13 nt, Coxiella burnetii RSA 493
ccuugcaauaagc

SEQ ID NO: 560889 - RNA, 21 nt, Coxiella burnetii RSA 493
ccuugagcgaaagccaaguuu

SEQ ID NO: 560890 - RNA, 19 nt, Coxiella burnetii RSA 493
ccuugcucaaguccuugcu

SEQ ID NO: 560891 - RNA, 22 nt, Coxiella burnetii RSA 493
ccuugcugaauucccuuuugaa

SEQ ID NO: 560892 - RNA, 21 nt, Coxiella burnetii RSA 493
ccuugcugcaagcccuuuuga

SEQ ID NO: 560893 - RNA, 22 nt, Coxiella burnetii RSA 493
ccuuguaauucaaauuuuaaag

SEQ ID NO: 560894 - RNA, 14 nt, Coxiella burnetii RSA 493
ccuuguuuuaaccu

SEQ ID NO: 560895 - RNA, 13 nt, Coxiella burnetii RSA 493
ccuuguugaauuc

SEQ ID NO: 560896 - RNA, 18 nt, Coxiella burnetii RSA 493
ccuuguugaauuccuugu

SEQ ID NO: 560897 - RNA, 15 nt, Coxiella burnetii RSA 493
ccuuucugacgcuuu

SEQ ID NO: 560898 - RNA, 14 nt, Coxiella burnetii RSA 493
ccuuucuuucuuca

SEQ ID NO: 560899 - RNA, 15 nt, Coxiella burnetii RSA 493
ccuuucuuucuucac

SEQ ID NO: 560900 - RNA, 19 nt, Coxiella burnetii RSA 493
ccuuucuuucuucacuuuc

SEQ ID NO: 560901 - RNA, 11 nt, Coxiella burnetii RSA 493
ccuuugcaaac

SEQ ID NO: 560902 - RNA, 18 nt, Coxiella burnetii RSA 493
ccuuuaguuuuauuugaa

SEQ ID NO: 560903 - RNA, 17 nt, Coxiella burnetii RSA 493
ccuuucauuuaauuuua

SEQ ID NO: 560904 - RNA, 20 nt, Coxiella burnetii RSA 493
ccuuucauuuaauuuuaaau

SEQ ID NO: 560905 - RNA, 15 nt, Coxiella burnetii RSA 493
cgaaaagucguguua

SEQ ID NO: 560906 - RNA, 11 nt, Coxiella burnetii RSA 493
cgaaaaaaauc

SEQ ID NO: 560907 - RNA, 15 nt, Coxiella burnetii RSA 493
cgaaaagauuccaau

SEQ ID NO: 560908 - RNA, 20 nt, Coxiella burnetii RSA 493
cgaaaacuaguuauuuuuaa

SEQ ID NO: 560909 - RNA, 22 nt, Coxiella burnetii RSA 493
cgaaaacuaguuauuuuuaaaa

SEQ ID NO: 560910 - RNA, 20 nt, Coxiella burnetii RSA 493
ccuuuuucguguuuuuacga

SEQ ID NO: 560911 - RNA, 21 nt, Coxiella burnetii RSA 493
ccuuuuucuagggagaaaaau

SEQ ID NO: 560912 - RNA, 13 nt, Coxiella burnetii RSA 493
ccuuuuugauuuc

SEQ ID NO: 560913 - RNA, 13 nt, Coxiella burnetii RSA 493
ccuuuuuuuucaa

SEQ ID NO: 560914 - RNA, 11 nt, Coxiella burnetii RSA 493
ccuuuuuuaaa

SEQ ID NO: 560915 - RNA, 19 nt, Coxiella burnetii RSA 493
ccuuuugaaggaauaaaac

SEQ ID NO: 560916 - RNA, 22 nt, Coxiella burnetii RSA 493
ccuuuucauuaagcaauuuuuu

SEQ ID NO: 560917 - RNA, 16 nt, Coxiella burnetii RSA 493
ccuuuucccuaggaaa

SEQ ID NO: 560918 - RNA, 17 nt, Coxiella burnetii RSA 493
ccuuuuguuaacuuuuc

SEQ ID NO: 560919 - RNA, 17 nt, Coxiella burnetii RSA 493
cgaaagcuaaaaaagaa

SEQ ID NO: 560920 - RNA, 14 nt, Coxiella burnetii RSA 493
cgaaauagaauuuu

SEQ ID NO: 560921 - RNA, 20 nt, Coxiella burnetii RSA 493
cgaaauaucaucaacagaac

SEQ ID NO: 560922 - RNA, 11 nt, Coxiella burnetii RSA 493
cgaaauuuaac

SEQ ID NO: 560923 - RNA, 21 nt, Coxiella burnetii RSA 493
cgaacagccgaugacaaauaa

SEQ ID NO: 560924 - RNA, 16 nt, Coxiella burnetii RSA 493
cgacgacauuaaaaau

SEQ ID NO: 560925 - RNA, 15 nt, Coxiella burnetii RSA 493
cgacgaucacccacg

SEQ ID NO: 560926 - RNA, 19 nt, Coxiella burnetii RSA 493
cgacauaggagauuuuuau

SEQ ID NO: 560927 - RNA, 23 nt, Coxiella burnetii RSA 493
cgacauaggagauuuuuaugaaa

SEQ ID NO: 560928 - RNA, 21 nt, Coxiella burnetii RSA 493
cgacaucggcuuuuucaagcu

SEQ ID NO: 560929 - RNA, 18 nt, Coxiella burnetii RSA 493
cgacaggacaaaccuggc

SEQ ID NO: 560930 - RNA, 15 nt, Coxiella burnetii RSA 493
cgaacuuuccaaacu

SEQ ID NO: 560931 - RNA, 19 nt, Coxiella burnetii RSA 493
cgaagcggcucuugcuuua

SEQ ID NO: 560932 - RNA, 23 nt, Coxiella burnetii RSA 493
cgaagccuauuuuugauuacuua

SEQ ID NO: 560933 - RNA, 22 nt, Coxiella burnetii RSA 493
cgaaggugauucucucaaagaa

SEQ ID NO: 560934 - RNA, 13 nt, Coxiella burnetii RSA 493
cgaaguucucaaa

SEQ ID NO: 560935 - RNA, 13 nt, Coxiella burnetii RSA 493
cgaauaacggaaa

SEQ ID NO: 560936 - RNA, 15 nt, Coxiella burnetii RSA 493
cgaauccucucaccc

SEQ ID NO: 560937 - RNA, 19 nt, Coxiella burnetii RSA 493
cgaaucaaguccaauuaua

SEQ ID NO: 560938 - RNA, 21 nt, Coxiella burnetii RSA 493
cgaaucacuuguccuucuucu

SEQ ID NO: 560939 - RNA, 15 nt, Coxiella burnetii RSA 493
cgaaucaucuuuuuu

SEQ ID NO: 560940 - RNA, 12 nt, Coxiella burnetii RSA 493
cgaauagccaau

SEQ ID NO: 560941 - RNA, 14 nt, Coxiella burnetii RSA 493
cgaauguuaauucg

SEQ ID NO: 560942 - RNA, 21 nt, Coxiella burnetii RSA 493
cgaaugguugaaagaaaaaaa

SEQ ID NO: 560943 - RNA, 16 nt, Coxiella burnetii RSA 493
cgaauguuuaaauuaa

SEQ ID NO: 560944 - RNA, 13 nt, Coxiella burnetii RSA 493
cgaauuaaaaaau

SEQ ID NO: 560945 - RNA, 17 nt, Coxiella burnetii RSA 493
cgacaauaaaagcgccu

SEQ ID NO: 560946 - RNA, 13 nt, Coxiella burnetii RSA 493
cgaauuuguucuu

SEQ ID NO: 560947 - RNA, 15 nt, Coxiella burnetii RSA 493
ccaaagcaaaaauac

SEQ ID NO: 560948 - RNA, 15 nt, Coxiella burnetii RSA 493
ccaaagcagauaaau

SEQ ID NO: 560949 - RNA, 17 nt, Coxiella burnetii RSA 493
ccaaacgccaucgauuu

SEQ ID NO: 560950 - RNA, 18 nt, Coxiella burnetii RSA 493
ccaaacgguccgccuaaa

SEQ ID NO: 560951 - RNA, 19 nt, Coxiella burnetii RSA 493
ccaaaucguugcauaauau

SEQ ID NO: 560952 - RNA, 22 nt, Coxiella burnetii RSA 493
ccaaaugaucggcgcauuuuua

SEQ ID NO: 560953 - RNA, 16 nt, Coxiella burnetii RSA 493
ccaaauaaaaaaacau

SEQ ID NO: 560954 - RNA, 23 nt, Coxiella burnetii RSA 493
ccaaaguuccgcuggggccgccg

SEQ ID NO: 560955 - RNA, 13 nt, Coxiella burnetii RSA 493
ccaaauaagccaa

SEQ ID NO: 560956 - RNA, 15 nt, Coxiella burnetii RSA 493
ccaaauaagccaaua

SEQ ID NO: 560957 - RNA, 13 nt, Coxiella burnetii RSA 493
ccaaauaauugau

SEQ ID NO: 560958 - RNA, 16 nt, Coxiella burnetii RSA 493
ccaaauaaugaguaug

SEQ ID NO: 560959 - RNA, 12 nt, Coxiella burnetii RSA 493
ccaaaaccgccg

SEQ ID NO: 560960 - RNA, 16 nt, Coxiella burnetii RSA 493
ccaaaagcaccccgug

SEQ ID NO: 560961 - RNA, 18 nt, Coxiella burnetii RSA 493
ccaaaaaauuaagagaaa

SEQ ID NO: 560962 - RNA, 19 nt, Coxiella burnetii RSA 493
ccaaaaacagauuuaaaua

SEQ ID NO: 560963 - RNA, 20 nt, Coxiella burnetii RSA 493
ccaaaaacagauuuaaauag

SEQ ID NO: 560964 - RNA, 22 nt, Coxiella burnetii RSA 493
ccaaaaacagauuuaaauagcu

SEQ ID NO: 560965 - RNA, 13 nt, Coxiella burnetii RSA 493
ccaaaaacauugg

SEQ ID NO: 560966 - RNA, 10 nt, Coxiella burnetii RSA 493
ccaaaaaccc

SEQ ID NO: 560967 - RNA, 11 nt, Coxiella burnetii RSA 493
ccaaacaaaag

SEQ ID NO: 560968 - RNA, 12 nt, Coxiella burnetii RSA 493
ccaaaauagaau

SEQ ID NO: 560969 - RNA, 23 nt, Coxiella burnetii RSA 493
ccaaaaggaaugaauagaaaaac

SEQ ID NO: 560970 - RNA, 17 nt, Coxiella burnetii RSA 493
ccaacuguuuagugcuu

SEQ ID NO: 560971 - RNA, 20 nt, Coxiella burnetii RSA 493
ccaacgcuuguuuuauaccu

SEQ ID NO: 560972 - RNA, 21 nt, Coxiella burnetii RSA 493
ccaacccaaggaaccaccaaa

SEQ ID NO: 560973 - RNA, 18 nt, Coxiella burnetii RSA 493
ccaacauucuuugaucuu

SEQ ID NO: 560974 - RNA, 19 nt, Coxiella burnetii RSA 493
ccaagcgggguuaaggaaa

SEQ ID NO: 560975 - RNA, 19 nt, Coxiella burnetii RSA 493
ccaaucacuaagucacuga

SEQ ID NO: 560976 - RNA, 11 nt, Coxiella burnetii RSA 493
ccaaucuauua

SEQ ID NO: 560977 - RNA, 19 nt, Coxiella burnetii RSA 493
ccaaugacgcagaauauaa

SEQ ID NO: 560978 - RNA, 18 nt, Coxiella burnetii RSA 493
ccaauacuagcuuuugaa

SEQ ID NO: 560979 - RNA, 13 nt, Coxiella burnetii RSA 493
ccaauaguaaaac

SEQ ID NO: 560980 - RNA, 17 nt, Coxiella burnetii RSA 493
ccacaaucacuacaaau

SEQ ID NO: 560981 - RNA, 20 nt, Coxiella burnetii RSA 493
ccaauugucuuugaugugaa

SEQ ID NO: 560982 - RNA, 20 nt, Coxiella burnetii RSA 493
ccaauuguuugaaaaaauac

SEQ ID NO: 560983 - RNA, 20 nt, Coxiella burnetii RSA 493
ccaauguaggugaaaacguc

SEQ ID NO: 560984 - RNA, 18 nt, Coxiella burnetii RSA 493
ccaauguuuccaaauaau

SEQ ID NO: 560985 - RNA, 20 nt, Coxiella burnetii RSA 493
ccaauuaaagaaucguaaua

SEQ ID NO: 560986 - RNA, 21 nt, Coxiella burnetii RSA 493
ccaauuauaacuauuuuaaau

SEQ ID NO: 560987 - RNA, 23 nt, Coxiella burnetii RSA 493
ccaauuauaacuauuuuaaaucu

SEQ ID NO: 560988 - RNA, 22 nt, Coxiella burnetii RSA 493
ccacacugucgaauaaccggcu

SEQ ID NO: 560989 - RNA, 17 nt, Coxiella burnetii RSA 493
ccacagacucuuuuuau

SEQ ID NO: 560990 - RNA, 14 nt, Coxiella burnetii RSA 493
ccaccacguguauu

SEQ ID NO: 560991 - RNA, 17 nt, Coxiella burnetii RSA 493
ccacaucuggaaucaag

SEQ ID NO: 560992 - RNA, 23 nt, Coxiella burnetii RSA 493
ccacauaaccguugaauagcagu

SEQ ID NO: 560993 - RNA, 18 nt, Coxiella burnetii RSA 493
ccagaccuguuaaaaacg

SEQ ID NO: 560994 - RNA, 23 nt, Coxiella burnetii RSA 493
ccagaaaacguuucaucaaaauu

SEQ ID NO: 560995 - RNA, 15 nt, Coxiella burnetii RSA 493
ccagaaaaguaaaaa

SEQ ID NO: 560996 - RNA, 21 nt, Coxiella burnetii RSA 493
ccagaaacaacuaccugauaa

SEQ ID NO: 560997 - RNA, 20 nt, Coxiella burnetii RSA 493
ccagccaaaucgcagugccc

SEQ ID NO: 560998 - RNA, 15 nt, Coxiella burnetii RSA 493
ccaggaaagauauuc

SEQ ID NO: 560999 - RNA, 19 nt, Coxiella burnetii RSA 493
ccagcccccucuacaauaa

SEQ ID NO: 561000 - RNA, 13 nt, Coxiella burnetii RSA 493
ccaguuuuaugcg

SEQ ID NO: 561001 - RNA, 14 nt, Coxiella burnetii RSA 493
ccauagaagaacaa

SEQ ID NO: 561002 - RNA, 15 nt, Coxiella burnetii RSA 493
ccauaauccuucuuu

SEQ ID NO: 561003 - RNA, 17 nt, Coxiella burnetii RSA 493
ccauacgggcuacuucc

SEQ ID NO: 561004 - RNA, 18 nt, Coxiella burnetii RSA 493
ccauauaaucgcaaaauu

SEQ ID NO: 561005 - RNA, 21 nt, Coxiella burnetii RSA 493
ccauauuugcugaauuuuauu

SEQ ID NO: 561006 - RNA, 17 nt, Coxiella burnetii RSA 493
ccaucucgaaauuauuu

SEQ ID NO: 561007 - RNA, 16 nt, Coxiella burnetii RSA 493
ccaugagugccacaaa

SEQ ID NO: 561008 - RNA, 21 nt, Coxiella burnetii RSA 493
ccaugucguuauugcucaucu

SEQ ID NO: 561009 - RNA, 20 nt, Coxiella burnetii RSA 493
ccauguuauuuuccucccau

SEQ ID NO: 561010 - RNA, 19 nt, Coxiella burnetii RSA 493
ccauucgcuaauuguuuug

SEQ ID NO: 561011 - RNA, 20 nt, Coxiella burnetii RSA 493
ccauuacgcaugucaauaac

SEQ ID NO: 561012 - RNA, 14 nt, Coxiella burnetii RSA 493
ccauucaaugcuaa

SEQ ID NO: 561013 - RNA, 21 nt, Coxiella burnetii RSA 493
ccauguuggauuucaucuugc

SEQ ID NO: 561014 - RNA, 14 nt, Coxiella burnetii RSA 493
ccauuaaaaacaau

SEQ ID NO: 561015 - RNA, 20 nt, Coxiella burnetii RSA 493
ccauuaaaagcgaggaccgu

SEQ ID NO: 561016 - RNA, 13 nt, Coxiella burnetii RSA 493
ccauuaauaaagu

SEQ ID NO: 561017 - RNA, 15 nt, Coxiella burnetii RSA 493
cccaaggaaucuauu

SEQ ID NO: 561018 - RNA, 22 nt, Coxiella burnetii RSA 493
cccaacgagcucaaaaguugau

SEQ ID NO: 561019 - RNA, 22 nt, Coxiella burnetii RSA 493
ccauugguuuaaaaaguucacc

SEQ ID NO: 561020 - RNA, 23 nt, Coxiella burnetii RSA 493
ccauugucucguuagaaaagcgc

SEQ ID NO: 561021 - RNA, 12 nt, Coxiella burnetii RSA 493
ccccguuaccaa

SEQ ID NO: 561022 - RNA, 15 nt, Coxiella burnetii RSA 493
ccccguauuucgcuu

SEQ ID NO: 561023 - RNA, 21 nt, Coxiella burnetii RSA 493
cccauugauaauaauugcugu

SEQ ID NO: 561024 - RNA, 13 nt, Coxiella burnetii RSA 493
ccccauuuuuuau

SEQ ID NO: 561025 - RNA, 16 nt, Coxiella burnetii RSA 493
ccccauuuuuuaucca

SEQ ID NO: 561026 - RNA, 17 nt, Coxiella burnetii RSA 493
ccccauugauaauaauu

SEQ ID NO: 561027 - RNA, 16 nt, Coxiella burnetii RSA 493
cccauaagcggguuau

SEQ ID NO: 561028 - RNA, 15 nt, Coxiella burnetii RSA 493
cccaugagguugcau

SEQ ID NO: 561029 - RNA, 21 nt, Coxiella burnetii RSA 493
cagcuaauuuagguguaaguc

SEQ ID NO: 561030 - RNA, 21 nt, Coxiella burnetii RSA 493
cagcgggugaugaaaucguuu

SEQ ID NO: 561031 - RNA, 14 nt, Coxiella burnetii RSA 493
caggaaaaagauaa

SEQ ID NO: 561032 - RNA, 15 nt, Coxiella burnetii RSA 493
caggaaaguuccccc

SEQ ID NO: 561033 - RNA, 15 nt, Coxiella burnetii RSA 493
caggauaauguuuga

SEQ ID NO: 561034 - RNA, 21 nt, Coxiella burnetii RSA 493
caggauaauguuugauaucaa

SEQ ID NO: 561035 - RNA, 16 nt, Coxiella burnetii RSA 493
caggcugcuagaagua

SEQ ID NO: 561036 - RNA, 14 nt, Coxiella burnetii RSA 493
cagguccuaaaaaa

SEQ ID NO: 561037 - RNA, 12 nt, Coxiella burnetii RSA 493
caguaucuauuc

SEQ ID NO: 561038 - RNA, 16 nt, Coxiella burnetii RSA 493
caguaucuauuccugc

SEQ ID NO: 561039 - RNA, 22 nt, Coxiella burnetii RSA 493
caguauuucuaucgccguuucu

SEQ ID NO: 561040 - RNA, 14 nt, Coxiella burnetii RSA 493
cagucaugggguaa

SEQ ID NO: 561041 - RNA, 18 nt, Coxiella burnetii RSA 493
caguaaugagcaucuuuu

SEQ ID NO: 561042 - RNA, 17 nt, Coxiella burnetii RSA 493
caguaaauaaucauuuu

SEQ ID NO: 561043 - RNA, 18 nt, Coxiella burnetii RSA 493
caguaaauaaucauuuuu

SEQ ID NO: 561044 - RNA, 19 nt, Coxiella burnetii RSA 493
caguucgcuaaauaacagu

SEQ ID NO: 561045 - RNA, 21 nt, Coxiella burnetii RSA 493
caguuaggccuauccuauucu

SEQ ID NO: 561046 - RNA, 14 nt, Coxiella burnetii RSA 493
cagugccccuccuc

SEQ ID NO: 561047 - RNA, 17 nt, Coxiella burnetii RSA 493
cauaacuucguccgaag

SEQ ID NO: 561048 - RNA, 18 nt, Coxiella burnetii RSA 493
cauaaagcuuauauaaag

SEQ ID NO: 561049 - RNA, 22 nt, Coxiella burnetii RSA 493
cauaaagcuuauauaaagggcc

SEQ ID NO: 561050 - RNA, 11 nt, Coxiella burnetii RSA 493
cauaaauaaaa

SEQ ID NO: 561051 - RNA, 15 nt, Coxiella burnetii RSA 493
cauaaggaaauugau

SEQ ID NO: 561052 - RNA, 20 nt, Coxiella burnetii RSA 493
cauaauaacgcuaugaaaac

SEQ ID NO: 561053 - RNA, 22 nt, Coxiella burnetii RSA 493
cauaauaaggcuaauuuuccuu

SEQ ID NO: 561054 - RNA, 14 nt, Coxiella burnetii RSA 493
caguuuucuucaau

SEQ ID NO: 561055 - RNA, 23 nt, Coxiella burnetii RSA 493
cauaaaauuagguaauuuauaac

SEQ ID NO: 561056 - RNA, 13 nt, Coxiella burnetii RSA 493
caguuugcagguu

SEQ ID NO: 561057 - RNA, 20 nt, Coxiella burnetii RSA 493
caguucgggccuucacuuuu

SEQ ID NO: 561058 - RNA, 17 nt, Coxiella burnetii RSA 493
caguuuaucguccaggu

SEQ ID NO: 561059 - RNA, 23 nt, Coxiella burnetii RSA 493
caugacgauuuuaauuuuuucuc

SEQ ID NO: 561060 - RNA, 21 nt, Coxiella burnetii RSA 493
caugaaguuccauuccaaaaa

SEQ ID NO: 561061 - RNA, 16 nt, Coxiella burnetii RSA 493
caucucucguucuuuu

SEQ ID NO: 561062 - RNA, 22 nt, Coxiella burnetii RSA 493
caugagcggucaguaaaccgcu

SEQ ID NO: 561063 - RNA, 20 nt, Coxiella burnetii RSA 493
caugaggagucaucgccaaa

SEQ ID NO: 561064 - RNA, 15 nt, Coxiella burnetii RSA 493
caugagguugcauga

SEQ ID NO: 561065 - RNA, 16 nt, Coxiella burnetii RSA 493
caugagguugcaugag

SEQ ID NO: 561066 - RNA, 21 nt, Coxiella burnetii RSA 493
caugaucgguuuuuugacugc

SEQ ID NO: 561067 - RNA, 21 nt, Coxiella burnetii RSA 493
caugcuugaccucgaagcaca

SEQ ID NO: 561068 - RNA, 18 nt, Coxiella burnetii RSA 493
caugcugauuuucacgaa

SEQ ID NO: 561069 - RNA, 15 nt, Coxiella burnetii RSA 493
caugcugcacgccuc

SEQ ID NO: 561070 - RNA, 17 nt, Coxiella burnetii RSA 493
cauuauauuuguauccg

SEQ ID NO: 561071 - RNA, 14 nt, Coxiella burnetii RSA 493
cauucaagagaggu

SEQ ID NO: 561072 - RNA, 21 nt, Coxiella burnetii RSA 493
cauuccaaaaacagauuuaaa

SEQ ID NO: 561073 - RNA, 22 nt, Coxiella burnetii RSA 493
cauuccaaaaacagauuuaaau

SEQ ID NO: 561074 - RNA, 14 nt, Coxiella burnetii RSA 493
cauucauucgcuuu

SEQ ID NO: 561075 - RNA, 19 nt, Coxiella burnetii RSA 493
cauucgaacgacuuuuuuu

SEQ ID NO: 561076 - RNA, 19 nt, Coxiella burnetii RSA 493
cauugggcuggaguugucc

SEQ ID NO: 561077 - RNA, 13 nt, Coxiella burnetii RSA 493
cauugguuuaaaa

SEQ ID NO: 561078 - RNA, 23 nt, Coxiella burnetii RSA 493
cauuggucaaugucagcuuccga

SEQ ID NO: 561079 - RNA, 20 nt, Coxiella burnetii RSA 493
cauugggccauuuaacaaaa

SEQ ID NO: 561080 - RNA, 18 nt, Coxiella burnetii RSA 493
cauucuuuuuucaagccc

SEQ ID NO: 561081 - RNA, 13 nt, Coxiella burnetii RSA 493
cauugaaaucaau

SEQ ID NO: 561082 - RNA, 19 nt, Coxiella burnetii RSA 493
cauucggguucgcagacau

SEQ ID NO: 561083 - RNA, 17 nt, Coxiella burnetii RSA 493
cauucgcguuuuuaaau

SEQ ID NO: 561084 - RNA, 18 nt, Coxiella burnetii RSA 493
cauuucggacaacaaaua

SEQ ID NO: 561085 - RNA, 16 nt, Coxiella burnetii RSA 493
cauuguauuauuaucc

SEQ ID NO: 561086 - RNA, 15 nt, Coxiella burnetii RSA 493
cauuucaauauuucu

SEQ ID NO: 561087 - RNA, 21 nt, Coxiella burnetii RSA 493
cauccaauuacuccaauuuca

SEQ ID NO: 561088 - RNA, 11 nt, Coxiella burnetii RSA 493
cauccaucccg

SEQ ID NO: 561089 - RNA, 22 nt, Coxiella burnetii RSA 493
cauccggaugucauaaucacaa

SEQ ID NO: 561090 - RNA, 14 nt, Coxiella burnetii RSA 493
caucgauuggguag

SEQ ID NO: 561091 - RNA, 14 nt, Coxiella burnetii RSA 493
caucggccuuuuuc

SEQ ID NO: 561092 - RNA, 21 nt, Coxiella burnetii RSA 493
caucguuaaacucggcuuuau

SEQ ID NO: 561093 - RNA, 21 nt, Coxiella burnetii RSA 493
caucguuuuauacacaucuuu

SEQ ID NO: 561094 - RNA, 17 nt, Coxiella burnetii RSA 493
cauauucgccuucuugc

SEQ ID NO: 561095 - RNA, 16 nt, Coxiella burnetii RSA 493
caucagauaccagaua

SEQ ID NO: 561096 - RNA, 17 nt, Coxiella burnetii RSA 493
cauaggagauuuuuaug

SEQ ID NO: 561097 - RNA, 16 nt, Coxiella burnetii RSA 493
cauagguauuuccuug

SEQ ID NO: 561098 - RNA, 19 nt, Coxiella burnetii RSA 493
cauagccucuauaaauaac

SEQ ID NO: 561099 - RNA, 12 nt, Coxiella burnetii RSA 493
cauaauucauca

SEQ ID NO: 561100 - RNA, 13 nt, Coxiella burnetii RSA 493
cauagaauuaaug

SEQ ID NO: 561101 - RNA, 21 nt, Coxiella burnetii RSA 493
caauucccccaaaaacuaaau

SEQ ID NO: 561102 - RNA, 17 nt, Coxiella burnetii RSA 493
caauuccgguuucaaau

SEQ ID NO: 561103 - RNA, 16 nt, Coxiella burnetii RSA 493
caauucgucgcuguau

SEQ ID NO: 561104 - RNA, 23 nt, Coxiella burnetii RSA 493
caauucucauaauucguuagcau

SEQ ID NO: 561105 - RNA, 21 nt, Coxiella burnetii RSA 493
caauugaaaaaccauucaaug

SEQ ID NO: 561106 - RNA, 12 nt, Coxiella burnetii RSA 493
caauucuuuuua

SEQ ID NO: 561107 - RNA, 13 nt, Coxiella burnetii RSA 493
caauucuuuuuaa

SEQ ID NO: 561108 - RNA, 20 nt, Coxiella burnetii RSA 493
caauuggagguucucuuuau

SEQ ID NO: 561109 - RNA, 16 nt, Coxiella burnetii RSA 493
caauuguugauuuaac

SEQ ID NO: 561110 - RNA, 16 nt, Coxiella burnetii RSA 493
caauuguucaauggcu

SEQ ID NO: 561111 - RNA, 17 nt, Coxiella burnetii RSA 493
caauuguuugaaaaaau

SEQ ID NO: 561112 - RNA, 18 nt, Coxiella burnetii RSA 493
caauuguuugaaaaaaua

SEQ ID NO: 561113 - RNA, 15 nt, Coxiella burnetii RSA 493
caauuacuuuuauaa

SEQ ID NO: 561114 - RNA, 21 nt, Coxiella burnetii RSA 493
caauuagcauuuucuccaaag

SEQ ID NO: 561115 - RNA, 19 nt, Coxiella burnetii RSA 493
caauuacgcccuuucucuu

SEQ ID NO: 561116 - RNA, 19 nt, Coxiella burnetii RSA 493
caauuacuccaauuucauu

SEQ ID NO: 561117 - RNA, 13 nt, Coxiella burnetii RSA 493
caauuaugaaaac

SEQ ID NO: 561118 - RNA, 22 nt, Coxiella burnetii RSA 493
caauuaugaaaacgacuuauuu

SEQ ID NO: 561119 - RNA, 13 nt, Coxiella burnetii RSA 493
caauucaaauaau

SEQ ID NO: 561120 - RNA, 17 nt, Coxiella burnetii RSA 493
caauuaacuuugcaaag

SEQ ID NO: 561121 - RNA, 22 nt, Coxiella burnetii RSA 493
caauuaaugcgccuacaaauac

SEQ ID NO: 561122 - RNA, 12 nt, Coxiella burnetii RSA 493
cacaaaaaaauu

SEQ ID NO: 561123 - RNA, 14 nt, Coxiella burnetii RSA 493
caauuuuaaaacau

SEQ ID NO: 561124 - RNA, 23 nt, Coxiella burnetii RSA 493
caauuugaugaucggaggaaaua

SEQ ID NO: 561125 - RNA, 12 nt, Coxiella burnetii RSA 493
caauuucuaauc

SEQ ID NO: 561126 - RNA, 19 nt, Coxiella burnetii RSA 493
caauuucucgccauauuug

SEQ ID NO: 561127 - RNA, 23 nt, Coxiella burnetii RSA 493
caauuucucguugauaaagauuc

SEQ ID NO: 561128 - RNA, 17 nt, Coxiella burnetii RSA 493
caauuuauucaacucuu

SEQ ID NO: 561129 - RNA, 13 nt, Coxiella burnetii RSA 493
caauuucauuauc

SEQ ID NO: 561130 - RNA, 20 nt, Coxiella burnetii RSA 493
caauuuaccuccaaaaccca

SEQ ID NO: 561131 - RNA, 22 nt, Coxiella burnetii RSA 493
caauuuaggcucaauuuauccg

SEQ ID NO: 561132 - RNA, 17 nt, Coxiella burnetii RSA 493
caauuucaacgccucuc

SEQ ID NO: 561133 - RNA, 16 nt, Coxiella burnetii RSA 493
caauuucaaugacuuu

SEQ ID NO: 561134 - RNA, 11 nt, Coxiella burnetii RSA 493
cacaaaauaag

SEQ ID NO: 561135 - RNA, 16 nt, Coxiella burnetii RSA 493
cacaacuuucuuccaa

SEQ ID NO: 561136 - RNA, 17 nt, Coxiella burnetii RSA 493
cacaaccacuguccucu

SEQ ID NO: 561137 - RNA, 13 nt, Coxiella burnetii RSA 493
cacaagucucaga

SEQ ID NO: 561138 - RNA, 17 nt, Coxiella burnetii RSA 493
cacaagucucagaaucu

SEQ ID NO: 561139 - RNA, 21 nt, Coxiella burnetii RSA 493
cacaauuaacguauaaauaac

SEQ ID NO: 561140 - RNA, 15 nt, Coxiella burnetii RSA 493
cacaaugcuuuucuc

SEQ ID NO: 561141 - RNA, 16 nt, Coxiella burnetii RSA 493
cacaaugcuuuucuca

SEQ ID NO: 561142 - RNA, 18 nt, Coxiella burnetii RSA 493
cacagcccuaauaaaaca

SEQ ID NO: 561143 - RNA, 13 nt, Coxiella burnetii RSA 493
cacaguucuuaac

SEQ ID NO: 561144 - RNA, 12 nt, Coxiella burnetii RSA 493
cacaugauuuuu

SEQ ID NO: 561145 - RNA, 16 nt, Coxiella burnetii RSA 493
cacauuuguucgauac

SEQ ID NO: 561146 - RNA, 13 nt, Coxiella burnetii RSA 493
caccaaaucacgc

SEQ ID NO: 561147 - RNA, 14 nt, Coxiella burnetii RSA 493
caccaaaucacgcu

SEQ ID NO: 561148 - RNA, 20 nt, Coxiella burnetii RSA 493
caccaagaaauugaucuucu

SEQ ID NO: 561149 - RNA, 13 nt, Coxiella burnetii RSA 493
caccacuacuucu

SEQ ID NO: 561150 - RNA, 16 nt, Coxiella burnetii RSA 493
caccacucacagcccu

SEQ ID NO: 561151 - RNA, 21 nt, Coxiella burnetii RSA 493
cacccacaucuggaaucaagu

SEQ ID NO: 561152 - RNA, 23 nt, Coxiella burnetii RSA 493
caccccacaucguuucaaacacu

SEQ ID NO: 561153 - RNA, 18 nt, Coxiella burnetii RSA 493
cacccaguuguuuuaaau

SEQ ID NO: 561154 - RNA, 15 nt, Coxiella burnetii RSA 493
caccuaaaucaauuu

SEQ ID NO: 561155 - RNA, 21 nt, Coxiella burnetii RSA 493
cacgaccccaaugcuccgcgu

SEQ ID NO: 561156 - RNA, 14 nt, Coxiella burnetii RSA 493
cacgacuaauagcu

SEQ ID NO: 561157 - RNA, 21 nt, Coxiella burnetii RSA 493
cacgaaccgccggguuuuuug

SEQ ID NO: 561158 - RNA, 14 nt, Coxiella burnetii RSA 493
caccgcaaaguccu

SEQ ID NO: 561159 - RNA, 17 nt, Coxiella burnetii RSA 493
caccgacaucgcuccca

SEQ ID NO: 561160 - RNA, 17 nt, Coxiella burnetii RSA 493
caccggcgucugaaugg

SEQ ID NO: 561161 - RNA, 13 nt, Coxiella burnetii RSA 493
cacgauuuuucuc

SEQ ID NO: 561162 - RNA, 18 nt, Coxiella burnetii RSA 493
cacgauuuaaauuggcca

SEQ ID NO: 561163 - RNA, 16 nt, Coxiella burnetii RSA 493
cacgaugauuaaauca

SEQ ID NO: 561164 - RNA, 22 nt, Coxiella burnetii RSA 493
cacgauaauccgccuaaauuaa

SEQ ID NO: 561165 - RNA, 18 nt, Coxiella burnetii RSA 493
cacgauauguuguuugcu

SEQ ID NO: 561166 - RNA, 17 nt, Coxiella burnetii RSA 493
cacgaucaacaaaauau

SEQ ID NO: 561167 - RNA, 13 nt, Coxiella burnetii RSA 493
cacgccaaagcau

SEQ ID NO: 561168 - RNA, 14 nt, Coxiella burnetii RSA 493
cacggcaaauaaag

SEQ ID NO: 561169 - RNA, 19 nt, Coxiella burnetii RSA 493
cacggaauuugaaauaaac

SEQ ID NO: 561170 - RNA, 22 nt, Coxiella burnetii RSA 493
cacgcguucuugggcaauuugu

SEQ ID NO: 561171 - RNA, 15 nt, Coxiella burnetii RSA 493
cacuaagucacugau

SEQ ID NO: 561172 - RNA, 15 nt, Coxiella burnetii RSA 493
cacguacccaggcgu

SEQ ID NO: 561173 - RNA, 16 nt, Coxiella burnetii RSA 493
cacguaucugcuaaaa

SEQ ID NO: 561174 - RNA, 22 nt, Coxiella burnetii RSA 493
cacucgguuggucggaauugcu

SEQ ID NO: 561175 - RNA, 16 nt, Coxiella burnetii RSA 493
cacucuuuaauuugca

SEQ ID NO: 561176 - RNA, 17 nt, Coxiella burnetii RSA 493
cacuauccacaaaggcu

SEQ ID NO: 561177 - RNA, 20 nt, Coxiella burnetii RSA 493
cacuaugaucaugccuuuuu

SEQ ID NO: 561178 - RNA, 14 nt, Coxiella burnetii RSA 493
cacuaguuuuacua

SEQ ID NO: 561179 - RNA, 17 nt, Coxiella burnetii RSA 493
cacuaguuuuacuacau

SEQ ID NO: 561180 - RNA, 14 nt, Coxiella burnetii RSA 493
cacuacgugcgcug

SEQ ID NO: 561181 - RNA, 16 nt, Coxiella burnetii RSA 493
cacuauugaagucugg

SEQ ID NO: 561182 - RNA, 13 nt, Coxiella burnetii RSA 493
caacgauuuuccc

SEQ ID NO: 561183 - RNA, 14 nt, Coxiella burnetii RSA 493
caacgguucucaaa

SEQ ID NO: 561184 - RNA, 14 nt, Coxiella burnetii RSA 493
caacgguauaaaau

SEQ ID NO: 561185 - RNA, 20 nt, Coxiella burnetii RSA 493
caacuccugaaaaauaauuu

SEQ ID NO: 561186 - RNA, 12 nt, Coxiella burnetii RSA 493
caacucuacuuc

SEQ ID NO: 561187 - RNA, 13 nt, Coxiella burnetii RSA 493
caacuuuuuuccu

SEQ ID NO: 561188 - RNA, 20 nt, Coxiella burnetii RSA 493
caagaggaguucuaaaaaau

SEQ ID NO: 561189 - RNA, 21 nt, Coxiella burnetii RSA 493
caagaggaguucuaaaaaauu

SEQ ID NO: 561190 - RNA, 14 nt, Coxiella burnetii RSA 493
caagaccccuauca

SEQ ID NO: 561191 - RNA, 17 nt, Coxiella burnetii RSA 493
caagaauuuuuuuauaa

SEQ ID NO: 561192 - RNA, 20 nt, Coxiella burnetii RSA 493
caauaccgguaaucauuucc

SEQ ID NO: 561193 - RNA, 18 nt, Coxiella burnetii RSA 493
caauaccauuuuuaaauu

SEQ ID NO: 561194 - RNA, 18 nt, Coxiella burnetii RSA 493
caauaccaauucaaauaa

SEQ ID NO: 561195 - RNA, 19 nt, Coxiella burnetii RSA 493
caauaccaauucaaauaau

SEQ ID NO: 561196 - RNA, 21 nt, Coxiella burnetii RSA 493
caauaccaagcucaugaaaag

SEQ ID NO: 561197 - RNA, 18 nt, Coxiella burnetii RSA 493
caauaacccacagccgcu

SEQ ID NO: 561198 - RNA, 13 nt, Coxiella burnetii RSA 493
caaguugcagagu

SEQ ID NO: 561199 - RNA, 17 nt, Coxiella burnetii RSA 493
caaguucuucuaaagaa

SEQ ID NO: 561200 - RNA, 14 nt, Coxiella burnetii RSA 493
caauagagcgggaa

SEQ ID NO: 561201 - RNA, 19 nt, Coxiella burnetii RSA 493
caauagagcgggaauuuuc

SEQ ID NO: 561202 - RNA, 16 nt, Coxiella burnetii RSA 493
caauagaguaauucca

SEQ ID NO: 561203 - RNA, 17 nt, Coxiella burnetii RSA 493
caauagaaaaaagaaau

SEQ ID NO: 561204 - RNA, 19 nt, Coxiella burnetii RSA 493
caaucaauucgaaagaaau

SEQ ID NO: 561205 - RNA, 20 nt, Coxiella burnetii RSA 493
caaucaauucgaaagaaaua

SEQ ID NO: 561206 - RNA, 17 nt, Coxiella burnetii RSA 493
caaucaaugcaguuaac

SEQ ID NO: 561207 - RNA, 18 nt, Coxiella burnetii RSA 493
caaucacaaguucuucua

SEQ ID NO: 561208 - RNA, 16 nt, Coxiella burnetii RSA 493
caauauggaacccguu

SEQ ID NO: 561209 - RNA, 16 nt, Coxiella burnetii RSA 493
caagauuuuuuuaagu

SEQ ID NO: 561210 - RNA, 11 nt, Coxiella burnetii RSA 493
caagcgcggcc

SEQ ID NO: 561211 - RNA, 18 nt, Coxiella burnetii RSA 493
caagcgaacgcggccuug

SEQ ID NO: 561212 - RNA, 13 nt, Coxiella burnetii RSA 493
caagcuuuugccu

SEQ ID NO: 561213 - RNA, 17 nt, Coxiella burnetii RSA 493
caagcucaugaaaagca

SEQ ID NO: 561214 - RNA, 19 nt, Coxiella burnetii RSA 493
caagcuggcauugaaaauc

SEQ ID NO: 561215 - RNA, 20 nt, Coxiella burnetii RSA 493
caagguuggggucgcgaguu

SEQ ID NO: 561216 - RNA, 15 nt, Coxiella burnetii RSA 493
caaguaauucagcau

SEQ ID NO: 561217 - RNA, 22 nt, Coxiella burnetii RSA 493
caaguaauucagcauucccaua

SEQ ID NO: 561218 - RNA, 18 nt, Coxiella burnetii RSA 493
caaggcuauuccccuucu

SEQ ID NO: 561219 - RNA, 17 nt, Coxiella burnetii RSA 493
caagugaccgagauuuu

SEQ ID NO: 561220 - RNA, 21 nt, Coxiella burnetii RSA 493
caaguccggacgcaauaccca

SEQ ID NO: 561221 - RNA, 21 nt, Coxiella burnetii RSA 493
caaguguucacaagucucaga

SEQ ID NO: 561222 - RNA, 23 nt, Coxiella burnetii RSA 493
caaaaguggggauaauugaaaug

SEQ ID NO: 561223 - RNA, 13 nt, Coxiella burnetii RSA 493
auuuuuaugaaaa

SEQ ID NO: 561224 - RNA, 21 nt, Coxiella burnetii RSA 493
auuuuuauucuuaauuuuucc

SEQ ID NO: 561225 - RNA, 14 nt, Coxiella burnetii RSA 493
auuuuuauucuucu

SEQ ID NO: 561226 - RNA, 12 nt, Coxiella burnetii RSA 493
caaaaucaccag

SEQ ID NO: 561227 - RNA, 15 nt, Coxiella burnetii RSA 493
caaaaucaccagaaa

SEQ ID NO: 561228 - RNA, 17 nt, Coxiella burnetii RSA 493
caaaaucaccagaaaac

SEQ ID NO: 561229 - RNA, 20 nt, Coxiella burnetii RSA 493
caaaauagaauuguaaacag

SEQ ID NO: 561230 - RNA, 17 nt, Coxiella burnetii RSA 493
caaaauacaguaaauaa

SEQ ID NO: 561231 - RNA, 18 nt, Coxiella burnetii RSA 493
caaaauacaguaaauaau

SEQ ID NO: 561232 - RNA, 20 nt, Coxiella burnetii RSA 493
caaaauacaguaaauaauca

SEQ ID NO: 561233 - RNA, 14 nt, Coxiella burnetii RSA 493
caaaauaauaaccc

SEQ ID NO: 561234 - RNA, 12 nt, Coxiella burnetii RSA 493
caaaauaagaaa

SEQ ID NO: 561235 - RNA, 17 nt, Coxiella burnetii RSA 493
caaaauuaggagaucuu

SEQ ID NO: 561236 - RNA, 13 nt, Coxiella burnetii RSA 493
caaaauuuacuuu

SEQ ID NO: 561237 - RNA, 16 nt, Coxiella burnetii RSA 493
caaacaaaucaauccc

SEQ ID NO: 561238 - RNA, 23 nt, Coxiella burnetii RSA 493
caaaaugagggggagccuguaau

SEQ ID NO: 561239 - RNA, 11 nt, Coxiella burnetii RSA 493
caaaccaauca

SEQ ID NO: 561240 - RNA, 15 nt, Coxiella burnetii RSA 493
caaaccaaucacuaa

SEQ ID NO: 561241 - RNA, 18 nt, Coxiella burnetii RSA 493
caaacccacggcaaauaa

SEQ ID NO: 561242 - RNA, 19 nt, Coxiella burnetii RSA 493
caaacccacggcaaauaaa

SEQ ID NO: 561243 - RNA, 17 nt, Coxiella burnetii RSA 493
caaacagcgaaaacaaa

SEQ ID NO: 561244 - RNA, 15 nt, Coxiella burnetii RSA 493
caaaccgcgcugaag

SEQ ID NO: 561245 - RNA, 19 nt, Coxiella burnetii RSA 493
caaacgaauggcccaauaa

SEQ ID NO: 561246 - RNA, 16 nt, Coxiella burnetii RSA 493
caaacgauuaccuuug

SEQ ID NO: 561247 - RNA, 18 nt, Coxiella burnetii RSA 493
caacacgaucaacaaaau

SEQ ID NO: 561248 - RNA, 20 nt, Coxiella burnetii RSA 493
caaaugaauaagcaaagauc

SEQ ID NO: 561249 - RNA, 15 nt, Coxiella burnetii RSA 493
caaauguauuuauca

SEQ ID NO: 561250 - RNA, 21 nt, Coxiella burnetii RSA 493
caaaugcuaauuccuuuggua

SEQ ID NO: 561251 - RNA, 20 nt, Coxiella burnetii RSA 493
caaaugguugcugucaaaaa

SEQ ID NO: 561252 - RNA, 21 nt, Coxiella burnetii RSA 493
caaaugguugcugucaaaaaa

SEQ ID NO: 561253 - RNA, 23 nt, Coxiella burnetii RSA 493
caaauuuuccgugcagaaacaau

SEQ ID NO: 561254 - RNA, 21 nt, Coxiella burnetii RSA 493
caacaaaauauacucacccac

SEQ ID NO: 561255 - RNA, 21 nt, Coxiella burnetii RSA 493
caaagaccaaucguaaagauc

SEQ ID NO: 561256 - RNA, 16 nt, Coxiella burnetii RSA 493
caaacuugccuugaga

SEQ ID NO: 561257 - RNA, 19 nt, Coxiella burnetii RSA 493
caaacuguuugcauuuaau

SEQ ID NO: 561258 - RNA, 23 nt, Coxiella burnetii RSA 493
caaauaucugcuaggauuuuuua

SEQ ID NO: 561259 - RNA, 18 nt, Coxiella burnetii RSA 493
caaauaagccaauacgaa

SEQ ID NO: 561260 - RNA, 20 nt, Coxiella burnetii RSA 493
caaaggccuuggguaaguga

SEQ ID NO: 561261 - RNA, 14 nt, Coxiella burnetii RSA 493
auuuagccaaaauu

SEQ ID NO: 561262 - RNA, 17 nt, Coxiella burnetii RSA 493
auuuaucauuuuuccgc

SEQ ID NO: 561263 - RNA, 22 nt, Coxiella burnetii RSA 493
auuuacaauaacaaaugaugaa

SEQ ID NO: 561264 - RNA, 23 nt, Coxiella burnetii RSA 493
auuuacaauaacaaaugaugaau

SEQ ID NO: 561265 - RNA, 14 nt, Coxiella burnetii RSA 493
auuuacaauauccc

SEQ ID NO: 561266 - RNA, 16 nt, Coxiella burnetii RSA 493
auuuaaacaaacugcu

SEQ ID NO: 561267 - RNA, 18 nt, Coxiella burnetii RSA 493
auuuaaacaaacugcugg

SEQ ID NO: 561268 - RNA, 17 nt, Coxiella burnetii RSA 493
auuuaagugauaauuau

SEQ ID NO: 561269 - RNA, 15 nt, Coxiella burnetii RSA 493
auuuaauaaaucaau

SEQ ID NO: 561270 - RNA, 15 nt, Coxiella burnetii RSA 493
auuuaaugagguuaa

SEQ ID NO: 561271 - RNA, 14 nt, Coxiella burnetii RSA 493
auuuaaugucuuuu

SEQ ID NO: 561272 - RNA, 20 nt, Coxiella burnetii RSA 493
auuuaauugggaagcaauuu

SEQ ID NO: 561273 - RNA, 22 nt, Coxiella burnetii RSA 493
auuggucuugauuccuucaauc

SEQ ID NO: 561274 - RNA, 14 nt, Coxiella burnetii RSA 493
auuuccaacgcuug

SEQ ID NO: 561275 - RNA, 20 nt, Coxiella burnetii RSA 493
auuuccaacgcuuguuuuau

SEQ ID NO: 561276 - RNA, 21 nt, Coxiella burnetii RSA 493
auuuccaaacgccaucgauuu

SEQ ID NO: 561277 - RNA, 23 nt, Coxiella burnetii RSA 493
auuucagggaacugccguucuug

SEQ ID NO: 561278 - RNA, 19 nt, Coxiella burnetii RSA 493
auuucaggcgccugcaaaa

SEQ ID NO: 561279 - RNA, 17 nt, Coxiella burnetii RSA 493
auuucacuuuauuuuca

SEQ ID NO: 561280 - RNA, 17 nt, Coxiella burnetii RSA 493
auuuaugaaugcuggag

SEQ ID NO: 561281 - RNA, 23 nt, Coxiella burnetii RSA 493
auuucacacguaucugcuaaaaa

SEQ ID NO: 561282 - RNA, 16 nt, Coxiella burnetii RSA 493
auuuccgucaauuuuu

SEQ ID NO: 561283 - RNA, 14 nt, Coxiella burnetii RSA 493
auuuccgugcaggg

SEQ ID NO: 561284 - RNA, 22 nt, Coxiella burnetii RSA 493
auuuccgcuucaaacaauugag

SEQ ID NO: 561285 - RNA, 23 nt, Coxiella burnetii RSA 493
auuuccgcuucaaacaauugagc

SEQ ID NO: 561286 - RNA, 23 nt, Coxiella burnetii RSA 493
auuuccgcaaaucggaaaagcca

SEQ ID NO: 561287 - RNA, 16 nt, Coxiella burnetii RSA 493
auuucccaaucaucaa

SEQ ID NO: 561288 - RNA, 17 nt, Coxiella burnetii RSA 493
auuucccaaucaucaau

SEQ ID NO: 561289 - RNA, 15 nt, Coxiella burnetii RSA 493
auuucgauuuuacaa

SEQ ID NO: 561290 - RNA, 18 nt, Coxiella burnetii RSA 493
auuuuacaauaauccaca

SEQ ID NO: 561291 - RNA, 22 nt, Coxiella burnetii RSA 493
auuuuaucgauccgagcccaau

SEQ ID NO: 561292 - RNA, 16 nt, Coxiella burnetii RSA 493
auuuucguccaauucu

SEQ ID NO: 561293 - RNA, 21 nt, Coxiella burnetii RSA 493
auuuucgucguagacaaucaa

SEQ ID NO: 561294 - RNA, 15 nt, Coxiella burnetii RSA 493
auuuucaaaugaaua

SEQ ID NO: 561295 - RNA, 16 nt, Coxiella burnetii RSA 493
auuuucaaaugaauaa

SEQ ID NO: 561296 - RNA, 14 nt, Coxiella burnetii RSA 493
auuuugaacaguuc

SEQ ID NO: 561297 - RNA, 18 nt, Coxiella burnetii RSA 493
auuuugaauccucaguaa

SEQ ID NO: 561298 - RNA, 24 nt, Coxiella burnetii RSA 493
auuuugcagaugcuccaucaugau

SEQ ID NO: 561299 - RNA, 16 nt, Coxiella burnetii RSA 493
auuuugcgcucauuuu

SEQ ID NO: 561300 - RNA, 18 nt, Coxiella burnetii RSA 493
auuuugcgcucauuuuca

SEQ ID NO: 561301 - RNA, 15 nt, Coxiella burnetii RSA 493
auuuugcuuaucaug

SEQ ID NO: 561302 - RNA, 22 nt, Coxiella burnetii RSA 493
auuuuggcucccuaauacugug

SEQ ID NO: 561303 - RNA, 18 nt, Coxiella burnetii RSA 493
auuucuuuugccucuuuu

SEQ ID NO: 561304 - RNA, 16 nt, Coxiella burnetii RSA 493
auuucuuagguuuuau

SEQ ID NO: 561305 - RNA, 10 nt, Coxiella burnetii RSA 493
auuucugcag

SEQ ID NO: 561306 - RNA, 18 nt, Coxiella burnetii RSA 493
auuucuaucgccguuucu

SEQ ID NO: 561307 - RNA, 16 nt, Coxiella burnetii RSA 493
auuucucuuuuaacuu

SEQ ID NO: 561308 - RNA, 16 nt, Coxiella burnetii RSA 493
auuucggguucaaaaa

SEQ ID NO: 561309 - RNA, 19 nt, Coxiella burnetii RSA 493
auuucguauaauucacgga

SEQ ID NO: 561310 - RNA, 17 nt, Coxiella burnetii RSA 493
auuugcauuaaucuucc

SEQ ID NO: 561311 - RNA, 18 nt, Coxiella burnetii RSA 493
auuugcauuaaucuucca

SEQ ID NO: 561312 - RNA, 14 nt, Coxiella burnetii RSA 493
auuugauuuuuuuu

SEQ ID NO: 561313 - RNA, 18 nt, Coxiella burnetii RSA 493
auuugauuuucugugguu

SEQ ID NO: 561314 - RNA, 13 nt, Coxiella burnetii RSA 493
auuugagaauaaa

SEQ ID NO: 561315 - RNA, 13 nt, Coxiella burnetii RSA 493
auuuuaaaacauc

SEQ ID NO: 561316 - RNA, 15 nt, Coxiella burnetii RSA 493
auucuucauaggauu

SEQ ID NO: 561317 - RNA, 18 nt, Coxiella burnetii RSA 493
auucugaacgcucuucca

SEQ ID NO: 561318 - RNA, 17 nt, Coxiella burnetii RSA 493
auugaaaugcccucaaa

SEQ ID NO: 561319 - RNA, 14 nt, Coxiella burnetii RSA 493
auucuuucauuauc

SEQ ID NO: 561320 - RNA, 17 nt, Coxiella burnetii RSA 493
auucugaaucacuucuu

SEQ ID NO: 561321 - RNA, 17 nt, Coxiella burnetii RSA 493
auucucccaaacaauca

SEQ ID NO: 561322 - RNA, 16 nt, Coxiella burnetii RSA 493
auucucuauuucgaga

SEQ ID NO: 561323 - RNA, 19 nt, Coxiella burnetii RSA 493
auucucauuugacuuguca

SEQ ID NO: 561324 - RNA, 17 nt, Coxiella burnetii RSA 493
auucuaauuaaauuacu

SEQ ID NO: 561325 - RNA, 18 nt, Coxiella burnetii RSA 493
auucuaauuaaauuacuu

SEQ ID NO: 561326 - RNA, 20 nt, Coxiella burnetii RSA 493
auucuaacguuaguuucuuu

SEQ ID NO: 561327 - RNA, 23 nt, Coxiella burnetii RSA 493
auucuaacguuaguuucuuuuau

SEQ ID NO: 561328 - RNA, 21 nt, Coxiella burnetii RSA 493
auucguauaggaacauucuaa

SEQ ID NO: 561329 - RNA, 22 nt, Coxiella burnetii RSA 493
auucgguuuuuuuaaaaaagaa

SEQ ID NO: 561330 - RNA, 16 nt, Coxiella burnetii RSA 493
auugaugcguuuuuuu

SEQ ID NO: 561331 - RNA, 17 nt, Coxiella burnetii RSA 493
auugauguguuuucucg

SEQ ID NO: 561332 - RNA, 11 nt, Coxiella burnetii RSA 493
auugacaaaua

SEQ ID NO: 561333 - RNA, 13 nt, Coxiella burnetii RSA 493
auugaauuugcuu

SEQ ID NO: 561334 - RNA, 14 nt, Coxiella burnetii RSA 493
auugaauuugcuug

SEQ ID NO: 561335 - RNA, 18 nt, Coxiella burnetii RSA 493
auugaauuugcuuguuaa

SEQ ID NO: 561336 - RNA, 21 nt, Coxiella burnetii RSA 493
auugacaugaagguacugaag

SEQ ID NO: 561337 - RNA, 17 nt, Coxiella burnetii RSA 493
auugauccggcuuuuga

SEQ ID NO: 561338 - RNA, 18 nt, Coxiella burnetii RSA 493
auugaucuucuugugcua

SEQ ID NO: 561339 - RNA, 19 nt, Coxiella burnetii RSA 493
auugaucgcccauauucaa

SEQ ID NO: 561340 - RNA, 20 nt, Coxiella burnetii RSA 493
auugcauuucuuucaauaaa

SEQ ID NO: 561341 - RNA, 13 nt, Coxiella burnetii RSA 493
auugccaaagaaa

SEQ ID NO: 561342 - RNA, 15 nt, Coxiella burnetii RSA 493
auugccaaagaaaug

SEQ ID NO: 561343 - RNA, 19 nt, Coxiella burnetii RSA 493
auugccacucuuuauuaua

SEQ ID NO: 561344 - RNA, 14 nt, Coxiella burnetii RSA 493
auugcgcguaaauu

SEQ ID NO: 561345 - RNA, 15 nt, Coxiella burnetii RSA 493
auugcugaauugaua

SEQ ID NO: 561346 - RNA, 18 nt, Coxiella burnetii RSA 493
auugcggcucaauuauua

SEQ ID NO: 561347 - RNA, 17 nt, Coxiella burnetii RSA 493
auuggcaguaucuauuc

SEQ ID NO: 561348 - RNA, 20 nt, Coxiella burnetii RSA 493
auuggccuagccgaauguuu

SEQ ID NO: 561349 - RNA, 20 nt, Coxiella burnetii RSA 493
auuggcgagauugauacugc

SEQ ID NO: 561350 - RNA, 13 nt, Coxiella burnetii RSA 493
auucaugaaaauc

SEQ ID NO: 561351 - RNA, 17 nt, Coxiella burnetii RSA 493
auucaugacaauuuaau

SEQ ID NO: 561352 - RNA, 22 nt, Coxiella burnetii RSA 493
auucauaucuuuuucaauuaua

SEQ ID NO: 561353 - RNA, 15 nt, Coxiella burnetii RSA 493
auucauaaaaaauga

SEQ ID NO: 561354 - RNA, 16 nt, Coxiella burnetii RSA 493
auucaguucgcuaaau

SEQ ID NO: 561355 - RNA, 16 nt, Coxiella burnetii RSA 493
auucauaaauaguuca

SEQ ID NO: 561356 - RNA, 20 nt, Coxiella burnetii RSA 493
auucauaaggaaauugaugu

SEQ ID NO: 561357 - RNA, 20 nt, Coxiella burnetii RSA 493
auuccaggcaguagagacaa

SEQ ID NO: 561358 - RNA, 15 nt, Coxiella burnetii RSA 493
auuccauuaaaaaca

SEQ ID NO: 561359 - RNA, 18 nt, Coxiella burnetii RSA 493
auuccaauaauugcugaa

SEQ ID NO: 561360 - RNA, 12 nt, Coxiella burnetii RSA 493
auuccaaaccgu

SEQ ID NO: 561361 - RNA, 16 nt, Coxiella burnetii RSA 493
auucauuaguuugguu

SEQ ID NO: 561362 - RNA, 23 nt, Coxiella burnetii RSA 493
auucauuaucaugcauuugauuu

SEQ ID NO: 561363 - RNA, 19 nt, Coxiella burnetii RSA 493
auucauucgcuuuuuugcu

SEQ ID NO: 561364 - RNA, 14 nt, Coxiella burnetii RSA 493
auucauuucaauau

SEQ ID NO: 561365 - RNA, 20 nt, Coxiella burnetii RSA 493
auucauuucaauauuucuug

SEQ ID NO: 561366 - RNA, 21 nt, Coxiella burnetii RSA 493
auucauuucaauauuucuuga

SEQ ID NO: 561367 - RNA, 14 nt, Coxiella burnetii RSA 493
auucgggcauucgg

SEQ ID NO: 561368 - RNA, 18 nt, Coxiella burnetii RSA 493
auucgcuuaaauuuugac

SEQ ID NO: 561369 - RNA, 16 nt, Coxiella burnetii RSA 493
auucgcguuuuuaaau

SEQ ID NO: 561370 - RNA, 15 nt, Coxiella burnetii RSA 493
auuccuucaaucaca

SEQ ID NO: 561371 - RNA, 15 nt, Coxiella burnetii RSA 493
auucgauaugaaagu

SEQ ID NO: 561372 - RNA, 20 nt, Coxiella burnetii RSA 493
auucgauauguuucaauaac

SEQ ID NO: 561373 - RNA, 16 nt, Coxiella burnetii RSA 493
auucgacauaaggcug

SEQ ID NO: 561374 - RNA, 20 nt, Coxiella burnetii RSA 493
auuccuuuuuuuaauguuug

SEQ ID NO: 561375 - RNA, 18 nt, Coxiella burnetii RSA 493
auucccuuuugaauucca

SEQ ID NO: 561376 - RNA, 16 nt, Coxiella burnetii RSA 493
auucccaccaaaauuc

SEQ ID NO: 561377 - RNA, 13 nt, Coxiella burnetii RSA 493
auucccauaaccg

SEQ ID NO: 561378 - RNA, 22 nt, Coxiella burnetii RSA 493
auucccauagaagaacaauuaa

SEQ ID NO: 561379 - RNA, 22 nt, Coxiella burnetii RSA 493
auucccaugcgcaucgcgccau

SEQ ID NO: 561380 - RNA, 16 nt, Coxiella burnetii RSA 493
auucccgauggggaua

SEQ ID NO: 561381 - RNA, 21 nt, Coxiella burnetii RSA 493
auucccugcgcuccagaugau

SEQ ID NO: 561382 - RNA, 22 nt, Coxiella burnetii RSA 493
aucugucaucaucgucaaaugg

SEQ ID NO: 561383 - RNA, 12 nt, Coxiella burnetii RSA 493
aucuaagucuau

SEQ ID NO: 561384 - RNA, 21 nt, Coxiella burnetii RSA 493
aucuaaucgucuugaccaaua

SEQ ID NO: 561385 - RNA, 16 nt, Coxiella burnetii RSA 493
aucugcuuccucuucu

SEQ ID NO: 561386 - RNA, 23 nt, Coxiella burnetii RSA 493
aucuuaucaccuuugcuaacaau

SEQ ID NO: 561387 - RNA, 11 nt, Coxiella burnetii RSA 493
aucuucaaaac

SEQ ID NO: 561388 - RNA, 20 nt, Coxiella burnetii RSA 493
aucuuaaugaaauuucucau

SEQ ID NO: 561389 - RNA, 21 nt, Coxiella burnetii RSA 493
aucuguuucaauuagcauuuu

SEQ ID NO: 561390 - RNA, 20 nt, Coxiella burnetii RSA 493
aucuguuugcaauucuagua

SEQ ID NO: 561391 - RNA, 14 nt, Coxiella burnetii RSA 493
aucuguuuuauccc

SEQ ID NO: 561392 - RNA, 17 nt, Coxiella burnetii RSA 493
aucuuccauuaauuucu

SEQ ID NO: 561393 - RNA, 15 nt, Coxiella burnetii RSA 493
aucuuccaauuuuuu

SEQ ID NO: 561394 - RNA, 16 nt, Coxiella burnetii RSA 493
aucuuccaauuuuuug

SEQ ID NO: 561395 - RNA, 19 nt, Coxiella burnetii RSA 493
aucuugggcaaaaaaagaa

SEQ ID NO: 561396 - RNA, 22 nt, Coxiella burnetii RSA 493
aucuugcggcgauaaucauuaa

SEQ ID NO: 561397 - RNA, 21 nt, Coxiella burnetii RSA 493
aucuuuuuucuuaucccaggc

SEQ ID NO: 561398 - RNA, 18 nt, Coxiella burnetii RSA 493
aucuuuuuuuugaaauuc

SEQ ID NO: 561399 - RNA, 13 nt, Coxiella burnetii RSA 493
augaaaaagauaa

SEQ ID NO: 561400 - RNA, 23 nt, Coxiella burnetii RSA 493
augaaaagcggagcagcuacaau

SEQ ID NO: 561401 - RNA, 23 nt, Coxiella burnetii RSA 493
augaacaacacgaucaacaaaau

SEQ ID NO: 561402 - RNA, 17 nt, Coxiella burnetii RSA 493
aucuuugcucuaaauua

SEQ ID NO: 561403 - RNA, 16 nt, Coxiella burnetii RSA 493
aucuuuuucaauuaua

SEQ ID NO: 561404 - RNA, 17 nt, Coxiella burnetii RSA 493
aucuuuuucuccuuuuc

SEQ ID NO: 561405 - RNA, 14 nt, Coxiella burnetii RSA 493
aucuuuuucaagau

SEQ ID NO: 561406 - RNA, 20 nt, Coxiella burnetii RSA 493
augagcguaaucaauaaaac

SEQ ID NO: 561407 - RNA, 16 nt, Coxiella burnetii RSA 493
augagcuauaauucuc

SEQ ID NO: 561408 - RNA, 13 nt, Coxiella burnetii RSA 493
augagcgaacgaa

SEQ ID NO: 561409 - RNA, 12 nt, Coxiella burnetii RSA 493
augagcaaugac

SEQ ID NO: 561410 - RNA, 21 nt, Coxiella burnetii RSA 493
augaggccaaaaauucguuaa

SEQ ID NO: 561411 - RNA, 22 nt, Coxiella burnetii RSA 493
augacccucuuuuuaaaaaauu

SEQ ID NO: 561412 - RNA, 13 nt, Coxiella burnetii RSA 493
augacggaauuug

SEQ ID NO: 561413 - RNA, 23 nt, Coxiella burnetii RSA 493
augacggaauuugugauuuuaaa

SEQ ID NO: 561414 - RNA, 15 nt, Coxiella burnetii RSA 493
augcaaaaccaauga

SEQ ID NO: 561415 - RNA, 12 nt, Coxiella burnetii RSA 493
augauuuuuccc

SEQ ID NO: 561416 - RNA, 13 nt, Coxiella burnetii RSA 493
augauuuuuccca

SEQ ID NO: 561417 - RNA, 19 nt, Coxiella burnetii RSA 493
augauuuuucugugucauu

SEQ ID NO: 561418 - RNA, 15 nt, Coxiella burnetii RSA 493
augauucccaccaaa

SEQ ID NO: 561419 - RNA, 19 nt, Coxiella burnetii RSA 493
augauucccaccaaaauuc

SEQ ID NO: 561420 - RNA, 14 nt, Coxiella burnetii RSA 493
augcagcacaaagc

SEQ ID NO: 561421 - RNA, 15 nt, Coxiella burnetii RSA 493
augcacgggcaccau

SEQ ID NO: 561422 - RNA, 21 nt, Coxiella burnetii RSA 493
augcacgggcaccauuuuucu

SEQ ID NO: 561423 - RNA, 17 nt, Coxiella burnetii RSA 493
augaucaucaucaaaau

SEQ ID NO: 561424 - RNA, 20 nt, Coxiella burnetii RSA 493
augaucauuuucucagggau

SEQ ID NO: 561425 - RNA, 18 nt, Coxiella burnetii RSA 493
augaucgacaagcagggc

SEQ ID NO: 561426 - RNA, 15 nt, Coxiella burnetii RSA 493
augaucgguuuuuug

SEQ ID NO: 561427 - RNA, 17 nt, Coxiella burnetii RSA 493
augaugcauuaaucauu

SEQ ID NO: 561428 - RNA, 22 nt, Coxiella burnetii RSA 493
augaugcauuaaucauuacaga

SEQ ID NO: 561429 - RNA, 12 nt, Coxiella burnetii RSA 493
augaugccuuaa

SEQ ID NO: 561430 - RNA, 14 nt, Coxiella burnetii RSA 493
augaucugcucuuu

SEQ ID NO: 561431 - RNA, 17 nt, Coxiella burnetii RSA 493
augauguuuuaaaauua

SEQ ID NO: 561432 - RNA, 19 nt, Coxiella burnetii RSA 493
augauuaagcguaaauuuu

SEQ ID NO: 561433 - RNA, 20 nt, Coxiella burnetii RSA 493
augucguuaccgaugaguug

SEQ ID NO: 561434 - RNA, 18 nt, Coxiella burnetii RSA 493
auguguaacaaaaacgac

SEQ ID NO: 561435 - RNA, 22 nt, Coxiella burnetii RSA 493
auguuaggaaggacaaaaauau

SEQ ID NO: 561436 - RNA, 20 nt, Coxiella burnetii RSA 493
auguucucuccauuuagaaa

SEQ ID NO: 561437 - RNA, 16 nt, Coxiella burnetii RSA 493
augucauaaucacaaa

SEQ ID NO: 561438 - RNA, 21 nt, Coxiella burnetii RSA 493
auguauuuuuuggaaugagca

SEQ ID NO: 561439 - RNA, 22 nt, Coxiella burnetii RSA 493
augucaauaacccacagccgcu

SEQ ID NO: 561440 - RNA, 17 nt, Coxiella burnetii RSA 493
augguccggcgaacagc

SEQ ID NO: 561441 - RNA, 16 nt, Coxiella burnetii RSA 493
auggugauuucuucca

SEQ ID NO: 561442 - RNA, 12 nt, Coxiella burnetii RSA 493
augguugauuuu

SEQ ID NO: 561443 - RNA, 17 nt, Coxiella burnetii RSA 493
augguugauuuuuuaau

SEQ ID NO: 561444 - RNA, 19 nt, Coxiella burnetii RSA 493
augguugauuuuuuaauua

SEQ ID NO: 561445 - RNA, 13 nt, Coxiella burnetii RSA 493
augguucuuuuga

SEQ ID NO: 561446 - RNA, 19 nt, Coxiella burnetii RSA 493
auggauucuucuuuugcca

SEQ ID NO: 561447 - RNA, 21 nt, Coxiella burnetii RSA 493
auggccuuugcgguuaaaaaa

SEQ ID NO: 561448 - RNA, 18 nt, Coxiella burnetii RSA 493
auggcgguacgucaucaa

SEQ ID NO: 561449 - RNA, 20 nt, Coxiella burnetii RSA 493
auggcgguacgucaucaaaa

SEQ ID NO: 561450 - RNA, 21 nt, Coxiella burnetii RSA 493
auggacgugcaaaugaguaaa

SEQ ID NO: 561451 - RNA, 22 nt, Coxiella burnetii RSA 493
auggacuacacgguuaguggga

SEQ ID NO: 561452 - RNA, 14 nt, Coxiella burnetii RSA 493
auggauuaaacccg

SEQ ID NO: 561453 - RNA, 20 nt, Coxiella burnetii RSA 493
auggaaguucuauccaauaa

SEQ ID NO: 561454 - RNA, 14 nt, Coxiella burnetii RSA 493
augcuuuuaaagug

SEQ ID NO: 561455 - RNA, 23 nt, Coxiella burnetii RSA 493
augcuuuuaaagugaugauuaaa

SEQ ID NO: 561456 - RNA, 22 nt, Coxiella burnetii RSA 493
augcuuucuuuuaauucauaaa

SEQ ID NO: 561457 - RNA, 14 nt, Coxiella burnetii RSA 493
augcuuuucuuuca

SEQ ID NO: 561458 - RNA, 17 nt, Coxiella burnetii RSA 493
augcuuuucuuucauua

SEQ ID NO: 561459 - RNA, 22 nt, Coxiella burnetii RSA 493
augcugaugaaauugcacaugg

SEQ ID NO: 561460 - RNA, 19 nt, Coxiella burnetii RSA 493
augcuucuaauuugaaaaa

SEQ ID NO: 561461 - RNA, 17 nt, Coxiella burnetii RSA 493
augcuucuuugauaaaa

SEQ ID NO: 561462 - RNA, 12 nt, Coxiella burnetii RSA 493
augcuugcucuu

SEQ ID NO: 561463 - RNA, 22 nt, Coxiella burnetii RSA 493
augcucgcgaaauuuaauaaaa

SEQ ID NO: 561464 - RNA, 18 nt, Coxiella burnetii RSA 493
augcuccaucaugauauc

SEQ ID NO: 561465 - RNA, 19 nt, Coxiella burnetii RSA 493
augcuccgcguuuuuccac

SEQ ID NO: 561466 - RNA, 19 nt, Coxiella burnetii RSA 493
augcgcuuuccauuuuuua

SEQ ID NO: 561467 - RNA, 15 nt, Coxiella burnetii RSA 493
augccaaaauuagaa

SEQ ID NO: 561468 - RNA, 16 nt, Coxiella burnetii RSA 493
augcgaauguaaugcu

SEQ ID NO: 561469 - RNA, 17 nt, Coxiella burnetii RSA 493
aucauaaucgguuauuu

SEQ ID NO: 561470 - RNA, 23 nt, Coxiella burnetii RSA 493
aucauacgcuuguaauucacgau

SEQ ID NO: 561471 - RNA, 21 nt, Coxiella burnetii RSA 493
aucaguuuugaugaaaagaaa

SEQ ID NO: 561472 - RNA, 14 nt, Coxiella burnetii RSA 493
aucaaucgaaaaaa

SEQ ID NO: 561473 - RNA, 16 nt, Coxiella burnetii RSA 493
aucaaucgaaaaaaau

SEQ ID NO: 561474 - RNA, 20 nt, Coxiella burnetii RSA 493
aucaaucguguagaaagaaa

SEQ ID NO: 561475 - RNA, 22 nt, Coxiella burnetii RSA 493
aucaaucguguagaaagaaagu

SEQ ID NO: 561476 - RNA, 14 nt, Coxiella burnetii RSA 493
aucaggcagugaau

SEQ ID NO: 561477 - RNA, 14 nt, Coxiella burnetii RSA 493
aucaucaaaauuaa

SEQ ID NO: 561478 - RNA, 14 nt, Coxiella burnetii RSA 493
aucaucaacagaac

SEQ ID NO: 561479 - RNA, 21 nt, Coxiella burnetii RSA 493
aucaucaaaggccgcgcagaa

SEQ ID NO: 561480 - RNA, 11 nt, Coxiella burnetii RSA 493
aucaucaaucc

SEQ ID NO: 561481 - RNA, 14 nt, Coxiella burnetii RSA 493
aucaucaucaaaau

SEQ ID NO: 561482 - RNA, 15 nt, Coxiella burnetii RSA 493
aucaucaucgccgga

SEQ ID NO: 561483 - RNA, 15 nt, Coxiella burnetii RSA 493
aucauccgcagaaca

SEQ ID NO: 561484 - RNA, 13 nt, Coxiella burnetii RSA 493
aucaucuuuuuug

SEQ ID NO: 561485 - RNA, 14 nt, Coxiella burnetii RSA 493
aucaugcauuugau

SEQ ID NO: 561486 - RNA, 15 nt, Coxiella burnetii RSA 493
aucaugccuuuuuug

SEQ ID NO: 561487 - RNA, 15 nt, Coxiella burnetii RSA 493
aucauuaucucuuaa

SEQ ID NO: 561488 - RNA, 12 nt, Coxiella burnetii RSA 493
auccaaaaucca

SEQ ID NO: 561489 - RNA, 13 nt, Coxiella burnetii RSA 493
auccaaaauccag

SEQ ID NO: 561490 - RNA, 13 nt, Coxiella burnetii RSA 493
aucauuuucucag

SEQ ID NO: 561491 - RNA, 21 nt, Coxiella burnetii RSA 493
aucauuuugauacgcuaacca

SEQ ID NO: 561492 - RNA, 15 nt, Coxiella burnetii RSA 493
aucauuuugauuuuu

SEQ ID NO: 561493 - RNA, 17 nt, Coxiella burnetii RSA 493
aucauuuugauuuuuua

SEQ ID NO: 561494 - RNA, 19 nt, Coxiella burnetii RSA 493
aucauuuugauuuuuuaau

SEQ ID NO: 561495 - RNA, 17 nt, Coxiella burnetii RSA 493
auccaacgguucucaaa

SEQ ID NO: 561496 - RNA, 14 nt, Coxiella burnetii RSA 493
auccaaauagaugg

SEQ ID NO: 561497 - RNA, 13 nt, Coxiella burnetii RSA 493
auccaaauauuua

SEQ ID NO: 561498 - RNA, 18 nt, Coxiella burnetii RSA 493
aucauugggccauuuaac

SEQ ID NO: 561499 - RNA, 21 nt, Coxiella burnetii RSA 493
aucauugggccauuuaacaaa

SEQ ID NO: 561500 - RNA, 23 nt, Coxiella burnetii RSA 493
aucauugggccauuuaacaaaaa

SEQ ID NO: 561501 - RNA, 23 nt, Coxiella burnetii RSA 493
auccaauaaacgggcuaaagguu

SEQ ID NO: 561502 - RNA, 20 nt, Coxiella burnetii RSA 493
auccaucacggggucgguaa

SEQ ID NO: 561503 - RNA, 21 nt, Coxiella burnetii RSA 493
auccauccggaugucauaauc

SEQ ID NO: 561504 - RNA, 16 nt, Coxiella burnetii RSA 493
auccauucuuucauua

SEQ ID NO: 561505 - RNA, 18 nt, Coxiella burnetii RSA 493
auccauguuggauuucau

SEQ ID NO: 561506 - RNA, 18 nt, Coxiella burnetii RSA 493
auccaugccauaaugccu

SEQ ID NO: 561507 - RNA, 17 nt, Coxiella burnetii RSA 493
aucccacguuguuugau

SEQ ID NO: 561508 - RNA, 15 nt, Coxiella burnetii RSA 493
aucccaauaguaaaa

SEQ ID NO: 561509 - RNA, 23 nt, Coxiella burnetii RSA 493
auccaggguugauugauuuuguc

SEQ ID NO: 561510 - RNA, 16 nt, Coxiella burnetii RSA 493
auccaggcugcuagaa

SEQ ID NO: 561511 - RNA, 23 nt, Coxiella burnetii RSA 493
auccaggcugcuagaaguauuuc

SEQ ID NO: 561512 - RNA, 20 nt, Coxiella burnetii RSA 493
auccgagcccaauaacaagc

SEQ ID NO: 561513 - RNA, 15 nt, Coxiella burnetii RSA 493
auccccgaacggcac

SEQ ID NO: 561514 - RNA, 16 nt, Coxiella burnetii RSA 493
aucccguuaaauuaaa

SEQ ID NO: 561515 - RNA, 17 nt, Coxiella burnetii RSA 493
auccucagaaguuuuag

SEQ ID NO: 561516 - RNA, 16 nt, Coxiella burnetii RSA 493
auccuauucuuuuauu

SEQ ID NO: 561517 - RNA, 17 nt, Coxiella burnetii RSA 493
auccguuuugaaaaaua

SEQ ID NO: 561518 - RNA, 15 nt, Coxiella burnetii RSA 493
auccuaauaaaaaua

SEQ ID NO: 561519 - RNA, 17 nt, Coxiella burnetii RSA 493
auccgguuuugauuuuu

SEQ ID NO: 561520 - RNA, 21 nt, Coxiella burnetii RSA 493
auccgguggaauuagagguuc

SEQ ID NO: 561521 - RNA, 15 nt, Coxiella burnetii RSA 493
auccggcaucacgau

SEQ ID NO: 561522 - RNA, 15 nt, Coxiella burnetii RSA 493
auccucaucaaacuu

SEQ ID NO: 561523 - RNA, 22 nt, Coxiella burnetii RSA 493
auccucaucaaacuugccuuga

SEQ ID NO: 561524 - RNA, 17 nt, Coxiella burnetii RSA 493
auccuccccacucucuu

SEQ ID NO: 561525 - RNA, 19 nt, Coxiella burnetii RSA 493
auccucgcguuuuaucauu

SEQ ID NO: 561526 - RNA, 16 nt, Coxiella burnetii RSA 493
auccuggccugaucau

SEQ ID NO: 561527 - RNA, 16 nt, Coxiella burnetii RSA 493
aucgucuugaccaaua

SEQ ID NO: 561528 - RNA, 12 nt, Coxiella burnetii RSA 493
aucguugcugag

SEQ ID NO: 561529 - RNA, 11 nt, Coxiella burnetii RSA 493
aucguuucugg

SEQ ID NO: 561530 - RNA, 17 nt, Coxiella burnetii RSA 493
aucguuuuacccuuugu

SEQ ID NO: 561531 - RNA, 14 nt, Coxiella burnetii RSA 493
aucguuuugaaauu

SEQ ID NO: 561532 - RNA, 22 nt, Coxiella burnetii RSA 493
aucguuuuguuuuaaguuuuca

SEQ ID NO: 561533 - RNA, 14 nt, Coxiella burnetii RSA 493
aucgcugugaaaau

SEQ ID NO: 561534 - RNA, 23 nt, Coxiella burnetii RSA 493
aucgcuccuaucgaagaagcguc

SEQ ID NO: 561535 - RNA, 22 nt, Coxiella burnetii RSA 493
aucgccuugcaaacaaacgaua

SEQ ID NO: 561536 - RNA, 22 nt, Coxiella burnetii RSA 493
aucgauccgagcccaauaacaa

SEQ ID NO: 561537 - RNA, 14 nt, Coxiella burnetii RSA 493
aucgacuuucucac

SEQ ID NO: 561538 - RNA, 17 nt, Coxiella burnetii RSA 493
aucgccugacagcccgg

SEQ ID NO: 561539 - RNA, 12 nt, Coxiella burnetii RSA 493
auccuugaggaa

SEQ ID NO: 561540 - RNA, 19 nt, Coxiella burnetii RSA 493
auccuugaggaauugcuac

SEQ ID NO: 561541 - RNA, 21 nt, Coxiella burnetii RSA 493
auccuugaggaauugcuaccu

SEQ ID NO: 561542 - RNA, 21 nt, Coxiella burnetii RSA 493
auccuuuaauucgcgcugcaa

SEQ ID NO: 561543 - RNA, 18 nt, Coxiella burnetii RSA 493
auccuuacaaaaauacuu

SEQ ID NO: 561544 - RNA, 16 nt, Coxiella burnetii RSA 493
aucgaccgagaauuaa

SEQ ID NO: 561545 - RNA, 18 nt, Coxiella burnetii RSA 493
aucgacaggacaaaccug

SEQ ID NO: 561546 - RNA, 17 nt, Coxiella burnetii RSA 493
auaaucucaucaucuuc

SEQ ID NO: 561547 - RNA, 18 nt, Coxiella burnetii RSA 493
auaaugaguggcugcuuc

SEQ ID NO: 561548 - RNA, 12 nt, Coxiella burnetii RSA 493
auaaugcacauc

SEQ ID NO: 561549 - RNA, 16 nt, Coxiella burnetii RSA 493
auaauccgccuaaauu

SEQ ID NO: 561550 - RNA, 16 nt, Coxiella burnetii RSA 493
auaaucauuuuuaugc

SEQ ID NO: 561551 - RNA, 18 nt, Coxiella burnetii RSA 493
auaaucauuuuuccuauu

SEQ ID NO: 561552 - RNA, 21 nt, Coxiella burnetii RSA 493
auaauccaagggaucauaauc

SEQ ID NO: 561553 - RNA, 24 nt, Coxiella burnetii RSA 493
auaauccaagggaucauaaucggu

SEQ ID NO: 561554 - RNA, 18 nt, Coxiella burnetii RSA 493
auaacgcuucuuuuagaa

SEQ ID NO: 561555 - RNA, 21 nt, Coxiella burnetii RSA 493
auaacggaaaauggaaacgac

SEQ ID NO: 561556 - RNA, 22 nt, Coxiella burnetii RSA 493
auaacgggaauguuuuuuaaua

SEQ ID NO: 561557 - RNA, 20 nt, Coxiella burnetii RSA 493
auaaugucugcauuuuuaau

SEQ ID NO: 561558 - RNA, 17 nt, Coxiella burnetii RSA 493
auaauucguuagcauuu

SEQ ID NO: 561559 - RNA, 21 nt, Coxiella burnetii RSA 493
auaauucguuuacuuguugcg

SEQ ID NO: 561560 - RNA, 18 nt, Coxiella burnetii RSA 493
auaauucgguuuuugcca

SEQ ID NO: 561561 - RNA, 14 nt, Coxiella burnetii RSA 493
auaauucgcacaau

SEQ ID NO: 561562 - RNA, 14 nt, Coxiella burnetii RSA 493
auaauucauaaaua

SEQ ID NO: 561563 - RNA, 16 nt, Coxiella burnetii RSA 493
auaauuuaaacucaau

SEQ ID NO: 561564 - RNA, 17 nt, Coxiella burnetii RSA 493
auaauucuuucugaaaa

SEQ ID NO: 561565 - RNA, 12 nt, Coxiella burnetii RSA 493
auaauugaggaa

SEQ ID NO: 561566 - RNA, 16 nt, Coxiella burnetii RSA 493
auaauugagguuuuaa

SEQ ID NO: 561567 - RNA, 17 nt, Coxiella burnetii RSA 493
auaauugagguuuuaau

SEQ ID NO: 561568 - RNA, 12 nt, Coxiella burnetii RSA 493
auaauuuccugu

SEQ ID NO: 561569 - RNA, 13 nt, Coxiella burnetii RSA 493
auacaaauucaau

SEQ ID NO: 561570 - RNA, 17 nt, Coxiella burnetii RSA 493
auacaaauuuuuaagac

SEQ ID NO: 561571 - RNA, 13 nt, Coxiella burnetii RSA 493
auaauuuuauaaa

SEQ ID NO: 561572 - RNA, 14 nt, Coxiella burnetii RSA 493
auaauuuuauaaag

SEQ ID NO: 561573 - RNA, 17 nt, Coxiella burnetii RSA 493
auaauuuuguauuucac

SEQ ID NO: 561574 - RNA, 14 nt, Coxiella burnetii RSA 493
auacacauaaugau

SEQ ID NO: 561575 - RNA, 18 nt, Coxiella burnetii RSA 493
auacaaugcguagucaua

SEQ ID NO: 561576 - RNA, 11 nt, Coxiella burnetii RSA 493
auacaggaaaa

SEQ ID NO: 561577 - RNA, 14 nt, Coxiella burnetii RSA 493
auacaggaaaaaga

SEQ ID NO: 561578 - RNA, 18 nt, Coxiella burnetii RSA 493
auacaucuugauccuuuu

SEQ ID NO: 561579 - RNA, 17 nt, Coxiella burnetii RSA 493
auagauaggugcugcaa

SEQ ID NO: 561580 - RNA, 14 nt, Coxiella burnetii RSA 493
auagacaauuuuuu

SEQ ID NO: 561581 - RNA, 19 nt, Coxiella burnetii RSA 493
auagcauuguuggaaauaa

SEQ ID NO: 561582 - RNA, 19 nt, Coxiella burnetii RSA 493
auagccaaccgccauuucg

SEQ ID NO: 561583 - RNA, 24 nt, Coxiella burnetii RSA 493
auagccaaccgccauuucgcuuuu

SEQ ID NO: 561584 - RNA, 22 nt, Coxiella burnetii RSA 493
auagccuccucgcgauuuucgu

SEQ ID NO: 561585 - RNA, 16 nt, Coxiella burnetii RSA 493
auagcaaauaucugcu

SEQ ID NO: 561586 - RNA, 22 nt, Coxiella burnetii RSA 493
auagcaucaagggcaaaaacau

SEQ ID NO: 561587 - RNA, 15 nt, Coxiella burnetii RSA 493
auacuagcuuuugaa

SEQ ID NO: 561588 - RNA, 17 nt, Coxiella burnetii RSA 493
auacuaauuucagggaa

SEQ ID NO: 561589 - RNA, 21 nt, Coxiella burnetii RSA 493
auacuaauuucagggaacugc

SEQ ID NO: 561590 - RNA, 17 nt, Coxiella burnetii RSA 493
auacuuaaaauuucuuu

SEQ ID NO: 561591 - RNA, 22 nt, Coxiella burnetii RSA 493
auagaaaaacuccgcugcucca

SEQ ID NO: 561592 - RNA, 14 nt, Coxiella burnetii RSA 493
auagaagcaucaga

SEQ ID NO: 561593 - RNA, 19 nt, Coxiella burnetii RSA 493
auagaauaaugaacaacac

SEQ ID NO: 561594 - RNA, 21 nt, Coxiella burnetii RSA 493
auacuaaauuguccuuuucua

SEQ ID NO: 561595 - RNA, 15 nt, Coxiella burnetii RSA 493
auacgaccuucugaa

SEQ ID NO: 561596 - RNA, 16 nt, Coxiella burnetii RSA 493
auacggacgacuuauu

SEQ ID NO: 561597 - RNA, 18 nt, Coxiella burnetii RSA 493
auacgaacaauuguucaa

SEQ ID NO: 561598 - RNA, 16 nt, Coxiella burnetii RSA 493
auaccuuuugcuggga

SEQ ID NO: 561599 - RNA, 15 nt, Coxiella burnetii RSA 493
auaccuuuuucccau

SEQ ID NO: 561600 - RNA, 14 nt, Coxiella burnetii RSA 493
auaccaaaaaguug

SEQ ID NO: 561601 - RNA, 19 nt, Coxiella burnetii RSA 493
auaccauacagaauuucuu

SEQ ID NO: 561602 - RNA, 14 nt, Coxiella burnetii RSA 493
auaccauuuuuaaa

SEQ ID NO: 561603 - RNA, 16 nt, Coxiella burnetii RSA 493
auaccauuuuuaaauu

SEQ ID NO: 561604 - RNA, 18 nt, Coxiella burnetii RSA 493
auaccauuuuuaaauuau

SEQ ID NO: 561605 - RNA, 14 nt, Coxiella burnetii RSA 493
auacccaaaaaccc

SEQ ID NO: 561606 - RNA, 14 nt, Coxiella burnetii RSA 493
auacccgguuguau

SEQ ID NO: 561607 - RNA, 22 nt, Coxiella burnetii RSA 493
auacccaaucaauucgaaagaa

SEQ ID NO: 561608 - RNA, 19 nt, Coxiella burnetii RSA 493
auagucuuugguuuuccau

SEQ ID NO: 561609 - RNA, 21 nt, Coxiella burnetii RSA 493
auagucuuuuuauauuccuga

SEQ ID NO: 561610 - RNA, 14 nt, Coxiella burnetii RSA 493
auagucuguaugaa

SEQ ID NO: 561611 - RNA, 18 nt, Coxiella burnetii RSA 493
auagucgcguauaaauga

SEQ ID NO: 561612 - RNA, 16 nt, Coxiella burnetii RSA 493
auaucaucaacagaac

SEQ ID NO: 561613 - RNA, 21 nt, Coxiella burnetii RSA 493
auaucauggucagcccaacua

SEQ ID NO: 561614 - RNA, 12 nt, Coxiella burnetii RSA 493
auauccauaucg

SEQ ID NO: 561615 - RNA, 23 nt, Coxiella burnetii RSA 493
auaugcaagcugcgcauaaacuu

SEQ ID NO: 561616 - RNA, 13 nt, Coxiella burnetii RSA 493
auaucuccauuuu

SEQ ID NO: 561617 - RNA, 16 nt, Coxiella burnetii RSA 493
auauguuguuugcuug

SEQ ID NO: 561618 - RNA, 14 nt, Coxiella burnetii RSA 493
auauguuucaauaa

SEQ ID NO: 561619 - RNA, 17 nt, Coxiella burnetii RSA 493
auauuagaaauaauacu

SEQ ID NO: 561620 - RNA, 19 nt, Coxiella burnetii RSA 493
auauuaguggaauuaaaua

SEQ ID NO: 561621 - RNA, 13 nt, Coxiella burnetii RSA 493
auauuaauauuaa

SEQ ID NO: 561622 - RNA, 16 nt, Coxiella burnetii RSA 493
auauuaauauuaaaac

SEQ ID NO: 561623 - RNA, 19 nt, Coxiella burnetii RSA 493
auauuaauauuaaaacaag

SEQ ID NO: 561624 - RNA, 18 nt, Coxiella burnetii RSA 493
auauuccugaaguaauuu

SEQ ID NO: 561625 - RNA, 22 nt, Coxiella burnetii RSA 493
auauuccugaaguaauuuuucg

SEQ ID NO: 561626 - RNA, 21 nt, Coxiella burnetii RSA 493
auauuuaccucuaaaaauuaa

SEQ ID NO: 561627 - RNA, 20 nt, Coxiella burnetii RSA 493
aucaaaauucuccuuaauaa

SEQ ID NO: 561628 - RNA, 23 nt, Coxiella burnetii RSA 493
aucaaauaaugguagcuaccagu

SEQ ID NO: 561629 - RNA, 15 nt, Coxiella burnetii RSA 493
auauuucgcaauccu

SEQ ID NO: 561630 - RNA, 14 nt, Coxiella burnetii RSA 493
aucaacaaaauaua

SEQ ID NO: 561631 - RNA, 15 nt, Coxiella burnetii RSA 493
aucaacaaaauauac

SEQ ID NO: 561632 - RNA, 22 nt, Coxiella burnetii RSA 493
aucaacaaaauauacucaccca

SEQ ID NO: 561633 - RNA, 23 nt, Coxiella burnetii RSA 493
aucaacaaaauauacucacccac

SEQ ID NO: 561634 - RNA, 13 nt, Coxiella burnetii RSA 493
aguacgugcuuug

SEQ ID NO: 561635 - RNA, 14 nt, Coxiella burnetii RSA 493
agcuggcagauaac

SEQ ID NO: 561636 - RNA, 17 nt, Coxiella burnetii RSA 493
aguacuguauugagcag

SEQ ID NO: 561637 - RNA, 16 nt, Coxiella burnetii RSA 493
aguaggugauaaugag

SEQ ID NO: 561638 - RNA, 15 nt, Coxiella burnetii RSA 493
aguagcugcaaauuc

SEQ ID NO: 561639 - RNA, 23 nt, Coxiella burnetii RSA 493
aguagcuaauacuaaacaaaaua

SEQ ID NO: 561640 - RNA, 14 nt, Coxiella burnetii RSA 493
aguagccaaaauaa

SEQ ID NO: 561641 - RNA, 17 nt, Coxiella burnetii RSA 493
aguagcgauaaauuuuu

SEQ ID NO: 561642 - RNA, 17 nt, Coxiella burnetii RSA 493
aguagcuaaaaaauuca

SEQ ID NO: 561643 - RNA, 15 nt, Coxiella burnetii RSA 493
aguauuuauuaaaaa

SEQ ID NO: 561644 - RNA, 15 nt, Coxiella burnetii RSA 493
aguauuuuucuuugg

SEQ ID NO: 561645 - RNA, 19 nt, Coxiella burnetii RSA 493
aguaugugggcucacuugc

SEQ ID NO: 561646 - RNA, 18 nt, Coxiella burnetii RSA 493
aguauccaacucucuagc

SEQ ID NO: 561647 - RNA, 13 nt, Coxiella burnetii RSA 493
aguauccauccca

SEQ ID NO: 561648 - RNA, 20 nt, Coxiella burnetii RSA 493
aguauggagaaggucaucca

SEQ ID NO: 561649 - RNA, 15 nt, Coxiella burnetii RSA 493
agucagacuugcuuu

SEQ ID NO: 561650 - RNA, 13 nt, Coxiella burnetii RSA 493
agucaaaaauaaa

SEQ ID NO: 561651 - RNA, 22 nt, Coxiella burnetii RSA 493
agucaaaaacuucaugcaaaaa

SEQ ID NO: 561652 - RNA, 16 nt, Coxiella burnetii RSA 493
agucaacaaacgaaug

SEQ ID NO: 561653 - RNA, 21 nt, Coxiella burnetii RSA 493
agucauucauuucaauauuuc

SEQ ID NO: 561654 - RNA, 17 nt, Coxiella burnetii RSA 493
agucgcaacaagcaacg

SEQ ID NO: 561655 - RNA, 22 nt, Coxiella burnetii RSA 493
agucgcguaaagauaaaaugac

SEQ ID NO: 561656 - RNA, 22 nt, Coxiella burnetii RSA 493
agucgcguagagauucccgcug

SEQ ID NO: 561657 - RNA, 14 nt, Coxiella burnetii RSA 493
agucgcuuucaauu

SEQ ID NO: 561658 - RNA, 21 nt, Coxiella burnetii RSA 493
aguccgcccccguaucaccaa

SEQ ID NO: 561659 - RNA, 13 nt, Coxiella burnetii RSA 493
agugaaauuuuuu

SEQ ID NO: 561660 - RNA, 14 nt, Coxiella burnetii RSA 493
agugaaucauccaa

SEQ ID NO: 561661 - RNA, 13 nt, Coxiella burnetii RSA 493
agugaaauaaccu

SEQ ID NO: 561662 - RNA, 13 nt, Coxiella burnetii RSA 493
agugaaaguuuca

SEQ ID NO: 561663 - RNA, 20 nt, Coxiella burnetii RSA 493
agucguauuccuuuuucuuu

SEQ ID NO: 561664 - RNA, 21 nt, Coxiella burnetii RSA 493
agucuauugaaaaaaacgccc

SEQ ID NO: 561665 - RNA, 17 nt, Coxiella burnetii RSA 493
agucucagcaucagccu

SEQ ID NO: 561666 - RNA, 23 nt, Coxiella burnetii RSA 493
agugccccuacacuauugaaguc

SEQ ID NO: 561667 - RNA, 15 nt, Coxiella burnetii RSA 493
agugauuaaauugcu

SEQ ID NO: 561668 - RNA, 18 nt, Coxiella burnetii RSA 493
agugauugauuuuuuaau

SEQ ID NO: 561669 - RNA, 16 nt, Coxiella burnetii RSA 493
agugauuuuucuuugu

SEQ ID NO: 561670 - RNA, 21 nt, Coxiella burnetii RSA 493
aguggcagcuucuuuaaaaua

SEQ ID NO: 561671 - RNA, 18 nt, Coxiella burnetii RSA 493
agugcuuuuaaacagucu

SEQ ID NO: 561672 - RNA, 19 nt, Coxiella burnetii RSA 493
agugcuuuuaaccacagac

SEQ ID NO: 561673 - RNA, 15 nt, Coxiella burnetii RSA 493
aguuaaauuuuuaau

SEQ ID NO: 561674 - RNA, 19 nt, Coxiella burnetii RSA 493
aguucagacgcuaauugau

SEQ ID NO: 561675 - RNA, 22 nt, Coxiella burnetii RSA 493
aguucagacgcuaauugauuaa

SEQ ID NO: 561676 - RNA, 14 nt, Coxiella burnetii RSA 493
aguuauuaucccuu

SEQ ID NO: 561677 - RNA, 16 nt, Coxiella burnetii RSA 493
aguuauuuuucaucuu

SEQ ID NO: 561678 - RNA, 21 nt, Coxiella burnetii RSA 493
aguuccguucggaaacaaagg

SEQ ID NO: 561679 - RNA, 16 nt, Coxiella burnetii RSA 493
aguucuucuaaagaau

SEQ ID NO: 561680 - RNA, 20 nt, Coxiella burnetii RSA 493
aguucuucuaaagaauuuuu

SEQ ID NO: 561681 - RNA, 17 nt, Coxiella burnetii RSA 493
aguucgcuaaaaguaac

SEQ ID NO: 561682 - RNA, 21 nt, Coxiella burnetii RSA 493
aguucuauuuccgcuacaucu

SEQ ID NO: 561683 - RNA, 21 nt, Coxiella burnetii RSA 493
aguucuaagcuaucagcaauc

SEQ ID NO: 561684 - RNA, 20 nt, Coxiella burnetii RSA 493
aguugccgguauuuugcaaa

SEQ ID NO: 561685 - RNA, 15 nt, Coxiella burnetii RSA 493
aguuggcuaaaucca

SEQ ID NO: 561686 - RNA, 19 nt, Coxiella burnetii RSA 493
aguuuuuuacuugcuucau

SEQ ID NO: 561687 - RNA, 12 nt, Coxiella burnetii RSA 493
aguuuucauuuu

SEQ ID NO: 561688 - RNA, 13 nt, Coxiella burnetii RSA 493
aguuuuauaacaa

SEQ ID NO: 561689 - RNA, 20 nt, Coxiella burnetii RSA 493
aguuuuauaacaagguuuua

SEQ ID NO: 561690 - RNA, 18 nt, Coxiella burnetii RSA 493
aguuuuauuuaaaaaacu

SEQ ID NO: 561691 - RNA, 13 nt, Coxiella burnetii RSA 493
aguuucaauuucg

SEQ ID NO: 561692 - RNA, 20 nt, Coxiella burnetii RSA 493
auaacaucccguuaaauuaa

SEQ ID NO: 561693 - RNA, 20 nt, Coxiella burnetii RSA 493
auaacaaauaaaccuaucca

SEQ ID NO: 561694 - RNA, 13 nt, Coxiella burnetii RSA 493
auaacaaaguaag

SEQ ID NO: 561695 - RNA, 20 nt, Coxiella burnetii RSA 493
auaacaagguuuuauuuuua

SEQ ID NO: 561696 - RNA, 11 nt, Coxiella burnetii RSA 493
auaaaugaucc

SEQ ID NO: 561697 - RNA, 12 nt, Coxiella burnetii RSA 493
auaaaugaugcu

SEQ ID NO: 561698 - RNA, 20 nt, Coxiella burnetii RSA 493
auaaauggacccuguuuuuu

SEQ ID NO: 561699 - RNA, 14 nt, Coxiella burnetii RSA 493
auaaauuauuuuaa

SEQ ID NO: 561700 - RNA, 16 nt, Coxiella burnetii RSA 493
auaaaguguuuuuuug

SEQ ID NO: 561701 - RNA, 15 nt, Coxiella burnetii RSA 493
auaaagaauuugaca

SEQ ID NO: 561702 - RNA, 22 nt, Coxiella burnetii RSA 493
auaaacuuguuuaucacuccaa

SEQ ID NO: 561703 - RNA, 12 nt, Coxiella burnetii RSA 493
auaaaguuuuag

SEQ ID NO: 561704 - RNA, 20 nt, Coxiella burnetii RSA 493
auaaauagcauuucguauaa

SEQ ID NO: 561705 - RNA, 22 nt, Coxiella burnetii RSA 493
auaaauaguucacgaauuugcg

SEQ ID NO: 561706 - RNA, 19 nt, Coxiella burnetii RSA 493
auaaaaccuuguuauaaaa

SEQ ID NO: 561707 - RNA, 20 nt, Coxiella burnetii RSA 493
auaaaagcccgcaauccucg

SEQ ID NO: 561708 - RNA, 22 nt, Coxiella burnetii RSA 493
auaaaaggaauucuaauuaaau

SEQ ID NO: 561709 - RNA, 11 nt, Coxiella burnetii RSA 493
auaaaaggaga

SEQ ID NO: 561710 - RNA, 12 nt, Coxiella burnetii RSA 493
auaaaaggagaa

SEQ ID NO: 561711 - RNA, 13 nt, Coxiella burnetii RSA 493
auaaaaggagaaa

SEQ ID NO: 561712 - RNA, 16 nt, Coxiella burnetii RSA 493
auaaaacuugauuauu

SEQ ID NO: 561713 - RNA, 18 nt, Coxiella burnetii RSA 493
auaaaacuugauuauuca

SEQ ID NO: 561714 - RNA, 21 nt, Coxiella burnetii RSA 493
auaaaacuugauuauucaauu

SEQ ID NO: 561715 - RNA, 19 nt, Coxiella burnetii RSA 493
auaaaaguccuguucuuuu

SEQ ID NO: 561716 - RNA, 23 nt, Coxiella burnetii RSA 493
auaaaaguccuguucuuuucaac

SEQ ID NO: 561717 - RNA, 18 nt, Coxiella burnetii RSA 493
auaaaauuuaauaagucu

SEQ ID NO: 561718 - RNA, 23 nt, Coxiella burnetii RSA 493
auaaaauuucggcccacaucugu

SEQ ID NO: 561719 - RNA, 23 nt, Coxiella burnetii RSA 493
auaaacuuuauucccagauaaag

SEQ ID NO: 561720 - RNA, 23 nt, Coxiella burnetii RSA 493
auaaacgggcuaaagguuucaaa

SEQ ID NO: 561721 - RNA, 21 nt, Coxiella burnetii RSA 493
agccauuguuuugcauccgaa

SEQ ID NO: 561722 - RNA, 19 nt, Coxiella burnetii RSA 493
agcccaacgguauaaaauu

SEQ ID NO: 561723 - RNA, 12 nt, Coxiella burnetii RSA 493
agcccucauugu

SEQ ID NO: 561724 - RNA, 22 nt, Coxiella burnetii RSA 493
agcccguaugagcgaagcgaaa

SEQ ID NO: 561725 - RNA, 23 nt, Coxiella burnetii RSA 493
agcccguaugcagcgaagcggaa

SEQ ID NO: 561726 - RNA, 15 nt, Coxiella burnetii RSA 493
agccgaugacaaaua

SEQ ID NO: 561727 - RNA, 18 nt, Coxiella burnetii RSA 493
agccgccacaccauaggc

SEQ ID NO: 561728 - RNA, 15 nt, Coxiella burnetii RSA 493
agcccuuuagccacg

SEQ ID NO: 561729 - RNA, 15 nt, Coxiella burnetii RSA 493
agcccuugcgguaca

SEQ ID NO: 561730 - RNA, 21 nt, Coxiella burnetii RSA 493
agccgaccaaggguauuuuuu

SEQ ID NO: 561731 - RNA, 17 nt, Coxiella burnetii RSA 493
agccgaagcgcggccau

SEQ ID NO: 561732 - RNA, 15 nt, Coxiella burnetii RSA 493
agccgguguuauauu

SEQ ID NO: 561733 - RNA, 17 nt, Coxiella burnetii RSA 493
agccguucaccccauuu

SEQ ID NO: 561734 - RNA, 15 nt, Coxiella burnetii RSA 493
agccuguugagcuuc

SEQ ID NO: 561735 - RNA, 14 nt, Coxiella burnetii RSA 493
agccuucuuuuuca

SEQ ID NO: 561736 - RNA, 18 nt, Coxiella burnetii RSA 493
agccuucgcauaaaacgc

SEQ ID NO: 561737 - RNA, 12 nt, Coxiella burnetii RSA 493
agcgaaaacaaa

SEQ ID NO: 561738 - RNA, 14 nt, Coxiella burnetii RSA 493
agcgaauaaaaaau

SEQ ID NO: 561739 - RNA, 22 nt, Coxiella burnetii RSA 493
agcgaauaaaaaauuacugaaa

SEQ ID NO: 561740 - RNA, 15 nt, Coxiella burnetii RSA 493
agcgaacgcggccuu

SEQ ID NO: 561741 - RNA, 18 nt, Coxiella burnetii RSA 493
agcgagcauauaaaaguu

SEQ ID NO: 561742 - RNA, 17 nt, Coxiella burnetii RSA 493
agcgagguaaagaggga

SEQ ID NO: 561743 - RNA, 20 nt, Coxiella burnetii RSA 493
agcugauuucucuuuuaacu

SEQ ID NO: 561744 - RNA, 20 nt, Coxiella burnetii RSA 493
agcugauuccgaucuugguc

SEQ ID NO: 561745 - RNA, 20 nt, Coxiella burnetii RSA 493
agcucguaagcgugcaacaa

SEQ ID NO: 561746 - RNA, 13 nt, Coxiella burnetii RSA 493
agcucuuaaaaga

SEQ ID NO: 561747 - RNA, 15 nt, Coxiella burnetii RSA 493
agcucgauaucuguu

SEQ ID NO: 561748 - RNA, 14 nt, Coxiella burnetii RSA 493
agcucauugaaauc

SEQ ID NO: 561749 - RNA, 17 nt, Coxiella burnetii RSA 493
agcucauugccaaagaa

SEQ ID NO: 561750 - RNA, 19 nt, Coxiella burnetii RSA 493
agcucauugccaaagaaau

SEQ ID NO: 561751 - RNA, 15 nt, Coxiella burnetii RSA 493
agcuccauagauggg

SEQ ID NO: 561752 - RNA, 20 nt, Coxiella burnetii RSA 493
agcuccccgcuccaauuguu

SEQ ID NO: 561753 - RNA, 17 nt, Coxiella burnetii RSA 493
agcguuccuuucaucaa

SEQ ID NO: 561754 - RNA, 18 nt, Coxiella burnetii RSA 493
agcgugacuaaaauaaag

SEQ ID NO: 561755 - RNA, 18 nt, Coxiella burnetii RSA 493
agcguuguaaauuuugcc

SEQ ID NO: 561756 - RNA, 18 nt, Coxiella burnetii RSA 493
agcuauaagcaauggguu

SEQ ID NO: 561757 - RNA, 13 nt, Coxiella burnetii RSA 493
agcguaauaauag

SEQ ID NO: 561758 - RNA, 12 nt, Coxiella burnetii RSA 493
agcguaaaacac

SEQ ID NO: 561759 - RNA, 13 nt, Coxiella burnetii RSA 493
agcguaaaacacg

SEQ ID NO: 561760 - RNA, 18 nt, Coxiella burnetii RSA 493
agcgucaugaaaagcgga

SEQ ID NO: 561761 - RNA, 23 nt, Coxiella burnetii RSA 493
agcgcuuuuggcuacuuucucaa

SEQ ID NO: 561762 - RNA, 21 nt, Coxiella burnetii RSA 493
agcggauggagcaaacagucc

SEQ ID NO: 561763 - RNA, 15 nt, Coxiella burnetii RSA 493
agcgcccaaaugauc

SEQ ID NO: 561764 - RNA, 21 nt, Coxiella burnetii RSA 493
agcgccgacucuaauugagua

SEQ ID NO: 561765 - RNA, 17 nt, Coxiella burnetii RSA 493
agcgccugccgcaacaa

SEQ ID NO: 561766 - RNA, 16 nt, Coxiella burnetii RSA 493
agcgccagagauuuuu

SEQ ID NO: 561767 - RNA, 18 nt, Coxiella burnetii RSA 493
agcgauuuauuucuucua

SEQ ID NO: 561768 - RNA, 17 nt, Coxiella burnetii RSA 493
agcgauuguaauugcuu

SEQ ID NO: 561769 - RNA, 16 nt, Coxiella burnetii RSA 493
agcgauuccaaagcag

SEQ ID NO: 561770 - RNA, 15 nt, Coxiella burnetii RSA 493
agcaugcugauuuuc

SEQ ID NO: 561771 - RNA, 20 nt, Coxiella burnetii RSA 493
agcaucuuuuugcaaauaau

SEQ ID NO: 561772 - RNA, 16 nt, Coxiella burnetii RSA 493
agcauuaccauuuuga

SEQ ID NO: 561773 - RNA, 15 nt, Coxiella burnetii RSA 493
agcauuaauaagacc

SEQ ID NO: 561774 - RNA, 18 nt, Coxiella burnetii RSA 493
agcauuagacauuuuucg

SEQ ID NO: 561775 - RNA, 18 nt, Coxiella burnetii RSA 493
agcauuguuggaaauaau

SEQ ID NO: 561776 - RNA, 19 nt, Coxiella burnetii RSA 493
agcauuguuggaaauaaug

SEQ ID NO: 561777 - RNA, 21 nt, Coxiella burnetii RSA 493
agcauuguuggaaauaaugga

SEQ ID NO: 561778 - RNA, 14 nt, Coxiella burnetii RSA 493
agcauuuucuccaa

SEQ ID NO: 561779 - RNA, 16 nt, Coxiella burnetii RSA 493
agccaaguuuuaagaa

SEQ ID NO: 561780 - RNA, 17 nt, Coxiella burnetii RSA 493
agccacacaaccacugu

SEQ ID NO: 561781 - RNA, 16 nt, Coxiella burnetii RSA 493
agccagcgaauacgaa

SEQ ID NO: 561782 - RNA, 13 nt, Coxiella burnetii RSA 493
agccauaucagga

SEQ ID NO: 561783 - RNA, 23 nt, Coxiella burnetii RSA 493
agcaggagggugcgauuaaaagu

SEQ ID NO: 561784 - RNA, 23 nt, Coxiella burnetii RSA 493
agcaggacauacggggaguuuag

SEQ ID NO: 561785 - RNA, 14 nt, Coxiella burnetii RSA 493
agcaggauuuucac

SEQ ID NO: 561786 - RNA, 22 nt, Coxiella burnetii RSA 493
agcaggugacuguuaaucacuu

SEQ ID NO: 561787 - RNA, 15 nt, Coxiella burnetii RSA 493
agcagcuaauuuagg

SEQ ID NO: 561788 - RNA, 18 nt, Coxiella burnetii RSA 493
agcaucuguuucaauuag

SEQ ID NO: 561789 - RNA, 11 nt, Coxiella burnetii RSA 493
agcauccccca

SEQ ID NO: 561790 - RNA, 19 nt, Coxiella burnetii RSA 493
agcaucaagggcaaaaaca

SEQ ID NO: 561791 - RNA, 20 nt, Coxiella burnetii RSA 493
agcaucaagggcaaaaacau

SEQ ID NO: 561792 - RNA, 15 nt, Coxiella burnetii RSA 493
agcaguuuuuuacuu

SEQ ID NO: 561793 - RNA, 14 nt, Coxiella burnetii RSA 493
agcauaaucuuuuu

SEQ ID NO: 561794 - RNA, 23 nt, Coxiella burnetii RSA 493
agcauaauaaggcuaauuuuccu

SEQ ID NO: 561795 - RNA, 21 nt, Coxiella burnetii RSA 493
agcaccgacgacauuaaaaau

SEQ ID NO: 561796 - RNA, 19 nt, Coxiella burnetii RSA 493
agcacccaauuaaggucug

SEQ ID NO: 561797 - RNA, 18 nt, Coxiella burnetii RSA 493
agcaauugucuaacauuu

SEQ ID NO: 561798 - RNA, 14 nt, Coxiella burnetii RSA 493
agcaauuuuuuauc

SEQ ID NO: 561799 - RNA, 21 nt, Coxiella burnetii RSA 493
agcacgcgauacuuguugaca

SEQ ID NO: 561800 - RNA, 21 nt, Coxiella burnetii RSA 493
agcacuuaacuccuucgcuuu

SEQ ID NO: 561801 - RNA, 17 nt, Coxiella burnetii RSA 493
agcagaggugagagcag

SEQ ID NO: 561802 - RNA, 17 nt, Coxiella burnetii RSA 493
agauaagcuguuucuuu

SEQ ID NO: 561803 - RNA, 22 nt, Coxiella burnetii RSA 493
agauaaugaccuuaaucgugaa

SEQ ID NO: 561804 - RNA, 16 nt, Coxiella burnetii RSA 493
agauaauuacaaucca

SEQ ID NO: 561805 - RNA, 17 nt, Coxiella burnetii RSA 493
agauuuuaaauaccauu

SEQ ID NO: 561806 - RNA, 16 nt, Coxiella burnetii RSA 493
agauuuagccaaaauu

SEQ ID NO: 561807 - RNA, 13 nt, Coxiella burnetii RSA 493
agcaaaaugaggg

SEQ ID NO: 561808 - RNA, 15 nt, Coxiella burnetii RSA 493
agcaaacccauuuca

SEQ ID NO: 561809 - RNA, 16 nt, Coxiella burnetii RSA 493
agcaaacccauuucau

SEQ ID NO: 561810 - RNA, 19 nt, Coxiella burnetii RSA 493
agcaagaggaguucuaaaa

SEQ ID NO: 561811 - RNA, 13 nt, Coxiella burnetii RSA 493
agcaaguuuucua

SEQ ID NO: 561812 - RNA, 17 nt, Coxiella burnetii RSA 493
agcaaugggaacuuuua

SEQ ID NO: 561813 - RNA, 19 nt, Coxiella burnetii RSA 493
agcaaugggaacuuuuaac

SEQ ID NO: 561814 - RNA, 13 nt, Coxiella burnetii RSA 493
agcaauggguuag

SEQ ID NO: 561815 - RNA, 20 nt, Coxiella burnetii RSA 493
agcaacuuuaacauuaucau

SEQ ID NO: 561816 - RNA, 22 nt, Coxiella burnetii RSA 493
agcaaccguugagcaagcagaa

SEQ ID NO: 561817 - RNA, 14 nt, Coxiella burnetii RSA 493
agaaggcagaggac

SEQ ID NO: 561818 - RNA, 23 nt, Coxiella burnetii RSA 493
agaaggguuuugugcauaaauua

SEQ ID NO: 561819 - RNA, 18 nt, Coxiella burnetii RSA 493
agaaauuaaauuuuuaaa

SEQ ID NO: 561820 - RNA, 12 nt, Coxiella burnetii RSA 493
agaauaaaacgg

SEQ ID NO: 561821 - RNA, 19 nt, Coxiella burnetii RSA 493
agaaguuuaaaguuauuuc

SEQ ID NO: 561822 - RNA, 19 nt, Coxiella burnetii RSA 493
agacacaugggacaaggcu

SEQ ID NO: 561823 - RNA, 13 nt, Coxiella burnetii RSA 493
agacaauguuaaa

SEQ ID NO: 561824 - RNA, 17 nt, Coxiella burnetii RSA 493
agacaauguuaaaacac

SEQ ID NO: 561825 - RNA, 13 nt, Coxiella burnetii RSA 493
agaauuaaaaaua

SEQ ID NO: 561826 - RNA, 14 nt, Coxiella burnetii RSA 493
agaauuaaaaauau

SEQ ID NO: 561827 - RNA, 15 nt, Coxiella burnetii RSA 493
agaauuaaaaauauu

SEQ ID NO: 561828 - RNA, 20 nt, Coxiella burnetii RSA 493
agaauuacuguaaacuaggg

SEQ ID NO: 561829 - RNA, 14 nt, Coxiella burnetii RSA 493
agaauuugacaagc

SEQ ID NO: 561830 - RNA, 12 nt, Coxiella burnetii RSA 493
agacaaagcuag

SEQ ID NO: 561831 - RNA, 16 nt, Coxiella burnetii RSA 493
agacaaaguuucuuca

SEQ ID NO: 561832 - RNA, 19 nt, Coxiella burnetii RSA 493
agacccauuuuuuugauuc

SEQ ID NO: 561833 - RNA, 20 nt, Coxiella burnetii RSA 493
agacauuguucauaaaauaa

SEQ ID NO: 561834 - RNA, 14 nt, Coxiella burnetii RSA 493
agacaucggauaau

SEQ ID NO: 561835 - RNA, 16 nt, Coxiella burnetii RSA 493
agaccuguuaaaaacg

SEQ ID NO: 561836 - RNA, 22 nt, Coxiella burnetii RSA 493
agacgcuggaaaaauaaaucca

SEQ ID NO: 561837 - RNA, 16 nt, Coxiella burnetii RSA 493
agacgcuaguuuuuaa

SEQ ID NO: 561838 - RNA, 16 nt, Coxiella burnetii RSA 493
agagacaauagaauaa

SEQ ID NO: 561839 - RNA, 17 nt, Coxiella burnetii RSA 493
agagaaauuaaauuuuu

SEQ ID NO: 561840 - RNA, 12 nt, Coxiella burnetii RSA 493
agagaaaaaacc

SEQ ID NO: 561841 - RNA, 17 nt, Coxiella burnetii RSA 493
agacuucgcuaaauaac

SEQ ID NO: 561842 - RNA, 18 nt, Coxiella burnetii RSA 493
agacuucgcuaaauaaca

SEQ ID NO: 561843 - RNA, 16 nt, Coxiella burnetii RSA 493
agaggaguucuaaaaa

SEQ ID NO: 561844 - RNA, 23 nt, Coxiella burnetii RSA 493
agaggugaaccaaaaggaaugaa

SEQ ID NO: 561845 - RNA, 19 nt, Coxiella burnetii RSA 493
agaggcuguucgccagaaa

SEQ ID NO: 561846 - RNA, 15 nt, Coxiella burnetii RSA 493
agaguaaauacucua

SEQ ID NO: 561847 - RNA, 14 nt, Coxiella burnetii RSA 493
agaguaaauguuuc

SEQ ID NO: 561848 - RNA, 22 nt, Coxiella burnetii RSA 493
agagguuuuaaguuuuuugcuc

SEQ ID NO: 561849 - RNA, 22 nt, Coxiella burnetii RSA 493
agaguaagucucugcuucauug

SEQ ID NO: 561850 - RNA, 22 nt, Coxiella burnetii RSA 493
agaguacgccaaccauaauccu

SEQ ID NO: 561851 - RNA, 17 nt, Coxiella burnetii RSA 493
agauaagccgggcggga

SEQ ID NO: 561852 - RNA, 20 nt, Coxiella burnetii RSA 493
agaaaacguuucaucaaaau

SEQ ID NO: 561853 - RNA, 15 nt, Coxiella burnetii RSA 493
agaaaaguaaaaaau

SEQ ID NO: 561854 - RNA, 17 nt, Coxiella burnetii RSA 493
agaaaauaaccuaaaau

SEQ ID NO: 561855 - RNA, 22 nt, Coxiella burnetii RSA 493
agaaaaccgcagcucaaacaaa

SEQ ID NO: 561856 - RNA, 11 nt, Coxiella burnetii RSA 493
agaaaaaauga

SEQ ID NO: 561857 - RNA, 17 nt, Coxiella burnetii RSA 493
agaaaaaagaaauggau

SEQ ID NO: 561858 - RNA, 15 nt, Coxiella burnetii RSA 493
agaaauauuuucuca

SEQ ID NO: 561859 - RNA, 22 nt, Coxiella burnetii RSA 493
agaaauauuuucucaauagaaa

SEQ ID NO: 561860 - RNA, 23 nt, Coxiella burnetii RSA 493
agaaauauuuucucaauagaaaa

SEQ ID NO: 561861 - RNA, 17 nt, Coxiella burnetii RSA 493
acuuuaagauuucuuca

SEQ ID NO: 561862 - RNA, 16 nt, Coxiella burnetii RSA 493
acuugucaauuuaccu

SEQ ID NO: 561863 - RNA, 14 nt, Coxiella burnetii RSA 493
acuuguccuucuuc

SEQ ID NO: 561864 - RNA, 13 nt, Coxiella burnetii RSA 493
acuuguugaaaac

SEQ ID NO: 561865 - RNA, 15 nt, Coxiella burnetii RSA 493
acuuguugaaaaccu

SEQ ID NO: 561866 - RNA, 14 nt, Coxiella burnetii RSA 493
acuuuauaguucau

SEQ ID NO: 561867 - RNA, 14 nt, Coxiella burnetii RSA 493
acuuuaccuaacuc

SEQ ID NO: 561868 - RNA, 19 nt, Coxiella burnetii RSA 493
acuuuaccuaacucaaccu

SEQ ID NO: 561869 - RNA, 12 nt, Coxiella burnetii RSA 493
acuuuccuuauc

SEQ ID NO: 561870 - RNA, 20 nt, Coxiella burnetii RSA 493
acuuucgauaaauuuugaau

SEQ ID NO: 561871 - RNA, 18 nt, Coxiella burnetii RSA 493
acuuucuuagcaucgauc

SEQ ID NO: 561872 - RNA, 17 nt, Coxiella burnetii RSA 493
acuuucucgcuuaauuc

SEQ ID NO: 561873 - RNA, 12 nt, Coxiella burnetii RSA 493
acuuugauaaau

SEQ ID NO: 561874 - RNA, 23 nt, Coxiella burnetii RSA 493
acuuugccccguuccaauauuuu

SEQ ID NO: 561875 - RNA, 18 nt, Coxiella burnetii RSA 493
acuuugguaguccugagu

SEQ ID NO: 561876 - RNA, 23 nt, Coxiella burnetii RSA 493
acuuugcuguuccaggaauugca

SEQ ID NO: 561877 - RNA, 21 nt, Coxiella burnetii RSA 493
acuuccagauuuaguaaagua

SEQ ID NO: 561878 - RNA, 22 nt, Coxiella burnetii RSA 493
acuucugacaagaccccuauca

SEQ ID NO: 561879 - RNA, 19 nt, Coxiella burnetii RSA 493
acuugcacacuuugaugag

SEQ ID NO: 561880 - RNA, 21 nt, Coxiella burnetii RSA 493
acuugauauucccucuuuacc

SEQ ID NO: 561881 - RNA, 22 nt, Coxiella burnetii RSA 493
acuugauauucccucuuuaccu

SEQ ID NO: 561882 - RNA, 23 nt, Coxiella burnetii RSA 493
acuugauauucccucuuuaccuc

SEQ ID NO: 561883 - RNA, 18 nt, Coxiella burnetii RSA 493
acuugcuuuuuucugcga

SEQ ID NO: 561884 - RNA, 20 nt, Coxiella burnetii RSA 493
acuugcuuccccaauuuauu

SEQ ID NO: 561885 - RNA, 13 nt, Coxiella burnetii RSA 493
acuuggauuuuau

SEQ ID NO: 561886 - RNA, 22 nt, Coxiella burnetii RSA 493
acuucauacgggcuacucuaau

SEQ ID NO: 561887 - RNA, 15 nt, Coxiella burnetii RSA 493
acuuacgcugaagua

SEQ ID NO: 561888 - RNA, 15 nt, Coxiella burnetii RSA 493
acuuacgcugaaguu

SEQ ID NO: 561889 - RNA, 17 nt, Coxiella burnetii RSA 493
acuuacgcugaaguuga

SEQ ID NO: 561890 - RNA, 13 nt, Coxiella burnetii RSA 493
acuguuuuaguuc

SEQ ID NO: 561891 - RNA, 13 nt, Coxiella burnetii RSA 493
acuguuuguugcu

SEQ ID NO: 561892 - RNA, 19 nt, Coxiella burnetii RSA 493
acugugcggauuaaauaac

SEQ ID NO: 561893 - RNA, 14 nt, Coxiella burnetii RSA 493
acuguaaccuucuc

SEQ ID NO: 561894 - RNA, 16 nt, Coxiella burnetii RSA 493
acgcaugucaauaacc

SEQ ID NO: 561895 - RNA, 19 nt, Coxiella burnetii RSA 493
acgcaucggccuuuuucau

SEQ ID NO: 561896 - RNA, 22 nt, Coxiella burnetii RSA 493
acgcaucggccuuuuucauuuc

SEQ ID NO: 561897 - RNA, 15 nt, Coxiella burnetii RSA 493
acgccaagcugacac

SEQ ID NO: 561898 - RNA, 16 nt, Coxiella burnetii RSA 493
acgccaugaagcaauu

SEQ ID NO: 561899 - RNA, 15 nt, Coxiella burnetii RSA 493
acgccgaauccgccg

SEQ ID NO: 561900 - RNA, 20 nt, Coxiella burnetii RSA 493
acgccuugccccaugaguuc

SEQ ID NO: 561901 - RNA, 18 nt, Coxiella burnetii RSA 493
acgcgacaagaauuuuuu

SEQ ID NO: 561902 - RNA, 16 nt, Coxiella burnetii RSA 493
acgccugaaauauuuu

SEQ ID NO: 561903 - RNA, 19 nt, Coxiella burnetii RSA 493
acgccguaaccaaaacuau

SEQ ID NO: 561904 - RNA, 14 nt, Coxiella burnetii RSA 493
acggcucucucuaa

SEQ ID NO: 561905 - RNA, 21 nt, Coxiella burnetii RSA 493
acgcugaguggaaaaccaccg

SEQ ID NO: 561906 - RNA, 15 nt, Coxiella burnetii RSA 493
acgcuaugaaaacca

SEQ ID NO: 561907 - RNA, 21 nt, Coxiella burnetii RSA 493
acgcucgauggaacugauaua

SEQ ID NO: 561908 - RNA, 22 nt, Coxiella burnetii RSA 493
acgcucgauggaacugauauac

SEQ ID NO: 561909 - RNA, 24 nt, Coxiella burnetii RSA 493
acgcucagauaaaugaugcuucuu

SEQ ID NO: 561910 - RNA, 15 nt, Coxiella burnetii RSA 493
acgcgauaagagcau

SEQ ID NO: 561911 - RNA, 15 nt, Coxiella burnetii RSA 493
acgucuuuucuguga

SEQ ID NO: 561912 - RNA, 15 nt, Coxiella burnetii RSA 493
acguuaaauagccaa

SEQ ID NO: 561913 - RNA, 21 nt, Coxiella burnetii RSA 493
acguucaucgucaaacuguuu

SEQ ID NO: 561914 - RNA, 21 nt, Coxiella burnetii RSA 493
acgucacgaauuuuuucagga

SEQ ID NO: 561915 - RNA, 18 nt, Coxiella burnetii RSA 493
acguauauggacccaccc

SEQ ID NO: 561916 - RNA, 15 nt, Coxiella burnetii RSA 493
acguauugccaaaau

SEQ ID NO: 561917 - RNA, 14 nt, Coxiella burnetii RSA 493
acgucagaaaacag

SEQ ID NO: 561918 - RNA, 13 nt, Coxiella burnetii RSA 493
acgggaaaacaau

SEQ ID NO: 561919 - RNA, 22 nt, Coxiella burnetii RSA 493
acgggaauguuuuuuaauaaau

SEQ ID NO: 561920 - RNA, 12 nt, Coxiella burnetii RSA 493
acuaagcauuaa

SEQ ID NO: 561921 - RNA, 11 nt, Coxiella burnetii RSA 493
acuaagucgcc

SEQ ID NO: 561922 - RNA, 19 nt, Coxiella burnetii RSA 493
acuaaucccgccccauuuu

SEQ ID NO: 561923 - RNA, 22 nt, Coxiella burnetii RSA 493
acuaaucccgccccauuuuugu

SEQ ID NO: 561924 - RNA, 15 nt, Coxiella burnetii RSA 493
acuaaucgcuguuaa

SEQ ID NO: 561925 - RNA, 23 nt, Coxiella burnetii RSA 493
acuaaaugacguaaugucucaag

SEQ ID NO: 561926 - RNA, 22 nt, Coxiella burnetii RSA 493
acuaaauuuucucaauuucuuu

SEQ ID NO: 561927 - RNA, 21 nt, Coxiella burnetii RSA 493
acguugaccgcuaaagcaaaa

SEQ ID NO: 561928 - RNA, 14 nt, Coxiella burnetii RSA 493
acuacuaagccacc

SEQ ID NO: 561929 - RNA, 22 nt, Coxiella burnetii RSA 493
acuacaaauucucccuuuuccu

SEQ ID NO: 561930 - RNA, 18 nt, Coxiella burnetii RSA 493
acuacacgcuugaaauag

SEQ ID NO: 561931 - RNA, 19 nt, Coxiella burnetii RSA 493
acuagcucuaauugaggug

SEQ ID NO: 561932 - RNA, 16 nt, Coxiella burnetii RSA 493
acuagcuauucuuuug

SEQ ID NO: 561933 - RNA, 13 nt, Coxiella burnetii RSA 493
acuagucaacaaa

SEQ ID NO: 561934 - RNA, 22 nt, Coxiella burnetii RSA 493
acuccacgaucugagugucuga

SEQ ID NO: 561935 - RNA, 19 nt, Coxiella burnetii RSA 493
acuccaauaauaaaacccg

SEQ ID NO: 561936 - RNA, 12 nt, Coxiella burnetii RSA 493
acucacuuuuuu

SEQ ID NO: 561937 - RNA, 22 nt, Coxiella burnetii RSA 493
acucaguggcagcuucuuuaaa

SEQ ID NO: 561938 - RNA, 17 nt, Coxiella burnetii RSA 493
acucauaacgcguuucc

SEQ ID NO: 561939 - RNA, 15 nt, Coxiella burnetii RSA 493
acucagcuuuccccc

SEQ ID NO: 561940 - RNA, 15 nt, Coxiella burnetii RSA 493
acucagcccaacaua

SEQ ID NO: 561941 - RNA, 22 nt, Coxiella burnetii RSA 493
acuaugaucaugccuuuuuugc

SEQ ID NO: 561942 - RNA, 20 nt, Coxiella burnetii RSA 493
acuccgcccccccaaacaaa

SEQ ID NO: 561943 - RNA, 22 nt, Coxiella burnetii RSA 493
acuccgcccccccaaacaaaag

SEQ ID NO: 561944 - RNA, 15 nt, Coxiella burnetii RSA 493
acugaagaguaaaaa

SEQ ID NO: 561945 - RNA, 19 nt, Coxiella burnetii RSA 493
acugaagaguaaaaaacca

SEQ ID NO: 561946 - RNA, 14 nt, Coxiella burnetii RSA 493
acucuuuauuauaa

SEQ ID NO: 561947 - RNA, 21 nt, Coxiella burnetii RSA 493
acucuugccggauugauaaag

SEQ ID NO: 561948 - RNA, 21 nt, Coxiella burnetii RSA 493
aauuaguaauauuuugcagau

SEQ ID NO: 561949 - RNA, 20 nt, Coxiella burnetii RSA 493
aauuucauucauucgcuuuu

SEQ ID NO: 561950 - RNA, 21 nt, Coxiella burnetii RSA 493
aauuucauuuaauaaaucaau

SEQ ID NO: 561951 - RNA, 15 nt, Coxiella burnetii RSA 493
aauuucguugauuaa

SEQ ID NO: 561952 - RNA, 16 nt, Coxiella burnetii RSA 493
aauuucguugauuaau

SEQ ID NO: 561953 - RNA, 21 nt, Coxiella burnetii RSA 493
aauuucucauauauuuaccuc

SEQ ID NO: 561954 - RNA, 18 nt, Coxiella burnetii RSA 493
aauuucucgccauauuug

SEQ ID NO: 561955 - RNA, 19 nt, Coxiella burnetii RSA 493
aauuucucgccauauuugc

SEQ ID NO: 561956 - RNA, 22 nt, Coxiella burnetii RSA 493
aauuucuggcuugcuaugaugc

SEQ ID NO: 561957 - RNA, 19 nt, Coxiella burnetii RSA 493
aauuuuaguugcuaaugaa

SEQ ID NO: 561958 - RNA, 17 nt, Coxiella burnetii RSA 493
aauuugugauuuuaaaa

SEQ ID NO: 561959 - RNA, 15 nt, Coxiella burnetii RSA 493
aauuugugaaauaug

SEQ ID NO: 561960 - RNA, 21 nt, Coxiella burnetii RSA 493
aauuuguugagagucaggaaa

SEQ ID NO: 561961 - RNA, 13 nt, Coxiella burnetii RSA 493
aauuuuaaaaaac

SEQ ID NO: 561962 - RNA, 13 nt, Coxiella burnetii RSA 493
aauuuuaaaacau

SEQ ID NO: 561963 - RNA, 16 nt, Coxiella burnetii RSA 493
aauuucuuucuguccu

SEQ ID NO: 561964 - RNA, 23 nt, Coxiella burnetii RSA 493
aauuugaaauaaacuggaaaaag

SEQ ID NO: 561965 - RNA, 23 nt, Coxiella burnetii RSA 493
aauuugagguugaauauccagca

SEQ ID NO: 561966 - RNA, 14 nt, Coxiella burnetii RSA 493
aauuugcuuguuaa

SEQ ID NO: 561967 - RNA, 15 nt, Coxiella burnetii RSA 493
aauuugggcugucuu

SEQ ID NO: 561968 - RNA, 22 nt, Coxiella burnetii RSA 493
aauuuucccaggaaagaaaaug

SEQ ID NO: 561969 - RNA, 19 nt, Coxiella burnetii RSA 493
aauuuuauucucccaaaca

SEQ ID NO: 561970 - RNA, 13 nt, Coxiella burnetii RSA 493
aauuuugaauccu

SEQ ID NO: 561971 - RNA, 20 nt, Coxiella burnetii RSA 493
aauuuuuuuauaauuaucca

SEQ ID NO: 561972 - RNA, 17 nt, Coxiella burnetii RSA 493
aauuuuugaguucuuua

SEQ ID NO: 561973 - RNA, 14 nt, Coxiella burnetii RSA 493
aauuuuuucauaac

SEQ ID NO: 561974 - RNA, 16 nt, Coxiella burnetii RSA 493
aauuuuuccuuucuuu

SEQ ID NO: 561975 - RNA, 17 nt, Coxiella burnetii RSA 493
acaaaagguaaaaaacu

SEQ ID NO: 561976 - RNA, 13 nt, Coxiella burnetii RSA 493
acaaaagccaugc

SEQ ID NO: 561977 - RNA, 21 nt, Coxiella burnetii RSA 493
acaaaaguggggauaauugaa

SEQ ID NO: 561978 - RNA, 11 nt, Coxiella burnetii RSA 493
acaaaaauacu

SEQ ID NO: 561979 - RNA, 18 nt, Coxiella burnetii RSA 493
acaaaacgggcauuggaa

SEQ ID NO: 561980 - RNA, 14 nt, Coxiella burnetii RSA 493
acaaaaaaauuauu

SEQ ID NO: 561981 - RNA, 16 nt, Coxiella burnetii RSA 493
acaaaaaaauuauuuu

SEQ ID NO: 561982 - RNA, 14 nt, Coxiella burnetii RSA 493
acaaacgauuaccu

SEQ ID NO: 561983 - RNA, 16 nt, Coxiella burnetii RSA 493
acaaagaauuuuucca

SEQ ID NO: 561984 - RNA, 22 nt, Coxiella burnetii RSA 493
acaaaguaaguagcucuuaaaa

SEQ ID NO: 561985 - RNA, 22 nt, Coxiella burnetii RSA 493
acaaagucagacuugcuuuuuu

SEQ ID NO: 561986 - RNA, 14 nt, Coxiella burnetii RSA 493
acaaagugaaauau

SEQ ID NO: 561987 - RNA, 20 nt, Coxiella burnetii RSA 493
acaaagugaaauaugucacu

SEQ ID NO: 561988 - RNA, 18 nt, Coxiella burnetii RSA 493
acaaaguuucuucauauu

SEQ ID NO: 561989 - RNA, 20 nt, Coxiella burnetii RSA 493
acaaaguuucuucauauucu

SEQ ID NO: 561990 - RNA, 14 nt, Coxiella burnetii RSA 493
acaacaaaauguuu

SEQ ID NO: 561991 - RNA, 17 nt, Coxiella burnetii RSA 493
acaaauguauuuaucau

SEQ ID NO: 561992 - RNA, 16 nt, Coxiella burnetii RSA 493
acaaauucucccuuuu

SEQ ID NO: 561993 - RNA, 21 nt, Coxiella burnetii RSA 493
acaaauaaagaauuugacaag

SEQ ID NO: 561994 - RNA, 14 nt, Coxiella burnetii RSA 493
acaaauaaagcagc

SEQ ID NO: 561995 - RNA, 18 nt, Coxiella burnetii RSA 493
acaaauaaagcagcaauu

SEQ ID NO: 561996 - RNA, 15 nt, Coxiella burnetii RSA 493
acaaaugccaaauuc

SEQ ID NO: 561997 - RNA, 15 nt, Coxiella burnetii RSA 493
acaagacaacaaaau

SEQ ID NO: 561998 - RNA, 19 nt, Coxiella burnetii RSA 493
acaagaccccuaucaauca

SEQ ID NO: 561999 - RNA, 21 nt, Coxiella burnetii RSA 493
acaagcagggcaguaaauaga

SEQ ID NO: 562000 - RNA, 20 nt, Coxiella burnetii RSA 493
acaacugccugcuaggauuu

SEQ ID NO: 562001 - RNA, 13 nt, Coxiella burnetii RSA 493
acaacuaccugau

SEQ ID NO: 562002 - RNA, 18 nt, Coxiella burnetii RSA 493
acaacuaccugauaaaau

SEQ ID NO: 562003 - RNA, 19 nt, Coxiella burnetii RSA 493
acaacuaccugauaaaaua

SEQ ID NO: 562004 - RNA, 22 nt, Coxiella burnetii RSA 493
acaacgaaaccuuguuauaaau

SEQ ID NO: 562005 - RNA, 15 nt, Coxiella burnetii RSA 493
acaacggcaucaacg

SEQ ID NO: 562006 - RNA, 13 nt, Coxiella burnetii RSA 493
acaacguaacuga

SEQ ID NO: 562007 - RNA, 19 nt, Coxiella burnetii RSA 493
acacauaaugaucgacaag

SEQ ID NO: 562008 - RNA, 15 nt, Coxiella burnetii RSA 493
acaauuuuaaaacau

SEQ ID NO: 562009 - RNA, 22 nt, Coxiella burnetii RSA 493
acaauugagcggcuuuuucaau

SEQ ID NO: 562010 - RNA, 18 nt, Coxiella burnetii RSA 493
acaauucccccaaaaacu

SEQ ID NO: 562011 - RNA, 22 nt, Coxiella burnetii RSA 493
acaaugcuuucuuuuaauucau

SEQ ID NO: 562012 - RNA, 19 nt, Coxiella burnetii RSA 493
acaaugcccgaaaaggaaa

SEQ ID NO: 562013 - RNA, 20 nt, Coxiella burnetii RSA 493
acaaugcccgaaaaggaaau

SEQ ID NO: 562014 - RNA, 15 nt, Coxiella burnetii RSA 493
acaaugcguuuuaaa

SEQ ID NO: 562015 - RNA, 14 nt, Coxiella burnetii RSA 493
acaauguuaaaaca

SEQ ID NO: 562016 - RNA, 16 nt, Coxiella burnetii RSA 493
acaauguuaaaacaca

SEQ ID NO: 562017 - RNA, 17 nt, Coxiella burnetii RSA 493
acaauguuaaaacacau

SEQ ID NO: 562018 - RNA, 13 nt, Coxiella burnetii RSA 493
acaaugaugucau

SEQ ID NO: 562019 - RNA, 13 nt, Coxiella burnetii RSA 493
acaauauacgcaa

SEQ ID NO: 562020 - RNA, 22 nt, Coxiella burnetii RSA 493
acaauagggcggcaaucagaau

SEQ ID NO: 562021 - RNA, 19 nt, Coxiella burnetii RSA 493
acaaguauaacaaaauuaa

SEQ ID NO: 562022 - RNA, 15 nt, Coxiella burnetii RSA 493
acaaguuaacaaaau

SEQ ID NO: 562023 - RNA, 13 nt, Coxiella burnetii RSA 493
acaauaaaaccga

SEQ ID NO: 562024 - RNA, 17 nt, Coxiella burnetii RSA 493
acaccuuuggcaauaau

SEQ ID NO: 562025 - RNA, 16 nt, Coxiella burnetii RSA 493
acaccgcccauuuccc

SEQ ID NO: 562026 - RNA, 17 nt, Coxiella burnetii RSA 493
acaccggagacaccaau

SEQ ID NO: 562027 - RNA, 22 nt, Coxiella burnetii RSA 493
acacaugggacaaggcucacaa

SEQ ID NO: 562028 - RNA, 20 nt, Coxiella burnetii RSA 493
acacauuuuuucaaauugcu

SEQ ID NO: 562029 - RNA, 17 nt, Coxiella burnetii RSA 493
acaccacgcuaaauggu

SEQ ID NO: 562030 - RNA, 19 nt, Coxiella burnetii RSA 493
acagcaucuaaccuauugc

SEQ ID NO: 562031 - RNA, 16 nt, Coxiella burnetii RSA 493
acagaacaacugcgcc

SEQ ID NO: 562032 - RNA, 17 nt, Coxiella burnetii RSA 493
acauaggagauuuuuau

SEQ ID NO: 562033 - RNA, 22 nt, Coxiella burnetii RSA 493
acauaggagauuuuuaugaaaa

SEQ ID NO: 562034 - RNA, 12 nt, Coxiella burnetii RSA 493
acauaaggcugc

SEQ ID NO: 562035 - RNA, 17 nt, Coxiella burnetii RSA 493
acaucccuggauaauua

SEQ ID NO: 562036 - RNA, 21 nt, Coxiella burnetii RSA 493
acaucccuuuucauuaagcaa

SEQ ID NO: 562037 - RNA, 15 nt, Coxiella burnetii RSA 493
acauauggcccacuu

SEQ ID NO: 562038 - RNA, 17 nt, Coxiella burnetii RSA 493
acauaucgcuccccuug

SEQ ID NO: 562039 - RNA, 16 nt, Coxiella burnetii RSA 493
acauucuucaguaauu

SEQ ID NO: 562040 - RNA, 17 nt, Coxiella burnetii RSA 493
acauucgauauguuuca

SEQ ID NO: 562041 - RNA, 17 nt, Coxiella burnetii RSA 493
acauucuaauaaaauag

SEQ ID NO: 562042 - RNA, 14 nt, Coxiella burnetii RSA 493
acaugcgccacuaa

SEQ ID NO: 562043 - RNA, 19 nt, Coxiella burnetii RSA 493
acaugcgccacuaaaacgc

SEQ ID NO: 562044 - RNA, 18 nt, Coxiella burnetii RSA 493
acaucuuuuaaaacgcca

SEQ ID NO: 562045 - RNA, 16 nt, Coxiella burnetii RSA 493
acauuguucauaaaau

SEQ ID NO: 562046 - RNA, 12 nt, Coxiella burnetii RSA 493
acauuuggauug

SEQ ID NO: 562047 - RNA, 21 nt, Coxiella burnetii RSA 493
accaaugaaacgcgccaaaca

SEQ ID NO: 562048 - RNA, 22 nt, Coxiella burnetii RSA 493
accaauaacucggaacugauga

SEQ ID NO: 562049 - RNA, 19 nt, Coxiella burnetii RSA 493
accaauaagcuagaaaaua

SEQ ID NO: 562050 - RNA, 22 nt, Coxiella burnetii RSA 493
accacuguccucuguccucugc

SEQ ID NO: 562051 - RNA, 15 nt, Coxiella burnetii RSA 493
accacugucuucugu

SEQ ID NO: 562052 - RNA, 19 nt, Coxiella burnetii RSA 493
accacuauuugcuuucuuu

SEQ ID NO: 562053 - RNA, 23 nt, Coxiella burnetii RSA 493
accacuuccauacuaauuucagg

SEQ ID NO: 562054 - RNA, 14 nt, Coxiella burnetii RSA 493
accacgcuaaaugg

SEQ ID NO: 562055 - RNA, 22 nt, Coxiella burnetii RSA 493
accaugagugccacaaagucag

SEQ ID NO: 562056 - RNA, 16 nt, Coxiella burnetii RSA 493
accaucaaucaaauga

SEQ ID NO: 562057 - RNA, 23 nt, Coxiella burnetii RSA 493
accaggacguuauagaguaaaua

SEQ ID NO: 562058 - RNA, 21 nt, Coxiella burnetii RSA 493
acccaguuguuuuaaauccuu

SEQ ID NO: 562059 - RNA, 21 nt, Coxiella burnetii RSA 493
acccacgaugauuaaaucaac

SEQ ID NO: 562060 - RNA, 17 nt, Coxiella burnetii RSA 493
acccacguugcaauaac

SEQ ID NO: 562061 - RNA, 14 nt, Coxiella burnetii RSA 493
accauuuugacaaa

SEQ ID NO: 562062 - RNA, 12 nt, Coxiella burnetii RSA 493
acccauccaucc

SEQ ID NO: 562063 - RNA, 13 nt, Coxiella burnetii RSA 493
acccauccauccc

SEQ ID NO: 562064 - RNA, 14 nt, Coxiella burnetii RSA 493
acccauuaaguacu

SEQ ID NO: 562065 - RNA, 16 nt, Coxiella burnetii RSA 493
acccuuuucaauuucu

SEQ ID NO: 562066 - RNA, 17 nt, Coxiella burnetii RSA 493
acccuuuugcaaaccgc

SEQ ID NO: 562067 - RNA, 23 nt, Coxiella burnetii RSA 493
acccuuuugcaaaccgcgcugaa

SEQ ID NO: 562068 - RNA, 15 nt, Coxiella burnetii RSA 493
accgagauuuuuccg

SEQ ID NO: 562069 - RNA, 22 nt, Coxiella burnetii RSA 493
accgacgacauuaaaaaugaua

SEQ ID NO: 562070 - RNA, 17 nt, Coxiella burnetii RSA 493
acccucuuuuuaaaaaa

SEQ ID NO: 562071 - RNA, 20 nt, Coxiella burnetii RSA 493
acccuugaccgcuuagcaau

SEQ ID NO: 562072 - RNA, 22 nt, Coxiella burnetii RSA 493
acccguuuaaauuugccuugau

SEQ ID NO: 562073 - RNA, 18 nt, Coxiella burnetii RSA 493
acccgucuuuaauacaag

SEQ ID NO: 562074 - RNA, 15 nt, Coxiella burnetii RSA 493
accgcuugcgggaga

SEQ ID NO: 562075 - RNA, 17 nt, Coxiella burnetii RSA 493
accgcagcucaaacaaa

SEQ ID NO: 562076 - RNA, 14 nt, Coxiella burnetii RSA 493
accgauaccagcga

SEQ ID NO: 562077 - RNA, 21 nt, Coxiella burnetii RSA 493
accgaggucuuuuauuucacg

SEQ ID NO: 562078 - RNA, 16 nt, Coxiella burnetii RSA 493
aaucaucaauccggug

SEQ ID NO: 562079 - RNA, 15 nt, Coxiella burnetii RSA 493
aaucagcaaguugca

SEQ ID NO: 562080 - RNA, 18 nt, Coxiella burnetii RSA 493
aaucagcaaguugcagag

SEQ ID NO: 562081 - RNA, 22 nt, Coxiella burnetii RSA 493
aaucagaaugcugauaauugaa

SEQ ID NO: 562082 - RNA, 16 nt, Coxiella burnetii RSA 493
aaucaccugcuccuuu

SEQ ID NO: 562083 - RNA, 21 nt, Coxiella burnetii RSA 493
aaucaaguagccaaaauaaua

SEQ ID NO: 562084 - RNA, 15 nt, Coxiella burnetii RSA 493
aaucaauaaaacucu

SEQ ID NO: 562085 - RNA, 18 nt, Coxiella burnetii RSA 493
aaucaaguccaauuauaa

SEQ ID NO: 562086 - RNA, 17 nt, Coxiella burnetii RSA 493
aaucaauucgaaagaaa

SEQ ID NO: 562087 - RNA, 21 nt, Coxiella burnetii RSA 493
aaucaauucgaaagaaauaac

SEQ ID NO: 562088 - RNA, 17 nt, Coxiella burnetii RSA 493
aaucacagcaucuaacc

SEQ ID NO: 562089 - RNA, 18 nt, Coxiella burnetii RSA 493
aaucacaaguucuucuaa

SEQ ID NO: 562090 - RNA, 23 nt, Coxiella burnetii RSA 493
aauauucuaaccacccugucaua

SEQ ID NO: 562091 - RNA, 19 nt, Coxiella burnetii RSA 493
aauauuggccuuagcguaa

SEQ ID NO: 562092 - RNA, 14 nt, Coxiella burnetii RSA 493
aauauuuagcaacu

SEQ ID NO: 562093 - RNA, 15 nt, Coxiella burnetii RSA 493
aauaugagcugucac

SEQ ID NO: 562094 - RNA, 20 nt, Coxiella burnetii RSA 493
aauauuaucguuuucauucu

SEQ ID NO: 562095 - RNA, 15 nt, Coxiella burnetii RSA 493
aauauuagaaauaau

SEQ ID NO: 562096 - RNA, 16 nt, Coxiella burnetii RSA 493
aauauuagaaauaaua

SEQ ID NO: 562097 - RNA, 18 nt, Coxiella burnetii RSA 493
aaucaaauuaaaauaauc

SEQ ID NO: 562098 - RNA, 12 nt, Coxiella burnetii RSA 493
aaucaaauauca

SEQ ID NO: 562099 - RNA, 15 nt, Coxiella burnetii RSA 493
aaucaacgaacacau

SEQ ID NO: 562100 - RNA, 23 nt, Coxiella burnetii RSA 493
aauauuuuucucuuucauaauuu

SEQ ID NO: 562101 - RNA, 23 nt, Coxiella burnetii RSA 493
aauauuuucucaauagaaaaaag

SEQ ID NO: 562102 - RNA, 17 nt, Coxiella burnetii RSA 493
aauauuuuuauucuucu

SEQ ID NO: 562103 - RNA, 18 nt, Coxiella burnetii RSA 493
aauauaaauaaucuuccc

SEQ ID NO: 562104 - RNA, 19 nt, Coxiella burnetii RSA 493
aauauaaauaaucuuccca

SEQ ID NO: 562105 - RNA, 19 nt, Coxiella burnetii RSA 493
aauauauucauauccuuuu

SEQ ID NO: 562106 - RNA, 15 nt, Coxiella burnetii RSA 493
aauagcguauagagu

SEQ ID NO: 562107 - RNA, 14 nt, Coxiella burnetii RSA 493
aauagaauuguaaa

SEQ ID NO: 562108 - RNA, 14 nt, Coxiella burnetii RSA 493
aauagaauuuuuga

SEQ ID NO: 562109 - RNA, 22 nt, Coxiella burnetii RSA 493
aauagaauuuuugacuaaguca

SEQ ID NO: 562110 - RNA, 22 nt, Coxiella burnetii RSA 493
aauagacuucgcuaaauaacau

SEQ ID NO: 562111 - RNA, 17 nt, Coxiella burnetii RSA 493
aauagagcgcgcugccu

SEQ ID NO: 562112 - RNA, 20 nt, Coxiella burnetii RSA 493
aauagagcgggaauuuucga

SEQ ID NO: 562113 - RNA, 23 nt, Coxiella burnetii RSA 493
aauaguacuguauugagcagcau

SEQ ID NO: 562114 - RNA, 15 nt, Coxiella burnetii RSA 493
aauacgagguuuuuu

SEQ ID NO: 562115 - RNA, 19 nt, Coxiella burnetii RSA 493
aauacuuaaaauuucuuuc

SEQ ID NO: 562116 - RNA, 18 nt, Coxiella burnetii RSA 493
aauacuagcuuuugaagc

SEQ ID NO: 562117 - RNA, 15 nt, Coxiella burnetii RSA 493
aauacauacauaaag

SEQ ID NO: 562118 - RNA, 19 nt, Coxiella burnetii RSA 493
aauacaucuugauccuuuu

SEQ ID NO: 562119 - RNA, 15 nt, Coxiella burnetii RSA 493
aauacaugacuuuau

SEQ ID NO: 562120 - RNA, 13 nt, Coxiella burnetii RSA 493
aauacauucuuca

SEQ ID NO: 562121 - RNA, 23 nt, Coxiella burnetii RSA 493
aauacauucuucaguaauuuuua

SEQ ID NO: 562122 - RNA, 15 nt, Coxiella burnetii RSA 493
aauacaggaaaaaga

SEQ ID NO: 562123 - RNA, 17 nt, Coxiella burnetii RSA 493
aauacaggaaaaagaua

SEQ ID NO: 562124 - RNA, 18 nt, Coxiella burnetii RSA 493
aauacaggaaaaagauaa

SEQ ID NO: 562125 - RNA, 23 nt, Coxiella burnetii RSA 493
aauacaguaaauaaucauuuuua

SEQ ID NO: 562126 - RNA, 17 nt, Coxiella burnetii RSA 493
aauacagauuuuaguga

SEQ ID NO: 562127 - RNA, 15 nt, Coxiella burnetii RSA 493
aauaaaguaauuuua

SEQ ID NO: 562128 - RNA, 13 nt, Coxiella burnetii RSA 493
aauaaagaaagcc

SEQ ID NO: 562129 - RNA, 18 nt, Coxiella burnetii RSA 493
aaugaagguguuugagga

SEQ ID NO: 562130 - RNA, 11 nt, Coxiella burnetii RSA 493
aaucuugcugc

SEQ ID NO: 562131 - RNA, 19 nt, Coxiella burnetii RSA 493
aaucuugcugcaaaaacgu

SEQ ID NO: 562132 - RNA, 15 nt, Coxiella burnetii RSA 493
aaucuuccaauuuuu

SEQ ID NO: 562133 - RNA, 14 nt, Coxiella burnetii RSA 493
aaugagaaacguga

SEQ ID NO: 562134 - RNA, 14 nt, Coxiella burnetii RSA 493
aaugagggggagcc

SEQ ID NO: 562135 - RNA, 14 nt, Coxiella burnetii RSA 493
aaugaguucauuaa

SEQ ID NO: 562136 - RNA, 17 nt, Coxiella burnetii RSA 493
aaugaccaccacccccc

SEQ ID NO: 562137 - RNA, 18 nt, Coxiella burnetii RSA 493
aaugaucaaugaaacaaa

SEQ ID NO: 562138 - RNA, 20 nt, Coxiella burnetii RSA 493
aaucucacacaacuccacga

SEQ ID NO: 562139 - RNA, 16 nt, Coxiella burnetii RSA 493
aaucucacuuggauuu

SEQ ID NO: 562140 - RNA, 19 nt, Coxiella burnetii RSA 493
aaucguugcauaauauuuu

SEQ ID NO: 562141 - RNA, 19 nt, Coxiella burnetii RSA 493
aaucguuuguaauaauuca

SEQ ID NO: 562142 - RNA, 14 nt, Coxiella burnetii RSA 493
aauccuuuuuguaa

SEQ ID NO: 562143 - RNA, 14 nt, Coxiella burnetii RSA 493
aauccuuguugaau

SEQ ID NO: 562144 - RNA, 18 nt, Coxiella burnetii RSA 493
aauccuuguugaauuccu

SEQ ID NO: 562145 - RNA, 13 nt, Coxiella burnetii RSA 493
aauccuuuaauuc

SEQ ID NO: 562146 - RNA, 18 nt, Coxiella burnetii RSA 493
aaucguguagaaagaaag

SEQ ID NO: 562147 - RNA, 19 nt, Coxiella burnetii RSA 493
aaucgugaaauaccucuuc

SEQ ID NO: 562148 - RNA, 14 nt, Coxiella burnetii RSA 493
aaucggaaaagcca

SEQ ID NO: 562149 - RNA, 17 nt, Coxiella burnetii RSA 493
aaucgauggaagaacau

SEQ ID NO: 562150 - RNA, 15 nt, Coxiella burnetii RSA 493
aaucgcaaaauucag

SEQ ID NO: 562151 - RNA, 21 nt, Coxiella burnetii RSA 493
aaugcugcgaccuucuuuuuu

SEQ ID NO: 562152 - RNA, 23 nt, Coxiella burnetii RSA 493
aaugcugagaucggcugaaacgu

SEQ ID NO: 562153 - RNA, 16 nt, Coxiella burnetii RSA 493
aaugcugauaauugaa

SEQ ID NO: 562154 - RNA, 13 nt, Coxiella burnetii RSA 493
aauggauucuucu

SEQ ID NO: 562155 - RNA, 16 nt, Coxiella burnetii RSA 493
aauggauucuucuuuu

SEQ ID NO: 562156 - RNA, 14 nt, Coxiella burnetii RSA 493
aauggauuuccacu

SEQ ID NO: 562157 - RNA, 15 nt, Coxiella burnetii RSA 493
aaugcguuuuaaaug

SEQ ID NO: 562158 - RNA, 16 nt, Coxiella burnetii RSA 493
aaugcuaauuccuuug

SEQ ID NO: 562159 - RNA, 14 nt, Coxiella burnetii RSA 493
aaugccauuuuuau

SEQ ID NO: 562160 - RNA, 22 nt, Coxiella burnetii RSA 493
aaugggcguacaaagagaagca

SEQ ID NO: 562161 - RNA, 18 nt, Coxiella burnetii RSA 493
aauggcuaacucacuuuu

SEQ ID NO: 562162 - RNA, 23 nt, Coxiella burnetii RSA 493
aaugucacguuaucauucuuauc

SEQ ID NO: 562163 - RNA, 23 nt, Coxiella burnetii RSA 493
aaugucagguucggauuucacuu

SEQ ID NO: 562164 - RNA, 21 nt, Coxiella burnetii RSA 493
aauuagaauuccuuuuaugaa

SEQ ID NO: 562165 - RNA, 13 nt, Coxiella burnetii RSA 493
aauuacuuuuaua

SEQ ID NO: 562166 - RNA, 14 nt, Coxiella burnetii RSA 493
aauuacuuuuauaa

SEQ ID NO: 562167 - RNA, 19 nt, Coxiella burnetii RSA 493
aauuaccugaaugcuuuua

SEQ ID NO: 562168 - RNA, 21 nt, Coxiella burnetii RSA 493
aauuaagacuaggaaaaaaua

SEQ ID NO: 562169 - RNA, 23 nt, Coxiella burnetii RSA 493
aauuaagcuugaaaaaauugaua

SEQ ID NO: 562170 - RNA, 16 nt, Coxiella burnetii RSA 493
aauuaacuuugcaaag

SEQ ID NO: 562171 - RNA, 17 nt, Coxiella burnetii RSA 493
aauuaacuuugcaaagc

SEQ ID NO: 562172 - RNA, 17 nt, Coxiella burnetii RSA 493
aauuaacguauaaauaa

SEQ ID NO: 562173 - RNA, 10 nt, Coxiella burnetii RSA 493
aauuaaauau

SEQ ID NO: 562174 - RNA, 13 nt, Coxiella burnetii RSA 493
aauuaaaugcuuu

SEQ ID NO: 562175 - RNA, 21 nt, Coxiella burnetii RSA 493
aauguuauuuauuuuucucuu

SEQ ID NO: 562176 - RNA, 21 nt, Coxiella burnetii RSA 493
aaugugugucauaaauaaaag

SEQ ID NO: 562177 - RNA, 13 nt, Coxiella burnetii RSA 493
aauuaaaaauauu

SEQ ID NO: 562178 - RNA, 23 nt, Coxiella burnetii RSA 493
aauuaaaaaucgguuuuuuucuu

SEQ ID NO: 562179 - RNA, 16 nt, Coxiella burnetii RSA 493
aauguuuuuuaauaaa

SEQ ID NO: 562180 - RNA, 18 nt, Coxiella burnetii RSA 493
aauguugauaauaaaugg

SEQ ID NO: 562181 - RNA, 12 nt, Coxiella burnetii RSA 493
aauguuuaaauu

SEQ ID NO: 562182 - RNA, 14 nt, Coxiella burnetii RSA 493
aauguuuaaucgcu

SEQ ID NO: 562183 - RNA, 16 nt, Coxiella burnetii RSA 493
aauguuugaauauuuu

SEQ ID NO: 562184 - RNA, 20 nt, Coxiella burnetii RSA 493
aauguuuccaaauaaugagu

SEQ ID NO: 562185 - RNA, 20 nt, Coxiella burnetii RSA 493
aagcgucaugaaaagcggag

SEQ ID NO: 562186 - RNA, 22 nt, Coxiella burnetii RSA 493
aagcggauggagcaaacagucc

SEQ ID NO: 562187 - RNA, 20 nt, Coxiella burnetii RSA 493
aagcggauaagccauuaaaa

SEQ ID NO: 562188 - RNA, 14 nt, Coxiella burnetii RSA 493
aagcauuuuuuugu

SEQ ID NO: 562189 - RNA, 13 nt, Coxiella burnetii RSA 493
aagccacacaacc

SEQ ID NO: 562190 - RNA, 20 nt, Coxiella burnetii RSA 493
aagccaaguuuuaagaaaaa

SEQ ID NO: 562191 - RNA, 22 nt, Coxiella burnetii RSA 493
aagcgcuuuuggcuacuuucuc

SEQ ID NO: 562192 - RNA, 22 nt, Coxiella burnetii RSA 493
aagcgcuuacagcaggaaccag

SEQ ID NO: 562193 - RNA, 18 nt, Coxiella burnetii RSA 493
aagcgcuugguuaacgaa

SEQ ID NO: 562194 - RNA, 16 nt, Coxiella burnetii RSA 493
aagcuagcgaaauuug

SEQ ID NO: 562195 - RNA, 13 nt, Coxiella burnetii RSA 493
aagcuaucagcaa

SEQ ID NO: 562196 - RNA, 22 nt, Coxiella burnetii RSA 493
aagcuaucagcaaucaaaugag

SEQ ID NO: 562197 - RNA, 13 nt, Coxiella burnetii RSA 493
aagcucuaacagg

SEQ ID NO: 562198 - RNA, 15 nt, Coxiella burnetii RSA 493
aagcuguuucuuuua

SEQ ID NO: 562199 - RNA, 17 nt, Coxiella burnetii RSA 493
aagcuuucaauaaauaa

SEQ ID NO: 562200 - RNA, 22 nt, Coxiella burnetii RSA 493
aagcuuucaauaaauaaaucaa

SEQ ID NO: 562201 - RNA, 14 nt, Coxiella burnetii RSA 493
aagcugccaccuuu

SEQ ID NO: 562202 - RNA, 19 nt, Coxiella burnetii RSA 493
aagcugcgcauaaacuuua

SEQ ID NO: 562203 - RNA, 15 nt, Coxiella burnetii RSA 493
aagcuuuugccuugg

SEQ ID NO: 562204 - RNA, 17 nt, Coxiella burnetii RSA 493
aaggaauagccuucuca

SEQ ID NO: 562205 - RNA, 21 nt, Coxiella burnetii RSA 493
aaggaauaaaaccuucaaaaa

SEQ ID NO: 562206 - RNA, 17 nt, Coxiella burnetii RSA 493
aaggaauucuaauuaaa

SEQ ID NO: 562207 - RNA, 22 nt, Coxiella burnetii RSA 493
aaggcuuuauuuacggaaauca

SEQ ID NO: 562208 - RNA, 16 nt, Coxiella burnetii RSA 493
aaggucucaacagccu

SEQ ID NO: 562209 - RNA, 19 nt, Coxiella burnetii RSA 493
aagguucuggcuuucccuu

SEQ ID NO: 562210 - RNA, 15 nt, Coxiella burnetii RSA 493
aagguugagaaguaa

SEQ ID NO: 562211 - RNA, 15 nt, Coxiella burnetii RSA 493
aagguguucaaccgc

SEQ ID NO: 562212 - RNA, 23 nt, Coxiella burnetii RSA 493
aaggugcgucccgcuuaaaccca

SEQ ID NO: 562213 - RNA, 15 nt, Coxiella burnetii RSA 493
aagguggaacaauau

SEQ ID NO: 562214 - RNA, 17 nt, Coxiella burnetii RSA 493
aagguggagagaauuuu

SEQ ID NO: 562215 - RNA, 18 nt, Coxiella burnetii RSA 493
aaggccccauugggcugg

SEQ ID NO: 562216 - RNA, 20 nt, Coxiella burnetii RSA 493
aaggcccgcuaauuguucag

SEQ ID NO: 562217 - RNA, 15 nt, Coxiella burnetii RSA 493
aaggccggcccuaac

SEQ ID NO: 562218 - RNA, 14 nt, Coxiella burnetii RSA 493
aaggcaacucuuug

SEQ ID NO: 562219 - RNA, 14 nt, Coxiella burnetii RSA 493
aaggcaauuuuuga

SEQ ID NO: 562220 - RNA, 14 nt, Coxiella burnetii RSA 493
aaggcagaggacag

SEQ ID NO: 562221 - RNA, 17 nt, Coxiella burnetii RSA 493
aaggcagcuuccagaaa

SEQ ID NO: 562222 - RNA, 19 nt, Coxiella burnetii RSA 493
aaggcagcuuccagaaauu

SEQ ID NO: 562223 - RNA, 17 nt, Coxiella burnetii RSA 493
aaggcaugaaauuuuug

SEQ ID NO: 562224 - RNA, 18 nt, Coxiella burnetii RSA 493
aaggcaugaaauuuuugg

SEQ ID NO: 562225 - RNA, 21 nt, Coxiella burnetii RSA 493
aaguuuucacuguugagcaaa

SEQ ID NO: 562226 - RNA, 14 nt, Coxiella burnetii RSA 493
aaguuuuaagaaaa

SEQ ID NO: 562227 - RNA, 19 nt, Coxiella burnetii RSA 493
aaguuuucuauauuuucuu

SEQ ID NO: 562228 - RNA, 20 nt, Coxiella burnetii RSA 493
aaguuuucuauauuuucuuu

SEQ ID NO: 562229 - RNA, 12 nt, Coxiella burnetii RSA 493
aaguuuuucacg

SEQ ID NO: 562230 - RNA, 18 nt, Coxiella burnetii RSA 493
aaguuucacgaauuaaaa

SEQ ID NO: 562231 - RNA, 17 nt, Coxiella burnetii RSA 493
aaguuucccacaaaaua

SEQ ID NO: 562232 - RNA, 22 nt, Coxiella burnetii RSA 493
aaguuuauaaaaauccucacga

SEQ ID NO: 562233 - RNA, 19 nt, Coxiella burnetii RSA 493
aaguuucucccgauaaguu

SEQ ID NO: 562234 - RNA, 11 nt, Coxiella burnetii RSA 493
aaguuugaccc

SEQ ID NO: 562235 - RNA, 22 nt, Coxiella burnetii RSA 493
aaguugggccaaaauagaauug

SEQ ID NO: 562236 - RNA, 15 nt, Coxiella burnetii RSA 493
aaguucucaaauuuu

SEQ ID NO: 562237 - RNA, 16 nt, Coxiella burnetii RSA 493
aaguucucaaauuuuc

SEQ ID NO: 562238 - RNA, 17 nt, Coxiella burnetii RSA 493
aaguucuuugccacccc

SEQ ID NO: 562239 - RNA, 17 nt, Coxiella burnetii RSA 493
aaguucuucuaaagaau

SEQ ID NO: 562240 - RNA, 22 nt, Coxiella burnetii RSA 493
aaguucuucuaaagaauuuuuc

SEQ ID NO: 562241 - RNA, 14 nt, Coxiella burnetii RSA 493
aauaaaaggagaaa

SEQ ID NO: 562242 - RNA, 22 nt, Coxiella burnetii RSA 493
aauaaaaggagaaauugacaaa

SEQ ID NO: 562243 - RNA, 20 nt, Coxiella burnetii RSA 493
aauaaaaguccuguucuuuu

SEQ ID NO: 562244 - RNA, 19 nt, Coxiella burnetii RSA 493
aauaaaaccuucaaaaaua

SEQ ID NO: 562245 - RNA, 18 nt, Coxiella burnetii RSA 493
aauaaaaaauuacugaaa

SEQ ID NO: 562246 - RNA, 21 nt, Coxiella burnetii RSA 493
aauaaaccuauccaaaaagau

SEQ ID NO: 562247 - RNA, 22 nt, Coxiella burnetii RSA 493
aauaaaccuauccaaaaagaua

SEQ ID NO: 562248 - RNA, 18 nt, Coxiella burnetii RSA 493
aauaaacuggaaaaaggu

SEQ ID NO: 562249 - RNA, 14 nt, Coxiella burnetii RSA 493
aagugggggaacag

SEQ ID NO: 562250 - RNA, 18 nt, Coxiella burnetii RSA 493
aagugggggaacagagga

SEQ ID NO: 562251 - RNA, 15 nt, Coxiella burnetii RSA 493
aagucuuugcuaaga

SEQ ID NO: 562252 - RNA, 23 nt, Coxiella burnetii RSA 493
aagugauuuuuuuagcacagcga

SEQ ID NO: 562253 - RNA, 18 nt, Coxiella burnetii RSA 493
aagucccucccgaggagc

SEQ ID NO: 562254 - RNA, 15 nt, Coxiella burnetii RSA 493
aagucuauugaaaaa

SEQ ID NO: 562255 - RNA, 21 nt, Coxiella burnetii RSA 493
aaguaaguagcucuuaaaaga

SEQ ID NO: 562256 - RNA, 20 nt, Coxiella burnetii RSA 493
aaguaugugggcucacuugc

SEQ ID NO: 562257 - RNA, 20 nt, Coxiella burnetii RSA 493
aagaauaaacuuuauuccca

SEQ ID NO: 562258 - RNA, 19 nt, Coxiella burnetii RSA 493
aaauugaaagaauuucucg

SEQ ID NO: 562259 - RNA, 14 nt, Coxiella burnetii RSA 493
aaauugacccuuuu

SEQ ID NO: 562260 - RNA, 22 nt, Coxiella burnetii RSA 493
aagacacguucuggaaugacuc

SEQ ID NO: 562261 - RNA, 20 nt, Coxiella burnetii RSA 493
aagacaauguuaaaacacau

SEQ ID NO: 562262 - RNA, 19 nt, Coxiella burnetii RSA 493
aagaauuucucgauaaaaa

SEQ ID NO: 562263 - RNA, 14 nt, Coxiella burnetii RSA 493
aagaauuuuucaug

SEQ ID NO: 562264 - RNA, 20 nt, Coxiella burnetii RSA 493
aagacauuguucauaaaaua

SEQ ID NO: 562265 - RNA, 16 nt, Coxiella burnetii RSA 493
aagacuaggaaaaaau

SEQ ID NO: 562266 - RNA, 12 nt, Coxiella burnetii RSA 493
aagacuaagaau

SEQ ID NO: 562267 - RNA, 14 nt, Coxiella burnetii RSA 493
aagacuaagaauaa

SEQ ID NO: 562268 - RNA, 17 nt, Coxiella burnetii RSA 493
aagacguaccauuaaaa

SEQ ID NO: 562269 - RNA, 15 nt, Coxiella burnetii RSA 493
aagacgcuuucaaca

SEQ ID NO: 562270 - RNA, 12 nt, Coxiella burnetii RSA 493
aagaguaaaaaa

SEQ ID NO: 562271 - RNA, 15 nt, Coxiella burnetii RSA 493
aagaguaaaaaacca

SEQ ID NO: 562272 - RNA, 17 nt, Coxiella burnetii RSA 493
aagagugcaauuagggu

SEQ ID NO: 562273 - RNA, 15 nt, Coxiella burnetii RSA 493
aagaguugagcgaag

SEQ ID NO: 562274 - RNA, 20 nt, Coxiella burnetii RSA 493
aagaguugagcgaagaaaaa

SEQ ID NO: 562275 - RNA, 17 nt, Coxiella burnetii RSA 493
aagcaagcuuacucaca

SEQ ID NO: 562276 - RNA, 18 nt, Coxiella burnetii RSA 493
aagcaaagcgcguaagca

SEQ ID NO: 562277 - RNA, 21 nt, Coxiella burnetii RSA 493
aagcaaaaauacaagcugaca

SEQ ID NO: 562278 - RNA, 22 nt, Coxiella burnetii RSA 493
aagcacaguuacguaauuauua

SEQ ID NO: 562279 - RNA, 11 nt, Coxiella burnetii RSA 493
aagcaauuuuu

SEQ ID NO: 562280 - RNA, 21 nt, Coxiella burnetii RSA 493
aagcaccgcuggcuuugauuc

SEQ ID NO: 562281 - RNA, 22 nt, Coxiella burnetii RSA 493
aagcaccgcuggcuuugauucc

SEQ ID NO: 562282 - RNA, 18 nt, Coxiella burnetii RSA 493
aagcacuaguuuuacuac

SEQ ID NO: 562283 - RNA, 20 nt, Coxiella burnetii RSA 493
aagcacugcaccauaacuaa

SEQ ID NO: 562284 - RNA, 14 nt, Coxiella burnetii RSA 493
aagcaguagcugaa

SEQ ID NO: 562285 - RNA, 19 nt, Coxiella burnetii RSA 493
aagcaugggccuacuuuau

SEQ ID NO: 562286 - RNA, 14 nt, Coxiella burnetii RSA 493
aagcaucagauacc

SEQ ID NO: 562287 - RNA, 18 nt, Coxiella burnetii RSA 493
aagauuuauaacaagguu

SEQ ID NO: 562288 - RNA, 17 nt, Coxiella burnetii RSA 493
aagauucguaauauuau

SEQ ID NO: 562289 - RNA, 13 nt, Coxiella burnetii RSA 493
aagauucuugaac

SEQ ID NO: 562290 - RNA, 12 nt, Coxiella burnetii RSA 493
aagaucgcugua

SEQ ID NO: 562291 - RNA, 14 nt, Coxiella burnetii RSA 493
aagaucuccuugag

SEQ ID NO: 562292 - RNA, 20 nt, Coxiella burnetii RSA 493
aagaucuccccuucuuuaau

SEQ ID NO: 562293 - RNA, 16 nt, Coxiella burnetii RSA 493
aagaucaauuacgaag

SEQ ID NO: 562294 - RNA, 21 nt, Coxiella burnetii RSA 493
aagauaucgucacccaaauca

SEQ ID NO: 562295 - RNA, 16 nt, Coxiella burnetii RSA 493
uuuguagauuagaaaa

SEQ ID NO: 562296 - RNA, 21 nt, Coxiella burnetii RSA 493
uuuguauucauuacgauuaau

SEQ ID NO: 562297 - RNA, 20 nt, Coxiella burnetii RSA 493
uuugugagucgccaauaaua

SEQ ID NO: 562298 - RNA, 17 nt, Coxiella burnetii RSA 493
uuugugauuuuaaaaau

SEQ ID NO: 562299 - RNA, 19 nt, Coxiella burnetii RSA 493
uuugguaaugcuucuaauu

SEQ ID NO: 562300 - RNA, 22 nt, Coxiella burnetii RSA 493
uuugguaaugcuucuaauuuga

SEQ ID NO: 562301 - RNA, 17 nt, Coxiella burnetii RSA 493
uuugguucguguuuauu

SEQ ID NO: 562302 - RNA, 21 nt, Coxiella burnetii RSA 493
uuugcugaagacguauuugga

SEQ ID NO: 562303 - RNA, 14 nt, Coxiella burnetii RSA 493
uuuggauaauuuuu

SEQ ID NO: 562304 - RNA, 19 nt, Coxiella burnetii RSA 493
uuuggauugccaauugucu

SEQ ID NO: 562305 - RNA, 13 nt, Coxiella burnetii RSA 493
uuuguuaauucuu

SEQ ID NO: 562306 - RNA, 15 nt, Coxiella burnetii RSA 493
uuuguuauugcuaaa

SEQ ID NO: 562307 - RNA, 18 nt, Coxiella burnetii RSA 493
uuuguuccuugagaguaa

SEQ ID NO: 562308 - RNA, 22 nt, Coxiella burnetii RSA 493
uuuguuugaacaugucuuugag

SEQ ID NO: 562309 - RNA, 13 nt, Coxiella burnetii RSA 493
uuuuaaaaaagaa

SEQ ID NO: 562310 - RNA, 14 nt, Coxiella burnetii RSA 493
uuuuaaaaaagaaa

SEQ ID NO: 562311 - RNA, 22 nt, Coxiella burnetii RSA 493
uuuuaaauaagggauaaaacac

SEQ ID NO: 562312 - RNA, 12 nt, Coxiella burnetii RSA 493
uuuuaaaucuuc

SEQ ID NO: 562313 - RNA, 20 nt, Coxiella burnetii RSA 493
uuuuaaaucuuccaauuuuu

SEQ ID NO: 562314 - RNA, 23 nt, Coxiella burnetii RSA 493
uuuuaaaugcgguacuuaagaaa

SEQ ID NO: 562315 - RNA, 12 nt, Coxiella burnetii RSA 493
uuuuaaauuucu

SEQ ID NO: 562316 - RNA, 20 nt, Coxiella burnetii RSA 493
uuuuaauaugauaaaaggca

SEQ ID NO: 562317 - RNA, 19 nt, Coxiella burnetii RSA 493
uuuuaagaugccagugcuc

SEQ ID NO: 562318 - RNA, 14 nt, Coxiella burnetii RSA 493
uuuuaagauuuuua

SEQ ID NO: 562319 - RNA, 21 nt, Coxiella burnetii RSA 493
uuuuaagcucgauaucuguuu

SEQ ID NO: 562320 - RNA, 13 nt, Coxiella burnetii RSA 493
uuuuaccauuuca

SEQ ID NO: 562321 - RNA, 22 nt, Coxiella burnetii RSA 493
uuuuacagugugcacgauuuua

SEQ ID NO: 562322 - RNA, 15 nt, Coxiella burnetii RSA 493
uuuuaaugcgauucu

SEQ ID NO: 562323 - RNA, 14 nt, Coxiella burnetii RSA 493
uuuuaauuuuugca

SEQ ID NO: 562324 - RNA, 16 nt, Coxiella burnetii RSA 493
uuuuacguuuaaauaa

SEQ ID NO: 562325 - RNA, 19 nt, Coxiella burnetii RSA 493
uuuuagaaaaucaaaugcu

SEQ ID NO: 562326 - RNA, 16 nt, Coxiella burnetii RSA 493
uuuuauagcuugcuua

SEQ ID NO: 562327 - RNA, 15 nt, Coxiella burnetii RSA 493
uuuuauaaaauuuaa

SEQ ID NO: 562328 - RNA, 16 nt, Coxiella burnetii RSA 493
uuuuauaaacuuguuu

SEQ ID NO: 562329 - RNA, 18 nt, Coxiella burnetii RSA 493
uuuuagugaaaguuucau

SEQ ID NO: 562330 - RNA, 14 nt, Coxiella burnetii RSA 493
uuuuaguuaaagaa

SEQ ID NO: 562331 - RNA, 16 nt, Coxiella burnetii RSA 493
uuuuauuaucaucgca

SEQ ID NO: 562332 - RNA, 17 nt, Coxiella burnetii RSA 493
uuuuaugucguucaauu

SEQ ID NO: 562333 - RNA, 11 nt, Coxiella burnetii RSA 493
uuuuauuguua

SEQ ID NO: 562334 - RNA, 17 nt, Coxiella burnetii RSA 493
uuuuauugucauguuca

SEQ ID NO: 562335 - RNA, 18 nt, Coxiella burnetii RSA 493
uuuuauuuaaaaaacuag

SEQ ID NO: 562336 - RNA, 13 nt, Coxiella burnetii RSA 493
uuuuauuugaaau

SEQ ID NO: 562337 - RNA, 14 nt, Coxiella burnetii RSA 493
uuuuauuugaaaua

SEQ ID NO: 562338 - RNA, 22 nt, Coxiella burnetii RSA 493
uuuuaugcgcuuuccauuuuuu

SEQ ID NO: 562339 - RNA, 21 nt, Coxiella burnetii RSA 493
uuuuaugcuucaauaaaaaag

SEQ ID NO: 562340 - RNA, 15 nt, Coxiella burnetii RSA 493
uuuuaucuuauuauu

SEQ ID NO: 562341 - RNA, 15 nt, Coxiella burnetii RSA 493
uuuuauccaaacuuu

SEQ ID NO: 562342 - RNA, 20 nt, Coxiella burnetii RSA 493
uuuuccugcugauugagaau

SEQ ID NO: 562343 - RNA, 15 nt, Coxiella burnetii RSA 493
uuuucguucugaaau

SEQ ID NO: 562344 - RNA, 14 nt, Coxiella burnetii RSA 493
uuuucggagaaauc

SEQ ID NO: 562345 - RNA, 22 nt, Coxiella burnetii RSA 493
uuuuccugacuuccagauuuag

SEQ ID NO: 562346 - RNA, 21 nt, Coxiella burnetii RSA 493
uuuuccggguuauauuuaauu

SEQ ID NO: 562347 - RNA, 19 nt, Coxiella burnetii RSA 493
uuuucccuaggaaacgaag

SEQ ID NO: 562348 - RNA, 13 nt, Coxiella burnetii RSA 493
uuuucauuuugau

SEQ ID NO: 562349 - RNA, 13 nt, Coxiella burnetii RSA 493
uuuucauucucaa

SEQ ID NO: 562350 - RNA, 23 nt, Coxiella burnetii RSA 493
uuuucauuucuucgaguuucgug

SEQ ID NO: 562351 - RNA, 20 nt, Coxiella burnetii RSA 493
uuuuccaugaggccaaaaau

SEQ ID NO: 562352 - RNA, 15 nt, Coxiella burnetii RSA 493
uuuucaccuuuuccc

SEQ ID NO: 562353 - RNA, 16 nt, Coxiella burnetii RSA 493
uuuucaugcaaaaacc

SEQ ID NO: 562354 - RNA, 17 nt, Coxiella burnetii RSA 493
uuuucaugcaaaaaccg

SEQ ID NO: 562355 - RNA, 19 nt, Coxiella burnetii RSA 493
uuuucaucuuguaaucgcu

SEQ ID NO: 562356 - RNA, 13 nt, Coxiella burnetii RSA 493
uuuuauuuuuaau

SEQ ID NO: 562357 - RNA, 14 nt, Coxiella burnetii RSA 493
uuuuauuuucaaau

SEQ ID NO: 562358 - RNA, 20 nt, Coxiella burnetii RSA 493
uuuucaaaacaaucaaugca

SEQ ID NO: 562359 - RNA, 13 nt, Coxiella burnetii RSA 493
uuuucaaaauuua

SEQ ID NO: 562360 - RNA, 18 nt, Coxiella burnetii RSA 493
uuuucaaagauaucgucc

SEQ ID NO: 562361 - RNA, 18 nt, Coxiella burnetii RSA 493
uuuucaacaaguaaagua

SEQ ID NO: 562362 - RNA, 15 nt, Coxiella burnetii RSA 493
uuuuucccgcaacau

SEQ ID NO: 562363 - RNA, 16 nt, Coxiella burnetii RSA 493
uuuuuauuuugacuua

SEQ ID NO: 562364 - RNA, 17 nt, Coxiella burnetii RSA 493
uuuuucagucaccauug

SEQ ID NO: 562365 - RNA, 18 nt, Coxiella burnetii RSA 493
uuuuucacgauucaccac

SEQ ID NO: 562366 - RNA, 22 nt, Coxiella burnetii RSA 493
uuuuuacgacccccaauuuaau

SEQ ID NO: 562367 - RNA, 23 nt, Coxiella burnetii RSA 493
uuuuuacccguuuaaauuugccu

SEQ ID NO: 562368 - RNA, 16 nt, Coxiella burnetii RSA 493
uuuuuagugcaaaaaa

SEQ ID NO: 562369 - RNA, 12 nt, Coxiella burnetii RSA 493
uuuuuauaaaug

SEQ ID NO: 562370 - RNA, 15 nt, Coxiella burnetii RSA 493
uuuuuauauuccuga

SEQ ID NO: 562371 - RNA, 12 nt, Coxiella burnetii RSA 493
uuuuuaugaaaa

SEQ ID NO: 562372 - RNA, 13 nt, Coxiella burnetii RSA 493
uuuuuauucuucu

SEQ ID NO: 562373 - RNA, 11 nt, Coxiella burnetii RSA 493
uuuuuauugga

SEQ ID NO: 562374 - RNA, 20 nt, Coxiella burnetii RSA 493
uuuuuaaaagugacaaugcc

SEQ ID NO: 562375 - RNA, 11 nt, Coxiella burnetii RSA 493
uuuuuaaaauu

SEQ ID NO: 562376 - RNA, 15 nt, Coxiella burnetii RSA 493
uuuuuaaaaaauucc

SEQ ID NO: 562377 - RNA, 11 nt, Coxiella burnetii RSA 493
uuuuuaaaaaa

SEQ ID NO: 562378 - RNA, 13 nt, Coxiella burnetii RSA 493
uuuuuaaacguuu

SEQ ID NO: 562379 - RNA, 18 nt, Coxiella burnetii RSA 493
uuuuuaaagccauagaau

SEQ ID NO: 562380 - RNA, 11 nt, Coxiella burnetii RSA 493
uuuuguacugc

SEQ ID NO: 562381 - RNA, 17 nt, Coxiella burnetii RSA 493
uuuuguaaauuuuccca

SEQ ID NO: 562382 - RNA, 16 nt, Coxiella burnetii RSA 493
uuuugugcauaaauua

SEQ ID NO: 562383 - RNA, 20 nt, Coxiella burnetii RSA 493
uuuugugcauaaauuauuuu

SEQ ID NO: 562384 - RNA, 20 nt, Coxiella burnetii RSA 493
uuuucugccgcugauauucc

SEQ ID NO: 562385 - RNA, 23 nt, Coxiella burnetii RSA 493
uuuucugccgcugauauucccau

SEQ ID NO: 562386 - RNA, 20 nt, Coxiella burnetii RSA 493
uuuucuggcuguacuuucac

SEQ ID NO: 562387 - RNA, 16 nt, Coxiella burnetii RSA 493
uuuucucaauuucuuu

SEQ ID NO: 562388 - RNA, 13 nt, Coxiella burnetii RSA 493
uuuucuauuuuuu

SEQ ID NO: 562389 - RNA, 17 nt, Coxiella burnetii RSA 493
uuuucuauccagaaacc

SEQ ID NO: 562390 - RNA, 20 nt, Coxiella burnetii RSA 493
uuuucuauaaguccaagacu

SEQ ID NO: 562391 - RNA, 21 nt, Coxiella burnetii RSA 493
uuuucugugaaauaaacagag

SEQ ID NO: 562392 - RNA, 23 nt, Coxiella burnetii RSA 493
uuuucuucgcuggauuuuuuaau

SEQ ID NO: 562393 - RNA, 15 nt, Coxiella burnetii RSA 493
uuuucuucugaauua

SEQ ID NO: 562394 - RNA, 23 nt, Coxiella burnetii RSA 493
uuuugaagcuauccaaauaaucg

SEQ ID NO: 562395 - RNA, 13 nt, Coxiella burnetii RSA 493
uuuugaaaaauaa

SEQ ID NO: 562396 - RNA, 15 nt, Coxiella burnetii RSA 493
uuuucuuuccaucac

SEQ ID NO: 562397 - RNA, 12 nt, Coxiella burnetii RSA 493
uuuucuuuuaau

SEQ ID NO: 562398 - RNA, 19 nt, Coxiella burnetii RSA 493
uuuugcaggggauaaagug

SEQ ID NO: 562399 - RNA, 13 nt, Coxiella burnetii RSA 493
uuuugauuuuuua

SEQ ID NO: 562400 - RNA, 14 nt, Coxiella burnetii RSA 493
uuuugaauuuugcc

SEQ ID NO: 562401 - RNA, 23 nt, Coxiella burnetii RSA 493
uuuugaauacaacgcuguuaaaa

SEQ ID NO: 562402 - RNA, 15 nt, Coxiella burnetii RSA 493
uuuuggaaugagcau

SEQ ID NO: 562403 - RNA, 21 nt, Coxiella burnetii RSA 493
uuuugccaauauaaauaaucu

SEQ ID NO: 562404 - RNA, 21 nt, Coxiella burnetii RSA 493
uuuugcgcuuauagcuuguuc

SEQ ID NO: 562405 - RNA, 15 nt, Coxiella burnetii RSA 493
uuuugcguaaauggu

SEQ ID NO: 562406 - RNA, 16 nt, Coxiella burnetii RSA 493
uuuugccggaguuaac

SEQ ID NO: 562407 - RNA, 14 nt, Coxiella burnetii RSA 493
aaauucauuuuuca

SEQ ID NO: 562408 - RNA, 21 nt, Coxiella burnetii RSA 493
aaauuccaccggcgucugaau

SEQ ID NO: 562409 - RNA, 18 nt, Coxiella burnetii RSA 493
aaauucaggggcaaucaa

SEQ ID NO: 562410 - RNA, 13 nt, Coxiella burnetii RSA 493
aaauuauuuuaau

SEQ ID NO: 562411 - RNA, 17 nt, Coxiella burnetii RSA 493
aaauucucccuuuuccu

SEQ ID NO: 562412 - RNA, 16 nt, Coxiella burnetii RSA 493
aaauucguuaaaaccu

SEQ ID NO: 562413 - RNA, 21 nt, Coxiella burnetii RSA 493
aaauucuagugugauaaucau

SEQ ID NO: 562414 - RNA, 21 nt, Coxiella burnetii RSA 493
aaauuccgauuguuguggaua

SEQ ID NO: 562415 - RNA, 15 nt, Coxiella burnetii RSA 493
aaauuauuaaucaua

SEQ ID NO: 562416 - RNA, 13 nt, Coxiella burnetii RSA 493
aaauuauucggau

SEQ ID NO: 562417 - RNA, 12 nt, Coxiella burnetii RSA 493
aaauuauuugau

SEQ ID NO: 562418 - RNA, 19 nt, Coxiella burnetii RSA 493
aaauuaguaauauuuugca

SEQ ID NO: 562419 - RNA, 17 nt, Coxiella burnetii RSA 493
aaauuagguaauuuaua

SEQ ID NO: 562420 - RNA, 18 nt, Coxiella burnetii RSA 493
aaauuagguaauuuauaa

SEQ ID NO: 562421 - RNA, 22 nt, Coxiella burnetii RSA 493
aaauuagcgaugucagccgcuu

SEQ ID NO: 562422 - RNA, 10 nt, Coxiella burnetii RSA 493
uuuuuuuaaa

SEQ ID NO: 562423 - RNA, 11 nt, Coxiella burnetii RSA 493
uuuuuuuaaaa

SEQ ID NO: 562424 - RNA, 23 nt, Coxiella burnetii RSA 493
uuuuuucuucugaauuaauuccc

SEQ ID NO: 562425 - RNA, 11 nt, Coxiella burnetii RSA 493
uuuuuuuucuu

SEQ ID NO: 562426 - RNA, 16 nt, Coxiella burnetii RSA 493
aaauuacuuggggguu

SEQ ID NO: 562427 - RNA, 21 nt, Coxiella burnetii RSA 493
aaauuacuuggggguuuugaa

SEQ ID NO: 562428 - RNA, 19 nt, Coxiella burnetii RSA 493
uuuuuggcgcgaucaagac

SEQ ID NO: 562429 - RNA, 22 nt, Coxiella burnetii RSA 493
uuuuuggcuugcuccaaaauaa

SEQ ID NO: 562430 - RNA, 21 nt, Coxiella burnetii RSA 493
uuuuugauuucguaaaacgau

SEQ ID NO: 562431 - RNA, 13 nt, Coxiella burnetii RSA 493
uuuuugcaaauaa

SEQ ID NO: 562432 - RNA, 12 nt, Coxiella burnetii RSA 493
uuuuuguuugau

SEQ ID NO: 562433 - RNA, 23 nt, Coxiella burnetii RSA 493
uuuuucuucugaauuaauuccca

SEQ ID NO: 562434 - RNA, 17 nt, Coxiella burnetii RSA 493
uuuuugaagcauauaac

SEQ ID NO: 562435 - RNA, 18 nt, Coxiella burnetii RSA 493
uuuuugaagcuauccaaa

SEQ ID NO: 562436 - RNA, 10 nt, Coxiella burnetii RSA 493
uuuuucucuu

SEQ ID NO: 562437 - RNA, 18 nt, Coxiella burnetii RSA 493
uuuuucguuuaacaauga

SEQ ID NO: 562438 - RNA, 19 nt, Coxiella burnetii RSA 493
aaauuaauauaaucagcaa

SEQ ID NO: 562439 - RNA, 11 nt, Coxiella burnetii RSA 493
aaauuaaauau

SEQ ID NO: 562440 - RNA, 14 nt, Coxiella burnetii RSA 493
aaauuaaaauaauc

SEQ ID NO: 562441 - RNA, 16 nt, Coxiella burnetii RSA 493
aaauguuaggaaggac

SEQ ID NO: 562442 - RNA, 15 nt, Coxiella burnetii RSA 493
uuuccaucuccuuuu

SEQ ID NO: 562443 - RNA, 14 nt, Coxiella burnetii RSA 493
uuuccccccaacua

SEQ ID NO: 562444 - RNA, 23 nt, Coxiella burnetii RSA 493
uuucccaaaugacgaucgucuaa

SEQ ID NO: 562445 - RNA, 16 nt, Coxiella burnetii RSA 493
uuuccggagugacagu

SEQ ID NO: 562446 - RNA, 23 nt, Coxiella burnetii RSA 493
uuuccgaguauuuauuaaaaacu

SEQ ID NO: 562447 - RNA, 20 nt, Coxiella burnetii RSA 493
uuucccgcuccagauuucuu

SEQ ID NO: 562448 - RNA, 15 nt, Coxiella burnetii RSA 493
uuuccuuuucauuuu

SEQ ID NO: 562449 - RNA, 20 nt, Coxiella burnetii RSA 493
uuucgagcgcgauuuucucu

SEQ ID NO: 562450 - RNA, 21 nt, Coxiella burnetii RSA 493
uuucgcaggauaauguuugau

SEQ ID NO: 562451 - RNA, 20 nt, Coxiella burnetii RSA 493
uuuccuucguuucuuccauu

SEQ ID NO: 562452 - RNA, 19 nt, Coxiella burnetii RSA 493
uuucuaacgucgcaaauaa

SEQ ID NO: 562453 - RNA, 22 nt, Coxiella burnetii RSA 493
uuucuaagacacguucuggaau

SEQ ID NO: 562454 - RNA, 13 nt, Coxiella burnetii RSA 493
uuucuaaaaauca

SEQ ID NO: 562455 - RNA, 21 nt, Coxiella burnetii RSA 493
uuucguaugccgcuugaaaaa

SEQ ID NO: 562456 - RNA, 19 nt, Coxiella burnetii RSA 493
uuucggugcuagcgcucca

SEQ ID NO: 562457 - RNA, 18 nt, Coxiella burnetii RSA 493
uuucggauuuugaacagu

SEQ ID NO: 562458 - RNA, 18 nt, Coxiella burnetii RSA 493
uuucgcuucaauucuuuu

SEQ ID NO: 562459 - RNA, 19 nt, Coxiella burnetii RSA 493
uuucuagggagaaaaauuu

SEQ ID NO: 562460 - RNA, 21 nt, Coxiella burnetii RSA 493
uuucuauuagccuuaauuucu

SEQ ID NO: 562461 - RNA, 22 nt, Coxiella burnetii RSA 493
uuucugcgauuuuguuucuuug

SEQ ID NO: 562462 - RNA, 15 nt, Coxiella burnetii RSA 493
uuucugguuuccuuu

SEQ ID NO: 562463 - RNA, 19 nt, Coxiella burnetii RSA 493
uuucugggagauuuauucc

SEQ ID NO: 562464 - RNA, 16 nt, Coxiella burnetii RSA 493
uuucucuuuuaacuua

SEQ ID NO: 562465 - RNA, 16 nt, Coxiella burnetii RSA 493
uuucucuuuuuuccaa

SEQ ID NO: 562466 - RNA, 14 nt, Coxiella burnetii RSA 493
uuucugauuuuuga

SEQ ID NO: 562467 - RNA, 19 nt, Coxiella burnetii RSA 493
uuucucgaaugacaacccc

SEQ ID NO: 562468 - RNA, 14 nt, Coxiella burnetii RSA 493
uuucuuuugccucu

SEQ ID NO: 562469 - RNA, 13 nt, Coxiella burnetii RSA 493
uuucuuuucuaaa

SEQ ID NO: 562470 - RNA, 15 nt, Coxiella burnetii RSA 493
uuugaaaguagaaaa

SEQ ID NO: 562471 - RNA, 18 nt, Coxiella burnetii RSA 493
uuugaaauaaacuggaaa

SEQ ID NO: 562472 - RNA, 19 nt, Coxiella burnetii RSA 493
uuugaaauaaacuggaaaa

SEQ ID NO: 562473 - RNA, 22 nt, Coxiella burnetii RSA 493
uuugaaauaaacuggaaaaagg

SEQ ID NO: 562474 - RNA, 15 nt, Coxiella burnetii RSA 493
uuugaaauagccauu

SEQ ID NO: 562475 - RNA, 16 nt, Coxiella burnetii RSA 493
uuugaauaauucguuu

SEQ ID NO: 562476 - RNA, 23 nt, Coxiella burnetii RSA 493
uuugacaacugccugcuaggauu

SEQ ID NO: 562477 - RNA, 15 nt, Coxiella burnetii RSA 493
uuugaauuuuuugaa

SEQ ID NO: 562478 - RNA, 15 nt, Coxiella burnetii RSA 493
uuugacaaacaguua

SEQ ID NO: 562479 - RNA, 22 nt, Coxiella burnetii RSA 493
uuugacuaagucaaaaacuuca

SEQ ID NO: 562480 - RNA, 12 nt, Coxiella burnetii RSA 493
uuucuuagagag

SEQ ID NO: 562481 - RNA, 17 nt, Coxiella burnetii RSA 493
uuucuucauauucuuca

SEQ ID NO: 562482 - RNA, 20 nt, Coxiella burnetii RSA 493
uuucuuccaacacguauuuu

SEQ ID NO: 562483 - RNA, 22 nt, Coxiella burnetii RSA 493
uuucuuccaacacguauuuuca

SEQ ID NO: 562484 - RNA, 10 nt, Coxiella burnetii RSA 493
uuucuucaua

SEQ ID NO: 562485 - RNA, 16 nt, Coxiella burnetii RSA 493
uuucuucuuuucuauu

SEQ ID NO: 562486 - RNA, 20 nt, Coxiella burnetii RSA 493
uuucuugucgaaaacuaguu

SEQ ID NO: 562487 - RNA, 16 nt, Coxiella burnetii RSA 493
uuucuuucuucuaaug

SEQ ID NO: 562488 - RNA, 23 nt, Coxiella burnetii RSA 493
uuucuuuggguuggcuuuugaca

SEQ ID NO: 562489 - RNA, 14 nt, Coxiella burnetii RSA 493
uuucuuuuauaaaa

SEQ ID NO: 562490 - RNA, 19 nt, Coxiella burnetii RSA 493
uuugauuuacaauauccca

SEQ ID NO: 562491 - RNA, 15 nt, Coxiella burnetii RSA 493
uuugcaaaugaauaa

SEQ ID NO: 562492 - RNA, 21 nt, Coxiella burnetii RSA 493
uuugcagcaucccccaagaga

SEQ ID NO: 562493 - RNA, 20 nt, Coxiella burnetii RSA 493
uuugaucgucccaucaucug

SEQ ID NO: 562494 - RNA, 19 nt, Coxiella burnetii RSA 493
uuugaucucuugcccccau

SEQ ID NO: 562495 - RNA, 19 nt, Coxiella burnetii RSA 493
uuugauccuugcaauaagc

SEQ ID NO: 562496 - RNA, 23 nt, Coxiella burnetii RSA 493
uuugaugaucggaggaaauauuu

SEQ ID NO: 562497 - RNA, 21 nt, Coxiella burnetii RSA 493
uuugauaggauuauuaucaaa

SEQ ID NO: 562498 - RNA, 17 nt, Coxiella burnetii RSA 493
uuugauaaauuaaaaaa

SEQ ID NO: 562499 - RNA, 18 nt, Coxiella burnetii RSA 493
uuugauaagguaucccuu

SEQ ID NO: 562500 - RNA, 15 nt, Coxiella burnetii RSA 493
uuugcgguuaaaaaa

SEQ ID NO: 562501 - RNA, 21 nt, Coxiella burnetii RSA 493
uuugcggccucgccuucuucg

SEQ ID NO: 562502 - RNA, 20 nt, Coxiella burnetii RSA 493
uuugcgcuuauagcuuguuc

SEQ ID NO: 562503 - RNA, 16 nt, Coxiella burnetii RSA 493
uuugcauuaaucuucc

SEQ ID NO: 562504 - RNA, 21 nt, Coxiella burnetii RSA 493
uuugccaauauaaauaaucuu

SEQ ID NO: 562505 - RNA, 23 nt, Coxiella burnetii RSA 493
uuugccaauauaaauaaucuucc

SEQ ID NO: 562506 - RNA, 14 nt, Coxiella burnetii RSA 493
uuugccaggacuuu

SEQ ID NO: 562507 - RNA, 22 nt, Coxiella burnetii RSA 493
uuugcagccgccaauuuuguuu

SEQ ID NO: 562508 - RNA, 18 nt, Coxiella burnetii RSA 493
uuugccggaguuaacagc

SEQ ID NO: 562509 - RNA, 19 nt, Coxiella burnetii RSA 493
uuugccauauaauuuaaug

SEQ ID NO: 562510 - RNA, 13 nt, Coxiella burnetii RSA 493
uugcugaccuuuu

SEQ ID NO: 562511 - RNA, 16 nt, Coxiella burnetii RSA 493
uugcugaccuuuuccu

SEQ ID NO: 562512 - RNA, 17 nt, Coxiella burnetii RSA 493
uuguuauaaaacuuccc

SEQ ID NO: 562513 - RNA, 22 nt, Coxiella burnetii RSA 493
uuguugcggauuggcuuugccu

SEQ ID NO: 562514 - RNA, 14 nt, Coxiella burnetii RSA 493
uuguuggaaauaau

SEQ ID NO: 562515 - RNA, 22 nt, Coxiella burnetii RSA 493
uuguuuaagugacagcucugaa

SEQ ID NO: 562516 - RNA, 21 nt, Coxiella burnetii RSA 493
uuguuucgcaacuuuuuuccu

SEQ ID NO: 562517 - RNA, 13 nt, Coxiella burnetii RSA 493
uuuaaaaaagaaa

SEQ ID NO: 562518 - RNA, 19 nt, Coxiella burnetii RSA 493
uuguuuuuggcauaccuuu

SEQ ID NO: 562519 - RNA, 17 nt, Coxiella burnetii RSA 493
uuuaaaguuauuucuuu

SEQ ID NO: 562520 - RNA, 17 nt, Coxiella burnetii RSA 493
uuuaaacucaauucgcu

SEQ ID NO: 562521 - RNA, 19 nt, Coxiella burnetii RSA 493
uuuaaaauaaguauccauc

SEQ ID NO: 562522 - RNA, 11 nt, Coxiella burnetii RSA 493
uuuaaaccacu

SEQ ID NO: 562523 - RNA, 13 nt, Coxiella burnetii RSA 493
uuuaaaccacuau

SEQ ID NO: 562524 - RNA, 19 nt, Coxiella burnetii RSA 493
uuuaaauuggccaccauug

SEQ ID NO: 562525 - RNA, 13 nt, Coxiella burnetii RSA 493
uuuaaauuuuuca

SEQ ID NO: 562526 - RNA, 15 nt, Coxiella burnetii RSA 493
uuuaaauuucucauc

SEQ ID NO: 562527 - RNA, 20 nt, Coxiella burnetii RSA 493
uuuaaccgcgaaugguugaa

SEQ ID NO: 562528 - RNA, 11 nt, Coxiella burnetii RSA 493
uuuagcgauuu

SEQ ID NO: 562529 - RNA, 23 nt, Coxiella burnetii RSA 493
uuuagcgauuuugacgucuuggu

SEQ ID NO: 562530 - RNA, 13 nt, Coxiella burnetii RSA 493
uuuaggcgccaca

SEQ ID NO: 562531 - RNA, 16 nt, Coxiella burnetii RSA 493
uuuacgcuauuuuuua

SEQ ID NO: 562532 - RNA, 20 nt, Coxiella burnetii RSA 493
uuuacgcuauuuuuuaaauc

SEQ ID NO: 562533 - RNA, 14 nt, Coxiella burnetii RSA 493
uuuaguuuuucccu

SEQ ID NO: 562534 - RNA, 21 nt, Coxiella burnetii RSA 493
uuuauaaaauuuaauaagucu

SEQ ID NO: 562535 - RNA, 18 nt, Coxiella burnetii RSA 493
uuuauaaaugauuuccaa

SEQ ID NO: 562536 - RNA, 15 nt, Coxiella burnetii RSA 493
uuuagugaaaguuuc

SEQ ID NO: 562537 - RNA, 14 nt, Coxiella burnetii RSA 493
uuuagguguaaguc

SEQ ID NO: 562538 - RNA, 23 nt, Coxiella burnetii RSA 493
uuuagguguaaguccuccuucaa

SEQ ID NO: 562539 - RNA, 14 nt, Coxiella burnetii RSA 493
uuuacaauucuauu

SEQ ID NO: 562540 - RNA, 20 nt, Coxiella burnetii RSA 493
uuuacaauacggugaaccga

SEQ ID NO: 562541 - RNA, 17 nt, Coxiella burnetii RSA 493
uuuaccaauuaaagaau

SEQ ID NO: 562542 - RNA, 19 nt, Coxiella burnetii RSA 493
uuuaauuaagcuugaaaaa

SEQ ID NO: 562543 - RNA, 13 nt, Coxiella burnetii RSA 493
uuuaauucauaaa

SEQ ID NO: 562544 - RNA, 22 nt, Coxiella burnetii RSA 493
uuuaauuucggauguuuuuuca

SEQ ID NO: 562545 - RNA, 20 nt, Coxiella burnetii RSA 493
uuucacacguaucugcuaaa

SEQ ID NO: 562546 - RNA, 22 nt, Coxiella burnetii RSA 493
uuucacacguaucugcuaaaaa

SEQ ID NO: 562547 - RNA, 13 nt, Coxiella burnetii RSA 493
uuucaauuucuuu

SEQ ID NO: 562548 - RNA, 21 nt, Coxiella burnetii RSA 493
uuucacgaauuaaaaaauuca

SEQ ID NO: 562549 - RNA, 16 nt, Coxiella burnetii RSA 493
uuucaccguuuucuau

SEQ ID NO: 562550 - RNA, 15 nt, Coxiella burnetii RSA 493
uuucacgauuuuucu

SEQ ID NO: 562551 - RNA, 13 nt, Coxiella burnetii RSA 493
uuucacuaaaaga

SEQ ID NO: 562552 - RNA, 13 nt, Coxiella burnetii RSA 493
uuucaauaacaga

SEQ ID NO: 562553 - RNA, 14 nt, Coxiella burnetii RSA 493
uuucaauaaauaaa

SEQ ID NO: 562554 - RNA, 19 nt, Coxiella burnetii RSA 493
uuucaauaaauaaaucaag

SEQ ID NO: 562555 - RNA, 19 nt, Coxiella burnetii RSA 493
uuucaagaacgauuucccg

SEQ ID NO: 562556 - RNA, 17 nt, Coxiella burnetii RSA 493
uuucaauuagcauuuuc

SEQ ID NO: 562557 - RNA, 15 nt, Coxiella burnetii RSA 493
uuucaauuauacuga

SEQ ID NO: 562558 - RNA, 13 nt, Coxiella burnetii RSA 493
uuucaaugccauu

SEQ ID NO: 562559 - RNA, 15 nt, Coxiella burnetii RSA 493
uuucaauauuucuug

SEQ ID NO: 562560 - RNA, 18 nt, Coxiella burnetii RSA 493
uuucaaucgcuuuucguu

SEQ ID NO: 562561 - RNA, 17 nt, Coxiella burnetii RSA 493
uuuauaacaaaccaucg

SEQ ID NO: 562562 - RNA, 15 nt, Coxiella burnetii RSA 493
uuuauucaacucuua

SEQ ID NO: 562563 - RNA, 14 nt, Coxiella burnetii RSA 493
uuuauuauaaaaaa

SEQ ID NO: 562564 - RNA, 16 nt, Coxiella burnetii RSA 493
uuuauucccagauaaa

SEQ ID NO: 562565 - RNA, 21 nt, Coxiella burnetii RSA 493
uuuauucuccauaacaaugga

SEQ ID NO: 562566 - RNA, 12 nt, Coxiella burnetii RSA 493
uuucaaagauau

SEQ ID NO: 562567 - RNA, 12 nt, Coxiella burnetii RSA 493
uuucaaauuucu

SEQ ID NO: 562568 - RNA, 17 nt, Coxiella burnetii RSA 493
uuucaacuacuugauau

SEQ ID NO: 562569 - RNA, 21 nt, Coxiella burnetii RSA 493
uuucaacuacuugauauuccc

SEQ ID NO: 562570 - RNA, 13 nt, Coxiella burnetii RSA 493
uuucauagguuuu

SEQ ID NO: 562571 - RNA, 15 nt, Coxiella burnetii RSA 493
uuucauaaaucaacu

SEQ ID NO: 562572 - RNA, 23 nt, Coxiella burnetii RSA 493
uuucauaaggccaauuucuaauc

SEQ ID NO: 562573 - RNA, 20 nt, Coxiella burnetii RSA 493
uuucauccagugaaaacccg

SEQ ID NO: 562574 - RNA, 22 nt, Coxiella burnetii RSA 493
uuuccaagcgauuaaauauuua

SEQ ID NO: 562575 - RNA, 13 nt, Coxiella burnetii RSA 493
uuucauuuucucu

SEQ ID NO: 562576 - RNA, 16 nt, Coxiella burnetii RSA 493
uuuccaacgcuuguuu

SEQ ID NO: 562577 - RNA, 14 nt, Coxiella burnetii RSA 493
uuuccaaaaaauua

SEQ ID NO: 562578 - RNA, 16 nt, Coxiella burnetii RSA 493
uuaacuccuucgcuuu

SEQ ID NO: 562579 - RNA, 20 nt, Coxiella burnetii RSA 493
uuaagagauaagcuguuucu

SEQ ID NO: 562580 - RNA, 20 nt, Coxiella burnetii RSA 493
uuaagaggaccugugaggga

SEQ ID NO: 562581 - RNA, 19 nt, Coxiella burnetii RSA 493
uuaagauaauaauuauacu

SEQ ID NO: 562582 - RNA, 21 nt, Coxiella burnetii RSA 493
uuaagcguuccuuucaucaaa

SEQ ID NO: 562583 - RNA, 15 nt, Coxiella burnetii RSA 493
uuaagcuugaaaaaa

SEQ ID NO: 562584 - RNA, 18 nt, Coxiella burnetii RSA 493
uuaagcuugaaaaaauug

SEQ ID NO: 562585 - RNA, 15 nt, Coxiella burnetii RSA 493
uuaacguauaaauaa

SEQ ID NO: 562586 - RNA, 18 nt, Coxiella burnetii RSA 493
uuaauccguuuugaaaaa

SEQ ID NO: 562587 - RNA, 23 nt, Coxiella burnetii RSA 493
uuaauccguuuugaaaaauaaaa

SEQ ID NO: 562588 - RNA, 15 nt, Coxiella burnetii RSA 493
uuaaucgcuccuaaa

SEQ ID NO: 562589 - RNA, 16 nt, Coxiella burnetii RSA 493
uuaauaugcaagcugc

SEQ ID NO: 562590 - RNA, 19 nt, Coxiella burnetii RSA 493
uuaauauuaaaacaagaca

SEQ ID NO: 562591 - RNA, 14 nt, Coxiella burnetii RSA 493
uuaaggaaaagcac

SEQ ID NO: 562592 - RNA, 19 nt, Coxiella burnetii RSA 493
uuaaguuaagauaauaauu

SEQ ID NO: 562593 - RNA, 23 nt, Coxiella burnetii RSA 493
uuacaauucgcuaaguugggcca

SEQ ID NO: 562594 - RNA, 17 nt, Coxiella burnetii RSA 493
uuacaauccaauacuag

SEQ ID NO: 562595 - RNA, 13 nt, Coxiella burnetii RSA 493
uuacaauauccca

SEQ ID NO: 562596 - RNA, 14 nt, Coxiella burnetii RSA 493
uuacaauaucccau

SEQ ID NO: 562597 - RNA, 16 nt, Coxiella burnetii RSA 493
uuacaauaauccacau

SEQ ID NO: 562598 - RNA, 20 nt, Coxiella burnetii RSA 493
uuacaauaauccacauauuu

SEQ ID NO: 562599 - RNA, 14 nt, Coxiella burnetii RSA 493
uuaauuuuaaaaaa

SEQ ID NO: 562600 - RNA, 15 nt, Coxiella burnetii RSA 493
uuaauuuuaaaaaac

SEQ ID NO: 562601 - RNA, 22 nt, Coxiella burnetii RSA 493
uuaauuucggauguuuuuucac

SEQ ID NO: 562602 - RNA, 18 nt, Coxiella burnetii RSA 493
uuaauuugaucauuuccu

SEQ ID NO: 562603 - RNA, 19 nt, Coxiella burnetii RSA 493
uuaauuugaucauuuccua

SEQ ID NO: 562604 - RNA, 20 nt, Coxiella burnetii RSA 493
uuaauuugccggcauauuca

SEQ ID NO: 562605 - RNA, 16 nt, Coxiella burnetii RSA 493
uuaccaauuaaagaau

SEQ ID NO: 562606 - RNA, 19 nt, Coxiella burnetii RSA 493
uuaaugucuuuuauuuuca

SEQ ID NO: 562607 - RNA, 20 nt, Coxiella burnetii RSA 493
uuaauguuauuuauuuuucu

SEQ ID NO: 562608 - RNA, 16 nt, Coxiella burnetii RSA 493
uuaaugagguuaauaa

SEQ ID NO: 562609 - RNA, 16 nt, Coxiella burnetii RSA 493
uuaaucucgauuuugg

SEQ ID NO: 562610 - RNA, 19 nt, Coxiella burnetii RSA 493
uuaauugauagcgauuucc

SEQ ID NO: 562611 - RNA, 23 nt, Coxiella burnetii RSA 493
uuaauugacuacgcauucagaaa

SEQ ID NO: 562612 - RNA, 21 nt, Coxiella burnetii RSA 493
uuaauucuucuucauuuauuu

SEQ ID NO: 562613 - RNA, 14 nt, Coxiella burnetii RSA 493
uuaauuaaugcagc

SEQ ID NO: 562614 - RNA, 15 nt, Coxiella burnetii RSA 493
uuaauuaaugcagca

SEQ ID NO: 562615 - RNA, 15 nt, Coxiella burnetii RSA 493
uuaguugcuaaugaa

SEQ ID NO: 562616 - RNA, 14 nt, Coxiella burnetii RSA 493
uuaguuuuucccuc

SEQ ID NO: 562617 - RNA, 24 nt, Coxiella burnetii RSA 493
uuauaaaacuucccauucuauaau

SEQ ID NO: 562618 - RNA, 16 nt, Coxiella burnetii RSA 493
uuagugaaaguuucau

SEQ ID NO: 562619 - RNA, 12 nt, Coxiella burnetii RSA 493
uuagugcaaaaa

SEQ ID NO: 562620 - RNA, 13 nt, Coxiella burnetii RSA 493
uuaguaauauuuu

SEQ ID NO: 562621 - RNA, 17 nt, Coxiella burnetii RSA 493
uuauacccaaaaaccca

SEQ ID NO: 562622 - RNA, 20 nt, Coxiella burnetii RSA 493
uuauaacccgcguauaaaug

SEQ ID NO: 562623 - RNA, 15 nt, Coxiella burnetii RSA 493
uuauaacaagguuuu

SEQ ID NO: 562624 - RNA, 16 nt, Coxiella burnetii RSA 493
uuauaacuauuuuaaa

SEQ ID NO: 562625 - RNA, 22 nt, Coxiella burnetii RSA 493
uuauaagacgcuuucaacauau

SEQ ID NO: 562626 - RNA, 19 nt, Coxiella burnetii RSA 493
uuagcaaugggaacuuuua

SEQ ID NO: 562627 - RNA, 22 nt, Coxiella burnetii RSA 493
uuagcaaugggaacuuuuaacu

SEQ ID NO: 562628 - RNA, 13 nt, Coxiella burnetii RSA 493
uuagagugaacca

SEQ ID NO: 562629 - RNA, 19 nt, Coxiella burnetii RSA 493
uuagcaucuugaaucauug

SEQ ID NO: 562630 - RNA, 14 nt, Coxiella burnetii RSA 493
uuagcuuccauugc

SEQ ID NO: 562631 - RNA, 23 nt, Coxiella burnetii RSA 493
uuagcuucggccgugaaaacgcu

SEQ ID NO: 562632 - RNA, 15 nt, Coxiella burnetii RSA 493
uuagcugacaucuua

SEQ ID NO: 562633 - RNA, 16 nt, Coxiella burnetii RSA 493
uuagcucauugaaauc

SEQ ID NO: 562634 - RNA, 22 nt, Coxiella burnetii RSA 493
uuagcuuuuuucaaaauuuacu

SEQ ID NO: 562635 - RNA, 15 nt, Coxiella burnetii RSA 493
uuacccguuuaaauu

SEQ ID NO: 562636 - RNA, 13 nt, Coxiella burnetii RSA 493
uuacuucuuuuuc

SEQ ID NO: 562637 - RNA, 12 nt, Coxiella burnetii RSA 493
uuacuugcuuca

SEQ ID NO: 562638 - RNA, 17 nt, Coxiella burnetii RSA 493
uuacuuguugaaaaccu

SEQ ID NO: 562639 - RNA, 15 nt, Coxiella burnetii RSA 493
uuacuccaauuucau

SEQ ID NO: 562640 - RNA, 16 nt, Coxiella burnetii RSA 493
uuaucuagauuuuccu

SEQ ID NO: 562641 - RNA, 20 nt, Coxiella burnetii RSA 493
uuaucuagauuuuccugcug

SEQ ID NO: 562642 - RNA, 21 nt, Coxiella burnetii RSA 493
uuaucucgugaagauugccac

SEQ ID NO: 562643 - RNA, 18 nt, Coxiella burnetii RSA 493
uuaucguaaaacuuuuuc

SEQ ID NO: 562644 - RNA, 15 nt, Coxiella burnetii RSA 493
uuaucgcagaaaaua

SEQ ID NO: 562645 - RNA, 21 nt, Coxiella burnetii RSA 493
uuaucggaugaugcauuaauc

SEQ ID NO: 562646 - RNA, 22 nt, Coxiella burnetii RSA 493
uuaucggaugaugcauuaauca

SEQ ID NO: 562647 - RNA, 14 nt, Coxiella burnetii RSA 493
uuaugauguuuuaa

SEQ ID NO: 562648 - RNA, 18 nt, Coxiella burnetii RSA 493
uuaugauguuuuaaaauu

SEQ ID NO: 562649 - RNA, 17 nt, Coxiella burnetii RSA 493
uuaugacgguuauguac

SEQ ID NO: 562650 - RNA, 18 nt, Coxiella burnetii RSA 493
uuaucuuaaugaaauuuc

SEQ ID NO: 562651 - RNA, 19 nt, Coxiella burnetii RSA 493
uuauuaagcguuccuuuca

SEQ ID NO: 562652 - RNA, 23 nt, Coxiella burnetii RSA 493
uuauuaauacaggaaaaagauaa

SEQ ID NO: 562653 - RNA, 23 nt, Coxiella burnetii RSA 493
uuaugggugggcgugauugaaag

SEQ ID NO: 562654 - RNA, 14 nt, Coxiella burnetii RSA 493
uuaugcguuauucu

SEQ ID NO: 562655 - RNA, 14 nt, Coxiella burnetii RSA 493
uuaugcuugaacuu

SEQ ID NO: 562656 - RNA, 13 nt, Coxiella burnetii RSA 493
uuaugcuucaaua

SEQ ID NO: 562657 - RNA, 14 nt, Coxiella burnetii RSA 493
uuauccguuuuauu

SEQ ID NO: 562658 - RNA, 18 nt, Coxiella burnetii RSA 493
uuaucccuuuaaccguca

SEQ ID NO: 562659 - RNA, 23 nt, Coxiella burnetii RSA 493
uuaucauuugggucuccguaaua

SEQ ID NO: 562660 - RNA, 21 nt, Coxiella burnetii RSA 493
uuaucaaucguguagaaagaa

SEQ ID NO: 562661 - RNA, 15 nt, Coxiella burnetii RSA 493
uuaucacuagcuauu

SEQ ID NO: 562662 - RNA, 21 nt, Coxiella burnetii RSA 493
uuaucacuagcuauucuuuug

SEQ ID NO: 562663 - RNA, 15 nt, Coxiella burnetii RSA 493
uuaucacuccaauaa

SEQ ID NO: 562664 - RNA, 19 nt, Coxiella burnetii RSA 493
uuauauuuacugagaaaac

SEQ ID NO: 562665 - RNA, 17 nt, Coxiella burnetii RSA 493
uuauaugacgaauacag

SEQ ID NO: 562666 - RNA, 19 nt, Coxiella burnetii RSA 493
uuauauugcugauaguuaa

SEQ ID NO: 562667 - RNA, 11 nt, Coxiella burnetii RSA 493
uuauacuuuuu

SEQ ID NO: 562668 - RNA, 21 nt, Coxiella burnetii RSA 493
uucaaucacaaguucuucuaa

SEQ ID NO: 562669 - RNA, 13 nt, Coxiella burnetii RSA 493
uucacuaaaagaa

SEQ ID NO: 562670 - RNA, 23 nt, Coxiella burnetii RSA 493
uucacuaaucgucgacaaaaaga

SEQ ID NO: 562671 - RNA, 17 nt, Coxiella burnetii RSA 493
uucacuaauuauaagac

SEQ ID NO: 562672 - RNA, 14 nt, Coxiella burnetii RSA 493
uucaggacacauuu

SEQ ID NO: 562673 - RNA, 23 nt, Coxiella burnetii RSA 493
uucaggacacauuuuuucaaauu

SEQ ID NO: 562674 - RNA, 17 nt, Coxiella burnetii RSA 493
uucaggauuaauuuuca

SEQ ID NO: 562675 - RNA, 24 nt, Coxiella burnetii RSA 493
uucagcauucccauagaagaacaa

SEQ ID NO: 562676 - RNA, 20 nt, Coxiella burnetii RSA 493
uucagccgauucuucauacu

SEQ ID NO: 562677 - RNA, 12 nt, Coxiella burnetii RSA 493
uuauuuguugaa

SEQ ID NO: 562678 - RNA, 18 nt, Coxiella burnetii RSA 493
uuauuuuuucuuugcuuu

SEQ ID NO: 562679 - RNA, 19 nt, Coxiella burnetii RSA 493
uuauuugaaaguagaaaac

SEQ ID NO: 562680 - RNA, 17 nt, Coxiella burnetii RSA 493
uuauuguguuguagaau

SEQ ID NO: 562681 - RNA, 17 nt, Coxiella burnetii RSA 493
uuauuguuagauaagcc

SEQ ID NO: 562682 - RNA, 15 nt, Coxiella burnetii RSA 493
uuauugagaaucucu

SEQ ID NO: 562683 - RNA, 13 nt, Coxiella burnetii RSA 493
uuauucuccauaa

SEQ ID NO: 562684 - RNA, 16 nt, Coxiella burnetii RSA 493
uuauuauaaaaaaaag

SEQ ID NO: 562685 - RNA, 18 nt, Coxiella burnetii RSA 493
uucaaaagugauuuuucu

SEQ ID NO: 562686 - RNA, 12 nt, Coxiella burnetii RSA 493
uucaauaaaaaa

SEQ ID NO: 562687 - RNA, 14 nt, Coxiella burnetii RSA 493
uucaagcacuaguu

SEQ ID NO: 562688 - RNA, 22 nt, Coxiella burnetii RSA 493
uugaacaggagcgauaaaauaa

SEQ ID NO: 562689 - RNA, 13 nt, Coxiella burnetii RSA 493
uugaaagaaaaaa

SEQ ID NO: 562690 - RNA, 17 nt, Coxiella burnetii RSA 493
uugaaagaaaaaaaacc

SEQ ID NO: 562691 - RNA, 23 nt, Coxiella burnetii RSA 493
uugaaagaaaaaaaaccaaugaa

SEQ ID NO: 562692 - RNA, 16 nt, Coxiella burnetii RSA 493
uugaaagaauuucucg

SEQ ID NO: 562693 - RNA, 16 nt, Coxiella burnetii RSA 493
uucuuuuagaaaauca

SEQ ID NO: 562694 - RNA, 12 nt, Coxiella burnetii RSA 493
uucuuuuauuaa

SEQ ID NO: 562695 - RNA, 13 nt, Coxiella burnetii RSA 493
uucuuuuauuaaa

SEQ ID NO: 562696 - RNA, 20 nt, Coxiella burnetii RSA 493
uucuuuuauuucuuuugccu

SEQ ID NO: 562697 - RNA, 18 nt, Coxiella burnetii RSA 493
uucuuuuucaaucgcuuu

SEQ ID NO: 562698 - RNA, 22 nt, Coxiella burnetii RSA 493
uucuuuuggaagcggauaaauc

SEQ ID NO: 562699 - RNA, 17 nt, Coxiella burnetii RSA 493
uugaaaaauaaaaggag

SEQ ID NO: 562700 - RNA, 18 nt, Coxiella burnetii RSA 493
uugaaaaauaaaaggaga

SEQ ID NO: 562701 - RNA, 22 nt, Coxiella burnetii RSA 493
uugaaaaccuacacguuaaaua

SEQ ID NO: 562702 - RNA, 16 nt, Coxiella burnetii RSA 493
uugaaaacguuauugu

SEQ ID NO: 562703 - RNA, 15 nt, Coxiella burnetii RSA 493
uugaaaaucccuuuu

SEQ ID NO: 562704 - RNA, 11 nt, Coxiella burnetii RSA 493
uucuuugcuuu

SEQ ID NO: 562705 - RNA, 19 nt, Coxiella burnetii RSA 493
uucuuuuaaagugauuuuu

SEQ ID NO: 562706 - RNA, 15 nt, Coxiella burnetii RSA 493
uucuuucuucacuuu

SEQ ID NO: 562707 - RNA, 20 nt, Coxiella burnetii RSA 493
uucuuuccagccuuuaguuu

SEQ ID NO: 562708 - RNA, 16 nt, Coxiella burnetii RSA 493
uucuuuccagcuuccc

SEQ ID NO: 562709 - RNA, 15 nt, Coxiella burnetii RSA 493
uucuuucaauaaacc

SEQ ID NO: 562710 - RNA, 13 nt, Coxiella burnetii RSA 493
uucuuuaauauca

SEQ ID NO: 562711 - RNA, 23 nt, Coxiella burnetii RSA 493
uucuugacaccacgcuaaauggu

SEQ ID NO: 562712 - RNA, 12 nt, Coxiella burnetii RSA 493
uucuugcuccca

SEQ ID NO: 562713 - RNA, 11 nt, Coxiella burnetii RSA 493
uucuuuaacuu

SEQ ID NO: 562714 - RNA, 12 nt, Coxiella burnetii RSA 493
uugaaucaaauu

SEQ ID NO: 562715 - RNA, 13 nt, Coxiella burnetii RSA 493
uugaacuucaaau

SEQ ID NO: 562716 - RNA, 15 nt, Coxiella burnetii RSA 493
uugaagcauauaacu

SEQ ID NO: 562717 - RNA, 22 nt, Coxiella burnetii RSA 493
uugaaggaauaaaaccuucaaa

SEQ ID NO: 562718 - RNA, 22 nt, Coxiella burnetii RSA 493
uugacaccacgcuaaauggucu

SEQ ID NO: 562719 - RNA, 16 nt, Coxiella burnetii RSA 493
uugaauuucuguuuua

SEQ ID NO: 562720 - RNA, 13 nt, Coxiella burnetii RSA 493
uugaauuugcuug

SEQ ID NO: 562721 - RNA, 20 nt, Coxiella burnetii RSA 493
uugaauuccuugcucaaguc

SEQ ID NO: 562722 - RNA, 13 nt, Coxiella burnetii RSA 493
uugaauuccuugu

SEQ ID NO: 562723 - RNA, 14 nt, Coxiella burnetii RSA 493
uugauaaagauucu

SEQ ID NO: 562724 - RNA, 15 nt, Coxiella burnetii RSA 493
uugaguuuuugacaa

SEQ ID NO: 562725 - RNA, 20 nt, Coxiella burnetii RSA 493
uugagaguccuaaaauacuu

SEQ ID NO: 562726 - RNA, 17 nt, Coxiella burnetii RSA 493
uugagaacguuucccaa

SEQ ID NO: 562727 - RNA, 20 nt, Coxiella burnetii RSA 493
uugagaacguuucccaagga

SEQ ID NO: 562728 - RNA, 22 nt, Coxiella burnetii RSA 493
uugagaauagcauuagacauuu

SEQ ID NO: 562729 - RNA, 13 nt, Coxiella burnetii RSA 493
uugauauucccuc

SEQ ID NO: 562730 - RNA, 17 nt, Coxiella burnetii RSA 493
uugauaucaaucgaaaa

SEQ ID NO: 562731 - RNA, 19 nt, Coxiella burnetii RSA 493
uugauaucaaucgaaaaaa

SEQ ID NO: 562732 - RNA, 22 nt, Coxiella burnetii RSA 493
uugauaucaaucgaaaaaaauc

SEQ ID NO: 562733 - RNA, 21 nt, Coxiella burnetii RSA 493
uugaugaaaagaaagcgguug

SEQ ID NO: 562734 - RNA, 14 nt, Coxiella burnetii RSA 493
uugauucaauaauc

SEQ ID NO: 562735 - RNA, 19 nt, Coxiella burnetii RSA 493
uugcaauccuuuuuguaau

SEQ ID NO: 562736 - RNA, 16 nt, Coxiella burnetii RSA 493
uugcaauagucacgag

SEQ ID NO: 562737 - RNA, 23 nt, Coxiella burnetii RSA 493
uugcaaaccgcgcugaaguccuu

SEQ ID NO: 562738 - RNA, 15 nt, Coxiella burnetii RSA 493
uugcaaaugaauaac

SEQ ID NO: 562739 - RNA, 21 nt, Coxiella burnetii RSA 493
uugcccccauugauaauaauu

SEQ ID NO: 562740 - RNA, 15 nt, Coxiella burnetii RSA 493
uugccccaugaguuc

SEQ ID NO: 562741 - RNA, 15 nt, Coxiella burnetii RSA 493
uugcacauggaaaaa

SEQ ID NO: 562742 - RNA, 13 nt, Coxiella burnetii RSA 493
uugcauuucuuuc

SEQ ID NO: 562743 - RNA, 15 nt, Coxiella burnetii RSA 493
uugcauuucuuucaa

SEQ ID NO: 562744 - RNA, 15 nt, Coxiella burnetii RSA 493
uugccgaggcaaaau

SEQ ID NO: 562745 - RNA, 16 nt, Coxiella burnetii RSA 493
uugcccgguaacauac

SEQ ID NO: 562746 - RNA, 22 nt, Coxiella burnetii RSA 493
uugccggauugauaaaguuuau

SEQ ID NO: 562747 - RNA, 15 nt, Coxiella burnetii RSA 493
uugccggacuuuuuc

SEQ ID NO: 562748 - RNA, 18 nt, Coxiella burnetii RSA 493
uugccggacuuuuucaau

SEQ ID NO: 562749 - RNA, 18 nt, Coxiella burnetii RSA 493
uuccuaucaauauuucgu

SEQ ID NO: 562750 - RNA, 19 nt, Coxiella burnetii RSA 493
uuccuguggaagguugaga

SEQ ID NO: 562751 - RNA, 15 nt, Coxiella burnetii RSA 493
uucccaggaaagaaa

SEQ ID NO: 562752 - RNA, 17 nt, Coxiella burnetii RSA 493
uucccaggaaagaaaau

SEQ ID NO: 562753 - RNA, 24 nt, Coxiella burnetii RSA 493
uucccaugucguuauugcucaucu

SEQ ID NO: 562754 - RNA, 11 nt, Coxiella burnetii RSA 493
uuccauuuuuu

SEQ ID NO: 562755 - RNA, 17 nt, Coxiella burnetii RSA 493
uucccaaucaucaauuc

SEQ ID NO: 562756 - RNA, 21 nt, Coxiella burnetii RSA 493
uucccaauguuuccaaauaau

SEQ ID NO: 562757 - RNA, 15 nt, Coxiella burnetii RSA 493
uucccacaaaauacc

SEQ ID NO: 562758 - RNA, 16 nt, Coxiella burnetii RSA 493
uucccacaaaauaccc

SEQ ID NO: 562759 - RNA, 19 nt, Coxiella burnetii RSA 493
uuccccaccacucacagcc

SEQ ID NO: 562760 - RNA, 23 nt, Coxiella burnetii RSA 493
uuccgcaaaucggaaaagccaau

SEQ ID NO: 562761 - RNA, 14 nt, Coxiella burnetii RSA 493
uuccgauaagcguu

SEQ ID NO: 562762 - RNA, 22 nt, Coxiella burnetii RSA 493
uuccgaaacuaaaagaggccac

SEQ ID NO: 562763 - RNA, 23 nt, Coxiella burnetii RSA 493
uuccauaauaacgcuaugaaaac

SEQ ID NO: 562764 - RNA, 12 nt, Coxiella burnetii RSA 493
uuccauuaaaaa

SEQ ID NO: 562765 - RNA, 14 nt, Coxiella burnetii RSA 493
uuccauuaaaaaca

SEQ ID NO: 562766 - RNA, 19 nt, Coxiella burnetii RSA 493
uuccaucgaaaaugcucgc

SEQ ID NO: 562767 - RNA, 15 nt, Coxiella burnetii RSA 493
uuccagauuuaguaa

SEQ ID NO: 562768 - RNA, 22 nt, Coxiella burnetii RSA 493
uuccacgcauacgaucuauauu

SEQ ID NO: 562769 - RNA, 11 nt, Coxiella burnetii RSA 493
uucuauuuccg

SEQ ID NO: 562770 - RNA, 18 nt, Coxiella burnetii RSA 493
uucuauaaucauuuuucc

SEQ ID NO: 562771 - RNA, 22 nt, Coxiella burnetii RSA 493
uucuauaaucauuuuuccuauu

SEQ ID NO: 562772 - RNA, 17 nt, Coxiella burnetii RSA 493
uucuagugugauaauca

SEQ ID NO: 562773 - RNA, 21 nt, Coxiella burnetii RSA 493
uucuagggagaaaaauuuauu

SEQ ID NO: 562774 - RNA, 16 nt, Coxiella burnetii RSA 493
uucuacagaacuuuuu

SEQ ID NO: 562775 - RNA, 14 nt, Coxiella burnetii RSA 493
uucuaauuaaauua

SEQ ID NO: 562776 - RNA, 15 nt, Coxiella burnetii RSA 493
uucuaauuugaaaaa

SEQ ID NO: 562777 - RNA, 22 nt, Coxiella burnetii RSA 493
uucuaauuugaaaaacccauuu

SEQ ID NO: 562778 - RNA, 14 nt, Coxiella burnetii RSA 493
uucuaauaaaauag

SEQ ID NO: 562779 - RNA, 22 nt, Coxiella burnetii RSA 493
uucucgauauucuaucucaaag

SEQ ID NO: 562780 - RNA, 19 nt, Coxiella burnetii RSA 493
uucucaguuaaaauaauga

SEQ ID NO: 562781 - RNA, 14 nt, Coxiella burnetii RSA 493
uucucguaacaaaa

SEQ ID NO: 562782 - RNA, 18 nt, Coxiella burnetii RSA 493
uucugauuuuugaagcua

SEQ ID NO: 562783 - RNA, 22 nt, Coxiella burnetii RSA 493
uucugaucgauaaaaauaauga

SEQ ID NO: 562784 - RNA, 18 nt, Coxiella burnetii RSA 493
uucucuuuaucagaaaaa

SEQ ID NO: 562785 - RNA, 22 nt, Coxiella burnetii RSA 493
uucucuugcgccuuaauaugca

SEQ ID NO: 562786 - RNA, 19 nt, Coxiella burnetii RSA 493
uucucugcgaggaccucuc

SEQ ID NO: 562787 - RNA, 16 nt, Coxiella burnetii RSA 493
uucucugcaaucgcau

SEQ ID NO: 562788 - RNA, 19 nt, Coxiella burnetii RSA 493
uucguggcuucgagaggaa

SEQ ID NO: 562789 - RNA, 20 nt, Coxiella burnetii RSA 493
uucuaaaucgguugaagaaa

SEQ ID NO: 562790 - RNA, 23 nt, Coxiella burnetii RSA 493
uucguaauauuauugagaaucuc

SEQ ID NO: 562791 - RNA, 17 nt, Coxiella burnetii RSA 493
uucguaaaccuuuaauu

SEQ ID NO: 562792 - RNA, 13 nt, Coxiella burnetii RSA 493
uucgguuucuauc

SEQ ID NO: 562793 - RNA, 21 nt, Coxiella burnetii RSA 493
uucgguuuuuuuaaaaaagaa

SEQ ID NO: 562794 - RNA, 17 nt, Coxiella burnetii RSA 493
uucggacaacaaauaaa

SEQ ID NO: 562795 - RNA, 18 nt, Coxiella burnetii RSA 493
uucggacaacaaauaaau

SEQ ID NO: 562796 - RNA, 12 nt, Coxiella burnetii RSA 493
uucggaaacaaa

SEQ ID NO: 562797 - RNA, 23 nt, Coxiella burnetii RSA 493
uucgccuucccgccuacccuuuu

SEQ ID NO: 562798 - RNA, 19 nt, Coxiella burnetii RSA 493
uucgcuggauuuuuuaauu

SEQ ID NO: 562799 - RNA, 17 nt, Coxiella burnetii RSA 493
uucgaacauuuguuuaa

SEQ ID NO: 562800 - RNA, 16 nt, Coxiella burnetii RSA 493
uuccuuguugaauucc

SEQ ID NO: 562801 - RNA, 13 nt, Coxiella burnetii RSA 493
uuccuuuuuuuaa

SEQ ID NO: 562802 - RNA, 16 nt, Coxiella burnetii RSA 493
uuccuuucuuucuuca

SEQ ID NO: 562803 - RNA, 22 nt, Coxiella burnetii RSA 493
uggacucgaugggaauuuuuga

SEQ ID NO: 562804 - RNA, 17 nt, Coxiella burnetii RSA 493
uggagagaauuuucaug

SEQ ID NO: 562805 - RNA, 21 nt, Coxiella burnetii RSA 493
uggacuacacgguuaguggga

SEQ ID NO: 562806 - RNA, 23 nt, Coxiella burnetii RSA 493
uggagcccauaaagcggaauuag

SEQ ID NO: 562807 - RNA, 19 nt, Coxiella burnetii RSA 493
uggaugaaagauuuuuuua

SEQ ID NO: 562808 - RNA, 14 nt, Coxiella burnetii RSA 493
uggauaguuucaaa

SEQ ID NO: 562809 - RNA, 19 nt, Coxiella burnetii RSA 493
uggauaguuucaaauuucu

SEQ ID NO: 562810 - RNA, 13 nt, Coxiella burnetii RSA 493
uggauagacaauu

SEQ ID NO: 562811 - RNA, 16 nt, Coxiella burnetii RSA 493
uggagucgcuuucaau

SEQ ID NO: 562812 - RNA, 13 nt, Coxiella burnetii RSA 493
uggcauaagcaga

SEQ ID NO: 562813 - RNA, 16 nt, Coxiella burnetii RSA 493
uggcaguuaaauuuuu

SEQ ID NO: 562814 - RNA, 18 nt, Coxiella burnetii RSA 493
uggcaguuaaauuuuuaa

SEQ ID NO: 562815 - RNA, 14 nt, Coxiella burnetii RSA 493
uggcauagggauca

SEQ ID NO: 562816 - RNA, 19 nt, Coxiella burnetii RSA 493
uggcauccgguggaauuag

SEQ ID NO: 562817 - RNA, 19 nt, Coxiella burnetii RSA 493
uggcaucgagaagucgcuc

SEQ ID NO: 562818 - RNA, 22 nt, Coxiella burnetii RSA 493
uggcaguggggucuucaucuuu

SEQ ID NO: 562819 - RNA, 14 nt, Coxiella burnetii RSA 493
uggcaguaucuauu

SEQ ID NO: 562820 - RNA, 17 nt, Coxiella burnetii RSA 493
uggauuuucaaaagagg

SEQ ID NO: 562821 - RNA, 15 nt, Coxiella burnetii RSA 493
uggaugguucuuuug

SEQ ID NO: 562822 - RNA, 18 nt, Coxiella burnetii RSA 493
ugggcaguuuucuucaau

SEQ ID NO: 562823 - RNA, 15 nt, Coxiella burnetii RSA 493
ugggagauuuauucc

SEQ ID NO: 562824 - RNA, 19 nt, Coxiella burnetii RSA 493
ugggcucaugaaaaugaau

SEQ ID NO: 562825 - RNA, 22 nt, Coxiella burnetii RSA 493
ugggcugucuucucuugcgccu

SEQ ID NO: 562826 - RNA, 15 nt, Coxiella burnetii RSA 493
ugggaauguucugau

SEQ ID NO: 562827 - RNA, 22 nt, Coxiella burnetii RSA 493
ugggaaguuuuauaacaagguu

SEQ ID NO: 562828 - RNA, 21 nt, Coxiella burnetii RSA 493
ugggaauuuuugaauaccagc

SEQ ID NO: 562829 - RNA, 18 nt, Coxiella burnetii RSA 493
ugggaacaacgaaaucua

SEQ ID NO: 562830 - RNA, 12 nt, Coxiella burnetii RSA 493
uggcugcacagg

SEQ ID NO: 562831 - RNA, 15 nt, Coxiella burnetii RSA 493
uggcugcuucuuuaa

SEQ ID NO: 562832 - RNA, 13 nt, Coxiella burnetii RSA 493
uggcuaacucacu

SEQ ID NO: 562833 - RNA, 19 nt, Coxiella burnetii RSA 493
uggcuaacucacuuuuuuc

SEQ ID NO: 562834 - RNA, 16 nt, Coxiella burnetii RSA 493
uggcguaauucuugca

SEQ ID NO: 562835 - RNA, 16 nt, Coxiella burnetii RSA 493
uggcguaugaauaauu

SEQ ID NO: 562836 - RNA, 18 nt, Coxiella burnetii RSA 493
uggcuacuuucucaauuu

SEQ ID NO: 562837 - RNA, 17 nt, Coxiella burnetii RSA 493
uggcggcgcucauggga

SEQ ID NO: 562838 - RNA, 17 nt, Coxiella burnetii RSA 493
uggcgguuguaauaaug

SEQ ID NO: 562839 - RNA, 14 nt, Coxiella burnetii RSA 493
uggcgcaucaaaaa

SEQ ID NO: 562840 - RNA, 18 nt, Coxiella burnetii RSA 493
uguaaugcuugcgcaucc

SEQ ID NO: 562841 - RNA, 19 nt, Coxiella burnetii RSA 493
uguaaguugggguuuaauu

SEQ ID NO: 562842 - RNA, 14 nt, Coxiella burnetii RSA 493
uguaagaauucucc

SEQ ID NO: 562843 - RNA, 15 nt, Coxiella burnetii RSA 493
uguaaggcugaagag

SEQ ID NO: 562844 - RNA, 14 nt, Coxiella burnetii RSA 493
uguaauuuauccca

SEQ ID NO: 562845 - RNA, 21 nt, Coxiella burnetii RSA 493
uguaauucacgauuuucguug

SEQ ID NO: 562846 - RNA, 16 nt, Coxiella burnetii RSA 493
uguaauugcuuccaau

SEQ ID NO: 562847 - RNA, 14 nt, Coxiella burnetii RSA 493
uguaaaucauuggu

SEQ ID NO: 562848 - RNA, 18 nt, Coxiella burnetii RSA 493
ugguuccacccgcaaacu

SEQ ID NO: 562849 - RNA, 13 nt, Coxiella burnetii RSA 493
ugguugaaaacga

SEQ ID NO: 562850 - RNA, 14 nt, Coxiella burnetii RSA 493
ugguugaaagaaaa

SEQ ID NO: 562851 - RNA, 18 nt, Coxiella burnetii RSA 493
ugguucguguuuauuuuc

SEQ ID NO: 562852 - RNA, 14 nt, Coxiella burnetii RSA 493
ugguucuuuugaau

SEQ ID NO: 562853 - RNA, 18 nt, Coxiella burnetii RSA 493
ugguugauucaauaaucu

SEQ ID NO: 562854 - RNA, 19 nt, Coxiella burnetii RSA 493
ugguugucuaugcaagcac

SEQ ID NO: 562855 - RNA, 13 nt, Coxiella burnetii RSA 493
ugguuuaaaaagu

SEQ ID NO: 562856 - RNA, 14 nt, Coxiella burnetii RSA 493
ugguuaaauaggcu

SEQ ID NO: 562857 - RNA, 15 nt, Coxiella burnetii RSA 493
ugguuaauucuucuu

SEQ ID NO: 562858 - RNA, 13 nt, Coxiella burnetii RSA 493
uggucucuuuuuu

SEQ ID NO: 562859 - RNA, 16 nt, Coxiella burnetii RSA 493
ugucaauuuaccucca

SEQ ID NO: 562860 - RNA, 22 nt, Coxiella burnetii RSA 493
ugucaauuuaccuccaaaaccc

SEQ ID NO: 562861 - RNA, 21 nt, Coxiella burnetii RSA 493
uguauuuucaccuuuucccua

SEQ ID NO: 562862 - RNA, 19 nt, Coxiella burnetii RSA 493
ugucaauaacccacagccg

SEQ ID NO: 562863 - RNA, 22 nt, Coxiella burnetii RSA 493
uguauucauuacgauuaaucau

SEQ ID NO: 562864 - RNA, 17 nt, Coxiella burnetii RSA 493
uguauucuucaauacua

SEQ ID NO: 562865 - RNA, 23 nt, Coxiella burnetii RSA 493
uguauugagcagcauucagcuuu

SEQ ID NO: 562866 - RNA, 21 nt, Coxiella burnetii RSA 493
uguauugauccggcuuuugau

SEQ ID NO: 562867 - RNA, 16 nt, Coxiella burnetii RSA 493
uguagauucuuucuga

SEQ ID NO: 562868 - RNA, 13 nt, Coxiella burnetii RSA 493
uguauuauuaucc

SEQ ID NO: 562869 - RNA, 21 nt, Coxiella burnetii RSA 493
ugucccccgagcaaagcauuu

SEQ ID NO: 562870 - RNA, 19 nt, Coxiella burnetii RSA 493
ugucagcuuccgacaauuc

SEQ ID NO: 562871 - RNA, 21 nt, Coxiella burnetii RSA 493
uguccugauuuacaauaacaa

SEQ ID NO: 562872 - RNA, 15 nt, Coxiella burnetii RSA 493
uguccuaaaaugaua

SEQ ID NO: 562873 - RNA, 13 nt, Coxiella burnetii RSA 493
uguccgcacaaac

SEQ ID NO: 562874 - RNA, 14 nt, Coxiella burnetii RSA 493
uguccuucuucuaa

SEQ ID NO: 562875 - RNA, 17 nt, Coxiella burnetii RSA 493
uguccuguucuuuuucc

SEQ ID NO: 562876 - RNA, 20 nt, Coxiella burnetii RSA 493
uguccuguucuuuuuccaug

SEQ ID NO: 562877 - RNA, 14 nt, Coxiella burnetii RSA 493
uguccuuuucuauu

SEQ ID NO: 562878 - RNA, 18 nt, Coxiella burnetii RSA 493
ugucgaauuuuugccaau

SEQ ID NO: 562879 - RNA, 22 nt, Coxiella burnetii RSA 493
ugucuaacauuuggccaaacua

SEQ ID NO: 562880 - RNA, 13 nt, Coxiella burnetii RSA 493
ugugauuuuaaaa

SEQ ID NO: 562881 - RNA, 16 nt, Coxiella burnetii RSA 493
ugugcaauuccauuaa

SEQ ID NO: 562882 - RNA, 19 nt, Coxiella burnetii RSA 493
ugugcaauuccauuaaaaa

SEQ ID NO: 562883 - RNA, 19 nt, Coxiella burnetii RSA 493
ugucugagauggccuuauc

SEQ ID NO: 562884 - RNA, 12 nt, Coxiella burnetii RSA 493
ugucuuuucgca

SEQ ID NO: 562885 - RNA, 16 nt, Coxiella burnetii RSA 493
ugucuuuucgcauaau

SEQ ID NO: 562886 - RNA, 23 nt, Coxiella burnetii RSA 493
ugcucuucuucaucuaaauuaaa

SEQ ID NO: 562887 - RNA, 22 nt, Coxiella burnetii RSA 493
ugcucucccuuaacuucucuuc

SEQ ID NO: 562888 - RNA, 14 nt, Coxiella burnetii RSA 493
ugcucuaaauuaaa

SEQ ID NO: 562889 - RNA, 20 nt, Coxiella burnetii RSA 493
ugcucguaagucguuuuaau

SEQ ID NO: 562890 - RNA, 23 nt, Coxiella burnetii RSA 493
ugcucgcgaaauuuaauaaaauu

SEQ ID NO: 562891 - RNA, 14 nt, Coxiella burnetii RSA 493
ugcucuuuuucauu

SEQ ID NO: 562892 - RNA, 15 nt, Coxiella burnetii RSA 493
ugcucuuuuucauuu

SEQ ID NO: 562893 - RNA, 21 nt, Coxiella burnetii RSA 493
ugcucuuuuucauuucuucga

SEQ ID NO: 562894 - RNA, 14 nt, Coxiella burnetii RSA 493
ugcugaacaaaagc

SEQ ID NO: 562895 - RNA, 13 nt, Coxiella burnetii RSA 493
ugcugauccucau

SEQ ID NO: 562896 - RNA, 16 nt, Coxiella burnetii RSA 493
aaauguauuuaucauc

SEQ ID NO: 562897 - RNA, 21 nt, Coxiella burnetii RSA 493
ugcugguagugguugguuaug

SEQ ID NO: 562898 - RNA, 14 nt, Coxiella burnetii RSA 493
ugcuuaucauguac

SEQ ID NO: 562899 - RNA, 21 nt, Coxiella burnetii RSA 493
ugcuuaucgcagaaaauagag

SEQ ID NO: 562900 - RNA, 15 nt, Coxiella burnetii RSA 493
ugcuucaauaaaaaa

SEQ ID NO: 562901 - RNA, 18 nt, Coxiella burnetii RSA 493
ugcuuccuuaaagcaacg

SEQ ID NO: 562902 - RNA, 19 nt, Coxiella burnetii RSA 493
ugcuuccccaauuuauuca

SEQ ID NO: 562903 - RNA, 13 nt, Coxiella burnetii RSA 493
ugcuucuuugaua

SEQ ID NO: 562904 - RNA, 13 nt, Coxiella burnetii RSA 493
ugcuuguuaagua

SEQ ID NO: 562905 - RNA, 22 nt, Coxiella burnetii RSA 493
ugcuugguugauucaauaaucu

SEQ ID NO: 562906 - RNA, 16 nt, Coxiella burnetii RSA 493
ugcuugcucuucuuca

SEQ ID NO: 562907 - RNA, 16 nt, Coxiella burnetii RSA 493
ugcuuuucuuucauua

SEQ ID NO: 562908 - RNA, 15 nt, Coxiella burnetii RSA 493
ugcuuuuauuuaagu

SEQ ID NO: 562909 - RNA, 16 nt, Coxiella burnetii RSA 493
ugcuuuuauuuaagug

SEQ ID NO: 562910 - RNA, 15 nt, Coxiella burnetii RSA 493
ugcuuucuuuuaauu

SEQ ID NO: 562911 - RNA, 17 nt, Coxiella burnetii RSA 493
ugcuuucccuuuuugau

SEQ ID NO: 562912 - RNA, 17 nt, Coxiella burnetii RSA 493
uggaacccguuuuaaug

SEQ ID NO: 562913 - RNA, 20 nt, Coxiella burnetii RSA 493
ugcuuuuuuauaaggucuua

SEQ ID NO: 562914 - RNA, 19 nt, Coxiella burnetii RSA 493
uggaaaaaggugcccaaga

SEQ ID NO: 562915 - RNA, 17 nt, Coxiella burnetii RSA 493
uggaccaccacguguau

SEQ ID NO: 562916 - RNA, 21 nt, Coxiella burnetii RSA 493
uggaauuuuaacaagcuggca

SEQ ID NO: 562917 - RNA, 15 nt, Coxiella burnetii RSA 493
uggaauuuuugacgc

SEQ ID NO: 562918 - RNA, 13 nt, Coxiella burnetii RSA 493
uggaauuaaauau

SEQ ID NO: 562919 - RNA, 20 nt, Coxiella burnetii RSA 493
uggaaucgcggacaauaaga

SEQ ID NO: 562920 - RNA, 13 nt, Coxiella burnetii RSA 493
ugcggaaaaggag

SEQ ID NO: 562921 - RNA, 15 nt, Coxiella burnetii RSA 493
ugcggaaaaggagaa

SEQ ID NO: 562922 - RNA, 22 nt, Coxiella burnetii RSA 493
ugcggaauucaggacugaaaua

SEQ ID NO: 562923 - RNA, 21 nt, Coxiella burnetii RSA 493
ugcgccgguacacaaaauuuc

SEQ ID NO: 562924 - RNA, 14 nt, Coxiella burnetii RSA 493
ugcgccgguuuaaa

SEQ ID NO: 562925 - RNA, 20 nt, Coxiella burnetii RSA 493
ugcgccggcguuugcacaua

SEQ ID NO: 562926 - RNA, 18 nt, Coxiella burnetii RSA 493
ugcguuguggacuuguuc

SEQ ID NO: 562927 - RNA, 14 nt, Coxiella burnetii RSA 493
ugcguaaauggucg

SEQ ID NO: 562928 - RNA, 13 nt, Coxiella burnetii RSA 493
ugcuauuuuuccc

SEQ ID NO: 562929 - RNA, 22 nt, Coxiella burnetii RSA 493
ugcuaaaugcgucaugaaauaa

SEQ ID NO: 562930 - RNA, 19 nt, Coxiella burnetii RSA 493
ugcuaaaaucgaugauaag

SEQ ID NO: 562931 - RNA, 12 nt, Coxiella burnetii RSA 493
ugcuaaaccacg

SEQ ID NO: 562932 - RNA, 20 nt, Coxiella burnetii RSA 493
ugcuaaaccacgcuauaauu

SEQ ID NO: 562933 - RNA, 15 nt, Coxiella burnetii RSA 493
ugcuaagauaauuac

SEQ ID NO: 562934 - RNA, 17 nt, Coxiella burnetii RSA 493
ugcuagaaguauuucca

SEQ ID NO: 562935 - RNA, 18 nt, Coxiella burnetii RSA 493
ugcuagaaguauuuccau

SEQ ID NO: 562936 - RNA, 14 nt, Coxiella burnetii RSA 493
ugcuccuuuucuuc

SEQ ID NO: 562937 - RNA, 13 nt, Coxiella burnetii RSA 493
ugcucaaguccuu

SEQ ID NO: 562938 - RNA, 20 nt, Coxiella burnetii RSA 493
ugcucaagcgaacgcggccu

SEQ ID NO: 562939 - RNA, 18 nt, Coxiella burnetii RSA 493
ugccuuggagcucuuguc

SEQ ID NO: 562940 - RNA, 21 nt, Coxiella burnetii RSA 493
ugcgaaauagaauuuuugacu

SEQ ID NO: 562941 - RNA, 15 nt, Coxiella burnetii RSA 493
ugcgaaauauuuccg

SEQ ID NO: 562942 - RNA, 16 nt, Coxiella burnetii RSA 493
ugcgaauguaaugcuu

SEQ ID NO: 562943 - RNA, 16 nt, Coxiella burnetii RSA 493
ugcgaggaccucucca

SEQ ID NO: 562944 - RNA, 17 nt, Coxiella burnetii RSA 493
ugcgaggaccucuccaa

SEQ ID NO: 562945 - RNA, 22 nt, Coxiella burnetii RSA 493
ugcgauaguuuuauuuaaaaaa

SEQ ID NO: 562946 - RNA, 17 nt, Coxiella burnetii RSA 493
ugcgccgcaaaguaaaa

SEQ ID NO: 562947 - RNA, 16 nt, Coxiella burnetii RSA 493
ugccuguaaaauaaga

SEQ ID NO: 562948 - RNA, 19 nt, Coxiella burnetii RSA 493
ugccuguaaaauaagaagg

SEQ ID NO: 562949 - RNA, 21 nt, Coxiella burnetii RSA 493
ugccucuuuuuguaaauuuuc

SEQ ID NO: 562950 - RNA, 13 nt, Coxiella burnetii RSA 493
ugcaaaaauuguu

SEQ ID NO: 562951 - RNA, 20 nt, Coxiella burnetii RSA 493
ugcaaacccacggcaaauaa

SEQ ID NO: 562952 - RNA, 22 nt, Coxiella burnetii RSA 493
ugcaaaccgcgcugaaguccuu

SEQ ID NO: 562953 - RNA, 12 nt, Coxiella burnetii RSA 493
ugauuuuuccca

SEQ ID NO: 562954 - RNA, 14 nt, Coxiella burnetii RSA 493
ugauuuuucccaau

SEQ ID NO: 562955 - RNA, 19 nt, Coxiella burnetii RSA 493
ugauuuucugugguuaauu

SEQ ID NO: 562956 - RNA, 16 nt, Coxiella burnetii RSA 493
ugauuuuuuuugcuuu

SEQ ID NO: 562957 - RNA, 21 nt, Coxiella burnetii RSA 493
ugauuuuugcucuaauucuga

SEQ ID NO: 562958 - RNA, 12 nt, Coxiella burnetii RSA 493
ugauuuuucuuu

SEQ ID NO: 562959 - RNA, 12 nt, Coxiella burnetii RSA 493
ugauuuuuuaaa

SEQ ID NO: 562960 - RNA, 16 nt, Coxiella burnetii RSA 493
ugauuuuuuaaaucuu

SEQ ID NO: 562961 - RNA, 23 nt, Coxiella burnetii RSA 493
ugauuuuuuaaaucuuccaauuu

SEQ ID NO: 562962 - RNA, 23 nt, Coxiella burnetii RSA 493
ugauuuuuuaaugaaaaauaggg

SEQ ID NO: 562963 - RNA, 20 nt, Coxiella burnetii RSA 493
ugauuccuucaaucacaagu

SEQ ID NO: 562964 - RNA, 18 nt, Coxiella burnetii RSA 493
ugauuccggagucacuau

SEQ ID NO: 562965 - RNA, 13 nt, Coxiella burnetii RSA 493
ugaugauguuuau

SEQ ID NO: 562966 - RNA, 20 nt, Coxiella burnetii RSA 493
ugaugacauuuaaaaaaacc

SEQ ID NO: 562967 - RNA, 14 nt, Coxiella burnetii RSA 493
ugauugauuuuuua

SEQ ID NO: 562968 - RNA, 16 nt, Coxiella burnetii RSA 493
ugcaaaugaguaaaaa

SEQ ID NO: 562969 - RNA, 17 nt, Coxiella burnetii RSA 493
ugcaaaugaguaaaaaa

SEQ ID NO: 562970 - RNA, 14 nt, Coxiella burnetii RSA 493
ugcaagcguucuua

SEQ ID NO: 562971 - RNA, 17 nt, Coxiella burnetii RSA 493
ugcaagcguuuuucauc

SEQ ID NO: 562972 - RNA, 20 nt, Coxiella burnetii RSA 493
ugcaagcguuuuucauccag

SEQ ID NO: 562973 - RNA, 18 nt, Coxiella burnetii RSA 493
ugcaagcaccgcuggcuu

SEQ ID NO: 562974 - RNA, 21 nt, Coxiella burnetii RSA 493
ugcaauacaccggaaauuuuu

SEQ ID NO: 562975 - RNA, 16 nt, Coxiella burnetii RSA 493
ugcaauaccauuuuua

SEQ ID NO: 562976 - RNA, 21 nt, Coxiella burnetii RSA 493
ugcaauaccauuuuuaaauua

SEQ ID NO: 562977 - RNA, 12 nt, Coxiella burnetii RSA 493
ugcaauguucuu

SEQ ID NO: 562978 - RNA, 19 nt, Coxiella burnetii RSA 493
ugcaaugaauucaaaccaa

SEQ ID NO: 562979 - RNA, 16 nt, Coxiella burnetii RSA 493
ugcaaugccagugcau

SEQ ID NO: 562980 - RNA, 17 nt, Coxiella burnetii RSA 493
ugcaauucuaguagaac

SEQ ID NO: 562981 - RNA, 20 nt, Coxiella burnetii RSA 493
ugcaauuccauuaaaaacaa

SEQ ID NO: 562982 - RNA, 17 nt, Coxiella burnetii RSA 493
ugcacauaagcgaauaa

SEQ ID NO: 562983 - RNA, 19 nt, Coxiella burnetii RSA 493
ugcauaaauuauuuuaaua

SEQ ID NO: 562984 - RNA, 21 nt, Coxiella burnetii RSA 493
ugcauaaauuauuuuaauaug

SEQ ID NO: 562985 - RNA, 15 nt, Coxiella burnetii RSA 493
ugcauaauauuuucu

SEQ ID NO: 562986 - RNA, 18 nt, Coxiella burnetii RSA 493
ugcauaauauuuucugcc

SEQ ID NO: 562987 - RNA, 21 nt, Coxiella burnetii RSA 493
ugcaguuaaccaauugauuaa

SEQ ID NO: 562988 - RNA, 14 nt, Coxiella burnetii RSA 493
ugcagcucuuucaa

SEQ ID NO: 562989 - RNA, 17 nt, Coxiella burnetii RSA 493
ugccacaaagucagacu

SEQ ID NO: 562990 - RNA, 14 nt, Coxiella burnetii RSA 493
ugcauuguuuucuu

SEQ ID NO: 562991 - RNA, 18 nt, Coxiella burnetii RSA 493
ugcauuugcgcuccucua

SEQ ID NO: 562992 - RNA, 24 nt, Coxiella burnetii RSA 493
ugcauuugcgcuccucuauauaag

SEQ ID NO: 562993 - RNA, 16 nt, Coxiella burnetii RSA 493
ugcauugcucaauauu

SEQ ID NO: 562994 - RNA, 18 nt, Coxiella burnetii RSA 493
ugcauugcucaauauuga

SEQ ID NO: 562995 - RNA, 15 nt, Coxiella burnetii RSA 493
ugaggaauuuuucaa

SEQ ID NO: 562996 - RNA, 16 nt, Coxiella burnetii RSA 493
ugagcuauaauucucu

SEQ ID NO: 562997 - RNA, 20 nt, Coxiella burnetii RSA 493
ugagcucauugccaaagaaa

SEQ ID NO: 562998 - RNA, 12 nt, Coxiella burnetii RSA 493
ugaggaagcgca

SEQ ID NO: 562999 - RNA, 17 nt, Coxiella burnetii RSA 493
ugagcggcuuuuucaau

SEQ ID NO: 563000 - RNA, 19 nt, Coxiella burnetii RSA 493
ugagauaucaauagcgcaa

SEQ ID NO: 563001 - RNA, 18 nt, Coxiella burnetii RSA 493
ugaguuuuugacaagcuu

SEQ ID NO: 563002 - RNA, 13 nt, Coxiella burnetii RSA 493
ugagucugccuuu

SEQ ID NO: 563003 - RNA, 20 nt, Coxiella burnetii RSA 493
ugagucugccuuuuuuuacu

SEQ ID NO: 563004 - RNA, 23 nt, Coxiella burnetii RSA 493
ugaggugccgcuaaaauuuuuug

SEQ ID NO: 563005 - RNA, 19 nt, Coxiella burnetii RSA 493
ugaggucgagcguaaaaca

SEQ ID NO: 563006 - RNA, 22 nt, Coxiella burnetii RSA 493
ugagugccacaaagucagacuu

SEQ ID NO: 563007 - RNA, 16 nt, Coxiella burnetii RSA 493
ugagugcgaauuucgg

SEQ ID NO: 563008 - RNA, 17 nt, Coxiella burnetii RSA 493
ugauaagguguuuuacg

SEQ ID NO: 563009 - RNA, 23 nt, Coxiella burnetii RSA 493
ugauaaagauucuguaacuuuuc

SEQ ID NO: 563010 - RNA, 16 nt, Coxiella burnetii RSA 493
ugauaagcauaauuca

SEQ ID NO: 563011 - RNA, 14 nt, Coxiella burnetii RSA 493
ugauaauaauugcu

SEQ ID NO: 563012 - RNA, 19 nt, Coxiella burnetii RSA 493
ugauacugcguuuuucagu

SEQ ID NO: 563013 - RNA, 14 nt, Coxiella burnetii RSA 493
ugauacuucuucau

SEQ ID NO: 563014 - RNA, 20 nt, Coxiella burnetii RSA 493
ugauacuucuucauuaaauc

SEQ ID NO: 563015 - RNA, 15 nt, Coxiella burnetii RSA 493
ugauauccuucuuuu

SEQ ID NO: 563016 - RNA, 17 nt, Coxiella burnetii RSA 493
ugauccuugcaauaagc

SEQ ID NO: 563017 - RNA, 21 nt, Coxiella burnetii RSA 493
ugauccgccuuuauuagaaaa

SEQ ID NO: 563018 - RNA, 14 nt, Coxiella burnetii RSA 493
ugauaugagaguag

SEQ ID NO: 563019 - RNA, 19 nt, Coxiella burnetii RSA 493
ugauaugagaguagauaac

SEQ ID NO: 563020 - RNA, 13 nt, Coxiella burnetii RSA 493
ugaucugcucuuu

SEQ ID NO: 563021 - RNA, 17 nt, Coxiella burnetii RSA 493
ugaucucuugcccccau

SEQ ID NO: 563022 - RNA, 19 nt, Coxiella burnetii RSA 493
ugaucggaggaaauauuua

SEQ ID NO: 563023 - RNA, 21 nt, Coxiella burnetii RSA 493
ugaucggaggaaauauuuaau

SEQ ID NO: 563024 - RNA, 18 nt, Coxiella burnetii RSA 493
ugacuaugguaauaauaa

SEQ ID NO: 563025 - RNA, 17 nt, Coxiella burnetii RSA 493
ugacuagucaacaaacg

SEQ ID NO: 563026 - RNA, 15 nt, Coxiella burnetii RSA 493
ugacuaagucaaaaa

SEQ ID NO: 563027 - RNA, 23 nt, Coxiella burnetii RSA 493
ugacggaauuugugauuuuaaaa

SEQ ID NO: 563028 - RNA, 15 nt, Coxiella burnetii RSA 493
ugacgcugcaauaau

SEQ ID NO: 563029 - RNA, 20 nt, Coxiella burnetii RSA 493
ugacucaggccuuuagcagg

SEQ ID NO: 563030 - RNA, 14 nt, Coxiella burnetii RSA 493
ugacucgcgaaauu

SEQ ID NO: 563031 - RNA, 23 nt, Coxiella burnetii RSA 493
ugagaacguuucccaaggaaucu

SEQ ID NO: 563032 - RNA, 15 nt, Coxiella burnetii RSA 493
ugagaagaauaagug

SEQ ID NO: 563033 - RNA, 18 nt, Coxiella burnetii RSA 493
ugagagucaggaaauuga

SEQ ID NO: 563034 - RNA, 23 nt, Coxiella burnetii RSA 493
ugagaguccuaaaauacuuaaaa

SEQ ID NO: 563035 - RNA, 22 nt, Coxiella burnetii RSA 493
ugagacucaguggcagcuucuu

SEQ ID NO: 563036 - RNA, 21 nt, Coxiella burnetii RSA 493
ugagacuuuaauaaagcgcuu

SEQ ID NO: 563037 - RNA, 23 nt, Coxiella burnetii RSA 493
ugacgauauugauuuaaauuuaa

SEQ ID NO: 563038 - RNA, 21 nt, Coxiella burnetii RSA 493
ugacgauuguggagacugcuu

SEQ ID NO: 563039 - RNA, 15 nt, Coxiella burnetii RSA 493
ugacauucugaacgc

SEQ ID NO: 563040 - RNA, 13 nt, Coxiella burnetii RSA 493
ucucuaaugauaa

SEQ ID NO: 563041 - RNA, 18 nt, Coxiella burnetii RSA 493
ucucuaaugauaauccac

SEQ ID NO: 563042 - RNA, 20 nt, Coxiella burnetii RSA 493
ucucuucaacgccagcuucc

SEQ ID NO: 563043 - RNA, 15 nt, Coxiella burnetii RSA 493
ucucguaacaaaaga

SEQ ID NO: 563044 - RNA, 23 nt, Coxiella burnetii RSA 493
aaaugcgguacuuaagaaaguau

SEQ ID NO: 563045 - RNA, 13 nt, Coxiella burnetii RSA 493
ucucuuuuuucca

SEQ ID NO: 563046 - RNA, 18 nt, Coxiella burnetii RSA 493
ucugaauuuaugaaugcu

SEQ ID NO: 563047 - RNA, 23 nt, Coxiella burnetii RSA 493
ucugaauugaaguccuuaucacu

SEQ ID NO: 563048 - RNA, 18 nt, Coxiella burnetii RSA 493
ucugaaucacuucuucca

SEQ ID NO: 563049 - RNA, 16 nt, Coxiella burnetii RSA 493
ucugaucgauaaaaau

SEQ ID NO: 563050 - RNA, 18 nt, Coxiella burnetii RSA 493
ucugaucgauaaaaauaa

SEQ ID NO: 563051 - RNA, 18 nt, Coxiella burnetii RSA 493
ucugauaggaauucuuuu

SEQ ID NO: 563052 - RNA, 18 nt, Coxiella burnetii RSA 493
ucugauccgccuuuauua

SEQ ID NO: 563053 - RNA, 13 nt, Coxiella burnetii RSA 493
ucugcugaagcag

SEQ ID NO: 563054 - RNA, 19 nt, Coxiella burnetii RSA 493
ucugcuggcgaucgcccac

SEQ ID NO: 563055 - RNA, 19 nt, Coxiella burnetii RSA 493
ucugcuaggauuuuuuauc

SEQ ID NO: 563056 - RNA, 17 nt, Coxiella burnetii RSA 493
ucugggugauaaggauu

SEQ ID NO: 563057 - RNA, 23 nt, Coxiella burnetii RSA 493
ucuggcggugcgaauaacaaaga

SEQ ID NO: 563058 - RNA, 19 nt, Coxiella burnetii RSA 493
ucugauggaugaaagauuu

SEQ ID NO: 563059 - RNA, 22 nt, Coxiella burnetii RSA 493
ucugauugcggcucaauuauua

SEQ ID NO: 563060 - RNA, 22 nt, Coxiella burnetii RSA 493
ucugauuuuacgcuauuuuuua

SEQ ID NO: 563061 - RNA, 23 nt, Coxiella burnetii RSA 493
ucugcgauuguuuucuuacuguu

SEQ ID NO: 563062 - RNA, 18 nt, Coxiella burnetii RSA 493
ucuucaucuuuagcaaua

SEQ ID NO: 563063 - RNA, 12 nt, Coxiella burnetii RSA 493
ucuucaucuuua

SEQ ID NO: 563064 - RNA, 13 nt, Coxiella burnetii RSA 493
ucuucauuuucug

SEQ ID NO: 563065 - RNA, 13 nt, Coxiella burnetii RSA 493
ucuucauauucuu

SEQ ID NO: 563066 - RNA, 15 nt, Coxiella burnetii RSA 493
ucuucaacaucaacc

SEQ ID NO: 563067 - RNA, 14 nt, Coxiella burnetii RSA 493
ucuucaaaaccuaa

SEQ ID NO: 563068 - RNA, 20 nt, Coxiella burnetii RSA 493
ucuucaaaagugauuuuucu

SEQ ID NO: 563069 - RNA, 20 nt, Coxiella burnetii RSA 493
ucuuauuuugugaugcacgg

SEQ ID NO: 563070 - RNA, 18 nt, Coxiella burnetii RSA 493
ucuuaauacccguuucuu

SEQ ID NO: 563071 - RNA, 17 nt, Coxiella burnetii RSA 493
ucuuaaugaaauuucuc

SEQ ID NO: 563072 - RNA, 17 nt, Coxiella burnetii RSA 493
ucuuaaagucuucaaaa

SEQ ID NO: 563073 - RNA, 20 nt, Coxiella burnetii RSA 493
ucuguuuucguaaucuuuaa

SEQ ID NO: 563074 - RNA, 19 nt, Coxiella burnetii RSA 493
ucuucuucauuuauuucug

SEQ ID NO: 563075 - RNA, 21 nt, Coxiella burnetii RSA 493
ucuucugucuucugucguacg

SEQ ID NO: 563076 - RNA, 19 nt, Coxiella burnetii RSA 493
ucuucuucaucuaaauuaa

SEQ ID NO: 563077 - RNA, 21 nt, Coxiella burnetii RSA 493
ucuucugaucgauaaaaauaa

SEQ ID NO: 563078 - RNA, 19 nt, Coxiella burnetii RSA 493
ucuucgaguuucguggcuu

SEQ ID NO: 563079 - RNA, 15 nt, Coxiella burnetii RSA 493
ucuucuagaaaaccc

SEQ ID NO: 563080 - RNA, 22 nt, Coxiella burnetii RSA 493
ucuucuuuucuauuugguugug

SEQ ID NO: 563081 - RNA, 10 nt, Coxiella burnetii RSA 493
ucuucuuuuc

SEQ ID NO: 563082 - RNA, 17 nt, Coxiella burnetii RSA 493
ucuucuuuuuuguaaau

SEQ ID NO: 563083 - RNA, 14 nt, Coxiella burnetii RSA 493
ucuugaaaaacuuc

SEQ ID NO: 563084 - RNA, 12 nt, Coxiella burnetii RSA 493
ucuucuuuggcc

SEQ ID NO: 563085 - RNA, 18 nt, Coxiella burnetii RSA 493
ucuugaucuaaucgucuu

SEQ ID NO: 563086 - RNA, 17 nt, Coxiella burnetii RSA 493
ucuugcaacguuugauu

SEQ ID NO: 563087 - RNA, 21 nt, Coxiella burnetii RSA 493
ucuugcccccauugauaauaa

SEQ ID NO: 563088 - RNA, 23 nt, Coxiella burnetii RSA 493
ucuugcccccauugauaauaauu

SEQ ID NO: 563089 - RNA, 16 nt, Coxiella burnetii RSA 493
ucuugcgacagucucu

SEQ ID NO: 563090 - RNA, 19 nt, Coxiella burnetii RSA 493
ucuugcgacagucucuuag

SEQ ID NO: 563091 - RNA, 16 nt, Coxiella burnetii RSA 493
ucuugccgauuuguuu

SEQ ID NO: 563092 - RNA, 17 nt, Coxiella burnetii RSA 493
ucuugcggcgauaauca

SEQ ID NO: 563093 - RNA, 18 nt, Coxiella burnetii RSA 493
ucuugggcaaaaaaagaa

SEQ ID NO: 563094 - RNA, 22 nt, Coxiella burnetii RSA 493
ucuuguaaucgcugauacuucu

SEQ ID NO: 563095 - RNA, 14 nt, Coxiella burnetii RSA 493
ucuugucauucccu

SEQ ID NO: 563096 - RNA, 16 nt, Coxiella burnetii RSA 493
ucuugucauucccuuu

SEQ ID NO: 563097 - RNA, 22 nt, Coxiella burnetii RSA 493
ucuugcugcauauauuccacaa

SEQ ID NO: 563098 - RNA, 16 nt, Coxiella burnetii RSA 493
ucuuggauuuuuucgg

SEQ ID NO: 563099 - RNA, 21 nt, Coxiella burnetii RSA 493
ucuuggagauuuagccaaaau

SEQ ID NO: 563100 - RNA, 20 nt, Coxiella burnetii RSA 493
ucuuuaauacaaggaaaauc

SEQ ID NO: 563101 - RNA, 15 nt, Coxiella burnetii RSA 493
ucuuuaauaucaaaa

SEQ ID NO: 563102 - RNA, 22 nt, Coxiella burnetii RSA 493
ucuuuaauaucaaaaaaccaua

SEQ ID NO: 563103 - RNA, 19 nt, Coxiella burnetii RSA 493
ucuuuaacaagaucaauac

SEQ ID NO: 563104 - RNA, 22 nt, Coxiella burnetii RSA 493
ucuuuacgcgcuucuuuuaauu

SEQ ID NO: 563105 - RNA, 19 nt, Coxiella burnetii RSA 493
ucuuuauuuuuucuuugcu

SEQ ID NO: 563106 - RNA, 11 nt, Coxiella burnetii RSA 493
ucuuuuaauug

SEQ ID NO: 563107 - RNA, 14 nt, Coxiella burnetii RSA 493
ucuuuucaacucau

SEQ ID NO: 563108 - RNA, 16 nt, Coxiella burnetii RSA 493
ucuuugguuuuccaug

SEQ ID NO: 563109 - RNA, 12 nt, Coxiella burnetii RSA 493
ucuuuucuguuu

SEQ ID NO: 563110 - RNA, 22 nt, Coxiella burnetii RSA 493
ucuuuuuccauguuuacauuaa

SEQ ID NO: 563111 - RNA, 16 nt, Coxiella burnetii RSA 493
ucuuuuucgucuguuu

SEQ ID NO: 563112 - RNA, 21 nt, Coxiella burnetii RSA 493
ucuuuuuguaaauuuucccau

SEQ ID NO: 563113 - RNA, 20 nt, Coxiella burnetii RSA 493
ucuuucugaaaauucugaau

SEQ ID NO: 563114 - RNA, 12 nt, Coxiella burnetii RSA 493
ucuuucacuaaa

SEQ ID NO: 563115 - RNA, 21 nt, Coxiella burnetii RSA 493
ucuuucauguaauuuauccca

SEQ ID NO: 563116 - RNA, 16 nt, Coxiella burnetii RSA 493
ucuuucauuaucuaga

SEQ ID NO: 563117 - RNA, 18 nt, Coxiella burnetii RSA 493
ucuuugacauaucauucc

SEQ ID NO: 563118 - RNA, 15 nt, Coxiella burnetii RSA 493
ucuuucuuuucuucu

SEQ ID NO: 563119 - RNA, 14 nt, Coxiella burnetii RSA 493
ucuuugaugugaaa

SEQ ID NO: 563120 - RNA, 16 nt, Coxiella burnetii RSA 493
ucuuugcucuaaauua

SEQ ID NO: 563121 - RNA, 21 nt, Coxiella burnetii RSA 493
ugaagauugccacucuuuauu

SEQ ID NO: 563122 - RNA, 18 nt, Coxiella burnetii RSA 493
ugaagaauuuguuuugau

SEQ ID NO: 563123 - RNA, 21 nt, Coxiella burnetii RSA 493
ugaaguaugugggcucacuug

SEQ ID NO: 563124 - RNA, 23 nt, Coxiella burnetii RSA 493
ugaaggaaauuugcauuaaucuu

SEQ ID NO: 563125 - RNA, 12 nt, Coxiella burnetii RSA 493
ugaaggagauca

SEQ ID NO: 563126 - RNA, 22 nt, Coxiella burnetii RSA 493
ugaacuaagcgugcucuuuuuc

SEQ ID NO: 563127 - RNA, 21 nt, Coxiella burnetii RSA 493
ugaaccuaaauuauaaaugga

SEQ ID NO: 563128 - RNA, 16 nt, Coxiella burnetii RSA 493
ugaaccgauucauaaa

SEQ ID NO: 563129 - RNA, 19 nt, Coxiella burnetii RSA 493
ugaacaggagcgauaaaau

SEQ ID NO: 563130 - RNA, 18 nt, Coxiella burnetii RSA 493
ugaacaggauuuucauua

SEQ ID NO: 563131 - RNA, 22 nt, Coxiella burnetii RSA 493
ugaaaucguuuuguuuuaaguu

SEQ ID NO: 563132 - RNA, 20 nt, Coxiella burnetii RSA 493
ugaaauaccucuucuaaagu

SEQ ID NO: 563133 - RNA, 15 nt, Coxiella burnetii RSA 493
ugaaauaaacagagu

SEQ ID NO: 563134 - RNA, 18 nt, Coxiella burnetii RSA 493
ugaaaguuuucccaaugu

SEQ ID NO: 563135 - RNA, 18 nt, Coxiella burnetii RSA 493
ugaaaaucccuuuuaauu

SEQ ID NO: 563136 - RNA, 20 nt, Coxiella burnetii RSA 493
ugaaaaucccuuuuaauuua

SEQ ID NO: 563137 - RNA, 22 nt, Coxiella burnetii RSA 493
ugaaaauaauugaggaaaauaa

SEQ ID NO: 563138 - RNA, 20 nt, Coxiella burnetii RSA 493
ugaaacggcuuguuuaagug

SEQ ID NO: 563139 - RNA, 14 nt, Coxiella burnetii RSA 493
ugaaacaucaauac

SEQ ID NO: 563140 - RNA, 19 nt, Coxiella burnetii RSA 493
ugaaaaaacggcguauuuu

SEQ ID NO: 563141 - RNA, 12 nt, Coxiella burnetii RSA 493
ucuuuuuuccaa

SEQ ID NO: 563142 - RNA, 13 nt, Coxiella burnetii RSA 493
ucuuuuuuggccc

SEQ ID NO: 563143 - RNA, 17 nt, Coxiella burnetii RSA 493
ugaaaaaauuaaauauu

SEQ ID NO: 563144 - RNA, 19 nt, Coxiella burnetii RSA 493
ugaaaaccuacacuuucaa

SEQ ID NO: 563145 - RNA, 17 nt, Coxiella burnetii RSA 493
ugaaaaccuacacuuuu

SEQ ID NO: 563146 - RNA, 17 nt, Coxiella burnetii RSA 493
ugaaaaauaaaaggaga

SEQ ID NO: 563147 - RNA, 15 nt, Coxiella burnetii RSA 493
ugaaaacguuauugu

SEQ ID NO: 563148 - RNA, 16 nt, Coxiella burnetii RSA 493
ugaaaaguaaauuuau

SEQ ID NO: 563149 - RNA, 17 nt, Coxiella burnetii RSA 493
ugaaaaguaaauuuaua

SEQ ID NO: 563150 - RNA, 17 nt, Coxiella burnetii RSA 493
ucauucgaacgacuuuu

SEQ ID NO: 563151 - RNA, 19 nt, Coxiella burnetii RSA 493
ucauugagcgggauauuuu

SEQ ID NO: 563152 - RNA, 12 nt, Coxiella burnetii RSA 493
ucauugaaauca

SEQ ID NO: 563153 - RNA, 15 nt, Coxiella burnetii RSA 493
ucauugaaaucaauu

SEQ ID NO: 563154 - RNA, 15 nt, Coxiella burnetii RSA 493
ucauuaucaugcauu

SEQ ID NO: 563155 - RNA, 23 nt, Coxiella burnetii RSA 493
ucauucacuaaucgucgacaaaa

SEQ ID NO: 563156 - RNA, 18 nt, Coxiella burnetii RSA 493
ucauucauuucaauauuu

SEQ ID NO: 563157 - RNA, 13 nt, Coxiella burnetii RSA 493
ucaguuaaaauaa

SEQ ID NO: 563158 - RNA, 16 nt, Coxiella burnetii RSA 493
ucaguuaaaauaauga

SEQ ID NO: 563159 - RNA, 16 nt, Coxiella burnetii RSA 493
ucauuuaauuuuaaau

SEQ ID NO: 563160 - RNA, 15 nt, Coxiella burnetii RSA 493
ucauugccaaagaaa

SEQ ID NO: 563161 - RNA, 15 nt, Coxiella burnetii RSA 493
ucauuguuaauccac

SEQ ID NO: 563162 - RNA, 17 nt, Coxiella burnetii RSA 493
uccaaagcagauaaaug

SEQ ID NO: 563163 - RNA, 19 nt, Coxiella burnetii RSA 493
uccaacacguauuuucauu

SEQ ID NO: 563164 - RNA, 20 nt, Coxiella burnetii RSA 493
uccaacacguauuuucauuc

SEQ ID NO: 563165 - RNA, 20 nt, Coxiella burnetii RSA 493
uccaaacuacucucaaaauc

SEQ ID NO: 563166 - RNA, 23 nt, Coxiella burnetii RSA 493
ucauuuucucuaaugauaaucca

SEQ ID NO: 563167 - RNA, 13 nt, Coxiella burnetii RSA 493
ucauuuugauucu

SEQ ID NO: 563168 - RNA, 20 nt, Coxiella burnetii RSA 493
ucauuuugauucucuauuuc

SEQ ID NO: 563169 - RNA, 18 nt, Coxiella burnetii RSA 493
uccaauaaggcauuugca

SEQ ID NO: 563170 - RNA, 21 nt, Coxiella burnetii RSA 493
uccaaggaaaggucaggcaau

SEQ ID NO: 563171 - RNA, 12 nt, Coxiella burnetii RSA 493
uccacuuaaaac

SEQ ID NO: 563172 - RNA, 16 nt, Coxiella burnetii RSA 493
uccacuaaugguugga

SEQ ID NO: 563173 - RNA, 22 nt, Coxiella burnetii RSA 493
uccaauuauaacuauuuuaaau

SEQ ID NO: 563174 - RNA, 15 nt, Coxiella burnetii RSA 493
uccacaauuuuccgg

SEQ ID NO: 563175 - RNA, 13 nt, Coxiella burnetii RSA 493
uccagaaauucau

SEQ ID NO: 563176 - RNA, 16 nt, Coxiella burnetii RSA 493
uccacuuguuuuucgg

SEQ ID NO: 563177 - RNA, 16 nt, Coxiella burnetii RSA 493
uccauaucguuuucac

SEQ ID NO: 563178 - RNA, 17 nt, Coxiella burnetii RSA 493
uccauagcgaaaauuca

SEQ ID NO: 563179 - RNA, 18 nt, Coxiella burnetii RSA 493
uccagguaguuuguuuuu

SEQ ID NO: 563180 - RNA, 21 nt, Coxiella burnetii RSA 493
uccagucguuuuuuaauauuu

SEQ ID NO: 563181 - RNA, 16 nt, Coxiella burnetii RSA 493
uccauguuuacauuaa

SEQ ID NO: 563182 - RNA, 15 nt, Coxiella burnetii RSA 493
uccauuaaaaacaau

SEQ ID NO: 563183 - RNA, 17 nt, Coxiella burnetii RSA 493
uccauuaauuucuuuuu

SEQ ID NO: 563184 - RNA, 14 nt, Coxiella burnetii RSA 493
uccaucuccuuuuc

SEQ ID NO: 563185 - RNA, 16 nt, Coxiella burnetii RSA 493
uccaucuccuuuucgu

SEQ ID NO: 563186 - RNA, 15 nt, Coxiella burnetii RSA 493
uccaucccuccuuuu

SEQ ID NO: 563187 - RNA, 18 nt, Coxiella burnetii RSA 493
ucccaauguuuccaaaua

SEQ ID NO: 563188 - RNA, 22 nt, Coxiella burnetii RSA 493
ucccaauguuuccaaauaauga

SEQ ID NO: 563189 - RNA, 22 nt, Coxiella burnetii RSA 493
ucccaauuacgcccuuucucuu

SEQ ID NO: 563190 - RNA, 13 nt, Coxiella burnetii RSA 493
ucccaccaaaauu

SEQ ID NO: 563191 - RNA, 20 nt, Coxiella burnetii RSA 493
ucccaauuucuuuucuaaau

SEQ ID NO: 563192 - RNA, 17 nt, Coxiella burnetii RSA 493
ucccaagcuuuugccuu

SEQ ID NO: 563193 - RNA, 18 nt, Coxiella burnetii RSA 493
ucccaaggaaucuauugu

SEQ ID NO: 563194 - RNA, 15 nt, Coxiella burnetii RSA 493
ucccaaacaaucauc

SEQ ID NO: 563195 - RNA, 12 nt, Coxiella burnetii RSA 493
uccauuguuucg

SEQ ID NO: 563196 - RNA, 20 nt, Coxiella burnetii RSA 493
uccauugaguggugguagaa

SEQ ID NO: 563197 - RNA, 20 nt, Coxiella burnetii RSA 493
uccauuuuuuacagugugca

SEQ ID NO: 563198 - RNA, 20 nt, Coxiella burnetii RSA 493
ucccaaaaaacuuagccaau

SEQ ID NO: 563199 - RNA, 13 nt, Coxiella burnetii RSA 493
uccauuuucaagu

SEQ ID NO: 563200 - RNA, 18 nt, Coxiella burnetii RSA 493
uccccaaaggugucaaaa

SEQ ID NO: 563201 - RNA, 23 nt, Coxiella burnetii RSA 493
uccccaaaggugucaaaauuauu

SEQ ID NO: 563202 - RNA, 20 nt, Coxiella burnetii RSA 493
ucccauaauuccgcauaaac

SEQ ID NO: 563203 - RNA, 20 nt, Coxiella burnetii RSA 493
ucccacguuguuugauuuac

SEQ ID NO: 563204 - RNA, 14 nt, Coxiella burnetii RSA 493
ucccgcaaaugauc

SEQ ID NO: 563205 - RNA, 21 nt, Coxiella burnetii RSA 493
uccccuuauagcgugagagga

SEQ ID NO: 563206 - RNA, 20 nt, Coxiella burnetii RSA 493
ucccgugcaauuguggcccg

SEQ ID NO: 563207 - RNA, 18 nt, Coxiella burnetii RSA 493
ucccggauaaaguguugu

SEQ ID NO: 563208 - RNA, 17 nt, Coxiella burnetii RSA 493
ucccggcugugaauuag

SEQ ID NO: 563209 - RNA, 14 nt, Coxiella burnetii RSA 493
ucccggcuuuaaaa

SEQ ID NO: 563210 - RNA, 23 nt, Coxiella burnetii RSA 493
ucccgcuuaaacccagaaaagua

SEQ ID NO: 563211 - RNA, 20 nt, Coxiella burnetii RSA 493
ucccgccugcgcgaaacgac

SEQ ID NO: 563212 - RNA, 16 nt, Coxiella burnetii RSA 493
ucccuggauaauuaaa

SEQ ID NO: 563213 - RNA, 23 nt, Coxiella burnetii RSA 493
ucccuuaaguugacgccuauugc

SEQ ID NO: 563214 - RNA, 16 nt, Coxiella burnetii RSA 493
ucccuuaaaucaugcu

SEQ ID NO: 563215 - RNA, 13 nt, Coxiella burnetii RSA 493
ucccuucugcuga

SEQ ID NO: 563216 - RNA, 22 nt, Coxiella burnetii RSA 493
ucccuaaagugggggaaaacag

SEQ ID NO: 563217 - RNA, 16 nt, Coxiella burnetii RSA 493
ucccucuuuaccuccu

SEQ ID NO: 563218 - RNA, 19 nt, Coxiella burnetii RSA 493
ucccucuuuaccuccuccc

SEQ ID NO: 563219 - RNA, 12 nt, Coxiella burnetii RSA 493
ucccuuuuucgu

SEQ ID NO: 563220 - RNA, 19 nt, Coxiella burnetii RSA 493
ucccuuuucauuaagcaau

SEQ ID NO: 563221 - RNA, 19 nt, Coxiella burnetii RSA 493
ucccuuuuccugaacagga

SEQ ID NO: 563222 - RNA, 12 nt, Coxiella burnetii RSA 493
ucccuuuaaccg

SEQ ID NO: 563223 - RNA, 21 nt, Coxiella burnetii RSA 493
uccgaauaguagguuagagag

SEQ ID NO: 563224 - RNA, 16 nt, Coxiella burnetii RSA 493
uccgacauucuucucc

SEQ ID NO: 563225 - RNA, 17 nt, Coxiella burnetii RSA 493
aaaucuguaacgccaug

SEQ ID NO: 563226 - RNA, 21 nt, Coxiella burnetii RSA 493
aaaucuguaacgccaugaagc

SEQ ID NO: 563227 - RNA, 17 nt, Coxiella burnetii RSA 493
uccgauuguuguggaua

SEQ ID NO: 563228 - RNA, 23 nt, Coxiella burnetii RSA 493
uccgcaaaucggaaaagccaauu

SEQ ID NO: 563229 - RNA, 13 nt, Coxiella burnetii RSA 493
uccgcauagguau

SEQ ID NO: 563230 - RNA, 21 nt, Coxiella burnetii RSA 493
uccgcauagguauuuccuugc

SEQ ID NO: 563231 - RNA, 17 nt, Coxiella burnetii RSA 493
uccgcauugcauuucuu

SEQ ID NO: 563232 - RNA, 12 nt, Coxiella burnetii RSA 493
uccgccuaaauu

SEQ ID NO: 563233 - RNA, 23 nt, Coxiella burnetii RSA 493
uccgccucaauuucaauuagaau

SEQ ID NO: 563234 - RNA, 18 nt, Coxiella burnetii RSA 493
uccgccuuuauuagaaaa

SEQ ID NO: 563235 - RNA, 21 nt, Coxiella burnetii RSA 493
uccgcuacaucuaagcuagua

SEQ ID NO: 563236 - RNA, 22 nt, Coxiella burnetii RSA 493
uccuugacgcucagauaaauga

SEQ ID NO: 563237 - RNA, 22 nt, Coxiella burnetii RSA 493
uccuugaggaauugcuaccugc

SEQ ID NO: 563238 - RNA, 11 nt, Coxiella burnetii RSA 493
uccuugagagu

SEQ ID NO: 563239 - RNA, 22 nt, Coxiella burnetii RSA 493
uccuucuuuuaaagugauuuuu

SEQ ID NO: 563240 - RNA, 11 nt, Coxiella burnetii RSA 493
uccuucuuuug

SEQ ID NO: 563241 - RNA, 15 nt, Coxiella burnetii RSA 493
uccuucuuuugucuu

SEQ ID NO: 563242 - RNA, 22 nt, Coxiella burnetii RSA 493
uccuuuaucguugcugagcaaa

SEQ ID NO: 563243 - RNA, 23 nt, Coxiella burnetii RSA 493
uccuuguugaauuccuuguugaa

SEQ ID NO: 563244 - RNA, 19 nt, Coxiella burnetii RSA 493
uccuuguugcaauccuuuu

SEQ ID NO: 563245 - RNA, 20 nt, Coxiella burnetii RSA 493
uccuuggaacaaaccauuca

SEQ ID NO: 563246 - RNA, 14 nt, Coxiella burnetii RSA 493
uccuuuuuuuaaug

SEQ ID NO: 563247 - RNA, 17 nt, Coxiella burnetii RSA 493
ucgaaaaacuuuuuagg

SEQ ID NO: 563248 - RNA, 16 nt, Coxiella burnetii RSA 493
ucgaaaacuaguuauu

SEQ ID NO: 563249 - RNA, 18 nt, Coxiella burnetii RSA 493
uccuuuuuauaaaugauu

SEQ ID NO: 563250 - RNA, 12 nt, Coxiella burnetii RSA 493
uccuuuuucuuu

SEQ ID NO: 563251 - RNA, 17 nt, Coxiella burnetii RSA 493
uccuuuucauuuugauu

SEQ ID NO: 563252 - RNA, 23 nt, Coxiella burnetii RSA 493
uccuuugguaacaaacugggagc

SEQ ID NO: 563253 - RNA, 22 nt, Coxiella burnetii RSA 493
uccuuucugacgcuuuuucccu

SEQ ID NO: 563254 - RNA, 21 nt, Coxiella burnetii RSA 493
ucgaacgacuuuuuuuaccau

SEQ ID NO: 563255 - RNA, 12 nt, Coxiella burnetii RSA 493
ucgaauuuguuc

SEQ ID NO: 563256 - RNA, 22 nt, Coxiella burnetii RSA 493
ucgaauuuguucuuuaacaaga

SEQ ID NO: 563257 - RNA, 19 nt, Coxiella burnetii RSA 493
ucgaaugcagcucuuucaa

SEQ ID NO: 563258 - RNA, 17 nt, Coxiella burnetii RSA 493
ucgacauaaggcugcga

SEQ ID NO: 563259 - RNA, 20 nt, Coxiella burnetii RSA 493
ucgacauaggagauuuuuau

SEQ ID NO: 563260 - RNA, 20 nt, Coxiella burnetii RSA 493
ucgagaaggccacauuucga

SEQ ID NO: 563261 - RNA, 22 nt, Coxiella burnetii RSA 493
ucgaggaagaccgcuaauuuua

SEQ ID NO: 563262 - RNA, 17 nt, Coxiella burnetii RSA 493
ucgauaagaucaauuac

SEQ ID NO: 563263 - RNA, 16 nt, Coxiella burnetii RSA 493
ucgauaaaaauaauga

SEQ ID NO: 563264 - RNA, 15 nt, Coxiella burnetii RSA 493
ucgauaaauuuugaa

SEQ ID NO: 563265 - RNA, 22 nt, Coxiella burnetii RSA 493
ucgauuuuuuugccggacuuuu

SEQ ID NO: 563266 - RNA, 20 nt, Coxiella burnetii RSA 493
ucgaugaagcugacgcuucu

SEQ ID NO: 563267 - RNA, 15 nt, Coxiella burnetii RSA 493
ucgaucccucggcca

SEQ ID NO: 563268 - RNA, 20 nt, Coxiella burnetii RSA 493
ucgauccgagcccaauaaca

SEQ ID NO: 563269 - RNA, 15 nt, Coxiella burnetii RSA 493
ucgauccuuuuaaua

SEQ ID NO: 563270 - RNA, 11 nt, Coxiella burnetii RSA 493
ucgaucggcaa

SEQ ID NO: 563271 - RNA, 19 nt, Coxiella burnetii RSA 493
ucgaugcacucuuuaauuu

SEQ ID NO: 563272 - RNA, 19 nt, Coxiella burnetii RSA 493
ucgcacaaugcuuuucuca

SEQ ID NO: 563273 - RNA, 22 nt, Coxiella burnetii RSA 493
ucgcacaaugcuuuucucaacg

SEQ ID NO: 563274 - RNA, 18 nt, Coxiella burnetii RSA 493
ucgcaauuaauacauucu

SEQ ID NO: 563275 - RNA, 21 nt, Coxiella burnetii RSA 493
ucgcaauugaaaaaccauuca

SEQ ID NO: 563276 - RNA, 16 nt, Coxiella burnetii RSA 493
ucgcacaucauugaaa

SEQ ID NO: 563277 - RNA, 16 nt, Coxiella burnetii RSA 493
ucgcaacuuuuuuccu

SEQ ID NO: 563278 - RNA, 13 nt, Coxiella burnetii RSA 493
ucgcaauccucuc

SEQ ID NO: 563279 - RNA, 21 nt, Coxiella burnetii RSA 493
ucgcaacaagcaacgaucaug

SEQ ID NO: 563280 - RNA, 15 nt, Coxiella burnetii RSA 493
ucgcauaauaaucga

SEQ ID NO: 563281 - RNA, 15 nt, Coxiella burnetii RSA 493
uccucagaaguuuua

SEQ ID NO: 563282 - RNA, 16 nt, Coxiella burnetii RSA 493
uccucagaaguuuuag

SEQ ID NO: 563283 - RNA, 23 nt, Coxiella burnetii RSA 493
uccucaguaaaaacauccuccau

SEQ ID NO: 563284 - RNA, 20 nt, Coxiella burnetii RSA 493
uccucuguccucugccuucu

SEQ ID NO: 563285 - RNA, 23 nt, Coxiella burnetii RSA 493
uccuuaaagcaacgacuucucuu

SEQ ID NO: 563286 - RNA, 13 nt, Coxiella burnetii RSA 493
uccuuauacuaaa

SEQ ID NO: 563287 - RNA, 13 nt, Coxiella burnetii RSA 493
uccuuacuauucg

SEQ ID NO: 563288 - RNA, 20 nt, Coxiella burnetii RSA 493
uccuuaaugaguucauuaau

SEQ ID NO: 563289 - RNA, 23 nt, Coxiella burnetii RSA 493
uccuucaaucacaaguucuucua

SEQ ID NO: 563290 - RNA, 21 nt, Coxiella burnetii RSA 493
uccuguggaagguugagaagu

SEQ ID NO: 563291 - RNA, 13 nt, Coxiella burnetii RSA 493
uccuguucuuuuc

SEQ ID NO: 563292 - RNA, 13 nt, Coxiella burnetii RSA 493
uccuguucuuuuu

SEQ ID NO: 563293 - RNA, 16 nt, Coxiella burnetii RSA 493
uccuguucuuuuucca

SEQ ID NO: 563294 - RNA, 23 nt, Coxiella burnetii RSA 493
uccuguucuuuuuccauguuuac

SEQ ID NO: 563295 - RNA, 19 nt, Coxiella burnetii RSA 493
uccucacggcaauucucau

SEQ ID NO: 563296 - RNA, 14 nt, Coxiella burnetii RSA 493
uccuaucgaagaag

SEQ ID NO: 563297 - RNA, 15 nt, Coxiella burnetii RSA 493
uccuaccgcccgcca

SEQ ID NO: 563298 - RNA, 18 nt, Coxiella burnetii RSA 493
uccuaagcuuucucccaa

SEQ ID NO: 563299 - RNA, 14 nt, Coxiella burnetii RSA 493
uccuaauaaaaaua

SEQ ID NO: 563300 - RNA, 16 nt, Coxiella burnetii RSA 493
uccuaauaaaaauauu

SEQ ID NO: 563301 - RNA, 23 nt, Coxiella burnetii RSA 493
uccuaaaauacuuaaaauuucuu

SEQ ID NO: 563302 - RNA, 23 nt, Coxiella burnetii RSA 493
uccguuuugaaaaauaaaaggag

SEQ ID NO: 563303 - RNA, 17 nt, Coxiella burnetii RSA 493
uccguaauuaccugaau

SEQ ID NO: 563304 - RNA, 18 nt, Coxiella burnetii RSA 493
uccgguucagcauaacua

SEQ ID NO: 563305 - RNA, 14 nt, Coxiella burnetii RSA 493
uccguauccaucac

SEQ ID NO: 563306 - RNA, 20 nt, Coxiella burnetii RSA 493
uccggcguugauuuuuuaaa

SEQ ID NO: 563307 - RNA, 13 nt, Coxiella burnetii RSA 493
uccgggaauagga

SEQ ID NO: 563308 - RNA, 19 nt, Coxiella burnetii RSA 493
uagucuuugguuuuccaug

SEQ ID NO: 563309 - RNA, 17 nt, Coxiella burnetii RSA 493
uagucuuaauuuuaaaa

SEQ ID NO: 563310 - RNA, 19 nt, Coxiella burnetii RSA 493
uagucuuaauuuuaaaaaa

SEQ ID NO: 563311 - RNA, 14 nt, Coxiella burnetii RSA 493
uagugaggcuucuu

SEQ ID NO: 563312 - RNA, 20 nt, Coxiella burnetii RSA 493
uaguacccagggcuauuuua

SEQ ID NO: 563313 - RNA, 11 nt, Coxiella burnetii RSA 493
uaguaauauuu

SEQ ID NO: 563314 - RNA, 15 nt, Coxiella burnetii RSA 493
uaguaauauuuugca

SEQ ID NO: 563315 - RNA, 17 nt, Coxiella burnetii RSA 493
uaguaauauuuugcaga

SEQ ID NO: 563316 - RNA, 16 nt, Coxiella burnetii RSA 493
uagucauagcuaagau

SEQ ID NO: 563317 - RNA, 22 nt, Coxiella burnetii RSA 493
uaguaacccuuucauuuaauuu

SEQ ID NO: 563318 - RNA, 17 nt, Coxiella burnetii RSA 493
uacuuucacuaauuaua

SEQ ID NO: 563319 - RNA, 19 nt, Coxiella burnetii RSA 493
uauaaggucuuaauuucua

SEQ ID NO: 563320 - RNA, 22 nt, Coxiella burnetii RSA 493
uauaaggucuuaauuucuaaaa

SEQ ID NO: 563321 - RNA, 22 nt, Coxiella burnetii RSA 493
uauaaguguggucugaaaauaa

SEQ ID NO: 563322 - RNA, 19 nt, Coxiella burnetii RSA 493
uauaauugcggcaaccagc

SEQ ID NO: 563323 - RNA, 22 nt, Coxiella burnetii RSA 493
uauaaaugauuuccaacgcuug

SEQ ID NO: 563324 - RNA, 18 nt, Coxiella burnetii RSA 493
uauaaauaacuuuaguuu

SEQ ID NO: 563325 - RNA, 13 nt, Coxiella burnetii RSA 493
uauaaauaaucuu

SEQ ID NO: 563326 - RNA, 15 nt, Coxiella burnetii RSA 493
uauaaaauuuaauaa

SEQ ID NO: 563327 - RNA, 20 nt, Coxiella burnetii RSA 493
uauaaaauuuaauaagucuu

SEQ ID NO: 563328 - RNA, 15 nt, Coxiella burnetii RSA 493
uauaaagguuuuucc

SEQ ID NO: 563329 - RNA, 16 nt, Coxiella burnetii RSA 493
uauaaagguuuuuccu

SEQ ID NO: 563330 - RNA, 19 nt, Coxiella burnetii RSA 493
uauaaagguuuuuccuuuu

SEQ ID NO: 563331 - RNA, 23 nt, Coxiella burnetii RSA 493
uauaaagguuuuuccuuuuauuc

SEQ ID NO: 563332 - RNA, 23 nt, Coxiella burnetii RSA 493
uauaaaguguuuuuuugaagcau

SEQ ID NO: 563333 - RNA, 20 nt, Coxiella burnetii RSA 493
uauaaaagcaucaauaaugc

SEQ ID NO: 563334 - RNA, 19 nt, Coxiella burnetii RSA 493
uauaguucauuaaauuuaa

SEQ ID NO: 563335 - RNA, 20 nt, Coxiella burnetii RSA 493
uauaguucauuaaauuuaau

SEQ ID NO: 563336 - RNA, 20 nt, Coxiella burnetii RSA 493
uaucaacgauuuuaagaauc

SEQ ID NO: 563337 - RNA, 16 nt, Coxiella burnetii RSA 493
uauauuuucuuucuuu

SEQ ID NO: 563338 - RNA, 14 nt, Coxiella burnetii RSA 493
uauauuaauuugau

SEQ ID NO: 563339 - RNA, 18 nt, Coxiella burnetii RSA 493
uauauuuacugagaaaac

SEQ ID NO: 563340 - RNA, 18 nt, Coxiella burnetii RSA 493
uauauuucgcaauccucu

SEQ ID NO: 563341 - RNA, 18 nt, Coxiella burnetii RSA 493
uauccagcacccaauuaa

SEQ ID NO: 563342 - RNA, 13 nt, Coxiella burnetii RSA 493
uaucauacuuaau

SEQ ID NO: 563343 - RNA, 14 nt, Coxiella burnetii RSA 493
uaucauacuuaauu

SEQ ID NO: 563344 - RNA, 16 nt, Coxiella burnetii RSA 493
uaucccaauaguaaaa

SEQ ID NO: 563345 - RNA, 16 nt, Coxiella burnetii RSA 493
uaucccgaaaacccgu

SEQ ID NO: 563346 - RNA, 15 nt, Coxiella burnetii RSA 493
uauccuaauaaaaau

SEQ ID NO: 563347 - RNA, 20 nt, Coxiella burnetii RSA 493
uauccgguuuugauuuuugc

SEQ ID NO: 563348 - RNA, 16 nt, Coxiella burnetii RSA 493
uaucgaccauuaacca

SEQ ID NO: 563349 - RNA, 21 nt, Coxiella burnetii RSA 493
uaucgaugaagcugacgcuuc

SEQ ID NO: 563350 - RNA, 21 nt, Coxiella burnetii RSA 493
uaugaagcgcggcgaaauaca

SEQ ID NO: 563351 - RNA, 22 nt, Coxiella burnetii RSA 493
uaugaagcgcggcgaaauacag

SEQ ID NO: 563352 - RNA, 22 nt, Coxiella burnetii RSA 493
uaugaagugggggaacagagga

SEQ ID NO: 563353 - RNA, 20 nt, Coxiella burnetii RSA 493
uaugaauaauuuuuuuaauu

SEQ ID NO: 563354 - RNA, 14 nt, Coxiella burnetii RSA 493
uaucuuuuaaauua

SEQ ID NO: 563355 - RNA, 16 nt, Coxiella burnetii RSA 493
uaucuuuuucaauuau

SEQ ID NO: 563356 - RNA, 14 nt, Coxiella burnetii RSA 493
uaucuuauuauuca

SEQ ID NO: 563357 - RNA, 15 nt, Coxiella burnetii RSA 493
uaucuuaaugaaauu

SEQ ID NO: 563358 - RNA, 20 nt, Coxiella burnetii RSA 493
uaucuguuuucgauaaaugc

SEQ ID NO: 563359 - RNA, 11 nt, Coxiella burnetii RSA 493
uaucuccauuu

SEQ ID NO: 563360 - RNA, 14 nt, Coxiella burnetii RSA 493
uaucucuuaaaauu

SEQ ID NO: 563361 - RNA, 19 nt, Coxiella burnetii RSA 493
uaucucuuaaggcagcaua

SEQ ID NO: 563362 - RNA, 11 nt, Coxiella burnetii RSA 493
uaucuggccag

SEQ ID NO: 563363 - RNA, 16 nt, Coxiella burnetii RSA 493
uaucugaucaaaaaua

SEQ ID NO: 563364 - RNA, 20 nt, Coxiella burnetii RSA 493
uaugcagcgaagcgaaauac

SEQ ID NO: 563365 - RNA, 19 nt, Coxiella burnetii RSA 493
uaugcaagguugaugcuua

SEQ ID NO: 563366 - RNA, 16 nt, Coxiella burnetii RSA 493
uaugaucauuuucuca

SEQ ID NO: 563367 - RNA, 19 nt, Coxiella burnetii RSA 493
uaugaauauagacaaugcu

SEQ ID NO: 563368 - RNA, 23 nt, Coxiella burnetii RSA 493
uauggcgcucuccuaccaaauaa

SEQ ID NO: 563369 - RNA, 20 nt, Coxiella burnetii RSA 493
uaugggggcccauccaguaa

SEQ ID NO: 563370 - RNA, 16 nt, Coxiella burnetii RSA 493
uaugcuucaauaaaaa

SEQ ID NO: 563371 - RNA, 17 nt, Coxiella burnetii RSA 493
uaugcuucaauaaaaaa

SEQ ID NO: 563372 - RNA, 19 nt, Coxiella burnetii RSA 493
uauggaguucuugcuccca

SEQ ID NO: 563373 - RNA, 15 nt, Coxiella burnetii RSA 493
uaugcgggguuuuuu

SEQ ID NO: 563374 - RNA, 13 nt, Coxiella burnetii RSA 493
uauucuuuuauuu

SEQ ID NO: 563375 - RNA, 21 nt, Coxiella burnetii RSA 493
uauucuucaauacuacagcac

SEQ ID NO: 563376 - RNA, 13 nt, Coxiella burnetii RSA 493
uauucuuaaaccc

SEQ ID NO: 563377 - RNA, 16 nt, Coxiella burnetii RSA 493
uauucuucauaggauu

SEQ ID NO: 563378 - RNA, 21 nt, Coxiella burnetii RSA 493
uauucuaacguuaguuucuuu

SEQ ID NO: 563379 - RNA, 20 nt, Coxiella burnetii RSA 493
uauucuaucucaaguggcuc

SEQ ID NO: 563380 - RNA, 23 nt, Coxiella burnetii RSA 493
uauuaugggugggcgugauugaa

SEQ ID NO: 563381 - RNA, 15 nt, Coxiella burnetii RSA 493
aaauccguaauuuua

SEQ ID NO: 563382 - RNA, 13 nt, Coxiella burnetii RSA 493
uauugaagucugg

SEQ ID NO: 563383 - RNA, 14 nt, Coxiella burnetii RSA 493
uauugcaauauuua

SEQ ID NO: 563384 - RNA, 17 nt, Coxiella burnetii RSA 493
uauugcauuguuuucuu

SEQ ID NO: 563385 - RNA, 22 nt, Coxiella burnetii RSA 493
uauugcauuguuuucuuacuuu

SEQ ID NO: 563386 - RNA, 15 nt, Coxiella burnetii RSA 493
uauuggauuuacuuc

SEQ ID NO: 563387 - RNA, 17 nt, Coxiella burnetii RSA 493
uauugggggucuuuuuu

SEQ ID NO: 563388 - RNA, 16 nt, Coxiella burnetii RSA 493
uauuacauauuucuuu

SEQ ID NO: 563389 - RNA, 19 nt, Coxiella burnetii RSA 493
uauuacauauuucuuuucu

SEQ ID NO: 563390 - RNA, 18 nt, Coxiella burnetii RSA 493
uauuagucuuaauuuuaa

SEQ ID NO: 563391 - RNA, 19 nt, Coxiella burnetii RSA 493
uauuaguggaauuaaauau

SEQ ID NO: 563392 - RNA, 20 nt, Coxiella burnetii RSA 493
uauuaagccgaugccaauga

SEQ ID NO: 563393 - RNA, 22 nt, Coxiella burnetii RSA 493
uauuaauacaggaaaaagauaa

SEQ ID NO: 563394 - RNA, 19 nt, Coxiella burnetii RSA 493
uauguuucaauaacagaga

SEQ ID NO: 563395 - RNA, 23 nt, Coxiella burnetii RSA 493
uauuaaaagagcgaauaaaaaau

SEQ ID NO: 563396 - RNA, 24 nt, Coxiella burnetii RSA 493
uauuaaaacaagacaacaaaaugu

SEQ ID NO: 563397 - RNA, 15 nt, Coxiella burnetii RSA 493
uauguauuuuuugga

SEQ ID NO: 563398 - RNA, 18 nt, Coxiella burnetii RSA 493
uauguauuuuuuggaaug

SEQ ID NO: 563399 - RNA, 23 nt, Coxiella burnetii RSA 493
uauguauuuuuuggaaugagcau

SEQ ID NO: 563400 - RNA, 16 nt, Coxiella burnetii RSA 493
uaugucguucaauucu

SEQ ID NO: 563401 - RNA, 17 nt, Coxiella burnetii RSA 493
uauguauuucaaggaau

SEQ ID NO: 563402 - RNA, 12 nt, Coxiella burnetii RSA 493
ucaggagcaggg

SEQ ID NO: 563403 - RNA, 16 nt, Coxiella burnetii RSA 493
ucaggacugaaauaau

SEQ ID NO: 563404 - RNA, 22 nt, Coxiella burnetii RSA 493
ucaguggcagcuucuuuaaaau

SEQ ID NO: 563405 - RNA, 22 nt, Coxiella burnetii RSA 493
ucagaauggggcgaaggcaauu

SEQ ID NO: 563406 - RNA, 18 nt, Coxiella burnetii RSA 493
aaaucguuuugaaauugg

SEQ ID NO: 563407 - RNA, 17 nt, Coxiella burnetii RSA 493
aaaucgguuuuuuucuu

SEQ ID NO: 563408 - RNA, 16 nt, Coxiella burnetii RSA 493
ucacuaucgugauucu

SEQ ID NO: 563409 - RNA, 14 nt, Coxiella burnetii RSA 493
ucacuaugaucaug

SEQ ID NO: 563410 - RNA, 12 nt, Coxiella burnetii RSA 493
ucacuugauaau

SEQ ID NO: 563411 - RNA, 17 nt, Coxiella burnetii RSA 493
ucacuuguccuucuucu

SEQ ID NO: 563412 - RNA, 13 nt, Coxiella burnetii RSA 493
ucacuuuauuuuc

SEQ ID NO: 563413 - RNA, 11 nt, Coxiella burnetii RSA 493
ucacuuuucug

SEQ ID NO: 563414 - RNA, 13 nt, Coxiella burnetii RSA 493
ucacuuuuuucag

SEQ ID NO: 563415 - RNA, 17 nt, Coxiella burnetii RSA 493
ucacuuuuuucagcguu

SEQ ID NO: 563416 - RNA, 15 nt, Coxiella burnetii RSA 493
ucacuuuccuuaucc

SEQ ID NO: 563417 - RNA, 15 nt, Coxiella burnetii RSA 493
ucacuagcuauucuu

SEQ ID NO: 563418 - RNA, 16 nt, Coxiella burnetii RSA 493
ucacggccccacggaa

SEQ ID NO: 563419 - RNA, 22 nt, Coxiella burnetii RSA 493
ucacggccccacggaaugggag

SEQ ID NO: 563420 - RNA, 18 nt, Coxiella burnetii RSA 493
ucacgccgcaucacgcuc

SEQ ID NO: 563421 - RNA, 20 nt, Coxiella burnetii RSA 493
ucaaauagauuagugaaucu

SEQ ID NO: 563422 - RNA, 15 nt, Coxiella burnetii RSA 493
ucaaacuguuugcau

SEQ ID NO: 563423 - RNA, 19 nt, Coxiella burnetii RSA 493
ucaaacuguuugcauuuaa

SEQ ID NO: 563424 - RNA, 20 nt, Coxiella burnetii RSA 493
ucaaacuguuugcauuuaau

SEQ ID NO: 563425 - RNA, 13 nt, Coxiella burnetii RSA 493
ucaaauuuuccca

SEQ ID NO: 563426 - RNA, 14 nt, Coxiella burnetii RSA 493
ucaaauuuucccag

SEQ ID NO: 563427 - RNA, 20 nt, Coxiella burnetii RSA 493
ucaaauuuucccaggaaaga

SEQ ID NO: 563428 - RNA, 14 nt, Coxiella burnetii RSA 493
ucaaauuuuaaagg

SEQ ID NO: 563429 - RNA, 17 nt, Coxiella burnetii RSA 493
ucaacaaaauuuuucau

SEQ ID NO: 563430 - RNA, 20 nt, Coxiella burnetii RSA 493
ucaaauucuagugugauaau

SEQ ID NO: 563431 - RNA, 13 nt, Coxiella burnetii RSA 493
ucaaauuaaaaua

SEQ ID NO: 563432 - RNA, 14 nt, Coxiella burnetii RSA 493
ucaaauuaaaauaa

SEQ ID NO: 563433 - RNA, 20 nt, Coxiella burnetii RSA 493
ucaaaccaacgaugcugaua

SEQ ID NO: 563434 - RNA, 13 nt, Coxiella burnetii RSA 493
ucaaaauuuacuu

SEQ ID NO: 563435 - RNA, 13 nt, Coxiella burnetii RSA 493
ucaaacaaaucaa

SEQ ID NO: 563436 - RNA, 12 nt, Coxiella burnetii RSA 493
ucaaacacuugu

SEQ ID NO: 563437 - RNA, 20 nt, Coxiella burnetii RSA 493
ucaaacaauugagcggcuuu

SEQ ID NO: 563438 - RNA, 12 nt, Coxiella burnetii RSA 493
ucaaaauuaaaa

SEQ ID NO: 563439 - RNA, 15 nt, Coxiella burnetii RSA 493
ucaaaauuaaaaucu

SEQ ID NO: 563440 - RNA, 21 nt, Coxiella burnetii RSA 493
ucaaaauuaaaaucuucugau

SEQ ID NO: 563441 - RNA, 17 nt, Coxiella burnetii RSA 493
ucaaaagaggguauuuu

SEQ ID NO: 563442 - RNA, 12 nt, Coxiella burnetii RSA 493
ucaacauauuuc

SEQ ID NO: 563443 - RNA, 15 nt, Coxiella burnetii RSA 493
ucaacauauuucuug

SEQ ID NO: 563444 - RNA, 16 nt, Coxiella burnetii RSA 493
ucaacaucaaccccag

SEQ ID NO: 563445 - RNA, 11 nt, Coxiella burnetii RSA 493
ucaacaaucag

SEQ ID NO: 563446 - RNA, 17 nt, Coxiella burnetii RSA 493
ucaacaacuauccccau

SEQ ID NO: 563447 - RNA, 14 nt, Coxiella burnetii RSA 493
ucaacagaacaacu

SEQ ID NO: 563448 - RNA, 22 nt, Coxiella burnetii RSA 493
ucaacgcuucagaaucugcuuc

SEQ ID NO: 563449 - RNA, 17 nt, Coxiella burnetii RSA 493
ucaacggaaaaacaaaa

SEQ ID NO: 563450 - RNA, 20 nt, Coxiella burnetii RSA 493
ucaacggaaaaacaaaacaa

SEQ ID NO: 563451 - RNA, 17 nt, Coxiella burnetii RSA 493
ucaacuacuugauauuc

SEQ ID NO: 563452 - RNA, 20 nt, Coxiella burnetii RSA 493
ucaacuacuugauauucccu

SEQ ID NO: 563453 - RNA, 19 nt, Coxiella burnetii RSA 493
ucaaccgguuuuucuucau

SEQ ID NO: 563454 - RNA, 22 nt, Coxiella burnetii RSA 493
ucaaccgguuuuucuucauuug

SEQ ID NO: 563455 - RNA, 23 nt, Coxiella burnetii RSA 493
ucaacgauuuuaagaaucgucgu

SEQ ID NO: 563456 - RNA, 14 nt, Coxiella burnetii RSA 493
ucaauuguuucaug

SEQ ID NO: 563457 - RNA, 23 nt, Coxiella burnetii RSA 493
ucaauugcuuucccuuuuugauu

SEQ ID NO: 563458 - RNA, 17 nt, Coxiella burnetii RSA 493
ucaauuuaccaauuaaa

SEQ ID NO: 563459 - RNA, 22 nt, Coxiella burnetii RSA 493
ucaauucggauacgaccuucug

SEQ ID NO: 563460 - RNA, 23 nt, Coxiella burnetii RSA 493
ucaauuauuaacgccagaugcca

SEQ ID NO: 563461 - RNA, 17 nt, Coxiella burnetii RSA 493
ucaauauggaacccguu

SEQ ID NO: 563462 - RNA, 20 nt, Coxiella burnetii RSA 493
ucaaugagugcuuuuaacca

SEQ ID NO: 563463 - RNA, 18 nt, Coxiella burnetii RSA 493
ucaaugggcaguuuucuu

SEQ ID NO: 563464 - RNA, 21 nt, Coxiella burnetii RSA 493
ucaauaaucucacacaacucc

SEQ ID NO: 563465 - RNA, 16 nt, Coxiella burnetii RSA 493
ucaauaaugccagauu

SEQ ID NO: 563466 - RNA, 20 nt, Coxiella burnetii RSA 493
ucaauaaugccagauugauu

SEQ ID NO: 563467 - RNA, 16 nt, Coxiella burnetii RSA 493
ucaauaaauaaaucaa

SEQ ID NO: 563468 - RNA, 18 nt, Coxiella burnetii RSA 493
ucaauaaauaaaucaagu

SEQ ID NO: 563469 - RNA, 17 nt, Coxiella burnetii RSA 493
ucaauaccaagcucaug

SEQ ID NO: 563470 - RNA, 21 nt, Coxiella burnetii RSA 493
ucaauaccaagcucaugaaaa

SEQ ID NO: 563471 - RNA, 18 nt, Coxiella burnetii RSA 493
ucaauaccgauuaauucu

SEQ ID NO: 563472 - RNA, 19 nt, Coxiella burnetii RSA 493
ucaauaccgauuaauucuu

SEQ ID NO: 563473 - RNA, 15 nt, Coxiella burnetii RSA 493
ucaauacagauuuua

SEQ ID NO: 563474 - RNA, 21 nt, Coxiella burnetii RSA 493
ucaauaggguagucaggaagc

SEQ ID NO: 563475 - RNA, 20 nt, Coxiella burnetii RSA 493
ucacaaaagguaaaaaacua

SEQ ID NO: 563476 - RNA, 21 nt, Coxiella burnetii RSA 493
ucacaaaagguaaaaaacuaa

SEQ ID NO: 563477 - RNA, 13 nt, Coxiella burnetii RSA 493
ucaauuucaauua

SEQ ID NO: 563478 - RNA, 20 nt, Coxiella burnetii RSA 493
ucaauuucaacgccucucuc

SEQ ID NO: 563479 - RNA, 17 nt, Coxiella burnetii RSA 493
aaaucgcugagcucauu

SEQ ID NO: 563480 - RNA, 13 nt, Coxiella burnetii RSA 493
ucacaugauuuuu

SEQ ID NO: 563481 - RNA, 15 nt, Coxiella burnetii RSA 493
ucacaugauuuuucu

SEQ ID NO: 563482 - RNA, 22 nt, Coxiella burnetii RSA 493
uaaagauaucgucacccaaauc

SEQ ID NO: 563483 - RNA, 22 nt, Coxiella burnetii RSA 493
uaaagccagugcuauucccgcc

SEQ ID NO: 563484 - RNA, 15 nt, Coxiella burnetii RSA 493
uaaagccauagaauu

SEQ ID NO: 563485 - RNA, 15 nt, Coxiella burnetii RSA 493
uaaaguaguugaaaa

SEQ ID NO: 563486 - RNA, 22 nt, Coxiella burnetii RSA 493
uaaagucagcuuuggaaaaaca

SEQ ID NO: 563487 - RNA, 16 nt, Coxiella burnetii RSA 493
uaaaguaauuuuaaaa

SEQ ID NO: 563488 - RNA, 21 nt, Coxiella burnetii RSA 493
uaaaguagcccguaugcagcg

SEQ ID NO: 563489 - RNA, 12 nt, Coxiella burnetii RSA 493
uaaaguuauuuc

SEQ ID NO: 563490 - RNA, 13 nt, Coxiella burnetii RSA 493
uaaaguuauuucu

SEQ ID NO: 563491 - RNA, 13 nt, Coxiella burnetii RSA 493
uaaaguuucuaac

SEQ ID NO: 563492 - RNA, 19 nt, Coxiella burnetii RSA 493
uaaaucauugguuuuugau

SEQ ID NO: 563493 - RNA, 14 nt, Coxiella burnetii RSA 493
uaaauaaggagcau

SEQ ID NO: 563494 - RNA, 16 nt, Coxiella burnetii RSA 493
uaaaccuauccaaaaa

SEQ ID NO: 563495 - RNA, 17 nt, Coxiella burnetii RSA 493
uaaaccuauccaaaaag

SEQ ID NO: 563496 - RNA, 19 nt, Coxiella burnetii RSA 493
uaaaccuauccaaaaagau

SEQ ID NO: 563497 - RNA, 13 nt, Coxiella burnetii RSA 493
uaaacgcuucaaa

SEQ ID NO: 563498 - RNA, 17 nt, Coxiella burnetii RSA 493
uaaagaauuugacaagc

SEQ ID NO: 563499 - RNA, 14 nt, Coxiella burnetii RSA 493
uaaacuggaaaaag

SEQ ID NO: 563500 - RNA, 22 nt, Coxiella burnetii RSA 493
uaaacaagaauggcgggaaaaa

SEQ ID NO: 563501 - RNA, 17 nt, Coxiella burnetii RSA 493
uaaacaaguuaacaaaa

SEQ ID NO: 563502 - RNA, 22 nt, Coxiella burnetii RSA 493
uaaaccgcacgccaaggcuauu

SEQ ID NO: 563503 - RNA, 15 nt, Coxiella burnetii RSA 493
uaaaccgcuuucuag

SEQ ID NO: 563504 - RNA, 20 nt, Coxiella burnetii RSA 493
uaaaugcgguacuuaagaaa

SEQ ID NO: 563505 - RNA, 18 nt, Coxiella burnetii RSA 493
uaaaucgguugaagaaau

SEQ ID NO: 563506 - RNA, 18 nt, Coxiella burnetii RSA 493
uaaaugcuuuucuuucau

SEQ ID NO: 563507 - RNA, 20 nt, Coxiella burnetii RSA 493
uaaaugcuuuucuuucauua

SEQ ID NO: 563508 - RNA, 15 nt, Coxiella burnetii RSA 493
uaaaugcuuuuuaaa

SEQ ID NO: 563509 - RNA, 20 nt, Coxiella burnetii RSA 493
uaaaugcuuuuuaaauaacu

SEQ ID NO: 563510 - RNA, 17 nt, Coxiella burnetii RSA 493
uaaauccuuaauuaacu

SEQ ID NO: 563511 - RNA, 21 nt, Coxiella burnetii RSA 493
uaaaucccuggugguuauuua

SEQ ID NO: 563512 - RNA, 17 nt, Coxiella burnetii RSA 493
uaaauuaaaugcuuuuu

SEQ ID NO: 563513 - RNA, 23 nt, Coxiella burnetii RSA 493
uaaauuaaaugcuuuuuaaauaa

SEQ ID NO: 563514 - RNA, 13 nt, Coxiella burnetii RSA 493
uaaauuaauauua

SEQ ID NO: 563515 - RNA, 14 nt, Coxiella burnetii RSA 493
uaaauuauuuuaau

SEQ ID NO: 563516 - RNA, 16 nt, Coxiella burnetii RSA 493
uaaauuauuuuaauau

SEQ ID NO: 563517 - RNA, 16 nt, Coxiella burnetii RSA 493
uaaauuuuuaauggaa

SEQ ID NO: 563518 - RNA, 12 nt, Coxiella burnetii RSA 493
uaaauuuuccca

SEQ ID NO: 563519 - RNA, 14 nt, Coxiella burnetii RSA 493
uaacaaaauuaaaa

SEQ ID NO: 563520 - RNA, 16 nt, Coxiella burnetii RSA 493
uaacaaaauuaaaaaa

SEQ ID NO: 563521 - RNA, 14 nt, Coxiella burnetii RSA 493
uaacaaaagauauu

SEQ ID NO: 563522 - RNA, 21 nt, Coxiella burnetii RSA 493
uaacaauuguugauuuaacuu

SEQ ID NO: 563523 - RNA, 17 nt, Coxiella burnetii RSA 493
uaaccacucggaaagca

SEQ ID NO: 563524 - RNA, 18 nt, Coxiella burnetii RSA 493
uaacccuuucauuuaauu

SEQ ID NO: 563525 - RNA, 22 nt, Coxiella burnetii RSA 493
uaaccacagacucuuuuuaucc

SEQ ID NO: 563526 - RNA, 23 nt, Coxiella burnetii RSA 493
uaacagacagacgcuggaaaaau

SEQ ID NO: 563527 - RNA, 21 nt, Coxiella burnetii RSA 493
uaacacggccuucauuauuga

SEQ ID NO: 563528 - RNA, 22 nt, Coxiella burnetii RSA 493
uaacacggccuucauuauugaa

SEQ ID NO: 563529 - RNA, 22 nt, Coxiella burnetii RSA 493
uaacgccuaucuuuuucaagau

SEQ ID NO: 563530 - RNA, 15 nt, Coxiella burnetii RSA 493
uaacgcgaaaccuac

SEQ ID NO: 563531 - RNA, 13 nt, Coxiella burnetii RSA 493
uaacgcuucuuuu

SEQ ID NO: 563532 - RNA, 23 nt, Coxiella burnetii RSA 493
uaacggggucgcggaaaauuuaa

SEQ ID NO: 563533 - RNA, 14 nt, Coxiella burnetii RSA 493
uaacgcaggaucaa

SEQ ID NO: 563534 - RNA, 13 nt, Coxiella burnetii RSA 493
uaacgauuucucu

SEQ ID NO: 563535 - RNA, 13 nt, Coxiella burnetii RSA 493
uaagcaaagaucu

SEQ ID NO: 563536 - RNA, 18 nt, Coxiella burnetii RSA 493
uaagauucuugaacagga

SEQ ID NO: 563537 - RNA, 13 nt, Coxiella burnetii RSA 493
uaagauuucuuca

SEQ ID NO: 563538 - RNA, 16 nt, Coxiella burnetii RSA 493
uaagcauaauucauca

SEQ ID NO: 563539 - RNA, 15 nt, Coxiella burnetii RSA 493
uaagcacuucuuuua

SEQ ID NO: 563540 - RNA, 19 nt, Coxiella burnetii RSA 493
uaagcaugggccuacuuua

SEQ ID NO: 563541 - RNA, 16 nt, Coxiella burnetii RSA 493
uaagcauuaaaaaaua

SEQ ID NO: 563542 - RNA, 21 nt, Coxiella burnetii RSA 493
uaagcauuaaaaaauaagaaa

SEQ ID NO: 563543 - RNA, 19 nt, Coxiella burnetii RSA 493
uaagcauuaacgauaaauc

SEQ ID NO: 563544 - RNA, 16 nt, Coxiella burnetii RSA 493
uaagccauuaaaagca

SEQ ID NO: 563545 - RNA, 16 nt, Coxiella burnetii RSA 493
uaagccauaucaggag

SEQ ID NO: 563546 - RNA, 18 nt, Coxiella burnetii RSA 493
uaagccauaucaggagca

SEQ ID NO: 563547 - RNA, 15 nt, Coxiella burnetii RSA 493
uaagcccuuuagcca

SEQ ID NO: 563548 - RNA, 21 nt, Coxiella burnetii RSA 493
uaagcucgagaagaugucccg

SEQ ID NO: 563549 - RNA, 23 nt, Coxiella burnetii RSA 493
uaagcugcccucaguugucaugu

SEQ ID NO: 563550 - RNA, 15 nt, Coxiella burnetii RSA 493
uaagcugauacacca

SEQ ID NO: 563551 - RNA, 16 nt, Coxiella burnetii RSA 493
uaagcuguuucuuuua

SEQ ID NO: 563552 - RNA, 20 nt, Coxiella burnetii RSA 493
uaagcuaucagcaaucaaau

SEQ ID NO: 563553 - RNA, 22 nt, Coxiella burnetii RSA 493
uaaggaacaggggcuaaauaag

SEQ ID NO: 563554 - RNA, 20 nt, Coxiella burnetii RSA 493
uaaggaggcaauacaucuug

SEQ ID NO: 563555 - RNA, 23 nt, Coxiella burnetii RSA 493
uaaggcugaagaggcugaauaag

SEQ ID NO: 563556 - RNA, 14 nt, Coxiella burnetii RSA 493
uaaggccaauucca

SEQ ID NO: 563557 - RNA, 11 nt, Coxiella burnetii RSA 493
uaauaaaacaa

SEQ ID NO: 563558 - RNA, 17 nt, Coxiella burnetii RSA 493
uaauaaaacaagauacc

SEQ ID NO: 563559 - RNA, 18 nt, Coxiella burnetii RSA 493
uaaguuuuuugcucuuua

SEQ ID NO: 563560 - RNA, 13 nt, Coxiella burnetii RSA 493
uaauaaaaauauu

SEQ ID NO: 563561 - RNA, 19 nt, Coxiella burnetii RSA 493
uaauaaaucaauuaaauuu

SEQ ID NO: 563562 - RNA, 19 nt, Coxiella burnetii RSA 493
uaauaaauggcguuguauu

SEQ ID NO: 563563 - RNA, 21 nt, Coxiella burnetii RSA 493
uaaguguggucugaaaauaau

SEQ ID NO: 563564 - RNA, 12 nt, Coxiella burnetii RSA 493
uaaggucucaac

SEQ ID NO: 563565 - RNA, 18 nt, Coxiella burnetii RSA 493
uaaggucucaacagccuu

SEQ ID NO: 563566 - RNA, 15 nt, Coxiella burnetii RSA 493
uaaguaaaugcaccu

SEQ ID NO: 563567 - RNA, 16 nt, Coxiella burnetii RSA 493
uaagguggauuuucaa

SEQ ID NO: 563568 - RNA, 12 nt, Coxiella burnetii RSA 493
uaaggugggggg

SEQ ID NO: 563569 - RNA, 21 nt, Coxiella burnetii RSA 493
uaagucccaauuucuuuucua

SEQ ID NO: 563570 - RNA, 18 nt, Coxiella burnetii RSA 493
uaaguccccuuauagcgu

SEQ ID NO: 563571 - RNA, 17 nt, Coxiella burnetii RSA 493
uaagucuauugaaaaaa

SEQ ID NO: 563572 - RNA, 16 nt, Coxiella burnetii RSA 493
uaaguagcuaaaaaau

SEQ ID NO: 563573 - RNA, 17 nt, Coxiella burnetii RSA 493
uaaguagcuaaaaaauu

SEQ ID NO: 563574 - RNA, 14 nt, Coxiella burnetii RSA 493
uaaguauccauccc

SEQ ID NO: 563575 - RNA, 18 nt, Coxiella burnetii RSA 493
uaaguagcucuuaaaaga

SEQ ID NO: 563576 - RNA, 14 nt, Coxiella burnetii RSA 493
uaagacgcuuucaa

SEQ ID NO: 563577 - RNA, 17 nt, Coxiella burnetii RSA 493
uaagacuaggaaaaaau

SEQ ID NO: 563578 - RNA, 23 nt, Coxiella burnetii RSA 493
uaagacacguucuggaaugacuc

SEQ ID NO: 563579 - RNA, 15 nt, Coxiella burnetii RSA 493
uaagaggaccuguga

SEQ ID NO: 563580 - RNA, 12 nt, Coxiella burnetii RSA 493
uaagagaaaaaa

SEQ ID NO: 563581 - RNA, 19 nt, Coxiella burnetii RSA 493
uaagagauagugcuauuuu

SEQ ID NO: 563582 - RNA, 23 nt, Coxiella burnetii RSA 493
uaagagauagugcuauuuuuccc

SEQ ID NO: 563583 - RNA, 17 nt, Coxiella burnetii RSA 493
uaagauaauuacaaucc

SEQ ID NO: 563584 - RNA, 13 nt, Coxiella burnetii RSA 493
uaagauaauaauu

SEQ ID NO: 563585 - RNA, 14 nt, Coxiella burnetii RSA 493
uaacuuuuccaucu

SEQ ID NO: 563586 - RNA, 21 nt, Coxiella burnetii RSA 493
uaacuuuuccaucuccuuuuc

SEQ ID NO: 563587 - RNA, 20 nt, Coxiella burnetii RSA 493
uaagaagagcacgcaaugcu

SEQ ID NO: 563588 - RNA, 19 nt, Coxiella burnetii RSA 493
uaacucuaauuuuccugac

SEQ ID NO: 563589 - RNA, 17 nt, Coxiella burnetii RSA 493
uaacuccacgaucugag

SEQ ID NO: 563590 - RNA, 20 nt, Coxiella burnetii RSA 493
uaacguuuugucguuuucau

SEQ ID NO: 563591 - RNA, 17 nt, Coxiella burnetii RSA 493
uaacgucgcaaauaaua

SEQ ID NO: 563592 - RNA, 19 nt, Coxiella burnetii RSA 493
uaacguuaguuucuuuuau

SEQ ID NO: 563593 - RNA, 22 nt, Coxiella burnetii RSA 493
aaauccauccggaugucauaau

SEQ ID NO: 563594 - RNA, 14 nt, Coxiella burnetii RSA 493
uaauuacaacuacu

SEQ ID NO: 563595 - RNA, 15 nt, Coxiella burnetii RSA 493
uaauguuuuuucuaa

SEQ ID NO: 563596 - RNA, 16 nt, Coxiella burnetii RSA 493
uaauguuuuuucuaau

SEQ ID NO: 563597 - RNA, 19 nt, Coxiella burnetii RSA 493
uaauguuugauaucaaucg

SEQ ID NO: 563598 - RNA, 15 nt, Coxiella burnetii RSA 493
uaauguuauuaaaca

SEQ ID NO: 563599 - RNA, 18 nt, Coxiella burnetii RSA 493
uaauguuauuaaacaaga

SEQ ID NO: 563600 - RNA, 14 nt, Coxiella burnetii RSA 493
uaauguuauuuauu

SEQ ID NO: 563601 - RNA, 20 nt, Coxiella burnetii RSA 493
uaauuccccguauuucgcuu

SEQ ID NO: 563602 - RNA, 15 nt, Coxiella burnetii RSA 493
uaaugagguuaauaa

SEQ ID NO: 563603 - RNA, 21 nt, Coxiella burnetii RSA 493
uaaugcaaaaccaaugaggau

SEQ ID NO: 563604 - RNA, 21 nt, Coxiella burnetii RSA 493
uaaugcgccuacaaauaccaa

SEQ ID NO: 563605 - RNA, 19 nt, Coxiella burnetii RSA 493
uaaugcggcauucaauggc

SEQ ID NO: 563606 - RNA, 19 nt, Coxiella burnetii RSA 493
uacaaaagcgccgaaaucc

SEQ ID NO: 563607 - RNA, 21 nt, Coxiella burnetii RSA 493
uacaaagagaagcaacuuuaa

SEQ ID NO: 563608 - RNA, 16 nt, Coxiella burnetii RSA 493
uacaaauaccaaaugg

SEQ ID NO: 563609 - RNA, 15 nt, Coxiella burnetii RSA 493
uacaaauuuuuaaga

SEQ ID NO: 563610 - RNA, 12 nt, Coxiella burnetii RSA 493
uacaaaaauacu

SEQ ID NO: 563611 - RNA, 22 nt, Coxiella burnetii RSA 493
uaauuuuugaguucuuuaagau

SEQ ID NO: 563612 - RNA, 13 nt, Coxiella burnetii RSA 493
uaauuuuuuuaau

SEQ ID NO: 563613 - RNA, 12 nt, Coxiella burnetii RSA 493
uaauuuuuccuu

SEQ ID NO: 563614 - RNA, 18 nt, Coxiella burnetii RSA 493
uaauuuuccuuuucuauu

SEQ ID NO: 563615 - RNA, 12 nt, Coxiella burnetii RSA 493
uaauuuguuuga

SEQ ID NO: 563616 - RNA, 13 nt, Coxiella burnetii RSA 493
uaauuuuuaaagc

SEQ ID NO: 563617 - RNA, 23 nt, Coxiella burnetii RSA 493
uaauugccgauauucuuuuucuu

SEQ ID NO: 563618 - RNA, 16 nt, Coxiella burnetii RSA 493
uaauugcauguuugcu

SEQ ID NO: 563619 - RNA, 19 nt, Coxiella burnetii RSA 493
uaauugaggaaaauaagau

SEQ ID NO: 563620 - RNA, 16 nt, Coxiella burnetii RSA 493
uaauugagguuuuaau

SEQ ID NO: 563621 - RNA, 14 nt, Coxiella burnetii RSA 493
uaauuugaaaaacc

SEQ ID NO: 563622 - RNA, 13 nt, Coxiella burnetii RSA 493
uaauuugauuuuu

SEQ ID NO: 563623 - RNA, 15 nt, Coxiella burnetii RSA 493
uaauuucagggaacu

SEQ ID NO: 563624 - RNA, 21 nt, Coxiella burnetii RSA 493
uaauaucgcuauaauuagaua

SEQ ID NO: 563625 - RNA, 22 nt, Coxiella burnetii RSA 493
uaauauuaaaacaagacaacaa

SEQ ID NO: 563626 - RNA, 20 nt, Coxiella burnetii RSA 493
uaauauguuuuuuauacauu

SEQ ID NO: 563627 - RNA, 23 nt, Coxiella burnetii RSA 493
uaauauguuuuuuauacauuggu

SEQ ID NO: 563628 - RNA, 15 nt, Coxiella burnetii RSA 493
uaauauuauugagaa

SEQ ID NO: 563629 - RNA, 18 nt, Coxiella burnetii RSA 493
uaauauuauugagaaucu

SEQ ID NO: 563630 - RNA, 17 nt, Coxiella burnetii RSA 493
uaaucaauugcuagucc

SEQ ID NO: 563631 - RNA, 18 nt, Coxiella burnetii RSA 493
uaaucaauugcuaguccu

SEQ ID NO: 563632 - RNA, 20 nt, Coxiella burnetii RSA 493
uaaucacaucccuuuucauu

SEQ ID NO: 563633 - RNA, 16 nt, Coxiella burnetii RSA 493
uaauccacauauuuuu

SEQ ID NO: 563634 - RNA, 18 nt, Coxiella burnetii RSA 493
uaauccaaggaaagguca

SEQ ID NO: 563635 - RNA, 19 nt, Coxiella burnetii RSA 493
uaauccaaggaaaggucag

SEQ ID NO: 563636 - RNA, 14 nt, Coxiella burnetii RSA 493
uaaucauuuuuccu

SEQ ID NO: 563637 - RNA, 20 nt, Coxiella burnetii RSA 493
uaaucauuaacgaaucgucu

SEQ ID NO: 563638 - RNA, 20 nt, Coxiella burnetii RSA 493
uaauacggcuuuauuuugga

SEQ ID NO: 563639 - RNA, 16 nt, Coxiella burnetii RSA 493
uaauaggaaaaaugau

SEQ ID NO: 563640 - RNA, 16 nt, Coxiella burnetii RSA 493
uaauauaaucagcaag

SEQ ID NO: 563641 - RNA, 13 nt, Coxiella burnetii RSA 493
uaauauaauugag

SEQ ID NO: 563642 - RNA, 15 nt, Coxiella burnetii RSA 493
uaauauaauugaggu

SEQ ID NO: 563643 - RNA, 16 nt, Coxiella burnetii RSA 493
uaauaauguuauuaaa

SEQ ID NO: 563644 - RNA, 22 nt, Coxiella burnetii RSA 493
uaauaaugucugcauuuuuaau

SEQ ID NO: 563645 - RNA, 18 nt, Coxiella burnetii RSA 493
uaauacaaggaaaauccg

SEQ ID NO: 563646 - RNA, 14 nt, Coxiella burnetii RSA 493
uaauacaggaaaaa

SEQ ID NO: 563647 - RNA, 17 nt, Coxiella burnetii RSA 493
uaauacccguuucuuau

SEQ ID NO: 563648 - RNA, 22 nt, Coxiella burnetii RSA 493
uaauacccguuucuuauucauu

SEQ ID NO: 563649 - RNA, 20 nt, Coxiella burnetii RSA 493
uaauaacgcuaugaaaacca

SEQ ID NO: 563650 - RNA, 23 nt, Coxiella burnetii RSA 493
uaauaacgcuaugaaaaccacaa

SEQ ID NO: 563651 - RNA, 18 nt, Coxiella burnetii RSA 493
uaauaaggcuaauuuucc

SEQ ID NO: 563652 - RNA, 19 nt, Coxiella burnetii RSA 493
uaauaaggcuaauuuuccu

SEQ ID NO: 563653 - RNA, 21 nt, Coxiella burnetii RSA 493
uaauaaggcuaauuuuccuuu

SEQ ID NO: 563654 - RNA, 16 nt, Coxiella burnetii RSA 493
uaauaaggguaauagu

SEQ ID NO: 563655 - RNA, 15 nt, Coxiella burnetii RSA 493
uacaguaaauaauca

SEQ ID NO: 563656 - RNA, 20 nt, Coxiella burnetii RSA 493
uacauagccucuauaaauaa

SEQ ID NO: 563657 - RNA, 13 nt, Coxiella burnetii RSA 493
uacauauuucuuu

SEQ ID NO: 563658 - RNA, 17 nt, Coxiella burnetii RSA 493
uacaucguugggaugau

SEQ ID NO: 563659 - RNA, 15 nt, Coxiella burnetii RSA 493
uaccacuugcacacu

SEQ ID NO: 563660 - RNA, 12 nt, Coxiella burnetii RSA 493
uaccagcaguga

SEQ ID NO: 563661 - RNA, 18 nt, Coxiella burnetii RSA 493
uaccagcagugaaauauc

SEQ ID NO: 563662 - RNA, 17 nt, Coxiella burnetii RSA 493
uaccaugguuccagaaa

SEQ ID NO: 563663 - RNA, 19 nt, Coxiella burnetii RSA 493
uaccaugguuccagaaaca

SEQ ID NO: 563664 - RNA, 18 nt, Coxiella burnetii RSA 493
uaccauacagaauuucuu

SEQ ID NO: 563665 - RNA, 13 nt, Coxiella burnetii RSA 493
uacccaacaauaa

SEQ ID NO: 563666 - RNA, 14 nt, Coxiella burnetii RSA 493
uaccauuuuuaaau

SEQ ID NO: 563667 - RNA, 22 nt, Coxiella burnetii RSA 493
uacccagguaguaauuucuucc

SEQ ID NO: 563668 - RNA, 23 nt, Coxiella burnetii RSA 493
uaccgacauggcgguaaugagaa

SEQ ID NO: 563669 - RNA, 21 nt, Coxiella burnetii RSA 493
uaccgcaaguggggacaguga

SEQ ID NO: 563670 - RNA, 19 nt, Coxiella burnetii RSA 493
uacccgaggaugaugaaaa

SEQ ID NO: 563671 - RNA, 19 nt, Coxiella burnetii RSA 493
uacuagcggauuguaaaca

SEQ ID NO: 563672 - RNA, 15 nt, Coxiella burnetii RSA 493
uacucuacucccuaa

SEQ ID NO: 563673 - RNA, 16 nt, Coxiella burnetii RSA 493
uacugacguuugagag

SEQ ID NO: 563674 - RNA, 12 nt, Coxiella burnetii RSA 493
uacugagaaaac

SEQ ID NO: 563675 - RNA, 16 nt, Coxiella burnetii RSA 493
uacucuuuuucuuaga

SEQ ID NO: 563676 - RNA, 15 nt, Coxiella burnetii RSA 493
uacgcgcuucuuuua

SEQ ID NO: 563677 - RNA, 16 nt, Coxiella burnetii RSA 493
uacguauucaugacaa

SEQ ID NO: 563678 - RNA, 17 nt, Coxiella burnetii RSA 493
uacgggauucaauuuca

SEQ ID NO: 563679 - RNA, 13 nt, Coxiella burnetii RSA 493
uacgggaaaacaa

SEQ ID NO: 563680 - RNA, 14 nt, Coxiella burnetii RSA 493
uacgggaaaacaau

SEQ ID NO: 563681 - RNA, 15 nt, Coxiella burnetii RSA 493
uacuaaauuaguaau

SEQ ID NO: 563682 - RNA, 16 nt, Coxiella burnetii RSA 493
uacgucuuuucuguga

SEQ ID NO: 563683 - RNA, 16 nt, Coxiella burnetii RSA 493
uacgccaaccauaauc

SEQ ID NO: 563684 - RNA, 17 nt, Coxiella burnetii RSA 493
uacgacuucauuucuac

SEQ ID NO: 563685 - RNA, 19 nt, Coxiella burnetii RSA 493
uaccguggccggcaaugca

SEQ ID NO: 563686 - RNA, 13 nt, Coxiella burnetii RSA 493
uaccgugaauaaa

SEQ ID NO: 563687 - RNA, 16 nt, Coxiella burnetii RSA 493
gucauccauucuuuca

SEQ ID NO: 563688 - RNA, 14 nt, Coxiella burnetii RSA 493
guccaaaaaaguuu

SEQ ID NO: 563689 - RNA, 20 nt, Coxiella burnetii RSA 493
gucauuuuggauaagauucg

SEQ ID NO: 563690 - RNA, 19 nt, Coxiella burnetii RSA 493
gucauuuuuuauaaaauuu

SEQ ID NO: 563691 - RNA, 23 nt, Coxiella burnetii RSA 493
gucaucgcauacagcggaacacc

SEQ ID NO: 563692 - RNA, 19 nt, Coxiella burnetii RSA 493
gucccaggaaagauauucu

SEQ ID NO: 563693 - RNA, 13 nt, Coxiella burnetii RSA 493
gucagcccaacua

SEQ ID NO: 563694 - RNA, 19 nt, Coxiella burnetii RSA 493
guccuucucaguuaaaaua

SEQ ID NO: 563695 - RNA, 21 nt, Coxiella burnetii RSA 493
guccuucucaguuaaaauaau

SEQ ID NO: 563696 - RNA, 14 nt, Coxiella burnetii RSA 493
guccugcuuuugca

SEQ ID NO: 563697 - RNA, 18 nt, Coxiella burnetii RSA 493
guccucccggcuuuaaaa

SEQ ID NO: 563698 - RNA, 17 nt, Coxiella burnetii RSA 493
guccuaaggauaggauc

SEQ ID NO: 563699 - RNA, 15 nt, Coxiella burnetii RSA 493
gucggcaccaaaauc

SEQ ID NO: 563700 - RNA, 16 nt, Coxiella burnetii RSA 493
gucgccugcuaaaaua

SEQ ID NO: 563701 - RNA, 14 nt, Coxiella burnetii RSA 493
gucucugcuucauu

SEQ ID NO: 563702 - RNA, 22 nt, Coxiella burnetii RSA 493
gucguucuuuuccuguggugcg

SEQ ID NO: 563703 - RNA, 22 nt, Coxiella burnetii RSA 493
gucugggugauaaggauuaucu

SEQ ID NO: 563704 - RNA, 21 nt, Coxiella burnetii RSA 493
gucugcgacgacgcuuugguu

SEQ ID NO: 563705 - RNA, 20 nt, Coxiella burnetii RSA 493
gucugaacaggcagaugauu

SEQ ID NO: 563706 - RNA, 17 nt, Coxiella burnetii RSA 493
gucuuggagauuuagcc

SEQ ID NO: 563707 - RNA, 21 nt, Coxiella burnetii RSA 493
gucuucucuugcgccuuaaua

SEQ ID NO: 563708 - RNA, 15 nt, Coxiella burnetii RSA 493
gucuuaauuuuaaaa

SEQ ID NO: 563709 - RNA, 16 nt, Coxiella burnetii RSA 493
gucuuaauuuuaaaaa

SEQ ID NO: 563710 - RNA, 17 nt, Coxiella burnetii RSA 493
gucuuaauuuuaaaaaa

SEQ ID NO: 563711 - RNA, 22 nt, Coxiella burnetii RSA 493
gucuucaaaagugauuuuucuu

SEQ ID NO: 563712 - RNA, 12 nt, Coxiella burnetii RSA 493
gucuguuucuuc

SEQ ID NO: 563713 - RNA, 15 nt, Coxiella burnetii RSA 493
aaauagcauuaauaa

SEQ ID NO: 563714 - RNA, 12 nt, Coxiella burnetii RSA 493
gugaaaguuuca

SEQ ID NO: 563715 - RNA, 19 nt, Coxiella burnetii RSA 493
gugaaaaauucuaaggcgu

SEQ ID NO: 563716 - RNA, 14 nt, Coxiella burnetii RSA 493
gugaaaacgcucga

SEQ ID NO: 563717 - RNA, 15 nt, Coxiella burnetii RSA 493
gucuugguuguuucu

SEQ ID NO: 563718 - RNA, 22 nt, Coxiella burnetii RSA 493
gucuuugaugugaaaaauucua

SEQ ID NO: 563719 - RNA, 17 nt, Coxiella burnetii RSA 493
gucuuugguuuuccaug

SEQ ID NO: 563720 - RNA, 18 nt, Coxiella burnetii RSA 493
gucuuuguagauucuuuc

SEQ ID NO: 563721 - RNA, 19 nt, Coxiella burnetii RSA 493
gucuuuucugugaaauaaa

SEQ ID NO: 563722 - RNA, 20 nt, Coxiella burnetii RSA 493
gucuuuucugugaaauaaac

SEQ ID NO: 563723 - RNA, 13 nt, Coxiella burnetii RSA 493
gucuuuuuuucuu

SEQ ID NO: 563724 - RNA, 17 nt, Coxiella burnetii RSA 493
aaauaguuucaauuucg

SEQ ID NO: 563725 - RNA, 13 nt, Coxiella burnetii RSA 493
gugacgcugcaau

SEQ ID NO: 563726 - RNA, 16 nt, Coxiella burnetii RSA 493
aaauagccauuaauaa

SEQ ID NO: 563727 - RNA, 21 nt, Coxiella burnetii RSA 493
aaauagcuugacgauauugau

SEQ ID NO: 563728 - RNA, 18 nt, Coxiella burnetii RSA 493
gugaagauugccacucuu

SEQ ID NO: 563729 - RNA, 20 nt, Coxiella burnetii RSA 493
gugaacgucccuaaaguggg

SEQ ID NO: 563730 - RNA, 16 nt, Coxiella burnetii RSA 493
gugauucauuaucaug

SEQ ID NO: 563731 - RNA, 21 nt, Coxiella burnetii RSA 493
gugcaauuccauuaaaaacaa

SEQ ID NO: 563732 - RNA, 22 nt, Coxiella burnetii RSA 493
gugcaauuguggcccgacgcuc

SEQ ID NO: 563733 - RNA, 15 nt, Coxiella burnetii RSA 493
gugcaauuucuggcu

SEQ ID NO: 563734 - RNA, 17 nt, Coxiella burnetii RSA 493
gugcaauuucuggcuug

SEQ ID NO: 563735 - RNA, 22 nt, Coxiella burnetii RSA 493
gugagagagccgaucgcuguga

SEQ ID NO: 563736 - RNA, 16 nt, Coxiella burnetii RSA 493
gugcuggcguuuuuaa

SEQ ID NO: 563737 - RNA, 21 nt, Coxiella burnetii RSA 493
guggaacgguuauaaacauaa

SEQ ID NO: 563738 - RNA, 19 nt, Coxiella burnetii RSA 493
guggagcaaguuuucuaua

SEQ ID NO: 563739 - RNA, 17 nt, Coxiella burnetii RSA 493
guggcaguuaaauuuuu

SEQ ID NO: 563740 - RNA, 18 nt, Coxiella burnetii RSA 493
guggcauuaaaagauuua

SEQ ID NO: 563741 - RNA, 16 nt, Coxiella burnetii RSA 493
gugucucuauaccaua

SEQ ID NO: 563742 - RNA, 16 nt, Coxiella burnetii RSA 493
gugguuguguggcuuc

SEQ ID NO: 563743 - RNA, 16 nt, Coxiella burnetii RSA 493
gugguuaacuucauua

SEQ ID NO: 563744 - RNA, 22 nt, Coxiella burnetii RSA 493
gugguuaauucuucuucauuua

SEQ ID NO: 563745 - RNA, 14 nt, Coxiella burnetii RSA 493
guguagaaagaaag

SEQ ID NO: 563746 - RNA, 17 nt, Coxiella burnetii RSA 493
guggggucuucaucuuu

SEQ ID NO: 563747 - RNA, 20 nt, Coxiella burnetii RSA 493
gugggggaacagaggacaga

SEQ ID NO: 563748 - RNA, 18 nt, Coxiella burnetii RSA 493
guguuaagucguuaacag

SEQ ID NO: 563749 - RNA, 16 nt, Coxiella burnetii RSA 493
gugugucucuauacca

SEQ ID NO: 563750 - RNA, 22 nt, Coxiella burnetii RSA 493
gugugcccccccaauuccucga

SEQ ID NO: 563751 - RNA, 14 nt, Coxiella burnetii RSA 493
gugugauaaucaug

SEQ ID NO: 563752 - RNA, 18 nt, Coxiella burnetii RSA 493
gugugauucauuaucaug

SEQ ID NO: 563753 - RNA, 18 nt, Coxiella burnetii RSA 493
aaauaucaucaacagaac

SEQ ID NO: 563754 - RNA, 12 nt, Coxiella burnetii RSA 493
guguugagagaa

SEQ ID NO: 563755 - RNA, 12 nt, Coxiella burnetii RSA 493
guuaaaagcgcc

SEQ ID NO: 563756 - RNA, 12 nt, Coxiella burnetii RSA 493
guuaauucuucu

SEQ ID NO: 563757 - RNA, 20 nt, Coxiella burnetii RSA 493
guuaauucuucuucauuuau

SEQ ID NO: 563758 - RNA, 21 nt, Coxiella burnetii RSA 493
guuaauucuucuucauuuauu

SEQ ID NO: 563759 - RNA, 17 nt, Coxiella burnetii RSA 493
guuaauuucauaaauca

SEQ ID NO: 563760 - RNA, 18 nt, Coxiella burnetii RSA 493
guuaauuucauaaaucaa

SEQ ID NO: 563761 - RNA, 14 nt, Coxiella burnetii RSA 493
guuagcuuccauug

SEQ ID NO: 563762 - RNA, 12 nt, Coxiella burnetii RSA 493
guuagcuuuucu

SEQ ID NO: 563763 - RNA, 22 nt, Coxiella burnetii RSA 493
guuaggagcaaguacagguugu

SEQ ID NO: 563764 - RNA, 16 nt, Coxiella burnetii RSA 493
guuacuucuuuuucga

SEQ ID NO: 563765 - RNA, 15 nt, Coxiella burnetii RSA 493
guuaccgaugaguug

SEQ ID NO: 563766 - RNA, 20 nt, Coxiella burnetii RSA 493
guuaccggcaaacccaucuc

SEQ ID NO: 563767 - RNA, 13 nt, Coxiella burnetii RSA 493
guuauauuagaca

SEQ ID NO: 563768 - RNA, 13 nt, Coxiella burnetii RSA 493
guuauagccgcgu

SEQ ID NO: 563769 - RNA, 13 nt, Coxiella burnetii RSA 493
guuagugggaagc

SEQ ID NO: 563770 - RNA, 23 nt, Coxiella burnetii RSA 493
guuaucuuaauuuaaucuacucu

SEQ ID NO: 563771 - RNA, 20 nt, Coxiella burnetii RSA 493
guuaugggaauuaaacacaa

SEQ ID NO: 563772 - RNA, 22 nt, Coxiella burnetii RSA 493
guuccauaauguuugauccuug

SEQ ID NO: 563773 - RNA, 23 nt, Coxiella burnetii RSA 493
guuccaugacaugcgccacuaaa

SEQ ID NO: 563774 - RNA, 17 nt, Coxiella burnetii RSA 493
guuccgcagccuaaauc

SEQ ID NO: 563775 - RNA, 20 nt, Coxiella burnetii RSA 493
guuccuuacucccgaaaaag

SEQ ID NO: 563776 - RNA, 21 nt, Coxiella burnetii RSA 493
guuccuugagaguaaauguuu

SEQ ID NO: 563777 - RNA, 16 nt, Coxiella burnetii RSA 493
guuauuuuucaucuug

SEQ ID NO: 563778 - RNA, 18 nt, Coxiella burnetii RSA 493
guuauuuauuuuucucuu

SEQ ID NO: 563779 - RNA, 14 nt, Coxiella burnetii RSA 493
guuauuguuaacac

SEQ ID NO: 563780 - RNA, 13 nt, Coxiella burnetii RSA 493
guuccagaaacau

SEQ ID NO: 563781 - RNA, 14 nt, Coxiella burnetii RSA 493
guucaugaaaaaga

SEQ ID NO: 563782 - RNA, 14 nt, Coxiella burnetii RSA 493
guucuaaggcuucc

SEQ ID NO: 563783 - RNA, 12 nt, Coxiella burnetii RSA 493
guucuaauaauu

SEQ ID NO: 563784 - RNA, 15 nt, Coxiella burnetii RSA 493
guugcugagcaaaca

SEQ ID NO: 563785 - RNA, 16 nt, Coxiella burnetii RSA 493
guugguuagcaauggg

SEQ ID NO: 563786 - RNA, 15 nt, Coxiella burnetii RSA 493
guugcuuuugcucuu

SEQ ID NO: 563787 - RNA, 22 nt, Coxiella burnetii RSA 493
aaauaucugcuaggauuuuuua

SEQ ID NO: 563788 - RNA, 16 nt, Coxiella burnetii RSA 493
guuucacgaauuaaaa

SEQ ID NO: 563789 - RNA, 16 nt, Coxiella burnetii RSA 493
guuucaugcucaagcg

SEQ ID NO: 563790 - RNA, 21 nt, Coxiella burnetii RSA 493
guuucauaaggccaauuucua

SEQ ID NO: 563791 - RNA, 24 nt, Coxiella burnetii RSA 493
guuucauaaggccaauuucuaauc

SEQ ID NO: 563792 - RNA, 20 nt, Coxiella burnetii RSA 493
aaauauuagaaauaauacuc

SEQ ID NO: 563793 - RNA, 19 nt, Coxiella burnetii RSA 493
guugucaacaaucaguuuu

SEQ ID NO: 563794 - RNA, 23 nt, Coxiella burnetii RSA 493
guugucaacaaucaguuuugaug

SEQ ID NO: 563795 - RNA, 22 nt, Coxiella burnetii RSA 493
guugucauguaaucaauugcua

SEQ ID NO: 563796 - RNA, 20 nt, Coxiella burnetii RSA 493
guuuaacagacagacgcugg

SEQ ID NO: 563797 - RNA, 14 nt, Coxiella burnetii RSA 493
guuuacguauucau

SEQ ID NO: 563798 - RNA, 15 nt, Coxiella burnetii RSA 493
guuuacgucuuuucu

SEQ ID NO: 563799 - RNA, 12 nt, Coxiella burnetii RSA 493
guuuagaaaaau

SEQ ID NO: 563800 - RNA, 21 nt, Coxiella burnetii RSA 493
guuuauauuuacugagaaaac

SEQ ID NO: 563801 - RNA, 20 nt, Coxiella burnetii RSA 493
guuuaucacuccaauaauaa

SEQ ID NO: 563802 - RNA, 18 nt, Coxiella burnetii RSA 493
guuucaauuagcauuuuc

SEQ ID NO: 563803 - RNA, 18 nt, Coxiella burnetii RSA 493
aaauauuugaaccgauaa

SEQ ID NO: 563804 - RNA, 12 nt, Coxiella burnetii RSA 493
aaauauuuauuu

SEQ ID NO: 563805 - RNA, 21 nt, Coxiella burnetii RSA 493
aaauauuucuuuuuuagcuuu

SEQ ID NO: 563806 - RNA, 14 nt, Coxiella burnetii RSA 493
aaauauuuuuauuu

SEQ ID NO: 563807 - RNA, 15 nt, Coxiella burnetii RSA 493
aaauauuuuuauuuc

SEQ ID NO: 563808 - RNA, 21 nt, Coxiella burnetii RSA 493
aaaucaacaccccaauuuuug

SEQ ID NO: 563809 - RNA, 19 nt, Coxiella burnetii RSA 493
guuucucccgauaaguugu

SEQ ID NO: 563810 - RNA, 19 nt, Coxiella burnetii RSA 493
guuucucgauauucuaucu

SEQ ID NO: 563811 - RNA, 17 nt, Coxiella burnetii RSA 493
guuucuacguugccagu

SEQ ID NO: 563812 - RNA, 12 nt, Coxiella burnetii RSA 493
aaaucaaucccc

SEQ ID NO: 563813 - RNA, 18 nt, Coxiella burnetii RSA 493
aaaucaaguguauuuuca

SEQ ID NO: 563814 - RNA, 22 nt, Coxiella burnetii RSA 493
aaaucaacucgcccauggaaau

SEQ ID NO: 563815 - RNA, 19 nt, Coxiella burnetii RSA 493
guuucgucgauauccaaaa

SEQ ID NO: 563816 - RNA, 16 nt, Coxiella burnetii RSA 493
guuucgguuucuaucg

SEQ ID NO: 563817 - RNA, 21 nt, Coxiella burnetii RSA 493
guuugauaagguaucccuucg

SEQ ID NO: 563818 - RNA, 23 nt, Coxiella burnetii RSA 493
guuugauaucaaucgaaaaaaau

SEQ ID NO: 563819 - RNA, 15 nt, Coxiella burnetii RSA 493
guuuuacguuuaaau

SEQ ID NO: 563820 - RNA, 20 nt, Coxiella burnetii RSA 493
guuuuacguuuaaauaacaa

SEQ ID NO: 563821 - RNA, 20 nt, Coxiella burnetii RSA 493
guuuuaccuuacuuucauca

SEQ ID NO: 563822 - RNA, 20 nt, Coxiella burnetii RSA 493
guuuguccuugccgcugcgg

SEQ ID NO: 563823 - RNA, 22 nt, Coxiella burnetii RSA 493
guuuuauuugaaaguagaaaac

SEQ ID NO: 563824 - RNA, 18 nt, Coxiella burnetii RSA 493
guuuugauuugaguaaga

SEQ ID NO: 563825 - RNA, 17 nt, Coxiella burnetii RSA 493
guuuugaucagagaaac

SEQ ID NO: 563826 - RNA, 15 nt, Coxiella burnetii RSA 493
guuuugaaauugguc

SEQ ID NO: 563827 - RNA, 21 nt, Coxiella burnetii RSA 493
guuuugaaaaauaaaaggaga

SEQ ID NO: 563828 - RNA, 13 nt, Coxiella burnetii RSA 493
aaauccagaccug

SEQ ID NO: 563829 - RNA, 19 nt, Coxiella burnetii RSA 493
guuuuauacacaucuuuua

SEQ ID NO: 563830 - RNA, 18 nt, Coxiella burnetii RSA 493
gcucauacgggcuacuuu

SEQ ID NO: 563831 - RNA, 14 nt, Coxiella burnetii RSA 493
gcucaugaaaagca

SEQ ID NO: 563832 - RNA, 13 nt, Coxiella burnetii RSA 493
gcuccgauaagug

SEQ ID NO: 563833 - RNA, 18 nt, Coxiella burnetii RSA 493
gcuccuaaauuuucuugu

SEQ ID NO: 563834 - RNA, 21 nt, Coxiella burnetii RSA 493
gcuccucaauuuccuauuuua

SEQ ID NO: 563835 - RNA, 15 nt, Coxiella burnetii RSA 493
gcuccuuuucuucga

SEQ ID NO: 563836 - RNA, 16 nt, Coxiella burnetii RSA 493
gcucgauucuuugucu

SEQ ID NO: 563837 - RNA, 17 nt, Coxiella burnetii RSA 493
gcucuccuaccaaauaa

SEQ ID NO: 563838 - RNA, 18 nt, Coxiella burnetii RSA 493
gcucuaauucugauuguu

SEQ ID NO: 563839 - RNA, 20 nt, Coxiella burnetii RSA 493
gcucgcuaaucgcaaugcuu

SEQ ID NO: 563840 - RNA, 19 nt, Coxiella burnetii RSA 493
gcugaagcaguagcugaag

SEQ ID NO: 563841 - RNA, 21 nt, Coxiella burnetii RSA 493
gcugaagcgccugucuaaucu

SEQ ID NO: 563842 - RNA, 16 nt, Coxiella burnetii RSA 493
gcugaaguccuuguug

SEQ ID NO: 563843 - RNA, 21 nt, Coxiella burnetii RSA 493
gcugaaguugacgcaacaaaa

SEQ ID NO: 563844 - RNA, 14 nt, Coxiella burnetii RSA 493
gcugaauaagcuga

SEQ ID NO: 563845 - RNA, 23 nt, Coxiella burnetii RSA 493
gcugaauuuuauugucauguuca

SEQ ID NO: 563846 - RNA, 13 nt, Coxiella burnetii RSA 493
gcugaauucaaac

SEQ ID NO: 563847 - RNA, 13 nt, Coxiella burnetii RSA 493
gcugauauuuuuu

SEQ ID NO: 563848 - RNA, 16 nt, Coxiella burnetii RSA 493
gcugauuucucuuuua

SEQ ID NO: 563849 - RNA, 14 nt, Coxiella burnetii RSA 493
gcugcuuuuuaaaa

SEQ ID NO: 563850 - RNA, 21 nt, Coxiella burnetii RSA 493
gcugcuuuugaauuuuuugaa

SEQ ID NO: 563851 - RNA, 13 nt, Coxiella burnetii RSA 493
gcuggaaaaauaa

SEQ ID NO: 563852 - RNA, 14 nt, Coxiella burnetii RSA 493
gcuggaaaaauaaa

SEQ ID NO: 563853 - RNA, 15 nt, Coxiella burnetii RSA 493
gcuggaaaaauaaau

SEQ ID NO: 563854 - RNA, 20 nt, Coxiella burnetii RSA 493
gcugcuccacaaugcauuug

SEQ ID NO: 563855 - RNA, 14 nt, Coxiella burnetii RSA 493
gcugcuaucugcaa

SEQ ID NO: 563856 - RNA, 13 nt, Coxiella burnetii RSA 493
aaaggagaaagug

SEQ ID NO: 563857 - RNA, 21 nt, Coxiella burnetii RSA 493
aaaggagaaauugacaaauaa

SEQ ID NO: 563858 - RNA, 18 nt, Coxiella burnetii RSA 493
aaaggaauucuaauuaaa

SEQ ID NO: 563859 - RNA, 20 nt, Coxiella burnetii RSA 493
gcuguacuuucacuaauuau

SEQ ID NO: 563860 - RNA, 22 nt, Coxiella burnetii RSA 493
gcuggugaggcugauucaaauu

SEQ ID NO: 563861 - RNA, 14 nt, Coxiella burnetii RSA 493
gcuuaaacccagaa

SEQ ID NO: 563862 - RNA, 21 nt, Coxiella burnetii RSA 493
gcuuagcaauguuucaaucug

SEQ ID NO: 563863 - RNA, 14 nt, Coxiella burnetii RSA 493
gcuucaauaaaaaa

SEQ ID NO: 563864 - RNA, 13 nt, Coxiella burnetii RSA 493
gcuucacagagcc

SEQ ID NO: 563865 - RNA, 14 nt, Coxiella burnetii RSA 493
gcuucgcaaagcuc

SEQ ID NO: 563866 - RNA, 17 nt, Coxiella burnetii RSA 493
gcuucgcgaacucagcc

SEQ ID NO: 563867 - RNA, 13 nt, Coxiella burnetii RSA 493
gcuucuuuaaaau

SEQ ID NO: 563868 - RNA, 16 nt, Coxiella burnetii RSA 493
gcuucuuuuaauugac

SEQ ID NO: 563869 - RNA, 17 nt, Coxiella burnetii RSA 493
gcuugacgauauugauu

SEQ ID NO: 563870 - RNA, 21 nt, Coxiella burnetii RSA 493
gcuugugcaauuccauuaaaa

SEQ ID NO: 563871 - RNA, 15 nt, Coxiella burnetii RSA 493
gcuugguuaacgaaa

SEQ ID NO: 563872 - RNA, 16 nt, Coxiella burnetii RSA 493
aaaggcguaagcacaa

SEQ ID NO: 563873 - RNA, 12 nt, Coxiella burnetii RSA 493
gcuuuauucauu

SEQ ID NO: 563874 - RNA, 19 nt, Coxiella burnetii RSA 493
gcuuuauucccgaugggga

SEQ ID NO: 563875 - RNA, 18 nt, Coxiella burnetii RSA 493
gcuuucaauaaauaaauc

SEQ ID NO: 563876 - RNA, 18 nt, Coxiella burnetii RSA 493
gcuuucaacauauuucuu

SEQ ID NO: 563877 - RNA, 21 nt, Coxiella burnetii RSA 493
gcuuucaauuacuuuuauaau

SEQ ID NO: 563878 - RNA, 22 nt, Coxiella burnetii RSA 493
gcuuuaaucgcuccgaaaauaa

SEQ ID NO: 563879 - RNA, 23 nt, Coxiella burnetii RSA 493
gcuuguuccgccauuucccagcu

SEQ ID NO: 563880 - RNA, 22 nt, Coxiella burnetii RSA 493
gcuuuacaccuaagagaaaaaa

SEQ ID NO: 563881 - RNA, 14 nt, Coxiella burnetii RSA 493
ggaacagaggacag

SEQ ID NO: 563882 - RNA, 21 nt, Coxiella burnetii RSA 493
gcuuucgcaggauaauguuug

SEQ ID NO: 563883 - RNA, 21 nt, Coxiella burnetii RSA 493
ggaaauuucgauuuuacaaua

SEQ ID NO: 563884 - RNA, 17 nt, Coxiella burnetii RSA 493
ggaacugaugaauaaca

SEQ ID NO: 563885 - RNA, 15 nt, Coxiella burnetii RSA 493
ggacaacaaauaaau

SEQ ID NO: 563886 - RNA, 22 nt, Coxiella burnetii RSA 493
ggaauucauaaucaaaaucaga

SEQ ID NO: 563887 - RNA, 23 nt, Coxiella burnetii RSA 493
ggaauuugugauuuuaaaaauaa

SEQ ID NO: 563888 - RNA, 13 nt, Coxiella burnetii RSA 493
ggaauguucugau

SEQ ID NO: 563889 - RNA, 20 nt, Coxiella burnetii RSA 493
ggaauacggagaaaaugauu

SEQ ID NO: 563890 - RNA, 18 nt, Coxiella burnetii RSA 493
ggaaugcuaccagcaucc

SEQ ID NO: 563891 - RNA, 14 nt, Coxiella burnetii RSA 493
ggaccuuuuuugca

SEQ ID NO: 563892 - RNA, 19 nt, Coxiella burnetii RSA 493
ggaccuuuuuugcaacuuc

SEQ ID NO: 563893 - RNA, 13 nt, Coxiella burnetii RSA 493
ggacagaggacag

SEQ ID NO: 563894 - RNA, 12 nt, Coxiella burnetii RSA 493
ggagacugcuuu

SEQ ID NO: 563895 - RNA, 19 nt, Coxiella burnetii RSA 493
ggacucugcgauuguuuuc

SEQ ID NO: 563896 - RNA, 17 nt, Coxiella burnetii RSA 493
aaaggucaggcaauuuu

SEQ ID NO: 563897 - RNA, 20 nt, Coxiella burnetii RSA 493
aaaggucaggcaauuuugau

SEQ ID NO: 563898 - RNA, 14 nt, Coxiella burnetii RSA 493
aaagguaaaaaacu

SEQ ID NO: 563899 - RNA, 19 nt, Coxiella burnetii RSA 493
ggaguucuugcucccaagc

SEQ ID NO: 563900 - RNA, 15 nt, Coxiella burnetii RSA 493
ggagugguuauaauu

SEQ ID NO: 563901 - RNA, 20 nt, Coxiella burnetii RSA 493
ggauaauaucuagauuuaaa

SEQ ID NO: 563902 - RNA, 17 nt, Coxiella burnetii RSA 493
ggauacgaccuucugaa

SEQ ID NO: 563903 - RNA, 16 nt, Coxiella burnetii RSA 493
ggaugaucgagaggag

SEQ ID NO: 563904 - RNA, 13 nt, Coxiella burnetii RSA 493
aaaguaauauuuc

SEQ ID NO: 563905 - RNA, 15 nt, Coxiella burnetii RSA 493
ggaugucauaaucac

SEQ ID NO: 563906 - RNA, 14 nt, Coxiella burnetii RSA 493
aaaguaauuuuaaa

SEQ ID NO: 563907 - RNA, 15 nt, Coxiella burnetii RSA 493
aaaguaauuuuaaaa

SEQ ID NO: 563908 - RNA, 20 nt, Coxiella burnetii RSA 493
aaaguaauuuuaaaaaaaau

SEQ ID NO: 563909 - RNA, 20 nt, Coxiella burnetii RSA 493
ggaugcgaagcaugcugauu

SEQ ID NO: 563910 - RNA, 16 nt, Coxiella burnetii RSA 493
ggauuuucaaaagagg

SEQ ID NO: 563911 - RNA, 15 nt, Coxiella burnetii RSA 493
ggauuuugaacaguu

SEQ ID NO: 563912 - RNA, 11 nt, Coxiella burnetii RSA 493
ggcaaaaaaag

SEQ ID NO: 563913 - RNA, 12 nt, Coxiella burnetii RSA 493
ggcaaaaaaaga

SEQ ID NO: 563914 - RNA, 21 nt, Coxiella burnetii RSA 493
aaagucagcuuuggaaaaaca

SEQ ID NO: 563915 - RNA, 22 nt, Coxiella burnetii RSA 493
aaagucagcuuuggaaaaacau

SEQ ID NO: 563916 - RNA, 17 nt, Coxiella burnetii RSA 493
ggcauggccaguacagc

SEQ ID NO: 563917 - RNA, 21 nt, Coxiella burnetii RSA 493
aaaguccucccggcuuuaaaa

SEQ ID NO: 563918 - RNA, 17 nt, Coxiella burnetii RSA 493
aaagucgacuuugauaa

SEQ ID NO: 563919 - RNA, 22 nt, Coxiella burnetii RSA 493
aaagucgcauagccaaccgcca

SEQ ID NO: 563920 - RNA, 18 nt, Coxiella burnetii RSA 493
aaagugaugauuaaacgu

SEQ ID NO: 563921 - RNA, 21 nt, Coxiella burnetii RSA 493
aaagugagccgcuaauaacau

SEQ ID NO: 563922 - RNA, 17 nt, Coxiella burnetii RSA 493
aaauacgggaaaacaau

SEQ ID NO: 563923 - RNA, 16 nt, Coxiella burnetii RSA 493
aaauaccggaagagca

SEQ ID NO: 563924 - RNA, 18 nt, Coxiella burnetii RSA 493
aaauaccucuucuaaagu

SEQ ID NO: 563925 - RNA, 21 nt, Coxiella burnetii RSA 493
aaauaccucuucuaaaguacu

SEQ ID NO: 563926 - RNA, 17 nt, Coxiella burnetii RSA 493
aaauaccuuugcaaaca

SEQ ID NO: 563927 - RNA, 16 nt, Coxiella burnetii RSA 493
ggcgguaaugagaacc

SEQ ID NO: 563928 - RNA, 18 nt, Coxiella burnetii RSA 493
aaauacaguaaauaauca

SEQ ID NO: 563929 - RNA, 19 nt, Coxiella burnetii RSA 493
aaauacaguaaauaaucau

SEQ ID NO: 563930 - RNA, 16 nt, Coxiella burnetii RSA 493
aaauaauucgcacaau

SEQ ID NO: 563931 - RNA, 10 nt, Coxiella burnetii RSA 493
aaauaagcca

SEQ ID NO: 563932 - RNA, 18 nt, Coxiella burnetii RSA 493
aaauaagguuaaaucccu

SEQ ID NO: 563933 - RNA, 13 nt, Coxiella burnetii RSA 493
aaauaaugacaau

SEQ ID NO: 563934 - RNA, 23 nt, Coxiella burnetii RSA 493
aaauaaugcuaagugauugauuu

SEQ ID NO: 563935 - RNA, 15 nt, Coxiella burnetii RSA 493
aaauaaugucuccaa

SEQ ID NO: 563936 - RNA, 15 nt, Coxiella burnetii RSA 493
aaauaaucauuuuua

SEQ ID NO: 563937 - RNA, 22 nt, Coxiella burnetii RSA 493
aaauaauccaagggaucauaau

SEQ ID NO: 563938 - RNA, 16 nt, Coxiella burnetii RSA 493
aaauaaccugagggaa

SEQ ID NO: 563939 - RNA, 22 nt, Coxiella burnetii RSA 493
aaauaaccuuucgcuuguuuau

SEQ ID NO: 563940 - RNA, 22 nt, Coxiella burnetii RSA 493
aaauaacguugucuuauuuugu

SEQ ID NO: 563941 - RNA, 13 nt, Coxiella burnetii RSA 493
aaauaacucaucg

SEQ ID NO: 563942 - RNA, 11 nt, Coxiella burnetii RSA 493
ggcgagcgcgc

SEQ ID NO: 563943 - RNA, 15 nt, Coxiella burnetii RSA 493
aaauaagaaacuuug

SEQ ID NO: 563944 - RNA, 21 nt, Coxiella burnetii RSA 493
ggcugagcuugcgaagcccaa

SEQ ID NO: 563945 - RNA, 15 nt, Coxiella burnetii RSA 493
ggcugaaaaaauuaa

SEQ ID NO: 563946 - RNA, 15 nt, Coxiella burnetii RSA 493
ggcugaagaggcuga

SEQ ID NO: 563947 - RNA, 12 nt, Coxiella burnetii RSA 493
ggcugaauaagc

SEQ ID NO: 563948 - RNA, 14 nt, Coxiella burnetii RSA 493
ggcugaauagagag

SEQ ID NO: 563949 - RNA, 19 nt, Coxiella burnetii RSA 493
ggcugcggcgauucaugag

SEQ ID NO: 563950 - RNA, 11 nt, Coxiella burnetii RSA 493
ggcucuucaua

SEQ ID NO: 563951 - RNA, 21 nt, Coxiella burnetii RSA 493
ggcuucuaaguaaacagcauu

SEQ ID NO: 563952 - RNA, 21 nt, Coxiella burnetii RSA 493
ggcuugagggcuguccucugc

SEQ ID NO: 563953 - RNA, 14 nt, Coxiella burnetii RSA 493
ggcuugauuucagg

SEQ ID NO: 563954 - RNA, 18 nt, Coxiella burnetii RSA 493
ggcuugauuucaggcgcc

SEQ ID NO: 563955 - RNA, 13 nt, Coxiella burnetii RSA 493
ggcuugcuaugau

SEQ ID NO: 563956 - RNA, 14 nt, Coxiella burnetii RSA 493
ggcuucauacagaa

SEQ ID NO: 563957 - RNA, 22 nt, Coxiella burnetii RSA 493
ggcuucgcaaagcucagcccaa

SEQ ID NO: 563958 - RNA, 21 nt, Coxiella burnetii RSA 493
ggcuuaaguuuuugauagggu

SEQ ID NO: 563959 - RNA, 18 nt, Coxiella burnetii RSA 493
gggaaccgccaaaaggga

SEQ ID NO: 563960 - RNA, 17 nt, Coxiella burnetii RSA 493
gggagcgagcauauaaa

SEQ ID NO: 563961 - RNA, 23 nt, Coxiella burnetii RSA 493
gggaggcauucugggcacccagu

SEQ ID NO: 563962 - RNA, 17 nt, Coxiella burnetii RSA 493
gggaguaaugacagaaa

SEQ ID NO: 563963 - RNA, 18 nt, Coxiella burnetii RSA 493
gggcaaaaaaagaaaauc

SEQ ID NO: 563964 - RNA, 18 nt, Coxiella burnetii RSA 493
gggauuaauuuuccacuc

SEQ ID NO: 563965 - RNA, 18 nt, Coxiella burnetii RSA 493
gggauugggauaauaacu

SEQ ID NO: 563966 - RNA, 20 nt, Coxiella burnetii RSA 493
gggcauucuuacggcucacg

SEQ ID NO: 563967 - RNA, 20 nt, Coxiella burnetii RSA 493
gggcuacucuaauuuucuuu

SEQ ID NO: 563968 - RNA, 21 nt, Coxiella burnetii RSA 493
gggcuacucuaauuuucuuuc

SEQ ID NO: 563969 - RNA, 22 nt, Coxiella burnetii RSA 493
gggcuacuuuacuuguugaaaa

SEQ ID NO: 563970 - RNA, 19 nt, Coxiella burnetii RSA 493
gggcuaguaugcuauaauu

SEQ ID NO: 563971 - RNA, 18 nt, Coxiella burnetii RSA 493
gggcggcaacucuacuuc

SEQ ID NO: 563972 - RNA, 21 nt, Coxiella burnetii RSA 493
ggggaucguuucugguuuccu

SEQ ID NO: 563973 - RNA, 17 nt, Coxiella burnetii RSA 493
ggggaugaucgagagga

SEQ ID NO: 563974 - RNA, 15 nt, Coxiella burnetii RSA 493
gggcugucuucucuu

SEQ ID NO: 563975 - RNA, 11 nt, Coxiella burnetii RSA 493
ggggaaauaau

SEQ ID NO: 563976 - RNA, 22 nt, Coxiella burnetii RSA 493
gggucaauugcaaaacagcccc

SEQ ID NO: 563977 - RNA, 12 nt, Coxiella burnetii RSA 493
ggguaaauuuau

SEQ ID NO: 563978 - RNA, 18 nt, Coxiella burnetii RSA 493
gguaaagccguuauccau

SEQ ID NO: 563979 - RNA, 12 nt, Coxiella burnetii RSA 493
gguaaugcuucu

SEQ ID NO: 563980 - RNA, 22 nt, Coxiella burnetii RSA 493
ggguugucugauugcggcucaa

SEQ ID NO: 563981 - RNA, 17 nt, Coxiella burnetii RSA 493
gggugauugaaaauccc

SEQ ID NO: 563982 - RNA, 19 nt, Coxiella burnetii RSA 493
gggugcaguuugggggcgu

SEQ ID NO: 563983 - RNA, 22 nt, Coxiella burnetii RSA 493
gguagagcacaaccuugccaag

SEQ ID NO: 563984 - RNA, 15 nt, Coxiella burnetii RSA 493
gguagcccgaaaaag

SEQ ID NO: 563985 - RNA, 16 nt, Coxiella burnetii RSA 493
gguacaagcgcuuggu

SEQ ID NO: 563986 - RNA, 16 nt, Coxiella burnetii RSA 493
ggucgcggaaaauuua

SEQ ID NO: 563987 - RNA, 14 nt, Coxiella burnetii RSA 493
ggucuucaucuuua

SEQ ID NO: 563988 - RNA, 14 nt, Coxiella burnetii RSA 493
ggucucaacagccu

SEQ ID NO: 563989 - RNA, 17 nt, Coxiella burnetii RSA 493
ggucauccauucuuuca

SEQ ID NO: 563990 - RNA, 14 nt, Coxiella burnetii RSA 493
gccucgccuucuuc

SEQ ID NO: 563991 - RNA, 19 nt, Coxiella burnetii RSA 493
gccuccggcgcgcgcuuga

SEQ ID NO: 563992 - RNA, 23 nt, Coxiella burnetii RSA 493
gccuaaucggccuacuuuuucug

SEQ ID NO: 563993 - RNA, 17 nt, Coxiella burnetii RSA 493
gccguuauaaaguguuu

SEQ ID NO: 563994 - RNA, 16 nt, Coxiella burnetii RSA 493
gccguggccauuuguc

SEQ ID NO: 563995 - RNA, 13 nt, Coxiella burnetii RSA 493
gccgcugugccug

SEQ ID NO: 563996 - RNA, 12 nt, Coxiella burnetii RSA 493
gccuuaaaacau

SEQ ID NO: 563997 - RNA, 21 nt, Coxiella burnetii RSA 493
gccuuaaaacauaaaggccaa

SEQ ID NO: 563998 - RNA, 22 nt, Coxiella burnetii RSA 493
gccucuauaaauaacagcgaac

SEQ ID NO: 563999 - RNA, 23 nt, Coxiella burnetii RSA 493
gccucugaauugaaguccuuauc

SEQ ID NO: 564000 - RNA, 17 nt, Coxiella burnetii RSA 493
gccuuggagcucuuguc

SEQ ID NO: 564001 - RNA, 16 nt, Coxiella burnetii RSA 493
gccuuuauuagaaaag

SEQ ID NO: 564002 - RNA, 14 nt, Coxiella burnetii RSA 493
gccuugcaaacaaa

SEQ ID NO: 564003 - RNA, 22 nt, Coxiella burnetii RSA 493
gccuuuugaaggaauaaaaccu

SEQ ID NO: 564004 - RNA, 18 nt, Coxiella burnetii RSA 493
gcgaaacgacgaaagagu

SEQ ID NO: 564005 - RNA, 17 nt, Coxiella burnetii RSA 493
gccuuuuuuaaauuucu

SEQ ID NO: 564006 - RNA, 18 nt, Coxiella burnetii RSA 493
gccuuuuuuaaauuucuc

SEQ ID NO: 564007 - RNA, 20 nt, Coxiella burnetii RSA 493
gcgaaagccaaguuuuaaga

SEQ ID NO: 564008 - RNA, 16 nt, Coxiella burnetii RSA 493
gcgaaauuuaauaaaa

SEQ ID NO: 564009 - RNA, 15 nt, Coxiella burnetii RSA 493
gcgcauaaacuuuaa

SEQ ID NO: 564010 - RNA, 18 nt, Coxiella burnetii RSA 493
gcgccagagauuuuuuuc

SEQ ID NO: 564011 - RNA, 14 nt, Coxiella burnetii RSA 493
gcgcacucaaccag

SEQ ID NO: 564012 - RNA, 20 nt, Coxiella burnetii RSA 493
gcgcacucaaccagaaauau

SEQ ID NO: 564013 - RNA, 19 nt, Coxiella burnetii RSA 493
gcgcaccagggguuauaaa

SEQ ID NO: 564014 - RNA, 20 nt, Coxiella burnetii RSA 493
gcgcaauacuuucugaagaa

SEQ ID NO: 564015 - RNA, 16 nt, Coxiella burnetii RSA 493
gcgcaagacaauguua

SEQ ID NO: 564016 - RNA, 16 nt, Coxiella burnetii RSA 493
gcgauuuucucuucaa

SEQ ID NO: 564017 - RNA, 17 nt, Coxiella burnetii RSA 493
gcgauuuauuucuucua

SEQ ID NO: 564018 - RNA, 14 nt, Coxiella burnetii RSA 493
gcgauuaaauauuu

SEQ ID NO: 564019 - RNA, 13 nt, Coxiella burnetii RSA 493
gcgaaggcgagga

SEQ ID NO: 564020 - RNA, 13 nt, Coxiella burnetii RSA 493
gcgacuaaaccaa

SEQ ID NO: 564021 - RNA, 19 nt, Coxiella burnetii RSA 493
gcgagaagauuuuuuuucu

SEQ ID NO: 564022 - RNA, 21 nt, Coxiella burnetii RSA 493
gcgauaugggggcccauccag

SEQ ID NO: 564023 - RNA, 15 nt, Coxiella burnetii RSA 493
gcggaaaaggagaaa

SEQ ID NO: 564024 - RNA, 21 nt, Coxiella burnetii RSA 493
gcgcuuuuggcuacuuucuca

SEQ ID NO: 564025 - RNA, 15 nt, Coxiella burnetii RSA 493
gcggaagggggucuu

SEQ ID NO: 564026 - RNA, 18 nt, Coxiella burnetii RSA 493
gcggcuuuuucaaugguu

SEQ ID NO: 564027 - RNA, 14 nt, Coxiella burnetii RSA 493
gcgggaagggcgag

SEQ ID NO: 564028 - RNA, 24 nt, Coxiella burnetii RSA 493
gcgcgaugggggguucuaacgcaa

SEQ ID NO: 564029 - RNA, 20 nt, Coxiella burnetii RSA 493
gcccauuucccaaaugacga

SEQ ID NO: 564030 - RNA, 17 nt, Coxiella burnetii RSA 493
gccccauuuuuguaaau

SEQ ID NO: 564031 - RNA, 14 nt, Coxiella burnetii RSA 493
gcccauaaauaacu

SEQ ID NO: 564032 - RNA, 20 nt, Coxiella burnetii RSA 493
gccauugguuuaaaaaguuc

SEQ ID NO: 564033 - RNA, 15 nt, Coxiella burnetii RSA 493
gccaucuugccacac

SEQ ID NO: 564034 - RNA, 23 nt, Coxiella burnetii RSA 493
gccaugcguuuccgccucaauuu

SEQ ID NO: 564035 - RNA, 18 nt, Coxiella burnetii RSA 493
gccgauauucuuuuucuu

SEQ ID NO: 564036 - RNA, 11 nt, Coxiella burnetii RSA 493
gccgauaaguu

SEQ ID NO: 564037 - RNA, 15 nt, Coxiella burnetii RSA 493
gccgauaaguuuuua

SEQ ID NO: 564038 - RNA, 14 nt, Coxiella burnetii RSA 493
gccgauaaaaaggc

SEQ ID NO: 564039 - RNA, 14 nt, Coxiella burnetii RSA 493
gccgccuguaaggu

SEQ ID NO: 564040 - RNA, 21 nt, Coxiella burnetii RSA 493
gccagacuucuuuaagcguuu

SEQ ID NO: 564041 - RNA, 23 nt, Coxiella burnetii RSA 493
gccagcaauggugauuucuucca

SEQ ID NO: 564042 - RNA, 22 nt, Coxiella burnetii RSA 493
gccacauuucggacaacaaaua

SEQ ID NO: 564043 - RNA, 13 nt, Coxiella burnetii RSA 493
gccaaagcauucc

SEQ ID NO: 564044 - RNA, 16 nt, Coxiella burnetii RSA 493
gccaaagcaaaaauac

SEQ ID NO: 564045 - RNA, 14 nt, Coxiella burnetii RSA 493
gccacacaagcgcg

SEQ ID NO: 564046 - RNA, 23 nt, Coxiella burnetii RSA 493
gccacacaagcgcgauucauucc

SEQ ID NO: 564047 - RNA, 20 nt, Coxiella burnetii RSA 493
gcaguuguuagauuggugaa

SEQ ID NO: 564048 - RNA, 14 nt, Coxiella burnetii RSA 493
gcaguuuucuucaa

SEQ ID NO: 564049 - RNA, 15 nt, Coxiella burnetii RSA 493
gcaguuaaauuuuua

SEQ ID NO: 564050 - RNA, 19 nt, Coxiella burnetii RSA 493
gcagugaaugaagguguuu

SEQ ID NO: 564051 - RNA, 15 nt, Coxiella burnetii RSA 493
gcaguaaauagaagc

SEQ ID NO: 564052 - RNA, 14 nt, Coxiella burnetii RSA 493
gcagcucaaacaaa

SEQ ID NO: 564053 - RNA, 18 nt, Coxiella burnetii RSA 493
gcagcucaaacaaaucaa

SEQ ID NO: 564054 - RNA, 17 nt, Coxiella burnetii RSA 493
gcagcugauuucugguu

SEQ ID NO: 564055 - RNA, 20 nt, Coxiella burnetii RSA 493
gcagcugauuucugguugaa

SEQ ID NO: 564056 - RNA, 20 nt, Coxiella burnetii RSA 493
gcaugcccauaaauaacuuc

SEQ ID NO: 564057 - RNA, 23 nt, Coxiella burnetii RSA 493
gcaugauuuaggcagccuaauuu

SEQ ID NO: 564058 - RNA, 18 nt, Coxiella burnetii RSA 493
gcaucuucgccuggccaa

SEQ ID NO: 564059 - RNA, 12 nt, Coxiella burnetii RSA 493
gcauuaauaaga

SEQ ID NO: 564060 - RNA, 15 nt, Coxiella burnetii RSA 493
gcauucauucuuuuu

SEQ ID NO: 564061 - RNA, 18 nt, Coxiella burnetii RSA 493
gcauuucccaaucaucaa

SEQ ID NO: 564062 - RNA, 19 nt, Coxiella burnetii RSA 493
gcauuucccaaucaucaau

SEQ ID NO: 564063 - RNA, 13 nt, Coxiella burnetii RSA 493
gcauaacuaauug

SEQ ID NO: 564064 - RNA, 11 nt, Coxiella burnetii RSA 493
gcauaauaauc

SEQ ID NO: 564065 - RNA, 18 nt, Coxiella burnetii RSA 493
gcaucaggcuaucgccau

SEQ ID NO: 564066 - RNA, 20 nt, Coxiella burnetii RSA 493
gcauauucgaacuuuccaaa

SEQ ID NO: 564067 - RNA, 16 nt, Coxiella burnetii RSA 493
gcaucgagaagucgcu

SEQ ID NO: 564068 - RNA, 18 nt, Coxiella burnetii RSA 493
gcaucgagaagucgcucc

SEQ ID NO: 564069 - RNA, 16 nt, Coxiella burnetii RSA 493
gauuuuuuaaaucuuc

SEQ ID NO: 564070 - RNA, 16 nt, Coxiella burnetii RSA 493
gauuuuuuaauuggua

SEQ ID NO: 564071 - RNA, 19 nt, Coxiella burnetii RSA 493
gcaaaccgcgcugaagucc

SEQ ID NO: 564072 - RNA, 23 nt, Coxiella burnetii RSA 493
gcaaacagcuagcccccgaaaca

SEQ ID NO: 564073 - RNA, 15 nt, Coxiella burnetii RSA 493
gcaaagaucuccccu

SEQ ID NO: 564074 - RNA, 23 nt, Coxiella burnetii RSA 493
gcaaagaucuccccuucuuuaau

SEQ ID NO: 564075 - RNA, 20 nt, Coxiella burnetii RSA 493
gcaaagccgcuauuucuagc

SEQ ID NO: 564076 - RNA, 23 nt, Coxiella burnetii RSA 493
gcaacaccacggcgaacaccuaa

SEQ ID NO: 564077 - RNA, 18 nt, Coxiella burnetii RSA 493
gcaaaugaguaaaaaaga

SEQ ID NO: 564078 - RNA, 21 nt, Coxiella burnetii RSA 493
gcaaauguugauaauaaaugg

SEQ ID NO: 564079 - RNA, 23 nt, Coxiella burnetii RSA 493
gcaaauaaugaguggcugcuucu

SEQ ID NO: 564080 - RNA, 19 nt, Coxiella burnetii RSA 493
gauucuucuuuugccauau

SEQ ID NO: 564081 - RNA, 21 nt, Coxiella burnetii RSA 493
gauugaacuaagcgugcucuu

SEQ ID NO: 564082 - RNA, 16 nt, Coxiella burnetii RSA 493
gauucucucaaagaaa

SEQ ID NO: 564083 - RNA, 14 nt, Coxiella burnetii RSA 493
gauucuguaacuuu

SEQ ID NO: 564084 - RNA, 12 nt, Coxiella burnetii RSA 493
gauucuauacuu

SEQ ID NO: 564085 - RNA, 18 nt, Coxiella burnetii RSA 493
gauugcacuucagucgcc

SEQ ID NO: 564086 - RNA, 18 nt, Coxiella burnetii RSA 493
gauugccaaaguucauua

SEQ ID NO: 564087 - RNA, 18 nt, Coxiella burnetii RSA 493
gauugauaguauguuauu

SEQ ID NO: 564088 - RNA, 15 nt, Coxiella burnetii RSA 493
gauugauuuuguccu

SEQ ID NO: 564089 - RNA, 16 nt, Coxiella burnetii RSA 493
gauugcguaaugcaau

SEQ ID NO: 564090 - RNA, 14 nt, Coxiella burnetii RSA 493
gauuccaauauuga

SEQ ID NO: 564091 - RNA, 23 nt, Coxiella burnetii RSA 493
gauuccaaagcagauaaauguuu

SEQ ID NO: 564092 - RNA, 20 nt, Coxiella burnetii RSA 493
gauucaugaaaaucuaaagg

SEQ ID NO: 564093 - RNA, 14 nt, Coxiella burnetii RSA 493
gauucguaauauua

SEQ ID NO: 564094 - RNA, 18 nt, Coxiella burnetii RSA 493
gauucuacagaacuuuuu

SEQ ID NO: 564095 - RNA, 19 nt, Coxiella burnetii RSA 493
gauuuacaauaacaaauga

SEQ ID NO: 564096 - RNA, 18 nt, Coxiella burnetii RSA 493
gauuuaccuuaagaagag

SEQ ID NO: 564097 - RNA, 18 nt, Coxiella burnetii RSA 493
gauuguuguggauaaagg

SEQ ID NO: 564098 - RNA, 14 nt, Coxiella burnetii RSA 493
gauuuauuucuucu

SEQ ID NO: 564099 - RNA, 19 nt, Coxiella burnetii RSA 493
gauuuccaacgcuuguuuu

SEQ ID NO: 564100 - RNA, 16 nt, Coxiella burnetii RSA 493
gauuuccacuuguuuu

SEQ ID NO: 564101 - RNA, 21 nt, Coxiella burnetii RSA 493
gauuuccacuuguuuuucggu

SEQ ID NO: 564102 - RNA, 15 nt, Coxiella burnetii RSA 493
gauuucacuuuauuu

SEQ ID NO: 564103 - RNA, 21 nt, Coxiella burnetii RSA 493
gauuucacuuuauuuucauac

SEQ ID NO: 564104 - RNA, 19 nt, Coxiella burnetii RSA 493
gauuucucuuuuaacuuau

SEQ ID NO: 564105 - RNA, 16 nt, Coxiella burnetii RSA 493
gauuuugaauuuugcc

SEQ ID NO: 564106 - RNA, 19 nt, Coxiella burnetii RSA 493
gauuuucguuguaagucug

SEQ ID NO: 564107 - RNA, 14 nt, Coxiella burnetii RSA 493
gauuuucaaaagag

SEQ ID NO: 564108 - RNA, 13 nt, Coxiella burnetii RSA 493
gauuuuaucuuau

SEQ ID NO: 564109 - RNA, 13 nt, Coxiella burnetii RSA 493
gauuuuaauugaa

SEQ ID NO: 564110 - RNA, 16 nt, Coxiella burnetii RSA 493
gauuuuaauuuuuucu

SEQ ID NO: 564111 - RNA, 17 nt, Coxiella burnetii RSA 493
gaugcuucuuugauaaa

SEQ ID NO: 564112 - RNA, 20 nt, Coxiella burnetii RSA 493
gauggaacugauauacgcca

SEQ ID NO: 564113 - RNA, 12 nt, Coxiella burnetii RSA 493
gauggaagaaca

SEQ ID NO: 564114 - RNA, 16 nt, Coxiella burnetii RSA 493
gauggaagaacauuug

SEQ ID NO: 564115 - RNA, 21 nt, Coxiella burnetii RSA 493
gauguauccuaauaaaaauau

SEQ ID NO: 564116 - RNA, 16 nt, Coxiella burnetii RSA 493
gaugucauaaucacaa

SEQ ID NO: 564117 - RNA, 13 nt, Coxiella burnetii RSA 493
gauuacuugauau

SEQ ID NO: 564118 - RNA, 14 nt, Coxiella burnetii RSA 493
gauuacuugauauu

SEQ ID NO: 564119 - RNA, 12 nt, Coxiella burnetii RSA 493
gauuagagcgau

SEQ ID NO: 564120 - RNA, 14 nt, Coxiella burnetii RSA 493
gauuaucuuucgac

SEQ ID NO: 564121 - RNA, 20 nt, Coxiella burnetii RSA 493
gauuaucuuucgaccaggac

SEQ ID NO: 564122 - RNA, 22 nt, Coxiella burnetii RSA 493
gauuaaacgcgauaucuccauu

SEQ ID NO: 564123 - RNA, 21 nt, Coxiella burnetii RSA 493
gauuaaacguauuccaaauaa

SEQ ID NO: 564124 - RNA, 17 nt, Coxiella burnetii RSA 493
gauguucucagcgucuu

SEQ ID NO: 564125 - RNA, 13 nt, Coxiella burnetii RSA 493
gauuaaaaauuuu

SEQ ID NO: 564126 - RNA, 11 nt, Coxiella burnetii RSA 493
gauuaaaagug

SEQ ID NO: 564127 - RNA, 12 nt, Coxiella burnetii RSA 493
gauuaaaagugu

SEQ ID NO: 564128 - RNA, 17 nt, Coxiella burnetii RSA 493
gaugaagcugacgcuuc

SEQ ID NO: 564129 - RNA, 22 nt, Coxiella burnetii RSA 493
gaugaauuaugcaagguugaug

SEQ ID NO: 564130 - RNA, 14 nt, Coxiella burnetii RSA 493
gaugacaaauaaac

SEQ ID NO: 564131 - RNA, 20 nt, Coxiella burnetii RSA 493
gaugaaaucguuuuguuuua

SEQ ID NO: 564132 - RNA, 15 nt, Coxiella burnetii RSA 493
gaucuuucgcccaua

SEQ ID NO: 564133 - RNA, 20 nt, Coxiella burnetii RSA 493
gaucuugggcaaaaaaagaa

SEQ ID NO: 564134 - RNA, 22 nt, Coxiella burnetii RSA 493
gaugacuuugguaguccugagu

SEQ ID NO: 564135 - RNA, 19 nt, Coxiella burnetii RSA 493
gaugacccucuuuuuaaaa

SEQ ID NO: 564136 - RNA, 21 nt, Coxiella burnetii RSA 493
aaagccuaaguuuaacagaca

SEQ ID NO: 564137 - RNA, 17 nt, Coxiella burnetii RSA 493
gaugcccauucuuucau

SEQ ID NO: 564138 - RNA, 13 nt, Coxiella burnetii RSA 493
gaugauuugcgcu

SEQ ID NO: 564139 - RNA, 15 nt, Coxiella burnetii RSA 493
gaugcacucuuuaau

SEQ ID NO: 564140 - RNA, 19 nt, Coxiella burnetii RSA 493
gaugcagcuucgugcaauu

SEQ ID NO: 564141 - RNA, 17 nt, Coxiella burnetii RSA 493
gaugauuaaaucaacac

SEQ ID NO: 564142 - RNA, 15 nt, Coxiella burnetii RSA 493
gauaagcauaauuca

SEQ ID NO: 564143 - RNA, 23 nt, Coxiella burnetii RSA 493
gauaagcauaauucaucaaggua

SEQ ID NO: 564144 - RNA, 16 nt, Coxiella burnetii RSA 493
gauacgaccuucugaa

SEQ ID NO: 564145 - RNA, 18 nt, Coxiella burnetii RSA 493
gauagacaauuuuuuuug

SEQ ID NO: 564146 - RNA, 13 nt, Coxiella burnetii RSA 493
gauacuuuguuuu

SEQ ID NO: 564147 - RNA, 23 nt, Coxiella burnetii RSA 493
gauacgcuucucguaacaaaaga

SEQ ID NO: 564148 - RNA, 12 nt, Coxiella burnetii RSA 493
gauacuucuuca

SEQ ID NO: 564149 - RNA, 18 nt, Coxiella burnetii RSA 493
gauagggaaagagcggau

SEQ ID NO: 564150 - RNA, 15 nt, Coxiella burnetii RSA 493
gauagucauuugcca

SEQ ID NO: 564151 - RNA, 20 nt, Coxiella burnetii RSA 493
gauagucuuugguuuuccau

SEQ ID NO: 564152 - RNA, 16 nt, Coxiella burnetii RSA 493
gauagugcuauuuuuc

SEQ ID NO: 564153 - RNA, 18 nt, Coxiella burnetii RSA 493
gauaugaaugagcugcuu

SEQ ID NO: 564154 - RNA, 16 nt, Coxiella burnetii RSA 493
gaucaucgcacuugcu

SEQ ID NO: 564155 - RNA, 16 nt, Coxiella burnetii RSA 493
gaucaugccuuuuuug

SEQ ID NO: 564156 - RNA, 22 nt, Coxiella burnetii RSA 493
gauauguuucaauaacagagau

SEQ ID NO: 564157 - RNA, 14 nt, Coxiella burnetii RSA 493
gaucaagaaagaca

SEQ ID NO: 564158 - RNA, 21 nt, Coxiella burnetii RSA 493
gauccaagugugggaaaaaua

SEQ ID NO: 564159 - RNA, 21 nt, Coxiella burnetii RSA 493
gaucccucggccaaagaaaau

SEQ ID NO: 564160 - RNA, 22 nt, Coxiella burnetii RSA 493
gaucccucggccaaagaaaauu

SEQ ID NO: 564161 - RNA, 14 nt, Coxiella burnetii RSA 493
gaucgcauugaagu

SEQ ID NO: 564162 - RNA, 15 nt, Coxiella burnetii RSA 493
gaucgcauugaagua

SEQ ID NO: 564163 - RNA, 15 nt, Coxiella burnetii RSA 493
gaucgauaaaaauaa

SEQ ID NO: 564164 - RNA, 15 nt, Coxiella burnetii RSA 493
gauccuugcaauaag

SEQ ID NO: 564165 - RNA, 23 nt, Coxiella burnetii RSA 493
gaucgaaaugucugguauuguug
